United States Patent 11,559,588 (MATERIALS AND METHODS FOR TREATMENT OF SPINOCEREBELLAR ATAXIA TYPE 1 (SCA1) AND OTHER SPINOCEREBELLAR ATAXIA TYPE 1 PROTEIN (ATXN1) GENE RELATED CONDITIONS OR DISORDERS) - sequence listing, part 5

SEQ ID NO: 50811 - DNA, 20 bp, Artificial Sequence
  Description of Artificial Sequence: Synthetic oligonucleotide
  Target: ATXN1; (-) strand; PAM type: NRG; PAM sequence: GAG
gcttggtgcagtgagtcagt

SEQ ID NO: 50812 - DNA, 20 bp, Artificial Sequence
  Description of Artificial Sequence: Synthetic oligonucleotide
  Target: ATXN1; (-) strand; PAM type: NRG; PAM sequence: CAG
catagcttggtgcagtgagt

SEQ ID NO: 50813 - DNA, 20 bp, Artificial Sequence
  Description of Artificial Sequence: Synthetic oligonucleotide
  Target: ATXN1; (-) strand; PAM type: NRG; PAM sequence: GAG
agaacatagcttggtgcagt

SEQ ID NO: 50814 - DNA, 20 bp, Artificial Sequence
  Description of Artificial Sequence: Synthetic oligonucleotide
  Target: ATXN1; (-) strand; PAM type: NRG; PAM sequence: CAG
agcaagaacatagcttggtg

SEQ ID NO: 50815 - DNA, 20 bp, Artificial Sequence
  Description of Artificial Sequence: Synthetic oligonucleotide
  Target: ATXN1; (-) strand; PAM type: NRG; PAM sequence: TGG
tgaatagcaagaacatagct

SEQ ID NO: 50816 - DNA, 20 bp, Artificial Sequence
  Description of Artificial Sequence: Synthetic oligonucleotide
  Target: ATXN1; (-) strand; PAM type: NRG; PAM sequence: TAG
ggaaatgaatagcaagaaca

SEQ ID NO: 50817 - DNA, 20 bp, Artificial Sequence
  Description of Artificial Sequence: Synthetic oligonucleotide
  Target: ATXN1; (-) strand; PAM type: NRG; PAM sequence: AAG
aattttgggaaatgaatagc

SEQ ID NO: 50818 - DNA, 20 bp, Artificial Sequence
  Description of Artificial Sequence: Synthetic oligonucleotide
  Target: ATXN1; (-) strand; PAM type: NRG; PAM sequence: TAG
atctaattttgggaaatgaa

SEQ ID NO: 50819 - DNA, 20 bp, Artificial Sequence
  Description of Artificial Sequence: Synthetic oligonucleotide
  Target: ATXN1; (-) strand; PAM type: NRG; PAM sequence: GGG
cagtaaggaaatctaatttt

SEQ ID NO: 50820 - DNA, 20 bp, Artificial Sequence
  Description of Artificial Sequence: Synthetic oligonucleotide
  Target: ATXN1; (-) strand; PAM type: NRG; PAM sequence: TGG
gcagtaaggaaatctaattt

SEQ ID NO: 50821 - DNA, 20 bp, Artificial Sequence
  Description of Artificial Sequence: Synthetic oligonucleotide
  Target: ATXN1; (-) strand; PAM type: NRG; PAM sequence: AGG
tgtatgtatttcttgcagta

SEQ ID NO: 50822 - DNA, 20 bp, Artificial Sequence
  Description of Artificial Sequence: Synthetic oligonucleotide
  Target: ATXN1; (-) strand; PAM type: NRG; PAM sequence: AAG
ctgtatgtatttcttgcagt

SEQ ID NO: 50823 - DNA, 20 bp, Artificial Sequence
  Description of Artificial Sequence: Synthetic oligonucleotide
  Target: ATXN1; (-) strand; PAM type: NRG; PAM sequence: CAG
taatctgtatgtatttcttg

SEQ ID NO: 50824 - DNA, 20 bp, Artificial Sequence
  Description of Artificial Sequence: Synthetic oligonucleotide
  Target: ATXN1; (-) strand; PAM type: NRG; PAM sequence: AGG
ttatatttaaaataaggagt

SEQ ID NO: 50825 - DNA, 20 bp, Artificial Sequence
  Description of Artificial Sequence: Synthetic oligonucleotide
  Target: ATXN1; (-) strand; PAM type: NRG; PAM sequence: TAG
cttatatttaaaataaggag

SEQ ID NO: 50826 - DNA, 20 bp, Artificial Sequence
  Description of Artificial Sequence: Synthetic oligonucleotide
  Target: ATXN1; (-) strand; PAM type: NRG; PAM sequence: GAG
atccttatatttaaaataag

SEQ ID NO: 50827 - DNA, 20 bp, Artificial Sequence
  Description of Artificial Sequence: Synthetic oligonucleotide
  Target: ATXN1; (-) strand; PAM type: NRG; PAM sequence: AGG
ctatccttatatttaaaata

SEQ ID NO: 50828 - DNA, 20 bp, Artificial Sequence
  Description of Artificial Sequence: Synthetic oligonucleotide
  Target: ATXN1; (-) strand; PAM type: NRG; PAM sequence: AAG
actatccttatatttaaaat

SEQ ID NO: 50829 - DNA, 20 bp, Artificial Sequence
  Description of Artificial Sequence: Synthetic oligonucleotide
  Target: ATXN1; (-) strand; PAM type: NRG; PAM sequence: AAG
ctttttatgtcaccttgaac

SEQ ID NO: 50830 - DNA, 20 bp, Artificial Sequence
  Description of Artificial Sequence: Synthetic oligonucleotide
  Target: ATXN1; (-) strand; PAM type: NRG; PAM sequence: CAG
ctcgtgttagccagacatta

SEQ ID NO: 50831 - DNA, 20 bp, Artificial Sequence
  Description of Artificial Sequence: Synthetic oligonucleotide
  Target: ATXN1; (-) strand; PAM type: NRG; PAM sequence: CAG
cctgggaagctcgtgttagc

SEQ ID NO: 50832 - DNA, 20 bp, Artificial Sequence
  Description of Artificial Sequence: Synthetic oligonucleotide
  Target: ATXN1; (-) strand; PAM type: NRG; PAM sequence: TAG
aaagcctgggaagctcgtgt

SEQ ID NO: 50833 - DNA, 20 bp, Artificial Sequence
  Description of Artificial Sequence: Synthetic oligonucleotide
  Target: ATXN1; (-) strand; PAM type: NRG; PAM sequence: AAG
ctgctaacttaaagcctggg

SEQ ID NO: 50834 - DNA, 20 bp, Artificial Sequence
  Description of Artificial Sequence: Synthetic oligonucleotide
  Target: ATXN1; (-) strand; PAM type: NRG; PAM sequence: GGG
cagctgctaacttaaagcct

SEQ ID NO: 50835 - DNA, 20 bp, Artificial Sequence
  Description of Artificial Sequence: Synthetic oligonucleotide
  Target: ATXN1; (-) strand; PAM type: NRG; PAM sequence: TGG
ccagctgctaacttaaagcc

SEQ ID NO: 50836 - DNA, 20 bp, Artificial Sequence
  Description of Artificial Sequence: Synthetic oligonucleotide
  Target: ATXN1; (-) strand; PAM type: NRG; PAM sequence: AAG
tgggaccagctgctaactta

SEQ ID NO: 50837 - DNA, 20 bp, Artificial Sequence
  Description of Artificial Sequence: Synthetic oligonucleotide
  Target: ATXN1; (-) strand; PAM type: NRG; PAM sequence: CAG
ttgagtctgtagtttgggac

SEQ ID NO: 50838 - DNA, 20 bp, Artificial Sequence
  Description of Artificial Sequence: Synthetic oligonucleotide
  Target: ATXN1; (-) strand; PAM type: NRG; PAM sequence: GGG
tggacttgagtctgtagttt

SEQ ID NO: 50839 - DNA, 20 bp, Artificial Sequence
  Description of Artificial Sequence: Synthetic oligonucleotide
  Target: ATXN1; (-) strand; PAM type: NRG; PAM sequence: TGG
gtggacttgagtctgtagtt

SEQ ID NO: 50840 - DNA, 20 bp, Artificial Sequence
  Description of Artificial Sequence: Synthetic oligonucleotide
  Target: ATXN1; (-) strand; PAM type: NRG; PAM sequence: TAG
gtagggtggacttgagtctg

SEQ ID NO: 50841 - DNA, 20 bp, Artificial Sequence
  Description of Artificial Sequence: Synthetic oligonucleotide
  Target: ATXN1; (-) strand; PAM type: NRG; PAM sequence: GAG
agtagcagtagggtggactt

SEQ ID NO: 50842 - DNA, 20 bp, Artificial Sequence
  Description of Artificial Sequence: Synthetic oligonucleotide
  Target: ATXN1; (-) strand; PAM type: NRG; PAM sequence: TGG
gagtactagtagcagtaggg

SEQ ID NO: 50843 - DNA, 20 bp, Artificial Sequence
  Description of Artificial Sequence: Synthetic oligonucleotide
  Target: ATXN1; (-) strand; PAM type: NRG; PAM sequence: GGG
ttagagtactagtagcagta

SEQ ID NO: 50844 - DNA, 20 bp, Artificial Sequence
  Description of Artificial Sequence: Synthetic oligonucleotide
  Target: ATXN1; (-) strand; PAM type: NRG; PAM sequence: AGG
gttagagtactagtagcagt

SEQ ID NO: 50845 - DNA, 20 bp, Artificial Sequence
  Description of Artificial Sequence: Synthetic oligonucleotide
  Target: ATXN1; (-) strand; PAM type: NRG; PAM sequence: TAG
agttagagtactagtagcag

SEQ ID NO: 50846 - DNA, 20 bp, Artificial Sequence
  Description of Artificial Sequence: Synthetic oligonucleotide
  Target: ATXN1; (-) strand; PAM type: NRG; PAM sequence: CAG
cacagttagagtactagtag

SEQ ID NO: 50847 - DNA, 20 bp, Artificial Sequence
  Description of Artificial Sequence: Synthetic oligonucleotide
  Target: ATXN1; (-) strand; PAM type: NRG; PAM sequence: TAG
tctcacagttagagtactag

SEQ ID NO: 50848 - DNA, 20 bp, Artificial Sequence
  Description of Artificial Sequence: Synthetic oligonucleotide
  Target: ATXN1; (-) strand; PAM type: NRG; PAM sequence: TAG
ggatctcacagttagagtac

SEQ ID NO: 50849 - DNA, 20 bp, Artificial Sequence
  Description of Artificial Sequence: Synthetic oligonucleotide
  Target: ATXN1; (-) strand; PAM type: NRG; PAM sequence: GAG
ggtcaaggatctcacagtta

SEQ ID NO: 50850 - DNA, 20 bp, Artificial Sequence
  Description of Artificial Sequence: Synthetic oligonucleotide
  Target: ATXN1; (-) strand; PAM type: NRG; PAM sequence: TAG
tgggtcaaggatctcacagt

SEQ ID NO: 50851 - DNA, 20 bp, Artificial Sequence
  Description of Artificial Sequence: Synthetic oligonucleotide
  Target: ATXN1; (-) strand; PAM type: NRG; PAM sequence: CAG
gctatgggtcaaggatctca

SEQ ID NO: 50852 - DNA, 20 bp, Artificial Sequence
  Description of Artificial Sequence: Synthetic oligonucleotide
  Target: ATXN1; (-) strand; PAM type: NRG; PAM sequence: AGG
aagtacagagctatgggtca

SEQ ID NO: 50853 - DNA, 20 bp, Artificial Sequence
  Description of Artificial Sequence: Synthetic oligonucleotide
  Target: ATXN1; (-) strand; PAM type: NRG; PAM sequence: AAG
caagtacagagctatgggtc

SEQ ID NO: 50854 - DNA, 20 bp, Artificial Sequence
  Description of Artificial Sequence: Synthetic oligonucleotide
  Target: ATXN1; (-) strand; PAM type: NRG; PAM sequence: GGG
taaaacaagtacagagctat

SEQ ID NO: 50855 - DNA, 20 bp, Artificial Sequence
  Description of Artificial Sequence: Synthetic oligonucleotide
  Target: ATXN1; (-) strand; PAM type: NRG; PAM sequence: TGG
gtaaaacaagtacagagcta

SEQ ID NO: 50856 - DNA, 20 bp, Artificial Sequence
  Description of Artificial Sequence: Synthetic oligonucleotide
  Target: ATXN1; (-) strand; PAM type: NRG; PAM sequence: GAG
tgggaagtaaaacaagtaca

SEQ ID NO: 50857 - DNA, 20 bp, Artificial Sequence
  Description of Artificial Sequence: Synthetic oligonucleotide
  Target: ATXN1; (-) strand; PAM type: NRG; PAM sequence: CAG
cttgggaagtaaaacaagta

SEQ ID NO: 50858 - DNA, 20 bp, Artificial Sequence
  Description of Artificial Sequence: Synthetic oligonucleotide
  Target: ATXN1; (-) strand; PAM type: NRG; PAM sequence: AAG
aagttcttgggaagtaaaac

SEQ ID NO: 50859 - DNA, 20 bp, Artificial Sequence
  Description of Artificial Sequence: Synthetic oligonucleotide
  Target: ATXN1; (-) strand; PAM type: NRG; PAM sequence: AAG
cattgccagaagttcttggg

SEQ ID NO: 50860 - DNA, 20 bp, Artificial Sequence
  Description of Artificial Sequence: Synthetic oligonucleotide
  Target: ATXN1; (-) strand; PAM type: NRG; PAM sequence: GGG
taccattgccagaagttctt

SEQ ID NO: 50861 - DNA, 20 bp, Artificial Sequence
  Description of Artificial Sequence: Synthetic oligonucleotide
  Target: ATXN1; (-) strand; PAM type: NRG; PAM sequence: TGG
ttaccattgccagaagttct

SEQ ID NO: 50862 - DNA, 20 bp, Artificial Sequence
  Description of Artificial Sequence: Synthetic oligonucleotide
  Target: ATXN1; (-) strand; PAM type: NRG; PAM sequence: AAG
gtgagaattaccattgccag

SEQ ID NO: 50863 - DNA, 20 bp, Artificial Sequence
  Description of Artificial Sequence: Synthetic oligonucleotide
  Target: ATXN1; (-) strand; PAM type: NRG; PAM sequence: CAG
gaggtgagaattaccattgc

SEQ ID NO: 50864 - DNA, 20 bp, Artificial Sequence
  Description of Artificial Sequence: Synthetic oligonucleotide
  Target: ATXN1; (-) strand; PAM type: NRG; PAM sequence: GAG
aaacatcagcattcagaggt

SEQ ID NO: 50865 - DNA, 20 bp, Artificial Sequence
  Description of Artificial Sequence: Synthetic oligonucleotide
  Target: ATXN1; (-) strand; PAM type: NRG; PAM sequence: AGG
gaaaaaacatcagcattcag

SEQ ID NO: 50866 - DNA, 20 bp, Artificial Sequence
  Description of Artificial Sequence: Synthetic oligonucleotide
  Target: ATXN1; (-) strand; PAM type: NRG; PAM sequence: GAG
tgaaaaaacatcagcattca

SEQ ID NO: 50867 - DNA, 20 bp, Artificial Sequence
  Description of Artificial Sequence: Synthetic oligonucleotide
  Target: ATXN1; (-) strand; PAM type: NRG; PAM sequence: CAG
aatgaaaaaacatcagcatt

SEQ ID NO: 50868 - DNA, 20 bp, Artificial Sequence
  Description of Artificial Sequence: Synthetic oligonucleotide
  Target: ATXN1; (-) strand; PAM type: NRG; PAM sequence: CAG
acatggcaatgaaaaaacat

SEQ ID NO: 50869 - DNA, 20 bp, Artificial Sequence
  Description of Artificial Sequence: Synthetic oligonucleotide
  Target: ATXN1; (-) strand; PAM type: NRG; PAM sequence: TGG
gacaacagatactgaaaaca

SEQ ID NO: 50870 - DNA, 20 bp, Artificial Sequence
  Description of Artificial Sequence: Synthetic oligonucleotide
  Target: ATXN1; (-) strand; PAM type: NRG; PAM sequence: CAG
ccaggaaggtgataggacaa

SEQ ID NO: 50871 - DNA, 20 bp, Artificial Sequence
  Description of Artificial Sequence: Synthetic oligonucleotide
  Target: ATXN1; (-) strand; PAM type: NRG; PAM sequence: AGG
agattagccaggaaggtgat

SEQ ID NO: 50872 - DNA, 20 bp, Artificial Sequence
  Description of Artificial Sequence: Synthetic oligonucleotide
  Target: ATXN1; (-) strand; PAM type: NRG; PAM sequence: TAG
aagattagccaggaaggtga

SEQ ID NO: 50873 - DNA, 20 bp, Artificial Sequence
  Description of Artificial Sequence: Synthetic oligonucleotide
  Target: ATXN1; (-) strand; PAM type: NRG; PAM sequence: AGG
gtaataaagattagccagga

SEQ ID NO: 50874 - DNA, 20 bp, Artificial Sequence
  Description of Artificial Sequence: Synthetic oligonucleotide
  Target: ATXN1; (-) strand; PAM type: NRG; PAM sequence: AAG
ggtaataaagattagccagg

SEQ ID NO: 50875 - DNA, 20 bp, Artificial Sequence
  Description of Artificial Sequence: Synthetic oligonucleotide
  Target: ATXN1; (-) strand; PAM type: NRG; PAM sequence: AGG
gagggtaataaagattagcc

SEQ ID NO: 50876 - DNA, 20 bp, Artificial Sequence
  Description of Artificial Sequence: Synthetic oligonucleotide
  Target: ATXN1; (-) strand; PAM type: NRG; PAM sequence: CAG
ggagggtaataaagattagc

SEQ ID NO: 50877 - DNA, 20 bp, Artificial Sequence
  Description of Artificial Sequence: Synthetic oligonucleotide
  Target: ATXN1; (-) strand; PAM type: NRG; PAM sequence: TAG
gcatggagggtaataaagat

SEQ ID NO: 50878 - DNA, 20 bp, Artificial Sequence
  Description of Artificial Sequence: Synthetic oligonucleotide
  Target: ATXN1; (-) strand; PAM type: NRG; PAM sequence: AAG
gcagggcatggagggtaata

SEQ ID NO: 50879 - DNA, 20 bp, Artificial Sequence
  Description of Artificial Sequence: Synthetic oligonucleotide
  Target: ATXN1; (-) strand; PAM type: NRG; PAM sequence: GGG
cccaagatgcagggcatgga

SEQ ID NO: 50880 - DNA, 20 bp, Artificial Sequence
  Description of Artificial Sequence: Synthetic oligonucleotide
  Target: ATXN1; (-) strand; PAM type: NRG; PAM sequence: AGG
gcccaagatgcagggcatgg

SEQ ID NO: 50881 - DNA, 20 bp, Artificial Sequence
  Description of Artificial Sequence: Synthetic oligonucleotide
  Target: ATXN1; (-) strand; PAM type: NRG; PAM sequence: GAG
ggcccaagatgcagggcatg

SEQ ID NO: 50882 - DNA, 20 bp, Artificial Sequence
  Description of Artificial Sequence: Synthetic oligonucleotide
  Target: ATXN1; (-) strand; PAM type: NRG; PAM sequence: TGG
ggggcccaagatgcagggca

SEQ ID NO: 50883 - DNA, 20 bp, Artificial Sequence
  Description of Artificial Sequence: Synthetic oligonucleotide
  Target: ATXN1; (-) strand; PAM type: NRG; PAM sequence: GGG
tcagtggggcccaagatgca

SEQ ID NO: 50884 - DNA, 20 bp, Artificial Sequence
  Description of Artificial Sequence: Synthetic oligonucleotide
  Target: ATXN1; (-) strand; PAM type: NRG; PAM sequence: AGG
ctcagtggggcccaagatgc

SEQ ID NO: 50885 - DNA, 20 bp, Artificial Sequence
  Description of Artificial Sequence: Synthetic oligonucleotide
  Target: ATXN1; (-) strand; PAM type: NRG; PAM sequence: CAG
tctcagtggggcccaagatg

SEQ ID NO: 50886 - DNA, 20 bp, Artificial Sequence
  Description of Artificial Sequence: Synthetic oligonucleotide
  Target: ATXN1; (-) strand; PAM type: NRG; PAM sequence: AAG
caaagctctcagtggggccc

SEQ ID NO: 50887 - DNA, 20 bp, Artificial Sequence
  Description of Artificial Sequence: Synthetic oligonucleotide
  Target: ATXN1; (-) strand; PAM type: NRG; PAM sequence: GGG
tcccagcaaagctctcagtg

SEQ ID NO: 50888 - DNA, 20 bp, Artificial Sequence
  Description of Artificial Sequence: Synthetic oligonucleotide
  Target: ATXN1; (-) strand; PAM type: NRG; PAM sequence: GGG
ctcccagcaaagctctcagt

SEQ ID NO: 50889 - DNA, 20 bp, Artificial Sequence
  Description of Artificial Sequence: Synthetic oligonucleotide
  Target: ATXN1; (-) strand; PAM type: NRG; PAM sequence: TGG
actcccagcaaagctctcag

SEQ ID NO: 50890 - DNA, 20 bp, Artificial Sequence
  Description of Artificial Sequence: Synthetic oligonucleotide
  Target: ATXN1; (-) strand; PAM type: NRG; PAM sequence: CAG
catactcccagcaaagctct

SEQ ID NO: 50891 - DNA, 20 bp, Artificial Sequence
  Description of Artificial Sequence: Synthetic oligonucleotide
  Target: ATXN1; (-) strand; PAM type: NRG; PAM sequence: AAG
ttgcatgcatactcccagca

SEQ ID NO: 50892 - DNA, 20 bp, Artificial Sequence
  Description of Artificial Sequence: Synthetic oligonucleotide
  Target: ATXN1; (-) strand; PAM type: NRG; PAM sequence: CAG
gatgcttgcatgcatactcc

SEQ ID NO: 50893 - DNA, 20 bp, Artificial Sequence
  Description of Artificial Sequence: Synthetic oligonucleotide
  Target: ATXN1; (-) strand; PAM type: NRG; PAM sequence: AAG
gcagtgcagtgtatgagaga

SEQ ID NO: 50894 - DNA, 20 bp, Artificial Sequence
  Description of Artificial Sequence: Synthetic oligonucleotide
  Target: ATXN1; (-) strand; PAM type: NRG; PAM sequence: GAG
aaaggcagtgcagtgtatga

SEQ ID NO: 50895 - DNA, 20 bp, Artificial Sequence
  Description of Artificial Sequence: Synthetic oligonucleotide
  Target: ATXN1; (-) strand; PAM type: NRG; PAM sequence: GAG
ccaaaggcagtgcagtgtat

SEQ ID NO: 50896 - DNA, 20 bp, Artificial Sequence
  Description of Artificial Sequence: Synthetic oligonucleotide
  Target: ATXN1; (-) strand; PAM type: NRG; PAM sequence: CAG
caggcatcccaaaggcagtg

SEQ ID NO: 50897 - DNA, 20 bp, Artificial Sequence
  Description of Artificial Sequence: Synthetic oligonucleotide
  Target: ATXN1; (-) strand; PAM type: NRG; PAM sequence: CAG
gaactcaggcatcccaaagg

SEQ ID NO: 50898 - DNA, 20 bp, Artificial Sequence
  Description of Artificial Sequence: Synthetic oligonucleotide
  Target: ATXN1; (-) strand; PAM type: NRG; PAM sequence: AGG
tatgaactcaggcatcccaa

SEQ ID NO: 50899 - DNA, 20 bp, Artificial Sequence
  Description of Artificial Sequence: Synthetic oligonucleotide
  Target: ATXN1; (-) strand; PAM type: NRG; PAM sequence: AAG
gtatgaactcaggcatccca

SEQ ID NO: 50900 - DNA, 20 bp, Artificial Sequence
  Description of Artificial Sequence: Synthetic oligonucleotide
  Target: ATXN1; (-) strand; PAM type: NRG; PAM sequence: AGG
tatggaaatagtatgaactc

SEQ ID NO: 50901 - DNA, 20 bp, Artificial Sequence
  Description of Artificial Sequence: Synthetic oligonucleotide
  Target: ATXN1; (-) strand; PAM type: NRG; PAM sequence: CAG
ttatggaaatagtatgaact

SEQ ID NO: 50902 - DNA, 20 bp, Artificial Sequence
  Description of Artificial Sequence: Synthetic oligonucleotide
  Target: ATXN1; (-) strand; PAM type: NRG; PAM sequence: TAG
gggatgggcagttatggaaa

SEQ ID NO: 50903 - DNA, 20 bp, Artificial Sequence
  Description of Artificial Sequence: Synthetic oligonucleotide
  Target: ATXN1; (-) strand; PAM type: NRG; PAM sequence: TGG
atttcagggatgggcagtta

SEQ ID NO: 50904 - DNA, 20 bp, Artificial Sequence
  Description of Artificial Sequence: Synthetic oligonucleotide
  Target: ATXN1; (-) strand; PAM type: NRG; PAM sequence: CAG
tcatctatttcagggatggg

SEQ ID NO: 50905 - DNA, 20 bp, Artificial Sequence
  Description of Artificial Sequence: Synthetic oligonucleotide
  Target: ATXN1; (-) strand; PAM type: NRG; PAM sequence: GGG
tgttcatctatttcagggat

SEQ ID NO: 50906 - DNA, 20 bp, Artificial Sequence
  Description of Artificial Sequence: Synthetic oligonucleotide
  Target: ATXN1; (-) strand; PAM type: NRG; PAM sequence: TGG
ctgttcatctatttcaggga

SEQ ID NO: 50907 - DNA, 20 bp, Artificial Sequence
  Description of Artificial Sequence: Synthetic oligonucleotide
  Target: ATXN1; (-) strand; PAM type: NRG; PAM sequence: GGG
gccactgttcatctatttca

SEQ ID NO: 50908 - DNA, 20 bp, Artificial Sequence
  Description of Artificial Sequence: Synthetic oligonucleotide
  Target: ATXN1; (-) strand; PAM type: NRG; PAM sequence: AGG
ggccactgttcatctatttc

SEQ ID NO: 50909 - DNA, 20 bp, Artificial Sequence
  Description of Artificial Sequence: Synthetic oligonucleotide
  Target: ATXN1; (-) strand; PAM type: NRG; PAM sequence: CAG
aggccactgttcatctattt

SEQ ID NO: 50910 - DNA, 20 bp, Artificial Sequence
  Description of Artificial Sequence: Synthetic oligonucleotide
  Target: ATXN1; (-) strand; PAM type: NRG; PAM sequence: AGG
caagttctaaactagagaga

SEQ ID NO: 50911 - DNA, 20 bp, Artificial Sequence
  Description of Artificial Sequence: Synthetic oligonucleotide
  Target: ATXN1; (-) strand; PAM type: NRG; PAM sequence: AAG
ccaagttctaaactagagag

SEQ ID NO: 50912 - DNA, 20 bp, Artificial Sequence
  Description of Artificial Sequence: Synthetic oligonucleotide
  Target: ATXN1; (-) strand; PAM type: NRG; PAM sequence: GAG
aacccaagttctaaactaga

SEQ ID NO: 50913 - DNA, 20 bp, Artificial Sequence
  Description of Artificial Sequence: Synthetic oligonucleotide
  Target: ATXN1; (-) strand; PAM type: NRG; PAM sequence: GAG
acaacccaagttctaaacta

SEQ ID NO: 50914 - DNA, 20 bp, Artificial Sequence
  Description of Artificial Sequence: Synthetic oligonucleotide
  Target: ATXN1; (-) strand; PAM type: NRG; PAM sequence: TAG
taacaacccaagttctaaac

SEQ ID NO: 50915 - DNA, 20 bp, Artificial Sequence
  Description of Artificial Sequence: Synthetic oligonucleotide
  Target: ATXN1; (-) strand; PAM type: NRG; PAM sequence: AAG
cccaaggagtctaacaaccc

SEQ ID NO: 50916 - DNA, 20 bp, Artificial Sequence
  Description of Artificial Sequence: Synthetic oligonucleotide
  Target: ATXN1; (-) strand; PAM type: NRG; PAM sequence: GAG
gaagctaagatagacccaag

SEQ ID NO: 50917 - DNA, 20 bp, Artificial Sequence
  Description of Artificial Sequence: Synthetic oligonucleotide
  Target: ATXN1; (-) strand; PAM type: NRG; PAM sequence: AGG
gagaagctaagatagaccca

SEQ ID NO: 50918 - DNA, 20 bp, Artificial Sequence
  Description of Artificial Sequence: Synthetic oligonucleotide
  Target: ATXN1; (-) strand; PAM type: NRG; PAM sequence: AAG
agagaagctaagatagaccc

SEQ ID NO: 50919 - DNA, 20 bp, Artificial Sequence
  Description of Artificial Sequence: Synthetic oligonucleotide
  Target: ATXN1; (-) strand; PAM type: NRG; PAM sequence: TAG
aacagggagagaagctaaga

SEQ ID NO: 50920 - DNA, 20 bp, Artificial Sequence
  Description of Artificial Sequence: Synthetic oligonucleotide
  Target: ATXN1; (-) strand; PAM type: NRG; PAM sequence: AAG
tgaaaacagggagagaagct

SEQ ID NO: 50921 - DNA, 20 bp, Artificial Sequence
  Description of Artificial Sequence: Synthetic oligonucleotide
  Target: ATXN1; (-) strand; PAM type: NRG; PAM sequence: AAG
caaactgaaaacagggagag

SEQ ID NO: 50922 - DNA, 20 bp, Artificial Sequence
  Description of Artificial Sequence: Synthetic oligonucleotide
  Target: ATXN1; (-) strand; PAM type: NRG; PAM sequence: GAG
atccaaactgaaaacaggga

SEQ ID NO: 50923 - DNA, 20 bp, Artificial Sequence
  Description of Artificial Sequence: Synthetic oligonucleotide
  Target: ATXN1; (-) strand; PAM type: NRG; PAM sequence: GAG
aaatccaaactgaaaacagg

SEQ ID NO: 50924 - DNA, 20 bp, Artificial Sequence
  Description of Artificial Sequence: Synthetic oligonucleotide
  Target: ATXN1; (-) strand; PAM type: NRG; PAM sequence: GGG
gaaaatccaaactgaaaaca

SEQ ID NO: 50925 - DNA, 20 bp, Artificial Sequence
  Description of Artificial Sequence: Synthetic oligonucleotide
  Target: ATXN1; (-) strand; PAM type: NRG; PAM sequence: AGG
agaaaatccaaactgaaaac

SEQ ID NO: 50926 - DNA, 20 bp, Artificial Sequence
  Description of Artificial Sequence: Synthetic oligonucleotide
  Target: ATXN1; (-) strand; PAM type: NRG; PAM sequence: CAG
tagaaaatccaaactgaaaa

SEQ ID NO: 50927 - DNA, 20 bp, Artificial Sequence
  Description of Artificial Sequence: Synthetic oligonucleotide
  Target: ATXN1; (-) strand; PAM type: NRG; PAM sequence: TAG
atagataagccaaatggagg

SEQ ID NO: 50928 - DNA, 20 bp, Artificial Sequence
  Description of Artificial Sequence: Synthetic oligonucleotide
  Target: ATXN1; (-) strand; PAM type: NRG; PAM sequence: AGG
gagatagataagccaaatgg

SEQ ID NO: 50929 - DNA, 20 bp, Artificial Sequence
  Description of Artificial Sequence: Synthetic oligonucleotide
  Target: ATXN1; (-) strand; PAM type: NRG; PAM sequence: GAG
agagatagataagccaaatg

SEQ ID NO: 50930 - DNA, 20 bp, Artificial Sequence
  Description of Artificial Sequence: Synthetic oligonucleotide
  Target: ATXN1; (-) strand; PAM type: NRG; PAM sequence: TGG
ctagagatagataagccaaa

SEQ ID NO: 50931 - DNA, 20 bp, Artificial Sequence
  Description of Artificial Sequence: Synthetic oligonucleotide
  Target: ATXN1; (-) strand; PAM type: NRG; PAM sequence: AAG
atatgacgctagagatagat

SEQ ID NO: 50932 - DNA, 20 bp, Artificial Sequence
  Description of Artificial Sequence: Synthetic oligonucleotide
  Target: ATXN1; (-) strand; PAM type: NRG; PAM sequence: TAG
gggagatatgacgctagaga

SEQ ID NO: 50933 - DNA, 20 bp, Artificial Sequence
  Description of Artificial Sequence: Synthetic oligonucleotide
  Target: ATXN1; (-) strand; PAM type: NRG; PAM sequence: GAG
atcagggagatatgacgcta

SEQ ID NO: 50934 - DNA, 20 bp, Artificial Sequence
  Description of Artificial Sequence: Synthetic oligonucleotide
  Target: ATXN1; (-) strand; PAM type: NRG; PAM sequence: TAG
tcatcagggagatatgacgc

SEQ ID NO: 50935 - DNA, 20 bp, Artificial Sequence
  Description of Artificial Sequence: Synthetic oligonucleotide
  Target: ATXN1; (-) strand; PAM type: NRG; PAM sequence: GAG
cactaccacggatcatcagg

SEQ ID NO: 50936 - DNA, 20 bp, Artificial Sequence
  Description of Artificial Sequence: Synthetic oligonucleotide
  Target: ATXN1; (-) strand; PAM type: NRG; PAM sequence: GGG
gccactaccacggatcatca

SEQ ID NO: 50937 - DNA, 20 bp, Artificial Sequence
  Description of Artificial Sequence: Synthetic oligonucleotide
  Target: ATXN1; (-) strand; PAM type: NRG; PAM sequence: AGG
cgccactaccacggatcatc

SEQ ID NO: 50938 - DNA, 20 bp, Artificial Sequence
  Description of Artificial Sequence: Synthetic oligonucleotide
  Target: ATXN1; (-) strand; PAM type: NRG; PAM sequence: CAG
acgccactaccacggatcat

SEQ ID NO: 50939 - DNA, 20 bp, Artificial Sequence
  Description of Artificial Sequence: Synthetic oligonucleotide
  Target: ATXN1; (-) strand; PAM type: NRG; PAM sequence: CGG
atggattaacgccactacca

SEQ ID NO: 50940 - DNA, 20 bp, Artificial Sequence
  Description of Artificial Sequence: Synthetic oligonucleotide
  Target: ATXN1; (-) strand; PAM type: NRG; PAM sequence: TGG
gttgtcttgtttttcgtaaa

SEQ ID NO: 50941 - DNA, 20 bp, Artificial Sequence
  Description of Artificial Sequence: Synthetic oligonucleotide
  Target: ATXN1; (-) strand; PAM type: NRG; PAM sequence: TGG
gacacttacggcttcttgtc

SEQ ID NO: 50942 - DNA, 20 bp, Artificial Sequence
  Description of Artificial Sequence: Synthetic oligonucleotide
  Target: ATXN1; (-) strand; PAM type: NRG; PAM sequence: CGG
ggaactagaaccgacactta

SEQ ID NO: 50943 - DNA, 20 bp, Artificial Sequence
  Description of Artificial Sequence: Synthetic oligonucleotide
  Target: ATXN1; (-) strand; PAM type: NRG; PAM sequence: TAG
cagtggagaggaattggaac

SEQ ID NO: 50944 - DNA, 20 bp, Artificial Sequence
  Description of Artificial Sequence: Synthetic oligonucleotide
  Target: ATXN1; (-) strand; PAM type: NRG; PAM sequence: TGG
atgctgcagtggagaggaat

SEQ ID NO: 50945 - DNA, 20 bp, Artificial Sequence
  Description of Artificial Sequence: Synthetic oligonucleotide
  Target: ATXN1; (-) strand; PAM type: NRG; PAM sequence: AGG
tctgagatgctgcagtggag

SEQ ID NO: 50946 - DNA, 20 bp, Artificial Sequence
  Description of Artificial Sequence: Synthetic oligonucleotide
  Target: ATXN1; (-) strand; PAM type: NRG; PAM sequence: GAG
atctgagatgctgcagtgga

SEQ ID NO: 50947 - DNA, 20 bp, Artificial Sequence
  Description of Artificial Sequence: Synthetic oligonucleotide
  Target: ATXN1; (-) strand; PAM type: NRG; PAM sequence: GAG
acatctgagatgctgcagtg

SEQ ID NO: 50948 - DNA, 20 bp, Artificial Sequence
  Description of Artificial Sequence: Synthetic oligonucleotide
  Target: ATXN1; (-) strand; PAM type: NRG; PAM sequence: TGG
ttacatctgagatgctgcag

SEQ ID NO: 50949 - DNA, 20 bp, Artificial Sequence
  Description of Artificial Sequence: Synthetic oligonucleotide
  Target: ATXN1; (-) strand; PAM type: NRG; PAM sequence: CAG
agtttacatctgagatgctg

SEQ ID NO: 50950 - DNA, 20 bp, Artificial Sequence
  Description of Artificial Sequence: Synthetic oligonucleotide
  Target: ATXN1; (-) strand; PAM type: NRG; PAM sequence: GAG
actgacgccagtttacatct

SEQ ID NO: 50951 - DNA, 20 bp, Artificial Sequence
  Description of Artificial Sequence: Synthetic oligonucleotide
  Target: ATXN1; (-) strand; PAM type: NRG; PAM sequence: CAG
acaggacctgttactgacgc

SEQ ID NO: 50952 - DNA, 20 bp, Artificial Sequence
  Description of Artificial Sequence: Synthetic oligonucleotide
  Target: ATXN1; (-) strand; PAM type: NRG; PAM sequence: AGG
tttcctgggaggtggatgac

SEQ ID NO: 50953 - DNA, 20 bp, Artificial Sequence
  Description of Artificial Sequence: Synthetic oligonucleotide
  Target: ATXN1; (-) strand; PAM type: NRG; PAM sequence: CAG
ttttcctgggaggtggatga

SEQ ID NO: 50954 - DNA, 20 bp, Artificial Sequence
  Description of Artificial Sequence: Synthetic oligonucleotide
  Target: ATXN1; (-) strand; PAM type: NRG; PAM sequence: TGG
ttgacaattttcctgggagg

SEQ ID NO: 50955 - DNA, 20 bp, Artificial Sequence
  Description of Artificial Sequence: Synthetic oligonucleotide
  Target: ATXN1; (-) strand; PAM type: NRG; PAM sequence: AGG
tctttgacaattttcctggg

SEQ ID NO: 50956 - DNA, 20 bp, Artificial Sequence
  Description of Artificial Sequence: Synthetic oligonucleotide
  Target: ATXN1; (-) strand; PAM type: NRG; PAM sequence: GAG
atctttgacaattttcctgg

SEQ ID NO: 50957 - DNA, 20 bp, Artificial Sequence
  Description of Artificial Sequence: Synthetic oligonucleotide
  Target: ATXN1; (-) strand; PAM type: NRG; PAM sequence: GGG
ttatctttgacaattttcct

SEQ ID NO: 50958 - DNA, 20 bp, Artificial Sequence
  Description of Artificial Sequence: Synthetic oligonucleotide
  Target: ATXN1; (-) strand; PAM type: NRG; PAM sequence: TGG
attatctttgacaattttcc

SEQ ID NO: 50959 - DNA, 20 bp, Artificial Sequence
  Description of Artificial Sequence: Synthetic oligonucleotide
  Target: ATXN1; (-) strand; PAM type: NRG; PAM sequence: TGG
caggcgtgagccaccacgcc

SEQ ID NO: 50960 - DNA, 20 bp, Artificial Sequence
  Description of Artificial Sequence: Synthetic oligonucleotide
  Target: ATXN1; (-) strand; PAM type: NRG; PAM sequence: GAG
agtggtgggattacaggcgt

SEQ ID NO: 50961 - DNA, 20 bp, Artificial Sequence
  Description of Artificial Sequence: Synthetic oligonucleotide
  Target: ATXN1; (-) strand; PAM type: NRG; PAM sequence: AGG
tcccaaagtggtgggattac

SEQ ID NO: 50962 - DNA, 20 bp, Artificial Sequence
  Description of Artificial Sequence: Synthetic oligonucleotide
  Target: ATXN1; (-) strand; PAM type: NRG; PAM sequence: CAG
ctcccaaagtggtgggatta

SEQ ID NO: 50963 - DNA, 20 bp, Artificial Sequence
  Description of Artificial Sequence: Synthetic oligonucleotide
  Target: ATXN1; (-) strand; PAM type: NRG; PAM sequence: GGG
cctcggcctcccaaagtggt

SEQ ID NO: 50964 - DNA, 20 bp, Artificial Sequence
  Description of Artificial Sequence: Synthetic oligonucleotide
  Target: ATXN1; (-) strand; PAM type: NRG; PAM sequence: TGG
gcctcggcctcccaaagtgg

SEQ ID NO: 50965 - DNA, 20 bp, Artificial Sequence
  Description of Artificial Sequence: Synthetic oligonucleotide
  Target: ATXN1; (-) strand; PAM type: NRG; PAM sequence: TGG
cctgcctcggcctcccaaag

SEQ ID NO: 50966 - DNA, 20 bp, Artificial Sequence
  Description of Artificial Sequence: Synthetic oligonucleotide
  Target: ATXN1; (-) strand; PAM type: NRG; PAM sequence: AAG
tcacctgcctcggcctccca

SEQ ID NO: 50967 - DNA, 20 bp, Artificial Sequence
  Description of Artificial Sequence: Synthetic oligonucleotide
  Target: ATXN1; (-) strand; PAM type: NRG; PAM sequence: CGG
ctcagatggttcacctgcct

SEQ ID NO: 50968 - DNA, 20 bp, Artificial Sequence
  Description of Artificial Sequence: Synthetic oligonucleotide
  Target: ATXN1; (-) strand; PAM type: NRG; PAM sequence: TGG
ctcaaactcccaacctcaga

SEQ ID NO: 50969 - DNA, 20 bp, Artificial Sequence
  Description of Artificial Sequence: Synthetic oligonucleotide
  Target: ATXN1; (-) strand; PAM type: NRG; PAM sequence: CAG
tgatctcaaactcccaacct

SEQ ID NO: 50970 - DNA, 20 bp, Artificial Sequence
  Description of Artificial Sequence: Synthetic oligonucleotide
  Target: ATXN1; (-) strand; PAM type: NRG; PAM sequence: AGG
ggggtttatccatgttgtcc

SEQ ID NO: 50971 - DNA, 20 bp, Artificial Sequence
  Description of Artificial Sequence: Synthetic oligonucleotide
  Target: ATXN1; (-) strand; PAM type: NRG; PAM sequence: CAG
tggggtttatccatgttgtc

SEQ ID NO: 50972 - DNA, 20 bp, Artificial Sequence
  Description of Artificial Sequence: Synthetic oligonucleotide
  Target: ATXN1; (-) strand; PAM type: NRG; PAM sequence: GGG
ttatatttttagtagagatg

SEQ ID NO: 50973 - DNA, 20 bp, Artificial Sequence
  Description of Artificial Sequence: Synthetic oligonucleotide
  Target: ATXN1; (-) strand; PAM type: NRG; PAM sequence: GGG
tttatatttttagtagagat

SEQ ID NO: 50974 - DNA, 20 bp, Artificial Sequence
  Description of Artificial Sequence: Synthetic oligonucleotide
  Target: ATXN1; (-) strand; PAM type: NRG; PAM sequence: TGG
ttttatatttttagtagaga

SEQ ID NO: 50975 - DNA, 20 bp, Artificial Sequence
  Description of Artificial Sequence: Synthetic oligonucleotide
  Target: ATXN1; (-) strand; PAM type: NRG; PAM sequence: GAG
aattttttatatttttagta

SEQ ID NO: 50976 - DNA, 20 bp, Artificial Sequence
  Description of Artificial Sequence: Synthetic oligonucleotide
  Target: ATXN1; (-) strand; PAM type: NRG; PAM sequence: TAG
ctaattttttatatttttag

SEQ ID NO: 50977 - DNA, 20 bp, Artificial Sequence
  Description of Artificial Sequence: Synthetic oligonucleotide
  Target: ATXN1; (-) strand; PAM type: NRG; PAM sequence: TAG
cagctaattttttatatttt

SEQ ID NO: 50978 - DNA, 20 bp, Artificial Sequence
  Description of Artificial Sequence: Synthetic oligonucleotide
  Target: ATXN1; (-) strand; PAM type: NRG; PAM sequence: CAG
cagacgtgtgctcctacgcc

SEQ ID NO: 50979 - DNA, 20 bp, Artificial Sequence
  Description of Artificial Sequence: Synthetic oligonucleotide
  Target: ATXN1; (-) strand; PAM type: NRG; PAM sequence: CAG
ctcctgattagctgggatta

SEQ ID NO: 50980 - DNA, 20 bp, Artificial Sequence
  Description of Artificial Sequence: Synthetic oligonucleotide
  Target: ATXN1; (-) strand; PAM type: NRG; PAM sequence: GGG
cctcagcctcctgattagct

SEQ ID NO: 50981 - DNA, 20 bp, Artificial Sequence
  Description of Artificial Sequence: Synthetic oligonucleotide
  Target: ATXN1; (-) strand; PAM type: NRG; PAM sequence: TGG
gcctcagcctcctgattagc

SEQ ID NO: 50982 - DNA, 20 bp, Artificial Sequence
  Description of Artificial Sequence: Synthetic oligonucleotide
  Target: ATXN1; (-) strand; PAM type: NRG; PAM sequence: TAG
tcctgcctcagcctcctgat

SEQ ID NO: 50983 - DNA, 20 bp, Artificial Sequence
  Description of Artificial Sequence: Synthetic oligonucleotide
  Target: ATXN1; (-) strand; PAM type: NRG; PAM sequence: CAG
ttcatgtgattctcctgcct

SEQ ID NO: 50984 - DNA, 20 bp, Artificial Sequence
  Description of Artificial Sequence: Synthetic oligonucleotide
  Target: ATXN1; (-) strand; PAM type: NRG; PAM sequence: AGG
cactgcaacctccgcctccc

SEQ ID NO: 50985 - DNA, 20 bp, Artificial Sequence
  Description of Artificial Sequence: Synthetic oligonucleotide
  Target: ATXN1; (-) strand; PAM type: NRG; PAM sequence: CAG
tcactgcaacctccgcctcc

SEQ ID NO: 50986 - DNA, 20 bp, Artificial Sequence
  Description of Artificial Sequence: Synthetic oligonucleotide
  Target: ATXN1; (-) strand; PAM type: NRG; PAM sequence: CGG
ggagtgcagtgacgcaatct

SEQ ID NO: 50987 - DNA, 20 bp, Artificial Sequence
  Description of Artificial Sequence: Synthetic oligonucleotide
  Target: ATXN1; (-) strand; PAM type: NRG; PAM sequence: CAG
gtgtcacccaggctggagtg

SEQ ID NO: 50988 - DNA, 20 bp, Artificial Sequence
  Description of Artificial Sequence: Synthetic oligonucleotide
  Target: ATXN1; (-) strand; PAM type: NRG; PAM sequence: GAG
ttgctgtgtcacccaggctg

SEQ ID NO: 50989 - DNA, 20 bp, Artificial Sequence
  Description of Artificial Sequence: Synthetic oligonucleotide
  Target: ATXN1; (-) strand; PAM type: NRG; PAM sequence: TGG
tcttgctgtgtcacccaggc

SEQ ID NO: 50990 - DNA, 20 bp, Artificial Sequence
  Description of Artificial Sequence: Synthetic oligonucleotide
  Target: ATXN1; (-) strand; PAM type: NRG; PAM sequence: AGG
ggagtcttgctgtgtcaccc

SEQ ID NO: 50991 - DNA, 20 bp, Artificial Sequence
  Description of Artificial Sequence: Synthetic oligonucleotide
  Target: ATXN1; (-) strand; PAM type: NRG; PAM sequence: CAG
tggagtcttgctgtgtcacc

SEQ ID NO: 50992 - DNA, 20 bp, Artificial Sequence
  Description of Artificial Sequence: Synthetic oligonucleotide
  Target: ATXN1; (-) strand; PAM type: NRG; PAM sequence: GAG
ttttttttttttttgagatg

SEQ ID NO: 50993 - DNA, 20 bp, Artificial Sequence
  Description of Artificial Sequence: Synthetic oligonucleotide
  Target: ATXN1; (-) strand; PAM type: NRG; PAM sequence: TGG
ttttttttttttttttgaga

SEQ ID NO: 50994 - DNA, 20 bp, Artificial Sequence
  Description of Artificial Sequence: Synthetic oligonucleotide
  Target: ATXN1; (-) strand; PAM type: NRG; PAM sequence: GAG
tttttttttttttttttttt

SEQ ID NO: 50995 - DNA, 20 bp, Artificial Sequence
  Description of Artificial Sequence: Synthetic oligonucleotide
  Target: ATXN1; (-) strand; PAM type: NRG; PAM sequence: AAG
tagtgttttcttgttttcag

SEQ ID NO: 50996 - DNA, 20 bp, Artificial Sequence
  Description of Artificial Sequence: Synthetic oligonucleotide
  Target: ATXN1; (-) strand; PAM type: NRG; PAM sequence: CAG
gaatagtgttttcttgtttt

SEQ ID NO: 50997 - DNA, 20 bp, Artificial Sequence
  Description of Artificial Sequence: Synthetic oligonucleotide
  Target: ATXN1; (-) strand; PAM type: NRG; PAM sequence: TAG
tataatagttttcatctgaa

SEQ ID NO: 50998 - DNA, 20 bp, Artificial Sequence
  Description of Artificial Sequence: Synthetic oligonucleotide
  Target: ATXN1; (-) strand; PAM type: NRG; PAM sequence: TAG
atagtaatctataaatataa

SEQ ID NO: 50999 - DNA, 20 bp, Artificial Sequence
  Description of Artificial Sequence: Synthetic oligonucleotide
  Target: ATXN1; (-) strand; PAM type: NRG; PAM sequence: TAG
ttcttttttttaaaaaaaaa

SEQ ID NO: 51000 - DNA, 20 bp, Artificial Sequence
  Description of Artificial Sequence: Synthetic oligonucleotide
  Target: ATXN1; (-) strand; PAM type: NRG; PAM sequence: GAG
attataggtaattcaaagaa

SEQ ID NO: 51001 - DNA, 20 bp, Artificial Sequence
  Description of Artificial Sequence: Synthetic oligonucleotide
  Target: ATXN1; (-) strand; PAM type: NRG; PAM sequence: AAG
gcattataggtaattcaaag

SEQ ID NO: 51002 - DNA, 20 bp, Artificial Sequence
  Description of Artificial Sequence: Synthetic oligonucleotide
  Target: ATXN1; (-) strand; PAM type: NRG; PAM sequence: AAG
gttgcattataggtaattca

SEQ ID NO: 51003 - DNA, 20 bp, Artificial Sequence
  Description of Artificial Sequence: Synthetic oligonucleotide
  Target: ATXN1; (-) strand; PAM type: NRG; PAM sequence: AGG
tggtgctgctgttgcattat

SEQ ID NO: 51004 - DNA, 20 bp, Artificial Sequence
  Description of Artificial Sequence: Synthetic oligonucleotide
  Target: ATXN1; (-) strand; PAM type: NRG; PAM sequence: TAG
atggtgctgctgttgcatta

SEQ ID NO: 51005 - DNA, 20 bp, Artificial Sequence
  Description of Artificial Sequence: Synthetic oligonucleotide
  Target: ATXN1; (-) strand; PAM type: NRG; PAM sequence: TGG
tgaattgtgcacaattttga

SEQ ID NO: 51006 - DNA, 20 bp, Artificial Sequence
  Description of Artificial Sequence: Synthetic oligonucleotide
  Target: ATXN1; (-) strand; PAM type: NRG; PAM sequence: GAG
tctgatgggcagccatgttt

SEQ ID NO: 51007 - DNA, 20 bp, Artificial Sequence
  Description of Artificial Sequence: Synthetic oligonucleotide
  Target: ATXN1; (-) strand; PAM type: NRG; PAM sequence: CAG
acaatggtgattctgatggg

SEQ ID NO: 51008 - DNA, 20 bp, Artificial Sequence
  Description of Artificial Sequence: Synthetic oligonucleotide
  Target: ATXN1; (-) strand; PAM type: NRG; PAM sequence: GGG
ggcacaatggtgattctgat

SEQ ID NO: 51009 - DNA, 20 bp, Artificial Sequence
  Description of Artificial Sequence: Synthetic oligonucleotide
  Target: ATXN1; (-) strand; PAM type: NRG; PAM sequence: TGG
aggcacaatggtgattctga

SEQ ID NO: 51010 - DNA, 20 bp, Artificial Sequence
  Description of Artificial Sequence: Synthetic oligonucleotide
  Target: ATXN1; (-) strand; PAM type: NRG; PAM sequence: TGG
gtgtttcctaaaaggcacaa

SEQ ID NO: 51011 - DNA, 20 bp, Artificial Sequence
  Description of Artificial Sequence: Synthetic oligonucleotide
  Target: ATXN1; (-) strand; PAM type: NRG; PAM sequence: AGG
gagaatctgtgtttcctaaa

SEQ ID NO: 51012 - DNA, 20 bp, Artificial Sequence
  Description of Artificial Sequence: Synthetic oligonucleotide
  Target: ATXN1; (-) strand; PAM type: NRG; PAM sequence: AAG
tgagaatctgtgtttcctaa

SEQ ID NO: 51013 - DNA, 20 bp, Artificial Sequence
  Description of Artificial Sequence: Synthetic oligonucleotide
  Target: ATXN1; (-) strand; PAM type: NRG; PAM sequence: GAG
attagagactgcaaatgtct

SEQ ID NO: 51014 - DNA, 20 bp, Artificial Sequence
  Description of Artificial Sequence: Synthetic oligonucleotide
  Target: ATXN1; (-) strand; PAM type: NRG; PAM sequence: GAG
cagaaaatccagggccatta

SEQ ID NO: 51015 - DNA, 20 bp, Artificial Sequence
  Description of Artificial Sequence: Synthetic oligonucleotide
  Target: ATXN1; (-) strand; PAM type: NRG; PAM sequence: TAG
cccagaaaatccagggccat

SEQ ID NO: 51016 - DNA, 20 bp, Artificial Sequence
  Description of Artificial Sequence: Synthetic oligonucleotide
  Target: ATXN1; (-) strand; PAM type: NRG; PAM sequence: GGG
gcactggcccagaaaatcca

SEQ ID NO: 51017 - DNA, 20 bp, Artificial Sequence
  Description of Artificial Sequence: Synthetic oligonucleotide
  Target: ATXN1; (-) strand; PAM type: NRG; PAM sequence: AGG
tgcactggcccagaaaatcc

SEQ ID NO: 51018 - DNA, 20 bp, Artificial Sequence
  Description of Artificial Sequence: Synthetic oligonucleotide
  Target: ATXN1; (-) strand; PAM type: NRG; PAM sequence: CAG
gtgcactggcccagaaaatc

SEQ ID NO: 51019 - DNA, 20 bp, Artificial Sequence
  Description of Artificial Sequence: Synthetic oligonucleotide
  Target: ATXN1; (-) strand; PAM type: NRG; PAM sequence: CAG
ccattacctgtgcactggcc

SEQ ID NO: 51020 - DNA, 20 bp, Artificial Sequence
  Description of Artificial Sequence: Synthetic oligonucleotide
  Target: ATXN1; (-) strand; PAM type: NRG; PAM sequence: TGG
aaataccattacctgtgcac

SEQ ID NO: 51021 - DNA, 20 bp, Artificial Sequence
  Description of Artificial Sequence: Synthetic oligonucleotide
  Target: ATXN1; (-) strand; PAM type: NRG; PAM sequence: GGG
aactgatcagaatcccttgg

SEQ ID NO: 51022 - DNA, 20 bp, Artificial Sequence
  Description of Artificial Sequence: Synthetic oligonucleotide
  Target: ATXN1; (-) strand; PAM type: NRG; PAM sequence: GGG
taactgatcagaatcccttg

SEQ ID NO: 51023 - DNA, 20 bp, Artificial Sequence
  Description of Artificial Sequence: Synthetic oligonucleotide
  Target: ATXN1; (-) strand; PAM type: NRG; PAM sequence: GGG
ctaactgatcagaatccctt

SEQ ID NO: 51024 - DNA, 20 bp, Artificial Sequence
  Description of Artificial Sequence: Synthetic oligonucleotide
  Target: ATXN1; (-) strand; PAM type: NRG; PAM sequence: TGG
cctaactgatcagaatccct

SEQ ID NO: 51025 - DNA, 20 bp, Artificial Sequence
  Description of Artificial Sequence: Synthetic oligonucleotide
  Target: ATXN1; (-) strand; PAM type: NRG; PAM sequence: CAG
ggatcccaaacctaactgat

SEQ ID NO: 51026 - DNA, 20 bp, Artificial Sequence
  Description of Artificial Sequence: Synthetic oligonucleotide
  Target: ATXN1; (-) strand; PAM type: NRG; PAM sequence: TGG
aacatgttatttttagaaag

SEQ ID NO: 51027 - DNA, 20 bp, Artificial Sequence
  Description of Artificial Sequence: Synthetic oligonucleotide
  Target: ATXN1; (-) strand; PAM type: NRG; PAM sequence: AAG
agaaacatgttatttttaga

SEQ ID NO: 51028 - DNA, 20 bp, Artificial Sequence
  Description of Artificial Sequence: Synthetic oligonucleotide
  Target: ATXN1; (-) strand; PAM type: NRG; PAM sequence: TAG
acagagaaacatgttatttt

SEQ ID NO: 51029 - DNA, 20 bp, Artificial Sequence
  Description of Artificial Sequence: Synthetic oligonucleotide
  Target: ATXN1; (-) strand; PAM type: NRG; PAM sequence: GAG
cttaaatttcctccgtcaca

SEQ ID NO: 51030 - DNA, 20 bp, Artificial Sequence
  Description of Artificial Sequence: Synthetic oligonucleotide
  Target: ATXN1; (-) strand; PAM type: NRG; PAM sequence: CAG
tacttaaatttcctccgtca

SEQ ID NO: 51031 - DNA, 20 bp, Artificial Sequence
  Description of Artificial Sequence: Synthetic oligonucleotide
  Target: ATXN1; (-) strand; PAM type: NRG; PAM sequence: TAG
gataacaaattcatgaatca

SEQ ID NO: 51032 - DNA, 20 bp, Artificial Sequence
  Description of Artificial Sequence: Synthetic oligonucleotide
  Target: ATXN1; (-) strand; PAM type: NRG; PAM sequence: CAG
atatcctctgaagaaaaaaa

SEQ ID NO: 51033 - DNA, 20 bp, Artificial Sequence
  Description of Artificial Sequence: Synthetic oligonucleotide
  Target: ATXN1; (-) strand; PAM type: NRG; PAM sequence: AAG
acttaaactgatatcctctg

SEQ ID NO: 51034 - DNA, 20 bp, Artificial Sequence
  Description of Artificial Sequence: Synthetic oligonucleotide
  Target: ATXN1; (-) strand; PAM type: NRG; PAM sequence: CAG
gttgtttgccttcagagtta

SEQ ID NO: 51035 - DNA, 20 bp, Artificial Sequence
  Description of Artificial Sequence: Synthetic oligonucleotide
  Target: ATXN1; (-) strand; PAM type: NRG; PAM sequence: GAG
ttgccagttgtttgccttca

SEQ ID NO: 51036 - DNA, 20 bp, Artificial Sequence
  Description of Artificial Sequence: Synthetic oligonucleotide
  Target: ATXN1; (-) strand; PAM type: NRG; PAM sequence: CAG
tcttgccagttgtttgcctt

SEQ ID NO: 51037 - DNA, 20 bp, Artificial Sequence
  Description of Artificial Sequence: Synthetic oligonucleotide
  Target: ATXN1; (-) strand; PAM type: NRG; PAM sequence: CAG
tcctgaaaactctctcttgc

SEQ ID NO: 51038 - DNA, 20 bp, Artificial Sequence
  Description of Artificial Sequence: Synthetic oligonucleotide
  Target: ATXN1; (-) strand; PAM type: NRG; PAM sequence: CAG
cttccgctgccttccagagc

SEQ ID NO: 51039 - DNA, 20 bp, Artificial Sequence
  Description of Artificial Sequence: Synthetic oligonucleotide
  Target: ATXN1; (-) strand; PAM type: NRG; PAM sequence: GAG
gaaccttccgctgccttcca

SEQ ID NO: 51040 - DNA, 20 bp, Artificial Sequence
  Description of Artificial Sequence: Synthetic oligonucleotide
  Target: ATXN1; (-) strand; PAM type: NRG; PAM sequence: CAG
cagaaccttccgctgccttc

SEQ ID NO: 51041 - DNA, 20 bp, Artificial Sequence
  Description of Artificial Sequence: Synthetic oligonucleotide
  Target: ATXN1; (-) strand; PAM type: NRG; PAM sequence: CAG
cataggacacattgcttttc

SEQ ID NO: 51042 - DNA, 20 bp, Artificial Sequence
  Description of Artificial Sequence: Synthetic oligonucleotide
  Target: ATXN1; (-) strand; PAM type: NRG; PAM sequence: AGG
aggtgaaaagtctagttcat

SEQ ID NO: 51043 - DNA, 20 bp, Artificial Sequence
  Description of Artificial Sequence: Synthetic oligonucleotide
  Target: ATXN1; (-) strand; PAM type: NRG; PAM sequence: TAG
caggtgaaaagtctagttca

SEQ ID NO: 51044 - DNA, 20 bp, Artificial Sequence
  Description of Artificial Sequence: Synthetic oligonucleotide
  Target: ATXN1; (-) strand; PAM type: NRG; PAM sequence: TAG
atgcttacaggtgaaaagtc

SEQ ID NO: 51045 - DNA, 20 bp, Artificial Sequence
  Description of Artificial Sequence: Synthetic oligonucleotide
  Target: ATXN1; (-) strand; PAM type: NRG; PAM sequence: AAG
ctgccatgcttacaggtgaa

SEQ ID NO: 51046 - DNA, 20 bp, Artificial Sequence
  Description of Artificial Sequence: Synthetic oligonucleotide
  Target: ATXN1; (-) strand; PAM type: NRG; PAM sequence: AGG
cctcttcctgccatgcttac

SEQ ID NO: 51047 - DNA, 20 bp, Artificial Sequence
  Description of Artificial Sequence: Synthetic oligonucleotide
  Target: ATXN1; (-) strand; PAM type: NRG; PAM sequence: CAG
gcctcttcctgccatgctta

SEQ ID NO: 51048 - DNA, 20 bp, Artificial Sequence
  Description of Artificial Sequence: Synthetic oligonucleotide
  Target: ATXN1; (-) strand; PAM type: NRG; PAM sequence: CAG
tagtcatccaccaccttgca

SEQ ID NO: 51049 - DNA, 20 bp, Artificial Sequence
  Description of Artificial Sequence: Synthetic oligonucleotide
  Target: ATXN1; (-) strand; PAM type: NRG; PAM sequence: TAG
gagtccacaacaaagccctg

SEQ ID NO: 51050 - DNA, 20 bp, Artificial Sequence
  Description of Artificial Sequence: Synthetic oligonucleotide
  Target: ATXN1; (-) strand; PAM type: NRG; PAM sequence: AAG
gaggcctggagtccacaaca

SEQ ID NO: 51051 - DNA, 20 bp, Artificial Sequence
  Description of Artificial Sequence: Synthetic oligonucleotide
  Target: ATXN1; (-) strand; PAM type: NRG; PAM sequence: GAG
tgaaagggattagaggcctg

SEQ ID NO: 51052 - DNA, 20 bp, Artificial Sequence
  Description of Artificial Sequence: Synthetic oligonucleotide
  Target: ATXN1; (-) strand; PAM type: NRG; PAM sequence: TGG
actgaaagggattagaggcc

SEQ ID NO: 51053 - DNA, 20 bp, Artificial Sequence
  Description of Artificial Sequence: Synthetic oligonucleotide
  Target: ATXN1; (-) strand; PAM type: NRG; PAM sequence: AGG
aaaagactgaaagggattag

SEQ ID NO: 51054 - DNA, 20 bp, Artificial Sequence
  Description of Artificial Sequence: Synthetic oligonucleotide
  Target: ATXN1; (-) strand; PAM type: NRG; PAM sequence: GAG
aaaaagactgaaagggatta

SEQ ID NO: 51055 - DNA, 20 bp, Artificial Sequence
  Description of Artificial Sequence: Synthetic oligonucleotide
  Target: ATXN1; (-) strand; PAM type: NRG; PAM sequence: TAG
ataaaaagactgaaagggat

SEQ ID NO: 51056 - DNA, 20 bp, Artificial Sequence
  Description of Artificial Sequence: Synthetic oligonucleotide
  Target: ATXN1; (-) strand; PAM type: NRG; PAM sequence: GGG
gagaaataaaaagactgaaa

SEQ ID NO: 51057 - DNA, 20 bp, Artificial Sequence
  Description of Artificial Sequence: Synthetic oligonucleotide
  Target: ATXN1; (-) strand; PAM type: NRG; PAM sequence: AGG
agagaaataaaaagactgaa

SEQ ID NO: 51058 - DNA, 20 bp, Artificial Sequence
  Description of Artificial Sequence: Synthetic oligonucleotide
  Target: ATXN1; (-) strand; PAM type: NRG; PAM sequence: AAG
cagagaaataaaaagactga

SEQ ID NO: 51059 - DNA, 20 bp, Artificial Sequence
  Description of Artificial Sequence: Synthetic oligonucleotide
  Target: ATXN1; (-) strand; PAM type: NRG; PAM sequence: AAG
tttgagggcagagaaataaa

SEQ ID NO: 51060 - DNA, 20 bp, Artificial Sequence
  Description of Artificial Sequence: Synthetic oligonucleotide
  Target: ATXN1; (-) strand; PAM type: NRG; PAM sequence: GAG
gctgctgggctttgagggca

SEQ ID NO: 51061 - DNA, 20 bp, Artificial Sequence
  Description of Artificial Sequence: Synthetic oligonucleotide
  Target: ATXN1; (-) strand; PAM type: NRG; PAM sequence: CAG
aggctgctgggctttgaggg

SEQ ID NO: 51062 - DNA, 20 bp, Artificial Sequence
  Description of Artificial Sequence: Synthetic oligonucleotide
  Target: ATXN1; (-) strand; PAM type: NRG; PAM sequence: GGG
tccaggctgctgggctttga

SEQ ID NO: 51063 - DNA, 20 bp, Artificial Sequence
  Description of Artificial Sequence: Synthetic oligonucleotide
  Target: ATXN1; (-) strand; PAM type: NRG; PAM sequence: AGG
ctccaggctgctgggctttg

SEQ ID NO: 51064 - DNA, 20 bp, Artificial Sequence
  Description of Artificial Sequence: Synthetic oligonucleotide
  Target: ATXN1; (-) strand; PAM type: NRG; PAM sequence: GAG
cctccaggctgctgggcttt

SEQ ID NO: 51065 - DNA, 20 bp, Artificial Sequence
  Description of Artificial Sequence: Synthetic oligonucleotide
  Target: ATXN1; (-) strand; PAM type: NRG; PAM sequence: GGG
cttctcccctccaggctgct

SEQ ID NO: 51066 - DNA, 20 bp, Artificial Sequence
  Description of Artificial Sequence: Synthetic oligonucleotide
  Target: ATXN1; (-) strand; PAM type: NRG; PAM sequence: TGG
ccttctcccctccaggctgc

SEQ ID NO: 51067 - DNA, 20 bp, Artificial Sequence
  Description of Artificial Sequence: Synthetic oligonucleotide
  Target: ATXN1; (-) strand; PAM type: NRG; PAM sequence: AGG
ggcactgccttctcccctcc

SEQ ID NO: 51068 - DNA, 20 bp, Artificial Sequence
  Description of Artificial Sequence: Synthetic oligonucleotide
  Target: ATXN1; (-) strand; PAM type: NRG; PAM sequence: CAG
gggcactgccttctcccctc

SEQ ID NO: 51069 - DNA, 20 bp, Artificial Sequence
  Description of Artificial Sequence: Synthetic oligonucleotide
  Target: ATXN1; (-) strand; PAM type: NRG; PAM sequence: GGG
aaacatcaggctgcagtcaa

SEQ ID NO: 51070 - DNA, 20 bp, Artificial Sequence
  Description of Artificial Sequence: Synthetic oligonucleotide
  Target: ATXN1; (-) strand; PAM type: NRG; PAM sequence: AGG
gaaacatcaggctgcagtca

SEQ ID NO: 51071 - DNA, 20 bp, Artificial Sequence
  Description of Artificial Sequence: Synthetic oligonucleotide
  Target: ATXN1; (-) strand; PAM type: NRG; PAM sequence: AAG
ggaaacatcaggctgcagtc

SEQ ID NO: 51072 - DNA, 20 bp, Artificial Sequence
  Description of Artificial Sequence: Synthetic oligonucleotide
  Target: ATXN1; (-) strand; PAM type: NRG; PAM sequence: CAG
caggaggaaacatcaggctg

SEQ ID NO: 51073 - DNA, 20 bp, Artificial Sequence
  Description of Artificial Sequence: Synthetic oligonucleotide
  Target: ATXN1; (-) strand; PAM type: NRG; PAM sequence: AGG
agaagccaggaggaaacatc

SEQ ID NO: 51074 - DNA, 20 bp, Artificial Sequence
  Description of Artificial Sequence: Synthetic oligonucleotide
  Target: ATXN1; (-) strand; PAM type: NRG; PAM sequence: CAG
cagaagccaggaggaaacat

SEQ ID NO: 51075 - DNA, 20 bp, Artificial Sequence
  Description of Artificial Sequence: Synthetic oligonucleotide
  Target: ATXN1; (-) strand; PAM type: NRG; PAM sequence: AGG
gtaggccaccagaagccagg

SEQ ID NO: 51076 - DNA, 20 bp, Artificial Sequence
  Description of Artificial Sequence: Synthetic oligonucleotide
  Target: ATXN1; (-) strand; PAM type: NRG; PAM sequence: GAG
cgtaggccaccagaagccag

SEQ ID NO: 51077 - DNA, 20 bp, Artificial Sequence
  Description of Artificial Sequence: Synthetic oligonucleotide
  Target: ATXN1; (-) strand; PAM type: NRG; PAM sequence: AGG
accgtaggccaccagaagcc

SEQ ID NO: 51078 - DNA, 20 bp, Artificial Sequence
  Description of Artificial Sequence: Synthetic oligonucleotide
  Target: ATXN1; (-) strand; PAM type: NRG; PAM sequence: CAG
gaccgtaggccaccagaagc

SEQ ID NO: 51079 - DNA, 20 bp, Artificial Sequence
  Description of Artificial Sequence: Synthetic oligonucleotide
  Target: ATXN1; (-) strand; PAM type: NRG; PAM sequence: AAG
aggagaccgtaggccaccag

SEQ ID NO: 51080 - DNA, 20 bp, Artificial Sequence
  Description of Artificial Sequence: Synthetic oligonucleotide
  Target: ATXN1; (-) strand; PAM type: NRG; PAM sequence: CAG
taaaggagaccgtaggccac

SEQ ID NO: 51081 - DNA, 20 bp, Artificial Sequence
  Description of Artificial Sequence: Synthetic oligonucleotide
  Target: ATXN1; (-) strand; PAM type: NRG; PAM sequence: AGG
cctacagtaaaggagaccgt

SEQ ID NO: 51082 - DNA, 20 bp, Artificial Sequence
  Description of Artificial Sequence: Synthetic oligonucleotide
  Target: ATXN1; (-) strand; PAM type: NRG; PAM sequence: TAG
acctacagtaaaggagaccg

SEQ ID NO: 51083 - DNA, 20 bp, Artificial Sequence
  Description of Artificial Sequence: Synthetic oligonucleotide
  Target: ATXN1; (-) strand; PAM type: NRG; PAM sequence: GAG
tccagaaacctacagtaaag

SEQ ID NO: 51084 - DNA, 20 bp, Artificial Sequence
  Description of Artificial Sequence: Synthetic oligonucleotide
  Target: ATXN1; (-) strand; PAM type: NRG; PAM sequence: AGG
gctccagaaacctacagtaa

SEQ ID NO: 51085 - DNA, 20 bp, Artificial Sequence
  Description of Artificial Sequence: Synthetic oligonucleotide
  Target: ATXN1; (-) strand; PAM type: NRG; PAM sequence: AAG
tgctccagaaacctacagta

SEQ ID NO: 51086 - DNA, 20 bp, Artificial Sequence
  Description of Artificial Sequence: Synthetic oligonucleotide
  Target: ATXN1; (-) strand; PAM type: NRG; PAM sequence: CAG
atttttgctccagaaaccta

SEQ ID NO: 51087 - DNA, 20 bp, Artificial Sequence
  Description of Artificial Sequence: Synthetic oligonucleotide
  Target: ATXN1; (-) strand; PAM type: NRG; PAM sequence: CAG
tgactgctggatttttgctc

SEQ ID NO: 51088 - DNA, 20 bp, Artificial Sequence
  Description of Artificial Sequence: Synthetic oligonucleotide
  Target: ATXN1; (-) strand; PAM type: NRG; PAM sequence: TGG
gatcctggtaacctgactgc

SEQ ID NO: 51089 - DNA, 20 bp, Artificial Sequence
  Description of Artificial Sequence: Synthetic oligonucleotide
  Target: ATXN1; (-) strand; PAM type: NRG; PAM sequence: TGG
tgcatagttgtcactgatcc

SEQ ID NO: 51090 - DNA, 20 bp, Artificial Sequence
  Description of Artificial Sequence: Synthetic oligonucleotide
  Target: ATXN1; (-) strand; PAM type: NRG; PAM sequence: TAG
gcctgcccctaattattgca

SEQ ID NO: 51091 - DNA, 20 bp, Artificial Sequence
  Description of Artificial Sequence: Synthetic oligonucleotide
  Target: ATXN1; (-) strand; PAM type: NRG; PAM sequence: TGG
agctctgtttctctgcctcc

SEQ ID NO: 51092 - DNA, 20 bp, Artificial Sequence
  Description of Artificial Sequence: Synthetic oligonucleotide
  Target: ATXN1; (-) strand; PAM type: NRG; PAM sequence: CAG
atcatagagtttctgccacc

SEQ ID NO: 51093 - DNA, 20 bp, Artificial Sequence
  Description of Artificial Sequence: Synthetic oligonucleotide
  Target: ATXN1; (-) strand; PAM type: NRG; PAM sequence: GAG
gtttcctttggggtatcata

SEQ ID NO: 51094 - DNA, 20 bp, Artificial Sequence
  Description of Artificial Sequence: Synthetic oligonucleotide
  Target: ATXN1; (-) strand; PAM type: NRG; PAM sequence: TAG
atgtttcctttggggtatca

SEQ ID NO: 51095 - DNA, 20 bp, Artificial Sequence
  Description of Artificial Sequence: Synthetic oligonucleotide
  Target: ATXN1; (-) strand; PAM type: NRG; PAM sequence: GGG
aagagttgatgtttcctttg

SEQ ID NO: 51096 - DNA, 20 bp, Artificial Sequence
  Description of Artificial Sequence: Synthetic oligonucleotide
  Target: ATXN1; (-) strand; PAM type: NRG; PAM sequence: GGG
gaagagttgatgtttccttt

SEQ ID NO: 51097 - DNA, 20 bp, Artificial Sequence
  Description of Artificial Sequence: Synthetic oligonucleotide
  Target: ATXN1; (-) strand; PAM type: NRG; PAM sequence: TGG
agaagagttgatgtttcctt

SEQ ID NO: 51098 - DNA, 20 bp, Artificial Sequence
  Description of Artificial Sequence: Synthetic oligonucleotide
  Target: ATXN1; (-) strand; PAM type: NRG; PAM sequence: GAG
ttcttgaccacctctgagaa

SEQ ID NO: 51099 - DNA, 20 bp, Artificial Sequence
  Description of Artificial Sequence: Synthetic oligonucleotide
  Target: ATXN1; (-) strand; PAM type: NRG; PAM sequence: AAG
tgttcttgaccacctctgag

SEQ ID NO: 51100 - DNA, 20 bp, Artificial Sequence
  Description of Artificial Sequence: Synthetic oligonucleotide
  Target: ATXN1; (-) strand; PAM type: NRG; PAM sequence: GAG
gcatgttcttgaccacctct

SEQ ID NO: 51101 - DNA, 20 bp, Artificial Sequence
  Description of Artificial Sequence: Synthetic oligonucleotide
  Target: ATXN1; (-) strand; PAM type: NRG; PAM sequence: TGG
aaccaggcaggcaaagcttc

SEQ ID NO: 51102 - DNA, 20 bp, Artificial Sequence
  Description of Artificial Sequence: Synthetic oligonucleotide
  Target: ATXN1; (-) strand; PAM type: NRG; PAM sequence: AAG
tgctgccaaccaggcaggca

SEQ ID NO: 51103 - DNA, 20 bp, Artificial Sequence
  Description of Artificial Sequence: Synthetic oligonucleotide
  Target: ATXN1; (-) strand; PAM type: NRG; PAM sequence: AGG
atttctgctgccaaccaggc

SEQ ID NO: 51104 - DNA, 20 bp, Artificial Sequence
  Description of Artificial Sequence: Synthetic oligonucleotide
  Target: ATXN1; (-) strand; PAM type: NRG; PAM sequence: CAG
catttctgctgccaaccagg

SEQ ID NO: 51105 - DNA, 20 bp, Artificial Sequence
  Description of Artificial Sequence: Synthetic oligonucleotide
  Target: ATXN1; (-) strand; PAM type: NRG; PAM sequence: AGG
tgccatttctgctgccaacc

SEQ ID NO: 51106 - DNA, 20 bp, Artificial Sequence
  Description of Artificial Sequence: Synthetic oligonucleotide
  Target: ATXN1; (-) strand; PAM type: NRG; PAM sequence: CAG
gtgccatttctgctgccaac

SEQ ID NO: 51107 - DNA, 20 bp, Artificial Sequence
  Description of Artificial Sequence: Synthetic oligonucleotide
  Target: ATXN1; (-) strand; PAM type: NRG; PAM sequence: TAG
ggttacgagtgatcactggc

SEQ ID NO: 51108 - DNA, 20 bp, Artificial Sequence
  Description of Artificial Sequence: Synthetic oligonucleotide
  Target: ATXN1; (-) strand; PAM type: NRG; PAM sequence: TGG
gcaaggttacgagtgatcac

SEQ ID NO: 51109 - DNA, 20 bp, Artificial Sequence
  Description of Artificial Sequence: Synthetic oligonucleotide
  Target: ATXN1; (-) strand; PAM type: NRG; PAM sequence: GAG
aaagaaggcagcaaggttac

SEQ ID NO: 51110 - DNA, 20 bp, Artificial Sequence
  Description of Artificial Sequence: Synthetic oligonucleotide
  Target: ATXN1; (-) strand; PAM type: NRG; PAM sequence: AGG
catctgtaaagaaggcagca

SEQ ID NO: 51111 - DNA, 20 bp, Artificial Sequence
  Description of Artificial Sequence: Synthetic oligonucleotide
  Target: ATXN1; (-) strand; PAM type: NRG; PAM sequence: AAG
ccatctgtaaagaaggcagc

SEQ ID NO: 51112 - DNA, 20 bp, Artificial Sequence
  Description of Artificial Sequence: Synthetic oligonucleotide
  Target: ATXN1; (-) strand; PAM type: NRG; PAM sequence: CAG
gcagccatctgtaaagaagg

SEQ ID NO: 51113 - DNA, 20 bp, Artificial Sequence
  Description of Artificial Sequence: Synthetic oligonucleotide
  Target: ATXN1; (-) strand; PAM type: NRG; PAM sequence: AGG
acagcagccatctgtaaaga

SEQ ID NO: 51114 - DNA, 20 bp, Artificial Sequence
  Description of Artificial Sequence: Synthetic oligonucleotide
  Target: ATXN1; (-) strand; PAM type: NRG; PAM sequence: AAG
gacagcagccatctgtaaag

SEQ ID NO: 51115 - DNA, 20 bp, Artificial Sequence
  Description of Artificial Sequence: Synthetic oligonucleotide
  Target: ATXN1; (-) strand; PAM type: NRG; PAM sequence: AAG
cctgacagcagccatctgta

SEQ ID NO: 51116 - DNA, 20 bp, Artificial Sequence
  Description of Artificial Sequence: Synthetic oligonucleotide
  Target: ATXN1; (-) strand; PAM type: NRG; PAM sequence: CAG
caaattaaacagcctgacag

SEQ ID NO: 51117 - DNA, 20 bp, Artificial Sequence
  Description of Artificial Sequence: Synthetic oligonucleotide
  Target: ATXN1; (-) strand; PAM type: NRG; PAM sequence: CAG
ctccaaattaaacagcctga

SEQ ID NO: 51118 - DNA, 20 bp, Artificial Sequence
  Description of Artificial Sequence: Synthetic oligonucleotide
  Target: ATXN1; (-) strand; PAM type: NRG; PAM sequence: CAG
ggaatttcctccaaattaaa

SEQ ID NO: 51119 - DNA, 20 bp, Artificial Sequence
  Description of Artificial Sequence: Synthetic oligonucleotide
  Target: ATXN1; (-) strand; PAM type: NRG; PAM sequence: TGG
catgtctctgctgatgacat

SEQ ID NO: 51120 - DNA, 20 bp, Artificial Sequence
  Description of Artificial Sequence: Synthetic oligonucleotide
  Target: ATXN1; (-) strand; PAM type: NRG; PAM sequence: CAG
agttctgtctttgtgcttgg

SEQ ID NO: 51121 - DNA, 20 bp, Artificial Sequence
  Description of Artificial Sequence: Synthetic oligonucleotide
  Target: ATXN1; (-) strand; PAM type: NRG; PAM sequence: TGG
ccaagttctgtctttgtgct

SEQ ID NO: 51122 - DNA, 20 bp, Artificial Sequence
  Description of Artificial Sequence: Synthetic oligonucleotide
  Target: ATXN1; (-) strand; PAM type: NRG; PAM sequence: AAG
gggtatcagctggggaagcc

SEQ ID NO: 51123 - DNA, 20 bp, Artificial Sequence
  Description of Artificial Sequence: Synthetic oligonucleotide
  Target: ATXN1; (-) strand; PAM type: NRG; PAM sequence: AAG
tccatgggtatcagctgggg

SEQ ID NO: 51124 - DNA, 20 bp, Artificial Sequence
  Description of Artificial Sequence: Synthetic oligonucleotide
  Target: ATXN1; (-) strand; PAM type: NRG; PAM sequence: GGG
gtatccatgggtatcagctg

SEQ ID NO: 51125 - DNA, 20 bp, Artificial Sequence
  Description of Artificial Sequence: Synthetic oligonucleotide
  Target: ATXN1; (-) strand; PAM type: NRG; PAM sequence: GGG
tgtatccatgggtatcagct

SEQ ID NO: 51126 - DNA, 20 bp, Artificial Sequence
  Description of Artificial Sequence: Synthetic oligonucleotide
  Target: ATXN1; (-) strand; PAM type: NRG; PAM sequence: TGG
ctgtatccatgggtatcagc

SEQ ID NO: 51127 - DNA, 20 bp, Artificial Sequence
  Description of Artificial Sequence: Synthetic oligonucleotide
  Target: ATXN1; (-) strand; PAM type: NRG; PAM sequence: CAG
gtttctgtatccatgggtat

SEQ ID NO: 51128 - DNA, 20 bp, Artificial Sequence
  Description of Artificial Sequence: Synthetic oligonucleotide
  Target: ATXN1; (-) strand; PAM type: NRG; PAM sequence: GGG
tagcctgtttctgtatccat

SEQ ID NO: 51129 - DNA, 20 bp, Artificial Sequence
  Description of Artificial Sequence: Synthetic oligonucleotide
  Target: ATXN1; (-) strand; PAM type: NRG; PAM sequence: TGG
ctagcctgtttctgtatcca

SEQ ID NO: 51130 - DNA, 20 bp, Artificial Sequence
  Description of Artificial Sequence: Synthetic oligonucleotide
  Target: ATXN1; (-) strand; PAM type: NRG; PAM sequence: TAG
gtctaaaagattgttaagac

SEQ ID NO: 51131 - DNA, 20 bp, Artificial Sequence
  Description of Artificial Sequence: Synthetic oligonucleotide
  Target: ATXN1; (-) strand; PAM type: NRG; PAM sequence: AAG
gtcaggtctaaaagattgtt

SEQ ID NO: 51132 - DNA, 20 bp, Artificial Sequence
  Description of Artificial Sequence: Synthetic oligonucleotide
  Target: ATXN1; (-) strand; PAM type: NRG; PAM sequence: AAG
gctactaaggtcaggtctaa

SEQ ID NO: 51133 - DNA, 20 bp, Artificial Sequence
  Description of Artificial Sequence: Synthetic oligonucleotide
  Target: ATXN1; (-) strand; PAM type: NRG; PAM sequence: AGG
tccagtttgctactaaggtc

SEQ ID NO: 51134 - DNA, 20 bp, Artificial Sequence
  Description of Artificial Sequence: Synthetic oligonucleotide
  Target: ATXN1; (-) strand; PAM type: NRG; PAM sequence: CAG
atccagtttgctactaaggt

SEQ ID NO: 51135 - DNA, 20 bp, Artificial Sequence
  Description of Artificial Sequence: Synthetic oligonucleotide
  Target: ATXN1; (-) strand; PAM type: NRG; PAM sequence: AGG
agttatccagtttgctacta

SEQ ID NO: 51136 - DNA, 20 bp, Artificial Sequence
  Description of Artificial Sequence: Synthetic oligonucleotide
  Target: ATXN1; (-) strand; PAM type: NRG; PAM sequence: AAG
cagttatccagtttgctact

SEQ ID NO: 51137 - DNA, 20 bp, Artificial Sequence
  Description of Artificial Sequence: Synthetic oligonucleotide
  Target: ATXN1; (-) strand; PAM type: NRG; PAM sequence: CAG
ttttatgactggcagttatc

SEQ ID NO: 51138 - DNA, 20 bp, Artificial Sequence
  Description of Artificial Sequence: Synthetic oligonucleotide
  Target: ATXN1; (-) strand; PAM type: NRG; PAM sequence: CAG
agaaacacttttatgactgg

SEQ ID NO: 51139 - DNA, 20 bp, Artificial Sequence
  Description of Artificial Sequence: Synthetic oligonucleotide
  Target: ATXN1; (-) strand; PAM type: NRG; PAM sequence: TGG
tttagaaacacttttatgac

SEQ ID NO: 51140 - DNA, 20 bp, Artificial Sequence
  Description of Artificial Sequence: Synthetic oligonucleotide
  Target: ATXN1; (-) strand; PAM type: NRG; PAM sequence: TAG
gggagaaaatcaggccactt

SEQ ID NO: 51141 - DNA, 20 bp, Artificial Sequence
  Description of Artificial Sequence: Synthetic oligonucleotide
  Target: ATXN1; (-) strand; PAM type: NRG; PAM sequence: AGG
taacaggaggggagaaaatc

SEQ ID NO: 51142 - DNA, 20 bp, Artificial Sequence
  Description of Artificial Sequence: Synthetic oligonucleotide
  Target: ATXN1; (-) strand; PAM type: NRG; PAM sequence: CAG
ctaacaggaggggagaaaat

SEQ ID NO: 51143 - DNA, 20 bp, Artificial Sequence
  Description of Artificial Sequence: Synthetic oligonucleotide
  Target: ATXN1; (-) strand; PAM type: NRG; PAM sequence: GAG
ccaggatcctaacaggaggg

SEQ ID NO: 51144 - DNA, 20 bp, Artificial Sequence
  Description of Artificial Sequence: Synthetic oligonucleotide
  Target: ATXN1; (-) strand; PAM type: NRG; PAM sequence: GGG
atccaggatcctaacaggag

SEQ ID NO: 51145 - DNA, 20 bp, Artificial Sequence
  Description of Artificial Sequence: Synthetic oligonucleotide
  Target: ATXN1; (-) strand; PAM type: NRG; PAM sequence: GGG
catccaggatcctaacagga

SEQ ID NO: 51146 - DNA, 20 bp, Artificial Sequence
  Description of Artificial Sequence: Synthetic oligonucleotide
  Target: ATXN1; (-) strand; PAM type: NRG; PAM sequence: AGG
gcatccaggatcctaacagg

SEQ ID NO: 51147 - DNA, 20 bp, Artificial Sequence
  Description of Artificial Sequence: Synthetic oligonucleotide
  Target: ATXN1; (-) strand; PAM type: NRG; PAM sequence: GAG
agcatccaggatcctaacag

SEQ ID NO: 51148 - DNA, 20 bp, Artificial Sequence
  Description of Artificial Sequence: Synthetic oligonucleotide
  Target: ATXN1; (-) strand; PAM type: NRG; PAM sequence: AGG
caagcatccaggatcctaac

SEQ ID NO: 51149 - DNA, 20 bp, Artificial Sequence
  Description of Artificial Sequence: Synthetic oligonucleotide
  Target: ATXN1; (-) strand; PAM type: NRG; PAM sequence: CAG
acaagcatccaggatcctaa

SEQ ID NO: 51150 - DNA, 20 bp, Artificial Sequence
  Description of Artificial Sequence: Synthetic oligonucleotide
  Target: ATXN1; (-) strand; PAM type: NRG; PAM sequence: AGG
aaatagcattacaagcatcc

SEQ ID NO: 51151 - DNA, 20 bp, Artificial Sequence
  Description of Artificial Sequence: Synthetic oligonucleotide
  Target: ATXN1; (-) strand; PAM type: NRG; PAM sequence: CAG
taaatagcattacaagcatc

SEQ ID NO: 51152 - DNA, 20 bp, Artificial Sequence
  Description of Artificial Sequence: Synthetic oligonucleotide
  Target: ATXN1; (-) strand; PAM type: NRG; PAM sequence: AAG
ccattgataaatagcattac

SEQ ID NO: 51153 - DNA, 20 bp, Artificial Sequence
  Description of Artificial Sequence: Synthetic oligonucleotide
  Target: ATXN1; (-) strand; PAM type: NRG; PAM sequence: TAG
acaaaataaccattgataaa

SEQ ID NO: 51154 - DNA, 20 bp, Artificial Sequence
  Description of Artificial Sequence: Synthetic oligonucleotide
  Target: ATXN1; (-) strand; PAM type: NRG; PAM sequence: AAG
aaaaatgtctgcacatcagt

SEQ ID NO: 51155 - DNA, 20 bp, Artificial Sequence
  Description of Artificial Sequence: Synthetic oligonucleotide
  Target: ATXN1; (-) strand; PAM type: NRG; PAM sequence: CAG
tggaaaaaatgtctgcacat

SEQ ID NO: 51156 - DNA, 20 bp, Artificial Sequence
  Description of Artificial Sequence: Synthetic oligonucleotide
  Target: ATXN1; (-) strand; PAM type: NRG; PAM sequence: TGG
aaaaaaaaaaaagaatgggt

SEQ ID NO: 51157 - DNA, 20 bp, Artificial Sequence
  Description of Artificial Sequence: Synthetic oligonucleotide
  Target: ATXN1; (-) strand; PAM type: NRG; PAM sequence: GGG
tctcaaaaaaaaaaaagaat

SEQ ID NO: 51158 - DNA, 20 bp, Artificial Sequence
  Description of Artificial Sequence: Synthetic oligonucleotide
  Target: ATXN1; (-) strand; PAM type: NRG; PAM sequence: TGG
atctcaaaaaaaaaaaagaa

SEQ ID NO: 51159 - DNA, 20 bp, Artificial Sequence
  Description of Artificial Sequence: Synthetic oligonucleotide
  Target: ATXN1; (-) strand; PAM type: NRG; PAM sequence: AAG
actccatctcaaaaaaaaaa

SEQ ID NO: 51160 - DNA, 20 bp, Artificial Sequence
  Description of Artificial Sequence: Synthetic oligonucleotide
  Target: ATXN1; (-) strand; PAM type: NRG; PAM sequence: GAG
tcactccaacctgggctata

SEQ ID NO: 51161 - DNA, 20 bp, Artificial Sequence
  Description of Artificial Sequence: Synthetic oligonucleotide
  Target: ATXN1; (-) strand; PAM type: NRG; PAM sequence: TAG
cttcactccaacctgggcta

SEQ ID NO: 51162 - DNA, 20 bp, Artificial Sequence
  Description of Artificial Sequence: Synthetic oligonucleotide
  Target: ATXN1; (-) strand; PAM type: NRG; PAM sequence: GGG
acaccgcttcactccaacct

SEQ ID NO: 51163 - DNA, 20 bp, Artificial Sequence
  Description of Artificial Sequence: Synthetic oligonucleotide
  Target: ATXN1; (-) strand; PAM type: NRG; PAM sequence: TGG
tacaccgcttcactccaacc

SEQ ID NO: 51164 - DNA, 20 bp, Artificial Sequence
  Description of Artificial Sequence: Synthetic oligonucleotide
  Target: ATXN1; (-) strand; PAM type: NRG; PAM sequence: AAG
ggcggaggttgcagggagcc

SEQ ID NO: 51165 - DNA, 20 bp, Artificial Sequence
  Description of Artificial Sequence: Synthetic oligonucleotide
  Target: ATXN1; (-) strand; PAM type: NRG; PAM sequence: GAG
tagaaggcggaggttgcagg

SEQ ID NO: 51166 - DNA, 20 bp, Artificial Sequence
  Description of Artificial Sequence: Synthetic oligonucleotide
  Target: ATXN1; (-) strand; PAM type: NRG; PAM sequence: GGG
cctagaaggcggaggttgca

SEQ ID NO: 51167 - DNA, 20 bp, Artificial Sequence
  Description of Artificial Sequence: Synthetic oligonucleotide
  Target: ATXN1; (-) strand; PAM type: NRG; PAM sequence: AGG
acctagaaggcggaggttgc

SEQ ID NO: 51168 - DNA, 20 bp, Artificial Sequence
  Description of Artificial Sequence: Synthetic oligonucleotide
  Target: ATXN1; (-) strand; PAM type: NRG; PAM sequence: CAG
aacctagaaggcggaggttg

SEQ ID NO: 51169 - DNA, 20 bp, Artificial Sequence
  Description of Artificial Sequence: Synthetic oligonucleotide
  Target: ATXN1; (-) strand; PAM type: NRG; PAM sequence: AGG
cgcttgaacctagaaggcgg

SEQ ID NO: 51170 - DNA, 20 bp, Artificial Sequence
  Description of Artificial Sequence: Synthetic oligonucleotide
  Target: ATXN1; (-) strand; PAM type: NRG; PAM sequence: GAG
tcgcttgaacctagaaggcg

SEQ ID NO: 51171 - DNA, 20 bp, Artificial Sequence
  Description of Artificial Sequence: Synthetic oligonucleotide
  Target: ATXN1; (-) strand; PAM type: NRG; PAM sequence: CGG
aatcgcttgaacctagaagg

SEQ ID NO: 51172 - DNA, 20 bp, Artificial Sequence
  Description of Artificial Sequence: Synthetic oligonucleotide
  Target: ATXN1; (-) strand; PAM type: NRG; PAM sequence: AGG
gagaatcgcttgaacctaga

SEQ ID NO: 51173 - DNA, 20 bp, Artificial Sequence
  Description of Artificial Sequence: Synthetic oligonucleotide
  Target: ATXN1; (-) strand; PAM type: NRG; PAM sequence: AAG
ggagaatcgcttgaacctag

SEQ ID NO: 51174 - DNA, 20 bp, Artificial Sequence
  Description of Artificial Sequence: Synthetic oligonucleotide
  Target: ATXN1; (-) strand; PAM type: NRG; PAM sequence: TAG
gcaggagaatcgcttgaacc

SEQ ID NO: 51175 - DNA, 20 bp, Artificial Sequence
  Description of Artificial Sequence: Synthetic oligonucleotide
  Target: ATXN1; (-) strand; PAM type: NRG; PAM sequence: GAG
tactcaggaggctgaggcag

SEQ ID NO: 51176 - DNA, 20 bp, Artificial Sequence
  Description of Artificial Sequence: Synthetic oligonucleotide
  Target: ATXN1; (-) strand; PAM type: NRG; PAM sequence: AGG
gctactcaggaggctgaggc

SEQ ID NO: 51177 - DNA, 20 bp, Artificial Sequence
  Description of Artificial Sequence: Synthetic oligonucleotide
  Target: ATXN1; (-) strand; PAM type: NRG; PAM sequence: CAG
agctactcaggaggctgagg

SEQ ID NO: 51178 - DNA, 20 bp, Artificial Sequence
  Description of Artificial Sequence: Synthetic oligonucleotide
  Target: ATXN1; (-) strand; PAM type: NRG; PAM sequence: AGG
cccagctactcaggaggctg

SEQ ID NO: 51179 - DNA, 20 bp, Artificial Sequence
  Description of Artificial Sequence: Synthetic oligonucleotide
  Target: ATXN1; (-) strand; PAM type: NRG; PAM sequence: GAG
tcccagctactcaggaggct

SEQ ID NO: 51180 - DNA, 20 bp, Artificial Sequence
  Description of Artificial Sequence: Synthetic oligonucleotide
  Target: ATXN1; (-) strand; PAM type: NRG; PAM sequence: AGG
tgtaatcccagctactcagg

SEQ ID NO: 51181 - DNA, 20 bp, Artificial Sequence
  Description of Artificial Sequence: Synthetic oligonucleotide
  Target: ATXN1; (-) strand; PAM type: NRG; PAM sequence: GAG
ctgtaatcccagctactcag

SEQ ID NO: 51182 - DNA, 20 bp, Artificial Sequence
  Description of Artificial Sequence: Synthetic oligonucleotide
  Target: ATXN1; (-) strand; PAM type: NRG; PAM sequence: AGG
gcctgtaatcccagctactc

SEQ ID NO: 51183 - DNA, 20 bp, Artificial Sequence
  Description of Artificial Sequence: Synthetic oligonucleotide
  Target: ATXN1; (-) strand; PAM type: NRG; PAM sequence: CAG
cgcctgtaatcccagctact

SEQ ID NO: 51184 - DNA, 20 bp, Artificial Sequence
  Description of Artificial Sequence: Synthetic oligonucleotide
  Target: ATXN1; (-) strand; PAM type: NRG; PAM sequence: CAG
gtggcgggcgcctgtaatcc

SEQ ID NO: 51185 - DNA, 20 bp, Artificial Sequence
  Description of Artificial Sequence: Synthetic oligonucleotide
  Target: ATXN1; (-) strand; PAM type: NRG; PAM sequence: GGG
aattagccaggtgtggtggc

SEQ ID NO: 51186 - DNA, 20 bp, Artificial Sequence
  Description of Artificial Sequence: Synthetic oligonucleotide
  Target: ATXN1; (-) strand; PAM type: NRG; PAM sequence: CGG
aaattagccaggtgtggtgg

SEQ ID NO: 51187 - DNA, 20 bp, Artificial Sequence
  Description of Artificial Sequence: Synthetic oligonucleotide
  Target: ATXN1; (-) strand; PAM type: NRG; PAM sequence: TGG
caaaaattagccaggtgtgg

SEQ ID NO: 51188 - DNA, 20 bp, Artificial Sequence
  Description of Artificial Sequence: Synthetic oligonucleotide
  Target: ATXN1; (-) strand; PAM type: NRG; PAM sequence: TGG
atacaaaaattagccaggtg

SEQ ID NO: 51189 - DNA, 20 bp, Artificial Sequence
  Description of Artificial Sequence: Synthetic oligonucleotide
  Target: ATXN1; (-) strand; PAM type: NRG; PAM sequence: AGG
taaaaatacaaaaattagcc

SEQ ID NO: 51190 - DNA, 20 bp, Artificial Sequence
  Description of Artificial Sequence: Synthetic oligonucleotide
  Target: ATXN1; (-) strand; PAM type: NRG; PAM sequence: CAG
ctaaaaatacaaaaattagc

SEQ ID NO: 51191 - DNA, 20 bp, Artificial Sequence
  Description of Artificial Sequence: Synthetic oligonucleotide
  Target: ATXN1; (-) strand; PAM type: NRG; PAM sequence: TAG
tctactaaaaatacaaaaat

SEQ ID NO: 51192 - DNA, 20 bp, Artificial Sequence
  Description of Artificial Sequence: Synthetic oligonucleotide
  Target: ATXN1; (-) strand; PAM type: NRG; PAM sequence: CAG
tgaggtcaggagttcgagac

SEQ ID NO: 51193 - DNA, 20 bp, Artificial Sequence
  Description of Artificial Sequence: Synthetic oligonucleotide
  Target: ATXN1; (-) strand; PAM type: NRG; PAM sequence: GAG
tcacctgaggtcaggagttc

SEQ ID NO: 51194 - DNA, 20 bp, Artificial Sequence
  Description of Artificial Sequence: Synthetic oligonucleotide
  Target: ATXN1; (-) strand; PAM type: NRG; PAM sequence: GAG
ggtggatcacctgaggtcag

SEQ ID NO: 51195 - DNA, 20 bp, Artificial Sequence
  Description of Artificial Sequence: Synthetic oligonucleotide
  Target: ATXN1; (-) strand; PAM type: NRG; PAM sequence: AGG
cgggtggatcacctgaggtc

SEQ ID NO: 51196 - DNA, 20 bp, Artificial Sequence
  Description of Artificial Sequence: Synthetic oligonucleotide
  Target: ATXN1; (-) strand; PAM type: NRG; PAM sequence: CAG
gcgggtggatcacctgaggt

SEQ ID NO: 51197 - DNA, 20 bp, Artificial Sequence
  Description of Artificial Sequence: Synthetic oligonucleotide
  Target: ATXN1; (-) strand; PAM type: NRG; PAM sequence: AGG
caaagcgggtggatcacctg

SEQ ID NO: 51198 - DNA, 20 bp, Artificial Sequence
  Description of Artificial Sequence: Synthetic oligonucleotide
  Target: ATXN1; (-) strand; PAM type: NRG; PAM sequence: GAG
ccaaagcgggtggatcacct

SEQ ID NO: 51199 - DNA, 20 bp, Artificial Sequence
  Description of Artificial Sequence: Synthetic oligonucleotide
  Target: ATXN1; (-) strand; PAM type: NRG; PAM sequence: TGG
ctttgggaggccaaagcggg

SEQ ID NO: 51200 - DNA, 20 bp, Artificial Sequence
  Description of Artificial Sequence: Synthetic oligonucleotide
  Target: ATXN1; (-) strand; PAM type: NRG; PAM sequence: GGG
gcactttgggaggccaaagc

SEQ ID NO: 51201 - DNA, 20 bp, Artificial Sequence
  Description of Artificial Sequence: Synthetic oligonucleotide
  Target: ATXN1; (-) strand; PAM type: NRG; PAM sequence: CGG
agcactttgggaggccaaag

SEQ ID NO: 51202 - DNA, 20 bp, Artificial Sequence
  Description of Artificial Sequence: Synthetic oligonucleotide
  Target: ATXN1; (-) strand; PAM type: NRG; PAM sequence: AAG
cctagcactttgggaggcca

SEQ ID NO: 51203 - DNA, 20 bp, Artificial Sequence
  Description of Artificial Sequence: Synthetic oligonucleotide
  Target: ATXN1; (-) strand; PAM type: NRG; PAM sequence: AGG
tctagtcctagcactttggg

SEQ ID NO: 51204 - DNA, 20 bp, Artificial Sequence
  Description of Artificial Sequence: Synthetic oligonucleotide
  Target: ATXN1; (-) strand; PAM type: NRG; PAM sequence: GAG
ctctagtcctagcactttgg

SEQ ID NO: 51205 - DNA, 20 bp, Artificial Sequence
  Description of Artificial Sequence: Synthetic oligonucleotide
  Target: ATXN1; (-) strand; PAM type: NRG; PAM sequence: GGG
gcctctagtcctagcacttt

SEQ ID NO: 51206 - DNA, 20 bp, Artificial Sequence
  Description of Artificial Sequence: Synthetic oligonucleotide
  Target: ATXN1; (-) strand; PAM type: NRG; PAM sequence: TGG
tgcctctagtcctagcactt

SEQ ID NO: 51207 - DNA, 20 bp, Artificial Sequence
  Description of Artificial Sequence: Synthetic oligonucleotide
  Target: ATXN1; (-) strand; PAM type: NRG; PAM sequence: TAG
atggctcatgcctctagtcc

SEQ ID NO: 51208 - DNA, 20 bp, Artificial Sequence
  Description of Artificial Sequence: Synthetic oligonucleotide
  Target: ATXN1; (-) strand; PAM type: NRG; PAM sequence: TAG
tgtgcgatggctcatgcctc

SEQ ID NO: 51209 - DNA, 20 bp, Artificial Sequence
  Description of Artificial Sequence: Synthetic oligonucleotide
  Target: ATXN1; (-) strand; PAM type: NRG; PAM sequence: TGG
atggttgaggtcgtgtgcga

SEQ ID NO: 51210 - DNA, 20 bp, Artificial Sequence
  Description of Artificial Sequence: Synthetic oligonucleotide
  Target: ATXN1; (-) strand; PAM type: NRG; PAM sequence: AGG
ttagagataaagaatggttg

SEQ ID NO: 51211 - DNA, 20 bp, Artificial Sequence
  Description of Artificial Sequence: Synthetic oligonucleotide
  Target: ATXN1; (-) strand; PAM type: NRG; PAM sequence: GAG
tttagagataaagaatggtt

SEQ ID NO: 51212 - DNA, 20 bp, Artificial Sequence
  Description of Artificial Sequence: Synthetic oligonucleotide
  Target: ATXN1; (-) strand; PAM type: NRG; PAM sequence: TGG
gtgagtttagagataaagaa

SEQ ID NO: 51213 - DNA, 20 bp, Artificial Sequence
  Description of Artificial Sequence: Synthetic oligonucleotide
  Target: ATXN1; (-) strand; PAM type: NRG; PAM sequence: AAG
gtcttgtgagtttagagata

SEQ ID NO: 51214 - DNA, 20 bp, Artificial Sequence
  Description of Artificial Sequence: Synthetic oligonucleotide
  Target: ATXN1; (-) strand; PAM type: NRG; PAM sequence: GAG
accactgtcttgtgagttta

SEQ ID NO: 51215 - DNA, 20 bp, Artificial Sequence
  Description of Artificial Sequence: Synthetic oligonucleotide
  Target: ATXN1; (-) strand; PAM type: NRG; PAM sequence: TAG
gaaccactgtcttgtgagtt

SEQ ID NO: 51216 - DNA, 20 bp, Artificial Sequence
  Description of Artificial Sequence: Synthetic oligonucleotide
  Target: ATXN1; (-) strand; PAM type: NRG; PAM sequence: GAG
tttgagaaccactgtcttgt

SEQ ID NO: 51217 - DNA, 20 bp, Artificial Sequence
  Description of Artificial Sequence: Synthetic oligonucleotide
  Target: ATXN1; (-) strand; PAM type: NRG; PAM sequence: GAG
ttccctgggtgactcacttt

SEQ ID NO: 51218 - DNA, 20 bp, Artificial Sequence
  Description of Artificial Sequence: Synthetic oligonucleotide
  Target: ATXN1; (-) strand; PAM type: NRG; PAM sequence: GGG
atcatgatgccgctttccct

SEQ ID NO: 51219 - DNA, 20 bp, Artificial Sequence
  Description of Artificial Sequence: Synthetic oligonucleotide
  Target: ATXN1; (-) strand; PAM type: NRG; PAM sequence: TGG
gatcatgatgccgctttccc

SEQ ID NO: 51220 - DNA, 20 bp, Artificial Sequence
  Description of Artificial Sequence: Synthetic oligonucleotide
  Target: ATXN1; (-) strand; PAM type: NRG; PAM sequence: AGG
tgcatttgtaacaagtttac

SEQ ID NO: 51221 - DNA, 20 bp, Artificial Sequence
  Description of Artificial Sequence: Synthetic oligonucleotide
  Target: ATXN1; (-) strand; PAM type: NRG; PAM sequence: CAG
ttgcatttgtaacaagttta

SEQ ID NO: 51222 - DNA, 20 bp, Artificial Sequence
  Description of Artificial Sequence: Synthetic oligonucleotide
  Target: ATXN1; (-) strand; PAM type: NRG; PAM sequence: AAG
caagaatttgcatttgtaac

SEQ ID NO: 51223 - DNA, 20 bp, Artificial Sequence
  Description of Artificial Sequence: Synthetic oligonucleotide
  Target: ATXN1; (-) strand; PAM type: NRG; PAM sequence: AAG
cacagattgctggaaagccc

SEQ ID NO: 51224 - DNA, 20 bp, Artificial Sequence
  Description of Artificial Sequence: Synthetic oligonucleotide
  Target: ATXN1; (-) strand; PAM type: NRG; PAM sequence: AAG
ttcaaacacagattgctgga

SEQ ID NO: 51225 - DNA, 20 bp, Artificial Sequence
  Description of Artificial Sequence: Synthetic oligonucleotide
  Target: ATXN1; (-) strand; PAM type: NRG; PAM sequence: TGG
cttgttcaaacacagattgc

SEQ ID NO: 51226 - DNA, 20 bp, Artificial Sequence
  Description of Artificial Sequence: Synthetic oligonucleotide
  Target: ATXN1; (-) strand; PAM type: NRG; PAM sequence: CAG
ctggaggacttgttcaaaca

SEQ ID NO: 51227 - DNA, 20 bp, Artificial Sequence
  Description of Artificial Sequence: Synthetic oligonucleotide
  Target: ATXN1; (-) strand; PAM type: NRG; PAM sequence: AGG
agtgcatgggcattgcctgg

SEQ ID NO: 51228 - DNA, 20 bp, Artificial Sequence
  Description of Artificial Sequence: Synthetic oligonucleotide
  Target: ATXN1; (-) strand; PAM type: NRG; PAM sequence: GAG
aagtgcatgggcattgcctg

SEQ ID NO: 51229 - DNA, 20 bp, Artificial Sequence
  Description of Artificial Sequence: Synthetic oligonucleotide
  Target: ATXN1; (-) strand; PAM type: NRG; PAM sequence: TGG
tcaagtgcatgggcattgcc

SEQ ID NO: 51230 - DNA, 20 bp, Artificial Sequence
  Description of Artificial Sequence: Synthetic oligonucleotide
  Target: ATXN1; (-) strand; PAM type: NRG; PAM sequence: GGG
ctgtcaaatttcaagtgcat

SEQ ID NO: 51231 - DNA, 20 bp, Artificial Sequence
  Description of Artificial Sequence: Synthetic oligonucleotide
  Target: ATXN1; (-) strand; PAM type: NRG; PAM sequence: TGG
actgtcaaatttcaagtgca

SEQ ID NO: 51232 - DNA, 20 bp, Artificial Sequence
  Description of Artificial Sequence: Synthetic oligonucleotide
  Target: ATXN1; (-) strand; PAM type: NRG; PAM sequence: AAG
gagagttactgtcaaatttc

SEQ ID NO: 51233 - DNA, 20 bp, Artificial Sequence
  Description of Artificial Sequence: Synthetic oligonucleotide
  Target: ATXN1; (-) strand; PAM type: NRG; PAM sequence: GAG
agccatgtgacctcttatga

SEQ ID NO: 51234 - DNA, 20 bp, Artificial Sequence
  Description of Artificial Sequence: Synthetic oligonucleotide
  Target: ATXN1; (-) strand; PAM type: NRG; PAM sequence: GAG
ggagccatgtgacctcttat

SEQ ID NO: 51235 - DNA, 20 bp, Artificial Sequence
  Description of Artificial Sequence: Synthetic oligonucleotide
  Target: ATXN1; (-) strand; PAM type: NRG; PAM sequence: GAG
tggtgtgtttacattaaggg

SEQ ID NO: 51236 - DNA, 20 bp, Artificial Sequence
  Description of Artificial Sequence: Synthetic oligonucleotide
  Target: ATXN1; (-) strand; PAM type: NRG; PAM sequence: GGG
tttggtgtgtttacattaag

SEQ ID NO: 51237 - DNA, 20 bp, Artificial Sequence
  Description of Artificial Sequence: Synthetic oligonucleotide
  Target: ATXN1; (-) strand; PAM type: NRG; PAM sequence: GGG
ttttggtgtgtttacattaa

SEQ ID NO: 51238 - DNA, 20 bp, Artificial Sequence
  Description of Artificial Sequence: Synthetic oligonucleotide
  Target: ATXN1; (-) strand; PAM type: NRG; PAM sequence: AGG
attttggtgtgtttacatta

SEQ ID NO: 51239 - DNA, 20 bp, Artificial Sequence
  Description of Artificial Sequence: Synthetic oligonucleotide
  Target: ATXN1; (-) strand; PAM type: NRG; PAM sequence: AAG
cattttggtgtgtttacatt

SEQ ID NO: 51240 - DNA, 20 bp, Artificial Sequence
  Description of Artificial Sequence: Synthetic oligonucleotide
  Target: ATXN1; (-) strand; PAM type: NRG; PAM sequence: TGG
aaatggttcttacttcattt

SEQ ID NO: 51241 - DNA, 20 bp, Artificial Sequence
  Description of Artificial Sequence: Synthetic oligonucleotide
  Target: ATXN1; (-) strand; PAM type: NRG; PAM sequence: TGG
tgaaacttcttaaaagaaaa

SEQ ID NO: 51242 - DNA, 20 bp, Artificial Sequence
  Description of Artificial Sequence: Synthetic oligonucleotide
  Target: ATXN1; (-) strand; PAM type: NRG; PAM sequence: AAG
aaggtcttgaaacttcttaa

SEQ ID NO: 51243 - DNA, 20 bp, Artificial Sequence
  Description of Artificial Sequence: Synthetic oligonucleotide
  Target: ATXN1; (-) strand; PAM type: NRG; PAM sequence: AGG
tactcgaataaaatgtctga

SEQ ID NO: 51244 - DNA, 20 bp, Artificial Sequence
  Description of Artificial Sequence: Synthetic oligonucleotide
  Target: ATXN1; (-) strand; PAM type: NRG; PAM sequence: AAG
ttactcgaataaaatgtctg

SEQ ID NO: 51245 - DNA, 20 bp, Artificial Sequence
  Description of Artificial Sequence: Synthetic oligonucleotide
  Target: ATXN1; (-) strand; PAM type: NRG; PAM sequence: AAG
atcatatttattaagcaaaa

SEQ ID NO: 51246 - DNA, 20 bp, Artificial Sequence
  Description of Artificial Sequence: Synthetic oligonucleotide
  Target: ATXN1; (-) strand; PAM type: NRG; PAM sequence: AAG
ctgagaaaatcatatttatt

SEQ ID NO: 51247 - DNA, 20 bp, Artificial Sequence
  Description of Artificial Sequence: Synthetic oligonucleotide
  Target: ATXN1; (-) strand; PAM type: NRG; PAM sequence: GAG
tgtgatctgttagtgggtct

SEQ ID NO: 51248 - DNA, 20 bp, Artificial Sequence
  Description of Artificial Sequence: Synthetic oligonucleotide
  Target: ATXN1; (-) strand; PAM type: NRG; PAM sequence: GGG
gaaacatgtgatctgttagt

SEQ ID NO: 51249 - DNA, 20 bp, Artificial Sequence
  Description of Artificial Sequence: Synthetic oligonucleotide
  Target: ATXN1; (-) strand; PAM type: NRG; PAM sequence: TGG
tgaaacatgtgatctgttag

SEQ ID NO: 51250 - DNA, 20 bp, Artificial Sequence
  Description of Artificial Sequence: Synthetic oligonucleotide
  Target: ATXN1; (-) strand; PAM type: NRG; PAM sequence: TAG
gggtgaaacatgtgatctgt

SEQ ID NO: 51251 - DNA, 20 bp, Artificial Sequence
  Description of Artificial Sequence: Synthetic oligonucleotide
  Target: ATXN1; (-) strand; PAM type: NRG; PAM sequence: GGG
agtcatacactattttgtgt

SEQ ID NO: 51252 - DNA, 20 bp, Artificial Sequence
  Description of Artificial Sequence: Synthetic oligonucleotide
  Target: ATXN1; (-) strand; PAM type: NRG; PAM sequence: TGG
aagtcatacactattttgtg

SEQ ID NO: 51253 - DNA, 20 bp, Artificial Sequence
  Description of Artificial Sequence: Synthetic oligonucleotide
  Target: ATXN1; (-) strand; PAM type: NRG; PAM sequence: AAG
tcttctctgtgatcattcgt

SEQ ID NO: 51254 - DNA, 20 bp, Artificial Sequence
  Description of Artificial Sequence: Synthetic oligonucleotide
  Target: ATXN1; (-) strand; PAM type: NRG; PAM sequence: AAG
aaataaattaaaaatttaaa

SEQ ID NO: 51255 - DNA, 20 bp, Artificial Sequence
  Description of Artificial Sequence: Synthetic oligonucleotide
  Target: ATXN1; (-) strand; PAM type: NRG; PAM sequence: AAG
agctatggatgtaacccaga

SEQ ID NO: 51256 - DNA, 20 bp, Artificial Sequence
  Description of Artificial Sequence: Synthetic oligonucleotide
  Target: ATXN1; (-) strand; PAM type: NRG; PAM sequence: CAG
agtgagctatggatgtaacc

SEQ ID NO: 51257 - DNA, 20 bp, Artificial Sequence
  Description of Artificial Sequence: Synthetic oligonucleotide
  Target: ATXN1; (-) strand; PAM type: NRG; PAM sequence: TGG
tttgaggctgcagtgagcta

SEQ ID NO: 51258 - DNA, 20 bp, Artificial Sequence
  Description of Artificial Sequence: Synthetic oligonucleotide
  Target: ATXN1; (-) strand; PAM type: NRG; PAM sequence: GAG
caggagtttgaggctgcagt

SEQ ID NO: 51259 - DNA, 20 bp, Artificial Sequence
  Description of Artificial Sequence: Synthetic oligonucleotide
  Target: ATXN1; (-) strand; PAM type: NRG; PAM sequence: CAG
agcccaggagtttgaggctg

SEQ ID NO: 51260 - DNA, 20 bp, Artificial Sequence
  Description of Artificial Sequence: Synthetic oligonucleotide
  Target: ATXN1; (-) strand; PAM type: NRG; PAM sequence: AGG
tgcttgagcccaggagtttg

SEQ ID NO: 51261 - DNA, 20 bp, Artificial Sequence
  Description of Artificial Sequence: Synthetic oligonucleotide
  Target: ATXN1; (-) strand; PAM type: NRG; PAM sequence: GAG
ttgcttgagcccaggagttt

SEQ ID NO: 51262 - DNA, 20 bp, Artificial Sequence
  Description of Artificial Sequence: Synthetic oligonucleotide
  Target: ATXN1; (-) strand; PAM type: NRG; PAM sequence: GAG
ggaggattgcttgagcccag

SEQ ID NO: 51263 - DNA, 20 bp, Artificial Sequence
  Description of Artificial Sequence: Synthetic oligonucleotide
  Target: ATXN1; (-) strand; PAM type: NRG; PAM sequence: AGG
tgggaggattgcttgagccc

SEQ ID NO: 51264 - DNA, 20 bp, Artificial Sequence
  Description of Artificial Sequence: Synthetic oligonucleotide
  Target: ATXN1; (-) strand; PAM type: NRG; PAM sequence: CAG
gtgggaggattgcttgagcc

SEQ ID NO: 51265 - DNA, 20 bp, Artificial Sequence
  Description of Artificial Sequence: Synthetic oligonucleotide
  Target: ATXN1; (-) strand; PAM type: NRG; PAM sequence: GAG
ctgatgtgggaggattgctt

SEQ ID NO: 51266 - DNA, 20 bp, Artificial Sequence
  Description of Artificial Sequence: Synthetic oligonucleotide
  Target: ATXN1; (-) strand; PAM type: NRG; PAM sequence: AGG
actcaggaggctgatgtggg

SEQ ID NO: 51267 - DNA, 20 bp, Artificial Sequence
  Description of Artificial Sequence: Synthetic oligonucleotide
  Target: ATXN1; (-) strand; PAM type: NRG; PAM sequence: GAG
tactcaggaggctgatgtgg

SEQ ID NO: 51268 - DNA, 20 bp, Artificial Sequence
  Description of Artificial Sequence: Synthetic oligonucleotide
  Target: ATXN1; (-) strand; PAM type: NRG; PAM sequence: GGG
gctactcaggaggctgatgt

SEQ ID NO: 51269 - DNA, 20 bp, Artificial Sequence
  Description of Artificial Sequence: Synthetic oligonucleotide
  Target: ATXN1; (-) strand; PAM type: NRG; PAM sequence: TGG
agctactcaggaggctgatg

SEQ ID NO: 51270 - DNA, 20 bp, Artificial Sequence
  Description of Artificial Sequence: Synthetic oligonucleotide
  Target: ATXN1; (-) strand; PAM type: NRG; PAM sequence: AGG
tgtagtcttagctactcagg

SEQ ID NO: 51271 - DNA, 20 bp, Artificial Sequence
  Description of Artificial Sequence: Synthetic oligonucleotide
  Target: ATXN1; (-) strand; PAM type: NRG; PAM sequence: GAG
ctgtagtcttagctactcag

SEQ ID NO: 51272 - DNA, 20 bp, Artificial Sequence
  Description of Artificial Sequence: Synthetic oligonucleotide
  Target: ATXN1; (-) strand; PAM type: NRG; PAM sequence: AGG
ctctgtagtcttagctactc

SEQ ID NO: 51273 - DNA, 20 bp, Artificial Sequence
  Description of Artificial Sequence: Synthetic oligonucleotide
  Target: ATXN1; (-) strand; PAM type: NRG; PAM sequence: CAG
tctctgtagtcttagctact

SEQ ID NO: 51274 - DNA, 20 bp, Artificial Sequence
  Description of Artificial Sequence: Synthetic oligonucleotide
  Target: ATXN1; (-) strand; PAM type: NRG; PAM sequence: TAG
gttgtacatctctgtagtct

SEQ ID NO: 51275 - DNA, 20 bp, Artificial Sequence
  Description of Artificial Sequence: Synthetic oligonucleotide
  Target: ATXN1; (-) strand; PAM type: NRG; PAM sequence: TAG
ggtatggttgtacatctctg

SEQ ID NO: 51276 - DNA, 20 bp, Artificial Sequence
  Description of Artificial Sequence: Synthetic oligonucleotide
  Target: ATXN1; (-) strand; PAM type: NRG; PAM sequence: TGG
atttaaaaattagccgggta

SEQ ID NO: 51277 - DNA, 20 bp, Artificial Sequence
  Description of Artificial Sequence: Synthetic oligonucleotide
  Target: ATXN1; (-) strand; PAM type: NRG; PAM sequence: GGG
aaaaaatttaaaaattagcc

SEQ ID NO: 51278 - DNA, 20 bp, Artificial Sequence
  Description of Artificial Sequence: Synthetic oligonucleotide
  Target: ATXN1; (-) strand; PAM type: NRG; PAM sequence: CGG
aaaaaaatttaaaaattagc

SEQ ID NO: 51279 - DNA, 20 bp, Artificial Sequence
  Description of Artificial Sequence: Synthetic oligonucleotide
  Target: ATXN1; (-) strand; PAM type: NRG; PAM sequence: TAG
ctacaaaaaaatttaaaaat

SEQ ID NO: 51280 - DNA, 20 bp, Artificial Sequence
  Description of Artificial Sequence: Synthetic oligonucleotide
  Target: ATXN1; (-) strand; PAM type: NRG; PAM sequence: AAG
caagaccggcctgggcaaaa

SEQ ID NO: 51281 - DNA, 20 bp, Artificial Sequence
  Description of Artificial Sequence: Synthetic oligonucleotide
  Target: ATXN1; (-) strand; PAM type: NRG; PAM sequence: GGG
caggaattcaagaccggcct

SEQ ID NO: 51282 - DNA, 20 bp, Artificial Sequence
  Description of Artificial Sequence: Synthetic oligonucleotide
  Target: ATXN1; (-) strand; PAM type: NRG; PAM sequence: TGG
tcaggaattcaagaccggcc

SEQ ID NO: 51283 - DNA, 20 bp, Artificial Sequence
  Description of Artificial Sequence: Synthetic oligonucleotide
  Target: ATXN1; (-) strand; PAM type: NRG; PAM sequence: CGG
tgaggtcaggaattcaagac

SEQ ID NO: 51284 - DNA, 20 bp, Artificial Sequence
  Description of Artificial Sequence: Synthetic oligonucleotide
  Target: ATXN1; (-) strand; PAM type: NRG; PAM sequence: AAG
tcacttgaggtcaggaattc

SEQ ID NO: 51285 - DNA, 20 bp, Artificial Sequence
  Description of Artificial Sequence: Synthetic oligonucleotide
  Target: ATXN1; (-) strand; PAM type: NRG; PAM sequence: AGG
taggaagatcacttgaggtc

SEQ ID NO: 51286 - DNA, 20 bp, Artificial Sequence
  Description of Artificial Sequence: Synthetic oligonucleotide
  Target: ATXN1; (-) strand; PAM type: NRG; PAM sequence: CAG
gtaggaagatcacttgaggt

SEQ ID NO: 51287 - DNA, 20 bp, Artificial Sequence
  Description of Artificial Sequence: Synthetic oligonucleotide
  Target: ATXN1; (-) strand; PAM type: NRG; PAM sequence: AGG
caaggtaggaagatcacttg

SEQ ID NO: 51288 - DNA, 20 bp, Artificial Sequence
  Description of Artificial Sequence: Synthetic oligonucleotide
  Target: ATXN1; (-) strand; PAM type: NRG; PAM sequence: GAG
ccaaggtaggaagatcactt

SEQ ID NO: 51289 - DNA, 20 bp, Artificial Sequence
  Description of Artificial Sequence: Synthetic oligonucleotide
  Target: ATXN1; (-) strand; PAM type: NRG; PAM sequence: AAG
ctttggaaggccaaggtagg

SEQ ID NO: 51290 - DNA, 20 bp, Artificial Sequence
  Description of Artificial Sequence: Synthetic oligonucleotide
  Target: ATXN1; (-) strand; PAM type: NRG; PAM sequence: AGG
acactttggaaggccaaggt

SEQ ID NO: 51291 - DNA, 20 bp, Artificial Sequence
  Description of Artificial Sequence: Synthetic oligonucleotide
  Target: ATXN1; (-) strand; PAM type: NRG; PAM sequence: TAG
aacactttggaaggccaagg

SEQ ID NO: 51292 - DNA, 20 bp, Artificial Sequence
  Description of Artificial Sequence: Synthetic oligonucleotide
  Target: ATXN1; (-) strand; PAM type: NRG; PAM sequence: AGG
tccaacactttggaaggcca

SEQ ID NO: 51293 - DNA, 20 bp, Artificial Sequence
  Description of Artificial Sequence: Synthetic oligonucleotide
  Target: ATXN1; (-) strand; PAM type: NRG; PAM sequence: AAG
ttccaacactttggaaggcc

SEQ ID NO: 51294 - DNA, 20 bp, Artificial Sequence
  Description of Artificial Sequence: Synthetic oligonucleotide
  Target: ATXN1; (-) strand; PAM type: NRG; PAM sequence: AGG
tacaattccaacactttgga

SEQ ID NO: 51295 - DNA, 20 bp, Artificial Sequence
  Description of Artificial Sequence: Synthetic oligonucleotide
  Target: ATXN1; (-) strand; PAM type: NRG; PAM sequence: AAG
ctacaattccaacactttgg

SEQ ID NO: 51296 - DNA, 20 bp, Artificial Sequence
  Description of Artificial Sequence: Synthetic oligonucleotide
  Target: ATXN1; (-) strand; PAM type: NRG; PAM sequence: TGG
cacctacaattccaacactt

SEQ ID NO: 51297 - DNA, 20 bp, Artificial Sequence
  Description of Artificial Sequence: Synthetic oligonucleotide
  Target: ATXN1; (-) strand; PAM type: NRG; PAM sequence: TGG
ctcactatgaaccatcatga

SEQ ID NO: 51298 - DNA, 20 bp, Artificial Sequence
  Description of Artificial Sequence: Synthetic oligonucleotide
  Target: ATXN1; (-) strand; PAM type: NRG; PAM sequence: GAG
aggcaaataatgtagagata

SEQ ID NO: 51299 - DNA, 20 bp, Artificial Sequence
  Description of Artificial Sequence: Synthetic oligonucleotide
  Target: ATXN1; (-) strand; PAM type: NRG; PAM sequence: TAG
gtaggcaaataatgtagaga

SEQ ID NO: 51300 - DNA, 20 bp, Artificial Sequence
  Description of Artificial Sequence: Synthetic oligonucleotide
  Target: ATXN1; (-) strand; PAM type: NRG; PAM sequence: GAG
atttgtaggcaaataatgta

SEQ ID NO: 51301 - DNA, 20 bp, Artificial Sequence
  Description of Artificial Sequence: Synthetic oligonucleotide
  Target: ATXN1; (-) strand; PAM type: NRG; PAM sequence: TAG
atatttgtaggcaaataatg

SEQ ID NO: 51302 - DNA, 20 bp, Artificial Sequence
  Description of Artificial Sequence: Synthetic oligonucleotide
  Target: ATXN1; (-) strand; PAM type: NRG; PAM sequence: AGG
aatttggtagacatatttgt

SEQ ID NO: 51303 - DNA, 20 bp, Artificial Sequence
  Description of Artificial Sequence: Synthetic oligonucleotide
  Target: ATXN1; (-) strand; PAM type: NRG; PAM sequence: TAG
gaatttggtagacatatttg

SEQ ID NO: 51304 - DNA, 20 bp, Artificial Sequence
  Description of Artificial Sequence: Synthetic oligonucleotide
  Target: ATXN1; (-) strand; PAM type: NRG; PAM sequence: TAG
gtcatatgtcatgaatttgg

SEQ ID NO: 51305 - DNA, 20 bp, Artificial Sequence
  Description of Artificial Sequence: Synthetic oligonucleotide
  Target: ATXN1; (-) strand; PAM type: NRG; PAM sequence: TGG
ctggtcatatgtcatgaatt

SEQ ID NO: 51306 - DNA, 20 bp, Artificial Sequence
  Description of Artificial Sequence: Synthetic oligonucleotide
  Target: ATXN1; (-) strand; PAM type: NRG; PAM sequence: TGG
tggtatgtattcagacacac

SEQ ID NO: 51307 - DNA, 20 bp, Artificial Sequence
  Description of Artificial Sequence: Synthetic oligonucleotide
  Target: ATXN1; (-) strand; PAM type: NRG; PAM sequence: CAG
cataaacactggtatgtatt

SEQ ID NO: 51308 - DNA, 20 bp, Artificial Sequence
  Description of Artificial Sequence: Synthetic oligonucleotide
  Target: ATXN1; (-) strand; PAM type: NRG; PAM sequence: TGG
aacgtcagtgccataaacac

SEQ ID NO: 51309 - DNA, 20 bp, Artificial Sequence
  Description of Artificial Sequence: Synthetic oligonucleotide
  Target: ATXN1; (-) strand; PAM type: NRG; PAM sequence: CAG
ccgaacaggacttaaaacgt

SEQ ID NO: 51310 - DNA, 20 bp, Artificial Sequence
  Description of Artificial Sequence: Synthetic oligonucleotide
  Target: ATXN1; (-) strand; PAM type: NRG; PAM sequence: AGG
tgcattttgtgtttccgaac

SEQ ID NO: 51311 - DNA, 20 bp, Artificial Sequence
  Description of Artificial Sequence: Synthetic oligonucleotide
  Target: ATXN1; (-) strand; PAM type: NRG; PAM sequence: CAG
gtgcattttgtgtttccgaa

SEQ ID NO: 51312 - DNA, 20 bp, Artificial Sequence
  Description of Artificial Sequence: Synthetic oligonucleotide
  Target: ATXN1; (-) strand; PAM type: NRG; PAM sequence: TAG
agtcacatatggaagctaag

SEQ ID NO: 51313 - DNA, 20 bp, Artificial Sequence
  Description of Artificial Sequence: Synthetic oligonucleotide
  Target: ATXN1; (-) strand; PAM type: NRG; PAM sequence: AAG
attagtcacatatggaagct

SEQ ID NO: 51314 - DNA, 20 bp, Artificial Sequence
  Description of Artificial Sequence: Synthetic oligonucleotide
  Target: ATXN1; (-) strand; PAM type: NRG; PAM sequence: AAG
ttaaaattagtcacatatgg

SEQ ID NO: 51315 - DNA, 20 bp, Artificial Sequence
  Description of Artificial Sequence: Synthetic oligonucleotide
  Target: ATXN1; (-) strand; PAM type: NRG; PAM sequence: TGG
attttaaaattagtcacata

SEQ ID NO: 51316 - DNA, 20 bp, Artificial Sequence
  Description of Artificial Sequence: Synthetic oligonucleotide
  Target: ATXN1; (-) strand; PAM type: NRG; PAM sequence: TAG
taaaaagcatattttaaaat

SEQ ID NO: 51317 - DNA, 20 bp, Artificial Sequence
  Description of Artificial Sequence: Synthetic oligonucleotide
  Target: ATXN1; (-) strand; PAM type: NRG; PAM sequence: AAG
gccactgcgtctggcctaaa

SEQ ID NO: 51318 - DNA, 20 bp, Artificial Sequence
  Description of Artificial Sequence: Synthetic oligonucleotide
  Target: ATXN1; (-) strand; PAM type: NRG; PAM sequence: TGG
caggtgtgagccactgcgtc

SEQ ID NO: 51319 - DNA, 20 bp, Artificial Sequence
  Description of Artificial Sequence: Synthetic oligonucleotide
  Target: ATXN1; (-) strand; PAM type: NRG; PAM sequence: GAG
agtgctgggattacaggtgt

SEQ ID NO: 51320 - DNA, 20 bp, Artificial Sequence
  Description of Artificial Sequence: Synthetic oligonucleotide
  Target: ATXN1; (-) strand; PAM type: NRG; PAM sequence: AGG
tcccaaagtgctgggattac

SEQ ID NO: 51321 - DNA, 20 bp, Artificial Sequence
  Description of Artificial Sequence: Synthetic oligonucleotide
  Target: ATXN1; (-) strand; PAM type: NRG; PAM sequence: CAG
ctcccaaagtgctgggatta

SEQ ID NO: 51322 - DNA, 20 bp, Artificial Sequence
  Description of Artificial Sequence: Synthetic oligonucleotide
  Target: ATXN1; (-) strand; PAM type: NRG; PAM sequence: GGG
ccttggcctcccaaagtgct

SEQ ID NO: 51323 - DNA, 20 bp, Artificial Sequence
  Description of Artificial Sequence: Synthetic oligonucleotide
  Target: ATXN1; (-) strand; PAM type: NRG; PAM sequence: TGG
accttggcctcccaaagtgc

SEQ ID NO: 51324 - DNA, 20 bp, Artificial Sequence
  Description of Artificial Sequence: Synthetic oligonucleotide
  Target: ATXN1; (-) strand; PAM type: NRG; PAM sequence: AAG
cctcccaccttggcctccca

SEQ ID NO: 51325 - DNA, 20 bp, Artificial Sequence
  Description of Artificial Sequence: Synthetic oligonucleotide
  Target: ATXN1; (-) strand; PAM type: NRG; PAM sequence: TGG
acctcgtgatcctcccacct

SEQ ID NO: 51326 - DNA, 20 bp, Artificial Sequence
  Description of Artificial Sequence: Synthetic oligonucleotide
  Target: ATXN1; (-) strand; PAM type: NRG; PAM sequence: TGG
tttcactgtgttggccagac

SEQ ID NO: 51327 - DNA, 20 bp, Artificial Sequence
  Description of Artificial Sequence: Synthetic oligonucleotide
  Target: ATXN1; (-) strand; PAM type: NRG; PAM sequence: CAG
caagatttcactgtgttggc

SEQ ID NO: 51328 - DNA, 20 bp, Artificial Sequence
  Description of Artificial Sequence: Synthetic oligonucleotide
  Target: ATXN1; (-) strand; PAM type: NRG; PAM sequence: TGG
cagacaagatttcactgtgt

SEQ ID NO: 51329 - DNA, 20 bp, Artificial Sequence
  Description of Artificial Sequence: Synthetic oligonucleotide
  Target: ATXN1; (-) strand; PAM type: NRG; PAM sequence: AAG
cactttattgtaatacagac

SEQ ID NO: 51330 - DNA, 20 bp, Artificial Sequence
  Description of Artificial Sequence: Synthetic oligonucleotide
  Target: ATXN1; (-) strand; PAM type: NRG; PAM sequence: CAG
tattacactttattgtaata

SEQ ID NO: 51331 - DNA, 20 bp, Artificial Sequence
  Description of Artificial Sequence: Synthetic oligonucleotide
  Target: ATXN1; (-) strand; PAM type: NRG; PAM sequence: AGG
gttagaatcccatgttgaaa

SEQ ID NO: 51332 - DNA, 20 bp, Artificial Sequence
  Description of Artificial Sequence: Synthetic oligonucleotide
  Target: ATXN1; (-) strand; PAM type: NRG; PAM sequence: AAG
tgttagaatcccatgttgaa

SEQ ID NO: 51333 - DNA, 20 bp, Artificial Sequence
  Description of Artificial Sequence: Synthetic oligonucleotide
  Target: ATXN1; (-) strand; PAM type: NRG; PAM sequence: TAG
aaaaaaaggtgattccatgt

SEQ ID NO: 51334 - DNA, 20 bp, Artificial Sequence
  Description of Artificial Sequence: Synthetic oligonucleotide
  Target: ATXN1; (-) strand; PAM type: NRG; PAM sequence: AGG
ttacaaaaaaaaaaaaaaaa

SEQ ID NO: 51335 - DNA, 20 bp, Artificial Sequence
  Description of Artificial Sequence: Synthetic oligonucleotide
  Target: ATXN1; (-) strand; PAM type: NRG; PAM sequence: AAG
attacaaaaaaaaaaaaaaa

SEQ ID NO: 51336 - DNA, 20 bp, Artificial Sequence
  Description of Artificial Sequence: Synthetic oligonucleotide
  Target: ATXN1; (-) strand; PAM type: NRG; PAM sequence: AGG
aggttaaaactaggggaggg

SEQ ID NO: 51337 - DNA, 20 bp, Artificial Sequence
  Description of Artificial Sequence: Synthetic oligonucleotide
  Target: ATXN1; (-) strand; PAM type: NRG; PAM sequence: GAG
taggttaaaactaggggagg

SEQ ID NO: 51338 - DNA, 20 bp, Artificial Sequence
  Description of Artificial Sequence: Synthetic oligonucleotide
  Target: ATXN1; (-) strand; PAM type: NRG; PAM sequence: GGG
cataggttaaaactagggga

SEQ ID NO: 51339 - DNA, 20 bp, Artificial Sequence
  Description of Artificial Sequence: Synthetic oligonucleotide
  Target: ATXN1; (-) strand; PAM type: NRG; PAM sequence: AGG
gcataggttaaaactagggg

SEQ ID NO: 51340 - DNA, 20 bp, Artificial Sequence
  Description of Artificial Sequence: Synthetic oligonucleotide
  Target: ATXN1; (-) strand; PAM type: NRG; PAM sequence: GAG
agcataggttaaaactaggg

SEQ ID NO: 51341 - DNA, 20 bp, Artificial Sequence
  Description of Artificial Sequence: Synthetic oligonucleotide
  Target: ATXN1; (-) strand; PAM type: NRG; PAM sequence: GGG
caagcataggttaaaactag

SEQ ID NO: 51342 - DNA, 20 bp, Artificial Sequence
  Description of Artificial Sequence: Synthetic oligonucleotide
  Target: ATXN1; (-) strand; PAM type: NRG; PAM sequence: GGG
ccaagcataggttaaaacta

SEQ ID NO: 51343 - DNA, 20 bp, Artificial Sequence
  Description of Artificial Sequence: Synthetic oligonucleotide
  Target: ATXN1; (-) strand; PAM type: NRG; PAM sequence: AGG
accaagcataggttaaaact

SEQ ID NO: 51344 - DNA, 20 bp, Artificial Sequence
  Description of Artificial Sequence: Synthetic oligonucleotide
  Target: ATXN1; (-) strand; PAM type: NRG; PAM sequence: TAG
gaccaagcataggttaaaac

SEQ ID NO: 51345 - DNA, 20 bp, Artificial Sequence
  Description of Artificial Sequence: Synthetic oligonucleotide
  Target: ATXN1; (-) strand; PAM type: NRG; PAM sequence: AGG
atgatatttggaccaagcat

SEQ ID NO: 51346 - DNA, 20 bp, Artificial Sequence
  Description of Artificial Sequence: Synthetic oligonucleotide
  Target: ATXN1; (-) strand; PAM type: NRG; PAM sequence: TAG
catgatatttggaccaagca

SEQ ID NO: 51347 - DNA, 20 bp, Artificial Sequence
  Description of Artificial Sequence: Synthetic oligonucleotide
  Target: ATXN1; (-) strand; PAM type: NRG; PAM sequence: AAG
agacccatgatatttggacc

SEQ ID NO: 51348 - DNA, 20 bp, Artificial Sequence
  Description of Artificial Sequence: Synthetic oligonucleotide
  Target: ATXN1; (-) strand; PAM type: NRG; PAM sequence: TGG
aaacatagacccatgatatt

SEQ ID NO: 51349 - DNA, 20 bp, Artificial Sequence
  Description of Artificial Sequence: Synthetic oligonucleotide
  Target: ATXN1; (-) strand; PAM type: NRG; PAM sequence: TAG
tgtcttagaccacagaaaca

SEQ ID NO: 51350 - DNA, 20 bp, Artificial Sequence
  Description of Artificial Sequence: Synthetic oligonucleotide
  Target: ATXN1; (-) strand; PAM type: NRG; PAM sequence: CAG
taaagaagtgtcttagacca

SEQ ID NO: 51351 - DNA, 20 bp, Artificial Sequence
  Description of Artificial Sequence: Synthetic oligonucleotide
  Target: ATXN1; (-) strand; PAM type: NRG; PAM sequence: TAG
cttatcttaaagaagtgtct

SEQ ID NO: 51352 - DNA, 20 bp, Artificial Sequence
  Description of Artificial Sequence: Synthetic oligonucleotide
  Target: ATXN1; (-) strand; PAM type: NRG; PAM sequence: AAG
gcatcgggcttatcttaaag

SEQ ID NO: 51353 - DNA, 20 bp, Artificial Sequence
  Description of Artificial Sequence: Synthetic oligonucleotide
  Target: ATXN1; (-) strand; PAM type: NRG; PAM sequence: AAG
taggcatcgggcttatctta

SEQ ID NO: 51354 - DNA, 20 bp, Artificial Sequence
  Description of Artificial Sequence: Synthetic oligonucleotide
  Target: ATXN1; (-) strand; PAM type: NRG; PAM sequence: GGG
ctagatgtgtgttaggcatc

SEQ ID NO: 51355 - DNA, 20 bp, Artificial Sequence
  Description of Artificial Sequence: Synthetic oligonucleotide
  Target: ATXN1; (-) strand; PAM type: NRG; PAM sequence: CGG
cctagatgtgtgttaggcat

SEQ ID NO: 51356 - DNA, 20 bp, Artificial Sequence
  Description of Artificial Sequence: Synthetic oligonucleotide
  Target: ATXN1; (-) strand; PAM type: NRG; PAM sequence: AGG
cttactcctagatgtgtgtt

SEQ ID NO: 51357 - DNA, 20 bp, Artificial Sequence
  Description of Artificial Sequence: Synthetic oligonucleotide
  Target: ATXN1; (-) strand; PAM type: NRG; PAM sequence: TAG
acttactcctagatgtgtgt

SEQ ID NO: 51358 - DNA, 20 bp, Artificial Sequence
  Description of Artificial Sequence: Synthetic oligonucleotide
  Target: ATXN1; (-) strand; PAM type: NRG; PAM sequence: TAG
cagaattgttaacttactcc

SEQ ID NO: 51359 - DNA, 20 bp, Artificial Sequence
  Description of Artificial Sequence: Synthetic oligonucleotide
  Target: ATXN1; (-) strand; PAM type: NRG; PAM sequence: CAG
agccaaagaaaccagtattt

SEQ ID NO: 51360 - DNA, 20 bp, Artificial Sequence
  Description of Artificial Sequence: Synthetic oligonucleotide
  Target: ATXN1; (-) strand; PAM type: NRG; PAM sequence: CAG
ggtctaaaagccaaagaaac

SEQ ID NO: 51361 - DNA, 20 bp, Artificial Sequence
  Description of Artificial Sequence: Synthetic oligonucleotide
  Target: ATXN1; (-) strand; PAM type: NRG; PAM sequence: AAG
atcaacaggtctaaaagcca

SEQ ID NO: 51362 - DNA, 20 bp, Artificial Sequence
  Description of Artificial Sequence: Synthetic oligonucleotide
  Target: ATXN1; (-) strand; PAM type: NRG; PAM sequence: AAG
aaaacaatcaacaggtctaa

SEQ ID NO: 51363 - DNA, 20 bp, Artificial Sequence
  Description of Artificial Sequence: Synthetic oligonucleotide
  Target: ATXN1; (-) strand; PAM type: NRG; PAM sequence: AGG
ttataaccaaaacaatcaac

SEQ ID NO: 51364 - DNA, 20 bp, Artificial Sequence
  Description of Artificial Sequence: Synthetic oligonucleotide
  Target: ATXN1; (-) strand; PAM type: NRG; PAM sequence: CAG
tttataaccaaaacaatcaa

SEQ ID NO: 51365 - DNA, 20 bp, Artificial Sequence
  Description of Artificial Sequence: Synthetic oligonucleotide
  Target: ATXN1; (-) strand; PAM type: NRG; PAM sequence: CAG
agaaggaaaaatgttaaagg

SEQ ID NO: 51366 - DNA, 20 bp, Artificial Sequence
  Description of Artificial Sequence: Synthetic oligonucleotide
  Target: ATXN1; (-) strand; PAM type: NRG; PAM sequence: AGG
cacagaaggaaaaatgttaa

SEQ ID NO: 51367 - DNA, 20 bp, Artificial Sequence
  Description of Artificial Sequence: Synthetic oligonucleotide
  Target: ATXN1; (-) strand; PAM type: NRG; PAM sequence: AAG
acacagaaggaaaaatgtta

SEQ ID NO: 51368 - DNA, 20 bp, Artificial Sequence
  Description of Artificial Sequence: Synthetic oligonucleotide
  Target: ATXN1; (-) strand; PAM type: NRG; PAM sequence: AGG
ggcctagttaggaacacaga

SEQ ID NO: 51369 - DNA, 20 bp, Artificial Sequence
  Description of Artificial Sequence: Synthetic oligonucleotide
  Target: ATXN1; (-) strand; PAM type: NRG; PAM sequence: AAG
aggcctagttaggaacacag

SEQ ID NO: 51370 - DNA, 20 bp, Artificial Sequence
  Description of Artificial Sequence: Synthetic oligonucleotide
  Target: ATXN1; (-) strand; PAM type: NRG; PAM sequence: CAG
cagaggcctagttaggaaca

SEQ ID NO: 51371 - DNA, 20 bp, Artificial Sequence
  Description of Artificial Sequence: Synthetic oligonucleotide
  Target: ATXN1; (-) strand; PAM type: NRG; PAM sequence: AGG
ggagactcagaggcctagtt

SEQ ID NO: 51372 - DNA, 20 bp, Artificial Sequence
  Description of Artificial Sequence: Synthetic oligonucleotide
  Target: ATXN1; (-) strand; PAM type: NRG; PAM sequence: TAG
tggagactcagaggcctagt

SEQ ID NO: 51373 - DNA, 20 bp, Artificial Sequence
  Description of Artificial Sequence: Synthetic oligonucleotide
  Target: ATXN1; (-) strand; PAM type: NRG; PAM sequence: TAG
acagtggagactcagaggcc

SEQ ID NO: 51374 - DNA, 20 bp, Artificial Sequence
  Description of Artificial Sequence: Synthetic oligonucleotide
  Target: ATXN1; (-) strand; PAM type: NRG; PAM sequence: AGG
ttttgacagtggagactcag

SEQ ID NO: 51375 - DNA, 20 bp, Artificial Sequence
  Description of Artificial Sequence: Synthetic oligonucleotide
  Target: ATXN1; (-) strand; PAM type: NRG; PAM sequence: GAG
attttgacagtggagactca

SEQ ID NO: 51376 - DNA, 20 bp, Artificial Sequence
  Description of Artificial Sequence: Synthetic oligonucleotide
  Target: ATXN1; (-) strand; PAM type: NRG; PAM sequence: CAG
acattttgacagtggagact

SEQ ID NO: 51377 - DNA, 20 bp, Artificial Sequence
  Description of Artificial Sequence: Synthetic oligonucleotide
  Target: ATXN1; (-) strand; PAM type: NRG; PAM sequence: GAG
tcagccacattttgacagtg

SEQ ID NO: 51378 - DNA, 20 bp, Artificial Sequence
  Description of Artificial Sequence: Synthetic oligonucleotide
  Target: ATXN1; (-) strand; PAM type: NRG; PAM sequence: TGG
gatcagccacattttgacag

SEQ ID NO: 51379 - DNA, 20 bp, Artificial Sequence
  Description of Artificial Sequence: Synthetic oligonucleotide
  Target: ATXN1; (-) strand; PAM type: NRG; PAM sequence: CAG
tctgatcagccacattttga

SEQ ID NO: 51380 - DNA, 20 bp, Artificial Sequence
  Description of Artificial Sequence: Synthetic oligonucleotide
  Target: ATXN1; (-) strand; PAM type: NRG; PAM sequence: CAG
agggttgcctaaagtctgat

SEQ ID NO: 51381 - DNA, 20 bp, Artificial Sequence
  Description of Artificial Sequence: Synthetic oligonucleotide
  Target: ATXN1; (-) strand; PAM type: NRG; PAM sequence: AAG
gttgaggtgagggttgccta

SEQ ID NO: 51382 - DNA, 20 bp, Artificial Sequence
  Description of Artificial Sequence: Synthetic oligonucleotide
  Target: ATXN1; (-) strand; PAM type: NRG; PAM sequence: GGG
ataatcacaggttgaggtga

SEQ ID NO: 51383 - DNA, 20 bp, Artificial Sequence
  Description of Artificial Sequence: Synthetic oligonucleotide
  Target: ATXN1; (-) strand; PAM type: NRG; PAM sequence: AGG
cataatcacaggttgaggtg

SEQ ID NO: 51384 - DNA, 20 bp, Artificial Sequence
  Description of Artificial Sequence: Synthetic oligonucleotide
  Target: ATXN1; (-) strand; PAM type: NRG; PAM sequence: GAG
ccataatcacaggttgaggt

SEQ ID NO: 51385 - DNA, 20 bp, Artificial Sequence
  Description of Artificial Sequence: Synthetic oligonucleotide
  Target: ATXN1; (-) strand; PAM type: NRG; PAM sequence: AGG
ccttccataatcacaggttg

SEQ ID NO: 51386 - DNA, 20 bp, Artificial Sequence
  Description of Artificial Sequence: Synthetic oligonucleotide
  Target: ATXN1; (-) strand; PAM type: NRG; PAM sequence: GAG
tccttccataatcacaggtt

SEQ ID NO: 51387 - DNA, 20 bp, Artificial Sequence
  Description of Artificial Sequence: Synthetic oligonucleotide
  Target: ATXN1; (-) strand; PAM type: NRG; PAM sequence: AGG
gtacttccttccataatcac

SEQ ID NO: 51388 - DNA, 20 bp, Artificial Sequence
  Description of Artificial Sequence: Synthetic oligonucleotide
  Target: ATXN1; (-) strand; PAM type: NRG; PAM sequence: CAG
tgtacttccttccataatca

SEQ ID NO: 51389 - DNA, 20 bp, Artificial Sequence
  Description of Artificial Sequence: Synthetic oligonucleotide
  Target: ATXN1; (-) strand; PAM type: NRG; PAM sequence: AAG
cgtgaccgggaaggagtgtt

SEQ ID NO: 51390 - DNA, 20 bp, Artificial Sequence
  Description of Artificial Sequence: Synthetic oligonucleotide
  Target: ATXN1; (-) strand; PAM type: NRG; PAM sequence: GAG
tgatgcacgtgaccgggaag

SEQ ID NO: 51391 - DNA, 20 bp, Artificial Sequence
  Description of Artificial Sequence: Synthetic oligonucleotide
  Target: ATXN1; (-) strand; PAM type: NRG; PAM sequence: AGG
catgatgcacgtgaccggga

SEQ ID NO: 51392 - DNA, 20 bp, Artificial Sequence
  Description of Artificial Sequence: Synthetic oligonucleotide
  Target: ATXN1; (-) strand; PAM type: NRG; PAM sequence: AAG
tcatgatgcacgtgaccggg

SEQ ID NO: 51393 - DNA, 20 bp, Artificial Sequence
  Description of Artificial Sequence: Synthetic oligonucleotide
  Target: ATXN1; (-) strand; PAM type: NRG; PAM sequence: GGG
cattcatgatgcacgtgacc

SEQ ID NO: 51394 - DNA, 20 bp, Artificial Sequence
  Description of Artificial Sequence: Synthetic oligonucleotide
  Target: ATXN1; (-) strand; PAM type: NRG; PAM sequence: CGG
tcattcatgatgcacgtgac

SEQ ID NO: 51395 - DNA, 20 bp, Artificial Sequence
  Description of Artificial Sequence: Synthetic oligonucleotide
  Target: ATXN1; (-) strand; PAM type: NRG; PAM sequence: TAG
agaacaaaagattgaaattt

SEQ ID NO: 51396 - DNA, 20 bp, Artificial Sequence
  Description of Artificial Sequence: Synthetic oligonucleotide
  Target: ATXN1; (-) strand; PAM type: NRG; PAM sequence: AAG
aaatggccggtggagaacaa

SEQ ID NO: 51397 - DNA, 20 bp, Artificial Sequence
  Description of Artificial Sequence: Synthetic oligonucleotide
  Target: ATXN1; (-) strand; PAM type: NRG; PAM sequence: GAG
tcgggaaaaaatggccggtg

SEQ ID NO: 51398 - DNA, 20 bp, Artificial Sequence
  Description of Artificial Sequence: Synthetic oligonucleotide
  Target: ATXN1; (-) strand; PAM type: NRG; PAM sequence: TGG
gttcgggaaaaaatggccgg

SEQ ID NO: 51399 - DNA, 20 bp, Artificial Sequence
  Description of Artificial Sequence: Synthetic oligonucleotide
  Target: ATXN1; (-) strand; PAM type: NRG; PAM sequence: CGG
agggttcgggaaaaaatggc

SEQ ID NO: 51400 - DNA, 20 bp, Artificial Sequence
  Description of Artificial Sequence: Synthetic oligonucleotide
  Target: ATXN1; (-) strand; PAM type: NRG; PAM sequence: TGG
cttaagggttcgggaaaaaa

SEQ ID NO: 51401 - DNA, 20 bp, Artificial Sequence
  Description of Artificial Sequence: Synthetic oligonucleotide
  Target: ATXN1; (-) strand; PAM type: NRG; PAM sequence: GGG
ctatctatccttaagggttc

SEQ ID NO: 51402 - DNA, 20 bp, Artificial Sequence
  Description of Artificial Sequence: Synthetic oligonucleotide
  Target: ATXN1; (-) strand; PAM type: NRG; PAM sequence: CGG
gctatctatccttaagggtt

SEQ ID NO: 51403 - DNA, 20 bp, Artificial Sequence
  Description of Artificial Sequence: Synthetic oligonucleotide
  Target: ATXN1; (-) strand; PAM type: NRG; PAM sequence: GGG
ttctggctatctatccttaa

SEQ ID NO: 51404 - DNA, 20 bp, Artificial Sequence
  Description of Artificial Sequence: Synthetic oligonucleotide
  Target: ATXN1; (-) strand; PAM type: NRG; PAM sequence: AGG
tttctggctatctatcctta

SEQ ID NO: 51405 - DNA, 20 bp, Artificial Sequence
  Description of Artificial Sequence: Synthetic oligonucleotide
  Target: ATXN1; (-) strand; PAM type: NRG; PAM sequence: AAG
ttttctggctatctatcctt

SEQ ID NO: 51406 - DNA, 20 bp, Artificial Sequence
  Description of Artificial Sequence: Synthetic oligonucleotide
  Target: ATXN1; (-) strand; PAM type: NRG; PAM sequence: TGG
gatttatttatttatttttc

SEQ ID NO: 51407 - DNA, 20 bp, Artificial Sequence
  Description of Artificial Sequence: Synthetic oligonucleotide
  Target: ATXN1; (-) strand; PAM type: NRG; PAM sequence: GAG
ctagaaaatattcccaagaa

SEQ ID NO: 51408 - DNA, 20 bp, Artificial Sequence
  Description of Artificial Sequence: Synthetic oligonucleotide
  Target: ATXN1; (-) strand; PAM type: NRG; PAM sequence: AAG
ttctagaaaatattcccaag

SEQ ID NO: 51409 - DNA, 20 bp, Artificial Sequence
  Description of Artificial Sequence: Synthetic oligonucleotide
  Target: ATXN1; (-) strand; PAM type: NRG; PAM sequence: AAG
acattctagaaaatattccc

SEQ ID NO: 51410 - DNA, 20 bp, Artificial Sequence
  Description of Artificial Sequence: Synthetic oligonucleotide
  Target: ATXN1; (-) strand; PAM type: NRG; PAM sequence: TAG
attttaaaatgaaaacattc

SEQ ID NO: 51411 - DNA, 20 bp, Artificial Sequence
  Description of Artificial Sequence: Synthetic oligonucleotide
  Target: ATXN1; (-) strand; PAM type: NRG; PAM sequence: TGG
tatcagatgtcaattaacaa

SEQ ID NO: 51412 - DNA, 20 bp, Artificial Sequence
  Description of Artificial Sequence: Synthetic oligonucleotide
  Target: ATXN1; (-) strand; PAM type: NRG; PAM sequence: CAG
ccataaatataagaaattat

SEQ ID NO: 51413 - DNA, 20 bp, Artificial Sequence
  Description of Artificial Sequence: Synthetic oligonucleotide
  Target: ATXN1; (-) strand; PAM type: NRG; PAM sequence: AAG
atactctagcccataaatat

SEQ ID NO: 51414 - DNA, 20 bp, Artificial Sequence
  Description of Artificial Sequence: Synthetic oligonucleotide
  Target: ATXN1; (-) strand; PAM type: NRG; PAM sequence: TAG
tgtattgaaacatcatactc

SEQ ID NO: 51415 - DNA, 20 bp, Artificial Sequence
  Description of Artificial Sequence: Synthetic oligonucleotide
  Target: ATXN1; (-) strand; PAM type: NRG; PAM sequence: AAG
aaagaactgataaaggtttg

SEQ ID NO: 51416 - DNA, 20 bp, Artificial Sequence
  Description of Artificial Sequence: Synthetic oligonucleotide
  Target: ATXN1; (-) strand; PAM type: NRG; PAM sequence: AGG
tcataacaaagaactgataa

SEQ ID NO: 51417 - DNA, 20 bp, Artificial Sequence
  Description of Artificial Sequence: Synthetic oligonucleotide
  Target: ATXN1; (-) strand; PAM type: NRG; PAM sequence: AAG
ctcataacaaagaactgata

SEQ ID NO: 51418 - DNA, 20 bp, Artificial Sequence
  Description of Artificial Sequence: Synthetic oligonucleotide
  Target: ATXN1; (-) strand; PAM type: NRG; PAM sequence: AAG
atttgaatgttctcataaca

SEQ ID NO: 51419 - DNA, 20 bp, Artificial Sequence
  Description of Artificial Sequence: Synthetic oligonucleotide
  Target: ATXN1; (-) strand; PAM type: NRG; PAM sequence: AGG
actgcagaaaactagacaag

SEQ ID NO: 51420 - DNA, 20 bp, Artificial Sequence
  Description of Artificial Sequence: Synthetic oligonucleotide
  Target: ATXN1; (-) strand; PAM type: NRG; PAM sequence: GAG
gactgcagaaaactagacaa

SEQ ID NO: 51421 - DNA, 20 bp, Artificial Sequence
  Description of Artificial Sequence: Synthetic oligonucleotide
  Target: ATXN1; (-) strand; PAM type: NRG; PAM sequence: AAG
aagactgcagaaaactagac

SEQ ID NO: 51422 - DNA, 20 bp, Artificial Sequence
  Description of Artificial Sequence: Synthetic oligonucleotide
  Target: ATXN1; (-) strand; PAM type: NRG; PAM sequence: TAG
aagagaagactgcagaaaac

SEQ ID NO: 51423 - DNA, 20 bp, Artificial Sequence
  Description of Artificial Sequence: Synthetic oligonucleotide
  Target: ATXN1; (-) strand; PAM type: NRG; PAM sequence: CAG
tggtccttaagagaagactg

SEQ ID NO: 51424 - DNA, 20 bp, Artificial Sequence
  Description of Artificial Sequence: Synthetic oligonucleotide
  Target: ATXN1; (-) strand; PAM type: NRG; PAM sequence: AAG
tcttctttggtccttaagag

SEQ ID NO: 51425 - DNA, 20 bp, Artificial Sequence
  Description of Artificial Sequence: Synthetic oligonucleotide
  Target: ATXN1; (-) strand; PAM type: NRG; PAM sequence: GAG
ttttcttctttggtccttaa

SEQ ID NO: 51426 - DNA, 20 bp, Artificial Sequence
  Description of Artificial Sequence: Synthetic oligonucleotide
  Target: ATXN1; (-) strand; PAM type: NRG; PAM sequence: AAG
tattttcttctttggtcctt

SEQ ID NO: 51427 - DNA, 20 bp, Artificial Sequence
  Description of Artificial Sequence: Synthetic oligonucleotide
  Target: ATXN1; (-) strand; PAM type: NRG; PAM sequence: TGG
gggtcttttattttcttctt

SEQ ID NO: 51428 - DNA, 20 bp, Artificial Sequence
  Description of Artificial Sequence: Synthetic oligonucleotide
  Target: ATXN1; (-) strand; PAM type: NRG; PAM sequence: GGG
aaacagagctgaattttata

SEQ ID NO: 51429 - DNA, 20 bp, Artificial Sequence
  Description of Artificial Sequence: Synthetic oligonucleotide
  Target: ATXN1; (-) strand; PAM type: NRG; PAM sequence: AGG
taaacagagctgaattttat

SEQ ID NO: 51430 - DNA, 20 bp, Artificial Sequence
  Description of Artificial Sequence: Synthetic oligonucleotide
  Target: ATXN1; (-) strand; PAM type: NRG; PAM sequence: TAG
ttaaacagagctgaatttta

SEQ ID NO: 51431 - DNA, 20 bp, Artificial Sequence
  Description of Artificial Sequence: Synthetic oligonucleotide
  Target: ATXN1; (-) strand; PAM type: NRG; PAM sequence: GAG
taaaagataggacttaaaca

SEQ ID NO: 51432 - DNA, 20 bp, Artificial Sequence
  Description of Artificial Sequence: Synthetic oligonucleotide
  Target: ATXN1; (-) strand; PAM type: NRG; PAM sequence: CAG
cttaaaagataggacttaaa

SEQ ID NO: 51433 - DNA, 20 bp, Artificial Sequence
  Description of Artificial Sequence: Synthetic oligonucleotide
  Target: ATXN1; (-) strand; PAM type: NRG; PAM sequence: AGG
tttttagttacttaaaagat

SEQ ID NO: 51434 - DNA, 20 bp, Artificial Sequence
  Description of Artificial Sequence: Synthetic oligonucleotide
  Target: ATXN1; (-) strand; PAM type: NRG; PAM sequence: TAG
ctttttagttacttaaaaga

SEQ ID NO: 51435 - DNA, 20 bp, Artificial Sequence
  Description of Artificial Sequence: Synthetic oligonucleotide
  Target: ATXN1; (-) strand; PAM type: NRG; PAM sequence: AAG
tcaactttttagttacttaa

SEQ ID NO: 51436 - DNA, 20 bp, Artificial Sequence
  Description of Artificial Sequence: Synthetic oligonucleotide
  Target: ATXN1; (-) strand; PAM type: NRG; PAM sequence: TAG
ggagctagtattcaactttt

SEQ ID NO: 51437 - DNA, 20 bp, Artificial Sequence
  Description of Artificial Sequence: Synthetic oligonucleotide
  Target: ATXN1; (-) strand; PAM type: NRG; PAM sequence: TAG
atggatctagttattggagc

SEQ ID NO: 51438 - DNA, 20 bp, Artificial Sequence
  Description of Artificial Sequence: Synthetic oligonucleotide
  Target: ATXN1; (-) strand; PAM type: NRG; PAM sequence: GAG
gtttatggatctagttattg

SEQ ID NO: 51439 - DNA, 20 bp, Artificial Sequence
  Description of Artificial Sequence: Synthetic oligonucleotide
  Target: ATXN1; (-) strand; PAM type: NRG; PAM sequence: TGG
tggtttatggatctagttat

SEQ ID NO: 51440 - DNA, 20 bp, Artificial Sequence
  Description of Artificial Sequence: Synthetic oligonucleotide
  Target: ATXN1; (-) strand; PAM type: NRG; PAM sequence: TAG
tgaaaaatggtttatggatc

SEQ ID NO: 51441 - DNA, 20 bp, Artificial Sequence
  Description of Artificial Sequence: Synthetic oligonucleotide
  Target: ATXN1; (-) strand; PAM type: NRG; PAM sequence: TGG
tagtattgaaaaatggttta

SEQ ID NO: 51442 - DNA, 20 bp, Artificial Sequence
  Description of Artificial Sequence: Synthetic oligonucleotide
  Target: ATXN1; (-) strand; PAM type: NRG; PAM sequence: TGG
agaaaattagtattgaaaaa

SEQ ID NO: 51443 - DNA, 20 bp, Artificial Sequence
  Description of Artificial Sequence: Synthetic oligonucleotide
  Target: ATXN1; (-) strand; PAM type: NRG; PAM sequence: TAG
atctctttggctaagaaaat

SEQ ID NO: 51444 - DNA, 20 bp, Artificial Sequence
  Description of Artificial Sequence: Synthetic oligonucleotide
  Target: ATXN1; (-) strand; PAM type: NRG; PAM sequence: AAG
tactgcatatctctttggct

SEQ ID NO: 51445 - DNA, 20 bp, Artificial Sequence
  Description of Artificial Sequence: Synthetic oligonucleotide
  Target: ATXN1; (-) strand; PAM type: NRG; PAM sequence: TGG
ttctctactgcatatctctt

SEQ ID NO: 51446 - DNA, 20 bp, Artificial Sequence
  Description of Artificial Sequence: Synthetic oligonucleotide
  Target: ATXN1; (-) strand; PAM type: NRG; PAM sequence: TGG
ttggactggctgtctactct

SEQ ID NO: 51447 - DNA, 20 bp, Artificial Sequence
  Description of Artificial Sequence: Synthetic oligonucleotide
  Target: ATXN1; (-) strand; PAM type: NRG; PAM sequence: TGG
tatttctgtggactttggac

SEQ ID NO: 51448 - DNA, 20 bp, Artificial Sequence
  Description of Artificial Sequence: Synthetic oligonucleotide
  Target: ATXN1; (-) strand; PAM type: NRG; PAM sequence: TGG
atttttatttctgtggactt

SEQ ID NO: 51449 - DNA, 20 bp, Artificial Sequence
  Description of Artificial Sequence: Synthetic oligonucleotide
  Target: ATXN1; (-) strand; PAM type: NRG; PAM sequence: TGG
taaatggatttttatttctg

SEQ ID NO: 51450 - DNA, 20 bp, Artificial Sequence
  Description of Artificial Sequence: Synthetic oligonucleotide
  Target: ATXN1; (-) strand; PAM type: NRG; PAM sequence: TGG
gtggaaaatgcagtcataaa

SEQ ID NO: 51451 - DNA, 20 bp, Artificial Sequence
  Description of Artificial Sequence: Synthetic oligonucleotide
  Target: ATXN1; (-) strand; PAM type: NRG; PAM sequence: CAG
gaaagccagcgtggaaaatg

SEQ ID NO: 51452 - DNA, 20 bp, Artificial Sequence
  Description of Artificial Sequence: Synthetic oligonucleotide
  Target: ATXN1; (-) strand; PAM type: NRG; PAM sequence: TGG
accatcctggaaagccagcg

SEQ ID NO: 51453 - DNA, 20 bp, Artificial Sequence
  Description of Artificial Sequence: Synthetic oligonucleotide
  Target: ATXN1; (-) strand; PAM type: NRG; PAM sequence: CAG
tcaggaccatcctggaaagc

SEQ ID NO: 51454 - DNA, 20 bp, Artificial Sequence
  Description of Artificial Sequence: Synthetic oligonucleotide
  Target: ATXN1; (-) strand; PAM type: NRG; PAM sequence: AAG
aagttcaggaccatcctgga

SEQ ID NO: 51455 - DNA, 20 bp, Artificial Sequence
  Description of Artificial Sequence: Synthetic oligonucleotide
  Target: ATXN1; (-) strand; PAM type: NRG; PAM sequence: TGG
tagcaagttcaggaccatcc

SEQ ID NO: 51456 - DNA, 20 bp, Artificial Sequence
  Description of Artificial Sequence: Synthetic oligonucleotide
  Target: ATXN1; (-) strand; PAM type: NRG; PAM sequence: AGG
taccatgaattagcaagttc

SEQ ID NO: 51457 - DNA, 20 bp, Artificial Sequence
  Description of Artificial Sequence: Synthetic oligonucleotide
  Target: ATXN1; (-) strand; PAM type: NRG; PAM sequence: CAG
ataccatgaattagcaagtt

SEQ ID NO: 51458 - DNA, 20 bp, Artificial Sequence
  Description of Artificial Sequence: Synthetic oligonucleotide
  Target: ATXN1; (-) strand; PAM type: NRG; PAM sequence: AAG
aagttataccatgaattagc

SEQ ID NO: 51459 - DNA, 20 bp, Artificial Sequence
  Description of Artificial Sequence: Synthetic oligonucleotide
  Target: ATXN1; (-) strand; PAM type: NRG; PAM sequence: TAG
tacaaagttataccatgaat

SEQ ID NO: 51460 - DNA, 20 bp, Artificial Sequence
  Description of Artificial Sequence: Synthetic oligonucleotide
  Target: ATXN1; (-) strand; PAM type: NRG; PAM sequence: AAG
cttggctgtgttacagtaca

SEQ ID NO: 51461 - DNA, 20 bp, Artificial Sequence
  Description of Artificial Sequence: Synthetic oligonucleotide
  Target: ATXN1; (-) strand; PAM type: NRG; PAM sequence: CAG
gtttctccttggctgtgtta

SEQ ID NO: 51462 - DNA, 20 bp, Artificial Sequence
  Description of Artificial Sequence: Synthetic oligonucleotide
  Target: ATXN1; (-) strand; PAM type: NRG; PAM sequence: TGG
aacatgctactgtttctcct

SEQ ID NO: 51463 - DNA, 20 bp, Artificial Sequence
  Description of Artificial Sequence: Synthetic oligonucleotide
  Target: ATXN1; (-) strand; PAM type: NRG; PAM sequence: TGG
actgttagctctcacagacc

SEQ ID NO: 51464 - DNA, 20 bp, Artificial Sequence
  Description of Artificial Sequence: Synthetic oligonucleotide
  Target: ATXN1; (-) strand; PAM type: NRG; PAM sequence: CAG
agcttaactgttagctctca

SEQ ID NO: 51465 - DNA, 20 bp, Artificial Sequence
  Description of Artificial Sequence: Synthetic oligonucleotide
  Target: ATXN1; (-) strand; PAM type: NRG; PAM sequence: TAG
tggctgtcaagcttaactgt

SEQ ID NO: 51466 - DNA, 20 bp, Artificial Sequence
  Description of Artificial Sequence: Synthetic oligonucleotide
  Target: ATXN1; (-) strand; PAM type: NRG; PAM sequence: AAG
atgttgaacgcttggctgtc

SEQ ID NO: 51467 - DNA, 20 bp, Artificial Sequence
  Description of Artificial Sequence: Synthetic oligonucleotide
  Target: ATXN1; (-) strand; PAM type: NRG; PAM sequence: TGG
cattggctatgttgaacgct

SEQ ID NO: 51468 - DNA, 20 bp, Artificial Sequence
  Description of Artificial Sequence: Synthetic oligonucleotide
  Target: ATXN1; (-) strand; PAM type: NRG; PAM sequence: TGG
tataagttaatttttaacat

SEQ ID NO: 51469 - DNA, 20 bp, Artificial Sequence
  Description of Artificial Sequence: Synthetic oligonucleotide
  Target: ATXN1; (-) strand; PAM type: NRG; PAM sequence: AAG
attaaaccataagtttatat

SEQ ID NO: 51470 - DNA, 20 bp, Artificial Sequence
  Description of Artificial Sequence: Synthetic oligonucleotide
  Target: ATXN1; (-) strand; PAM type: NRG; PAM sequence: AAG
aatataatttattaaaccat

SEQ ID NO: 51471 - DNA, 20 bp, Artificial Sequence
  Description of Artificial Sequence: Synthetic oligonucleotide
  Target: ATXN1; (-) strand; PAM type: NRG; PAM sequence: GAG
ggtgatccgcctcgcctcag

SEQ ID NO: 51472 - DNA, 20 bp, Artificial Sequence
  Description of Artificial Sequence: Synthetic oligonucleotide
  Target: ATXN1; (-) strand; PAM type: NRG; PAM sequence: AGG
cgggtgatccgcctcgcctc

SEQ ID NO: 51473 - DNA, 20 bp, Artificial Sequence
  Description of Artificial Sequence: Synthetic oligonucleotide
  Target: ATXN1; (-) strand; PAM type: NRG; PAM sequence: CAG
tcgggtgatccgcctcgcct

SEQ ID NO: 51474 - DNA, 20 bp, Artificial Sequence
  Description of Artificial Sequence: Synthetic oligonucleotide
  Target: ATXN1; (-) strand; PAM type: NRG; PAM sequence: GGG
gtctcgaactccccgatctc

SEQ ID NO: 51475 - DNA, 20 bp, Artificial Sequence
  Description of Artificial Sequence: Synthetic oligonucleotide
  Target: ATXN1; (-) strand; PAM type: NRG; PAM sequence: CGG
ggtctcgaactccccgatct

SEQ ID NO: 51476 - DNA, 20 bp, Artificial Sequence
  Description of Artificial Sequence: Synthetic oligonucleotide
  Target: ATXN1; (-) strand; PAM type: NRG; PAM sequence: TGG
tttctccatgttggtccgac

SEQ ID NO: 51477 - DNA, 20 bp, Artificial Sequence
  Description of Artificial Sequence: Synthetic oligonucleotide
  Target: ATXN1; (-) strand; PAM type: NRG; PAM sequence: TGG
gagacgggatttctccatgt

SEQ ID NO: 51478 - DNA, 20 bp, Artificial Sequence
  Description of Artificial Sequence: Synthetic oligonucleotide
  Target: ATXN1; (-) strand; PAM type: NRG; PAM sequence: GGG
tttgtatttttagtagagac

SEQ ID NO: 51479 - DNA, 20 bp, Artificial Sequence
  Description of Artificial Sequence: Synthetic oligonucleotide
  Target: ATXN1; (-) strand; PAM type: NRG; PAM sequence: CGG
ttttgtatttttagtagaga

SEQ ID NO: 51480 - DNA, 20 bp, Artificial Sequence
  Description of Artificial Sequence: Synthetic oligonucleotide
  Target: ATXN1; (-) strand; PAM type: NRG; PAM sequence: GAG
ctaattttgtatttttagta

SEQ ID NO: 51481 - DNA, 20 bp, Artificial Sequence
  Description of Artificial Sequence: Synthetic oligonucleotide
  Target: ATXN1; (-) strand; PAM type: NRG; PAM sequence: TAG
agctaattttgtatttttag

SEQ ID NO: 51482 - DNA, 20 bp, Artificial Sequence
  Description of Artificial Sequence: Synthetic oligonucleotide
  Target: ATXN1; (-) strand; PAM type: NRG; PAM sequence: TAG
cccagctaattttgtatttt

SEQ ID NO: 51483 - DNA, 20 bp, Artificial Sequence
  Description of Artificial Sequence: Synthetic oligonucleotide
  Target: ATXN1; (-) strand; PAM type: NRG; PAM sequence: CAG
caggcatgagccaccatgcc

SEQ ID NO: 51484 - DNA, 20 bp, Artificial Sequence
  Description of Artificial Sequence: Synthetic oligonucleotide
  Target: ATXN1; (-) strand; PAM type: NRG; PAM sequence: GAG
agtagtgtgattacaggcat

SEQ ID NO: 51485 - DNA, 20 bp, Artificial Sequence
  Description of Artificial Sequence: Synthetic oligonucleotide
  Target: ATXN1; (-) strand; PAM type: NRG; PAM sequence: AGG
ctcctgagtagtgtgattac

SEQ ID NO: 51486 - DNA, 20 bp, Artificial Sequence
  Description of Artificial Sequence: Synthetic oligonucleotide
  Target: ATXN1; (-) strand; PAM type: NRG; PAM sequence: CAG
cctcctgagtagtgtgatta

SEQ ID NO: 51487 - DNA, 20 bp, Artificial Sequence
  Description of Artificial Sequence: Synthetic oligonucleotide
  Target: ATXN1; (-) strand; PAM type: NRG; PAM sequence: TAG
tcctgcctcagcctcctgag

SEQ ID NO: 51488 - DNA, 20 bp, Artificial Sequence
  Description of Artificial Sequence: Synthetic oligonucleotide
  Target: ATXN1; (-) strand; PAM type: NRG; PAM sequence: GAG
ttctcctgcctcagcctcct

SEQ ID NO: 51489 - DNA, 20 bp, Artificial Sequence
  Description of Artificial Sequence: Synthetic oligonucleotide
  Target: ATXN1; (-) strand; PAM type: NRG; PAM sequence: CAG
ttcaagtgattctcctgcct

SEQ ID NO: 51490 - DNA, 20 bp, Artificial Sequence
  Description of Artificial Sequence: Synthetic oligonucleotide
  Target: ATXN1; (-) strand; PAM type: NRG; PAM sequence: AAG
aacctccacctcccgggttc

SEQ ID NO: 51491 - DNA, 20 bp, Artificial Sequence
  Description of Artificial Sequence: Synthetic oligonucleotide
  Target: ATXN1; (-) strand; PAM type: NRG; PAM sequence: GGG
caccgcaacctccacctccc

SEQ ID NO: 51492 - DNA, 20 bp, Artificial Sequence
  Description of Artificial Sequence: Synthetic oligonucleotide
  Target: ATXN1; (-) strand; PAM type: NRG; PAM sequence: CGG
tcaccgcaacctccacctcc

SEQ ID NO: 51493 - DNA, 20 bp, Artificial Sequence
  Description of Artificial Sequence: Synthetic oligonucleotide
  Target: ATXN1; (-) strand; PAM type: NRG; PAM sequence: TGG
ggaatgcaatggcgcaatct

SEQ ID NO: 51494 - DNA, 20 bp, Artificial Sequence
  Description of Artificial Sequence: Synthetic oligonucleotide
  Target: ATXN1; (-) strand; PAM type: NRG; PAM sequence: TGG
ttggccaggctggaatgcaa

SEQ ID NO: 51495 - DNA, 20 bp, Artificial Sequence
  Description of Artificial Sequence: Synthetic oligonucleotide
  Target: ATXN1; (-) strand; PAM type: NRG; PAM sequence: TGG
ttcgctcttgttggccaggc

SEQ ID NO: 51496 - DNA, 20 bp, Artificial Sequence
  Description of Artificial Sequence: Synthetic oligonucleotide
  Target: ATXN1; (-) strand; PAM type: NRG; PAM sequence: AGG
gagtttcgctcttgttggcc

SEQ ID NO: 51497 - DNA, 20 bp, Artificial Sequence
  Description of Artificial Sequence: Synthetic oligonucleotide
  Target: ATXN1; (-) strand; PAM type: NRG; PAM sequence: CAG
ggagtttcgctcttgttggc

SEQ ID NO: 51498 - DNA, 20 bp, Artificial Sequence
  Description of Artificial Sequence: Synthetic oligonucleotide
  Target: ATXN1; (-) strand; PAM type: NRG; PAM sequence: TGG
agacggagtttcgctcttgt

SEQ ID NO: 51499 - DNA, 20 bp, Artificial Sequence
  Description of Artificial Sequence: Synthetic oligonucleotide
  Target: ATXN1; (-) strand; PAM type: NRG; PAM sequence: GAG
ttttttttttttttgagacg

SEQ ID NO: 51500 - DNA, 20 bp, Artificial Sequence
  Description of Artificial Sequence: Synthetic oligonucleotide
  Target: ATXN1; (-) strand; PAM type: NRG; PAM sequence: CGG
ttttttttttttttttgaga

SEQ ID NO: 51501 - DNA, 20 bp, Artificial Sequence
  Description of Artificial Sequence: Synthetic oligonucleotide
  Target: ATXN1; (-) strand; PAM type: NRG; PAM sequence: GAG
tttttttttttttttttttt

SEQ ID NO: 51502 - DNA, 20 bp, Artificial Sequence
  Description of Artificial Sequence: Synthetic oligonucleotide
  Target: ATXN1; (-) strand; PAM type: NRG; PAM sequence: GAG
gtaaaatgagggatgatgat

SEQ ID NO: 51503 - DNA, 20 bp, Artificial Sequence
  Description of Artificial Sequence: Synthetic oligonucleotide
  Target: ATXN1; (-) strand; PAM type: NRG; PAM sequence: GGG
agtaaaatagagtaaaatga

SEQ ID NO: 51504 - DNA, 20 bp, Artificial Sequence
  Description of Artificial Sequence: Synthetic oligonucleotide
  Target: ATXN1; (-) strand; PAM type: NRG; PAM sequence: AGG
tagtaaaatagagtaaaatg

SEQ ID NO: 51505 - DNA, 20 bp, Artificial Sequence
  Description of Artificial Sequence: Synthetic oligonucleotide
  Target: ATXN1; (-) strand; PAM type: NRG; PAM sequence: GAG
atagtaaaatagagtaaaat

SEQ ID NO: 51506 - DNA, 20 bp, Artificial Sequence
  Description of Artificial Sequence: Synthetic oligonucleotide
  Target: ATXN1; (-) strand; PAM type: NRG; PAM sequence: GAG
atacagataatagtaaaata

SEQ ID NO: 51507 - DNA, 20 bp, Artificial Sequence
  Description of Artificial Sequence: Synthetic oligonucleotide
  Target: ATXN1; (-) strand; PAM type: NRG; PAM sequence: TAG
tcatacagataatagtaaaa

SEQ ID NO: 51508 - DNA, 20 bp, Artificial Sequence
  Description of Artificial Sequence: Synthetic oligonucleotide
  Target: ATXN1; (-) strand; PAM type: NRG; PAM sequence: TAG
aacctcagtcatacagataa

SEQ ID NO: 51509 - DNA, 20 bp, Artificial Sequence
  Description of Artificial Sequence: Synthetic oligonucleotide
  Target: ATXN1; (-) strand; PAM type: NRG; PAM sequence: CAG
tgtaattaacctcagtcata

SEQ ID NO: 51510 - DNA, 20 bp, Artificial Sequence
  Description of Artificial Sequence: Synthetic oligonucleotide
  Target: ATXN1; (-) strand; PAM type: NRG; PAM sequence: CAG
caagtagatgtaattaacct

SEQ ID NO: 51511 - DNA, 20 bp, Artificial Sequence
  Description of Artificial Sequence: Synthetic oligonucleotide
  Target: ATXN1; (-) strand; PAM type: NRG; PAM sequence: TAG
ctttatatccactatacaag

SEQ ID NO: 51512 - DNA, 20 bp, Artificial Sequence
  Description of Artificial Sequence: Synthetic oligonucleotide
  Target: ATXN1; (-) strand; PAM type: NRG; PAM sequence: AAG
tgactttatatccactatac

SEQ ID NO: 51513 - DNA, 20 bp, Artificial Sequence
  Description of Artificial Sequence: Synthetic oligonucleotide
  Target: ATXN1; (-) strand; PAM type: NRG; PAM sequence: TGG
ctgacccaaatgttgttatg

SEQ ID NO: 51514 - DNA, 20 bp, Artificial Sequence
  Description of Artificial Sequence: Synthetic oligonucleotide
  Target: ATXN1; (-) strand; PAM type: NRG; PAM sequence: CGG
gctgtcacatatgcaatccg

SEQ ID NO: 51515 - DNA, 20 bp, Artificial Sequence
  Description of Artificial Sequence: Synthetic oligonucleotide
  Target: ATXN1; (-) strand; PAM type: NRG; PAM sequence: CAG
agtaggcagtagaaaatttt

SEQ ID NO: 51516 - DNA, 20 bp, Artificial Sequence
  Description of Artificial Sequence: Synthetic oligonucleotide
  Target: ATXN1; (-) strand; PAM type: NRG; PAM sequence: TAG
gctacagcatcagtaggcag

SEQ ID NO: 51517 - DNA, 20 bp, Artificial Sequence
  Description of Artificial Sequence: Synthetic oligonucleotide
  Target: ATXN1; (-) strand; PAM type: NRG; PAM sequence: CAG
acagctacagcatcagtagg

SEQ ID NO: 51518 - DNA, 20 bp, Artificial Sequence
  Description of Artificial Sequence: Synthetic oligonucleotide
  Target: ATXN1; (-) strand; PAM type: NRG; PAM sequence: AGG
tggacagctacagcatcagt

SEQ ID NO: 51519 - DNA, 20 bp, Artificial Sequence
  Description of Artificial Sequence: Synthetic oligonucleotide
  Target: ATXN1; (-) strand; PAM type: NRG; PAM sequence: TAG
ttggacagctacagcatcag

SEQ ID NO: 51520 - DNA, 20 bp, Artificial Sequence
  Description of Artificial Sequence: Synthetic oligonucleotide
  Target: ATXN1; (-) strand; PAM type: NRG; PAM sequence: CAG
acattggacagctacagcat

SEQ ID NO: 51521 - DNA, 20 bp, Artificial Sequence
  Description of Artificial Sequence: Synthetic oligonucleotide
  Target: ATXN1; (-) strand; PAM type: NRG; PAM sequence: CAG
actattacattggacagcta

SEQ ID NO: 51522 - DNA, 20 bp, Artificial Sequence
  Description of Artificial Sequence: Synthetic oligonucleotide
  Target: ATXN1; (-) strand; PAM type: NRG; PAM sequence: CAG
tattacactattacattgga

SEQ ID NO: 51523 - DNA, 20 bp, Artificial Sequence
  Description of Artificial Sequence: Synthetic oligonucleotide
  Target: ATXN1; (-) strand; PAM type: NRG; PAM sequence: TGG
aatgtattacactattacat

SEQ ID NO: 51524 - DNA, 20 bp, Artificial Sequence
  Description of Artificial Sequence: Synthetic oligonucleotide
  Target: ATXN1; (-) strand; PAM type: NRG; PAM sequence: GAG
cagcatcaccacaaacatat

SEQ ID NO: 51525 - DNA, 20 bp, Artificial Sequence
  Description of Artificial Sequence: Synthetic oligonucleotide
  Target: ATXN1; (-) strand; PAM type: NRG; PAM sequence: CAG
tgcaggacgtttatatatac

SEQ ID NO: 51526 - DNA, 20 bp, Artificial Sequence
  Description of Artificial Sequence: Synthetic oligonucleotide
  Target: ATXN1; (-) strand; PAM type: NRG; PAM sequence: AGG
ttttataggactggcactgc

SEQ ID NO: 51527 - DNA, 20 bp, Artificial Sequence
  Description of Artificial Sequence: Synthetic oligonucleotide
  Target: ATXN1; (-) strand; PAM type: NRG; PAM sequence: CAG
cttttataggactggcactg

SEQ ID NO: 51528 - DNA, 20 bp, Artificial Sequence
  Description of Artificial Sequence: Synthetic oligonucleotide
  Target: ATXN1; (-) strand; PAM type: NRG; PAM sequence: TGG
gtgctatacttttataggac

SEQ ID NO: 51529 - DNA, 20 bp, Artificial Sequence
  Description of Artificial Sequence: Synthetic oligonucleotide
  Target: ATXN1; (-) strand; PAM type: NRG; PAM sequence: AGG
tgcatgtgctatacttttat

SEQ ID NO: 51530 - DNA, 20 bp, Artificial Sequence
  Description of Artificial Sequence: Synthetic oligonucleotide
  Target: ATXN1; (-) strand; PAM type: NRG; PAM sequence: TAG
ttgcatgtgctatactttta

SEQ ID NO: 51531 - DNA, 20 bp, Artificial Sequence
  Description of Artificial Sequence: Synthetic oligonucleotide
  Target: ATXN1; (-) strand; PAM type: NRG; PAM sequence: TAG
aaatacacaaaccagtaaca

SEQ ID NO: 51532 - DNA, 20 bp, Artificial Sequence
  Description of Artificial Sequence: Synthetic oligonucleotide
  Target: ATXN1; (-) strand; PAM type: NRG; PAM sequence: CAG
agtatcgtaaatacacaaac

SEQ ID NO: 51533 - DNA, 20 bp, Artificial Sequence
  Description of Artificial Sequence: Synthetic oligonucleotide
  Target: ATXN1; (-) strand; PAM type: NRG; PAM sequence: TAG
tcaaataacaataaaaagta

SEQ ID NO: 51534 - DNA, 20 bp, Artificial Sequence
  Description of Artificial Sequence: Synthetic oligonucleotide
  Target: ATXN1; (-) strand; PAM type: NRG; PAM sequence: AAG
cactctcaaataacaataaa

SEQ ID NO: 51535 - DNA, 20 bp, Artificial Sequence
  Description of Artificial Sequence: Synthetic oligonucleotide
  Target: ATXN1; (-) strand; PAM type: NRG; PAM sequence: GAG
taatttcttataggtagaaa

SEQ ID NO: 51536 - DNA, 20 bp, Artificial Sequence
  Description of Artificial Sequence: Synthetic oligonucleotide
  Target: ATXN1; (-) strand; PAM type: NRG; PAM sequence: AAG
gttaatttcttataggtaga

SEQ ID NO: 51537 - DNA, 20 bp, Artificial Sequence
  Description of Artificial Sequence: Synthetic oligonucleotide
  Target: ATXN1; (-) strand; PAM type: NRG; PAM sequence: TAG
tacagttaatttcttatagg

SEQ ID NO: 51538 - DNA, 20 bp, Artificial Sequence
  Description of Artificial Sequence: Synthetic oligonucleotide
  Target: ATXN1; (-) strand; PAM type: NRG; PAM sequence: AGG
gcctacagttaatttcttat

SEQ ID NO: 51539 - DNA, 20 bp, Artificial Sequence
  Description of Artificial Sequence: Synthetic oligonucleotide
  Target: ATXN1; (-) strand; PAM type: NRG; PAM sequence: TAG
ggcctacagttaatttctta

SEQ ID NO: 51540 - DNA, 20 bp, Artificial Sequence
  Description of Artificial Sequence: Synthetic oligonucleotide
  Target: ATXN1; (-) strand; PAM type: NRG; PAM sequence: CAG
gagccactgcgcccggccta

SEQ ID NO: 51541 - DNA, 20 bp, Artificial Sequence
  Description of Artificial Sequence: Synthetic oligonucleotide
  Target: ATXN1; (-) strand; PAM type: NRG; PAM sequence: CGG
caggcatgagccactgcgcc

SEQ ID NO: 51542 - DNA, 20 bp, Artificial Sequence
  Description of Artificial Sequence: Synthetic oligonucleotide
  Target: ATXN1; (-) strand; PAM type: NRG; PAM sequence: GAG
agtgctgggattacaggcat

SEQ ID NO: 51543 - DNA, 20 bp, Artificial Sequence
  Description of Artificial Sequence: Synthetic oligonucleotide
  Target: ATXN1; (-) strand; PAM type: NRG; PAM sequence: AGG
tcccaaagtgctgggattac

SEQ ID NO: 51544 - DNA, 20 bp, Artificial Sequence
  Description of Artificial Sequence: Synthetic oligonucleotide
  Target: ATXN1; (-) strand; PAM type: NRG; PAM sequence: CAG
ctcccaaagtgctgggatta

SEQ ID NO: 51545 - DNA, 20 bp, Artificial Sequence
  Description of Artificial Sequence: Synthetic oligonucleotide
  Target: ATXN1; (-) strand; PAM type: NRG; PAM sequence: GGG
ccttggcctcccaaagtgct

SEQ ID NO: 51546 - DNA, 20 bp, Artificial Sequence
  Description of Artificial Sequence: Synthetic oligonucleotide
  Target: ATXN1; (-) strand; PAM type: NRG; PAM sequence: TGG
accttggcctcccaaagtgc

SEQ ID NO: 51547 - DNA, 20 bp, Artificial Sequence
  Description of Artificial Sequence: Synthetic oligonucleotide
  Target: ATXN1; (-) strand; PAM type: NRG; PAM sequence: AAG
ctgcccaccttggcctccca

SEQ ID NO: 51548 - DNA, 20 bp, Artificial Sequence
  Description of Artificial Sequence: Synthetic oligonucleotide
  Target: ATXN1; (-) strand; PAM type: NRG; PAM sequence: TGG
acctcgtgatctgcccacct

SEQ ID NO: 51549 - DNA, 20 bp, Artificial Sequence
  Description of Artificial Sequence: Synthetic oligonucleotide
  Target: ATXN1; (-) strand; PAM type: NRG; PAM sequence: TGG
tttcaccatgttggccagga

SEQ ID NO: 51550 - DNA, 20 bp, Artificial Sequence
  Description of Artificial Sequence: Synthetic oligonucleotide
  Target: ATXN1; (-) strand; PAM type: NRG; PAM sequence: AGG
tgggtttcaccatgttggcc

SEQ ID NO: 51551 - DNA, 20 bp, Artificial Sequence
  Description of Artificial Sequence: Synthetic oligonucleotide
  Target: ATXN1; (-) strand; PAM type: NRG; PAM sequence: CAG
atgggtttcaccatgttggc

SEQ ID NO: 51552 - DNA, 20 bp, Artificial Sequence
  Description of Artificial Sequence: Synthetic oligonucleotide
  Target: ATXN1; (-) strand; PAM type: NRG; PAM sequence: TGG
agagatgggtttcaccatgt

SEQ ID NO: 51553 - DNA, 20 bp, Artificial Sequence
  Description of Artificial Sequence: Synthetic oligonucleotide
  Target: ATXN1; (-) strand; PAM type: NRG; PAM sequence: GGG
tttgtatttttagtagagat

SEQ ID NO: 51554 - DNA, 20 bp, Artificial Sequence
  Description of Artificial Sequence: Synthetic oligonucleotide
  Target: ATXN1; (-) strand; PAM type: NRG; PAM sequence: TGG
ttttgtatttttagtagaga

SEQ ID NO: 51555 - DNA, 20 bp, Artificial Sequence
  Description of Artificial Sequence: Synthetic oligonucleotide
  Target: ATXN1; (-) strand; PAM type: NRG; PAM sequence: GAG
taatttttgtatttttagta

SEQ ID NO: 51556 - DNA, 20 bp, Artificial Sequence
  Description of Artificial Sequence: Synthetic oligonucleotide
  Target: ATXN1; (-) strand; PAM type: NRG; PAM sequence: TAG
gctaatttttgtatttttag

SEQ ID NO: 51557 - DNA, 20 bp, Artificial Sequence
  Description of Artificial Sequence: Synthetic oligonucleotide
  Target: ATXN1; (-) strand; PAM type: NRG; PAM sequence: TAG
ccagctaatttttgtatttt

SEQ ID NO: 51558 - DNA, 20 bp, Artificial Sequence
  Description of Artificial Sequence: Synthetic oligonucleotide
  Target: ATXN1; (-) strand; PAM type: NRG; PAM sequence: CAG
caggcacgtgccactatgcc

SEQ ID NO: 51559 - DNA, 20 bp, Artificial Sequence
  Description of Artificial Sequence: Synthetic oligonucleotide
  Target: ATXN1; (-) strand; PAM type: NRG; PAM sequence: AGG
acccgaagagctgagattac

SEQ ID NO: 51560 - DNA, 20 bp, Artificial Sequence
  Description of Artificial Sequence: Synthetic oligonucleotide
  Target: ATXN1; (-) strand; PAM type: NRG; PAM sequence: CAG
cacccgaagagctgagatta

SEQ ID NO: 51561 - DNA, 20 bp, Artificial Sequence
  Description of Artificial Sequence: Synthetic oligonucleotide
  Target: ATXN1; (-) strand; PAM type: NRG; PAM sequence: GAG
cctcagccacccgaagagct

SEQ ID NO: 51562 - DNA, 20 bp, Artificial Sequence
  Description of Artificial Sequence: Synthetic oligonucleotide
  Target: ATXN1; (-) strand; PAM type: NRG; PAM sequence: GAG
ttctgcctcagccacccgaa

SEQ ID NO: 51563 - DNA, 20 bp, Artificial Sequence
  Description of Artificial Sequence: Synthetic oligonucleotide
  Target: ATXN1; (-) strand; PAM type: NRG; PAM sequence: AAG
tcttctgcctcagccacccg

SEQ ID NO: 51564 - DNA, 20 bp, Artificial Sequence
  Description of Artificial Sequence: Synthetic oligonucleotide
  Target: ATXN1; (-) strand; PAM type: NRG; PAM sequence: CAG
ttcaagtgattcttctgcct

SEQ ID NO: 51565 - DNA, 20 bp, Artificial Sequence
  Description of Artificial Sequence: Synthetic oligonucleotide
  Target: ATXN1; (-) strand; PAM type: NRG; PAM sequence: AAG
aacctccgactccctggttc

SEQ ID NO: 51566 - DNA, 20 bp, Artificial Sequence
  Description of Artificial Sequence: Synthetic oligonucleotide
  Target: ATXN1; (-) strand; PAM type: NRG; PAM sequence: TGG
cactgcaacctccgactccc

SEQ ID NO: 51567 - DNA, 20 bp, Artificial Sequence
  Description of Artificial Sequence: Synthetic oligonucleotide
  Target: ATXN1; (-) strand; PAM type: NRG; PAM sequence: CAG
ggagtgcagtggcacaatct

SEQ ID NO: 51568 - DNA, 20 bp, Artificial Sequence
  Description of Artificial Sequence: Synthetic oligonucleotide
  Target: ATXN1; (-) strand; PAM type: NRG; PAM sequence: TGG
gtcaccaggctggagtgcag

SEQ ID NO: 51569 - DNA, 20 bp, Artificial Sequence
  Description of Artificial Sequence: Synthetic oligonucleotide
  Target: ATXN1; (-) strand; PAM type: NRG; PAM sequence: CAG
tctgtcaccaggctggagtg

SEQ ID NO: 51570 - DNA, 20 bp, Artificial Sequence
  Description of Artificial Sequence: Synthetic oligonucleotide
  Target: ATXN1; (-) strand; PAM type: NRG; PAM sequence: GAG
ctcgctctgtcaccaggctg

SEQ ID NO: 51571 - DNA, 20 bp, Artificial Sequence
  Description of Artificial Sequence: Synthetic oligonucleotide
  Target: ATXN1; (-) strand; PAM type: NRG; PAM sequence: TGG
gtctcgctctgtcaccaggc

SEQ ID NO: 51572 - DNA, 20 bp, Artificial Sequence
  Description of Artificial Sequence: Synthetic oligonucleotide
  Target: ATXN1; (-) strand; PAM type: NRG; PAM sequence: AGG
cggagtctcgctctgtcacc

SEQ ID NO: 51573 - DNA, 20 bp, Artificial Sequence
  Description of Artificial Sequence: Synthetic oligonucleotide
  Target: ATXN1; (-) strand; PAM type: NRG; PAM sequence: CAG
acggagtctcgctctgtcac

SEQ ID NO: 51574 - DNA, 20 bp, Artificial Sequence
  Description of Artificial Sequence: Synthetic oligonucleotide
  Target: ATXN1; (-) strand; PAM type: NRG; PAM sequence: GAG
ttttttttttttttgagacg

SEQ ID NO: 51575 - DNA, 20 bp, Artificial Sequence
  Description of Artificial Sequence: Synthetic oligonucleotide
  Target: ATXN1; (-) strand; PAM type: NRG; PAM sequence: CGG
ttttttttttttttttgaga

SEQ ID NO: 51576 - DNA, 20 bp, Artificial Sequence
  Description of Artificial Sequence: Synthetic oligonucleotide
  Target: ATXN1; (-) strand; PAM type: NRG; PAM sequence: GAG
tttttttttttttttttttt

SEQ ID NO: 51577 - DNA, 20 bp, Artificial Sequence
  Description of Artificial Sequence: Synthetic oligonucleotide
  Target: ATXN1; (-) strand; PAM type: NRG; PAM sequence: TGG
tgaggctgtttacagttaat

SEQ ID NO: 51578 - DNA, 20 bp, Artificial Sequence
  Description of Artificial Sequence: Synthetic oligonucleotide
  Target: ATXN1; (-) strand; PAM type: NRG; PAM sequence: CAG
gacctgcctgaggctgttta

SEQ ID NO: 51579 - DNA, 20 bp, Artificial Sequence
  Description of Artificial Sequence: Synthetic oligonucleotide
  Target: ATXN1; (-) strand; PAM type: NRG; PAM sequence: AGG
cctccagagggacctgcctg

SEQ ID NO: 51580 - DNA, 20 bp, Artificial Sequence
  Description of Artificial Sequence: Synthetic oligonucleotide
  Target: ATXN1; (-) strand; PAM type: NRG; PAM sequence: GAG
acctccagagggacctgcct

SEQ ID NO: 51581 - DNA, 20 bp, Artificial Sequence
  Description of Artificial Sequence: Synthetic oligonucleotide
  Target: ATXN1; (-) strand; PAM type: NRG; PAM sequence: GGG
tcttcttgaacacctccaga

SEQ ID NO: 51582 - DNA, 20 bp, Artificial Sequence
  Description of Artificial Sequence: Synthetic oligonucleotide
  Target: ATXN1; (-) strand; PAM type: NRG; PAM sequence: AGG
ttcttcttgaacacctccag

SEQ ID NO: 51583 - DNA, 20 bp, Artificial Sequence
  Description of Artificial Sequence: Synthetic oligonucleotide
  Target: ATXN1; (-) strand; PAM type: NRG; PAM sequence: GAG
cttcttcttgaacacctcca

SEQ ID NO: 51584 - DNA, 20 bp, Artificial Sequence
  Description of Artificial Sequence: Synthetic oligonucleotide
  Target: ATXN1; (-) strand; PAM type: NRG; PAM sequence: CAG
gccttcttcttgaacacctc

SEQ ID NO: 51585 - DNA, 20 bp, Artificial Sequence
  Description of Artificial Sequence: Synthetic oligonucleotide
  Target: ATXN1; (-) strand; PAM type: NRG; PAM sequence: GAG
cagaggcaataccatgaatg

SEQ ID NO: 51586 - DNA, 20 bp, Artificial Sequence
  Description of Artificial Sequence: Synthetic oligonucleotide
  Target: ATXN1; (-) strand; PAM type: NRG; PAM sequence: TGG
ttcagaggcaataccatgaa

SEQ ID NO: 51587 - DNA, 20 bp, Artificial Sequence
  Description of Artificial Sequence: Synthetic oligonucleotide
  Target: ATXN1; (-) strand; PAM type: NRG; PAM sequence: AGG
tccatctgtaaggtcttcag

SEQ ID NO: 51588 - DNA, 20 bp, Artificial Sequence
  Description of Artificial Sequence: Synthetic oligonucleotide
  Target: ATXN1; (-) strand; PAM type: NRG; PAM sequence: GAG
ttccatctgtaaggtcttca

SEQ ID NO: 51589 - DNA, 20 bp, Artificial Sequence
  Description of Artificial Sequence: Synthetic oligonucleotide
  Target: ATXN1; (-) strand; PAM type: NRG; PAM sequence: CAG
ttttccatctgtaaggtctt

SEQ ID NO: 51590 - DNA, 20 bp, Artificial Sequence
  Description of Artificial Sequence: Synthetic oligonucleotide
  Target: ATXN1; (-) strand; PAM type: NRG; PAM sequence: AGG
ccttatcttttccatctgta

SEQ ID NO: 51591 - DNA, 20 bp, Artificial Sequence
  Description of Artificial Sequence: Synthetic oligonucleotide
  Target: ATXN1; (-) strand; PAM type: NRG; PAM sequence: AAG
tccttatcttttccatctgt

SEQ ID NO: 51592 - DNA, 20 bp, Artificial Sequence
  Description of Artificial Sequence: Synthetic oligonucleotide
  Target: ATXN1; (-) strand; PAM type: NRG; PAM sequence: CAG
ccacacagggtcatgatggt

SEQ ID NO: 51593 - DNA, 20 bp, Artificial Sequence
  Description of Artificial Sequence: Synthetic oligonucleotide
  Target: ATXN1; (-) strand; PAM type: NRG; PAM sequence: TGG
agccccacacagggtcatga

SEQ ID NO: 51594 - DNA, 20 bp, Artificial Sequence
  Description of Artificial Sequence: Synthetic oligonucleotide
  Target: ATXN1; (-) strand; PAM type: NRG; PAM sequence: GGG
cattagcctagccccacaca

SEQ ID NO: 51595 - DNA, 20 bp, Artificial Sequence
  Description of Artificial Sequence: Synthetic oligonucleotide
  Target: ATXN1; (-) strand; PAM type: NRG; PAM sequence: AGG
acattagcctagccccacac

SEQ ID NO: 51596 - DNA, 20 bp, Artificial Sequence
  Description of Artificial Sequence: Synthetic oligonucleotide
  Target: ATXN1; (-) strand; PAM type: NRG; PAM sequence: CAG
tacattagcctagccccaca

SEQ ID NO: 51597 - DNA, 20 bp, Artificial Sequence
  Description of Artificial Sequence: Synthetic oligonucleotide
  Target: ATXN1; (-) strand; PAM type: NRG; PAM sequence: TAG
cacaaacacatacattagcc

SEQ ID NO: 51598 - DNA, 20 bp, Artificial Sequence
  Description of Artificial Sequence: Synthetic oligonucleotide
  Target: ATXN1; (-) strand; PAM type: NRG; PAM sequence: TAG
taagacacaaacacatacat

SEQ ID NO: 51599 - DNA, 20 bp, Artificial Sequence
  Description of Artificial Sequence: Synthetic oligonucleotide
  Target: ATXN1; (-) strand; PAM type: NRG; PAM sequence: AAG
taagttttctgttaaaaact

SEQ ID NO: 51600 - DNA, 20 bp, Artificial Sequence
  Description of Artificial Sequence: Synthetic oligonucleotide
  Target: ATXN1; (-) strand; PAM type: NRG; PAM sequence: AAG
aaaaaaagtttttttttttt

SEQ ID NO: 51601 - DNA, 20 bp, Artificial Sequence
  Description of Artificial Sequence: Synthetic oligonucleotide
  Target: ATXN1; (-) strand; PAM type: NRG; PAM sequence: AAG
aagctttttcttattaaaaa

SEQ ID NO: 51602 - DNA, 20 bp, Artificial Sequence
  Description of Artificial Sequence: Synthetic oligonucleotide
  Target: ATXN1; (-) strand; PAM type: NRG; PAM sequence: AAG
caccaccacatccagtttat

SEQ ID NO: 51603 - DNA, 20 bp, Artificial Sequence
  Description of Artificial Sequence: Synthetic oligonucleotide
  Target: ATXN1; (-) strand; PAM type: NRG; PAM sequence: CAG
caggtgtacaccaccacatc

SEQ ID NO: 51604 - DNA, 20 bp, Artificial Sequence
  Description of Artificial Sequence: Synthetic oligonucleotide
  Target: ATXN1; (-) strand; PAM type: NRG; PAM sequence: AGG
tcccaaaatgctgggattac

SEQ ID NO: 51605 - DNA, 20 bp, Artificial Sequence
  Description of Artificial Sequence: Synthetic oligonucleotide
  Target: ATXN1; (-) strand; PAM type: NRG; PAM sequence: CAG
ctcccaaaatgctgggatta

SEQ ID NO: 51606 - DNA, 20 bp, Artificial Sequence
  Description of Artificial Sequence: Synthetic oligonucleotide
  Target: ATXN1; (-) strand; PAM type: NRG; PAM sequence: GGG
cctcagcctcccaaaatgct

SEQ ID NO: 51607 - DNA, 20 bp, Artificial Sequence
  Description of Artificial Sequence: Synthetic oligonucleotide
  Target: ATXN1; (-) strand; PAM type: NRG; PAM sequence: TGG
gcctcagcctcccaaaatgc

SEQ ID NO: 51608 - DNA, 20 bp, Artificial Sequence
  Description of Artificial Sequence: Synthetic oligonucleotide
  Target: ATXN1; (-) strand; PAM type: NRG; PAM sequence: CAG
ctcaagccatcctcctgcct

SEQ ID NO: 51609 - DNA, 20 bp, Artificial Sequence
  Description of Artificial Sequence: Synthetic oligonucleotide
  Target: ATXN1; (-) strand; PAM type: NRG; PAM sequence: AAG
ggtttcgcgcacccgggctc

SEQ ID NO: 51610 - DNA, 20 bp, Artificial Sequence
  Description of Artificial Sequence: Synthetic oligonucleotide
  Target: ATXN1; (-) strand; PAM type: NRG; PAM sequence: GGG
caggctggtttcgcgcaccc

SEQ ID NO: 51611 - DNA, 20 bp, Artificial Sequence
  Description of Artificial Sequence: Synthetic oligonucleotide
  Target: ATXN1; (-) strand; PAM type: NRG; PAM sequence: CGG
ccaggctggtttcgcgcacc

SEQ ID NO: 51612 - DNA, 20 bp, Artificial Sequence
  Description of Artificial Sequence: Synthetic oligonucleotide
  Target: ATXN1; (-) strand; PAM type: NRG; PAM sequence: TGG
tctcactatgttgcccaggc

SEQ ID NO: 51613 - DNA, 20 bp, Artificial Sequence
  Description of Artificial Sequence: Synthetic oligonucleotide
  Target: ATXN1; (-) strand; PAM type: NRG; PAM sequence: AGG
taagtctcactatgttgccc

SEQ ID NO: 51614 - DNA, 20 bp, Artificial Sequence
  Description of Artificial Sequence: Synthetic oligonucleotide
  Target: ATXN1; (-) strand; PAM type: NRG; PAM sequence: CAG
ctaagtctcactatgttgcc

SEQ ID NO: 51615 - DNA, 20 bp, Artificial Sequence
  Description of Artificial Sequence: Synthetic oligonucleotide
  Target: ATXN1; (-) strand; PAM type: NRG; PAM sequence: AAG
agcttgtttttgtagaaact

SEQ ID NO: 51616 - DNA, 20 bp, Artificial Sequence
  Description of Artificial Sequence: Synthetic oligonucleotide
  Target: ATXN1; (-) strand; PAM type: NRG; PAM sequence: TAG
attctataagcttgtttttg

SEQ ID NO: 51617 - DNA, 20 bp, Artificial Sequence
  Description of Artificial Sequence: Synthetic oligonucleotide
  Target: ATXN1; (-) strand; PAM type: NRG; PAM sequence: AAG
tctttatatctttattctat

SEQ ID NO: 51618 - DNA, 20 bp, Artificial Sequence
  Description of Artificial Sequence: Synthetic oligonucleotide
  Target: ATXN1; (-) strand; PAM type: NRG; PAM sequence: AAG
aacacattttacagctgtac

SEQ ID NO: 51619 - DNA, 20 bp, Artificial Sequence
  Description of Artificial Sequence: Synthetic oligonucleotide
  Target: ATXN1; (-) strand; PAM type: NRG; PAM sequence: CAG
taaaatacaaacacatttta

SEQ ID NO: 51620 - DNA, 20 bp, Artificial Sequence
  Description of Artificial Sequence: Synthetic oligonucleotide
  Target: ATXN1; (-) strand; PAM type: NRG; PAM sequence: CAG
ataactttcataatagcact

SEQ ID NO: 51621 - DNA, 20 bp, Artificial Sequence
  Description of Artificial Sequence: Synthetic oligonucleotide
  Target: ATXN1; (-) strand; PAM type: NRG; PAM sequence: TAG
ctttttgataactttcataa

SEQ ID NO: 51622 - DNA, 20 bp, Artificial Sequence
  Description of Artificial Sequence: Synthetic oligonucleotide
  Target: ATXN1; (-) strand; PAM type: NRG; PAM sequence: CAG
gataataaattaaccacgct

SEQ ID NO: 51623 - DNA, 20 bp, Artificial Sequence
  Description of Artificial Sequence: Synthetic oligonucleotide
  Target: ATXN1; (-) strand; PAM type: NRG; PAM sequence: AAG
ctgtacacttaggctacact

SEQ ID NO: 51624 - DNA, 20 bp, Artificial Sequence
  Description of Artificial Sequence: Synthetic oligonucleotide
  Target: ATXN1; (-) strand; PAM type: NRG; PAM sequence: AGG
tttataaggactgtacactt

SEQ ID NO: 51625 - DNA, 20 bp, Artificial Sequence
  Description of Artificial Sequence: Synthetic oligonucleotide
  Target: ATXN1; (-) strand; PAM type: NRG; PAM sequence: TAG
ctttataaggactgtacact

SEQ ID NO: 51626 - DNA, 20 bp, Artificial Sequence
  Description of Artificial Sequence: Synthetic oligonucleotide
  Target: ATXN1; (-) strand; PAM type: NRG; PAM sequence: AGG
accccactgtagactttata

SEQ ID NO: 51627 - DNA, 20 bp, Artificial Sequence
  Description of Artificial Sequence: Synthetic oligonucleotide
  Target: ATXN1; (-) strand; PAM type: NRG; PAM sequence: AAG
taccccactgtagactttat

SEQ ID NO: 51628 - DNA, 20 bp, Artificial Sequence
  Description of Artificial Sequence: Synthetic oligonucleotide
  Target: ATXN1; (-) strand; PAM type: NRG; PAM sequence: TAG
tgtatcactgtaccccactg

SEQ ID NO: 51629 - DNA, 20 bp, Artificial Sequence
  Description of Artificial Sequence: Synthetic oligonucleotide
  Target: ATXN1; (-) strand; PAM type: NRG; PAM sequence: AGG
gtgagtgaatgtgaaggcct

SEQ ID NO: 51630 - DNA, 20 bp, Artificial Sequence
  Description of Artificial Sequence: Synthetic oligonucleotide
  Target: ATXN1; (-) strand; PAM type: NRG; PAM sequence: TAG
ggtgagtgaatgtgaaggcc

SEQ ID NO: 51631 - DNA, 20 bp, Artificial Sequence
  Description of Artificial Sequence: Synthetic oligonucleotide
  Target: ATXN1; (-) strand; PAM type: NRG; PAM sequence: AGG
tgggtggtgagtgaatgtga

SEQ ID NO: 51632 - DNA, 20 bp, Artificial Sequence
  Description of Artificial Sequence: Synthetic oligonucleotide
  Target: ATXN1; (-) strand; PAM type: NRG; PAM sequence: AAG
gtgggtggtgagtgaatgtg

SEQ ID NO: 51633 - DNA, 20 bp, Artificial Sequence
  Description of Artificial Sequence: Synthetic oligonucleotide
  Target: ATXN1; (-) strand; PAM type: NRG; PAM sequence: GAG
tgagtcagtgagtgggtggt

SEQ ID NO: 51634 - DNA, 20 bp, Artificial Sequence
  Description of Artificial Sequence: Synthetic oligonucleotide
  Target: ATXN1; (-) strand; PAM type: NRG; PAM sequence: TGG
tgggtgagtcagtgagtggg

SEQ ID NO: 51635 - DNA, 20 bp, Artificial Sequence
  Description of Artificial Sequence: Synthetic oligonucleotide
  Target: ATXN1; (-) strand; PAM type: NRG; PAM sequence: GGG
ctctgggtgagtcagtgagt

SEQ ID NO: 51636 - DNA, 20 bp, Artificial Sequence
  Description of Artificial Sequence: Synthetic oligonucleotide
  Target: ATXN1; (-) strand; PAM type: NRG; PAM sequence: TGG
gctctgggtgagtcagtgag

SEQ ID NO: 51637 - DNA, 20 bp, Artificial Sequence
  Description of Artificial Sequence: Synthetic oligonucleotide
  Target: ATXN1; (-) strand; PAM type: NRG; PAM sequence: GAG
gttgctctgggtgagtcagt

SEQ ID NO: 51638 - DNA, 20 bp, Artificial Sequence
  Description of Artificial Sequence: Synthetic oligonucleotide
  Target: ATXN1; (-) strand; PAM type: NRG; PAM sequence: CAG
ggaagttgctctgggtgagt

SEQ ID NO: 51639 - DNA, 20 bp, Artificial Sequence
  Description of Artificial Sequence: Synthetic oligonucleotide
  Target: ATXN1; (-) strand; PAM type: NRG; PAM sequence: GAG
gactggaagttgctctgggt

SEQ ID NO: 51640 - DNA, 20 bp, Artificial Sequence
  Description of Artificial Sequence: Synthetic oligonucleotide
  Target: ATXN1; (-) strand; PAM type: NRG; PAM sequence: GGG
gcaggactggaagttgctct

SEQ ID NO: 51641 - DNA, 20 bp, Artificial Sequence
  Description of Artificial Sequence: Synthetic oligonucleotide
  Target: ATXN1; (-) strand; PAM type: NRG; PAM sequence: TGG
tgcaggactggaagttgctc

SEQ ID NO: 51642 - DNA, 20 bp, Artificial Sequence
  Description of Artificial Sequence: Synthetic oligonucleotide
  Target: ATXN1; (-) strand; PAM type: NRG; PAM sequence: AAG
aatggagcttgcaggactgg

SEQ ID NO: 51643 - DNA, 20 bp, Artificial Sequence
  Description of Artificial Sequence: Synthetic oligonucleotide
  Target: ATXN1; (-) strand; PAM type: NRG; PAM sequence: TGG
atgaatggagcttgcaggac

SEQ ID NO: 51644 - DNA, 20 bp, Artificial Sequence
  Description of Artificial Sequence: Synthetic oligonucleotide
  Target: ATXN1; (-) strand; PAM type: NRG; PAM sequence: AGG
ttaccatgaatggagcttgc

SEQ ID NO: 51645 - DNA, 20 bp, Artificial Sequence
  Description of Artificial Sequence: Synthetic oligonucleotide
  Target: ATXN1; (-) strand; PAM type: NRG; PAM sequence: CAG
cttaccatgaatggagcttg

SEQ ID NO: 51646 - DNA, 20 bp, Artificial Sequence
  Description of Artificial Sequence: Synthetic oligonucleotide
  Target: ATXN1; (-) strand; PAM type: NRG; PAM sequence: GAG
tagggcacttaccatgaatg

SEQ ID NO: 51647 - DNA, 20 bp, Artificial Sequence
  Description of Artificial Sequence: Synthetic oligonucleotide
  Target: ATXN1; (-) strand; PAM type: NRG; PAM sequence: TGG
tatagggcacttaccatgaa

SEQ ID NO: 51648 - DNA, 20 bp, Artificial Sequence
  Description of Artificial Sequence: Synthetic oligonucleotide
  Target: ATXN1; (-) strand; PAM type: NRG; PAM sequence: GGG
taaaagggcacacctatata

SEQ ID NO: 51649 - DNA, 20 bp, Artificial Sequence
  Description of Artificial Sequence: Synthetic oligonucleotide
  Target: ATXN1; (-) strand; PAM type: NRG; PAM sequence: AGG
ttaaaagggcacacctatat

SEQ ID NO: 51650 - DNA, 20 bp, Artificial Sequence
  Description of Artificial Sequence: Synthetic oligonucleotide
  Target: ATXN1; (-) strand; PAM type: NRG; PAM sequence: TAG
tttaaaagggcacacctata

SEQ ID NO: 51651 - DNA, 20 bp, Artificial Sequence
  Description of Artificial Sequence: Synthetic oligonucleotide
  Target: ATXN1; (-) strand; PAM type: NRG; PAM sequence: GGG
aagtagaaaagattttaaaa

SEQ ID NO: 51652 - DNA, 20 bp, Artificial Sequence
  Description of Artificial Sequence: Synthetic oligonucleotide
  Target: ATXN1; (-) strand; PAM type: NRG; PAM sequence: AGG
gaagtagaaaagattttaaa

SEQ ID NO: 51653 - DNA, 20 bp, Artificial Sequence
  Description of Artificial Sequence: Synthetic oligonucleotide
  Target: ATXN1; (-) strand; PAM type: NRG; PAM sequence: AAG
tgaagtagaaaagattttaa

SEQ ID NO: 51654 - DNA, 20 bp, Artificial Sequence
  Description of Artificial Sequence: Synthetic oligonucleotide
  Target: ATXN1; (-) strand; PAM type: NRG; PAM sequence: AAG
acagtaaaaatgaagtagaa

SEQ ID NO: 51655 - DNA, 20 bp, Artificial Sequence
  Description of Artificial Sequence: Synthetic oligonucleotide
  Target: ATXN1; (-) strand; PAM type: NRG; PAM sequence: TAG
taggtacagtaaaaatgaag

SEQ ID NO: 51656 - DNA, 20 bp, Artificial Sequence
  Description of Artificial Sequence: Synthetic oligonucleotide
  Target: ATXN1; (-) strand; PAM type: NRG; PAM sequence: AAG
gaataggtacagtaaaaatg

SEQ ID NO: 51657 - DNA, 20 bp, Artificial Sequence
  Description of Artificial Sequence: Synthetic oligonucleotide
  Target: ATXN1; (-) strand; PAM type: NRG; PAM sequence: CAG
atctagacatagaataggta

SEQ ID NO: 51658 - DNA, 20 bp, Artificial Sequence
  Description of Artificial Sequence: Synthetic oligonucleotide
  Target: ATXN1; (-) strand; PAM type: NRG; PAM sequence: AGG
tgtgcatctagacatagaat

SEQ ID NO: 51659 - DNA, 20 bp, Artificial Sequence
  Description of Artificial Sequence: Synthetic oligonucleotide
  Target: ATXN1; (-) strand; PAM type: NRG; PAM sequence: TAG
ttgtgcatctagacatagaa

SEQ ID NO: 51660 - DNA, 20 bp, Artificial Sequence
  Description of Artificial Sequence: Synthetic oligonucleotide
  Target: ATXN1; (-) strand; PAM type: NRG; PAM sequence: TAG
agtttttgtgcatctagaca

SEQ ID NO: 51661 - DNA, 20 bp, Artificial Sequence
  Description of Artificial Sequence: Synthetic oligonucleotide
  Target: ATXN1; (-) strand; PAM type: NRG; PAM sequence: TAG
aaacatagtttttgtgcatc

SEQ ID NO: 51662 - DNA, 20 bp, Artificial Sequence
  Description of Artificial Sequence: Synthetic oligonucleotide
  Target: ATXN1; (-) strand; PAM type: NRG; PAM sequence: TAG
taacacaatgttcctaaaca

SEQ ID NO: 51663 - DNA, 20 bp, Artificial Sequence
  Description of Artificial Sequence: Synthetic oligonucleotide
  Target: ATXN1; (-) strand; PAM type: NRG; PAM sequence: AGG
cttactgtactgaatactgt

SEQ ID NO: 51664 - DNA, 20 bp, Artificial Sequence
  Description of Artificial Sequence: Synthetic oligonucleotide
  Target: ATXN1; (-) strand; PAM type: NRG; PAM sequence: TAG
ccttactgtactgaatactg

SEQ ID NO: 51665 - DNA, 20 bp, Artificial Sequence
  Description of Artificial Sequence: Synthetic oligonucleotide
  Target: ATXN1; (-) strand; PAM type: NRG; PAM sequence: CAG
ttacgattgcctacagcact

SEQ ID NO: 51666 - DNA, 20 bp, Artificial Sequence
  Description of Artificial Sequence: Synthetic oligonucleotide
  Target: ATXN1; (-) strand; PAM type: NRG; PAM sequence: CAG
catagggttacgattgccta

SEQ ID NO: 51667 - DNA, 20 bp, Artificial Sequence
  Description of Artificial Sequence: Synthetic oligonucleotide
  Target: ATXN1; (-) strand; PAM type: NRG; PAM sequence: GGG
aggatacaaacttggacata

SEQ ID NO: 51668 - DNA, 20 bp, Artificial Sequence
  Description of Artificial Sequence: Synthetic oligonucleotide
  Target: ATXN1; (-) strand; PAM type: NRG; PAM sequence: AGG
taggatacaaacttggacat

SEQ ID NO: 51669 - DNA, 20 bp, Artificial Sequence
  Description of Artificial Sequence: Synthetic oligonucleotide
  Target: ATXN1; (-) strand; PAM type: NRG; PAM sequence: TAG
ctaggatacaaacttggaca

SEQ ID NO: 51670 - DNA, 20 bp, Artificial Sequence
  Description of Artificial Sequence: Synthetic oligonucleotide
  Target: ATXN1; (-) strand; PAM type: NRG; PAM sequence: TGG
ttgctcctaggatacaaact

SEQ ID NO: 51671 - DNA, 20 bp, Artificial Sequence
  Description of Artificial Sequence: Synthetic oligonucleotide
  Target: ATXN1; (-) strand; PAM type: NRG; PAM sequence: AGG
taatgcagcctgttgctcct

SEQ ID NO: 51672 - DNA, 20 bp, Artificial Sequence
  Description of Artificial Sequence: Synthetic oligonucleotide
  Target: ATXN1; (-) strand; PAM type: NRG; PAM sequence: TAG
ataatgcagcctgttgctcc

SEQ ID NO: 51673 - DNA, 20 bp, Artificial Sequence
  Description of Artificial Sequence: Synthetic oligonucleotide
  Target: ATXN1; (-) strand; PAM type: NRG; PAM sequence: CAG
cacatctaagctatataatg

SEQ ID NO: 51674 - DNA, 20 bp, Artificial Sequence
  Description of Artificial Sequence: Synthetic oligonucleotide
  Target: ATXN1; (-) strand; PAM type: NRG; PAM sequence: AAG
gtacagcctgctacacatct

SEQ ID NO: 51675 - DNA, 20 bp, Artificial Sequence
  Description of Artificial Sequence: Synthetic oligonucleotide
  Target: ATXN1; (-) strand; PAM type: NRG; PAM sequence: CAG
tcacccaagcctagatggta

SEQ ID NO: 51676 - DNA, 20 bp, Artificial Sequence
  Description of Artificial Sequence: Synthetic oligonucleotide
  Target: ATXN1; (-) strand; PAM type: NRG; PAM sequence: TGG
tgtgttcacccaagcctaga

SEQ ID NO: 51677 - DNA, 20 bp, Artificial Sequence
  Description of Artificial Sequence: Synthetic oligonucleotide
  Target: ATXN1; (-) strand; PAM type: NRG; PAM sequence: TAG
aaagtgtgttcacccaagcc

SEQ ID NO: 51678 - DNA, 20 bp, Artificial Sequence
  Description of Artificial Sequence: Synthetic oligonucleotide
  Target: ATXN1; (-) strand; PAM type: NRG; PAM sequence: AAG
atcataaagtgtgttcaccc

SEQ ID NO: 51679 - DNA, 20 bp, Artificial Sequence
  Description of Artificial Sequence: Synthetic oligonucleotide
  Target: ATXN1; (-) strand; PAM type: NRG; PAM sequence: AAG
gtccttctgcaaatatcata

SEQ ID NO: 51680 - DNA, 20 bp, Artificial Sequence
  Description of Artificial Sequence: Synthetic oligonucleotide
  Target: ATXN1; (-) strand; PAM type: NRG; PAM sequence: GAG
taataatgggaatgcattct

SEQ ID NO: 51681 - DNA, 20 bp, Artificial Sequence
  Description of Artificial Sequence: Synthetic oligonucleotide
  Target: ATXN1; (-) strand; PAM type: NRG; PAM sequence: GGG
gtcgtgcatcacttaataat

SEQ ID NO: 51682 - DNA, 20 bp, Artificial Sequence
  Description of Artificial Sequence: Synthetic oligonucleotide
  Target: ATXN1; (-) strand; PAM type: NRG; PAM sequence: TGG
agtcgtgcatcacttaataa

SEQ ID NO: 51683 - DNA, 20 bp, Artificial Sequence
  Description of Artificial Sequence: Synthetic oligonucleotide
  Target: ATXN1; (-) strand; PAM type: NRG; PAM sequence: CAG
tagcacaccaccatatagga

SEQ ID NO: 51684 - DNA, 20 bp, Artificial Sequence
  Description of Artificial Sequence: Synthetic oligonucleotide
  Target: ATXN1; (-) strand; PAM type: NRG; PAM sequence: AGG
acagtagcacaccaccatat

SEQ ID NO: 51685 - DNA, 20 bp, Artificial Sequence
  Description of Artificial Sequence: Synthetic oligonucleotide
  Target: ATXN1; (-) strand; PAM type: NRG; PAM sequence: TAG
cacagtagcacaccaccata

SEQ ID NO: 51686 - DNA, 20 bp, Artificial Sequence
  Description of Artificial Sequence: Synthetic oligonucleotide
  Target: ATXN1; (-) strand; PAM type: NRG; PAM sequence: TAG
gattgtaaagagatgcacag

SEQ ID NO: 51687 - DNA, 20 bp, Artificial Sequence
  Description of Artificial Sequence: Synthetic oligonucleotide
  Target: ATXN1; (-) strand; PAM type: NRG; PAM sequence: CAG
tgagattgtaaagagatgca

SEQ ID NO: 51688 - DNA, 20 bp, Artificial Sequence
  Description of Artificial Sequence: Synthetic oligonucleotide
  Target: ATXN1; (-) strand; PAM type: NRG; PAM sequence: GAG
accaaccatgagattgtaaa

SEQ ID NO: 51689 - DNA, 20 bp, Artificial Sequence
  Description of Artificial Sequence: Synthetic oligonucleotide
  Target: ATXN1; (-) strand; PAM type: NRG; PAM sequence: AAG
ttaccaaccatgagattgta

SEQ ID NO: 51690 - DNA, 20 bp, Artificial Sequence
  Description of Artificial Sequence: Synthetic oligonucleotide
  Target: ATXN1; (-) strand; PAM type: NRG; PAM sequence: GAG
aatgtgacattaccaaccat

SEQ ID NO: 51691 - DNA, 20 bp, Artificial Sequence
  Description of Artificial Sequence: Synthetic oligonucleotide
  Target: ATXN1; (-) strand; PAM type: NRG; PAM sequence: TAG
ataacaggacgtttgatttg

SEQ ID NO: 51692 - DNA, 20 bp, Artificial Sequence
  Description of Artificial Sequence: Synthetic oligonucleotide
  Target: ATXN1; (-) strand; PAM type: NRG; PAM sequence: AGG
gctactggctcgggaataac

SEQ ID NO: 51693 - DNA, 20 bp, Artificial Sequence
  Description of Artificial Sequence: Synthetic oligonucleotide
  Target: ATXN1; (-) strand; PAM type: NRG; PAM sequence: CAG
agctactggctcgggaataa

SEQ ID NO: 51694 - DNA, 20 bp, Artificial Sequence
  Description of Artificial Sequence: Synthetic oligonucleotide
  Target: ATXN1; (-) strand; PAM type: NRG; PAM sequence: GGG
aaaagtttagctactggctc

SEQ ID NO: 51695 - DNA, 20 bp, Artificial Sequence
  Description of Artificial Sequence: Synthetic oligonucleotide
  Target: ATXN1; (-) strand; PAM type: NRG; PAM sequence: CGG
aaaaagtttagctactggct

SEQ ID NO: 51696 - DNA, 20 bp, Artificial Sequence
  Description of Artificial Sequence: Synthetic oligonucleotide
  Target: ATXN1; (-) strand; PAM type: NRG; PAM sequence: TGG
aaaacaaaaagtttagctac

SEQ ID NO: 51697 - DNA, 20 bp, Artificial Sequence
  Description of Artificial Sequence: Synthetic oligonucleotide
  Target: ATXN1; (-) strand; PAM type: NRG; PAM sequence: TAG
aaaaaacaaaacaaaaagtt

SEQ ID NO: 51698 - DNA, 20 bp, Artificial Sequence
  Description of Artificial Sequence: Synthetic oligonucleotide
  Target: ATXN1; (-) strand; PAM type: NRG; PAM sequence: AAG
aaaacaaaaaacaaaacaaa

SEQ ID NO: 51699 - DNA, 20 bp, Artificial Sequence
  Description of Artificial Sequence: Synthetic oligonucleotide
  Target: ATXN1; (-) strand; PAM type: NRG; PAM sequence: GAG
tccagcctggatgacagaac

SEQ ID NO: 51700 - DNA, 20 bp, Artificial Sequence
  Description of Artificial Sequence: Synthetic oligonucleotide
  Target: ATXN1; (-) strand; PAM type: NRG; PAM sequence: CAG
ttgcactccagcctggatga

SEQ ID NO: 51701 - DNA, 20 bp, Artificial Sequence
  Description of Artificial Sequence: Synthetic oligonucleotide
  Target: ATXN1; (-) strand; PAM type: NRG; PAM sequence: TGG
cgtgccattgcactccagcc

SEQ ID NO: 51702 - DNA, 20 bp, Artificial Sequence
  Description of Artificial Sequence: Synthetic oligonucleotide
  Target: ATXN1; (-) strand; PAM type: NRG; PAM sequence: CAG
aagatcgtgccattgcactc

SEQ ID NO: 51703 - DNA, 20 bp, Artificial Sequence
  Description of Artificial Sequence: Synthetic oligonucleotide
  Target: ATXN1; (-) strand; PAM type: NRG; PAM sequence: AAG
ggtggaggttgcagtgagcc

SEQ ID NO: 51704 - DNA, 20 bp, Artificial Sequence
  Description of Artificial Sequence: Synthetic oligonucleotide
  Target: ATXN1; (-) strand; PAM type: NRG; PAM sequence: GAG
ttggaggtggaggttgcagt

SEQ ID NO: 51705 - DNA, 20 bp, Artificial Sequence
  Description of Artificial Sequence: Synthetic oligonucleotide
  Target: ATXN1; (-) strand; PAM type: NRG; PAM sequence: CAG
tcacttggaggtggaggttg

SEQ ID NO: 51706 - DNA, 20 bp, Artificial Sequence
  Description of Artificial Sequence: Synthetic oligonucleotide
  Target: ATXN1; (-) strand; PAM type: NRG; PAM sequence: AGG
ggagaatcacttggaggtgg

SEQ ID NO: 51707 - DNA, 20 bp, Artificial Sequence
  Description of Artificial Sequence: Synthetic oligonucleotide
  Target: ATXN1; (-) strand; PAM type: NRG; PAM sequence: GAG
aggagaatcacttggaggtg

SEQ ID NO: 51708 - DNA, 20 bp, Artificial Sequence
  Description of Artificial Sequence: Synthetic oligonucleotide
  Target: ATXN1; (-) strand; PAM type: NRG; PAM sequence: TGG
gcaggagaatcacttggagg

SEQ ID NO: 51709 - DNA, 20 bp, Artificial Sequence
  Description of Artificial Sequence: Synthetic oligonucleotide
  Target: ATXN1; (-) strand; PAM type: NRG; PAM sequence: AGG
gaagcaggagaatcacttgg

SEQ ID NO: 51710 - DNA, 20 bp, Artificial Sequence
  Description of Artificial Sequence: Synthetic oligonucleotide
  Target: ATXN1; (-) strand; PAM type: NRG; PAM sequence: GAG
tgaagcaggagaatcacttg

SEQ ID NO: 51711 - DNA, 20 bp, Artificial Sequence
  Description of Artificial Sequence: Synthetic oligonucleotide
  Target: ATXN1; (-) strand; PAM type: NRG; PAM sequence: TGG
gctgaagcaggagaatcact

SEQ ID NO: 51712 - DNA, 20 bp, Artificial Sequence
  Description of Artificial Sequence: Synthetic oligonucleotide
  Target: ATXN1; (-) strand; PAM type: NRG; PAM sequence: GAG
tactcgggaggctgaagcag

SEQ ID NO: 51713 - DNA, 20 bp, Artificial Sequence
  Description of Artificial Sequence: Synthetic oligonucleotide
  Target: ATXN1; (-) strand; PAM type: NRG; PAM sequence: AGG
gctactcgggaggctgaagc

SEQ ID NO: 51714 - DNA, 20 bp, Artificial Sequence
  Description of Artificial Sequence: Synthetic oligonucleotide
  Target: ATXN1; (-) strand; PAM type: NRG; PAM sequence: CAG
agctactcgggaggctgaag

SEQ ID NO: 51715 - DNA, 20 bp, Artificial Sequence
  Description of Artificial Sequence: Synthetic oligonucleotide
  Target: ATXN1; (-) strand; PAM type: NRG; PAM sequence: AAG
tccagctactcgggaggctg

SEQ ID NO: 51716 - DNA, 20 bp, Artificial Sequence
  Description of Artificial Sequence: Synthetic oligonucleotide
  Target: ATXN1; (-) strand; PAM type: NRG; PAM sequence: AGG
tgtaattccagctactcggg

SEQ ID NO: 51717 - DNA, 20 bp, Artificial Sequence
  Description of Artificial Sequence: Synthetic oligonucleotide
  Target: ATXN1; (-) strand; PAM type: NRG; PAM sequence: GAG
ctgtaattccagctactcgg

SEQ ID NO: 51718 - DNA, 20 bp, Artificial Sequence
  Description of Artificial Sequence: Synthetic oligonucleotide
  Target: ATXN1; (-) strand; PAM type: NRG; PAM sequence: GGG
acctgtaattccagctactc

SEQ ID NO: 51719 - DNA, 20 bp, Artificial Sequence
  Description of Artificial Sequence: Synthetic oligonucleotide
  Target: ATXN1; (-) strand; PAM type: NRG; PAM sequence: CGG
cacctgtaattccagctact

SEQ ID NO: 51720 - DNA, 20 bp, Artificial Sequence
  Description of Artificial Sequence: Synthetic oligonucleotide
  Target: ATXN1; (-) strand; PAM type: NRG; PAM sequence: CAG
gtggtgggcacctgtaattc

SEQ ID NO: 51721 - DNA, 20 bp, Artificial Sequence
  Description of Artificial Sequence: Synthetic oligonucleotide
  Target: ATXN1; (-) strand; PAM type: NRG; PAM sequence: GGG
tactagccgggcatggtggt

SEQ ID NO: 51722 - DNA, 20 bp, Artificial Sequence
  Description of Artificial Sequence: Synthetic oligonucleotide
  Target: ATXN1; (-) strand; PAM type: NRG; PAM sequence: TGG
atactagccgggcatggtgg

SEQ ID NO: 51723 - DNA, 20 bp, Artificial Sequence
  Description of Artificial Sequence: Synthetic oligonucleotide
  Target: ATXN1; (-) strand; PAM type: NRG; PAM sequence: TGG
taaatactagccgggcatgg

SEQ ID NO: 51724 - DNA, 20 bp, Artificial Sequence
  Description of Artificial Sequence: Synthetic oligonucleotide
  Target: ATXN1; (-) strand; PAM type: NRG; PAM sequence: TGG
atataaatactagccgggca

SEQ ID NO: 51725 - DNA, 20 bp, Artificial Sequence
  Description of Artificial Sequence: Synthetic oligonucleotide
  Target: ATXN1; (-) strand; PAM type: NRG; PAM sequence: GGG
taaaaatataaatactagcc

SEQ ID NO: 51726 - DNA, 20 bp, Artificial Sequence
  Description of Artificial Sequence: Synthetic oligonucleotide
  Target: ATXN1; (-) strand; PAM type: NRG; PAM sequence: CGG
ctaaaaatataaatactagc

SEQ ID NO: 51727 - DNA, 20 bp, Artificial Sequence
  Description of Artificial Sequence: Synthetic oligonucleotide
  Target: ATXN1; (-) strand; PAM type: NRG; PAM sequence: TAG
tctactaaaaatataaatac

SEQ ID NO: 51728 - DNA, 20 bp, Artificial Sequence
  Description of Artificial Sequence: Synthetic oligonucleotide
  Target: ATXN1; (-) strand; PAM type: NRG; PAM sequence: TAG
tgagaccagcctggccaaca

SEQ ID NO: 51729 - DNA, 20 bp, Artificial Sequence
  Description of Artificial Sequence: Synthetic oligonucleotide
  Target: ATXN1; (-) strand; PAM type: NRG; PAM sequence: TGG
tcaggagtttgagaccagcc

SEQ ID NO: 51730 - DNA, 20 bp, Artificial Sequence
  Description of Artificial Sequence: Synthetic oligonucleotide
  Target: ATXN1; (-) strand; PAM type: NRG; PAM sequence: CAG
tgaggtcaggagtttgagac

SEQ ID NO: 51731 - DNA, 20 bp, Artificial Sequence
  Description of Artificial Sequence: Synthetic oligonucleotide
  Target: ATXN1; (-) strand; PAM type: NRG; PAM sequence: GAG
tcacctgaggtcaggagttt

SEQ ID NO: 51732 - DNA, 20 bp, Artificial Sequence
  Description of Artificial Sequence: Synthetic oligonucleotide
  Target: ATXN1; (-) strand; PAM type: NRG; PAM sequence: GAG
ggcagatcacctgaggtcag

SEQ ID NO: 51733 - DNA, 20 bp, Artificial Sequence
  Description of Artificial Sequence: Synthetic oligonucleotide
  Target: ATXN1; (-) strand; PAM type: NRG; PAM sequence: AGG
caggcagatcacctgaggtc

SEQ ID NO: 51734 - DNA, 20 bp, Artificial Sequence
  Description of Artificial Sequence: Synthetic oligonucleotide
  Target: ATXN1; (-) strand; PAM type: NRG; PAM sequence: CAG
gcaggcagatcacctgaggt

SEQ ID NO: 51735 - DNA, 20 bp, Artificial Sequence
  Description of Artificial Sequence: Synthetic oligonucleotide
  Target: ATXN1; (-) strand; PAM type: NRG; PAM sequence: AGG
tgaggcaggcagatcacctg

SEQ ID NO: 51736 - DNA, 20 bp, Artificial Sequence
  Description of Artificial Sequence: Synthetic oligonucleotide
  Target: ATXN1; (-) strand; PAM type: NRG; PAM sequence: GAG
ctgaggcaggcagatcacct

SEQ ID NO: 51737 - DNA, 20 bp, Artificial Sequence
  Description of Artificial Sequence: Synthetic oligonucleotide
  Target: ATXN1; (-) strand; PAM type: NRG; PAM sequence: CAG
ctttgagaggctgaggcagg

SEQ ID NO: 51738 - DNA, 20 bp, Artificial Sequence
  Description of Artificial Sequence: Synthetic oligonucleotide
  Target: ATXN1; (-) strand; PAM type: NRG; PAM sequence: AGG
gcactttgagaggctgaggc

SEQ ID NO: 51739 - DNA, 20 bp, Artificial Sequence
  Description of Artificial Sequence: Synthetic oligonucleotide
  Target: ATXN1; (-) strand; PAM type: NRG; PAM sequence: CAG
ggcactttgagaggctgagg

SEQ ID NO: 51740 - DNA, 20 bp, Artificial Sequence
  Description of Artificial Sequence: Synthetic oligonucleotide
  Target: ATXN1; (-) strand; PAM type: NRG; PAM sequence: AGG
agtggcactttgagaggctg

SEQ ID NO: 51741 - DNA, 20 bp, Artificial Sequence
  Description of Artificial Sequence: Synthetic oligonucleotide
  Target: ATXN1; (-) strand; PAM type: NRG; PAM sequence: GAG
cagtggcactttgagaggct

SEQ ID NO: 51742 - DNA, 20 bp, Artificial Sequence
  Description of Artificial Sequence: Synthetic oligonucleotide
  Target: ATXN1; (-) strand; PAM type: NRG; PAM sequence: AGG
gggcacagtggcactttgag

SEQ ID NO: 51743 - DNA, 20 bp, Artificial Sequence
  Description of Artificial Sequence: Synthetic oligonucleotide
  Target: ATXN1; (-) strand; PAM type: NRG; PAM sequence: GAG
cgggcacagtggcactttga

SEQ ID NO: 51744 - DNA, 20 bp, Artificial Sequence
  Description of Artificial Sequence: Synthetic oligonucleotide
  Target: ATXN1; (-) strand; PAM type: NRG; PAM sequence: GAG
gccgggcacagtggcacttt

SEQ ID NO: 51745 - DNA, 20 bp, Artificial Sequence
  Description of Artificial Sequence: Synthetic oligonucleotide
  Target: ATXN1; (-) strand; PAM type: NRG; PAM sequence: TGG
ctactggcggccgggcacag

SEQ ID NO: 51746 - DNA, 20 bp, Artificial Sequence
  Description of Artificial Sequence: Synthetic oligonucleotide
  Target: ATXN1; (-) strand; PAM type: NRG; PAM sequence: CAG
ctactactggcggccgggca

SEQ ID NO: 51747 - DNA, 20 bp, Artificial Sequence
  Description of Artificial Sequence: Synthetic oligonucleotide
  Target: ATXN1; (-) strand; PAM type: NRG; PAM sequence: GGG
tttagctactactggcggcc

SEQ ID NO: 51748 - DNA, 20 bp, Artificial Sequence
  Description of Artificial Sequence: Synthetic oligonucleotide
  Target: ATXN1; (-) strand; PAM type: NRG; PAM sequence: CGG
gtttagctactactggcggc

SEQ ID NO: 51749 - DNA, 20 bp, Artificial Sequence
  Description of Artificial Sequence: Synthetic oligonucleotide
  Target: ATXN1; (-) strand; PAM type: NRG; PAM sequence: CGG
aaaagtttagctactactgg

SEQ ID NO: 51750 - DNA, 20 bp, Artificial Sequence
  Description of Artificial Sequence: Synthetic oligonucleotide
  Target: ATXN1; (-) strand; PAM type: NRG; PAM sequence: TGG
gataaaagtttagctactac

SEQ ID NO: 51751 - DNA, 20 bp, Artificial Sequence
  Description of Artificial Sequence: Synthetic oligonucleotide
  Target: ATXN1; (-) strand; PAM type: NRG; PAM sequence: TAG
gcagtgtgctgataaaagtt

SEQ ID NO: 51752 - DNA, 20 bp, Artificial Sequence
  Description of Artificial Sequence: Synthetic oligonucleotide
  Target: ATXN1; (-) strand; PAM type: NRG; PAM sequence: AAG
taccagcagtgtgctgataa

SEQ ID NO: 51753 - DNA, 20 bp, Artificial Sequence
  Description of Artificial Sequence: Synthetic oligonucleotide
  Target: ATXN1; (-) strand; PAM type: NRG; PAM sequence: CAG
aaagttggaatggataccag

SEQ ID NO: 51754 - DNA, 20 bp, Artificial Sequence
  Description of Artificial Sequence: Synthetic oligonucleotide
  Target: ATXN1; (-) strand; PAM type: NRG; PAM sequence: CAG
gaaaaagttggaatggatac

SEQ ID NO: 51755 - DNA, 20 bp, Artificial Sequence
  Description of Artificial Sequence: Synthetic oligonucleotide
  Target: ATXN1; (-) strand; PAM type: NRG; PAM sequence: TGG
cacttaagaaaaagttggaa

SEQ ID NO: 51756 - DNA, 20 bp, Artificial Sequence
  Description of Artificial Sequence: Synthetic oligonucleotide
  Target: ATXN1; (-) strand; PAM type: NRG; PAM sequence: TGG
tatttcacttaagaaaaagt

SEQ ID NO: 51757 - DNA, 20 bp, Artificial Sequence
  Description of Artificial Sequence: Synthetic oligonucleotide
  Target: ATXN1; (-) strand; PAM type: NRG; PAM sequence: AAG
gttctatttcacttaagaaa

SEQ ID NO: 51758 - DNA, 20 bp, Artificial Sequence
  Description of Artificial Sequence: Synthetic oligonucleotide
  Target: ATXN1; (-) strand; PAM type: NRG; PAM sequence: AAG
cccctagttctatttcactt

SEQ ID NO: 51759 - DNA, 20 bp, Artificial Sequence
  Description of Artificial Sequence: Synthetic oligonucleotide
  Target: ATXN1; (-) strand; PAM type: NRG; PAM sequence: TAG
ctattcctactgttctcccc

SEQ ID NO: 51760 - DNA, 20 bp, Artificial Sequence
  Description of Artificial Sequence: Synthetic oligonucleotide
  Target: ATXN1; (-) strand; PAM type: NRG; PAM sequence: AAG
cctgcacatgtaatcatgga

SEQ ID NO: 51761 - DNA, 20 bp, Artificial Sequence
  Description of Artificial Sequence: Synthetic oligonucleotide
  Target: ATXN1; (-) strand; PAM type: NRG; PAM sequence: TGG
tgtacctgcacatgtaatca

SEQ ID NO: 51762 - DNA, 20 bp, Artificial Sequence
  Description of Artificial Sequence: Synthetic oligonucleotide
  Target: ATXN1; (-) strand; PAM type: NRG; PAM sequence: TGG
tttggtggcatatggcttgg

SEQ ID NO: 51763 - DNA, 20 bp, Artificial Sequence
  Description of Artificial Sequence: Synthetic oligonucleotide
  Target: ATXN1; (-) strand; PAM type: NRG; PAM sequence: TGG
tgatttggtggcatatggct

SEQ ID NO: 51764 - DNA, 20 bp, Artificial Sequence
  Description of Artificial Sequence: Synthetic oligonucleotide
  Target: ATXN1; (-) strand; PAM type: NRG; PAM sequence: TGG
agcaatgatttggtggcata

SEQ ID NO: 51765 - DNA, 20 bp, Artificial Sequence
  Description of Artificial Sequence: Synthetic oligonucleotide
  Target: ATXN1; (-) strand; PAM type: NRG; PAM sequence: TGG
tctggacagcaatgatttgg

SEQ ID NO: 51766 - DNA, 20 bp, Artificial Sequence
  Description of Artificial Sequence: Synthetic oligonucleotide
  Target: ATXN1; (-) strand; PAM type: NRG; PAM sequence: TGG
aactctggacagcaatgatt

SEQ ID NO: 51767 - DNA, 20 bp, Artificial Sequence
  Description of Artificial Sequence: Synthetic oligonucleotide
  Target: ATXN1; (-) strand; PAM type: NRG; PAM sequence: CAG
gattagttggaaactctgga

SEQ ID NO: 51768 - DNA, 20 bp, Artificial Sequence
  Description of Artificial Sequence: Synthetic oligonucleotide
  Target: ATXN1; (-) strand; PAM type: NRG; PAM sequence: TGG
aatagattagttggaaactc

SEQ ID NO: 51769 - DNA, 20 bp, Artificial Sequence
  Description of Artificial Sequence: Synthetic oligonucleotide
  Target: ATXN1; (-) strand; PAM type: NRG; PAM sequence: TGG
taaatcagcaatagattagt

SEQ ID NO: 51770 - DNA, 20 bp, Artificial Sequence
  Description of Artificial Sequence: Synthetic oligonucleotide
  Target: ATXN1; (-) strand; PAM type: NRG; PAM sequence: TAG
ggagtaaatcagcaatagat

SEQ ID NO: 51771 - DNA, 20 bp, Artificial Sequence
  Description of Artificial Sequence: Synthetic oligonucleotide
  Target: ATXN1; (-) strand; PAM type: NRG; PAM sequence: TAG
cagagggagtaaatcagcaa

SEQ ID NO: 51772 - DNA, 20 bp, Artificial Sequence
  Description of Artificial Sequence: Synthetic oligonucleotide
  Target: ATXN1; (-) strand; PAM type: NRG; PAM sequence: CAG
gataaacagagggagtaaat

SEQ ID NO: 51773 - DNA, 20 bp, Artificial Sequence
  Description of Artificial Sequence: Synthetic oligonucleotide
  Target: ATXN1; (-) strand; PAM type: NRG; PAM sequence: GAG
cagtagcagataaacagagg

SEQ ID NO: 51774 - DNA, 20 bp, Artificial Sequence
  Description of Artificial Sequence: Synthetic oligonucleotide
  Target: ATXN1; (-) strand; PAM type: NRG; PAM sequence: GGG
ttcagtagcagataaacaga

SEQ ID NO: 51775 - DNA, 20 bp, Artificial Sequence
  Description of Artificial Sequence: Synthetic oligonucleotide
  Target: ATXN1; (-) strand; PAM type: NRG; PAM sequence: AGG
tttcagtagcagataaacag

SEQ ID NO: 51776 - DNA, 20 bp, Artificial Sequence
  Description of Artificial Sequence: Synthetic oligonucleotide
  Target: ATXN1; (-) strand; PAM type: NRG; PAM sequence: GAG
atttcagtagcagataaaca

SEQ ID NO: 51777 - DNA, 20 bp, Artificial Sequence
  Description of Artificial Sequence: Synthetic oligonucleotide
  Target: ATXN1; (-) strand; PAM type: NRG; PAM sequence: CAG
tgatttcagtagcagataaa

SEQ ID NO: 51778 - DNA, 20 bp, Artificial Sequence
  Description of Artificial Sequence: Synthetic oligonucleotide
  Target: ATXN1; (-) strand; PAM type: NRG; PAM sequence: CAG
agtcagactgatttcagtag

SEQ ID NO: 51779 - DNA, 20 bp, Artificial Sequence
  Description of Artificial Sequence: Synthetic oligonucleotide
  Target: ATXN1; (-) strand; PAM type: NRG; PAM sequence: TAG
ctgagtcagactgatttcag

SEQ ID NO: 51780 - DNA, 20 bp, Artificial Sequence
  Description of Artificial Sequence: Synthetic oligonucleotide
  Target: ATXN1; (-) strand; PAM type: NRG; PAM sequence: CAG
tttctgagtcagactgattt

SEQ ID NO: 51781 - DNA, 20 bp, Artificial Sequence
  Description of Artificial Sequence: Synthetic oligonucleotide
  Target: ATXN1; (-) strand; PAM type: NRG; PAM sequence: CAG
atacaattacatttctgagt

SEQ ID NO: 51782 - DNA, 20 bp, Artificial Sequence
  Description of Artificial Sequence: Synthetic oligonucleotide
  Target: ATXN1; (-) strand; PAM type: NRG; PAM sequence: GAG
acacatacaattacatttct

SEQ ID NO: 51783 - DNA, 20 bp, Artificial Sequence
  Description of Artificial Sequence: Synthetic oligonucleotide
  Target: ATXN1; (-) strand; PAM type: NRG; PAM sequence: GAG
tgaagatagtattcttgtgt

SEQ ID NO: 51784 - DNA, 20 bp, Artificial Sequence
  Description of Artificial Sequence: Synthetic oligonucleotide
  Target: ATXN1; (-) strand; PAM type: NRG; PAM sequence: TAG
ggcgtttttgttcttgaaga

SEQ ID NO: 51785 - DNA, 20 bp, Artificial Sequence
  Description of Artificial Sequence: Synthetic oligonucleotide
  Target: ATXN1; (-) strand; PAM type: NRG; PAM sequence: AAG
cagtggcgtttttgttcttg

SEQ ID NO: 51786 - DNA, 20 bp, Artificial Sequence
  Description of Artificial Sequence: Synthetic oligonucleotide
  Target: ATXN1; (-) strand; PAM type: NRG; PAM sequence: TGG
aggatgatacaaatatccag

SEQ ID NO: 51787 - DNA, 20 bp, Artificial Sequence
  Description of Artificial Sequence: Synthetic oligonucleotide
  Target: ATXN1; (-) strand; PAM type: NRG; PAM sequence: CAG
tgaaggatgatacaaatatc

SEQ ID NO: 51788 - DNA, 20 bp, Artificial Sequence
  Description of Artificial Sequence: Synthetic oligonucleotide
  Target: ATXN1; (-) strand; PAM type: NRG; PAM sequence: AGG
aaattctgtggccgtggtga

SEQ ID NO: 51789 - DNA, 20 bp, Artificial Sequence
  Description of Artificial Sequence: Synthetic oligonucleotide
  Target: ATXN1; (-) strand; PAM type: NRG; PAM sequence: AAG
caaattctgtggccgtggtg

SEQ ID NO: 51790 - DNA, 20 bp, Artificial Sequence
  Description of Artificial Sequence: Synthetic oligonucleotide
  Target: ATXN1; (-) strand; PAM type: NRG; PAM sequence: TGG
tccgtcaaattctgtggccg

SEQ ID NO: 51791 - DNA, 20 bp, Artificial Sequence
  Description of Artificial Sequence: Synthetic oligonucleotide
  Target: ATXN1; (-) strand; PAM type: NRG; PAM sequence: TGG
aggtaatccgtcaaattctg

SEQ ID NO: 51792 - DNA, 20 bp, Artificial Sequence
  Description of Artificial Sequence: Synthetic oligonucleotide
  Target: ATXN1; (-) strand; PAM type: NRG; PAM sequence: AGG
atggttgcgaggagttaatg

SEQ ID NO: 51793 - DNA, 20 bp, Artificial Sequence
  Description of Artificial Sequence: Synthetic oligonucleotide
  Target: ATXN1; (-) strand; PAM type: NRG; PAM sequence: GAG
aatggttgcgaggagttaat

SEQ ID NO: 51794 - DNA, 20 bp, Artificial Sequence
  Description of Artificial Sequence: Synthetic oligonucleotide
  Target: ATXN1; (-) strand; PAM type: NRG; PAM sequence: GAG
aacatagcaatggttgcgag

SEQ ID NO: 51795 - DNA, 20 bp, Artificial Sequence
  Description of Artificial Sequence: Synthetic oligonucleotide
  Target: ATXN1; (-) strand; PAM type: NRG; PAM sequence: AGG
tcaacatagcaatggttgcg

SEQ ID NO: 51796 - DNA, 20 bp, Artificial Sequence
  Description of Artificial Sequence: Synthetic oligonucleotide
  Target: ATXN1; (-) strand; PAM type: NRG; PAM sequence: GAG
ctcaacatagcaatggttgc

SEQ ID NO: 51797 - DNA, 20 bp, Artificial Sequence
  Description of Artificial Sequence: Synthetic oligonucleotide
  Target: ATXN1; (-) strand; PAM type: NRG; PAM sequence: TGG
aatgaaactcaacatagcaa

SEQ ID NO: 51798 - DNA, 20 bp, Artificial Sequence
  Description of Artificial Sequence: Synthetic oligonucleotide
  Target: ATXN1; (-) strand; PAM type: NRG; PAM sequence: TAG
agggacaatgaaactcaaca

SEQ ID NO: 51799 - DNA, 20 bp, Artificial Sequence
  Description of Artificial Sequence: Synthetic oligonucleotide
  Target: ATXN1; (-) strand; PAM type: NRG; PAM sequence: GGG
ctaatctcacctgtcaaaca

SEQ ID NO: 51800 - DNA, 20 bp, Artificial Sequence
  Description of Artificial Sequence: Synthetic oligonucleotide
  Target: ATXN1; (-) strand; PAM type: NRG; PAM sequence: AGG
cctaatctcacctgtcaaac

SEQ ID NO: 51801 - DNA, 20 bp, Artificial Sequence
  Description of Artificial Sequence: Synthetic oligonucleotide
  Target: ATXN1; (-) strand; PAM type: NRG; PAM sequence: CAG
acctaatctcacctgtcaaa

SEQ ID NO: 51802 - DNA, 20 bp, Artificial Sequence
  Description of Artificial Sequence: Synthetic oligonucleotide
  Target: ATXN1; (-) strand; PAM type: NRG; PAM sequence: CAG
actagatatgtggccttgga

SEQ ID NO: 51803 - DNA, 20 bp, Artificial Sequence
  Description of Artificial Sequence: Synthetic oligonucleotide
  Target: ATXN1; (-) strand; PAM type: NRG; PAM sequence: TGG
acttactagatatgtggcct

SEQ ID NO: 51804 - DNA, 20 bp, Artificial Sequence
  Description of Artificial Sequence: Synthetic oligonucleotide
  Target: ATXN1; (-) strand; PAM type: NRG; PAM sequence: TGG
tatgcaacttactagatatg

SEQ ID NO: 51805 - DNA, 20 bp, Artificial Sequence
  Description of Artificial Sequence: Synthetic oligonucleotide
  Target: ATXN1; (-) strand; PAM type: NRG; PAM sequence: TAG
gtcctgtctatgcaacttac

SEQ ID NO: 51806 - DNA, 20 bp, Artificial Sequence
  Description of Artificial Sequence: Synthetic oligonucleotide
  Target: ATXN1; (-) strand; PAM type: NRG; PAM sequence: GAG
agatttggatttctggattt

SEQ ID NO: 51807 - DNA, 20 bp, Artificial Sequence
  Description of Artificial Sequence: Synthetic oligonucleotide
  Target: ATXN1; (-) strand; PAM type: NRG; PAM sequence: TGG
gaatacaagatttggatttc

SEQ ID NO: 51808 - DNA, 20 bp, Artificial Sequence
  Description of Artificial Sequence: Synthetic oligonucleotide
  Target: ATXN1; (-) strand; PAM type: NRG; PAM sequence: TGG
agtctaaagaatacaagatt

SEQ ID NO: 51809 - DNA, 20 bp, Artificial Sequence
  Description of Artificial Sequence: Synthetic oligonucleotide
  Target: ATXN1; (-) strand; PAM type: NRG; PAM sequence: AAG
tggtaaagtctaaagaatac

SEQ ID NO: 51810 - DNA, 20 bp, Artificial Sequence
  Description of Artificial Sequence: Synthetic oligonucleotide
  Target: ATXN1; (-) strand; PAM type: NRG; PAM sequence: AAG
ataacctgtggtaaagtcta

SEQ ID NO: 51811 - DNA, 20 bp, Artificial Sequence
  Description of Artificial Sequence: Synthetic oligonucleotide
  Target: ATXN1; (-) strand; PAM type: NRG; PAM sequence: AAG
aaaagcaataacctgtggta

SEQ ID NO: 51812 - DNA, 20 bp, Artificial Sequence
  Description of Artificial Sequence: Synthetic oligonucleotide
  Target: ATXN1; (-) strand; PAM type: NRG; PAM sequence: TGG
ggcataaaagcaataacctg

SEQ ID NO: 51813 - DNA, 20 bp, Artificial Sequence
  Description of Artificial Sequence: Synthetic oligonucleotide
  Target: ATXN1; (-) strand; PAM type: NRG; PAM sequence: AAG
ttcatgacagattggcataa

SEQ ID NO: 51814 - DNA, 20 bp, Artificial Sequence
  Description of Artificial Sequence: Synthetic oligonucleotide
  Target: ATXN1; (-) strand; PAM type: NRG; PAM sequence: TGG
gtcccattttcatgacagat

SEQ ID NO: 51815 - DNA, 20 bp, Artificial Sequence
  Description of Artificial Sequence: Synthetic oligonucleotide
  Target: ATXN1; (-) strand; PAM type: NRG; PAM sequence: CAG
aaaaagtcccattttcatga

SEQ ID NO: 51816 - DNA, 20 bp, Artificial Sequence
  Description of Artificial Sequence: Synthetic oligonucleotide
  Target: ATXN1; (-) strand; PAM type: NRG; PAM sequence: AAG
atgttgaccttttgaaaaaa

SEQ ID NO: 51817 - DNA, 20 bp, Artificial Sequence
  Description of Artificial Sequence: Synthetic oligonucleotide
  Target: ATXN1; (-) strand; PAM type: NRG; PAM sequence: CAG
aggaaggagagaagtgagcc

SEQ ID NO: 51818 - DNA, 20 bp, Artificial Sequence
  Description of Artificial Sequence: Synthetic oligonucleotide
  Target: ATXN1; (-) strand; PAM type: NRG; PAM sequence: GAG
actaaaggaaggagagaagt

SEQ ID NO: 51819 - DNA, 20 bp, Artificial Sequence
  Description of Artificial Sequence: Synthetic oligonucleotide
  Target: ATXN1; (-) strand; PAM type: NRG; PAM sequence: AAG
gctaactaaaggaaggagag

SEQ ID NO: 51820 - DNA, 20 bp, Artificial Sequence
  Description of Artificial Sequence: Synthetic oligonucleotide
  Target: ATXN1; (-) strand; PAM type: NRG; PAM sequence: GAG
gttgctaactaaaggaagga

SEQ ID NO: 51821 - DNA, 20 bp, Artificial Sequence
  Description of Artificial Sequence: Synthetic oligonucleotide
  Target: ATXN1; (-) strand; PAM type: NRG; PAM sequence: GAG
gcgttgctaactaaaggaag

SEQ ID NO: 51822 - DNA, 20 bp, Artificial Sequence
  Description of Artificial Sequence: Synthetic oligonucleotide
  Target: ATXN1; (-) strand; PAM type: NRG; PAM sequence: AGG
ctgcgttgctaactaaagga

SEQ ID NO: 51823 - DNA, 20 bp, Artificial Sequence
  Description of Artificial Sequence: Synthetic oligonucleotide
  Target: ATXN1; (-) strand; PAM type: NRG; PAM sequence: AAG
gctgcgttgctaactaaagg

SEQ ID NO: 51824 - DNA, 20 bp, Artificial Sequence
  Description of Artificial Sequence: Synthetic oligonucleotide
  Target: ATXN1; (-) strand; PAM type: NRG; PAM sequence: AGG
ttggctgcgttgctaactaa

SEQ ID NO: 51825 - DNA, 20 bp, Artificial Sequence
  Description of Artificial Sequence: Synthetic oligonucleotide
  Target: ATXN1; (-) strand; PAM type: NRG; PAM sequence: AAG
gttggctgcgttgctaacta

SEQ ID NO: 51826 - DNA, 20 bp, Artificial Sequence
  Description of Artificial Sequence: Synthetic oligonucleotide
  Target: ATXN1; (-) strand; PAM type: NRG; PAM sequence: TGG
agatgtgggtgcctcaaagt

SEQ ID NO: 51827 - DNA, 20 bp, Artificial Sequence
  Description of Artificial Sequence: Synthetic oligonucleotide
  Target: ATXN1; (-) strand; PAM type: NRG; PAM sequence: AAG
acgtagatgtgggtgcctca

SEQ ID NO: 51828 - DNA, 20 bp, Artificial Sequence
  Description of Artificial Sequence: Synthetic oligonucleotide
  Target: ATXN1; (-) strand; PAM type: NRG; PAM sequence: GGG
gtatttgtaaacgtagatgt

SEQ ID NO: 51829 - DNA, 20 bp, Artificial Sequence
  Description of Artificial Sequence: Synthetic oligonucleotide
  Target: ATXN1; (-) strand; PAM type: NRG; PAM sequence: TGG
cgtatttgtaaacgtagatg

SEQ ID NO: 51830 - DNA, 20 bp, Artificial Sequence
  Description of Artificial Sequence: Synthetic oligonucleotide
  Target: ATXN1; (-) strand; PAM type: NRG; PAM sequence: TAG
ggagttcgtatttgtaaacg

SEQ ID NO: 51831 - DNA, 20 bp, Artificial Sequence
  Description of Artificial Sequence: Synthetic oligonucleotide
  Target: ATXN1; (-) strand; PAM type: NRG; PAM sequence: GAG
ggaagggagcttagatggtg

SEQ ID NO: 51832 - DNA, 20 bp, Artificial Sequence
  Description of Artificial Sequence: Synthetic oligonucleotide
  Target: ATXN1; (-) strand; PAM type: NRG; PAM sequence: TGG
caggaagggagcttagatgg

SEQ ID NO: 51833 - DNA, 20 bp, Artificial Sequence
  Description of Artificial Sequence: Synthetic oligonucleotide
  Target: ATXN1; (-) strand; PAM type: NRG; PAM sequence: TGG
gggcaggaagggagcttaga

SEQ ID NO: 51834 - DNA, 20 bp, Artificial Sequence
  Description of Artificial Sequence: Synthetic oligonucleotide
  Target: ATXN1; (-) strand; PAM type: NRG; PAM sequence: TAG
ctttgggcaggaagggagct

SEQ ID NO: 51835 - DNA, 20 bp, Artificial Sequence
  Description of Artificial Sequence: Synthetic oligonucleotide
  Target: ATXN1; (-) strand; PAM type: NRG; PAM sequence: GAG
tctgcctttgggcaggaagg

SEQ ID NO: 51836 - DNA, 20 bp, Artificial Sequence
  Description of Artificial Sequence: Synthetic oligonucleotide
  Target: ATXN1; (-) strand; PAM type: NRG; PAM sequence: GGG
tttctgcctttgggcaggaa

SEQ ID NO: 51837 - DNA, 20 bp, Artificial Sequence
  Description of Artificial Sequence: Synthetic oligonucleotide
  Target: ATXN1; (-) strand; PAM type: NRG; PAM sequence: AGG
atttctgcctttgggcagga

SEQ ID NO: 51838 - DNA, 20 bp, Artificial Sequence
  Description of Artificial Sequence: Synthetic oligonucleotide
  Target: ATXN1; (-) strand; PAM type: NRG; PAM sequence: AAG
aatttctgcctttgggcagg

SEQ ID NO: 51839 - DNA, 20 bp, Artificial Sequence
  Description of Artificial Sequence: Synthetic oligonucleotide
  Target: ATXN1; (-) strand; PAM type: NRG; PAM sequence: AGG
tgtaatttctgcctttgggc

SEQ ID NO: 51840 - DNA, 20 bp, Artificial Sequence
  Description of Artificial Sequence: Synthetic oligonucleotide
  Target: ATXN1; (-) strand; PAM type: NRG; PAM sequence: CAG
atgtaatttctgcctttggg

SEQ ID NO: 51841 - DNA, 20 bp, Artificial Sequence
  Description of Artificial Sequence: Synthetic oligonucleotide
  Target: ATXN1; (-) strand; PAM type: NRG; PAM sequence: GGG
gggatgtaatttctgccttt

SEQ ID NO: 51842 - DNA, 20 bp, Artificial Sequence
  Description of Artificial Sequence: Synthetic oligonucleotide
  Target: ATXN1; (-) strand; PAM type: NRG; PAM sequence: TGG
ggggatgtaatttctgcctt

SEQ ID NO: 51843 - DNA, 20 bp, Artificial Sequence
  Description of Artificial Sequence: Synthetic oligonucleotide
  Target: ATXN1; (-) strand; PAM type: NRG; PAM sequence: GGG
tctaagacgttgcagcagtg

SEQ ID NO: 51844 - DNA, 20 bp, Artificial Sequence
  Description of Artificial Sequence: Synthetic oligonucleotide
  Target: ATXN1; (-) strand; PAM type: NRG; PAM sequence: GGG
atctaagacgttgcagcagt

SEQ ID NO: 51845 - DNA, 20 bp, Artificial Sequence
  Description of Artificial Sequence: Synthetic oligonucleotide
  Target: ATXN1; (-) strand; PAM type: NRG; PAM sequence: TGG
tatctaagacgttgcagcag

SEQ ID NO: 51846 - DNA, 20 bp, Artificial Sequence
  Description of Artificial Sequence: Synthetic oligonucleotide
  Target: ATXN1; (-) strand; PAM type: NRG; PAM sequence: CAG
atttatctaagacgttgcag

SEQ ID NO: 51847 - DNA, 20 bp, Artificial Sequence
  Description of Artificial Sequence: Synthetic oligonucleotide
  Target: ATXN1; (-) strand; PAM type: NRG; PAM sequence: CAG
ttgatttatctaagacgttg

SEQ ID NO: 51848 - DNA, 20 bp, Artificial Sequence
  Description of Artificial Sequence: Synthetic oligonucleotide
  Target: ATXN1; (-) strand; PAM type: NRG; PAM sequence: AAG
tgtttgcatttgatttatct

SEQ ID NO: 51849 - DNA, 20 bp, Artificial Sequence
  Description of Artificial Sequence: Synthetic oligonucleotide
  Target: ATXN1; (-) strand; PAM type: NRG; PAM sequence: AAG
atctttaggaattcaggtgg

SEQ ID NO: 51850 - DNA, 20 bp, Artificial Sequence
  Description of Artificial Sequence: Synthetic oligonucleotide
  Target: ATXN1; (-) strand; PAM type: NRG; PAM sequence: TGG
gacatctttaggaattcagg

SEQ ID NO: 51851 - DNA, 20 bp, Artificial Sequence
  Description of Artificial Sequence: Synthetic oligonucleotide
  Target: ATXN1; (-) strand; PAM type: NRG; PAM sequence: AGG
taggacatctttaggaattc

SEQ ID NO: 51852 - DNA, 20 bp, Artificial Sequence
  Description of Artificial Sequence: Synthetic oligonucleotide
  Target: ATXN1; (-) strand; PAM type: NRG; PAM sequence: CAG
ctaggacatctttaggaatt

SEQ ID NO: 51853 - DNA, 20 bp, Artificial Sequence
  Description of Artificial Sequence: Synthetic oligonucleotide
  Target: ATXN1; (-) strand; PAM type: NRG; PAM sequence: AGG
cacctgcctaggacatcttt

SEQ ID NO: 51854 - DNA, 20 bp, Artificial Sequence
  Description of Artificial Sequence: Synthetic oligonucleotide
  Target: ATXN1; (-) strand; PAM type: NRG; PAM sequence: TAG
ccacctgcctaggacatctt

SEQ ID NO: 51855 - DNA, 20 bp, Artificial Sequence
  Description of Artificial Sequence: Synthetic oligonucleotide
  Target: ATXN1; (-) strand; PAM type: NRG; PAM sequence: AGG
ctaatgatgcccacctgcct

SEQ ID NO: 51856 - DNA, 20 bp, Artificial Sequence
  Description of Artificial Sequence: Synthetic oligonucleotide
  Target: ATXN1; (-) strand; PAM type: NRG; PAM sequence: TAG
cctaatgatgcccacctgcc

SEQ ID NO: 51857 - DNA, 20 bp, Artificial Sequence
  Description of Artificial Sequence: Synthetic oligonucleotide
  Target: ATXN1; (-) strand; PAM type: NRG; PAM sequence: AAG
gtttgaataacttagacaca

SEQ ID NO: 51858 - DNA, 20 bp, Artificial Sequence
  Description of Artificial Sequence: Synthetic oligonucleotide
  Target: ATXN1; (-) strand; PAM type: NRG; PAM sequence: TAG
ctctttgggtttgaataact

SEQ ID NO: 51859 - DNA, 20 bp, Artificial Sequence
  Description of Artificial Sequence: Synthetic oligonucleotide
  Target: ATXN1; (-) strand; PAM type: NRG; PAM sequence: GGG
gatgccttaggcttctcttt

SEQ ID NO: 51860 - DNA, 20 bp, Artificial Sequence
  Description of Artificial Sequence: Synthetic oligonucleotide
  Target: ATXN1; (-) strand; PAM type: NRG; PAM sequence: TGG
agatgccttaggcttctctt

SEQ ID NO: 51861 - DNA, 20 bp, Artificial Sequence
  Description of Artificial Sequence: Synthetic oligonucleotide
  Target: ATXN1; (-) strand; PAM type: NRG; PAM sequence: AGG
gaatttaaattagatgcctt

SEQ ID NO: 51862 - DNA, 20 bp, Artificial Sequence
  Description of Artificial Sequence: Synthetic oligonucleotide
  Target: ATXN1; (-) strand; PAM type: NRG; PAM sequence: TAG
tgaatttaaattagatgcct

SEQ ID NO: 51863 - DNA, 20 bp, Artificial Sequence
  Description of Artificial Sequence: Synthetic oligonucleotide
  Target: ATXN1; (-) strand; PAM type: NRG; PAM sequence: TAG
acttctatttgaatttaaat

SEQ ID NO: 51864 - DNA, 20 bp, Artificial Sequence
  Description of Artificial Sequence: Synthetic oligonucleotide
  Target: ATXN1; (-) strand; PAM type: NRG; PAM sequence: TGG
caccattaagtgcaagaact

SEQ ID NO: 51865 - DNA, 20 bp, Artificial Sequence
  Description of Artificial Sequence: Synthetic oligonucleotide
  Target: ATXN1; (-) strand; PAM type: NRG; PAM sequence: AAG
ttattttcaccattaagtgc

SEQ ID NO: 51866 - DNA, 20 bp, Artificial Sequence
  Description of Artificial Sequence: Synthetic oligonucleotide
  Target: ATXN1; (-) strand; PAM type: NRG; PAM sequence: AAG
tatatattattttcaccatt

SEQ ID NO: 51867 - DNA, 20 bp, Artificial Sequence
  Description of Artificial Sequence: Synthetic oligonucleotide
  Target: ATXN1; (-) strand; PAM type: NRG; PAM sequence: TAG
cgtgtatatgtgtatgtata

SEQ ID NO: 51868 - DNA, 20 bp, Artificial Sequence
  Description of Artificial Sequence: Synthetic oligonucleotide
  Target: ATXN1; (-) strand; PAM type: NRG; PAM sequence: GAG
catatgtatgtgtatataga

SEQ ID NO: 51869 - DNA, 20 bp, Artificial Sequence
  Description of Artificial Sequence: Synthetic oligonucleotide
  Target: ATXN1; (-) strand; PAM type: NRG; PAM sequence: GAG
tgcatatgtatgtgtatata

SEQ ID NO: 51870 - DNA, 20 bp, Artificial Sequence
  Description of Artificial Sequence: Synthetic oligonucleotide
  Target: ATXN1; (-) strand; PAM type: NRG; PAM sequence: TAG
tgtgcatatgtatgtgtata

SEQ ID NO: 51871 - DNA, 20 bp, Artificial Sequence
  Description of Artificial Sequence: Synthetic oligonucleotide
  Target: ATXN1; (-) strand; PAM type: NRG; PAM sequence: TAG
ggaggaggcgaaaaacaaac

SEQ ID NO: 51872 - DNA, 20 bp, Artificial Sequence
  Description of Artificial Sequence: Synthetic oligonucleotide
  Target: ATXN1; (-) strand; PAM type: NRG; PAM sequence: AGG
tgctgtataactcctggagg

SEQ ID NO: 51873 - DNA, 20 bp, Artificial Sequence
  Description of Artificial Sequence: Synthetic oligonucleotide
  Target: ATXN1; (-) strand; PAM type: NRG; PAM sequence: GAG
ttgctgtataactcctggag

SEQ ID NO: 51874 - DNA, 20 bp, Artificial Sequence
  Description of Artificial Sequence: Synthetic oligonucleotide
  Target: ATXN1; (-) strand; PAM type: NRG; PAM sequence: AGG
ttttgctgtataactcctgg

SEQ ID NO: 51875 - DNA, 20 bp, Artificial Sequence
  Description of Artificial Sequence: Synthetic oligonucleotide
  Target: ATXN1; (-) strand; PAM type: NRG; PAM sequence: GAG
tttttgctgtataactcctg

SEQ ID NO: 51876 - DNA, 20 bp, Artificial Sequence
  Description of Artificial Sequence: Synthetic oligonucleotide
  Target: ATXN1; (-) strand; PAM type: NRG; PAM sequence: TGG
cttttttgctgtataactcc

SEQ ID NO: 51877 - DNA, 20 bp, Artificial Sequence
  Description of Artificial Sequence: Synthetic oligonucleotide
  Target: ATXN1; (-) strand; PAM type: NRG; PAM sequence: GGG
tacatatctgataaaaggca

SEQ ID NO: 51878 - DNA, 20 bp, Artificial Sequence
  Description of Artificial Sequence: Synthetic oligonucleotide
  Target: ATXN1; (-) strand; PAM type: NRG; PAM sequence: AGG
gtacatatctgataaaaggc

SEQ ID NO: 51879 - DNA, 20 bp, Artificial Sequence
  Description of Artificial Sequence: Synthetic oligonucleotide
  Target: ATXN1; (-) strand; PAM type: NRG; PAM sequence: CAG
tgtacatatctgataaaagg

SEQ ID NO: 51880 - DNA, 20 bp, Artificial Sequence
  Description of Artificial Sequence: Synthetic oligonucleotide
  Target: ATXN1; (-) strand; PAM type: NRG; PAM sequence: AGG
atgtgtacatatctgataaa

SEQ ID NO: 51881 - DNA, 20 bp, Artificial Sequence
  Description of Artificial Sequence: Synthetic oligonucleotide
  Target: ATXN1; (-) strand; PAM type: NRG; PAM sequence: AAG
aatgtgtacatatctgataa

SEQ ID NO: 51882 - DNA, 20 bp, Artificial Sequence
  Description of Artificial Sequence: Synthetic oligonucleotide
  Target: ATXN1; (-) strand; PAM type: NRG; PAM sequence: AGG
atcattttagacatattgca

SEQ ID NO: 51883 - DNA, 20 bp, Artificial Sequence
  Description of Artificial Sequence: Synthetic oligonucleotide
  Target: ATXN1; (-) strand; PAM type: NRG; PAM sequence: AAG
aatcattttagacatattgc

SEQ ID NO: 51884 - DNA, 20 bp, Artificial Sequence
  Description of Artificial Sequence: Synthetic oligonucleotide
  Target: ATXN1; (-) strand; PAM type: NRG; PAM sequence: TAG
atttagtcataaaatcattt

SEQ ID NO: 51885 - DNA, 20 bp, Artificial Sequence
  Description of Artificial Sequence: Synthetic oligonucleotide
  Target: ATXN1; (-) strand; PAM type: NRG; PAM sequence: TAG
ttcacatttttcccaggatt

SEQ ID NO: 51886 - DNA, 20 bp, Artificial Sequence
  Description of Artificial Sequence: Synthetic oligonucleotide
  Target: ATXN1; (-) strand; PAM type: NRG; PAM sequence: AGG
gcattcttcacatttttccc

SEQ ID NO: 51887 - DNA, 20 bp, Artificial Sequence
  Description of Artificial Sequence: Synthetic oligonucleotide
  Target: ATXN1; (-) strand; PAM type: NRG; PAM sequence: CAG
agcattcttcacatttttcc

SEQ ID NO: 51888 - DNA, 20 bp, Artificial Sequence
  Description of Artificial Sequence: Synthetic oligonucleotide
  Target: ATXN1; (-) strand; PAM type: NRG; PAM sequence: AAG
gaaaagcttgccatctagcc

SEQ ID NO: 51889 - DNA, 20 bp, Artificial Sequence
  Description of Artificial Sequence: Synthetic oligonucleotide
  Target: ATXN1; (-) strand; PAM type: NRG; PAM sequence: TAG
tactggaaaagcttgccatc

SEQ ID NO: 51890 - DNA, 20 bp, Artificial Sequence
  Description of Artificial Sequence: Synthetic oligonucleotide
  Target: ATXN1; (-) strand; PAM type: NRG; PAM sequence: AAG
gtgttgtgtttttactggaa

SEQ ID NO: 51891 - DNA, 20 bp, Artificial Sequence
  Description of Artificial Sequence: Synthetic oligonucleotide
  Target: ATXN1; (-) strand; PAM type: NRG; PAM sequence: TGG
aagcagtgttgtgtttttac

SEQ ID NO: 51892 - DNA, 20 bp, Artificial Sequence
  Description of Artificial Sequence: Synthetic oligonucleotide
  Target: ATXN1; (-) strand; PAM type: NRG; PAM sequence: CAG
caagtgctacaattcataag

SEQ ID NO: 51893 - DNA, 20 bp, Artificial Sequence
  Description of Artificial Sequence: Synthetic oligonucleotide
  Target: ATXN1; (-) strand; PAM type: NRG; PAM sequence: AAG
ctccaagtgctacaattcat

SEQ ID NO: 51894 - DNA, 20 bp, Artificial Sequence
  Description of Artificial Sequence: Synthetic oligonucleotide
  Target: ATXN1; (-) strand; PAM type: NRG; PAM sequence: AAG
catgttgaaaagtcttctcc

SEQ ID NO: 51895 - DNA, 20 bp, Artificial Sequence
  Description of Artificial Sequence: Synthetic oligonucleotide
  Target: ATXN1; (-) strand; PAM type: NRG; PAM sequence: AAG
aaaatgtacatcatgttgaa

SEQ ID NO: 51896 - DNA, 20 bp, Artificial Sequence
  Description of Artificial Sequence: Synthetic oligonucleotide
  Target: ATXN1; (-) strand; PAM type: NRG; PAM sequence: GAG
caggatttagtctcaagcta

SEQ ID NO: 51897 - DNA, 20 bp, Artificial Sequence
  Description of Artificial Sequence: Synthetic oligonucleotide
  Target: ATXN1; (-) strand; PAM type: NRG; PAM sequence: TAG
aacaggatttagtctcaagc

SEQ ID NO: 51898 - DNA, 20 bp, Artificial Sequence
  Description of Artificial Sequence: Synthetic oligonucleotide
  Target: ATXN1; (-) strand; PAM type: NRG; PAM sequence: AAG
tccaaacaggatttagtctc

SEQ ID NO: 51899 - DNA, 20 bp, Artificial Sequence
  Description of Artificial Sequence: Synthetic oligonucleotide
  Target: ATXN1; (-) strand; PAM type: NRG; PAM sequence: TAG
acctacctccaaacaggatt

SEQ ID NO: 51900 - DNA, 20 bp, Artificial Sequence
  Description of Artificial Sequence: Synthetic oligonucleotide
  Target: ATXN1; (-) strand; PAM type: NRG; PAM sequence: AGG
aagaaaacctacctccaaac

SEQ ID NO: 51901 - DNA, 20 bp, Artificial Sequence
  Description of Artificial Sequence: Synthetic oligonucleotide
  Target: ATXN1; (-) strand; PAM type: NRG; PAM sequence: CAG
aaagaaaacctacctccaaa

SEQ ID NO: 51902 - DNA, 20 bp, Artificial Sequence
  Description of Artificial Sequence: Synthetic oligonucleotide
  Target: ATXN1; (-) strand; PAM type: NRG; PAM sequence: AAG
tcaactttttctgaaagcca

SEQ ID NO: 51903 - DNA, 20 bp, Artificial Sequence
  Description of Artificial Sequence: Synthetic oligonucleotide
  Target: ATXN1; (-) strand; PAM type: NRG; PAM sequence: AAG
atcggttcaactttttctga

SEQ ID NO: 51904 - DNA, 20 bp, Artificial Sequence
  Description of Artificial Sequence: Synthetic oligonucleotide
  Target: ATXN1; (-) strand; PAM type: NRG; PAM sequence: CGG
aaagacccatgttgtacaat

SEQ ID NO: 51905 - DNA, 20 bp, Artificial Sequence
  Description of Artificial Sequence: Synthetic oligonucleotide
  Target: ATXN1; (-) strand; PAM type: NRG; PAM sequence: AAG
agtccacgttggagggccca

SEQ ID NO: 51906 - DNA, 20 bp, Artificial Sequence
  Description of Artificial Sequence: Synthetic oligonucleotide
  Target: ATXN1; (-) strand; PAM type: NRG; PAM sequence: GGG
catggtgagtccacgttgga

SEQ ID NO: 51907 - DNA, 20 bp, Artificial Sequence
  Description of Artificial Sequence: Synthetic oligonucleotide
  Target: ATXN1; (-) strand; PAM type: NRG; PAM sequence: AGG
tcatggtgagtccacgttgg

SEQ ID NO: 51908 - DNA, 20 bp, Artificial Sequence
  Description of Artificial Sequence: Synthetic oligonucleotide
  Target: ATXN1; (-) strand; PAM type: NRG; PAM sequence: GAG
ctcatggtgagtccacgttg

SEQ ID NO: 51909 - DNA, 20 bp, Artificial Sequence
  Description of Artificial Sequence: Synthetic oligonucleotide
  Target: ATXN1; (-) strand; PAM type: NRG; PAM sequence: TGG
ctctcatggtgagtccacgt

SEQ ID NO: 51910 - DNA, 20 bp, Artificial Sequence
  Description of Artificial Sequence: Synthetic oligonucleotide
  Target: ATXN1; (-) strand; PAM type: NRG; PAM sequence: GAG
cacgatcgtcctctcatggt

SEQ ID NO: 51911 - DNA, 20 bp, Artificial Sequence
  Description of Artificial Sequence: Synthetic oligonucleotide
  Target: ATXN1; (-) strand; PAM type: NRG; PAM sequence: TGG
agcacacgatcgtcctctca

SEQ ID NO: 51912 - DNA, 20 bp, Artificial Sequence
  Description of Artificial Sequence: Synthetic oligonucleotide
  Target: ATXN1; (-) strand; PAM type: NRG; PAM sequence: TAG
cggaggcatgtttaatggaa

SEQ ID NO: 51913 - DNA, 20 bp, Artificial Sequence
  Description of Artificial Sequence: Synthetic oligonucleotide
  Target: ATXN1; (-) strand; PAM type: NRG; PAM sequence: TGG
tgagacggaggcatgtttaa

SEQ ID NO: 51914 - DNA, 20 bp, Artificial Sequence
  Description of Artificial Sequence: Synthetic oligonucleotide
  Target: ATXN1; (-) strand; PAM type: NRG; PAM sequence: AGG
tggctggagtcgtgagacgg

SEQ ID NO: 51915 - DNA, 20 bp, Artificial Sequence
  Description of Artificial Sequence: Synthetic oligonucleotide
  Target: ATXN1; (-) strand; PAM type: NRG; PAM sequence: GAG
ctggctggagtcgtgagacg

SEQ ID NO: 51916 - DNA, 20 bp, Artificial Sequence
  Description of Artificial Sequence: Synthetic oligonucleotide
  Target: ATXN1; (-) strand; PAM type: NRG; PAM sequence: CGG
ccctggctggagtcgtgaga

SEQ ID NO: 51917 - DNA, 20 bp, Artificial Sequence
  Description of Artificial Sequence: Synthetic oligonucleotide
  Target: ATXN1; (-) strand; PAM type: NRG; PAM sequence: GAG
ttaaccctggctggagtcgt

SEQ ID NO: 51918 - DNA, 20 bp, Artificial Sequence
  Description of Artificial Sequence: Synthetic oligonucleotide
  Target: ATXN1; (-) strand; PAM type: NRG; PAM sequence: GAG
gaaggttttaaccctggctg

SEQ ID NO: 51919 - DNA, 20 bp, Artificial Sequence
  Description of Artificial Sequence: Synthetic oligonucleotide
  Target: ATXN1; (-) strand; PAM type: NRG; PAM sequence: TGG
ctgaaggttttaaccctggc

SEQ ID NO: 51920 - DNA, 20 bp, Artificial Sequence
  Description of Artificial Sequence: Synthetic oligonucleotide
  Target: ATXN1; (-) strand; PAM type: NRG; PAM sequence: TGG
acatctgaaggttttaaccc

SEQ ID NO: 51921 - DNA, 20 bp, Artificial Sequence
  Description of Artificial Sequence: Synthetic oligonucleotide
  Target: ATXN1; (-) strand; PAM type: NRG; PAM sequence: AGG
tgtgttgagaaaacatctga

SEQ ID NO: 51922 - DNA, 20 bp, Artificial Sequence
  Description of Artificial Sequence: Synthetic oligonucleotide
  Target: ATXN1; (-) strand; PAM type: NRG; PAM sequence: AAG
atgtgttgagaaaacatctg

SEQ ID NO: 51923 - DNA, 20 bp, Artificial Sequence
  Description of Artificial Sequence: Synthetic oligonucleotide
  Target: ATXN1; (-) strand; PAM type: NRG; PAM sequence: GAG
ttagttctgcttaatgtgtt

SEQ ID NO: 51924 - DNA, 20 bp, Artificial Sequence
  Description of Artificial Sequence: Synthetic oligonucleotide
  Target: ATXN1; (-) strand; PAM type: NRG; PAM sequence: TAG
gtttttgcctttgtgatggt

SEQ ID NO: 51925 - DNA, 20 bp, Artificial Sequence
  Description of Artificial Sequence: Synthetic oligonucleotide
  Target: ATXN1; (-) strand; PAM type: NRG; PAM sequence: TGG
tttagtttttgcctttgtga

SEQ ID NO: 51926 - DNA, 20 bp, Artificial Sequence
  Description of Artificial Sequence: Synthetic oligonucleotide
  Target: ATXN1; (-) strand; PAM type: NRG; PAM sequence: TAG
gacaaggggacagatgggtt

SEQ ID NO: 51927 - DNA, 20 bp, Artificial Sequence
  Description of Artificial Sequence: Synthetic oligonucleotide
  Target: ATXN1; (-) strand; PAM type: NRG; PAM sequence: GGG
atcctgacaaggggacagat

SEQ ID NO: 51928 - DNA, 20 bp, Artificial Sequence
  Description of Artificial Sequence: Synthetic oligonucleotide
  Target: ATXN1; (-) strand; PAM type: NRG; PAM sequence: TGG
aatcctgacaaggggacaga

SEQ ID NO: 51929 - DNA, 20 bp, Artificial Sequence
  Description of Artificial Sequence: Synthetic oligonucleotide
  Target: ATXN1; (-) strand; PAM type: NRG; PAM sequence: CAG
caaaaatcctgacaagggga

SEQ ID NO: 51930 - DNA, 20 bp, Artificial Sequence
  Description of Artificial Sequence: Synthetic oligonucleotide
  Target: ATXN1; (-) strand; PAM type: NRG; PAM sequence: GGG
atctcaaaaatcctgacaag

SEQ ID NO: 51931 - DNA, 20 bp, Artificial Sequence
  Description of Artificial Sequence: Synthetic oligonucleotide
  Target: ATXN1; (-) strand; PAM type: NRG; PAM sequence: GGG
aatctcaaaaatcctgacaa

SEQ ID NO: 51932 - DNA, 20 bp, Artificial Sequence
  Description of Artificial Sequence: Synthetic oligonucleotide
  Target: ATXN1; (-) strand; PAM type: NRG; PAM sequence: AGG
caatctcaaaaatcctgaca

SEQ ID NO: 51933 - DNA, 20 bp, Artificial Sequence
  Description of Artificial Sequence: Synthetic oligonucleotide
  Target: ATXN1; (-) strand; PAM type: NRG; PAM sequence: AAG
acaatctcaaaaatcctgac

SEQ ID NO: 51934 - DNA, 20 bp, Artificial Sequence
  Description of Artificial Sequence: Synthetic oligonucleotide
  Target: ATXN1; (-) strand; PAM type: NRG; PAM sequence: CAG
atgttttccagccacaaggt

SEQ ID NO: 51935 - DNA, 20 bp, Artificial Sequence
  Description of Artificial Sequence: Synthetic oligonucleotide
  Target: ATXN1; (-) strand; PAM type: NRG; PAM sequence: AGG
caaaatgttttccagccaca

SEQ ID NO: 51936 - DNA, 20 bp, Artificial Sequence
  Description of Artificial Sequence: Synthetic oligonucleotide
  Target: ATXN1; (-) strand; PAM type: NRG; PAM sequence: AAG
ccaaaatgttttccagccac

SEQ ID NO: 51937 - DNA, 20 bp, Artificial Sequence
  Description of Artificial Sequence: Synthetic oligonucleotide
  Target: ATXN1; (-) strand; PAM type: NRG; PAM sequence: CAG
acggcctccaaaatgttttc

SEQ ID NO: 51938 - DNA, 20 bp, Artificial Sequence
  Description of Artificial Sequence: Synthetic oligonucleotide
  Target: ATXN1; (-) strand; PAM type: NRG; PAM sequence: CGG
cacatttaacttttgttaca

SEQ ID NO: 51939 - DNA, 20 bp, Artificial Sequence
  Description of Artificial Sequence: Synthetic oligonucleotide
  Target: ATXN1; (-) strand; PAM type: NRG; PAM sequence: AAG
gtaattcactagtgacctct

SEQ ID NO: 51940 - DNA, 20 bp, Artificial Sequence
  Description of Artificial Sequence: Synthetic oligonucleotide
  Target: ATXN1; (-) strand; PAM type: NRG; PAM sequence: TAG
taatggtgttagtaattcac

SEQ ID NO: 51941 - DNA, 20 bp, Artificial Sequence
  Description of Artificial Sequence: Synthetic oligonucleotide
  Target: ATXN1; (-) strand; PAM type: NRG; PAM sequence: TAG
tcttgccagggtaatggtgt

SEQ ID NO: 51942 - DNA, 20 bp, Artificial Sequence
  Description of Artificial Sequence: Synthetic oligonucleotide
  Target: ATXN1; (-) strand; PAM type: NRG; PAM sequence: TGG
atcatctcttgccagggtaa

SEQ ID NO: 51943 - DNA, 20 bp, Artificial Sequence
  Description of Artificial Sequence: Synthetic oligonucleotide
  Target: ATXN1; (-) strand; PAM type: NRG; PAM sequence: GGG
aactccatcatctcttgcca

SEQ ID NO: 51944 - DNA, 20 bp, Artificial Sequence
  Description of Artificial Sequence: Synthetic oligonucleotide
  Target: ATXN1; (-) strand; PAM type: NRG; PAM sequence: AGG
aaactccatcatctcttgcc

SEQ ID NO: 51945 - DNA, 20 bp, Artificial Sequence
  Description of Artificial Sequence: Synthetic oligonucleotide
  Target: ATXN1; (-) strand; PAM type: NRG; PAM sequence: CAG
gaaactccatcatctcttgc

SEQ ID NO: 51946 - DNA, 20 bp, Artificial Sequence
  Description of Artificial Sequence: Synthetic oligonucleotide
  Target: ATXN1; (-) strand; PAM type: NRG; PAM sequence: TGG
accaaacctctgagataaaa

SEQ ID NO: 51947 - DNA, 20 bp, Artificial Sequence
  Description of Artificial Sequence: Synthetic oligonucleotide
  Target: ATXN1; (-) strand; PAM type: NRG; PAM sequence: GAG
catacacccaccaaacctct

SEQ ID NO: 51948 - DNA, 20 bp, Artificial Sequence
  Description of Artificial Sequence: Synthetic oligonucleotide
  Target: ATXN1; (-) strand; PAM type: NRG; PAM sequence: AAG
acgtagcctaacgtcatttt

SEQ ID NO: 51949 - DNA, 20 bp, Artificial Sequence
  Description of Artificial Sequence: Synthetic oligonucleotide
  Target: ATXN1; (-) strand; PAM type: NRG; PAM sequence: TAG
ccaagaaagtgttggctacg

SEQ ID NO: 51950 - DNA, 20 bp, Artificial Sequence
  Description of Artificial Sequence: Synthetic oligonucleotide
  Target: ATXN1; (-) strand; PAM type: NRG; PAM sequence: TGG
agtcctttccaagaaagtgt

SEQ ID NO: 51951 - DNA, 20 bp, Artificial Sequence
  Description of Artificial Sequence: Synthetic oligonucleotide
  Target: ATXN1; (-) strand; PAM type: NRG; PAM sequence: AAG
agggaaagtcctttccaaga

SEQ ID NO: 51952 - DNA, 20 bp, Artificial Sequence
  Description of Artificial Sequence: Synthetic oligonucleotide
  Target: ATXN1; (-) strand; PAM type: NRG; PAM sequence: AAG
cagcagggaaagtcctttcc

SEQ ID NO: 51953 - DNA, 20 bp, Artificial Sequence
  Description of Artificial Sequence: Synthetic oligonucleotide
  Target: ATXN1; (-) strand; PAM type: NRG; PAM sequence: AAG
ttttaatagaacagcaggga

SEQ ID NO: 51954 - DNA, 20 bp, Artificial Sequence
  Description of Artificial Sequence: Synthetic oligonucleotide
  Target: ATXN1; (-) strand; PAM type: NRG; PAM sequence: GGG
acagttttaatagaacagca

SEQ ID NO: 51955 - DNA, 20 bp, Artificial Sequence
  Description of Artificial Sequence: Synthetic oligonucleotide
  Target: ATXN1; (-) strand; PAM type: NRG; PAM sequence: AGG
gacagttttaatagaacagc

SEQ ID NO: 51956 - DNA, 20 bp, Artificial Sequence
  Description of Artificial Sequence: Synthetic oligonucleotide
  Target: ATXN1; (-) strand; PAM type: NRG; PAM sequence: CAG
tgacagttttaatagaacag

SEQ ID NO: 51957 - DNA, 20 bp, Artificial Sequence
  Description of Artificial Sequence: Synthetic oligonucleotide
  Target: ATXN1; (-) strand; PAM type: NRG; PAM sequence: CAG
tgctgacagttttaatagaa

SEQ ID NO: 51958 - DNA, 20 bp, Artificial Sequence
  Description of Artificial Sequence: Synthetic oligonucleotide
  Target: ATXN1; (-) strand; PAM type: NRG; PAM sequence: TAG
ctatttgctgacagttttaa

SEQ ID NO: 51959 - DNA, 20 bp, Artificial Sequence
  Description of Artificial Sequence: Synthetic oligonucleotide
  Target: ATXN1; (-) strand; PAM type: NRG; PAM sequence: CAG
gccttggccctatttgctga

SEQ ID NO: 51960 - DNA, 20 bp, Artificial Sequence
  Description of Artificial Sequence: Synthetic oligonucleotide
  Target: ATXN1; (-) strand; PAM type: NRG; PAM sequence: TGG
gcatagaccagtgagcgcct

SEQ ID NO: 51961 - DNA, 20 bp, Artificial Sequence
  Description of Artificial Sequence: Synthetic oligonucleotide
  Target: ATXN1; (-) strand; PAM type: NRG; PAM sequence: GAG
tgtcctcggcatagaccagt

SEQ ID NO: 51962 - DNA, 20 bp, Artificial Sequence
  Description of Artificial Sequence: Synthetic oligonucleotide
  Target: ATXN1; (-) strand; PAM type: NRG; PAM sequence: CAG
aaggtgtcctcggcatagac

SEQ ID NO: 51963 - DNA, 20 bp, Artificial Sequence
  Description of Artificial Sequence: Synthetic oligonucleotide
  Target: ATXN1; (-) strand; PAM type: NRG; PAM sequence: TAG
actttaaggtgtcctcggca

SEQ ID NO: 51964 - DNA, 20 bp, Artificial Sequence
  Description of Artificial Sequence: Synthetic oligonucleotide
  Target: ATXN1; (-) strand; PAM type: NRG; PAM sequence: CGG
tgattactttaaggtgtcct

SEQ ID NO: 51965 - DNA, 20 bp, Artificial Sequence
  Description of Artificial Sequence: Synthetic oligonucleotide
  Target: ATXN1; (-) strand; PAM type: NRG; PAM sequence: AGG
ttgacggcctgattacttta

SEQ ID NO: 51966 - DNA, 20 bp, Artificial Sequence
  Description of Artificial Sequence: Synthetic oligonucleotide
  Target: ATXN1; (-) strand; PAM type: NRG; PAM sequence: AAG
tttgacggcctgattacttt

SEQ ID NO: 51967 - DNA, 20 bp, Artificial Sequence
  Description of Artificial Sequence: Synthetic oligonucleotide
  Target: ATXN1; (-) strand; PAM type: NRG; PAM sequence: CGG
aagtgtttgcctttatttga

SEQ ID NO: 51968 - DNA, 20 bp, Artificial Sequence
  Description of Artificial Sequence: Synthetic oligonucleotide
  Target: ATXN1; (-) strand; PAM type: NRG; PAM sequence: AAG
tgtctttagaaatgttgaga

SEQ ID NO: 51969 - DNA, 20 bp, Artificial Sequence
  Description of Artificial Sequence: Synthetic oligonucleotide
  Target: ATXN1; (-) strand; PAM type: NRG; PAM sequence: GAG
tttctgtctttagaaatgtt

SEQ ID NO: 51970 - DNA, 20 bp, Artificial Sequence
  Description of Artificial Sequence: Synthetic oligonucleotide
  Target: ATXN1; (-) strand; PAM type: NRG; PAM sequence: TAG
cttttcgctatttctgtctt

SEQ ID NO: 51971 - DNA, 20 bp, Artificial Sequence
  Description of Artificial Sequence: Synthetic oligonucleotide
  Target: ATXN1; (-) strand; PAM type: NRG; PAM sequence: TGG
tgacttaagtctgatatgct

SEQ ID NO: 51972 - DNA, 20 bp, Artificial Sequence
  Description of Artificial Sequence: Synthetic oligonucleotide
  Target: ATXN1; (-) strand; PAM type: NRG; PAM sequence: AAG
ccatgaggcagaaatgactt

SEQ ID NO: 51973 - DNA, 20 bp, Artificial Sequence
  Description of Artificial Sequence: Synthetic oligonucleotide
  Target: ATXN1; (-) strand; PAM type: NRG; PAM sequence: CAG
tgtcttctagaaccatgagg

SEQ ID NO: 51974 - DNA, 20 bp, Artificial Sequence
  Description of Artificial Sequence: Synthetic oligonucleotide
  Target: ATXN1; (-) strand; PAM type: NRG; PAM sequence: AGG
tcttgtcttctagaaccatg

SEQ ID NO: 51975 - DNA, 20 bp, Artificial Sequence
  Description of Artificial Sequence: Synthetic oligonucleotide
  Target: ATXN1; (-) strand; PAM type: NRG; PAM sequence: GAG
ctcttgtcttctagaaccat

SEQ ID NO: 51976 - DNA, 20 bp, Artificial Sequence
  Description of Artificial Sequence: Synthetic oligonucleotide
  Target: ATXN1; (-) strand; PAM type: NRG; PAM sequence: TAG
cacctccacctcttgtcttc

SEQ ID NO: 51977 - DNA, 20 bp, Artificial Sequence
  Description of Artificial Sequence: Synthetic oligonucleotide
  Target: ATXN1; (-) strand; PAM type: NRG; PAM sequence: GAG
gagagccagagggttagaag

SEQ ID NO: 51978 - DNA, 20 bp, Artificial Sequence
  Description of Artificial Sequence: Synthetic oligonucleotide
  Target: ATXN1; (-) strand; PAM type: NRG; PAM sequence: AGG
ttgagagccagagggttaga

SEQ ID NO: 51979 - DNA, 20 bp, Artificial Sequence
  Description of Artificial Sequence: Synthetic oligonucleotide
  Target: ATXN1; (-) strand; PAM type: NRG; PAM sequence: AAG
gttgagagccagagggttag

SEQ ID NO: 51980 - DNA, 20 bp, Artificial Sequence
  Description of Artificial Sequence: Synthetic oligonucleotide
  Target: ATXN1; (-) strand; PAM type: NRG; PAM sequence: TAG
ccggttgagagccagagggt

SEQ ID NO: 51981 - DNA, 20 bp, Artificial Sequence
  Description of Artificial Sequence: Synthetic oligonucleotide
  Target: ATXN1; (-) strand; PAM type: NRG; PAM sequence: GGG
gcttccggttgagagccaga

SEQ ID NO: 51982 - DNA, 20 bp, Artificial Sequence
  Description of Artificial Sequence: Synthetic oligonucleotide
  Target: ATXN1; (-) strand; PAM type: NRG; PAM sequence: AGG
tgcttccggttgagagccag

SEQ ID NO: 51983 - DNA, 20 bp, Artificial Sequence
  Description of Artificial Sequence: Synthetic oligonucleotide
  Target: ATXN1; (-) strand; PAM type: NRG; PAM sequence: GAG
ttgcttccggttgagagcca

SEQ ID NO: 51984 - DNA, 20 bp, Artificial Sequence
  Description of Artificial Sequence: Synthetic oligonucleotide
  Target: ATXN1; (-) strand; PAM type: NRG; PAM sequence: CAG
aattgcttccggttgagagc

SEQ ID NO: 51985 - DNA, 20 bp, Artificial Sequence
  Description of Artificial Sequence: Synthetic oligonucleotide
  Target: ATXN1; (-) strand; PAM type: NRG; PAM sequence: GAG
gcaaaattgcttccggttga

SEQ ID NO: 51986 - DNA, 20 bp, Artificial Sequence
  Description of Artificial Sequence: Synthetic oligonucleotide
  Target: ATXN1; (-) strand; PAM type: NRG; PAM sequence: GAG
gagcaaaattgcttccggtt

SEQ ID NO: 51987 - DNA, 20 bp, Artificial Sequence
  Description of Artificial Sequence: Synthetic oligonucleotide
  Target: ATXN1; (-) strand; PAM type: NRG; PAM sequence: CGG
ttgcagagcaaaattgcttc

SEQ ID NO: 51988 - DNA, 20 bp, Artificial Sequence
  Description of Artificial Sequence: Synthetic oligonucleotide
  Target: ATXN1; (-) strand; PAM type: NRG; PAM sequence: GAG
acttccaggtgtcccttgca

SEQ ID NO: 51989 - DNA, 20 bp, Artificial Sequence
  Description of Artificial Sequence: Synthetic oligonucleotide
  Target: ATXN1; (-) strand; PAM type: NRG; PAM sequence: CAG
acacttccaggtgtcccttg

SEQ ID NO: 51990 - DNA, 20 bp, Artificial Sequence
  Description of Artificial Sequence: Synthetic oligonucleotide
  Target: ATXN1; (-) strand; PAM type: NRG; PAM sequence: AGG
aaatgtcctcagacacttcc

SEQ ID NO: 51991 - DNA, 20 bp, Artificial Sequence
  Description of Artificial Sequence: Synthetic oligonucleotide
  Target: ATXN1; (-) strand; PAM type: NRG; PAM sequence: CAG
aaaatgtcctcagacacttc

SEQ ID NO: 51992 - DNA, 20 bp, Artificial Sequence
  Description of Artificial Sequence: Synthetic oligonucleotide
  Target: ATXN1; (-) strand; PAM type: NRG; PAM sequence: CAG
gtgacaatcaaaaatgtcct

SEQ ID NO: 51993 - DNA, 20 bp, Artificial Sequence
  Description of Artificial Sequence: Synthetic oligonucleotide
  Target: ATXN1; (-) strand; PAM type: NRG; PAM sequence: CAG
tggatgctggtagcacccgg

SEQ ID NO: 51994 - DNA, 20 bp, Artificial Sequence
  Description of Artificial Sequence: Synthetic oligonucleotide
  Target: ATXN1; (-) strand; PAM type: NRG; PAM sequence: CGG
cgctggatgctggtagcacc

SEQ ID NO: 51995 - DNA, 20 bp, Artificial Sequence
  Description of Artificial Sequence: Synthetic oligonucleotide
  Target: ATXN1; (-) strand; PAM type: NRG; PAM sequence: TAG
ctctatgcgctggatgctgg

SEQ ID NO: 51996 - DNA, 20 bp, Artificial Sequence
  Description of Artificial Sequence: Synthetic oligonucleotide
  Target: ATXN1; (-) strand; PAM type: NRG; PAM sequence: TGG
ggcctctatgcgctggatgc

SEQ ID NO: 51997 - DNA, 20 bp, Artificial Sequence
  Description of Artificial Sequence: Synthetic oligonucleotide
  Target: ATXN1; (-) strand; PAM type: NRG; PAM sequence: TGG
cattcctggcctctatgcgc

SEQ ID NO: 51998 - DNA, 20 bp, Artificial Sequence
  Description of Artificial Sequence: Synthetic oligonucleotide
  Target: ATXN1; (-) strand; PAM type: NRG; PAM sequence: TGG
gagaaatttagcagcattcc

SEQ ID NO: 51999 - DNA, 20 bp, Artificial Sequence
  Description of Artificial Sequence: Synthetic oligonucleotide
  Target: ATXN1; (-) strand; PAM type: NRG; PAM sequence: CAG
gtgcattgggagaaatttag

SEQ ID NO: 52000 - DNA, 20 bp, Artificial Sequence
  Description of Artificial Sequence: Synthetic oligonucleotide
  Target: ATXN1; (-) strand; PAM type: NRG; PAM sequence: TAG
cccgtgcattgggagaaatt

SEQ ID NO: 52001 - DNA, 20 bp, Artificial Sequence
  Description of Artificial Sequence: Synthetic oligonucleotide
  Target: ATXN1; (-) strand; PAM type: NRG; PAM sequence: GAG
ggaggtgtcccgtgcattgg

SEQ ID NO: 52002 - DNA, 20 bp, Artificial Sequence
  Description of Artificial Sequence: Synthetic oligonucleotide
  Target: ATXN1; (-) strand; PAM type: NRG; PAM sequence: GGG
gtggaggtgtcccgtgcatt

SEQ ID NO: 52003 - DNA, 20 bp, Artificial Sequence
  Description of Artificial Sequence: Synthetic oligonucleotide
  Target: ATXN1; (-) strand; PAM type: NRG; PAM sequence: TGG
ggtggaggtgtcccgtgcat

SEQ ID NO: 52004 - DNA, 20 bp, Artificial Sequence
  Description of Artificial Sequence: Synthetic oligonucleotide
  Target: ATXN1; (-) strand; PAM type: NRG; PAM sequence: AGG
cagggagatggagggggtgg

SEQ ID NO: 52005 - DNA, 20 bp, Artificial Sequence
  Description of Artificial Sequence: Synthetic oligonucleotide
  Target: ATXN1; (-) strand; PAM type: NRG; PAM sequence: GAG
gcagggagatggagggggtg

SEQ ID NO: 52006 - DNA, 20 bp, Artificial Sequence
  Description of Artificial Sequence: Synthetic oligonucleotide
  Target: ATXN1; (-) strand; PAM type: NRG; PAM sequence: TGG
aagcagggagatggaggggg

SEQ ID NO: 52007 - DNA, 20 bp, Artificial Sequence
  Description of Artificial Sequence: Synthetic oligonucleotide
  Target: ATXN1; (-) strand; PAM type: NRG; PAM sequence: GGG
gggaagcagggagatggagg

SEQ ID NO: 52008 - DNA, 20 bp, Artificial Sequence
  Description of Artificial Sequence: Synthetic oligonucleotide
  Target: ATXN1; (-) strand; PAM type: NRG; PAM sequence: GGG
ggggaagcagggagatggag

SEQ ID NO: 52009 - DNA, 20 bp, Artificial Sequence
  Description of Artificial Sequence: Synthetic oligonucleotide
  Target: ATXN1; (-) strand; PAM type: NRG; PAM sequence: GGG
tggggaagcagggagatgga

SEQ ID NO: 52010 - DNA, 20 bp, Artificial Sequence
  Description of Artificial Sequence: Synthetic oligonucleotide
  Target: ATXN1; (-) strand; PAM type: NRG; PAM sequence: AGG
ttggggaagcagggagatgg

SEQ ID NO: 52011 - DNA, 20 bp, Artificial Sequence
  Description of Artificial Sequence: Synthetic oligonucleotide
  Target: ATXN1; (-) strand; PAM type: NRG; PAM sequence: GAG
tttggggaagcagggagatg

SEQ ID NO: 52012 - DNA, 20 bp, Artificial Sequence
  Description of Artificial Sequence: Synthetic oligonucleotide
  Target: ATXN1; (-) strand; PAM type: NRG; PAM sequence: TGG
tatttggggaagcagggaga

SEQ ID NO: 52013 - DNA, 20 bp, Artificial Sequence
  Description of Artificial Sequence: Synthetic oligonucleotide
  Target: ATXN1; (-) strand; PAM type: NRG; PAM sequence: GAG
atcctatttggggaagcagg

SEQ ID NO: 52014 - DNA, 20 bp, Artificial Sequence
  Description of Artificial Sequence: Synthetic oligonucleotide
  Target: ATXN1; (-) strand; PAM type: NRG; PAM sequence: GGG
tcatcctatttggggaagca

SEQ ID NO: 52015 - DNA, 20 bp, Artificial Sequence
  Description of Artificial Sequence: Synthetic oligonucleotide
  Target: ATXN1; (-) strand; PAM type: NRG; PAM sequence: AGG
atcatcctatttggggaagc

SEQ ID NO: 52016 - DNA, 20 bp, Artificial Sequence
  Description of Artificial Sequence: Synthetic oligonucleotide
  Target: ATXN1; (-) strand; PAM type: NRG; PAM sequence: CAG
gatcatcctatttggggaag

SEQ ID NO: 52017 - DNA, 20 bp, Artificial Sequence
  Description of Artificial Sequence: Synthetic oligonucleotide
  Target: ATXN1; (-) strand; PAM type: NRG; PAM sequence: AAG
ccagatcatcctatttgggg

SEQ ID NO: 52018 - DNA, 20 bp, Artificial Sequence
  Description of Artificial Sequence: Synthetic oligonucleotide
  Target: ATXN1; (-) strand; PAM type: NRG; PAM sequence: GGG
ggcccagatcatcctatttg

SEQ ID NO: 52019 - DNA, 20 bp, Artificial Sequence
  Description of Artificial Sequence: Synthetic oligonucleotide
  Target: ATXN1; (-) strand; PAM type: NRG; PAM sequence: GGG
gggcccagatcatcctattt

SEQ ID NO: 52020 - DNA, 20 bp, Artificial Sequence
  Description of Artificial Sequence: Synthetic oligonucleotide
  Target: ATXN1; (-) strand; PAM type: NRG; PAM sequence: TGG
ggggcccagatcatcctatt

SEQ ID NO: 52021 - DNA, 20 bp, Artificial Sequence
  Description of Artificial Sequence: Synthetic oligonucleotide
  Target: ATXN1; (-) strand; PAM type: NRG; PAM sequence: CAG
cactgttgacatttggggcc

SEQ ID NO: 52022 - DNA, 20 bp, Artificial Sequence
  Description of Artificial Sequence: Synthetic oligonucleotide
  Target: ATXN1; (-) strand; PAM type: NRG; PAM sequence: GGG
aacagcactgttgacatttg

SEQ ID NO: 52023 - DNA, 20 bp, Artificial Sequence
  Description of Artificial Sequence: Synthetic oligonucleotide
  Target: ATXN1; (-) strand; PAM type: NRG; PAM sequence: GGG
caacagcactgttgacattt

SEQ ID NO: 52024 - DNA, 20 bp, Artificial Sequence
  Description of Artificial Sequence: Synthetic oligonucleotide
  Target: ATXN1; (-) strand; PAM type: NRG; PAM sequence: TGG
tcaacagcactgttgacatt

SEQ ID NO: 52025 - DNA, 20 bp, Artificial Sequence
  Description of Artificial Sequence: Synthetic oligonucleotide
  Target: ATXN1; (-) strand; PAM type: NRG; PAM sequence: CAG
tttagagcagggaatctcaa

SEQ ID NO: 52026 - DNA, 20 bp, Artificial Sequence
  Description of Artificial Sequence: Synthetic oligonucleotide
  Target: ATXN1; (-) strand; PAM type: NRG; PAM sequence: GGG
ttctgcttccctttagagca

SEQ ID NO: 52027 - DNA, 20 bp, Artificial Sequence
  Description of Artificial Sequence: Synthetic oligonucleotide
  Target: ATXN1; (-) strand; PAM type: NRG; PAM sequence: AGG
tttctgcttccctttagagc

SEQ ID NO: 52028 - DNA, 20 bp, Artificial Sequence
  Description of Artificial Sequence: Synthetic oligonucleotide
  Target: ATXN1; (-) strand; PAM type: NRG; PAM sequence: CAG
ttttctgcttccctttagag

SEQ ID NO: 52029 - DNA, 20 bp, Artificial Sequence
  Description of Artificial Sequence: Synthetic oligonucleotide
  Target: ATXN1; (-) strand; PAM type: NRG; PAM sequence: GAG
atcttttctgcttcccttta

SEQ ID NO: 52030 - DNA, 20 bp, Artificial Sequence
  Description of Artificial Sequence: Synthetic oligonucleotide
  Target: ATXN1; (-) strand; PAM type: NRG; PAM sequence: TAG
tgatcttttctgcttccctt

SEQ ID NO: 52031 - DNA, 20 bp, Artificial Sequence
  Description of Artificial Sequence: Synthetic oligonucleotide
  Target: ATXN1; (-) strand; PAM type: NRG; PAM sequence: CAG
aatggaaaattctctggctg

SEQ ID NO: 52032 - DNA, 20 bp, Artificial Sequence
  Description of Artificial Sequence: Synthetic oligonucleotide
  Target: ATXN1; (-) strand; PAM type: NRG; PAM sequence: TGG
aaggtcaatggaaaattctc

SEQ ID NO: 52033 - DNA, 20 bp, Artificial Sequence
  Description of Artificial Sequence: Synthetic oligonucleotide
  Target: ATXN1; (-) strand; PAM type: NRG; PAM sequence: TGG
ggcaacagttagaaggtcaa

SEQ ID NO: 52034 - DNA, 20 bp, Artificial Sequence
  Description of Artificial Sequence: Synthetic oligonucleotide
  Target: ATXN1; (-) strand; PAM type: NRG; PAM sequence: AGG
gagcccaggcaacagttaga

SEQ ID NO: 52035 - DNA, 20 bp, Artificial Sequence
  Description of Artificial Sequence: Synthetic oligonucleotide
  Target: ATXN1; (-) strand; PAM type: NRG; PAM sequence: AAG
ggagcccaggcaacagttag

SEQ ID NO: 52036 - DNA, 20 bp, Artificial Sequence
  Description of Artificial Sequence: Synthetic oligonucleotide
  Target: ATXN1; (-) strand; PAM type: NRG; PAM sequence: TAG
ccaggagcccaggcaacagt

SEQ ID NO: 52037 - DNA, 20 bp, Artificial Sequence
  Description of Artificial Sequence: Synthetic oligonucleotide
  Target: ATXN1; (-) strand; PAM type: NRG; PAM sequence: CAG
tcctccaggagcccaggcaa

SEQ ID NO: 52038 - DNA, 20 bp, Artificial Sequence
  Description of Artificial Sequence: Synthetic oligonucleotide
  Target: ATXN1; (-) strand; PAM type: NRG; PAM sequence: AGG
aggatgtcctccaggagccc

SEQ ID NO: 52039 - DNA, 20 bp, Artificial Sequence
  Description of Artificial Sequence: Synthetic oligonucleotide
  Target: ATXN1; (-) strand; PAM type: NRG; PAM sequence: CAG
gaggatgtcctccaggagcc

SEQ ID NO: 52040 - DNA, 20 bp, Artificial Sequence
  Description of Artificial Sequence: Synthetic oligonucleotide
  Target: ATXN1; (-) strand; PAM type: NRG; PAM sequence: GAG
cttcagaggatgtcctccag

SEQ ID NO: 52041 - DNA, 20 bp, Artificial Sequence
  Description of Artificial Sequence: Synthetic oligonucleotide
  Target: ATXN1; (-) strand; PAM type: NRG; PAM sequence: AGG
atcttcagaggatgtcctcc

SEQ ID NO: 52042 - DNA, 20 bp, Artificial Sequence
  Description of Artificial Sequence: Synthetic oligonucleotide
  Target: ATXN1; (-) strand; PAM type: NRG; PAM sequence: CAG
catcttcagaggatgtcctc

SEQ ID NO: 52043 - DNA, 20 bp, Artificial Sequence
  Description of Artificial Sequence: Synthetic oligonucleotide
  Target: ATXN1; (-) strand; PAM type: NRG; PAM sequence: AGG
aaggaaacaagcatcttcag

SEQ ID NO: 52044 - DNA, 20 bp, Artificial Sequence
  Description of Artificial Sequence: Synthetic oligonucleotide
  Target: ATXN1; (-) strand; PAM type: NRG; PAM sequence: GAG
caaggaaacaagcatcttca

SEQ ID NO: 52045 - DNA, 20 bp, Artificial Sequence
  Description of Artificial Sequence: Synthetic oligonucleotide
  Target: ATXN1; (-) strand; PAM type: NRG; PAM sequence: CAG
gtcaaggaaacaagcatctt

SEQ ID NO: 52046 - DNA, 20 bp, Artificial Sequence
  Description of Artificial Sequence: Synthetic oligonucleotide
  Target: ATXN1; (-) strand; PAM type: NRG; PAM sequence: AAG
agcgtttaggtcaaggaaac

SEQ ID NO: 52047 - DNA, 20 bp, Artificial Sequence
  Description of Artificial Sequence: Synthetic oligonucleotide
  Target: ATXN1; (-) strand; PAM type: NRG; PAM sequence: AGG
tgaggctagcgtttaggtca

SEQ ID NO: 52048 - DNA, 20 bp, Artificial Sequence
  Description of Artificial Sequence: Synthetic oligonucleotide
  Target: ATXN1; (-) strand; PAM type: NRG; PAM sequence: AAG
gtgaggctagcgtttaggtc

SEQ ID NO: 52049 - DNA, 20 bp, Artificial Sequence
  Description of Artificial Sequence: Synthetic oligonucleotide
  Target: ATXN1; (-) strand; PAM type: NRG; PAM sequence: AGG
ccatggtgaggctagcgttt

SEQ ID NO: 52050 - DNA, 20 bp, Artificial Sequence
  Description of Artificial Sequence: Synthetic oligonucleotide
  Target: ATXN1; (-) strand; PAM type: NRG; PAM sequence: TAG
gccatggtgaggctagcgtt

SEQ ID NO: 52051 - DNA, 20 bp, Artificial Sequence
  Description of Artificial Sequence: Synthetic oligonucleotide
  Target: ATXN1; (-) strand; PAM type: NRG; PAM sequence: TAG
gctgtgggccatggtgaggc

SEQ ID NO: 52052 - DNA, 20 bp, Artificial Sequence
  Description of Artificial Sequence: Synthetic oligonucleotide
  Target: ATXN1; (-) strand; PAM type: NRG; PAM sequence: AGG
ctgggctgtgggccatggtg

SEQ ID NO: 52053 - DNA, 20 bp, Artificial Sequence
  Description of Artificial Sequence: Synthetic oligonucleotide
  Target: ATXN1; (-) strand; PAM type: NRG; PAM sequence: GAG
gctgggctgtgggccatggt

SEQ ID NO: 52054 - DNA, 20 bp, Artificial Sequence
  Description of Artificial Sequence: Synthetic oligonucleotide
  Target: ATXN1; (-) strand; PAM type: NRG; PAM sequence: TGG
tgctgctgggctgtgggcca

SEQ ID NO: 52055 - DNA, 20 bp, Artificial Sequence
  Description of Artificial Sequence: Synthetic oligonucleotide
  Target: ATXN1; (-) strand; PAM type: NRG; PAM sequence: GGG
tgctgatgctgctgggctgt

SEQ ID NO: 52056 - DNA, 20 bp, Artificial Sequence
  Description of Artificial Sequence: Synthetic oligonucleotide
  Target: ATXN1; (-) strand; PAM type: NRG; PAM sequence: TGG
atgctgatgctgctgggctg

SEQ ID NO: 52057 - DNA, 20 bp, Artificial Sequence
  Description of Artificial Sequence: Synthetic oligonucleotide
  Target: ATXN1; (-) strand; PAM type: NRG; PAM sequence: GGG
ctagtgatgctgatgctgct

SEQ ID NO: 52058 - DNA, 20 bp, Artificial Sequence
  Description of Artificial Sequence: Synthetic oligonucleotide
  Target: ATXN1; (-) strand; PAM type: NRG; PAM sequence: TGG
cctagtgatgctgatgctgc

SEQ ID NO: 52059 - DNA, 20 bp, Artificial Sequence
  Description of Artificial Sequence: Synthetic oligonucleotide
  Target: ATXN1; (-) strand; PAM type: NRG; PAM sequence: TAG
tgcatttcccacatgctccc

SEQ ID NO: 52060 - DNA, 20 bp, Artificial Sequence
  Description of Artificial Sequence: Synthetic oligonucleotide
  Target: ATXN1; (-) strand; PAM type: NRG; PAM sequence: GAG
tgtcagtctgggtgggacct

SEQ ID NO: 52061 - DNA, 20 bp, Artificial Sequence
  Description of Artificial Sequence: Synthetic oligonucleotide
  Target: ATXN1; (-) strand; PAM type: NRG; PAM sequence: GGG
ctggttctgtcagtctgggt

SEQ ID NO: 52062 - DNA, 20 bp, Artificial Sequence
  Description of Artificial Sequence: Synthetic oligonucleotide
  Target: ATXN1; (-) strand; PAM type: NRG; PAM sequence: TGG
tctggttctgtcagtctggg

SEQ ID NO: 52063 - DNA, 20 bp, Artificial Sequence
  Description of Artificial Sequence: Synthetic oligonucleotide
  Target: ATXN1; (-) strand; PAM type: NRG; PAM sequence: GGG
cattctggttctgtcagtct

SEQ ID NO: 52064 - DNA, 20 bp, Artificial Sequence
  Description of Artificial Sequence: Synthetic oligonucleotide
  Target: ATXN1; (-) strand; PAM type: NRG; PAM sequence: TGG
acattctggttctgtcagtc

SEQ ID NO: 52065 - DNA, 20 bp, Artificial Sequence
  Description of Artificial Sequence: Synthetic oligonucleotide
  Target: ATXN1; (-) strand; PAM type: NRG; PAM sequence: CAG
aatgcacattctggttctgt

SEQ ID NO: 52066 - DNA, 20 bp, Artificial Sequence
  Description of Artificial Sequence: Synthetic oligonucleotide
  Target: ATXN1; (-) strand; PAM type: NRG; PAM sequence: TGG
tctagtggaaatgcacattc

SEQ ID NO: 52067 - DNA, 20 bp, Artificial Sequence
  Description of Artificial Sequence: Synthetic oligonucleotide
  Target: ATXN1; (-) strand; PAM type: NRG; PAM sequence: TGG
ggaagcccccagcgttctag

SEQ ID NO: 52068 - DNA, 20 bp, Artificial Sequence
  Description of Artificial Sequence: Synthetic oligonucleotide
  Target: ATXN1; (-) strand; PAM type: NRG; PAM sequence: TAG
ctaggaagcccccagcgttc

SEQ ID NO: 52069 - DNA, 20 bp, Artificial Sequence
  Description of Artificial Sequence: Synthetic oligonucleotide
  Target: ATXN1; (-) strand; PAM type: NRG; PAM sequence: CAG
tcaagtgtctaggaagcccc

SEQ ID NO: 52070 - DNA, 20 bp, Artificial Sequence
  Description of Artificial Sequence: Synthetic oligonucleotide
  Target: ATXN1; (-) strand; PAM type: NRG; PAM sequence: AAG
gaaagtttcaagtgtctagg

SEQ ID NO: 52071 - DNA, 20 bp, Artificial Sequence
  Description of Artificial Sequence: Synthetic oligonucleotide
  Target: ATXN1; (-) strand; PAM type: NRG; PAM sequence: AGG
tctgaaagtttcaagtgtct

SEQ ID NO: 52072 - DNA, 20 bp, Artificial Sequence
  Description of Artificial Sequence: Synthetic oligonucleotide
  Target: ATXN1; (-) strand; PAM type: NRG; PAM sequence: TAG
ttctgaaagtttcaagtgtc

SEQ ID NO: 52073 - DNA, 20 bp, Artificial Sequence
  Description of Artificial Sequence: Synthetic oligonucleotide
  Target: ATXN1; (-) strand; PAM type: NRG; PAM sequence: AAG
ctggtgcttctgaaagtttc

SEQ ID NO: 52074 - DNA, 20 bp, Artificial Sequence
  Description of Artificial Sequence: Synthetic oligonucleotide
  Target: ATXN1; (-) strand; PAM type: NRG; PAM sequence: AAG
ggtctgtctggtgcttctga

SEQ ID NO: 52075 - DNA, 20 bp, Artificial Sequence
  Description of Artificial Sequence: Synthetic oligonucleotide
  Target: ATXN1; (-) strand; PAM type: NRG; PAM sequence: TGG
ataggtgagagaggtctgtc

SEQ ID NO: 52076 - DNA, 20 bp, Artificial Sequence
  Description of Artificial Sequence: Synthetic oligonucleotide
  Target: ATXN1; (-) strand; PAM type: NRG; PAM sequence: AGG
gacctaaggataggtgagag

SEQ ID NO: 52077 - DNA, 20 bp, Artificial Sequence
  Description of Artificial Sequence: Synthetic oligonucleotide
  Target: ATXN1; (-) strand; PAM type: NRG; PAM sequence: GAG
agacctaaggataggtgaga

SEQ ID NO: 52078 - DNA, 20 bp, Artificial Sequence
  Description of Artificial Sequence: Synthetic oligonucleotide
  Target: ATXN1; (-) strand; PAM type: NRG; PAM sequence: GAG
acagacctaaggataggtga

SEQ ID NO: 52079 - DNA, 20 bp, Artificial Sequence
  Description of Artificial Sequence: Synthetic oligonucleotide
  Target: ATXN1; (-) strand; PAM type: NRG; PAM sequence: GAG
agacagacctaaggataggt

SEQ ID NO: 52080 - DNA, 20 bp, Artificial Sequence
  Description of Artificial Sequence: Synthetic oligonucleotide
  Target: ATXN1; (-) strand; PAM type: NRG; PAM sequence: AGG
ggacagacagacctaaggat

SEQ ID NO: 52081 - DNA, 20 bp, Artificial Sequence
  Description of Artificial Sequence: Synthetic oligonucleotide
  Target: ATXN1; (-) strand; PAM type: NRG; PAM sequence: TAG
aggacagacagacctaagga

SEQ ID NO: 52082 - DNA, 20 bp, Artificial Sequence
  Description of Artificial Sequence: Synthetic oligonucleotide
  Target: ATXN1; (-) strand; PAM type: NRG; PAM sequence: AGG
tagaaggacagacagaccta

SEQ ID NO: 52083 - DNA, 20 bp, Artificial Sequence
  Description of Artificial Sequence: Synthetic oligonucleotide
  Target: ATXN1; (-) strand; PAM type: NRG; PAM sequence: AAG
atagaaggacagacagacct

SEQ ID NO: 52084 - DNA, 20 bp, Artificial Sequence
  Description of Artificial Sequence: Synthetic oligonucleotide
  Target: ATXN1; (-) strand; PAM type: NRG; PAM sequence: CAG
tgagtgaatagaaggacaga

SEQ ID NO: 52085 - DNA, 20 bp, Artificial Sequence
  Description of Artificial Sequence: Synthetic oligonucleotide
  Target: ATXN1; (-) strand; PAM type: NRG; PAM sequence: CAG
atactgagtgaatagaagga

SEQ ID NO: 52086 - DNA, 20 bp, Artificial Sequence
  Description of Artificial Sequence: Synthetic oligonucleotide
  Target: ATXN1; (-) strand; PAM type: NRG; PAM sequence: AGG
attaatactgagtgaataga

SEQ ID NO: 52087 - DNA, 20 bp, Artificial Sequence
  Description of Artificial Sequence: Synthetic oligonucleotide
  Target: ATXN1; (-) strand; PAM type: NRG; PAM sequence: AAG
aattaatactgagtgaatag

SEQ ID NO: 52088 - DNA, 20 bp, Artificial Sequence
  Description of Artificial Sequence: Synthetic oligonucleotide
  Target: ATXN1; (-) strand; PAM type: NRG; PAM sequence: TAG
aataattaatactgagtgaa

SEQ ID NO: 52089 - DNA, 20 bp, Artificial Sequence
  Description of Artificial Sequence: Synthetic oligonucleotide
  Target: ATXN1; (-) strand; PAM type: NRG; PAM sequence: GAG
gagtggaaataattaatact

SEQ ID NO: 52090 - DNA, 20 bp, Artificial Sequence
  Description of Artificial Sequence: Synthetic oligonucleotide
  Target: ATXN1; (-) strand; PAM type: NRG; PAM sequence: TGG
tgtgtattcagagggcagag

SEQ ID NO: 52091 - DNA, 20 bp, Artificial Sequence
  Description of Artificial Sequence: Synthetic oligonucleotide
  Target: ATXN1; (-) strand; PAM type: NRG; PAM sequence: GAG
tactgtgtattcagagggca

SEQ ID NO: 52092 - DNA, 20 bp, Artificial Sequence
  Description of Artificial Sequence: Synthetic oligonucleotide
  Target: ATXN1; (-) strand; PAM type: NRG; PAM sequence: CAG
attactgtgtattcagaggg

SEQ ID NO: 52093 - DNA, 20 bp, Artificial Sequence
  Description of Artificial Sequence: Synthetic oligonucleotide
  Target: ATXN1; (-) strand; PAM type: NRG; PAM sequence: GGG
tagattactgtgtattcaga

SEQ ID NO: 52094 - DNA, 20 bp, Artificial Sequence
  Description of Artificial Sequence: Synthetic oligonucleotide
  Target: ATXN1; (-) strand; PAM type: NRG; PAM sequence: AGG
ctagattactgtgtattcag

SEQ ID NO: 52095 - DNA, 20 bp, Artificial Sequence
  Description of Artificial Sequence: Synthetic oligonucleotide
  Target: ATXN1; (-) strand; PAM type: NRG; PAM sequence: GAG
actagattactgtgtattca

SEQ ID NO: 52096 - DNA, 20 bp, Artificial Sequence
  Description of Artificial Sequence: Synthetic oligonucleotide
  Target: ATXN1; (-) strand; PAM type: NRG; PAM sequence: CAG
ttactagattactgtgtatt

SEQ ID NO: 52097 - DNA, 20 bp, Artificial Sequence
  Description of Artificial Sequence: Synthetic oligonucleotide
  Target: ATXN1; (-) strand; PAM type: NRG; PAM sequence: TAG
agaagagagctactttttac

SEQ ID NO: 52098 - DNA, 20 bp, Artificial Sequence
  Description of Artificial Sequence: Synthetic oligonucleotide
  Target: ATXN1; (-) strand; PAM type: NRG; PAM sequence: GAG
gaaaggctgaagcaagaaga

SEQ ID NO: 52099 - DNA, 20 bp, Artificial Sequence
  Description of Artificial Sequence: Synthetic oligonucleotide
  Target: ATXN1; (-) strand; PAM type: NRG; PAM sequence: GAG
aggaaaggctgaagcaagaa

SEQ ID NO: 52100 - DNA, 20 bp, Artificial Sequence
  Description of Artificial Sequence: Synthetic oligonucleotide
  Target: ATXN1; (-) strand; PAM type: NRG; PAM sequence: AAG
tgaggaaaggctgaagcaag

SEQ ID NO: 52101 - DNA, 20 bp, Artificial Sequence
  Description of Artificial Sequence: Synthetic oligonucleotide
  Target: ATXN1; (-) strand; PAM type: NRG; PAM sequence: AAG
ttctgaggaaaggctgaagc

SEQ ID NO: 52102 - DNA, 20 bp, Artificial Sequence
  Description of Artificial Sequence: Synthetic oligonucleotide
  Target: ATXN1; (-) strand; PAM type: NRG; PAM sequence: AAG
aatgttctgaggaaaggctg

SEQ ID NO: 52103 - DNA, 20 bp, Artificial Sequence
  Description of Artificial Sequence: Synthetic oligonucleotide
  Target: ATXN1; (-) strand; PAM type: NRG; PAM sequence: AGG
ggagagaatgttctgaggaa

SEQ ID NO: 52104 - DNA, 20 bp, Artificial Sequence
  Description of Artificial Sequence: Synthetic oligonucleotide
  Target: ATXN1; (-) strand; PAM type: NRG; PAM sequence: AAG
tggagagaatgttctgagga

SEQ ID NO: 52105 - DNA, 20 bp, Artificial Sequence
  Description of Artificial Sequence: Synthetic oligonucleotide
  Target: ATXN1; (-) strand; PAM type: NRG; PAM sequence: AGG
gggttggagagaatgttctg

SEQ ID NO: 52106 - DNA, 20 bp, Artificial Sequence
  Description of Artificial Sequence: Synthetic oligonucleotide
  Target: ATXN1; (-) strand; PAM type: NRG; PAM sequence: GAG
tgggttggagagaatgttct

SEQ ID NO: 52107 - DNA, 20 bp, Artificial Sequence
  Description of Artificial Sequence: Synthetic oligonucleotide
  Target: ATXN1; (-) strand; PAM type: NRG; PAM sequence: GAG
aggttacagtctgggttgga

SEQ ID NO: 52108 - DNA, 20 bp, Artificial Sequence
  Description of Artificial Sequence: Synthetic oligonucleotide
  Target: ATXN1; (-) strand; PAM type: NRG; PAM sequence: GAG
caaggttacagtctgggttg

SEQ ID NO: 52109 - DNA, 20 bp, Artificial Sequence
  Description of Artificial Sequence: Synthetic oligonucleotide
  Target: ATXN1; (-) strand; PAM type: NRG; PAM sequence: TGG
gccaaggttacagtctgggt

SEQ ID NO: 52110 - DNA, 20 bp, Artificial Sequence
  Description of Artificial Sequence: Synthetic oligonucleotide
  Target: ATXN1; (-) strand; PAM type: NRG; PAM sequence: GGG
gggagccaaggttacagtct

SEQ ID NO: 52111 - DNA, 20 bp, Artificial Sequence
  Description of Artificial Sequence: Synthetic oligonucleotide
  Target: ATXN1; (-) strand; PAM type: NRG; PAM sequence: TGG
agggagccaaggttacagtc

SEQ ID NO: 52112 - DNA, 20 bp, Artificial Sequence
  Description of Artificial Sequence: Synthetic oligonucleotide
  Target: ATXN1; (-) strand; PAM type: NRG; PAM sequence: CAG
tctgcagggagccaaggtta

SEQ ID NO: 52113 - DNA, 20 bp, Artificial Sequence
  Description of Artificial Sequence: Synthetic oligonucleotide
  Target: ATXN1; (-) strand; PAM type: NRG; PAM sequence: AGG
gggctgtctgcagggagcca

SEQ ID NO: 52114 - DNA, 20 bp, Artificial Sequence
  Description of Artificial Sequence: Synthetic oligonucleotide
  Target: ATXN1; (-) strand; PAM type: NRG; PAM sequence: AAG
agggctgtctgcagggagcc

SEQ ID NO: 52115 - DNA, 20 bp, Artificial Sequence
  Description of Artificial Sequence: Synthetic oligonucleotide
  Target: ATXN1; (-) strand; PAM type: NRG; PAM sequence: GAG
gaaacagggctgtctgcagg

SEQ ID NO: 52116 - DNA, 20 bp, Artificial Sequence
  Description of Artificial Sequence: Synthetic oligonucleotide
  Target: ATXN1; (-) strand; PAM type: NRG; PAM sequence: GGG
gagaaacagggctgtctgca

SEQ ID NO: 52117 - DNA, 20 bp, Artificial Sequence
  Description of Artificial Sequence: Synthetic oligonucleotide
  Target: ATXN1; (-) strand; PAM type: NRG; PAM sequence: AGG
ggagaaacagggctgtctgc

SEQ ID NO: 52118 - DNA, 20 bp, Artificial Sequence
  Description of Artificial Sequence: Synthetic oligonucleotide
  Target: ATXN1; (-) strand; PAM type: NRG; PAM sequence: CAG
aggagaaacagggctgtctg

SEQ ID NO: 52119 - DNA, 20 bp, Artificial Sequence
  Description of Artificial Sequence: Synthetic oligonucleotide
  Target: ATXN1; (-) strand; PAM type: NRG; PAM sequence: GGG
agagggctgtaggagaaaca

SEQ ID NO: 52120 - DNA, 20 bp, Artificial Sequence
  Description of Artificial Sequence: Synthetic oligonucleotide
  Target: ATXN1; (-) strand; PAM type: NRG; PAM sequence: AGG
cagagggctgtaggagaaac

SEQ ID NO: 52121 - DNA, 20 bp, Artificial Sequence
  Description of Artificial Sequence: Synthetic oligonucleotide
  Target: ATXN1; (-) strand; PAM type: NRG; PAM sequence: CAG
tcagagggctgtaggagaaa

SEQ ID NO: 52122 - DNA, 20 bp, Artificial Sequence
  Description of Artificial Sequence: Synthetic oligonucleotide
  Target: ATXN1; (-) strand; PAM type: NRG; PAM sequence: GAG
tccacctcagagggctgtag

SEQ ID NO: 52123 - DNA, 20 bp, Artificial Sequence
  Description of Artificial Sequence: Synthetic oligonucleotide
  Target: ATXN1; (-) strand; PAM type: NRG; PAM sequence: AGG
tctccacctcagagggctgt

SEQ ID NO: 52124 - DNA, 20 bp, Artificial Sequence
  Description of Artificial Sequence: Synthetic oligonucleotide
  Target: ATXN1; (-) strand; PAM type: NRG; PAM sequence: TAG
ctctccacctcagagggctg

SEQ ID NO: 52125 - DNA, 20 bp, Artificial Sequence
  Description of Artificial Sequence: Synthetic oligonucleotide
  Target: ATXN1; (-) strand; PAM type: NRG; PAM sequence: GGG
tgagctctctccacctcaga

SEQ ID NO: 52126 - DNA, 20 bp, Artificial Sequence
  Description of Artificial Sequence: Synthetic oligonucleotide
  Target: ATXN1; (-) strand; PAM type: NRG; PAM sequence: AGG
ttgagctctctccacctcag

SEQ ID NO: 52127 - DNA, 20 bp, Artificial Sequence
  Description of Artificial Sequence: Synthetic oligonucleotide
  Target: ATXN1; (-) strand; PAM type: NRG; PAM sequence: GAG
gttgagctctctccacctca

SEQ ID NO: 52128 - DNA, 20 bp, Artificial Sequence
  Description of Artificial Sequence: Synthetic oligonucleotide
  Target: ATXN1; (-) strand; PAM type: NRG; PAM sequence: CAG
aggttgagctctctccacct

SEQ ID NO: 52129 - DNA, 20 bp, Artificial Sequence
  Description of Artificial Sequence: Synthetic oligonucleotide
  Target: ATXN1; (-) strand; PAM type: NRG; PAM sequence: GAG
gaacaggggcttgggaggtt

SEQ ID NO: 52130 - DNA, 20 bp, Artificial Sequence
  Description of Artificial Sequence: Synthetic oligonucleotide
  Target: ATXN1; (-) strand; PAM type: NRG; PAM sequence: AGG
gccctgaacaggggcttggg

SEQ ID NO: 52131 - DNA, 20 bp, Artificial Sequence
  Description of Artificial Sequence: Synthetic oligonucleotide
  Target: ATXN1; (-) strand; PAM type: NRG; PAM sequence: GAG
agccctgaacaggggcttgg

SEQ ID NO: 52132 - DNA, 20 bp, Artificial Sequence
  Description of Artificial Sequence: Synthetic oligonucleotide
  Target: ATXN1; (-) strand; PAM type: NRG; PAM sequence: GGG
ggagccctgaacaggggctt

SEQ ID NO: 52133 - DNA, 20 bp, Artificial Sequence
  Description of Artificial Sequence: Synthetic oligonucleotide
  Target: ATXN1; (-) strand; PAM type: NRG; PAM sequence: TGG
cggagccctgaacaggggct

SEQ ID NO: 52134 - DNA, 20 bp, Artificial Sequence
  Description of Artificial Sequence: Synthetic oligonucleotide
  Target: ATXN1; (-) strand; PAM type: NRG; PAM sequence: GGG
agccacggagccctgaacag

SEQ ID NO: 52135 - DNA, 20 bp, Artificial Sequence
  Description of Artificial Sequence: Synthetic oligonucleotide
  Target: ATXN1; (-) strand; PAM type: NRG; PAM sequence: GGG
tagccacggagccctgaaca

SEQ ID NO: 52136 - DNA, 20 bp, Artificial Sequence
  Description of Artificial Sequence: Synthetic oligonucleotide
  Target: ATXN1; (-) strand; PAM type: NRG; PAM sequence: AGG
gtagccacggagccctgaac

SEQ ID NO: 52137 - DNA, 20 bp, Artificial Sequence
  Description of Artificial Sequence: Synthetic oligonucleotide
  Target: ATXN1; (-) strand; PAM type: NRG; PAM sequence: CAG
agtagccacggagccctgaa

SEQ ID NO: 52138 - DNA, 20 bp, Artificial Sequence
  Description of Artificial Sequence: Synthetic oligonucleotide
  Target: ATXN1; (-) strand; PAM type: NRG; PAM sequence: GAG
ggatagaggaagtagccacg

SEQ ID NO: 52139 - DNA, 20 bp, Artificial Sequence
  Description of Artificial Sequence: Synthetic oligonucleotide
  Target: ATXN1; (-) strand; PAM type: NRG; PAM sequence: CGG
gaggatagaggaagtagcca

SEQ ID NO: 52140 - DNA, 20 bp, Artificial Sequence
  Description of Artificial Sequence: Synthetic oligonucleotide
  Target: ATXN1; (-) strand; PAM type: NRG; PAM sequence: TAG
tcgaatgaggatagaggaag

SEQ ID NO: 52141 - DNA, 20 bp, Artificial Sequence
  Description of Artificial Sequence: Synthetic oligonucleotide
  Target: ATXN1; (-) strand; PAM type: NRG; PAM sequence: AAG
ttttcgaatgaggatagagg

SEQ ID NO: 52142 - DNA, 20 bp, Artificial Sequence
  Description of Artificial Sequence: Synthetic oligonucleotide
  Target: ATXN1; (-) strand; PAM type: NRG; PAM sequence: AGG
gaattttcgaatgaggatag

SEQ ID NO: 52143 - DNA, 20 bp, Artificial Sequence
  Description of Artificial Sequence: Synthetic oligonucleotide
  Target: ATXN1; (-) strand; PAM type: NRG; PAM sequence: GAG
ggaattttcgaatgaggata

SEQ ID NO: 52144 - DNA, 20 bp, Artificial Sequence
  Description of Artificial Sequence: Synthetic oligonucleotide
  Target: ATXN1; (-) strand; PAM type: NRG; PAM sequence: TAG
aaggaattttcgaatgagga

SEQ ID NO: 52145 - DNA, 20 bp, Artificial Sequence
  Description of Artificial Sequence: Synthetic oligonucleotide
  Target: ATXN1; (-) strand; PAM type: NRG; PAM sequence: AGG
agagaaggaattttcgaatg

SEQ ID NO: 52146 - DNA, 20 bp, Artificial Sequence
  Description of Artificial Sequence: Synthetic oligonucleotide
  Target: ATXN1; (-) strand; PAM type: NRG; PAM sequence: GAG
aagagaaggaattttcgaat

SEQ ID NO: 52147 - DNA, 20 bp, Artificial Sequence
  Description of Artificial Sequence: Synthetic oligonucleotide
  Target: ATXN1; (-) strand; PAM type: NRG; PAM sequence: AGG
ggccacgtggtcagaagaga

SEQ ID NO: 52148 - DNA, 20 bp, Artificial Sequence
  Description of Artificial Sequence: Synthetic oligonucleotide
  Target: ATXN1; (-) strand; PAM type: NRG; PAM sequence: AAG
tggccacgtggtcagaagag

SEQ ID NO: 52149 - DNA, 20 bp, Artificial Sequence
  Description of Artificial Sequence: Synthetic oligonucleotide
  Target: ATXN1; (-) strand; PAM type: NRG; PAM sequence: GAG
ccatggccacgtggtcagaa

SEQ ID NO: 52150 - DNA, 20 bp, Artificial Sequence
  Description of Artificial Sequence: Synthetic oligonucleotide
  Target: ATXN1; (-) strand; PAM type: NRG; PAM sequence: AAG
ggccatggccacgtggtcag

SEQ ID NO: 52151 - DNA, 20 bp, Artificial Sequence
  Description of Artificial Sequence: Synthetic oligonucleotide
  Target: ATXN1; (-) strand; PAM type: NRG; PAM sequence: CAG
tctggccatggccacgtggt

SEQ ID NO: 52152 - DNA, 20 bp, Artificial Sequence
  Description of Artificial Sequence: Synthetic oligonucleotide
  Target: ATXN1; (-) strand; PAM type: NRG; PAM sequence: TGG
gtggtctggccatggccacg

SEQ ID NO: 52153 - DNA, 20 bp, Artificial Sequence
  Description of Artificial Sequence: Synthetic oligonucleotide
  Target: ATXN1; (-) strand; PAM type: NRG; PAM sequence: TGG
atggccatgtggtctggcca

SEQ ID NO: 52154 - DNA, 20 bp, Artificial Sequence
  Description of Artificial Sequence: Synthetic oligonucleotide
  Target: ATXN1; (-) strand; PAM type: NRG; PAM sequence: TGG
aagccaatggccatgtggtc

SEQ ID NO: 52155 - DNA, 20 bp, Artificial Sequence
  Description of Artificial Sequence: Synthetic oligonucleotide
  Target: ATXN1; (-) strand; PAM type: NRG; PAM sequence: TGG
aatggaagccaatggccatg

SEQ ID NO: 52156 - DNA, 20 bp, Artificial Sequence
  Description of Artificial Sequence: Synthetic oligonucleotide
  Target: ATXN1; (-) strand; PAM type: NRG; PAM sequence: TGG
caacaataaatggaagccaa

SEQ ID NO: 52157 - DNA, 20 bp, Artificial Sequence
  Description of Artificial Sequence: Synthetic oligonucleotide
  Target: ATXN1; (-) strand; PAM type: NRG; PAM sequence: AAG
taccttgcaacaataaatgg

SEQ ID NO: 52158 - DNA, 20 bp, Artificial Sequence
  Description of Artificial Sequence: Synthetic oligonucleotide
  Target: ATXN1; (-) strand; PAM type: NRG; PAM sequence: TGG
ttgtaccttgcaacaataaa

SEQ ID NO: 52159 - DNA, 20 bp, Artificial Sequence
  Description of Artificial Sequence: Synthetic oligonucleotide
  Target: ATXN1; (-) strand; PAM type: NRG; PAM sequence: TGG
atgatccaggtacctagaac

SEQ ID NO: 52160 - DNA, 20 bp, Artificial Sequence
  Description of Artificial Sequence: Synthetic oligonucleotide
  Target: ATXN1; (-) strand; PAM type: NRG; PAM sequence: TAG
aatgccatgatccaggtacc

SEQ ID NO: 52161 - DNA, 20 bp, Artificial Sequence
  Description of Artificial Sequence: Synthetic oligonucleotide
  Target: ATXN1; (-) strand; PAM type: NRG; PAM sequence: AGG
aaataggaatgccatgatcc

SEQ ID NO: 52162 - DNA, 20 bp, Artificial Sequence
  Description of Artificial Sequence: Synthetic oligonucleotide
  Target: ATXN1; (-) strand; PAM type: NRG; PAM sequence: CAG
caaataggaatgccatgatc

SEQ ID NO: 52163 - DNA, 20 bp, Artificial Sequence
  Description of Artificial Sequence: Synthetic oligonucleotide
  Target: ATXN1; (-) strand; PAM type: NRG; PAM sequence: AGG
cagttgggttgagggcaaat

SEQ ID NO: 52164 - DNA, 20 bp, Artificial Sequence
  Description of Artificial Sequence: Synthetic oligonucleotide
  Target: ATXN1; (-) strand; PAM type: NRG; PAM sequence: TAG
acagttgggttgagggcaaa

SEQ ID NO: 52165 - DNA, 20 bp, Artificial Sequence
  Description of Artificial Sequence: Synthetic oligonucleotide
  Target: ATXN1; (-) strand; PAM type: NRG; PAM sequence: GGG
gaattccacagttgggttga

SEQ ID NO: 52166 - DNA, 20 bp, Artificial Sequence
  Description of Artificial Sequence: Synthetic oligonucleotide
  Target: ATXN1; (-) strand; PAM type: NRG; PAM sequence: AGG
agaattccacagttgggttg

SEQ ID NO: 52167 - DNA, 20 bp, Artificial Sequence
  Description of Artificial Sequence: Synthetic oligonucleotide
  Target: ATXN1; (-) strand; PAM type: NRG; PAM sequence: GAG
gagaattccacagttgggtt

SEQ ID NO: 52168 - DNA, 20 bp, Artificial Sequence
  Description of Artificial Sequence: Synthetic oligonucleotide
  Target: ATXN1; (-) strand; PAM type: NRG; PAM sequence: GGG
cactggagaattccacagtt

SEQ ID NO: 52169 - DNA, 20 bp, Artificial Sequence
  Description of Artificial Sequence: Synthetic oligonucleotide
  Target: ATXN1; (-) strand; PAM type: NRG; PAM sequence: TGG
tcactggagaattccacagt

SEQ ID NO: 52170 - DNA, 20 bp, Artificial Sequence
  Description of Artificial Sequence: Synthetic oligonucleotide
  Target: ATXN1; (-) strand; PAM type: NRG; PAM sequence: CAG
atagtcactggagaattcca

SEQ ID NO: 52171 - DNA, 20 bp, Artificial Sequence
  Description of Artificial Sequence: Synthetic oligonucleotide
  Target: ATXN1; (-) strand; PAM type: NRG; PAM sequence: GAG
tgtcatccacatagtcactg

SEQ ID NO: 52172 - DNA, 20 bp, Artificial Sequence
  Description of Artificial Sequence: Synthetic oligonucleotide
  Target: ATXN1; (-) strand; PAM type: NRG; PAM sequence: TGG
gatgtcatccacatagtcac

SEQ ID NO: 52173 - DNA, 20 bp, Artificial Sequence
  Description of Artificial Sequence: Synthetic oligonucleotide
  Target: ATXN1; (-) strand; PAM type: NRG; PAM sequence: TAG
tgtgtaagatgtcatccaca

SEQ ID NO: 52174 - DNA, 20 bp, Artificial Sequence
  Description of Artificial Sequence: Synthetic oligonucleotide
  Target: ATXN1; (-) strand; PAM type: NRG; PAM sequence: AAG
ggaaccaggaattcttgtgt

SEQ ID NO: 52175 - DNA, 20 bp, Artificial Sequence
  Description of Artificial Sequence: Synthetic oligonucleotide
  Target: ATXN1; (-) strand; PAM type: NRG; PAM sequence: AGG
gtagaaaaggttcaggaacc

SEQ ID NO: 52176 - DNA, 20 bp, Artificial Sequence
  Description of Artificial Sequence: Synthetic oligonucleotide
  Target: ATXN1; (-) strand; PAM type: NRG; PAM sequence: CAG
tgtagaaaaggttcaggaac

SEQ ID NO: 52177 - DNA, 20 bp, Artificial Sequence
  Description of Artificial Sequence: Synthetic oligonucleotide
  Target: ATXN1; (-) strand; PAM type: NRG; PAM sequence: AGG
tgccactgtagaaaaggttc

SEQ ID NO: 52178 - DNA, 20 bp, Artificial Sequence
  Description of Artificial Sequence: Synthetic oligonucleotide
  Target: ATXN1; (-) strand; PAM type: NRG; PAM sequence: CAG
ttgccactgtagaaaaggtt

SEQ ID NO: 52179 - DNA, 20 bp, Artificial Sequence
  Description of Artificial Sequence: Synthetic oligonucleotide
  Target: ATXN1; (-) strand; PAM type: NRG; PAM sequence: AGG
ggttgttgccactgtagaaa

SEQ ID NO: 52180 - DNA, 20 bp, Artificial Sequence
  Description of Artificial Sequence: Synthetic oligonucleotide
  Target: ATXN1; (-) strand; PAM type: NRG; PAM sequence: AAG
tggttgttgccactgtagaa

SEQ ID NO: 52181 - DNA, 20 bp, Artificial Sequence
  Description of Artificial Sequence: Synthetic oligonucleotide
  Target: ATXN1; (-) strand; PAM type: NRG; PAM sequence: TAG
gaatgtggttgttgccactg

SEQ ID NO: 52182 - DNA, 20 bp, Artificial Sequence
  Description of Artificial Sequence: Synthetic oligonucleotide
  Target: ATXN1; (-) strand; PAM type: NRG; PAM sequence: TGG
gaatgttctgaaggggaatg

SEQ ID NO: 52183 - DNA, 20 bp, Artificial Sequence
  Description of Artificial Sequence: Synthetic oligonucleotide
  Target: ATXN1; (-) strand; PAM type: NRG; PAM sequence: GGG
aacaaatgaatgttctgaag

SEQ ID NO: 52184 - DNA, 20 bp, Artificial Sequence
  Description of Artificial Sequence: Synthetic oligonucleotide
  Target: ATXN1; (-) strand; PAM type: NRG; PAM sequence: GGG
taacaaatgaatgttctgaa

SEQ ID NO: 52185 - DNA, 20 bp, Artificial Sequence
  Description of Artificial Sequence: Synthetic oligonucleotide
  Target: ATXN1; (-) strand; PAM type: NRG; PAM sequence: AGG
ttaacaaatgaatgttctga

SEQ ID NO: 52186 - DNA, 20 bp, Artificial Sequence
  Description of Artificial Sequence: Synthetic oligonucleotide
  Target: ATXN1; (-) strand; PAM type: NRG; PAM sequence: AAG
attaacaaatgaatgttctg

SEQ ID NO: 52187 - DNA, 20 bp, Artificial Sequence
  Description of Artificial Sequence: Synthetic oligonucleotide
  Target: ATXN1; (-) strand; PAM type: NRG; PAM sequence: TGG
aagagacacatcataaatat

SEQ ID NO: 52188 - DNA, 20 bp, Artificial Sequence
  Description of Artificial Sequence: Synthetic oligonucleotide
  Target: ATXN1; (-) strand; PAM type: NRG; PAM sequence: GAG
gcacacagtcagatatgaaa

SEQ ID NO: 52189 - DNA, 20 bp, Artificial Sequence
  Description of Artificial Sequence: Synthetic oligonucleotide
  Target: ATXN1; (-) strand; PAM type: NRG; PAM sequence: AAG
tagcacacagtcagatatga

SEQ ID NO: 52190 - DNA, 20 bp, Artificial Sequence
  Description of Artificial Sequence: Synthetic oligonucleotide
  Target: ATXN1; (-) strand; PAM type: NRG; PAM sequence: CAG
taatatctttagcacacagt

SEQ ID NO: 52191 - DNA, 20 bp, Artificial Sequence
  Description of Artificial Sequence: Synthetic oligonucleotide
  Target: ATXN1; (-) strand; PAM type: NRG; PAM sequence: CAG
atcttaatatctttagcaca

SEQ ID NO: 52192 - DNA, 20 bp, Artificial Sequence
  Description of Artificial Sequence: Synthetic oligonucleotide
  Target: ATXN1; (-) strand; PAM type: NRG; PAM sequence: TAG
tatggtaatcttaatatctt

SEQ ID NO: 52193 - DNA, 20 bp, Artificial Sequence
  Description of Artificial Sequence: Synthetic oligonucleotide
  Target: ATXN1; (-) strand; PAM type: NRG; PAM sequence: TGG
cattgagaacaaggacaata

SEQ ID NO: 52194 - DNA, 20 bp, Artificial Sequence
  Description of Artificial Sequence: Synthetic oligonucleotide
  Target: ATXN1; (-) strand; PAM type: NRG; PAM sequence: AGG
ctgtaagctcattgagaaca

SEQ ID NO: 52195 - DNA, 20 bp, Artificial Sequence
  Description of Artificial Sequence: Synthetic oligonucleotide
  Target: ATXN1; (-) strand; PAM type: NRG; PAM sequence: AAG
actgtaagctcattgagaac

SEQ ID NO: 52196 - DNA, 20 bp, Artificial Sequence
  Description of Artificial Sequence: Synthetic oligonucleotide
  Target: ATXN1; (-) strand; PAM type: NRG; PAM sequence: GAG
ttttagactgtaagctcatt

SEQ ID NO: 52197 - DNA, 20 bp, Artificial Sequence
  Description of Artificial Sequence: Synthetic oligonucleotide
  Target: ATXN1; (-) strand; PAM type: NRG; PAM sequence: AAG
ccctccctcttttagactgt

SEQ ID NO: 52198 - DNA, 20 bp, Artificial Sequence
  Description of Artificial Sequence: Synthetic oligonucleotide
  Target: ATXN1; (-) strand; PAM type: NRG; PAM sequence: TAG
ttctccctccctccctcttt

SEQ ID NO: 52199 - DNA, 20 bp, Artificial Sequence
  Description of Artificial Sequence: Synthetic oligonucleotide
  Target: ATXN1; (-) strand; PAM type: NRG; PAM sequence: TAG
gtaattcccgaagctccttc

SEQ ID NO: 52200 - DNA, 20 bp, Artificial Sequence
  Description of Artificial Sequence: Synthetic oligonucleotide
  Target: ATXN1; (-) strand; PAM type: NRG; PAM sequence: AAG
tctctggcttgtaattcccg

SEQ ID NO: 52201 - DNA, 20 bp, Artificial Sequence
  Description of Artificial Sequence: Synthetic oligonucleotide
  Target: ATXN1; (-) strand; PAM type: NRG; PAM sequence: TGG
accttctttgagcttttctc

SEQ ID NO: 52202 - DNA, 20 bp, Artificial Sequence
  Description of Artificial Sequence: Synthetic oligonucleotide
  Target: ATXN1; (-) strand; PAM type: NRG; PAM sequence: GAG
agtagaccatgaccttcttt

SEQ ID NO: 52203 - DNA, 20 bp, Artificial Sequence
  Description of Artificial Sequence: Synthetic oligonucleotide
  Target: ATXN1; (-) strand; PAM type: NRG; PAM sequence: TAG
caataaaaatggccaaaaag

SEQ ID NO: 52204 - DNA, 20 bp, Artificial Sequence
  Description of Artificial Sequence: Synthetic oligonucleotide
  Target: ATXN1; (-) strand; PAM type: NRG; PAM sequence: AAG
agccaataaaaatggccaaa

SEQ ID NO: 52205 - DNA, 20 bp, Artificial Sequence
  Description of Artificial Sequence: Synthetic oligonucleotide
  Target: ATXN1; (-) strand; PAM type: NRG; PAM sequence: TGG
ggagtgttagccaataaaaa

SEQ ID NO: 52206 - DNA, 20 bp, Artificial Sequence
  Description of Artificial Sequence: Synthetic oligonucleotide
  Target: ATXN1; (-) strand; PAM type: NRG; PAM sequence: TAG
gaactactgggttggagtgt

SEQ ID NO: 52207 - DNA, 20 bp, Artificial Sequence
  Description of Artificial Sequence: Synthetic oligonucleotide
  Target: ATXN1; (-) strand; PAM type: NRG; PAM sequence: GAG
atgtgggaactactgggttg

SEQ ID NO: 52208 - DNA, 20 bp, Artificial Sequence
  Description of Artificial Sequence: Synthetic oligonucleotide
  Target: ATXN1; (-) strand; PAM type: NRG; PAM sequence: TGG
gcatgtgggaactactgggt

SEQ ID NO: 52209 - DNA, 20 bp, Artificial Sequence
  Description of Artificial Sequence: Synthetic oligonucleotide
  Target: ATXN1; (-) strand; PAM type: NRG; PAM sequence: GGG
accagcatgtgggaactact

SEQ ID NO: 52210 - DNA, 20 bp, Artificial Sequence
  Description of Artificial Sequence: Synthetic oligonucleotide
  Target: ATXN1; (-) strand; PAM type: NRG; PAM sequence: TGG
gaccagcatgtgggaactac

SEQ ID NO: 52211 - DNA, 20 bp, Artificial Sequence
  Description of Artificial Sequence: Synthetic oligonucleotide
  Target: ATXN1; (-) strand; PAM type: NRG; PAM sequence: GGG
tggttctcagaccagcatgt

SEQ ID NO: 52212 - DNA, 20 bp, Artificial Sequence
  Description of Artificial Sequence: Synthetic oligonucleotide
  Target: ATXN1; (-) strand; PAM type: NRG; PAM sequence: TGG
ctggttctcagaccagcatg

SEQ ID NO: 52213 - DNA, 20 bp, Artificial Sequence
  Description of Artificial Sequence: Synthetic oligonucleotide
  Target: ATXN1; (-) strand; PAM type: NRG; PAM sequence: CAG
attggccctggttctcagac

SEQ ID NO: 52214 - DNA, 20 bp, Artificial Sequence
  Description of Artificial Sequence: Synthetic oligonucleotide
  Target: ATXN1; (-) strand; PAM type: NRG; PAM sequence: CAG
cacggattggccctggttct

SEQ ID NO: 52215 - DNA, 20 bp, Artificial Sequence
  Description of Artificial Sequence: Synthetic oligonucleotide
  Target: ATXN1; (-) strand; PAM type: NRG; PAM sequence: TGG
tcatttccacggattggccc

SEQ ID NO: 52216 - DNA, 20 bp, Artificial Sequence
  Description of Artificial Sequence: Synthetic oligonucleotide
  Target: ATXN1; (-) strand; PAM type: NRG; PAM sequence: TGG
ttttcttcatttccacggat

SEQ ID NO: 52217 - DNA, 20 bp, Artificial Sequence
  Description of Artificial Sequence: Synthetic oligonucleotide
  Target: ATXN1; (-) strand; PAM type: NRG; PAM sequence: CGG
tttatttttcttcatttcca

SEQ ID NO: 52218 - DNA, 20 bp, Artificial Sequence
  Description of Artificial Sequence: Synthetic oligonucleotide
  Target: ATXN1; (-) strand; PAM type: NRG; PAM sequence: TGG
gtcctagaaatttaatatta

SEQ ID NO: 52219 - DNA, 20 bp, Artificial Sequence
  Description of Artificial Sequence: Synthetic oligonucleotide
  Target: ATXN1; (-) strand; PAM type: NRG; PAM sequence: TAG
tataatatcagagtaagtcc

SEQ ID NO: 52220 - DNA, 20 bp, Artificial Sequence
  Description of Artificial Sequence: Synthetic oligonucleotide
  Target: ATXN1; (-) strand; PAM type: NRG; PAM sequence: AAG
aaataatataatatcagagt

SEQ ID NO: 52221 - DNA, 20 bp, Artificial Sequence
  Description of Artificial Sequence: Synthetic oligonucleotide
  Target: ATXN1; (-) strand; PAM type: NRG; PAM sequence: GAG
gtgaaaataatataatatca

SEQ ID NO: 52222 - DNA, 20 bp, Artificial Sequence
  Description of Artificial Sequence: Synthetic oligonucleotide
  Target: ATXN1; (-) strand; PAM type: NRG; PAM sequence: CAG
aagtgaaaataatataatat

SEQ ID NO: 52223 - DNA, 20 bp, Artificial Sequence
  Description of Artificial Sequence: Synthetic oligonucleotide
  Target: ATXN1; (-) strand; PAM type: NRG; PAM sequence: AAG
gggatattttaacatcccca

SEQ ID NO: 52224 - DNA, 20 bp, Artificial Sequence
  Description of Artificial Sequence: Synthetic oligonucleotide
  Target: ATXN1; (-) strand; PAM type: NRG; PAM sequence: GGG
ctaatctttttaaaaaggaa

SEQ ID NO: 52225 - DNA, 20 bp, Artificial Sequence
  Description of Artificial Sequence: Synthetic oligonucleotide
  Target: ATXN1; (-) strand; PAM type: NRG; PAM sequence: AGG
tctaatctttttaaaaagga

SEQ ID NO: 52226 - DNA, 20 bp, Artificial Sequence
  Description of Artificial Sequence: Synthetic oligonucleotide
  Target: ATXN1; (-) strand; PAM type: NRG; PAM sequence: AAG
ttctaatctttttaaaaagg

SEQ ID NO: 52227 - DNA, 20 bp, Artificial Sequence
  Description of Artificial Sequence: Synthetic oligonucleotide
  Target: ATXN1; (-) strand; PAM type: NRG; PAM sequence: AGG
gttttctaatctttttaaaa

SEQ ID NO: 52228 - DNA, 20 bp, Artificial Sequence
  Description of Artificial Sequence: Synthetic oligonucleotide
  Target: ATXN1; (-) strand; PAM type: NRG; PAM sequence: AAG
agttttctaatctttttaaa

SEQ ID NO: 52229 - DNA, 20 bp, Artificial Sequence
  Description of Artificial Sequence: Synthetic oligonucleotide
  Target: ATXN1; (-) strand; PAM type: NRG; PAM sequence: AAG
gacactggacactttaaaat

SEQ ID NO: 52230 - DNA, 20 bp, Artificial Sequence
  Description of Artificial Sequence: Synthetic oligonucleotide
  Target: ATXN1; (-) strand; PAM type: NRG; PAM sequence: TGG
ttattttaatgtaaggacac

SEQ ID NO: 52231 - DNA, 20 bp, Artificial Sequence
  Description of Artificial Sequence: Synthetic oligonucleotide
  Target: ATXN1; (-) strand; PAM type: NRG; PAM sequence: AGG
caactctttattttaatgta

SEQ ID NO: 52232 - DNA, 20 bp, Artificial Sequence
  Description of Artificial Sequence: Synthetic oligonucleotide
  Target: ATXN1; (-) strand; PAM type: NRG; PAM sequence: AAG
tcaactctttattttaatgt

SEQ ID NO: 52233 - DNA, 20 bp, Artificial Sequence
  Description of Artificial Sequence: Synthetic oligonucleotide
  Target: ATXN1; (-) strand; PAM type: NRG; PAM sequence: GGG
aatggggtactagcatatgt

SEQ ID NO: 52234 - DNA, 20 bp, Artificial Sequence
  Description of Artificial Sequence: Synthetic oligonucleotide
  Target: ATXN1; (-) strand; PAM type: NRG; PAM sequence: TGG
taatggggtactagcatatg

SEQ ID NO: 52235 - DNA, 20 bp, Artificial Sequence
  Description of Artificial Sequence: Synthetic oligonucleotide
  Target: ATXN1; (-) strand; PAM type: NRG; PAM sequence: TAG
ttagaaaattaatggggtac

SEQ ID NO: 52236 - DNA, 20 bp, Artificial Sequence
  Description of Artificial Sequence: Synthetic oligonucleotide
  Target: ATXN1; (-) strand; PAM type: NRG; PAM sequence: GGG
tgagttttagaaaattaatg

SEQ ID NO: 52237 - DNA, 20 bp, Artificial Sequence
  Description of Artificial Sequence: Synthetic oligonucleotide
  Target: ATXN1; (-) strand; PAM type: NRG; PAM sequence: GGG
atgagttttagaaaattaat

SEQ ID NO: 52238 - DNA, 20 bp, Artificial Sequence
  Description of Artificial Sequence: Synthetic oligonucleotide
  Target: ATXN1; (-) strand; PAM type: NRG; PAM sequence: TGG
gatgagttttagaaaattaa

SEQ ID NO: 52239 - DNA, 20 bp, Artificial Sequence
  Description of Artificial Sequence: Synthetic oligonucleotide
  Target: ATXN1; (-) strand; PAM type: NRG; PAM sequence: TAG
caggtttcaaggatgagttt

SEQ ID NO: 52240 - DNA, 20 bp, Artificial Sequence
  Description of Artificial Sequence: Synthetic oligonucleotide
  Target: ATXN1; (-) strand; PAM type: NRG; PAM sequence: GAG
cacttccaggtttcaaggat

SEQ ID NO: 52241 - DNA, 20 bp, Artificial Sequence
  Description of Artificial Sequence: Synthetic oligonucleotide
  Target: ATXN1; (-) strand; PAM type: NRG; PAM sequence: AGG
aaagccacttccaggtttca

SEQ ID NO: 52242 - DNA, 20 bp, Artificial Sequence
  Description of Artificial Sequence: Synthetic oligonucleotide
  Target: ATXN1; (-) strand; PAM type: NRG; PAM sequence: AAG
gaaagccacttccaggtttc

SEQ ID NO: 52243 - DNA, 20 bp, Artificial Sequence
  Description of Artificial Sequence: Synthetic oligonucleotide
  Target: ATXN1; (-) strand; PAM type: NRG; PAM sequence: AGG
agacctggaaagccacttcc

SEQ ID NO: 52244 - DNA, 20 bp, Artificial Sequence
  Description of Artificial Sequence: Synthetic oligonucleotide
  Target: ATXN1; (-) strand; PAM type: NRG; PAM sequence: CAG
tagacctggaaagccacttc

SEQ ID NO: 52245 - DNA, 20 bp, Artificial Sequence
  Description of Artificial Sequence: Synthetic oligonucleotide
  Target: ATXN1; (-) strand; PAM type: NRG; PAM sequence: AAG
ccctcccatgtagacctgga

SEQ ID NO: 52246 - DNA, 20 bp, Artificial Sequence
  Description of Artificial Sequence: Synthetic oligonucleotide
  Target: ATXN1; (-) strand; PAM type: NRG; PAM sequence: TGG
aagcccctcccatgtagacc

SEQ ID NO: 52247 - DNA, 20 bp, Artificial Sequence
  Description of Artificial Sequence: Synthetic oligonucleotide
  Target: ATXN1; (-) strand; PAM type: NRG; PAM sequence: TAG
ctaagcaagcccctcccatg

SEQ ID NO: 52248 - DNA, 20 bp, Artificial Sequence
  Description of Artificial Sequence: Synthetic oligonucleotide
  Target: ATXN1; (-) strand; PAM type: NRG; PAM sequence: AAG
agactgtccctggcctaagc

SEQ ID NO: 52249 - DNA, 20 bp, Artificial Sequence
  Description of Artificial Sequence: Synthetic oligonucleotide
  Target: ATXN1; (-) strand; PAM type: NRG; PAM sequence: AAG
aaccagactgtccctggcct

SEQ ID NO: 52250 - DNA, 20 bp, Artificial Sequence
  Description of Artificial Sequence: Synthetic oligonucleotide
  Target: ATXN1; (-) strand; PAM type: NRG; PAM sequence: TGG
cgctacaaccagactgtccc

SEQ ID NO: 52251 - DNA, 20 bp, Artificial Sequence
  Description of Artificial Sequence: Synthetic oligonucleotide
  Target: ATXN1; (-) strand; PAM type: NRG; PAM sequence: CAG
ttgccaaccctcgctacaac

SEQ ID NO: 52252 - DNA, 20 bp, Artificial Sequence
  Description of Artificial Sequence: Synthetic oligonucleotide
  Target: ATXN1; (-) strand; PAM type: NRG; PAM sequence: AAG
ggcaaatgtggcttcaaagc

SEQ ID NO: 52253 - DNA, 20 bp, Artificial Sequence
  Description of Artificial Sequence: Synthetic oligonucleotide
  Target: ATXN1; (-) strand; PAM type: NRG; PAM sequence: AAG
gacgggcaaatgtggcttca

SEQ ID NO: 52254 - DNA, 20 bp, Artificial Sequence
  Description of Artificial Sequence: Synthetic oligonucleotide
  Target: ATXN1; (-) strand; PAM type: NRG; PAM sequence: TGG
tgtaaagagacgggcaaatg

SEQ ID NO: 52255 - DNA, 20 bp, Artificial Sequence
  Description of Artificial Sequence: Synthetic oligonucleotide
  Target: ATXN1; (-) strand; PAM type: NRG; PAM sequence: GGG
cccatgttgtgtaaagagac

SEQ ID NO: 52256 - DNA, 20 bp, Artificial Sequence
  Description of Artificial Sequence: Synthetic oligonucleotide
  Target: ATXN1; (-) strand; PAM type: NRG; PAM sequence: CGG
tcccatgttgtgtaaagaga

SEQ ID NO: 52257 - DNA, 20 bp, Artificial Sequence
  Description of Artificial Sequence: Synthetic oligonucleotide
  Target: ATXN1; (-) strand; PAM type: NRG; PAM sequence: GAG
gacttcccatgttgtgtaaa

SEQ ID NO: 52258 - DNA, 20 bp, Artificial Sequence
  Description of Artificial Sequence: Synthetic oligonucleotide
  Target: ATXN1; (-) strand; PAM type: NRG; PAM sequence: AAG
atgacttcccatgttgtgta

SEQ ID NO: 52259 - DNA, 20 bp, Artificial Sequence
  Description of Artificial Sequence: Synthetic oligonucleotide
  Target: ATXN1; (-) strand; PAM type: NRG; PAM sequence: AAG
ggcacattgaatcttttatg

SEQ ID NO: 52260 - DNA, 20 bp, Artificial Sequence
  Description of Artificial Sequence: Synthetic oligonucleotide
  Target: ATXN1; (-) strand; PAM type: NRG; PAM sequence: TGG
ctggtcccccaggcttgact

SEQ ID NO: 52261 - DNA, 20 bp, Artificial Sequence
  Description of Artificial Sequence: Synthetic oligonucleotide
  Target: ATXN1; (-) strand; PAM type: NRG; PAM sequence: AGG
aggtgtgagcctggtccccc

SEQ ID NO: 52262 - DNA, 20 bp, Artificial Sequence
  Description of Artificial Sequence: Synthetic oligonucleotide
  Target: ATXN1; (-) strand; PAM type: NRG; PAM sequence: CAG
caggtgtgagcctggtcccc

SEQ ID NO: 52263 - DNA, 20 bp, Artificial Sequence
  Description of Artificial Sequence: Synthetic oligonucleotide
  Target: ATXN1; (-) strand; PAM type: NRG; PAM sequence: TGG
caggattacaggtgtgagcc

SEQ ID NO: 52264 - DNA, 20 bp, Artificial Sequence
  Description of Artificial Sequence: Synthetic oligonucleotide
  Target: ATXN1; (-) strand; PAM type: NRG; PAM sequence: GAG
aacaccaggattacaggtgt

SEQ ID NO: 52265 - DNA, 20 bp, Artificial Sequence
  Description of Artificial Sequence: Synthetic oligonucleotide
  Target: ATXN1; (-) strand; PAM type: NRG; PAM sequence: AGG
tcccaaaacaccaggattac

SEQ ID NO: 52266 - DNA, 20 bp, Artificial Sequence
  Description of Artificial Sequence: Synthetic oligonucleotide
  Target: ATXN1; (-) strand; PAM type: NRG; PAM sequence: CAG
ttcccaaaacaccaggatta

SEQ ID NO: 52267 - DNA, 20 bp, Artificial Sequence
  Description of Artificial Sequence: Synthetic oligonucleotide
  Target: ATXN1; (-) strand; PAM type: NRG; PAM sequence: AGG
cctcagcttcccaaaacacc

SEQ ID NO: 52268 - DNA, 20 bp, Artificial Sequence
  Description of Artificial Sequence: Synthetic oligonucleotide
  Target: ATXN1; (-) strand; PAM type: NRG; PAM sequence: CAG
gcctcagcttcccaaaacac

SEQ ID NO: 52269 - DNA, 20 bp, Artificial Sequence
  Description of Artificial Sequence: Synthetic oligonucleotide
  Target: ATXN1; (-) strand; PAM type: NRG; PAM sequence: CAG
gtcaagtgatcctcctgcct

SEQ ID NO: 52270 - DNA, 20 bp, Artificial Sequence
  Description of Artificial Sequence: Synthetic oligonucleotide
  Target: ATXN1; (-) strand; PAM type: NRG; PAM sequence: AAG
gatcttgacctcctggtgtc

SEQ ID NO: 52271 - DNA, 20 bp, Artificial Sequence
  Description of Artificial Sequence: Synthetic oligonucleotide
  Target: ATXN1; (-) strand; PAM type: NRG; PAM sequence: TGG
tccggctgatcttgacctcc

SEQ ID NO: 52272 - DNA, 20 bp, Artificial Sequence
  Description of Artificial Sequence: Synthetic oligonucleotide
  Target: ATXN1; (-) strand; PAM type: NRG; PAM sequence: CGG
agggtctcaccttgtttctc

SEQ ID NO: 52273 - DNA, 20 bp, Artificial Sequence
  Description of Artificial Sequence: Synthetic oligonucleotide
  Target: ATXN1; (-) strand; PAM type: NRG; PAM sequence: GGG
attatgttttttagagtcaa

SEQ ID NO: 52274 - DNA, 20 bp, Artificial Sequence
  Description of Artificial Sequence: Synthetic oligonucleotide
  Target: ATXN1; (-) strand; PAM type: NRG; PAM sequence: AGG
aattatgttttttagagtca

SEQ ID NO: 52275 - DNA, 20 bp, Artificial Sequence
  Description of Artificial Sequence: Synthetic oligonucleotide
  Target: ATXN1; (-) strand; PAM type: NRG; PAM sequence: AAG
aaattatgttttttagagtc

SEQ ID NO: 52276 - DNA, 20 bp, Artificial Sequence
  Description of Artificial Sequence: Synthetic oligonucleotide
  Target: ATXN1; (-) strand; PAM type: NRG; PAM sequence: GAG
tttttaaattatgtttttta

SEQ ID NO: 52277 - DNA, 20 bp, Artificial Sequence
  Description of Artificial Sequence: Synthetic oligonucleotide
  Target: ATXN1; (-) strand; PAM type: NRG; PAM sequence: TAG
aatttttaaattatgttttt

SEQ ID NO: 52278 - DNA, 20 bp, Artificial Sequence
  Description of Artificial Sequence: Synthetic oligonucleotide
  Target: ATXN1; (-) strand; PAM type: NRG; PAM sequence: CAG
gcaggcacatgtaccacacc

SEQ ID NO: 52279 - DNA, 20 bp, Artificial Sequence
  Description of Artificial Sequence: Synthetic oligonucleotide
  Target: ATXN1; (-) strand; PAM type: NRG; PAM sequence: AGG
ctctgagtagctgggactgc

SEQ ID NO: 52280 - DNA, 20 bp, Artificial Sequence
  Description of Artificial Sequence: Synthetic oligonucleotide
  Target: ATXN1; (-) strand; PAM type: NRG; PAM sequence: CAG
cctctgagtagctgggactg

SEQ ID NO: 52281 - DNA, 20 bp, Artificial Sequence
  Description of Artificial Sequence: Synthetic oligonucleotide
  Target: ATXN1; (-) strand; PAM type: NRG; PAM sequence: GGG
ccctcagcctctgagtagct

SEQ ID NO: 52282 - DNA, 20 bp, Artificial Sequence
  Description of Artificial Sequence: Synthetic oligonucleotide
  Target: ATXN1; (-) strand; PAM type: NRG; PAM sequence: TGG
accctcagcctctgagtagc

SEQ ID NO: 52283 - DNA, 20 bp, Artificial Sequence
  Description of Artificial Sequence: Synthetic oligonucleotide
  Target: ATXN1; (-) strand; PAM type: NRG; PAM sequence: TAG
ctccaccctcagcctctgag

SEQ ID NO: 52284 - DNA, 20 bp, Artificial Sequence
  Description of Artificial Sequence: Synthetic oligonucleotide
  Target: ATXN1; (-) strand; PAM type: NRG; PAM sequence: GAG
attctccaccctcagcctct

SEQ ID NO: 52285 - DNA, 20 bp, Artificial Sequence
  Description of Artificial Sequence: Synthetic oligonucleotide
  Target: ATXN1; (-) strand; PAM type: NRG; PAM sequence: CAG
ctcaagcgattctccaccct

SEQ ID NO: 52286 - DNA, 20 bp, Artificial Sequence
  Description of Artificial Sequence: Synthetic oligonucleotide
  Target: ATXN1; (-) strand; PAM type: NRG; PAM sequence: AAG
gtcctagccacagctctctc

SEQ ID NO: 52287 - DNA, 20 bp, Artificial Sequence
  Description of Artificial Sequence: Synthetic oligonucleotide
  Target: ATXN1; (-) strand; PAM type: NRG; PAM sequence: CAG
ccaactaaaagtcctagcca

SEQ ID NO: 52288 - DNA, 20 bp, Artificial Sequence
  Description of Artificial Sequence: Synthetic oligonucleotide
  Target: ATXN1; (-) strand; PAM type: NRG; PAM sequence: TAG
tctgccccaactaaaagtcc

SEQ ID NO: 52289 - DNA, 20 bp, Artificial Sequence
  Description of Artificial Sequence: Synthetic oligonucleotide
  Target: ATXN1; (-) strand; PAM type: NRG; PAM sequence: AAG
atttcatctgccccaactaa

SEQ ID NO: 52290 - DNA, 20 bp, Artificial Sequence
  Description of Artificial Sequence: Synthetic oligonucleotide
  Target: ATXN1; (-) strand; PAM type: NRG; PAM sequence: TAG
tttttgttgctgtctaacct

SEQ ID NO: 52291 - DNA, 20 bp, Artificial Sequence
  Description of Artificial Sequence: Synthetic oligonucleotide
  Target: ATXN1; (-) strand; PAM type: NRG; PAM sequence: AAG
aatggaggcaaaatctgcca

SEQ ID NO: 52292 - DNA, 20 bp, Artificial Sequence
  Description of Artificial Sequence: Synthetic oligonucleotide
  Target: ATXN1; (-) strand; PAM type: NRG; PAM sequence: AGG
aggagcactcttcccaatgg

SEQ ID NO: 52293 - DNA, 20 bp, Artificial Sequence
  Description of Artificial Sequence: Synthetic oligonucleotide
  Target: ATXN1; (-) strand; PAM type: NRG; PAM sequence: GAG
caggagcactcttcccaatg

SEQ ID NO: 52294 - DNA, 20 bp, Artificial Sequence
  Description of Artificial Sequence: Synthetic oligonucleotide
  Target: ATXN1; (-) strand; PAM type: NRG; PAM sequence: TGG
accaggagcactcttcccaa

SEQ ID NO: 52295 - DNA, 20 bp, Artificial Sequence
  Description of Artificial Sequence: Synthetic oligonucleotide
  Target: ATXN1; (-) strand; PAM type: NRG; PAM sequence: GAG
actcaaagtgtgtccaccag

SEQ ID NO: 52296 - DNA, 20 bp, Artificial Sequence
  Description of Artificial Sequence: Synthetic oligonucleotide
  Target: ATXN1; (-) strand; PAM type: NRG; PAM sequence: AGG
agactcaaagtgtgtccacc

SEQ ID NO: 52297 - DNA, 20 bp, Artificial Sequence
  Description of Artificial Sequence: Synthetic oligonucleotide
  Target: ATXN1; (-) strand; PAM type: NRG; PAM sequence: CAG
gagactcaaagtgtgtccac

SEQ ID NO: 52298 - DNA, 20 bp, Artificial Sequence
  Description of Artificial Sequence: Synthetic oligonucleotide
  Target: ATXN1; (-) strand; PAM type: NRG; PAM sequence: AAG
attttcctttttgagactca

SEQ ID NO: 52299 - DNA, 20 bp, Artificial Sequence
  Description of Artificial Sequence: Synthetic oligonucleotide
  Target: ATXN1; (-) strand; PAM type: NRG; PAM sequence: GAG
tcaacattattttccttttt

SEQ ID NO: 52300 - DNA, 20 bp, Artificial Sequence
  Description of Artificial Sequence: Synthetic oligonucleotide
  Target: ATXN1; (-) strand; PAM type: NRG; PAM sequence: AAG
gctgagaactgaagagctaa

SEQ ID NO: 52301 - DNA, 20 bp, Artificial Sequence
  Description of Artificial Sequence: Synthetic oligonucleotide
  Target: ATXN1; (-) strand; PAM type: NRG; PAM sequence: GAG
tgtaactgctgagaactgaa

SEQ ID NO: 52302 - DNA, 20 bp, Artificial Sequence
  Description of Artificial Sequence: Synthetic oligonucleotide
  Target: ATXN1; (-) strand; PAM type: NRG; PAM sequence: AAG
gttgtaactgctgagaactg

SEQ ID NO: 52303 - DNA, 20 bp, Artificial Sequence
  Description of Artificial Sequence: Synthetic oligonucleotide
  Target: ATXN1; (-) strand; PAM type: NRG; PAM sequence: GAG
gtacttttgttgtaactgct

SEQ ID NO: 52304 - DNA, 20 bp, Artificial Sequence
  Description of Artificial Sequence: Synthetic oligonucleotide
  Target: ATXN1; (-) strand; PAM type: NRG; PAM sequence: TAG
acactcatgagatataaaca

SEQ ID NO: 52305 - DNA, 20 bp, Artificial Sequence
  Description of Artificial Sequence: Synthetic oligonucleotide
  Target: ATXN1; (-) strand; PAM type: NRG; PAM sequence: GAG
aaatattcagttacactcat

SEQ ID NO: 52306 - DNA, 20 bp, Artificial Sequence
  Description of Artificial Sequence: Synthetic oligonucleotide
  Target: ATXN1; (-) strand; PAM type: NRG; PAM sequence: CAG
ccctaaaggggaaaaatatt

SEQ ID NO: 52307 - DNA, 20 bp, Artificial Sequence
  Description of Artificial Sequence: Synthetic oligonucleotide
  Target: ATXN1; (-) strand; PAM type: NRG; PAM sequence: GGG
cagagcccttgaccctaaag

SEQ ID NO: 52308 - DNA, 20 bp, Artificial Sequence
  Description of Artificial Sequence: Synthetic oligonucleotide
  Target: ATXN1; (-) strand; PAM type: NRG; PAM sequence: GGG
acagagcccttgaccctaaa

SEQ ID NO: 52309 - DNA, 20 bp, Artificial Sequence
  Description of Artificial Sequence: Synthetic oligonucleotide
  Target: ATXN1; (-) strand; PAM type: NRG; PAM sequence: AGG
gacagagcccttgaccctaa

SEQ ID NO: 52310 - DNA, 20 bp, Artificial Sequence
  Description of Artificial Sequence: Synthetic oligonucleotide
  Target: ATXN1; (-) strand; PAM type: NRG; PAM sequence: AAG
agacagagcccttgacccta

SEQ ID NO: 52311 - DNA, 20 bp, Artificial Sequence
  Description of Artificial Sequence: Synthetic oligonucleotide
  Target: ATXN1; (-) strand; PAM type: NRG; PAM sequence: GAG
aacaagtgatccctgagaca

SEQ ID NO: 52312 - DNA, 20 bp, Artificial Sequence
  Description of Artificial Sequence: Synthetic oligonucleotide
  Target: ATXN1; (-) strand; PAM type: NRG; PAM sequence: CAG
gaaacaagtgatccctgaga

SEQ ID NO: 52313 - DNA, 20 bp, Artificial Sequence
  Description of Artificial Sequence: Synthetic oligonucleotide
  Target: ATXN1; (-) strand; PAM type: NRG; PAM sequence: GAG
ttaagaaacaagtgatccct

SEQ ID NO: 52314 - DNA, 20 bp, Artificial Sequence
  Description of Artificial Sequence: Synthetic oligonucleotide
  Target: ATXN1; (-) strand; PAM type: NRG; PAM sequence: AAG
cagcctgagatttaagaaac

SEQ ID NO: 52315 - DNA, 20 bp, Artificial Sequence
  Description of Artificial Sequence: Synthetic oligonucleotide
  Target: ATXN1; (-) strand; PAM type: NRG; PAM sequence: AAG
aatgtagcagcctgagattt

SEQ ID NO: 52316 - DNA, 20 bp, Artificial Sequence
  Description of Artificial Sequence: Synthetic oligonucleotide
  Target: ATXN1; (-) strand; PAM type: NRG; PAM sequence: GAG
ttgagaaaatgtagcagcct

SEQ ID NO: 52317 - DNA, 20 bp, Artificial Sequence
  Description of Artificial Sequence: Synthetic oligonucleotide
  Target: ATXN1; (-) strand; PAM type: NRG; PAM sequence: CAG
tggtggttgagaaaatgtag

SEQ ID NO: 52318 - DNA, 20 bp, Artificial Sequence
  Description of Artificial Sequence: Synthetic oligonucleotide
  Target: ATXN1; (-) strand; PAM type: NRG; PAM sequence: TAG
gactggtggttgagaaaatg

SEQ ID NO: 52319 - DNA, 20 bp, Artificial Sequence
  Description of Artificial Sequence: Synthetic oligonucleotide
  Target: ATXN1; (-) strand; PAM type: NRG; PAM sequence: GAG
gactaatacgactggtggtt

SEQ ID NO: 52320 - DNA, 20 bp, Artificial Sequence
  Description of Artificial Sequence: Synthetic oligonucleotide
  Target: ATXN1; (-) strand; PAM type: NRG; PAM sequence: TGG
aaatggactaatacgactgg

SEQ ID NO: 52321 - DNA, 20 bp, Artificial Sequence
  Description of Artificial Sequence: Synthetic oligonucleotide
  Target: ATXN1; (-) strand; PAM type: NRG; PAM sequence: TGG
taaaaatggactaatacgac

SEQ ID NO: 52322 - DNA, 20 bp, Artificial Sequence
  Description of Artificial Sequence: Synthetic oligonucleotide
  Target: ATXN1; (-) strand; PAM type: NRG; PAM sequence: TGG
ctttatcaacagcataaaaa

SEQ ID NO: 52323 - DNA, 20 bp, Artificial Sequence
  Description of Artificial Sequence: Synthetic oligonucleotide
  Target: ATXN1; (-) strand; PAM type: NRG; PAM sequence: CAG
ctcgggtatgtctttatcaa

SEQ ID NO: 52324 - DNA, 20 bp, Artificial Sequence
  Description of Artificial Sequence: Synthetic oligonucleotide
  Target: ATXN1; (-) strand; PAM type: NRG; PAM sequence: GGG
tttgtaaattgctcagtctc

SEQ ID NO: 52325 - DNA, 20 bp, Artificial Sequence
  Description of Artificial Sequence: Synthetic oligonucleotide
  Target: ATXN1; (-) strand; PAM type: NRG; PAM sequence: CGG
ttttgtaaattgctcagtct

SEQ ID NO: 52326 - DNA, 20 bp, Artificial Sequence
  Description of Artificial Sequence: Synthetic oligonucleotide
  Target: ATXN1; (-) strand; PAM type: NRG; PAM sequence: CAG
tctttcttttgtaaattgct

SEQ ID NO: 52327 - DNA, 20 bp, Artificial Sequence
  Description of Artificial Sequence: Synthetic oligonucleotide
  Target: ATXN1; (-) strand; PAM type: NRG; PAM sequence: AAG
cctcagccatgtggaactgt

SEQ ID NO: 52328 - DNA, 20 bp, Artificial Sequence
  Description of Artificial Sequence: Synthetic oligonucleotide
  Target: ATXN1; (-) strand; PAM type: NRG; PAM sequence: TGG
gagaggcttcctcagccatg

SEQ ID NO: 52329 - DNA, 20 bp, Artificial Sequence
  Description of Artificial Sequence: Synthetic oligonucleotide
  Target: ATXN1; (-) strand; PAM type: NRG; PAM sequence: CAG
ccatgattgagaggcttcct

SEQ ID NO: 52330 - DNA, 20 bp, Artificial Sequence
  Description of Artificial Sequence: Synthetic oligonucleotide
  Target: ATXN1; (-) strand; PAM type: NRG; PAM sequence: AGG
tgccttccaccatgattgag

SEQ ID NO: 52331 - DNA, 20 bp, Artificial Sequence
  Description of Artificial Sequence: Synthetic oligonucleotide
  Target: ATXN1; (-) strand; PAM type: NRG; PAM sequence: GAG
ttgccttccaccatgattga

SEQ ID NO: 52332 - DNA, 20 bp, Artificial Sequence
  Description of Artificial Sequence: Synthetic oligonucleotide
  Target: ATXN1; (-) strand; PAM type: NRG; PAM sequence: GAG
ccttgccttccaccatgatt

SEQ ID NO: 52333 - DNA, 20 bp, Artificial Sequence
  Description of Artificial Sequence: Synthetic oligonucleotide
  Target: ATXN1; (-) strand; PAM type: NRG; PAM sequence: AAG
ttgcctgccaccatccatgt

SEQ ID NO: 52334 - DNA, 20 bp, Artificial Sequence
  Description of Artificial Sequence: Synthetic oligonucleotide
  Target: ATXN1; (-) strand; PAM type: NRG; PAM sequence: AAG
aaagaggcattcccctgcat

SEQ ID NO: 52335 - DNA, 20 bp, Artificial Sequence
  Description of Artificial Sequence: Synthetic oligonucleotide
  Target: ATXN1; (-) strand; PAM type: NRG; PAM sequence: AGG
gatctgatggttttaaaaag

SEQ ID NO: 52336 - DNA, 20 bp, Artificial Sequence
  Description of Artificial Sequence: Synthetic oligonucleotide
  Target: ATXN1; (-) strand; PAM type: NRG; PAM sequence: GAG
agatctgatggttttaaaaa

SEQ ID NO: 52337 - DNA, 20 bp, Artificial Sequence
  Description of Artificial Sequence: Synthetic oligonucleotide
  Target: ATXN1; (-) strand; PAM type: NRG; PAM sequence: AAG
cgagatctgatggttttaaa

SEQ ID NO: 52338 - DNA, 20 bp, Artificial Sequence
  Description of Artificial Sequence: Synthetic oligonucleotide
  Target: ATXN1; (-) strand; PAM type: NRG; PAM sequence: TGG
ataagtctcacgagatctga

SEQ ID NO: 52339 - DNA, 20 bp, Artificial Sequence
  Description of Artificial Sequence: Synthetic oligonucleotide
  Target: ATXN1; (-) strand; PAM type: NRG; PAM sequence: GAG
tggtaatggataagtctcac

SEQ ID NO: 52340 - DNA, 20 bp, Artificial Sequence
  Description of Artificial Sequence: Synthetic oligonucleotide
  Target: ATXN1; (-) strand; PAM type: NRG; PAM sequence: AAG
ctgttctcgtggtaatggat

SEQ ID NO: 52341 - DNA, 20 bp, Artificial Sequence
  Description of Artificial Sequence: Synthetic oligonucleotide
  Target: ATXN1; (-) strand; PAM type: NRG; PAM sequence: TGG
ccatgctgttctcgtggtaa

SEQ ID NO: 52342 - DNA, 20 bp, Artificial Sequence
  Description of Artificial Sequence: Synthetic oligonucleotide
  Target: ATXN1; (-) strand; PAM type: NRG; PAM sequence: TGG
tctttcccatgctgttctcg

SEQ ID NO: 52343 - DNA, 20 bp, Artificial Sequence
  Description of Artificial Sequence: Synthetic oligonucleotide
  Target: ATXN1; (-) strand; PAM type: NRG; PAM sequence: AGG
ggtattgaatcatggggggc

SEQ ID NO: 52344 - DNA, 20 bp, Artificial Sequence
  Description of Artificial Sequence: Synthetic oligonucleotide
  Target: ATXN1; (-) strand; PAM type: NRG; PAM sequence: CAG
aggtattgaatcatgggggg

SEQ ID NO: 52345 - DNA, 20 bp, Artificial Sequence
  Description of Artificial Sequence: Synthetic oligonucleotide
  Target: ATXN1; (-) strand; PAM type: NRG; PAM sequence: GGG
gggaggtattgaatcatggg

SEQ ID NO: 52346 - DNA, 20 bp, Artificial Sequence
  Description of Artificial Sequence: Synthetic oligonucleotide
  Target: ATXN1; (-) strand; PAM type: NRG; PAM sequence: GGG
tgggaggtattgaatcatgg

SEQ ID NO: 52347 - DNA, 20 bp, Artificial Sequence
  Description of Artificial Sequence: Synthetic oligonucleotide
  Target: ATXN1; (-) strand; PAM type: NRG; PAM sequence: GGG
gtgggaggtattgaatcatg

SEQ ID NO: 52348 - DNA, 20 bp, Artificial Sequence
  Description of Artificial Sequence: Synthetic oligonucleotide
  Target: ATXN1; (-) strand; PAM type: NRG; PAM sequence: GGG
ggtgggaggtattgaatcat

SEQ ID NO: 52349 - DNA, 20 bp, Artificial Sequence
  Description of Artificial Sequence: Synthetic oligonucleotide
  Target: ATXN1; (-) strand; PAM type: NRG; PAM sequence: TGG
tggtgggaggtattgaatca

SEQ ID NO: 52350 - DNA, 20 bp, Artificial Sequence
  Description of Artificial Sequence: Synthetic oligonucleotide
  Target: ATXN1; (-) strand; PAM type: NRG; PAM sequence: AGG
tgtgggagggacctggtggg

SEQ ID NO: 52351 - DNA, 20 bp, Artificial Sequence
  Description of Artificial Sequence: Synthetic oligonucleotide
  Target: ATXN1; (-) strand; PAM type: NRG; PAM sequence: GAG
gtgtgggagggacctggtgg

SEQ ID NO: 52352 - DNA, 20 bp, Artificial Sequence
  Description of Artificial Sequence: Synthetic oligonucleotide
  Target: ATXN1; (-) strand; PAM type: NRG; PAM sequence: GGG
gtgtgtgggagggacctggt

SEQ ID NO: 52353 - DNA, 20 bp, Artificial Sequence
  Description of Artificial Sequence: Synthetic oligonucleotide
  Target: ATXN1; (-) strand; PAM type: NRG; PAM sequence: TGG
tgtgtgtgggagggacctgg

SEQ ID NO: 52354 - DNA, 20 bp, Artificial Sequence
  Description of Artificial Sequence: Synthetic oligonucleotide
  Target: ATXN1; (-) strand; PAM type: NRG; PAM sequence: TGG
ccatgtgtgtgggagggacc

SEQ ID NO: 52355 - DNA, 20 bp, Artificial Sequence
  Description of Artificial Sequence: Synthetic oligonucleotide
  Target: ATXN1; (-) strand; PAM type: NRG; PAM sequence: GGG
gacctcccatgtgtgtggga

SEQ ID NO: 52356 - DNA, 20 bp, Artificial Sequence
  Description of Artificial Sequence: Synthetic oligonucleotide
  Target: ATXN1; (-) strand; PAM type: NRG; PAM sequence: AGG
tgacctcccatgtgtgtggg

SEQ ID NO: 52357 - DNA, 20 bp, Artificial Sequence
  Description of Artificial Sequence: Synthetic oligonucleotide
  Target: ATXN1; (-) strand; PAM type: NRG; PAM sequence: GAG
ttgacctcccatgtgtgtgg

SEQ ID NO: 52358 - DNA, 20 bp, Artificial Sequence
  Description of Artificial Sequence: Synthetic oligonucleotide
  Target: ATXN1; (-) strand; PAM type: NRG; PAM sequence: GGG
tcttgacctcccatgtgtgt

SEQ ID NO: 52359 - DNA, 20 bp, Artificial Sequence
  Description of Artificial Sequence: Synthetic oligonucleotide
  Target: ATXN1; (-) strand; PAM type: NRG; PAM sequence: TGG
atcttgacctcccatgtgtg

SEQ ID NO: 52360 - DNA, 20 bp, Artificial Sequence
  Description of Artificial Sequence: Synthetic oligonucleotide
  Target: ATXN1; (-) strand; PAM type: NRG; PAM sequence: CAG
ggtttggctgtgtccctgcc

SEQ ID NO: 52361 - DNA, 20 bp, Artificial Sequence
  Description of Artificial Sequence: Synthetic oligonucleotide
  Target: ATXN1; (-) strand; PAM type: NRG; PAM sequence: TGG
gatcaactgatgatatggtt

SEQ ID NO: 52362 - DNA, 20 bp, Artificial Sequence
  Description of Artificial Sequence: Synthetic oligonucleotide
  Target: ATXN1; (-) strand; PAM type: NRG; PAM sequence: TGG
atatagatcaactgatgata

SEQ ID NO: 52363 - DNA, 20 bp, Artificial Sequence
  Description of Artificial Sequence: Synthetic oligonucleotide
  Target: ATXN1; (-) strand; PAM type: NRG; PAM sequence: TAG
tcttgttttttccagccata

SEQ ID NO: 52364 - DNA, 20 bp, Artificial Sequence
  Description of Artificial Sequence: Synthetic oligonucleotide
  Target: ATXN1; (-) strand; PAM type: NRG; PAM sequence: CAG
gcgagaagtcttgttttttc

SEQ ID NO: 52365 - DNA, 20 bp, Artificial Sequence
  Description of Artificial Sequence: Synthetic oligonucleotide
  Target: ATXN1; (-) strand; PAM type: NRG; PAM sequence: AAG
aactgtcagtggttggcgag

SEQ ID NO: 52366 - DNA, 20 bp, Artificial Sequence
  Description of Artificial Sequence: Synthetic oligonucleotide
  Target: ATXN1; (-) strand; PAM type: NRG; PAM sequence: GAG
aaaaactgtcagtggttggc

SEQ ID NO: 52367 - DNA, 20 bp, Artificial Sequence
  Description of Artificial Sequence: Synthetic oligonucleotide
  Target: ATXN1; (-) strand; PAM type: NRG; PAM sequence: TGG
aaaaaaaaactgtcagtggt

SEQ ID NO: 52368 - DNA, 20 bp, Artificial Sequence
  Description of Artificial Sequence: Synthetic oligonucleotide
  Target: ATXN1; (-) strand; PAM type: NRG; PAM sequence: TGG
aaaaaaaaaaaaactgtcag

SEQ ID NO: 52369 - DNA, 20 bp, Artificial Sequence
  Description of Artificial Sequence: Synthetic oligonucleotide
  Target: ATXN1; (-) strand; PAM type: NRG; PAM sequence: CAG
aaaaaaaaaaaaaaaactgt

SEQ ID NO: 52370 - DNA, 20 bp, Artificial Sequence
  Description of Artificial Sequence: Synthetic oligonucleotide
  Target: ATXN1; (-) strand; PAM type: NRG; PAM sequence: AAG
tgaccaagcattagaactag

SEQ ID NO: 52371 - DNA, 20 bp, Artificial Sequence
  Description of Artificial Sequence: Synthetic oligonucleotide
  Target: ATXN1; (-) strand; PAM type: NRG; PAM sequence: TAG
taatgaccaagcattagaac

SEQ ID NO: 52372 - DNA, 20 bp, Artificial Sequence
  Description of Artificial Sequence: Synthetic oligonucleotide
  Target: ATXN1; (-) strand; PAM type: NRG; PAM sequence: TAG
agaaattaatgaccaagcat

SEQ ID NO: 52373 - DNA, 20 bp, Artificial Sequence
  Description of Artificial Sequence: Synthetic oligonucleotide
  Target: ATXN1; (-) strand; PAM type: NRG; PAM sequence: AAG
ttctagagaaattaatgacc

SEQ ID NO: 52374 - DNA, 20 bp, Artificial Sequence
  Description of Artificial Sequence: Synthetic oligonucleotide
  Target: ATXN1; (-) strand; PAM type: NRG; PAM sequence: GAG
caaatatattctgagttcta

SEQ ID NO: 52375 - DNA, 20 bp, Artificial Sequence
  Description of Artificial Sequence: Synthetic oligonucleotide
  Target: ATXN1; (-) strand; PAM type: NRG; PAM sequence: TAG
atcaaatatattctgagttc

SEQ ID NO: 52376 - DNA, 20 bp, Artificial Sequence
  Description of Artificial Sequence: Synthetic oligonucleotide
  Target: ATXN1; (-) strand; PAM type: NRG; PAM sequence: GAG
atgtgcatcaaatatattct

SEQ ID NO: 52377 - DNA, 20 bp, Artificial Sequence
  Description of Artificial Sequence: Synthetic oligonucleotide
  Target: ATXN1; (-) strand; PAM type: NRG; PAM sequence: CAG
taaataaaaaggaaggagaa

SEQ ID NO: 52378 - DNA, 20 bp, Artificial Sequence
  Description of Artificial Sequence: Synthetic oligonucleotide
  Target: ATXN1; (-) strand; PAM type: NRG; PAM sequence: GAG
aagggtaaataaaaaggaag

SEQ ID NO: 52379 - DNA, 20 bp, Artificial Sequence
  Description of Artificial Sequence: Synthetic oligonucleotide
  Target: ATXN1; (-) strand; PAM type: NRG; PAM sequence: AGG
taaagggtaaataaaaagga

SEQ ID NO: 52380 - DNA, 20 bp, Artificial Sequence
  Description of Artificial Sequence: Synthetic oligonucleotide
  Target: ATXN1; (-) strand; PAM type: NRG; PAM sequence: AAG
ttaaagggtaaataaaaagg

SEQ ID NO: 52381 - DNA, 20 bp, Artificial Sequence
  Description of Artificial Sequence: Synthetic oligonucleotide
  Target: ATXN1; (-) strand; PAM type: NRG; PAM sequence: AGG
acattaaagggtaaataaaa

SEQ ID NO: 52382 - DNA, 20 bp, Artificial Sequence
  Description of Artificial Sequence: Synthetic oligonucleotide
  Target: ATXN1; (-) strand; PAM type: NRG; PAM sequence: AAG
aacattaaagggtaaataaa

SEQ ID NO: 52383 - DNA, 20 bp, Artificial Sequence
  Description of Artificial Sequence: Synthetic oligonucleotide
  Target: ATXN1; (-) strand; PAM type: NRG; PAM sequence: GGG
tgttttgtgaaaacattaaa

SEQ ID NO: 52384 - DNA, 20 bp, Artificial Sequence
  Description of Artificial Sequence: Synthetic oligonucleotide
  Target: ATXN1; (-) strand; PAM type: NRG; PAM sequence: AGG
ctgttttgtgaaaacattaa

SEQ ID NO: 52385 - DNA, 20 bp, Artificial Sequence
  Description of Artificial Sequence: Synthetic oligonucleotide
  Target: ATXN1; (-) strand; PAM type: NRG; PAM sequence: AAG
cctgttttgtgaaaacatta

SEQ ID NO: 52386 - DNA, 20 bp, Artificial Sequence
  Description of Artificial Sequence: Synthetic oligonucleotide
  Target: ATXN1; (-) strand; PAM type: NRG; PAM sequence: TGG
agaaaaaccataaaatcctc

SEQ ID NO: 52387 - DNA, 20 bp, Artificial Sequence
  Description of Artificial Sequence: Synthetic oligonucleotide
  Target: ATXN1; (-) strand; PAM type: NRG; PAM sequence: TAG
cgtaagttttaaaaacgaat

SEQ ID NO: 52388 - DNA, 20 bp, Artificial Sequence
  Description of Artificial Sequence: Synthetic oligonucleotide
  Target: ATXN1; (-) strand; PAM type: NRG; PAM sequence: AAG
ctataagccagttgtctcgt

SEQ ID NO: 52389 - DNA, 20 bp, Artificial Sequence
  Description of Artificial Sequence: Synthetic oligonucleotide
  Target: ATXN1; (-) strand; PAM type: NRG; PAM sequence: CAG
actggaaaattgctataagc

SEQ ID NO: 52390 - DNA, 20 bp, Artificial Sequence
  Description of Artificial Sequence: Synthetic oligonucleotide
  Target: ATXN1; (-) strand; PAM type: NRG; PAM sequence: AAG
gttaactggaaaattgctat

SEQ ID NO: 52391 - DNA, 20 bp, Artificial Sequence
  Description of Artificial Sequence: Synthetic oligonucleotide
  Target: ATXN1; (-) strand; PAM type: NRG; PAM sequence: TGG
gttgtgttcgtgttgttaac

SEQ ID NO: 52392 - DNA, 20 bp, Artificial Sequence
  Description of Artificial Sequence: Synthetic oligonucleotide
  Target: ATXN1; (-) strand; PAM type: NRG; PAM sequence: GGG
ttctgttgttcttggcttgt

SEQ ID NO: 52393 - DNA, 20 bp, Artificial Sequence
  Description of Artificial Sequence: Synthetic oligonucleotide
  Target: ATXN1; (-) strand; PAM type: NRG; PAM sequence: TGG
cttctgttgttcttggcttg

SEQ ID NO: 52394 - DNA, 20 bp, Artificial Sequence
  Description of Artificial Sequence: Synthetic oligonucleotide
  Target: ATXN1; (-) strand; PAM type: NRG; PAM sequence: TGG
ctctcctcttctgttgttct

SEQ ID NO: 52395 - DNA, 20 bp, Artificial Sequence
  Description of Artificial Sequence: Synthetic oligonucleotide
  Target: ATXN1; (-) strand; PAM type: NRG; PAM sequence: AAG
agcagtgggaaagatctcat

SEQ ID NO: 52396 - DNA, 20 bp, Artificial Sequence
  Description of Artificial Sequence: Synthetic oligonucleotide
  Target: ATXN1; (-) strand; PAM type: NRG; PAM sequence: AAG
tctggtgctaagcagtggga

SEQ ID NO: 52397 - DNA, 20 bp, Artificial Sequence
  Description of Artificial Sequence: Synthetic oligonucleotide
  Target: ATXN1; (-) strand; PAM type: NRG; PAM sequence: GGG
tagatctggtgctaagcagt

SEQ ID NO: 52398 - DNA, 20 bp, Artificial Sequence
  Description of Artificial Sequence: Synthetic oligonucleotide
  Target: ATXN1; (-) strand; PAM type: NRG; PAM sequence: TGG
atagatctggtgctaagcag

SEQ ID NO: 52399 - DNA, 20 bp, Artificial Sequence
  Description of Artificial Sequence: Synthetic oligonucleotide
  Target: ATXN1; (-) strand; PAM type: NRG; PAM sequence: CAG
attatagatctggtgctaag

SEQ ID NO: 52400 - DNA, 20 bp, Artificial Sequence
  Description of Artificial Sequence: Synthetic oligonucleotide
  Target: ATXN1; (-) strand; PAM type: NRG; PAM sequence: AAG
tgcattatagatctggtgct

SEQ ID NO: 52401 - DNA, 20 bp, Artificial Sequence
  Description of Artificial Sequence: Synthetic oligonucleotide
  Target: ATXN1; (-) strand; PAM type: NRG; PAM sequence: TGG
ccttgcatgcattatagatc

SEQ ID NO: 52402 - DNA, 20 bp, Artificial Sequence
  Description of Artificial Sequence: Synthetic oligonucleotide
  Target: ATXN1; (-) strand; PAM type: NRG; PAM sequence: TAG
gctaagccttgcatgcatta

SEQ ID NO: 52403 - DNA, 20 bp, Artificial Sequence
  Description of Artificial Sequence: Synthetic oligonucleotide
  Target: ATXN1; (-) strand; PAM type: NRG; PAM sequence: AAG
tttcatcatttgttccagct

SEQ ID NO: 52404 - DNA, 20 bp, Artificial Sequence
  Description of Artificial Sequence: Synthetic oligonucleotide
  Target: ATXN1; (-) strand; PAM type: NRG; PAM sequence: CAG
acagctttcatcatttgttc

SEQ ID NO: 52405 - DNA, 20 bp, Artificial Sequence
  Description of Artificial Sequence: Synthetic oligonucleotide
  Target: ATXN1; (-) strand; PAM type: NRG; PAM sequence: CAG
tcctcccttgaaaggaggaa

SEQ ID NO: 52406 - DNA, 20 bp, Artificial Sequence
  Description of Artificial Sequence: Synthetic oligonucleotide
  Target: ATXN1; (-) strand; PAM type: NRG; PAM sequence: AGG
aatgatcctcccttgaaagg

SEQ ID NO: 52407 - DNA, 20 bp, Artificial Sequence
  Description of Artificial Sequence: Synthetic oligonucleotide
  Target: ATXN1; (-) strand; PAM type: NRG; PAM sequence: GAG
aaatgatcctcccttgaaag

SEQ ID NO: 52408 - DNA, 20 bp, Artificial Sequence
  Description of Artificial Sequence: Synthetic oligonucleotide
  Target: ATXN1; (-) strand; PAM type: NRG; PAM sequence: AGG
gtaaatgatcctcccttgaa

SEQ ID NO: 52409 - DNA, 20 bp, Artificial Sequence
  Description of Artificial Sequence: Synthetic oligonucleotide
  Target: ATXN1; (-) strand; PAM type: NRG; PAM sequence: AAG
tgtaaatgatcctcccttga

SEQ ID NO: 52410 - DNA, 20 bp, Artificial Sequence
  Description of Artificial Sequence: Synthetic oligonucleotide
  Target: ATXN1; (-) strand; PAM type: NRG; PAM sequence: GGG
aatgagaacaggagtggtct

SEQ ID NO: 52411 - DNA, 20 bp, Artificial Sequence
  Description of Artificial Sequence: Synthetic oligonucleotide
  Target: ATXN1; (-) strand; PAM type: NRG; PAM sequence: TGG
aaatgagaacaggagtggtc

SEQ ID NO: 52412 - DNA, 20 bp, Artificial Sequence
  Description of Artificial Sequence: Synthetic oligonucleotide
  Target: ATXN1; (-) strand; PAM type: NRG; PAM sequence: TGG
tgaataaatgagaacaggag

SEQ ID NO: 52413 - DNA, 20 bp, Artificial Sequence
  Description of Artificial Sequence: Synthetic oligonucleotide
  Target: ATXN1; (-) strand; PAM type: NRG; PAM sequence: GAG
agttgaataaatgagaacag

SEQ ID NO: 52414 - DNA, 20 bp, Artificial Sequence
  Description of Artificial Sequence: Synthetic oligonucleotide
  Target: ATXN1; (-) strand; PAM type: NRG; PAM sequence: AGG
gaagttgaataaatgagaac

SEQ ID NO: 52415 - DNA, 20 bp, Artificial Sequence
  Description of Artificial Sequence: Synthetic oligonucleotide
  Target: ATXN1; (-) strand; PAM type: NRG; PAM sequence: CAG
ggaagttgaataaatgagaa

SEQ ID NO: 52416 - DNA, 20 bp, Artificial Sequence
  Description of Artificial Sequence: Synthetic oligonucleotide
  Target: ATXN1; (-) strand; PAM type: NRG; PAM sequence: GAG
gggctggaagttgaataaat

SEQ ID NO: 52417 - DNA, 20 bp, Artificial Sequence
  Description of Artificial Sequence: Synthetic oligonucleotide
  Target: ATXN1; (-) strand; PAM type: NRG; PAM sequence: AAG
ttaatgtcagtgagggctgg

SEQ ID NO: 52418 - DNA, 20 bp, Artificial Sequence
  Description of Artificial Sequence: Synthetic oligonucleotide
  Target: ATXN1; (-) strand; PAM type: NRG; PAM sequence: TGG
tggttaatgtcagtgagggc

SEQ ID NO: 52419 - DNA, 20 bp, Artificial Sequence
  Description of Artificial Sequence: Synthetic oligonucleotide
  Target: ATXN1; (-) strand; PAM type: NRG; PAM sequence: GGG
ctcctggttaatgtcagtga

SEQ ID NO: 52420 - DNA, 20 bp, Artificial Sequence
  Description of Artificial Sequence: Synthetic oligonucleotide
  Target: ATXN1; (-) strand; PAM type: NRG; PAM sequence: AGG
gctcctggttaatgtcagtg

SEQ ID NO: 52421 - DNA, 20 bp, Artificial Sequence
  Description of Artificial Sequence: Synthetic oligonucleotide
  Target: ATXN1; (-) strand; PAM type: NRG; PAM sequence: GAG
tgctcctggttaatgtcagt

SEQ ID NO: 52422 - DNA, 20 bp, Artificial Sequence
  Description of Artificial Sequence: Synthetic oligonucleotide
  Target: ATXN1; (-) strand; PAM type: NRG; PAM sequence: CAG
tctctgctcctggttaatgt

SEQ ID NO: 52423 - DNA, 20 bp, Artificial Sequence
  Description of Artificial Sequence: Synthetic oligonucleotide
  Target: ATXN1; (-) strand; PAM type: NRG; PAM sequence: TGG
caccagatgttctctgctcc

SEQ ID NO: 52424 - DNA, 20 bp, Artificial Sequence
  Description of Artificial Sequence: Synthetic oligonucleotide
  Target: ATXN1; (-) strand; PAM type: NRG; PAM sequence: CAG
gcgggagttggttctgacac

SEQ ID NO: 52425 - DNA, 20 bp, Artificial Sequence
  Description of Artificial Sequence: Synthetic oligonucleotide
  Target: ATXN1; (-) strand; PAM type: NRG; PAM sequence: TGG
gccctgggcacagcgggagt

SEQ ID NO: 52426 - DNA, 20 bp, Artificial Sequence
  Description of Artificial Sequence: Synthetic oligonucleotide
  Target: ATXN1; (-) strand; PAM type: NRG; PAM sequence: GAG
aacagccctgggcacagcgg

SEQ ID NO: 52427 - DNA, 20 bp, Artificial Sequence
  Description of Artificial Sequence: Synthetic oligonucleotide
  Target: ATXN1; (-) strand; PAM type: NRG; PAM sequence: GGG
acaacagccctgggcacagc

SEQ ID NO: 52428 - DNA, 20 bp, Artificial Sequence
  Description of Artificial Sequence: Synthetic oligonucleotide
  Target: ATXN1; (-) strand; PAM type: NRG; PAM sequence: CGG
gacaacagccctgggcacag

SEQ ID NO: 52429 - DNA, 20 bp, Artificial Sequence
  Description of Artificial Sequence: Synthetic oligonucleotide
  Target: ATXN1; (-) strand; PAM type: NRG; PAM sequence: CAG
tgagacaacagccctgggca

SEQ ID NO: 52430 - DNA, 20 bp, Artificial Sequence
  Description of Artificial Sequence: Synthetic oligonucleotide
  Target: ATXN1; (-) strand; PAM type: NRG; PAM sequence: GGG
aacagtgagacaacagccct

SEQ ID NO: 52431 - DNA, 20 bp, Artificial Sequence
  Description of Artificial Sequence: Synthetic oligonucleotide
  Target: ATXN1; (-) strand; PAM type: NRG; PAM sequence: TGG
caacagtgagacaacagccc

SEQ ID NO: 52432 - DNA, 20 bp, Artificial Sequence
  Description of Artificial Sequence: Synthetic oligonucleotide
  Target: ATXN1; (-) strand; PAM type: NRG; PAM sequence: CAG
tttctgcaacagtgagacaa

SEQ ID NO: 52433 - DNA, 20 bp, Artificial Sequence
  Description of Artificial Sequence: Synthetic oligonucleotide
  Target: ATXN1; (-) strand; PAM type: NRG; PAM sequence: GAG
ctggccttttctgcaacagt

SEQ ID NO: 52434 - DNA, 20 bp, Artificial Sequence
  Description of Artificial Sequence: Synthetic oligonucleotide
  Target: ATXN1; (-) strand; PAM type: NRG; PAM sequence: CAG
ccctctggccttttctgcaa

SEQ ID NO: 52435 - DNA, 20 bp, Artificial Sequence
  Description of Artificial Sequence: Synthetic oligonucleotide
  Target: ATXN1; (-) strand; PAM type: NRG; PAM sequence: TGG
agccaagcagccttgccctc

SEQ ID NO: 52436 - DNA, 20 bp, Artificial Sequence
  Description of Artificial Sequence: Synthetic oligonucleotide
  Target: ATXN1; (-) strand; PAM type: NRG; PAM sequence: CAG
gaggcccatcttcagccaag

SEQ ID NO: 52437 - DNA, 20 bp, Artificial Sequence
  Description of Artificial Sequence: Synthetic oligonucleotide
  Target: ATXN1; (-) strand; PAM type: NRG; PAM sequence: AAG
tctgaggcccatcttcagcc

SEQ ID NO: 52438 - DNA, 20 bp, Artificial Sequence
  Description of Artificial Sequence: Synthetic oligonucleotide
  Target: ATXN1; (-) strand; PAM type: NRG; PAM sequence: CAG
gaacctctgaggcccatctt

SEQ ID NO: 52439 - DNA, 20 bp, Artificial Sequence
  Description of Artificial Sequence: Synthetic oligonucleotide
  Target: ATXN1; (-) strand; PAM type: NRG; PAM sequence: AGG
taaaaagcccagaacctctg

SEQ ID NO: 52440 - DNA, 20 bp, Artificial Sequence
  Description of Artificial Sequence: Synthetic oligonucleotide
  Target: ATXN1; (-) strand; PAM type: NRG; PAM sequence: GAG
ataaaaagcccagaacctct

SEQ ID NO: 52441 - DNA, 20 bp, Artificial Sequence
  Description of Artificial Sequence: Synthetic oligonucleotide
  Target: ATXN1; (-) strand; PAM type: NRG; PAM sequence: CAG
gcctaattccataaaaagcc

SEQ ID NO: 52442 - DNA, 20 bp, Artificial Sequence
  Description of Artificial Sequence: Synthetic oligonucleotide
  Target: ATXN1; (-) strand; PAM type: NRG; PAM sequence: AAG
cccatgcctaattccataaa

SEQ ID NO: 52443 - DNA, 20 bp, Artificial Sequence
  Description of Artificial Sequence: Synthetic oligonucleotide
  Target: ATXN1; (-) strand; PAM type: NRG; PAM sequence: AAG
acgtttgatgtaggagagca

SEQ ID NO: 52444 - DNA, 20 bp, Artificial Sequence
  Description of Artificial Sequence: Synthetic oligonucleotide
  Target: ATXN1; (-) strand; PAM type: NRG; PAM sequence: GAG
agataacgtttgatgtagga

SEQ ID NO: 52445 - DNA, 20 bp, Artificial Sequence
  Description of Artificial Sequence: Synthetic oligonucleotide
  Target: ATXN1; (-) strand; PAM type: NRG; PAM sequence: GAG
taagataacgtttgatgtag

SEQ ID NO: 52446 - DNA, 20 bp, Artificial Sequence
  Description of Artificial Sequence: Synthetic oligonucleotide
  Target: ATXN1; (-) strand; PAM type: NRG; PAM sequence: AGG
gttaagataacgtttgatgt

SEQ ID NO: 52447 - DNA, 20 bp, Artificial Sequence
  Description of Artificial Sequence: Synthetic oligonucleotide
  Target: ATXN1; (-) strand; PAM type: NRG; PAM sequence: TAG
agttaagataacgtttgatg

SEQ ID NO: 52448 - DNA, 20 bp, Artificial Sequence
  Description of Artificial Sequence: Synthetic oligonucleotide
  Target: ATXN1; (-) strand; PAM type: NRG; PAM sequence: AAG
tgaattttttctgtggagtt

SEQ ID NO: 52449 - DNA, 20 bp, Artificial Sequence
  Description of Artificial Sequence: Synthetic oligonucleotide
  Target: ATXN1; (-) strand; PAM type: NRG; PAM sequence: GAG
gttcgtgaattttttctgtg

SEQ ID NO: 52450 - DNA, 20 bp, Artificial Sequence
  Description of Artificial Sequence: Synthetic oligonucleotide
  Target: ATXN1; (-) strand; PAM type: NRG; PAM sequence: TGG
gagttcgtgaattttttctg

SEQ ID NO: 52451 - DNA, 20 bp, Artificial Sequence
  Description of Artificial Sequence: Synthetic oligonucleotide
  Target: ATXN1; (-) strand; PAM type: NRG; PAM sequence: GAG
ttgtcaagaggaaggttttg

SEQ ID NO: 52452 - DNA, 20 bp, Artificial Sequence
  Description of Artificial Sequence: Synthetic oligonucleotide
  Target: ATXN1; (-) strand; PAM type: NRG; PAM sequence: TGG
ggttgtcaagaggaaggttt

SEQ ID NO: 52453 - DNA, 20 bp, Artificial Sequence
  Description of Artificial Sequence: Synthetic oligonucleotide
  Target: ATXN1; (-) strand; PAM type: NRG; PAM sequence: AGG
tcctctggttgtcaagagga

SEQ ID NO: 52454 - DNA, 20 bp, Artificial Sequence
  Description of Artificial Sequence: Synthetic oligonucleotide
  Target: ATXN1; (-) strand; PAM type: NRG; PAM sequence: AAG
ctcctctggttgtcaagagg

SEQ ID NO: 52455 - DNA, 20 bp, Artificial Sequence
  Description of Artificial Sequence: Synthetic oligonucleotide
  Target: ATXN1; (-) strand; PAM type: NRG; PAM sequence: AGG
ttcctcctctggttgtcaag

SEQ ID NO: 52456 - DNA, 20 bp, Artificial Sequence
  Description of Artificial Sequence: Synthetic oligonucleotide
  Target: ATXN1; (-) strand; PAM type: NRG; PAM sequence: GAG
cttcctcctctggttgtcaa

SEQ ID NO: 52457 - DNA, 20 bp, Artificial Sequence
  Description of Artificial Sequence: Synthetic oligonucleotide
  Target: ATXN1; (-) strand; PAM type: NRG; PAM sequence: AAG
accttcctcctctggttgtc

SEQ ID NO: 52458 - DNA, 20 bp, Artificial Sequence
  Description of Artificial Sequence: Synthetic oligonucleotide
  Target: ATXN1; (-) strand; PAM type: NRG; PAM sequence: TGG
ttaaaaccaccttcctcctc

SEQ ID NO: 52459 - DNA, 20 bp, Artificial Sequence
  Description of Artificial Sequence: Synthetic oligonucleotide
  Target: ATXN1; (-) strand; PAM type: NRG; PAM sequence: GGG
tacagatttgaattcagact

SEQ ID NO: 52460 - DNA, 20 bp, Artificial Sequence
  Description of Artificial Sequence: Synthetic oligonucleotide
  Target: ATXN1; (-) strand; PAM type: NRG; PAM sequence: TGG
ctacagatttgaattcagac

SEQ ID NO: 52461 - DNA, 20 bp, Artificial Sequence
  Description of Artificial Sequence: Synthetic oligonucleotide
  Target: ATXN1; (-) strand; PAM type: NRG; PAM sequence: CAG
actatctacagatttgaatt

SEQ ID NO: 52462 - DNA, 20 bp, Artificial Sequence
  Description of Artificial Sequence: Synthetic oligonucleotide
  Target: ATXN1; (-) strand; PAM type: NRG; PAM sequence: CAG
taaaaaaaattcactatcta

SEQ ID NO: 52463 - DNA, 20 bp, Artificial Sequence
  Description of Artificial Sequence: Synthetic oligonucleotide
  Target: ATXN1; (-) strand; PAM type: NRG; PAM sequence: GAG
ttcaaagcgctgttttaaga

SEQ ID NO: 52464 - DNA, 20 bp, Artificial Sequence
  Description of Artificial Sequence: Synthetic oligonucleotide
  Target: ATXN1; (-) strand; PAM type: NRG; PAM sequence: GAG
aattcaaagcgctgttttaa

SEQ ID NO: 52465 - DNA, 20 bp, Artificial Sequence
  Description of Artificial Sequence: Synthetic oligonucleotide
  Target: ATXN1; (-) strand; PAM type: NRG; PAM sequence: AAG
aaaattcaaagcgctgtttt

SEQ ID NO: 52466 - DNA, 20 bp, Artificial Sequence
  Description of Artificial Sequence: Synthetic oligonucleotide
  Target: ATXN1; (-) strand; PAM type: NRG; PAM sequence: AAG
atcaagatgttcaaaattca

SEQ ID NO: 52467 - DNA, 20 bp, Artificial Sequence
  Description of Artificial Sequence: Synthetic oligonucleotide
  Target: ATXN1; (-) strand; PAM type: NRG; PAM sequence: AAG
atgtgtatgtatatataatc

SEQ ID NO: 52468 - DNA, 20 bp, Artificial Sequence
  Description of Artificial Sequence: Synthetic oligonucleotide
  Target: ATXN1; (-) strand; PAM type: NRG; PAM sequence: GAG
gccagagtcccagtctttct

SEQ ID NO: 52469 - DNA, 20 bp, Artificial Sequence
  Description of Artificial Sequence: Synthetic oligonucleotide
  Target: ATXN1; (-) strand; PAM type: NRG; PAM sequence: CAG
tctggttcctgccagagtcc

SEQ ID NO: 52470 - DNA, 20 bp, Artificial Sequence
  Description of Artificial Sequence: Synthetic oligonucleotide
  Target: ATXN1; (-) strand; PAM type: NRG; PAM sequence: GAG
cagaattctggttcctgcca

SEQ ID NO: 52471 - DNA, 20 bp, Artificial Sequence
  Description of Artificial Sequence: Synthetic oligonucleotide
  Target: ATXN1; (-) strand; PAM type: NRG; PAM sequence: CAG
ggcagaattctggttcctgc

SEQ ID NO: 52472 - DNA, 20 bp, Artificial Sequence
  Description of Artificial Sequence: Synthetic oligonucleotide
  Target: ATXN1; (-) strand; PAM type: NRG; PAM sequence: TGG
tttgggatgtggcagaattc

SEQ ID NO: 52473 - DNA, 20 bp, Artificial Sequence
  Description of Artificial Sequence: Synthetic oligonucleotide
  Target: ATXN1; (-) strand; PAM type: NRG; PAM sequence: CAG
ctgctaggtttgggatgtgg

SEQ ID NO: 52474 - DNA, 20 bp, Artificial Sequence
  Description of Artificial Sequence: Synthetic oligonucleotide
  Target: ATXN1; (-) strand; PAM type: NRG; PAM sequence: TGG
ggtctgctaggtttgggatg

SEQ ID NO: 52475 - DNA, 20 bp, Artificial Sequence
  Description of Artificial Sequence: Synthetic oligonucleotide
  Target: ATXN1; (-) strand; PAM type: NRG; PAM sequence: GGG
gaacttggtctgctaggttt

SEQ ID NO: 52476 - DNA, 20 bp, Artificial Sequence
  Description of Artificial Sequence: Synthetic oligonucleotide
  Target: ATXN1; (-) strand; PAM type: NRG; PAM sequence: TGG
tgaacttggtctgctaggtt

SEQ ID NO: 52477 - DNA, 20 bp, Artificial Sequence
  Description of Artificial Sequence: Synthetic oligonucleotide
  Target: ATXN1; (-) strand; PAM type: NRG; PAM sequence: AGG
aaagttgaacttggtctgct

SEQ ID NO: 52478 - DNA, 20 bp, Artificial Sequence
  Description of Artificial Sequence: Synthetic oligonucleotide
  Target: ATXN1; (-) strand; PAM type: NRG; PAM sequence: TAG
caaagttgaacttggtctgc

SEQ ID NO: 52479 - DNA, 20 bp, Artificial Sequence
  Description of Artificial Sequence: Synthetic oligonucleotide
  Target: ATXN1; (-) strand; PAM type: NRG; PAM sequence: TGG
tgcatttccaaagttgaact

SEQ ID NO: 52480 - DNA, 20 bp, Artificial Sequence
  Description of Artificial Sequence: Synthetic oligonucleotide
  Target: ATXN1; (-) strand; PAM type: NRG; PAM sequence: AAG
aaggtgatgatgcatttcca

SEQ ID NO: 52481 - DNA, 20 bp, Artificial Sequence
  Description of Artificial Sequence: Synthetic oligonucleotide
  Target: ATXN1; (-) strand; PAM type: NRG; PAM sequence: AGG
tgtttgtgattctggcgtga

SEQ ID NO: 52482 - DNA, 20 bp, Artificial Sequence
  Description of Artificial Sequence: Synthetic oligonucleotide
  Target: ATXN1; (-) strand; PAM type: NRG; PAM sequence: AAG
gtgtttgtgattctggcgtg

SEQ ID NO: 52483 - DNA, 20 bp, Artificial Sequence
  Description of Artificial Sequence: Synthetic oligonucleotide
  Target: ATXN1; (-) strand; PAM type: NRG; PAM sequence: TGG
tgcccgtgtgtttgtgattc

SEQ ID NO: 52484 - DNA, 20 bp, Artificial Sequence
  Description of Artificial Sequence: Synthetic oligonucleotide
  Target: ATXN1; (-) strand; PAM type: NRG; PAM sequence: GGG
agctgagaagccgaggacct

SEQ ID NO: 52485 - DNA, 20 bp, Artificial Sequence
  Description of Artificial Sequence: Synthetic oligonucleotide
  Target: ATXN1; (-) strand; PAM type: NRG; PAM sequence: TGG
cagctgagaagccgaggacc

SEQ ID NO: 52486 - DNA, 20 bp, Artificial Sequence
  Description of Artificial Sequence: Synthetic oligonucleotide
  Target: ATXN1; (-) strand; PAM type: NRG; PAM sequence: AGG
atgtgtcagctgagaagccg

SEQ ID NO: 52487 - DNA, 20 bp, Artificial Sequence
  Description of Artificial Sequence: Synthetic oligonucleotide
  Target: ATXN1; (-) strand; PAM type: NRG; PAM sequence: GAG
gatgtgtcagctgagaagcc

SEQ ID NO: 52488 - DNA, 20 bp, Artificial Sequence
  Description of Artificial Sequence: Synthetic oligonucleotide
  Target: ATXN1; (-) strand; PAM type: NRG; PAM sequence: AAG
actctgatgtgtcagctgag

SEQ ID NO: 52489 - DNA, 20 bp, Artificial Sequence
  Description of Artificial Sequence: Synthetic oligonucleotide
  Target: ATXN1; (-) strand; PAM type: NRG; PAM sequence: GAG
taaactctgatgtgtcagct

SEQ ID NO: 52490 - DNA, 20 bp, Artificial Sequence
  Description of Artificial Sequence: Synthetic oligonucleotide
  Target: ATXN1; (-) strand; PAM type: NRG; PAM sequence: CAG
acgcataaactctgatgtgt

SEQ ID NO: 52491 - DNA, 20 bp, Artificial Sequence
  Description of Artificial Sequence: Synthetic oligonucleotide
  Target: ATXN1; (-) strand; PAM type: NRG; PAM sequence: TAG
cttgaataacttcctcttct

SEQ ID NO: 52492 - DNA, 20 bp, Artificial Sequence
  Description of Artificial Sequence: Synthetic oligonucleotide
  Target: ATXN1; (-) strand; PAM type: NRG; PAM sequence: GAG
ttaaaaaatttttttttaaa

SEQ ID NO: 52493 - DNA, 20 bp, Artificial Sequence
  Description of Artificial Sequence: Synthetic oligonucleotide
  Target: ATXN1; (-) strand; PAM type: NRG; PAM sequence: AAG
tcttaaaaaattttttttta

SEQ ID NO: 52494 - DNA, 20 bp, Artificial Sequence
  Description of Artificial Sequence: Synthetic oligonucleotide
  Target: ATXN1; (-) strand; PAM type: NRG; PAM sequence: GAG
tccaacctgagtgacaaagt

SEQ ID NO: 52495 - DNA, 20 bp, Artificial Sequence
  Description of Artificial Sequence: Synthetic oligonucleotide
  Target: ATXN1; (-) strand; PAM type: NRG; PAM sequence: AAG
gcactccaacctgagtgaca

SEQ ID NO: 52496 - DNA, 20 bp, Artificial Sequence
  Description of Artificial Sequence: Synthetic oligonucleotide
  Target: ATXN1; (-) strand; PAM type: NRG; PAM sequence: GAG
acaccactgcactccaacct

SEQ ID NO: 52497 - DNA, 20 bp, Artificial Sequence
  Description of Artificial Sequence: Synthetic oligonucleotide
  Target: ATXN1; (-) strand; PAM type: NRG; PAM sequence: GAG
ggtcaaggctgaagtgagct

SEQ ID NO: 52498 - DNA, 20 bp, Artificial Sequence
  Description of Artificial Sequence: Synthetic oligonucleotide
  Target: ATXN1; (-) strand; PAM type: NRG; PAM sequence: GAG
cagaaggtcaaggctgaagt

SEQ ID NO: 52499 - DNA, 20 bp, Artificial Sequence
  Description of Artificial Sequence: Synthetic oligonucleotide
  Target: ATXN1; (-) strand; PAM type: NRG; PAM sequence: AAG
aacccagaaggtcaaggctg

SEQ ID NO: 52500 - DNA, 20 bp, Artificial Sequence
  Description of Artificial Sequence: Synthetic oligonucleotide
  Target: ATXN1; (-) strand; PAM type: NRG; PAM sequence: AGG
tgcttgaacccagaaggtca

SEQ ID NO: 52501 - DNA, 20 bp, Artificial Sequence
  Description of Artificial Sequence: Synthetic oligonucleotide
  Target: ATXN1; (-) strand; PAM type: NRG; PAM sequence: AAG
ttgcttgaacccagaaggtc

SEQ ID NO: 52502 - DNA, 20 bp, Artificial Sequence
  Description of Artificial Sequence: Synthetic oligonucleotide
  Target: ATXN1; (-) strand; PAM type: NRG; PAM sequence: AGG
gagaattgcttgaacccaga

SEQ ID NO: 52503 - DNA, 20 bp, Artificial Sequence
  Description of Artificial Sequence: Synthetic oligonucleotide
  Target: ATXN1; (-) strand; PAM type: NRG; PAM sequence: AAG
ggagaattgcttgaacccag

SEQ ID NO: 52504 - DNA, 20 bp, Artificial Sequence
  Description of Artificial Sequence: Synthetic oligonucleotide
  Target: ATXN1; (-) strand; PAM type: NRG; PAM sequence: CAG
gcaggagaattgcttgaacc

SEQ ID NO: 52505 - DNA, 20 bp, Artificial Sequence
  Description of Artificial Sequence: Synthetic oligonucleotide
  Target: ATXN1; (-) strand; PAM type: NRG; PAM sequence: GAG
tacttaaggggctgaagcag

SEQ ID NO: 52506 - DNA, 20 bp, Artificial Sequence
  Description of Artificial Sequence: Synthetic oligonucleotide
  Target: ATXN1; (-) strand; PAM type: NRG; PAM sequence: AGG
actacttaaggggctgaagc

SEQ ID NO: 52507 - DNA, 20 bp, Artificial Sequence
  Description of Artificial Sequence: Synthetic oligonucleotide
  Target: ATXN1; (-) strand; PAM type: NRG; PAM sequence: CAG
aactacttaaggggctgaag

SEQ ID NO: 52508 - DNA, 20 bp, Artificial Sequence
  Description of Artificial Sequence: Synthetic oligonucleotide
  Target: ATXN1; (-) strand; PAM type: NRG; PAM sequence: AAG
cccaactacttaaggggctg

SEQ ID NO: 52509 - DNA, 20 bp, Artificial Sequence
  Description of Artificial Sequence: Synthetic oligonucleotide
  Target: ATXN1; (-) strand; PAM type: NRG; PAM sequence: GGG
tgtagtcccaactacttaag

SEQ ID NO: 52510 - DNA, 20 bp, Artificial Sequence
  Description of Artificial Sequence: Synthetic oligonucleotide
  Target: ATXN1; (-) strand; PAM type: NRG; PAM sequence: GGG
ctgtagtcccaactacttaa

SEQ ID NO: 52511 - DNA, 20 bp, Artificial Sequence
  Description of Artificial Sequence: Synthetic oligonucleotide
  Target: ATXN1; (-) strand; PAM type: NRG; PAM sequence: AGG
tctgtagtcccaactactta

SEQ ID NO: 52512 - DNA, 20 bp, Artificial Sequence
  Description of Artificial Sequence: Synthetic oligonucleotide
  Target: ATXN1; (-) strand; PAM type: NRG; PAM sequence: AAG
atctgtagtcccaactactt

SEQ ID NO: 52513 - DNA, 20 bp, Artificial Sequence
  Description of Artificial Sequence: Synthetic oligonucleotide
  Target: ATXN1; (-) strand; PAM type: NRG; PAM sequence: TAG
ggtgtattggcatgcatctg

SEQ ID NO: 52514 - DNA, 20 bp, Artificial Sequence
  Description of Artificial Sequence: Synthetic oligonucleotide
  Target: ATXN1; (-) strand; PAM type: NRG; PAM sequence: TGG
caaaaattagtcaggtgtat

SEQ ID NO: 52515 - DNA, 20 bp, Artificial Sequence
  Description of Artificial Sequence: Synthetic oligonucleotide
  Target: ATXN1; (-) strand; PAM type: NRG; PAM sequence: AGG
taaaaatacaaaaattagtc

SEQ ID NO: 52516 - DNA, 20 bp, Artificial Sequence
  Description of Artificial Sequence: Synthetic oligonucleotide
  Target: ATXN1; (-) strand; PAM type: NRG; PAM sequence: CAG
ctaaaaatacaaaaattagt

SEQ ID NO: 52517 - DNA, 20 bp, Artificial Sequence
  Description of Artificial Sequence: Synthetic oligonucleotide
  Target: ATXN1; (-) strand; PAM type: NRG; PAM sequence: TAG
tctactaaaaatacaaaaat

SEQ ID NO: 52518 - DNA, 20 bp, Artificial Sequence
  Description of Artificial Sequence: Synthetic oligonucleotide
  Target: ATXN1; (-) strand; PAM type: NRG; PAM sequence: TGG
cgagaccagcctggccaatg

SEQ ID NO: 52519 - DNA, 20 bp, Artificial Sequence
  Description of Artificial Sequence: Synthetic oligonucleotide
  Target: ATXN1; (-) strand; PAM type: NRG; PAM sequence: TGG
tcaagagttcgagaccagcc

SEQ ID NO: 52520 - DNA, 20 bp, Artificial Sequence
  Description of Artificial Sequence: Synthetic oligonucleotide
  Target: ATXN1; (-) strand; PAM type: NRG; PAM sequence: CAG
tgagctcaagagttcgagac

SEQ ID NO: 52521 - DNA, 20 bp, Artificial Sequence
  Description of Artificial Sequence: Synthetic oligonucleotide
  Target: ATXN1; (-) strand; PAM type: NRG; PAM sequence: GAG
tcacttgagctcaagagttc

SEQ ID NO: 52522 - DNA, 20 bp, Artificial Sequence
  Description of Artificial Sequence: Synthetic oligonucleotide
  Target: ATXN1; (-) strand; PAM type: NRG; PAM sequence: GAG
tgaggatcacttgagctcaa

SEQ ID NO: 52523 - DNA, 20 bp, Artificial Sequence
  Description of Artificial Sequence: Synthetic oligonucleotide
  Target: ATXN1; (-) strand; PAM type: NRG; PAM sequence: AAG
tgtgaggatcacttgagctc

SEQ ID NO: 52524 - DNA, 20 bp, Artificial Sequence
  Description of Artificial Sequence: Synthetic oligonucleotide
  Target: ATXN1; (-) strand; PAM type: NRG; PAM sequence: GAG
ccaaggtgtgaggatcactt

SEQ ID NO: 52525 - DNA, 20 bp, Artificial Sequence
  Description of Artificial Sequence: Synthetic oligonucleotide
  Target: ATXN1; (-) strand; PAM type: NRG; PAM sequence: AGG
cttttggaggccaaggtgtg

SEQ ID NO: 52526 - DNA, 20 bp, Artificial Sequence
  Description of Artificial Sequence: Synthetic oligonucleotide
  Target: ATXN1; (-) strand; PAM type: NRG; PAM sequence: GAG
acttttggaggccaaggtgt

SEQ ID NO: 52527 - DNA, 20 bp, Artificial Sequence
  Description of Artificial Sequence: Synthetic oligonucleotide
  Target: ATXN1; (-) strand; PAM type: NRG; PAM sequence: AGG
cctagcacttttggaggcca

SEQ ID NO: 52528 - DNA, 20 bp, Artificial Sequence
  Description of Artificial Sequence: Synthetic oligonucleotide
  Target: ATXN1; (-) strand; PAM type: NRG; PAM sequence: AAG
tcctagcacttttggaggcc

SEQ ID NO: 52529 - DNA, 20 bp, Artificial Sequence
  Description of Artificial Sequence: Synthetic oligonucleotide
  Target: ATXN1; (-) strand; PAM type: NRG; PAM sequence: AGG
tgtaatcctagcacttttgg

SEQ ID NO: 52530 - DNA, 20 bp, Artificial Sequence
  Description of Artificial Sequence: Synthetic oligonucleotide
  Target: ATXN1; (-) strand; PAM type: NRG; PAM sequence: GAG
ctgtaatcctagcacttttg

SEQ ID NO: 52531 - DNA, 20 bp, Artificial Sequence
  Description of Artificial Sequence: Synthetic oligonucleotide
  Target: ATXN1; (-) strand; PAM type: NRG; PAM sequence: TGG
gcctgtaatcctagcacttt

SEQ ID NO: 52532 - DNA, 20 bp, Artificial Sequence
  Description of Artificial Sequence: Synthetic oligonucleotide
  Target: ATXN1; (-) strand; PAM type: NRG; PAM sequence: TAG
atggctcacgcctgtaatcc

SEQ ID NO: 52533 - DNA, 20 bp, Artificial Sequence
  Description of Artificial Sequence: Synthetic oligonucleotide
  Target: ATXN1; (-) strand; PAM type: NRG; PAM sequence: TGG
gagcttagggccgggcgcca

SEQ ID NO: 52534 - DNA, 20 bp, Artificial Sequence
  Description of Artificial Sequence: Synthetic oligonucleotide
  Target: ATXN1; (-) strand; PAM type: NRG; PAM sequence: GGG
catttaaagagcttagggcc

SEQ ID NO: 52535 - DNA, 20 bp, Artificial Sequence
  Description of Artificial Sequence: Synthetic oligonucleotide
  Target: ATXN1; (-) strand; PAM type: NRG; PAM sequence: CGG
gcatttaaagagcttagggc

SEQ ID NO: 52536 - DNA, 20 bp, Artificial Sequence
  Description of Artificial Sequence: Synthetic oligonucleotide
  Target: ATXN1; (-) strand; PAM type: NRG; PAM sequence: GGG
tgctgcatttaaagagctta

SEQ ID NO: 52537 - DNA, 20 bp, Artificial Sequence
  Description of Artificial Sequence: Synthetic oligonucleotide
  Target: ATXN1; (-) strand; PAM type: NRG; PAM sequence: AGG
ttgctgcatttaaagagctt

SEQ ID NO: 52538 - DNA, 20 bp, Artificial Sequence
  Description of Artificial Sequence: Synthetic oligonucleotide
  Target: ATXN1; (-) strand; PAM type: NRG; PAM sequence: TAG
gttgctgcatttaaagagct

SEQ ID NO: 52539 - DNA, 20 bp, Artificial Sequence
  Description of Artificial Sequence: Synthetic oligonucleotide
  Target: ATXN1; (-) strand; PAM type: NRG; PAM sequence: GAG
tgaaagttgctgcatttaaa

SEQ ID NO: 52540 - DNA, 20 bp, Artificial Sequence
  Description of Artificial Sequence: Synthetic oligonucleotide
  Target: ATXN1; (-) strand; PAM type: NRG; PAM sequence: AAG
tatgaaagttgctgcattta

SEQ ID NO: 52541 - DNA, 20 bp, Artificial Sequence
  Description of Artificial Sequence: Synthetic oligonucleotide
  Target: ATXN1; (-) strand; PAM type: NRG; PAM sequence: AAG
gggtaataaatatggtatga

SEQ ID NO: 52542 - DNA, 20 bp, Artificial Sequence
  Description of Artificial Sequence: Synthetic oligonucleotide
  Target: ATXN1; (-) strand; PAM type: NRG; PAM sequence: TGG
aggggacagggtaataaata

SEQ ID NO: 52543 - DNA, 20 bp, Artificial Sequence
  Description of Artificial Sequence: Synthetic oligonucleotide
  Target: ATXN1; (-) strand; PAM type: NRG; PAM sequence: GGG
atgggactcaggaggggaca

SEQ ID NO: 52544 - DNA, 20 bp, Artificial Sequence
  Description of Artificial Sequence: Synthetic oligonucleotide
  Target: ATXN1; (-) strand; PAM type: NRG; PAM sequence: AGG
gatgggactcaggaggggac

SEQ ID NO: 52545 - DNA, 20 bp, Artificial Sequence
  Description of Artificial Sequence: Synthetic oligonucleotide
  Target: ATXN1; (-) strand; PAM type: NRG; PAM sequence: CAG
ggatgggactcaggagggga

SEQ ID NO: 52546 - DNA, 20 bp, Artificial Sequence
  Description of Artificial Sequence: Synthetic oligonucleotide
  Target: ATXN1; (-) strand; PAM type: NRG; PAM sequence: GGG
cagaggatgggactcaggag

SEQ ID NO: 52547 - DNA, 20 bp, Artificial Sequence
  Description of Artificial Sequence: Synthetic oligonucleotide
  Target: ATXN1; (-) strand; PAM type: NRG; PAM sequence: GGG
tcagaggatgggactcagga

SEQ ID NO: 52548 - DNA, 20 bp, Artificial Sequence
  Description of Artificial Sequence: Synthetic oligonucleotide
  Target: ATXN1; (-) strand; PAM type: NRG; PAM sequence: AGG
gtcagaggatgggactcagg

SEQ ID NO: 52549 - DNA, 20 bp, Artificial Sequence
  Description of Artificial Sequence: Synthetic oligonucleotide
  Target: ATXN1; (-) strand; PAM type: NRG; PAM sequence: GAG
ggtcagaggatgggactcag

SEQ ID NO: 52550 - DNA, 20 bp, Artificial Sequence
  Description of Artificial Sequence: Synthetic oligonucleotide
  Target: ATXN1; (-) strand; PAM type: NRG; PAM sequence: AGG
gtggtcagaggatgggactc

SEQ ID NO: 52551 - DNA, 20 bp, Artificial Sequence
  Description of Artificial Sequence: Synthetic oligonucleotide
  Target: ATXN1; (-) strand; PAM type: NRG; PAM sequence: CAG
agtggtcagaggatgggact

SEQ ID NO: 52552 - DNA, 20 bp, Artificial Sequence
  Description of Artificial Sequence: Synthetic oligonucleotide
  Target: ATXN1; (-) strand; PAM type: NRG; PAM sequence: GGG
agatgaagtggtcagaggat

SEQ ID NO: 52553 - DNA, 20 bp, Artificial Sequence
  Description of Artificial Sequence: Synthetic oligonucleotide
  Target: ATXN1; (-) strand; PAM type: NRG; PAM sequence: TGG
aagatgaagtggtcagagga

SEQ ID NO: 52554 - DNA, 20 bp, Artificial Sequence
  Description of Artificial Sequence: Synthetic oligonucleotide
  Target: ATXN1; (-) strand; PAM type: NRG; PAM sequence: AGG
gaagaagatgaagtggtcag

SEQ ID NO: 52555 - DNA, 20 bp, Artificial Sequence
  Description of Artificial Sequence: Synthetic oligonucleotide
  Target: ATXN1; (-) strand; PAM type: NRG; PAM sequence: GAG
agaagaagatgaagtggtca

SEQ ID NO: 52556 - DNA, 20 bp, Artificial Sequence
  Description of Artificial Sequence: Synthetic oligonucleotide
  Target: ATXN1; (-) strand; PAM type: NRG; PAM sequence: CAG
gtagaagaagatgaagtggt

SEQ ID NO: 52557 - DNA, 20 bp, Artificial Sequence
  Description of Artificial Sequence: Synthetic oligonucleotide
  Target: ATXN1; (-) strand; PAM type: NRG; PAM sequence: TGG
ggaggtagaagaagatgaag

SEQ ID NO: 52558 - DNA, 20 bp, Artificial Sequence
  Description of Artificial Sequence: Synthetic oligonucleotide
  Target: ATXN1; (-) strand; PAM type: NRG; PAM sequence: AAG
tttggaggtagaagaagatg

SEQ ID NO: 52559 - DNA, 20 bp, Artificial Sequence
  Description of Artificial Sequence: Synthetic oligonucleotide
  Target: ATXN1; (-) strand; PAM type: NRG; PAM sequence: AAG
gagagttttggaggtagaag

SEQ ID NO: 52560 - DNA, 20 bp, Artificial Sequence
  Description of Artificial Sequence: Synthetic oligonucleotide
  Target: ATXN1; (-) strand; PAM type: NRG; PAM sequence: AAG
gaggagagttttggaggtag

SEQ ID NO: 52561 - DNA, 20 bp, Artificial Sequence
  Description of Artificial Sequence: Synthetic oligonucleotide
  Target: ATXN1; (-) strand; PAM type: NRG; PAM sequence: TAG
gatgaggagagttttggagg

SEQ ID NO: 52562 - DNA, 20 bp, Artificial Sequence
  Description of Artificial Sequence: Synthetic oligonucleotide
  Target: ATXN1; (-) strand; PAM type: NRG; PAM sequence: AGG
caggatgaggagagttttgg

SEQ ID NO: 52563 - DNA, 20 bp, Artificial Sequence
  Description of Artificial Sequence: Synthetic oligonucleotide
  Target: ATXN1; (-) strand; PAM type: NRG; PAM sequence: GAG
tcaggatgaggagagttttg

SEQ ID NO: 52564 - DNA, 20 bp, Artificial Sequence
  Description of Artificial Sequence: Synthetic oligonucleotide
  Target: ATXN1; (-) strand; PAM type: NRG; PAM sequence: TGG
tttcaggatgaggagagttt

SEQ ID NO: 52565 - DNA, 20 bp, Artificial Sequence
  Description of Artificial Sequence: Synthetic oligonucleotide
  Target: ATXN1; (-) strand; PAM type: NRG; PAM sequence: GAG
gctttttttcaggatgagga

SEQ ID NO: 52566 - DNA, 20 bp, Artificial Sequence
  Description of Artificial Sequence: Synthetic oligonucleotide
  Target: ATXN1; (-) strand; PAM type: NRG; PAM sequence: GAG
gtgctttttttcaggatgag

SEQ ID NO: 52567 - DNA, 20 bp, Artificial Sequence
  Description of Artificial Sequence: Synthetic oligonucleotide
  Target: ATXN1; (-) strand; PAM type: NRG; PAM sequence: AGG
ctgtgctttttttcaggatg

SEQ ID NO: 52568 - DNA, 20 bp, Artificial Sequence
  Description of Artificial Sequence: Synthetic oligonucleotide
  Target: ATXN1; (-) strand; PAM type: NRG; PAM sequence: GAG
tctgtgctttttttcaggat

SEQ ID NO: 52569 - DNA, 20 bp, Artificial Sequence
  Description of Artificial Sequence: Synthetic oligonucleotide
  Target: ATXN1; (-) strand; PAM type: NRG; PAM sequence: AGG
tgctgtctgtgctttttttc

SEQ ID NO: 52570 - DNA, 20 bp, Artificial Sequence
  Description of Artificial Sequence: Synthetic oligonucleotide
  Target: ATXN1; (-) strand; PAM type: NRG; PAM sequence: CAG
ctgctgtctgtgcttttttt

SEQ ID NO: 52571 - DNA, 20 bp, Artificial Sequence
  Description of Artificial Sequence: Synthetic oligonucleotide
  Target: ATXN1; (-) strand; PAM type: NRG; PAM sequence: TAG
acatgcagccccacaaccta

SEQ ID NO: 52572 - DNA, 20 bp, Artificial Sequence
  Description of Artificial Sequence: Synthetic oligonucleotide
  Target: ATXN1; (-) strand; PAM type: NRG; PAM sequence: CAG
aaagccagaaatatcacatg

SEQ ID NO: 52573 - DNA, 20 bp, Artificial Sequence
  Description of Artificial Sequence: Synthetic oligonucleotide
  Target: ATXN1; (-) strand; PAM type: NRG; PAM sequence: CAG
caagaacagaacgtgaaagc

SEQ ID NO: 52574 - DNA, 20 bp, Artificial Sequence
  Description of Artificial Sequence: Synthetic oligonucleotide
  Target: ATXN1; (-) strand; PAM type: NRG; PAM sequence: AAG
acttcaagaacagaacgtga

SEQ ID NO: 52575 - DNA, 20 bp, Artificial Sequence
  Description of Artificial Sequence: Synthetic oligonucleotide
  Target: ATXN1; (-) strand; PAM type: NRG; PAM sequence: CAG
ctttaagcttacttcaagaa

SEQ ID NO: 52576 - DNA, 20 bp, Artificial Sequence
  Description of Artificial Sequence: Synthetic oligonucleotide
  Target: ATXN1; (-) strand; PAM type: NRG; PAM sequence: AAG
attgtctttaagcttacttc

SEQ ID NO: 52577 - DNA, 20 bp, Artificial Sequence
  Description of Artificial Sequence: Synthetic oligonucleotide
  Target: ATXN1; (-) strand; PAM type: NRG; PAM sequence: AAG
gagagtatgttattgtcttt

SEQ ID NO: 52578 - DNA, 20 bp, Artificial Sequence
  Description of Artificial Sequence: Synthetic oligonucleotide
  Target: ATXN1; (-) strand; PAM type: NRG; PAM sequence: GAG
tcttttaaccatagcaggga

SEQ ID NO: 52579 - DNA, 20 bp, Artificial Sequence
  Description of Artificial Sequence: Synthetic oligonucleotide
  Target: ATXN1; (-) strand; PAM type: NRG; PAM sequence: GAG
attcttttaaccatagcagg

SEQ ID NO: 52580 - DNA, 20 bp, Artificial Sequence
  Description of Artificial Sequence: Synthetic oligonucleotide
  Target: ATXN1; (-) strand; PAM type: NRG; PAM sequence: GGG
gaattcttttaaccatagca

SEQ ID NO: 52581 - DNA, 20 bp, Artificial Sequence
  Description of Artificial Sequence: Synthetic oligonucleotide
  Target: ATXN1; (-) strand; PAM type: NRG; PAM sequence: AGG
agaattcttttaaccatagc

SEQ ID NO: 52582 - DNA, 20 bp, Artificial Sequence
  Description of Artificial Sequence: Synthetic oligonucleotide
  Target: ATXN1; (-) strand; PAM type: NRG; PAM sequence: CAG
aagaattcttttaaccatag

SEQ ID NO: 52583 - DNA, 20 bp, Artificial Sequence
  Description of Artificial Sequence: Synthetic oligonucleotide
  Target: ATXN1; (-) strand; PAM type: NRG; PAM sequence: TAG
cctaagaattcttttaacca

SEQ ID NO: 52584 - DNA, 20 bp, Artificial Sequence
  Description of Artificial Sequence: Synthetic oligonucleotide
  Target: ATXN1; (-) strand; PAM type: NRG; PAM sequence: AAG
ttttttttcccaaagatcct

SEQ ID NO: 52585 - DNA, 20 bp, Artificial Sequence
  Description of Artificial Sequence: Synthetic oligonucleotide
  Target: ATXN1; (-) strand; PAM type: NRG; PAM sequence: AAG
tgagatttttttttttccca

SEQ ID NO: 52586 - DNA, 20 bp, Artificial Sequence
  Description of Artificial Sequence: Synthetic oligonucleotide
  Target: ATXN1; (-) strand; PAM type: NRG; PAM sequence: GAG
tatattgtcatatttacttt

SEQ ID NO: 52587 - DNA, 20 bp, Artificial Sequence
  Description of Artificial Sequence: Synthetic oligonucleotide
  Target: ATXN1; (-) strand; PAM type: NRG; PAM sequence: CAG
tagatgtttagagctccctc

SEQ ID NO: 52588 - DNA, 20 bp, Artificial Sequence
  Description of Artificial Sequence: Synthetic oligonucleotide
  Target: ATXN1; (-) strand; PAM type: NRG; PAM sequence: GAG
ttcctatcactagatgttta

SEQ ID NO: 52589 - DNA, 20 bp, Artificial Sequence
  Description of Artificial Sequence: Synthetic oligonucleotide
  Target: ATXN1; (-) strand; PAM type: NRG; PAM sequence: TAG
ttttcctatcactagatgtt

SEQ ID NO: 52590 - DNA, 20 bp, Artificial Sequence
  Description of Artificial Sequence: Synthetic oligonucleotide
  Target: ATXN1; (-) strand; PAM type: NRG; PAM sequence: TAG
ttcagcatttttcctatcac

SEQ ID NO: 52591 - DNA, 20 bp, Artificial Sequence
  Description of Artificial Sequence: Synthetic oligonucleotide
  Target: ATXN1; (-) strand; PAM type: NRG; PAM sequence: CAG
aattttaggatacataattt

SEQ ID NO: 52592 - DNA, 20 bp, Artificial Sequence
  Description of Artificial Sequence: Synthetic oligonucleotide
  Target: ATXN1; (-) strand; PAM type: NRG; PAM sequence: AGG
agcagtaacttttcaatttt

SEQ ID NO: 52593 - DNA, 20 bp, Artificial Sequence
  Description of Artificial Sequence: Synthetic oligonucleotide
  Target: ATXN1; (-) strand; PAM type: NRG; PAM sequence: TAG
aagcagtaacttttcaattt

SEQ ID NO: 52594 - DNA, 20 bp, Artificial Sequence
  Description of Artificial Sequence: Synthetic oligonucleotide
  Target: ATXN1; (-) strand; PAM type: NRG; PAM sequence: CAG
taccatattatcccacaaag

SEQ ID NO: 52595 - DNA, 20 bp, Artificial Sequence
  Description of Artificial Sequence: Synthetic oligonucleotide
  Target: ATXN1; (-) strand; PAM type: NRG; PAM sequence: AAG
atttaccatattatcccaca

SEQ ID NO: 52596 - DNA, 20 bp, Artificial Sequence
  Description of Artificial Sequence: Synthetic oligonucleotide
  Target: ATXN1; (-) strand; PAM type: NRG; PAM sequence: CAG
gcacagagatgactaaaagc

SEQ ID NO: 52597 - DNA, 20 bp, Artificial Sequence
  Description of Artificial Sequence: Synthetic oligonucleotide
  Target: ATXN1; (-) strand; PAM type: NRG; PAM sequence: AAG
atgggcacagagatgactaa

SEQ ID NO: 52598 - DNA, 20 bp, Artificial Sequence
  Description of Artificial Sequence: Synthetic oligonucleotide
  Target: ATXN1; (-) strand; PAM type: NRG; PAM sequence: GAG
cagtattaagaatgggcaca

SEQ ID NO: 52599 - DNA, 20 bp, Artificial Sequence
  Description of Artificial Sequence: Synthetic oligonucleotide
  Target: ATXN1; (-) strand; PAM type: NRG; PAM sequence: CAG
atcagtattaagaatgggca

SEQ ID NO: 52600 - DNA, 20 bp, Artificial Sequence
  Description of Artificial Sequence: Synthetic oligonucleotide
  Target: ATXN1; (-) strand; PAM type: NRG; PAM sequence: GGG
tctgaatcagtattaagaat

SEQ ID NO: 52601 - DNA, 20 bp, Artificial Sequence
  Description of Artificial Sequence: Synthetic oligonucleotide
  Target: ATXN1; (-) strand; PAM type: NRG; PAM sequence: TGG
ctctgaatcagtattaagaa

SEQ ID NO: 52602 - DNA, 20 bp, Artificial Sequence
  Description of Artificial Sequence: Synthetic oligonucleotide
  Target: ATXN1; (-) strand; PAM type: NRG; PAM sequence: AAG
ttctgctctgaatcagtatt

SEQ ID NO: 52603 - DNA, 20 bp, Artificial Sequence
  Description of Artificial Sequence: Synthetic oligonucleotide
  Target: ATXN1; (-) strand; PAM type: NRG; PAM sequence: CAG
aactatcttctgctctgaat

SEQ ID NO: 52604 - DNA, 20 bp, Artificial Sequence
  Description of Artificial Sequence: Synthetic oligonucleotide
  Target: ATXN1; (-) strand; PAM type: NRG; PAM sequence: TGG
cgcatgcacacacgttgata

SEQ ID NO: 52605 - DNA, 20 bp, Artificial Sequence
  Description of Artificial Sequence: Synthetic oligonucleotide
  Target: ATXN1; (-) strand; PAM type: NRG; PAM sequence: TAG
aaagagtcatatgtttaaga

SEQ ID NO: 52606 - DNA, 20 bp, Artificial Sequence
  Description of Artificial Sequence: Synthetic oligonucleotide
  Target: ATXN1; (-) strand; PAM type: NRG; PAM sequence: AAG
gggtaaagagtcatatgttt

SEQ ID NO: 52607 - DNA, 20 bp, Artificial Sequence
  Description of Artificial Sequence: Synthetic oligonucleotide
  Target: ATXN1; (-) strand; PAM type: NRG; PAM sequence: GAG
ggcctccttttttgggtaaa

SEQ ID NO: 52608 - DNA, 20 bp, Artificial Sequence
  Description of Artificial Sequence: Synthetic oligonucleotide
  Target: ATXN1; (-) strand; PAM type: NRG; PAM sequence: AAG
atggcctccttttttgggta

SEQ ID NO: 52609 - DNA, 20 bp, Artificial Sequence
  Description of Artificial Sequence: Synthetic oligonucleotide
  Target: ATXN1; (-) strand; PAM type: NRG; PAM sequence: GGG
aataaatggcctcctttttt

SEQ ID NO: 52610 - DNA, 20 bp, Artificial Sequence
  Description of Artificial Sequence: Synthetic oligonucleotide
  Target: ATXN1; (-) strand; PAM type: NRG; PAM sequence: TGG
gaataaatggcctccttttt

SEQ ID NO: 52611 - DNA, 20 bp, Artificial Sequence
  Description of Artificial Sequence: Synthetic oligonucleotide
  Target: ATXN1; (-) strand; PAM type: NRG; PAM sequence: TGG
ctgtggaagccaagaataaa

SEQ ID NO: 52612 - DNA, 20 bp, Artificial Sequence
  Description of Artificial Sequence: Synthetic oligonucleotide
  Target: ATXN1; (-) strand; PAM type: NRG; PAM sequence: AAG
tcagaggccctgtggaagcc

SEQ ID NO: 52613 - DNA, 20 bp, Artificial Sequence
  Description of Artificial Sequence: Synthetic oligonucleotide
  Target: ATXN1; (-) strand; PAM type: NRG; PAM sequence: AAG
acttttcagaggccctgtgg

SEQ ID NO: 52614 - DNA, 20 bp, Artificial Sequence
  Description of Artificial Sequence: Synthetic oligonucleotide
  Target: ATXN1; (-) strand; PAM type: NRG; PAM sequence: TGG
tatacttttcagaggccctg

SEQ ID NO: 52615 - DNA, 20 bp, Artificial Sequence
  Description of Artificial Sequence: Synthetic oligonucleotide
  Target: ATXN1; (-) strand; PAM type: NRG; PAM sequence: AGG
tttcagagtatacttttcag

SEQ ID NO: 52616 - DNA, 20 bp, Artificial Sequence
  Description of Artificial Sequence: Synthetic oligonucleotide
  Target: ATXN1; (-) strand; PAM type: NRG; PAM sequence: GAG
ttttcagagtatacttttca

SEQ ID NO: 52617 - DNA, 20 bp, Artificial Sequence
  Description of Artificial Sequence: Synthetic oligonucleotide
  Target: ATXN1; (-) strand; PAM type: NRG; PAM sequence: CAG
tattttcagagtatactttt

SEQ ID NO: 52618 - DNA, 20 bp, Artificial Sequence
  Description of Artificial Sequence: Synthetic oligonucleotide
  Target: ATXN1; (-) strand; PAM type: NRG; PAM sequence: GAG
tctccaagaaaatattttca

SEQ ID NO: 52619 - DNA, 20 bp, Artificial Sequence
  Description of Artificial Sequence: Synthetic oligonucleotide
  Target: ATXN1; (-) strand; PAM type: NRG; PAM sequence: CAG
actctccaagaaaatatttt

SEQ ID NO: 52620 - DNA, 20 bp, Artificial Sequence
  Description of Artificial Sequence: Synthetic oligonucleotide
  Target: ATXN1; (-) strand; PAM type: NRG; PAM sequence: AAG
tctgctttaaagaactctcc

SEQ ID NO: 52621 - DNA, 20 bp, Artificial Sequence
  Description of Artificial Sequence: Synthetic oligonucleotide
  Target: ATXN1; (-) strand; PAM type: NRG; PAM sequence: AAG
tcttaaatctttctgcttta

SEQ ID NO: 52622 - DNA, 20 bp, Artificial Sequence
  Description of Artificial Sequence: Synthetic oligonucleotide
  Target: ATXN1; (-) strand; PAM type: NRG; PAM sequence: CAG
aaacaaggctcactttggtc

SEQ ID NO: 52623 - DNA, 20 bp, Artificial Sequence
  Description of Artificial Sequence: Synthetic oligonucleotide
  Target: ATXN1; (-) strand; PAM type: NRG; PAM sequence: TGG
agttcaaacaaggctcactt

SEQ ID NO: 52624 - DNA, 20 bp, Artificial Sequence
  Description of Artificial Sequence: Synthetic oligonucleotide
  Target: ATXN1; (-) strand; PAM type: NRG; PAM sequence: AGG
aaacatgctcagttcaaaca

SEQ ID NO: 52625 - DNA, 20 bp, Artificial Sequence
  Description of Artificial Sequence: Synthetic oligonucleotide
  Target: ATXN1; (-) strand; PAM type: NRG; PAM sequence: AAG
aaaacatgctcagttcaaac

SEQ ID NO: 52626 - DNA, 20 bp, Artificial Sequence
  Description of Artificial Sequence: Synthetic oligonucleotide
  Target: ATXN1; (-) strand; PAM type: NRG; PAM sequence: CAG
atgtgaaaacaaaacatgct

SEQ ID NO: 52627 - DNA, 20 bp, Artificial Sequence
  Description of Artificial Sequence: Synthetic oligonucleotide
  Target: ATXN1; (-) strand; PAM type: NRG; PAM sequence: TGG
aaggacaaagcaccttttag

SEQ ID NO: 52628 - DNA, 20 bp, Artificial Sequence
  Description of Artificial Sequence: Synthetic oligonucleotide
  Target: ATXN1; (-) strand; PAM type: NRG; PAM sequence: TAG
ccaaaggacaaagcaccttt

SEQ ID NO: 52629 - DNA, 20 bp, Artificial Sequence
  Description of Artificial Sequence: Synthetic oligonucleotide
  Target: ATXN1; (-) strand; PAM type: NRG; PAM sequence: AAG
cacattcctcccaaaggaca

SEQ ID NO: 52630 - DNA, 20 bp, Artificial Sequence
  Description of Artificial Sequence: Synthetic oligonucleotide
  Target: ATXN1; (-) strand; PAM type: NRG; PAM sequence: AGG
agagggcacattcctcccaa

SEQ ID NO: 52631 - DNA, 20 bp, Artificial Sequence
  Description of Artificial Sequence: Synthetic oligonucleotide
  Target: ATXN1; (-) strand; PAM type: NRG; PAM sequence: AAG
aagagggcacattcctccca

SEQ ID NO: 52632 - DNA, 20 bp, Artificial Sequence
  Description of Artificial Sequence: Synthetic oligonucleotide
  Target: ATXN1; (-) strand; PAM type: NRG; PAM sequence: GGG
agggaaaggtgggatgaaga

SEQ ID NO: 52633 - DNA, 20 bp, Artificial Sequence
  Description of Artificial Sequence: Synthetic oligonucleotide
  Target: ATXN1; (-) strand; PAM type: NRG; PAM sequence: AGG
gagggaaaggtgggatgaag

SEQ ID NO: 52634 - DNA, 20 bp, Artificial Sequence
  Description of Artificial Sequence: Synthetic oligonucleotide
  Target: ATXN1; (-) strand; PAM type: NRG; PAM sequence: GAG
ggagggaaaggtgggatgaa

SEQ ID NO: 52635 - DNA, 20 bp, Artificial Sequence
  Description of Artificial Sequence: Synthetic oligonucleotide
  Target: ATXN1; (-) strand; PAM type: NRG; PAM sequence: AAG
tgggagggaaaggtgggatg

SEQ ID NO: 52636 - DNA, 20 bp, Artificial Sequence
  Description of Artificial Sequence: Synthetic oligonucleotide
  Target: ATXN1; (-) strand; PAM type: NRG; PAM sequence: GGG
gggctctgggagggaaaggt

SEQ ID NO: 52637 - DNA, 20 bp, Artificial Sequence
  Description of Artificial Sequence: Synthetic oligonucleotide
  Target: ATXN1; (-) strand; PAM type: NRG; PAM sequence: TGG
ggggctctgggagggaaagg

SEQ ID NO: 52638 - DNA, 20 bp, Artificial Sequence
  Description of Artificial Sequence: Synthetic oligonucleotide
  Target: ATXN1; (-) strand; PAM type: NRG; PAM sequence: AGG
ctgggggctctgggagggaa

SEQ ID NO: 52639 - DNA, 20 bp, Artificial Sequence
  Description of Artificial Sequence: Synthetic oligonucleotide
  Target: ATXN1; (-) strand; PAM type: NRG; PAM sequence: AAG
gctgggggctctgggaggga

SEQ ID NO: 52640 - DNA, 20 bp, Artificial Sequence
  Description of Artificial Sequence: Synthetic oligonucleotide
  Target: ATXN1; (-) strand; PAM type: NRG; PAM sequence: GGG
cattgctgggggctctggga

SEQ ID NO: 52641 - DNA, 20 bp, Artificial Sequence
  Description of Artificial Sequence: Synthetic oligonucleotide
  Target: ATXN1; (-) strand; PAM type: NRG; PAM sequence: AGG
tcattgctgggggctctggg

SEQ ID NO: 52642 - DNA, 20 bp, Artificial Sequence
  Description of Artificial Sequence: Synthetic oligonucleotide
  Target: ATXN1; (-) strand; PAM type: NRG; PAM sequence: GAG
ctcattgctgggggctctgg

SEQ ID NO: 52643 - DNA, 20 bp, Artificial Sequence
  Description of Artificial Sequence: Synthetic oligonucleotide
  Target: ATXN1; (-) strand; PAM type: NRG; PAM sequence: GGG
ctctcattgctgggggctct

SEQ ID NO: 52644 - DNA, 20 bp, Artificial Sequence
  Description of Artificial Sequence: Synthetic oligonucleotide
  Target: ATXN1; (-) strand; PAM type: NRG; PAM sequence: TGG
cctctcattgctgggggctc

SEQ ID NO: 52645 - DNA, 20 bp, Artificial Sequence
  Description of Artificial Sequence: Synthetic oligonucleotide
  Target: ATXN1; (-) strand; PAM type: NRG; PAM sequence: GGG
agacgccctctcattgctgg

SEQ ID NO: 52646 - DNA, 20 bp, Artificial Sequence
  Description of Artificial Sequence: Synthetic oligonucleotide
  Target: ATXN1; (-) strand; PAM type: NRG; PAM sequence: GGG
cagacgccctctcattgctg

SEQ ID NO: 52647 - DNA, 20 bp, Artificial Sequence
  Description of Artificial Sequence: Synthetic oligonucleotide
  Target: ATXN1; (-) strand; PAM type: NRG; PAM sequence: GGG
ccagacgccctctcattgct

SEQ ID NO: 52648 - DNA, 20 bp, Artificial Sequence
  Description of Artificial Sequence: Synthetic oligonucleotide
  Target: ATXN1; (-) strand; PAM type: NRG; PAM sequence: TGG
accagacgccctctcattgc

SEQ ID NO: 52649 - DNA, 20 bp, Artificial Sequence
  Description of Artificial Sequence: Synthetic oligonucleotide
  Target: ATXN1; (-) strand; PAM type: NRG; PAM sequence: CAG
tggacctgacagatgtgaac

SEQ ID NO: 52650 - DNA, 20 bp, Artificial Sequence
  Description of Artificial Sequence: Synthetic oligonucleotide
  Target: ATXN1; (-) strand; PAM type: NRG; PAM sequence: CAG
tagtcaggttctggacctga

SEQ ID NO: 52651 - DNA, 20 bp, Artificial Sequence
  Description of Artificial Sequence: Synthetic oligonucleotide
  Target: ATXN1; (-) strand; PAM type: NRG; PAM sequence: TGG
acttgtgcttagtcaggttc

SEQ ID NO: 52652 - DNA, 20 bp, Artificial Sequence
  Description of Artificial Sequence: Synthetic oligonucleotide
  Target: ATXN1; (-) strand; PAM type: NRG; PAM sequence: AGG
gacagaacttgtgcttagtc

SEQ ID NO: 52653 - DNA, 20 bp, Artificial Sequence
  Description of Artificial Sequence: Synthetic oligonucleotide
  Target: ATXN1; (-) strand; PAM type: NRG; PAM sequence: CAG
ggacagaacttgtgcttagt

SEQ ID NO: 52654 - DNA, 20 bp, Artificial Sequence
  Description of Artificial Sequence: Synthetic oligonucleotide
  Target: ATXN1; (-) strand; PAM type: NRG; PAM sequence: TAG
atcaggacagaacttgtgct

SEQ ID NO: 52655 - DNA, 20 bp, Artificial Sequence
  Description of Artificial Sequence: Synthetic oligonucleotide
  Target: ATXN1; (-) strand; PAM type: NRG; PAM sequence: CAG
tctcttgagtcccatcagga

SEQ ID NO: 52656 - DNA, 20 bp, Artificial Sequence
  Description of Artificial Sequence: Synthetic oligonucleotide
  Target: ATXN1; (-) strand; PAM type: NRG; PAM sequence: AGG
agcatctcttgagtcccatc

SEQ ID NO: 52657 - DNA, 20 bp, Artificial Sequence
  Description of Artificial Sequence: Synthetic oligonucleotide
  Target: ATXN1; (-) strand; PAM type: NRG; PAM sequence: CAG
cagcatctcttgagtcccat

SEQ ID NO: 52658 - DNA, 20 bp, Artificial Sequence
  Description of Artificial Sequence: Synthetic oligonucleotide
  Target: ATXN1; (-) strand; PAM type: NRG; PAM sequence: GAG
cccctcactcagcatctctt

SEQ ID NO: 52659 - DNA, 20 bp, Artificial Sequence
  Description of Artificial Sequence: Synthetic oligonucleotide
  Target: ATXN1; (-) strand; PAM type: NRG; PAM sequence: CAG
tgtcaaaatgccccctcact

SEQ ID NO: 52660 - DNA, 20 bp, Artificial Sequence
  Description of Artificial Sequence: Synthetic oligonucleotide
  Target: ATXN1; (-) strand; PAM type: NRG; PAM sequence: GGG
gagcgtgacaggaaccccaa

SEQ ID NO: 52661 - DNA, 20 bp, Artificial Sequence
  Description of Artificial Sequence: Synthetic oligonucleotide
  Target: ATXN1; (-) strand; PAM type: NRG; PAM sequence: AGG
tgagcgtgacaggaacccca

SEQ ID NO: 52662 - DNA, 20 bp, Artificial Sequence
  Description of Artificial Sequence: Synthetic oligonucleotide
  Target: ATXN1; (-) strand; PAM type: NRG; PAM sequence: AAG
ctgagcgtgacaggaacccc

SEQ ID NO: 52663 - DNA, 20 bp, Artificial Sequence
  Description of Artificial Sequence: Synthetic oligonucleotide
  Target: ATXN1; (-) strand; PAM type: NRG; PAM sequence: AGG
agcaggaagctgagcgtgac

SEQ ID NO: 52664 - DNA, 20 bp, Artificial Sequence
  Description of Artificial Sequence: Synthetic oligonucleotide
  Target: ATXN1; (-) strand; PAM type: NRG; PAM sequence: CAG
gagcaggaagctgagcgtga

SEQ ID NO: 52665 - DNA, 20 bp, Artificial Sequence
  Description of Artificial Sequence: Synthetic oligonucleotide
  Target: ATXN1; (-) strand; PAM type: NRG; PAM sequence: GAG
taaaagtcgagcaggaagct

SEQ ID NO: 52666 - DNA, 20 bp, Artificial Sequence
  Description of Artificial Sequence: Synthetic oligonucleotide
  Target: ATXN1; (-) strand; PAM type: NRG; PAM sequence: AAG
tctggtaaaagtcgagcagg

SEQ ID NO: 52667 - DNA, 20 bp, Artificial Sequence
  Description of Artificial Sequence: Synthetic oligonucleotide
  Target: ATXN1; (-) strand; PAM type: NRG; PAM sequence: AGG
gactctggtaaaagtcgagc

SEQ ID NO: 52668 - DNA, 20 bp, Artificial Sequence
  Description of Artificial Sequence: Synthetic oligonucleotide
  Target: ATXN1; (-) strand; PAM type: NRG; PAM sequence: CAG
agactctggtaaaagtcgag

SEQ ID NO: 52669 - DNA, 20 bp, Artificial Sequence
  Description of Artificial Sequence: Synthetic oligonucleotide
  Target: ATXN1; (-) strand; PAM type: NRG; PAM sequence: GAG
ggcagactctggtaaaagtc

SEQ ID NO: 52670 - DNA, 20 bp, Artificial Sequence
  Description of Artificial Sequence: Synthetic oligonucleotide
  Target: ATXN1; (-) strand; PAM type: NRG; PAM sequence: AAG
taccaggcagactctggtaa

SEQ ID NO: 52671 - DNA, 20 bp, Artificial Sequence
  Description of Artificial Sequence: Synthetic oligonucleotide
  Target: ATXN1; (-) strand; PAM type: NRG; PAM sequence: TGG
agactttaccaggcagactc

SEQ ID NO: 52672 - DNA, 20 bp, Artificial Sequence
  Description of Artificial Sequence: Synthetic oligonucleotide
  Target: ATXN1; (-) strand; PAM type: NRG; PAM sequence: CAG
ggaggaaagactttaccagg

SEQ ID NO: 52673 - DNA, 20 bp, Artificial Sequence
  Description of Artificial Sequence: Synthetic oligonucleotide
  Target: ATXN1; (-) strand; PAM type: NRG; PAM sequence: AGG
actggaggaaagactttacc

SEQ ID NO: 52674 - DNA, 20 bp, Artificial Sequence
  Description of Artificial Sequence: Synthetic oligonucleotide
  Target: ATXN1; (-) strand; PAM type: NRG; PAM sequence: CAG
aactggaggaaagactttac

SEQ ID NO: 52675 - DNA, 20 bp, Artificial Sequence
  Description of Artificial Sequence: Synthetic oligonucleotide
  Target: ATXN1; (-) strand; PAM type: NRG; PAM sequence: AAG
cagggaccttaactggagga

SEQ ID NO: 52676 - DNA, 20 bp, Artificial Sequence
  Description of Artificial Sequence: Synthetic oligonucleotide
  Target: ATXN1; (-) strand; PAM type: NRG; PAM sequence: AGG
aacccagggaccttaactgg

SEQ ID NO: 52677 - DNA, 20 bp, Artificial Sequence
  Description of Artificial Sequence: Synthetic oligonucleotide
  Target: ATXN1; (-) strand; PAM type: NRG; PAM sequence: GAG
caacccagggaccttaactg

SEQ ID NO: 52678 - DNA, 20 bp, Artificial Sequence
  Description of Artificial Sequence: Synthetic oligonucleotide
  Target: ATXN1; (-) strand; PAM type: NRG; PAM sequence: TGG
tacaacccagggaccttaac

SEQ ID NO: 52679 - DNA, 20 bp, Artificial Sequence
  Description of Artificial Sequence: Synthetic oligonucleotide
  Target: ATXN1; (-) strand; PAM type: NRG; PAM sequence: GGG
gacagcttgaatacaaccca

SEQ ID NO: 52680 - DNA, 20 bp, Artificial Sequence
  Description of Artificial Sequence: Synthetic oligonucleotide
  Target: ATXN1; (-) strand; PAM type: NRG; PAM sequence: AGG
ggacagcttgaatacaaccc

SEQ ID NO: 52681 - DNA, 20 bp, Artificial Sequence
  Description of Artificial Sequence: Synthetic oligonucleotide
  Target: ATXN1; (-) strand; PAM type: NRG; PAM sequence: CAG
gggacagcttgaatacaacc

SEQ ID NO: 52682 - DNA, 20 bp, Artificial Sequence
  Description of Artificial Sequence: Synthetic oligonucleotide
  Target: ATXN1; (-) strand; PAM type: NRG; PAM sequence: CAG
catgtggtgggggctgggga

SEQ ID NO: 52683 - DNA, 20 bp, Artificial Sequence
  Description of Artificial Sequence: Synthetic oligonucleotide
  Target: ATXN1; (-) strand; PAM type: NRG; PAM sequence: GGG
tgcacatgtggtgggggctg

SEQ ID NO: 52684 - DNA, 20 bp, Artificial Sequence
  Description of Artificial Sequence: Synthetic oligonucleotide
  Target: ATXN1; (-) strand; PAM type: NRG; PAM sequence: GGG
gtgcacatgtggtgggggct

SEQ ID NO: 52685 - DNA, 20 bp, Artificial Sequence
  Description of Artificial Sequence: Synthetic oligonucleotide
  Target: ATXN1; (-) strand; PAM type: NRG; PAM sequence: TGG
ggtgcacatgtggtgggggc

SEQ ID NO: 52686 - DNA, 20 bp, Artificial Sequence
  Description of Artificial Sequence: Synthetic oligonucleotide
  Target: ATXN1; (-) strand; PAM type: NRG; PAM sequence: GGG
gtatggtgcacatgtggtgg

SEQ ID NO: 52687 - DNA, 20 bp, Artificial Sequence
  Description of Artificial Sequence: Synthetic oligonucleotide
  Target: ATXN1; (-) strand; PAM type: NRG; PAM sequence: GGG
cgtatggtgcacatgtggtg

SEQ ID NO: 52688 - DNA, 20 bp, Artificial Sequence
  Description of Artificial Sequence: Synthetic oligonucleotide
  Target: ATXN1; (-) strand; PAM type: NRG; PAM sequence: GGG
gcgtatggtgcacatgtggt

SEQ ID NO: 52689 - DNA, 20 bp, Artificial Sequence
  Description of Artificial Sequence: Synthetic oligonucleotide
  Target: ATXN1; (-) strand; PAM type: NRG; PAM sequence: TGG
tgcgtatggtgcacatgtgg

SEQ ID NO: 52690 - DNA, 20 bp, Artificial Sequence
  Description of Artificial Sequence: Synthetic oligonucleotide
  Target: ATXN1; (-) strand; PAM type: NRG; PAM sequence: TGG
atgtgcgtatggtgcacatg

SEQ ID NO: 52691 - DNA, 20 bp, Artificial Sequence
  Description of Artificial Sequence: Synthetic oligonucleotide
  Target: ATXN1; (-) strand; PAM type: NRG; PAM sequence: TGG
agtgcgcgtgcatgtgcgta

SEQ ID NO: 52692 - DNA, 20 bp, Artificial Sequence
  Description of Artificial Sequence: Synthetic oligonucleotide
  Target: ATXN1; (-) strand; PAM type: NRG; PAM sequence: GAG
gtgcgtgtgtgcgcgcgcgc

SEQ ID NO: 52693 - DNA, 20 bp, Artificial Sequence
  Description of Artificial Sequence: Synthetic oligonucleotide
  Target: ATXN1; (-) strand; PAM type: NRG; PAM sequence: GAG
cccagaaaactaacaacgtg

SEQ ID NO: 52694 - DNA, 20 bp, Artificial Sequence
  Description of Artificial Sequence: Synthetic oligonucleotide
  Target: ATXN1; (-) strand; PAM type: NRG; PAM sequence: TGG
gacccagaaaactaacaacg

SEQ ID NO: 52695 - DNA, 20 bp, Artificial Sequence
  Description of Artificial Sequence: Synthetic oligonucleotide
  Target: ATXN1; (-) strand; PAM type: NRG; PAM sequence: CAG
acatttcacaggaaatgacc

SEQ ID NO: 52696 - DNA, 20 bp, Artificial Sequence
  Description of Artificial Sequence: Synthetic oligonucleotide
  Target: ATXN1; (-) strand; PAM type: NRG; PAM sequence: AGG
agggaacagtgacatttcac

SEQ ID NO: 52697 - DNA, 20 bp, Artificial Sequence
  Description of Artificial Sequence: Synthetic oligonucleotide
  Target: ATXN1; (-) strand; PAM type: NRG; PAM sequence: CAG
gagggaacagtgacatttca

SEQ ID NO: 52698 - DNA, 20 bp, Artificial Sequence
  Description of Artificial Sequence: Synthetic oligonucleotide
  Target: ATXN1; (-) strand; PAM type: NRG; PAM sequence: CAG
tccggccactaaagagggaa

SEQ ID NO: 52699 - DNA, 20 bp, Artificial Sequence
  Description of Artificial Sequence: Synthetic oligonucleotide
  Target: ATXN1; (-) strand; PAM type: NRG; PAM sequence: GGG
tgagatccggccactaaaga

SEQ ID NO: 52700 - DNA, 20 bp, Artificial Sequence
  Description of Artificial Sequence: Synthetic oligonucleotide
  Target: ATXN1; (-) strand; PAM type: NRG; PAM sequence: AGG
ctgagatccggccactaaag

SEQ ID NO: 52701 - DNA, 20 bp, Artificial Sequence
  Description of Artificial Sequence: Synthetic oligonucleotide
  Target: ATXN1; (-) strand; PAM type: NRG; PAM sequence: GAG
gctgagatccggccactaaa

SEQ ID NO: 52702 - DNA, 20 bp, Artificial Sequence
  Description of Artificial Sequence: Synthetic oligonucleotide
  Target: ATXN1; (-) strand; PAM type: NRG; PAM sequence: AAG
aggctgagatccggccacta

SEQ ID NO: 52703 - DNA, 20 bp, Artificial Sequence
  Description of Artificial Sequence: Synthetic oligonucleotide
  Target: ATXN1; (-) strand; PAM type: NRG; PAM sequence: CGG
cggactcccaggctgagatc

SEQ ID NO: 52704 - DNA, 20 bp, Artificial Sequence
  Description of Artificial Sequence: Synthetic oligonucleotide
  Target: ATXN1; (-) strand; PAM type: NRG; PAM sequence: GAG
ctcagtcggactcccaggct

SEQ ID NO: 52705 - DNA, 20 bp, Artificial Sequence
  Description of Artificial Sequence: Synthetic oligonucleotide
  Target: ATXN1; (-) strand; PAM type: NRG; PAM sequence: AGG
ttgctctcagtcggactccc

SEQ ID NO: 52706 - DNA, 20 bp, Artificial Sequence
  Description of Artificial Sequence: Synthetic oligonucleotide
  Target: ATXN1; (-) strand; PAM type: NRG; PAM sequence: CAG
cttgctctcagtcggactcc

SEQ ID NO: 52707 - DNA, 20 bp, Artificial Sequence
  Description of Artificial Sequence: Synthetic oligonucleotide
  Target: ATXN1; (-) strand; PAM type: NRG; PAM sequence: CGG
gacagccccttgctctcagt

SEQ ID NO: 52708 - DNA, 20 bp, Artificial Sequence
  Description of Artificial Sequence: Synthetic oligonucleotide
  Target: ATXN1; (-) strand; PAM type: NRG; PAM sequence: CAG
taccgacagccccttgctct

SEQ ID NO: 52709 - DNA, 20 bp, Artificial Sequence
  Description of Artificial Sequence: Synthetic oligonucleotide
  Target: ATXN1; (-) strand; PAM type: NRG; PAM sequence: CAG
ctctccccaggctgtaccga

SEQ ID NO: 52710 - DNA, 20 bp, Artificial Sequence
  Description of Artificial Sequence: Synthetic oligonucleotide
  Target: ATXN1; (-) strand; PAM type: NRG; PAM sequence: AGG
gggggtgggaccctctcccc

SEQ ID NO: 52711 - DNA, 20 bp, Artificial Sequence
  Description of Artificial Sequence: Synthetic oligonucleotide
  Target: ATXN1; (-) strand; PAM type: NRG; PAM sequence: CAG
tgggggtgggaccctctccc

SEQ ID NO: 52712 - DNA, 20 bp, Artificial Sequence
  Description of Artificial Sequence: Synthetic oligonucleotide
  Target: ATXN1; (-) strand; PAM type: NRG; PAM sequence: GGG
atctggtgtgaggtgggggt

SEQ ID NO: 52713 - DNA, 20 bp, Artificial Sequence
  Description of Artificial Sequence: Synthetic oligonucleotide
  Target: ATXN1; (-) strand; PAM type: NRG; PAM sequence: TGG
aatctggtgtgaggtggggg

SEQ ID NO: 52714 - DNA, 20 bp, Artificial Sequence
  Description of Artificial Sequence: Synthetic oligonucleotide
  Target: ATXN1; (-) strand; PAM type: NRG; PAM sequence: GGG
caaaatctggtgtgaggtgg

SEQ ID NO: 52715 - DNA, 20 bp, Artificial Sequence
  Description of Artificial Sequence: Synthetic oligonucleotide
  Target: ATXN1; (-) strand; PAM type: NRG; PAM sequence: GGG
acaaaatctggtgtgaggtg

SEQ ID NO: 52716 - DNA, 20 bp, Artificial Sequence
  Description of Artificial Sequence: Synthetic oligonucleotide
  Target: ATXN1; (-) strand; PAM type: NRG; PAM sequence: GGG
tacaaaatctggtgtgaggt

SEQ ID NO: 52717 - DNA, 20 bp, Artificial Sequence
  Description of Artificial Sequence: Synthetic oligonucleotide
  Target: ATXN1; (-) strand; PAM type: NRG; PAM sequence: TGG
atacaaaatctggtgtgagg

SEQ ID NO: 52718 - DNA, 20 bp, Artificial Sequence
  Description of Artificial Sequence: Synthetic oligonucleotide
  Target: ATXN1; (-) strand; PAM type: NRG; PAM sequence: AGG
ttaatacaaaatctggtgtg

SEQ ID NO: 52719 - DNA, 20 bp, Artificial Sequence
  Description of Artificial Sequence: Synthetic oligonucleotide
  Target: ATXN1; (-) strand; PAM type: NRG; PAM sequence: GAG
attaatacaaaatctggtgt

SEQ ID NO: 52720 - DNA, 20 bp, Artificial Sequence
  Description of Artificial Sequence: Synthetic oligonucleotide
  Target: ATXN1; (-) strand; PAM type: NRG; PAM sequence: TGG
attattattaatacaaaatc

SEQ ID NO: 52721 - DNA, 20 bp, Artificial Sequence
  Description of Artificial Sequence: Synthetic oligonucleotide
  Target: ATXN1; (-) strand; PAM type: NRG; PAM sequence: GAG
aggctagaaacaggtgagtg

SEQ ID NO: 52722 - DNA, 20 bp, Artificial Sequence
  Description of Artificial Sequence: Synthetic oligonucleotide
  Target: ATXN1; (-) strand; PAM type: NRG; PAM sequence: TGG
ccaggctagaaacaggtgag

SEQ ID NO: 52723 - DNA, 20 bp, Artificial Sequence
  Description of Artificial Sequence: Synthetic oligonucleotide
  Target: ATXN1; (-) strand; PAM type: NRG; PAM sequence: GAG
ttcccaggctagaaacaggt

SEQ ID NO: 52724 - DNA, 20 bp, Artificial Sequence
  Description of Artificial Sequence: Synthetic oligonucleotide
  Target: ATXN1; (-) strand; PAM type: NRG; PAM sequence: AGG
aagtttcccaggctagaaac

SEQ ID NO: 52725 - DNA, 20 bp, Artificial Sequence
  Description of Artificial Sequence: Synthetic oligonucleotide
  Target: ATXN1; (-) strand; PAM type: NRG; PAM sequence: CAG
aaagtttcccaggctagaaa

SEQ ID NO: 52726 - DNA, 20 bp, Artificial Sequence
  Description of Artificial Sequence: Synthetic oligonucleotide
  Target: ATXN1; (-) strand; PAM type: NRG; PAM sequence: TAG
aggaagaaagtttcccaggc

SEQ ID NO: 52727 - DNA, 20 bp, Artificial Sequence
  Description of Artificial Sequence: Synthetic oligonucleotide
  Target: ATXN1; (-) strand; PAM type: NRG; PAM sequence: AGG
atgaaggaagaaagtttccc

SEQ ID NO: 52728 - DNA, 20 bp, Artificial Sequence
  Description of Artificial Sequence: Synthetic oligonucleotide
  Target: ATXN1; (-) strand; PAM type: NRG; PAM sequence: CAG
aatgaaggaagaaagtttcc

SEQ ID NO: 52729 - DNA, 20 bp, Artificial Sequence
  Description of Artificial Sequence: Synthetic oligonucleotide
  Target: ATXN1; (-) strand; PAM type: NRG; PAM sequence: AAG
tagtgctgaatgaaggaaga

SEQ ID NO: 52730 - DNA, 20 bp, Artificial Sequence
  Description of Artificial Sequence: Synthetic oligonucleotide
  Target: ATXN1; (-) strand; PAM type: NRG; PAM sequence: AAG
taaatagtgctgaatgaagg

SEQ ID NO: 52731 - DNA, 20 bp, Artificial Sequence
  Description of Artificial Sequence: Synthetic oligonucleotide
  Target: ATXN1; (-) strand; PAM type: NRG; PAM sequence: AGG
caataaatagtgctgaatga

SEQ ID NO: 52732 - DNA, 20 bp, Artificial Sequence
  Description of Artificial Sequence: Synthetic oligonucleotide
  Target: ATXN1; (-) strand; PAM type: NRG; PAM sequence: AAG
gcaataaatagtgctgaatg

SEQ ID NO: 52733 - DNA, 20 bp, Artificial Sequence
  Description of Artificial Sequence: Synthetic oligonucleotide
  Target: ATXN1; (-) strand; PAM type: NRG; PAM sequence: TAG
tgttttaggtgtgcaataaa

SEQ ID NO: 52734 - DNA, 20 bp, Artificial Sequence
  Description of Artificial Sequence: Synthetic oligonucleotide
  Target: ATXN1; (-) strand; PAM type: NRG; PAM sequence: AGG
cacagtagcattaatgtttt

SEQ ID NO: 52735 - DNA, 20 bp, Artificial Sequence
  Description of Artificial Sequence: Synthetic oligonucleotide
  Target: ATXN1; (-) strand; PAM type: NRG; PAM sequence: TAG
acacagtagcattaatgttt

SEQ ID NO: 52736 - DNA, 20 bp, Artificial Sequence
  Description of Artificial Sequence: Synthetic oligonucleotide
  Target: ATXN1; (-) strand; PAM type: NRG; PAM sequence: TAG
atcttccaagccccacacag

SEQ ID NO: 52737 - DNA, 20 bp, Artificial Sequence
  Description of Artificial Sequence: Synthetic oligonucleotide
  Target: ATXN1; (-) strand; PAM type: NRG; PAM sequence: CAG
gacatcttccaagccccaca

SEQ ID NO: 52738 - DNA, 20 bp, Artificial Sequence
  Description of Artificial Sequence: Synthetic oligonucleotide
  Target: ATXN1; (-) strand; PAM type: NRG; PAM sequence: AAG
caaacaccaggacatcttcc

SEQ ID NO: 52739 - DNA, 20 bp, Artificial Sequence
  Description of Artificial Sequence: Synthetic oligonucleotide
  Target: ATXN1; (-) strand; PAM type: NRG; PAM sequence: AGG
tgagaaagtacccaaacacc

SEQ ID NO: 52740 - DNA, 20 bp, Artificial Sequence
  Description of Artificial Sequence: Synthetic oligonucleotide
  Target: ATXN1; (-) strand; PAM type: NRG; PAM sequence: CAG
ctgagaaagtacccaaacac

SEQ ID NO: 52741 - DNA, 20 bp, Artificial Sequence
  Description of Artificial Sequence: Synthetic oligonucleotide
  Target: ATXN1; (-) strand; PAM type: NRG; PAM sequence: AAG
agaaagtcttgcttctgaga

SEQ ID NO: 52742 - DNA, 20 bp, Artificial Sequence
  Description of Artificial Sequence: Synthetic oligonucleotide
  Target: ATXN1; (-) strand; PAM type: NRG; PAM sequence: GAG
aatgagaaagtcttgcttct

SEQ ID NO: 52743 - DNA, 20 bp, Artificial Sequence
  Description of Artificial Sequence: Synthetic oligonucleotide
  Target: ATXN1; (-) strand; PAM type: NRG; PAM sequence: AAG
attcagagacccaaatgaga

SEQ ID NO: 52744 - DNA, 20 bp, Artificial Sequence
  Description of Artificial Sequence: Synthetic oligonucleotide
  Target: ATXN1; (-) strand; PAM type: NRG; PAM sequence: GAG
tgatattcagagacccaaat

SEQ ID NO: 52745 - DNA, 20 bp, Artificial Sequence
  Description of Artificial Sequence: Synthetic oligonucleotide
  Target: ATXN1; (-) strand; PAM type: NRG; PAM sequence: GAG
ctggtcacatttgatattca

SEQ ID NO: 52746 - DNA, 20 bp, Artificial Sequence
  Description of Artificial Sequence: Synthetic oligonucleotide
  Target: ATXN1; (-) strand; PAM type: NRG; PAM sequence: CAG
ggctggtcacatttgatatt

SEQ ID NO: 52747 - DNA, 20 bp, Artificial Sequence
  Description of Artificial Sequence: Synthetic oligonucleotide
  Target: ATXN1; (-) strand; PAM type: NRG; PAM sequence: TGG
aaatgtacatacttgttggc

SEQ ID NO: 52748 - DNA, 20 bp, Artificial Sequence
  Description of Artificial Sequence: Synthetic oligonucleotide
  Target: ATXN1; (-) strand; PAM type: NRG; PAM sequence: TGG
actgaaatgtacatacttgt

SEQ ID NO: 52749 - DNA, 20 bp, Artificial Sequence
  Description of Artificial Sequence: Synthetic oligonucleotide
  Target: ATXN1; (-) strand; PAM type: NRG; PAM sequence: GGG
tattctccaggaaaaggtga

SEQ ID NO: 52750 - DNA, 20 bp, Artificial Sequence
  Description of Artificial Sequence: Synthetic oligonucleotide
  Target: ATXN1; (-) strand; PAM type: NRG; PAM sequence: AGG
ctattctccaggaaaaggtg

SEQ ID NO: 52751 - DNA, 20 bp, Artificial Sequence
  Description of Artificial Sequence: Synthetic oligonucleotide
  Target: ATXN1; (-) strand; PAM type: NRG; PAM sequence: GAG
tctattctccaggaaaaggt

SEQ ID NO: 52752 - DNA, 20 bp, Artificial Sequence
  Description of Artificial Sequence: Synthetic oligonucleotide
  Target: ATXN1; (-) strand; PAM type: NRG; PAM sequence: AGG
aaactctattctccaggaaa

SEQ ID NO: 52753 - DNA, 20 bp, Artificial Sequence
  Description of Artificial Sequence: Synthetic oligonucleotide
  Target: ATXN1; (-) strand; PAM type: NRG; PAM sequence: AAG
caaactctattctccaggaa

SEQ ID NO: 52754 - DNA, 20 bp, Artificial Sequence
  Description of Artificial Sequence: Synthetic oligonucleotide
  Target: ATXN1; (-) strand; PAM type: NRG; PAM sequence: AGG
catatcaaactctattctcc

SEQ ID NO: 52755 - DNA, 20 bp, Artificial Sequence
  Description of Artificial Sequence: Synthetic oligonucleotide
  Target: ATXN1; (-) strand; PAM type: NRG; PAM sequence: CAG
tcatatcaaactctattctc

SEQ ID NO: 52756 - DNA, 20 bp, Artificial Sequence
  Description of Artificial Sequence: Synthetic oligonucleotide
  Target: ATXN1; (-) strand; PAM type: NRG; PAM sequence: GAG
tttctgtcgtgtgtgctgag

SEQ ID NO: 52757 - DNA, 20 bp, Artificial Sequence
  Description of Artificial Sequence: Synthetic oligonucleotide
  Target: ATXN1; (-) strand; PAM type: NRG; PAM sequence: AGG
attttctgtcgtgtgtgctg

SEQ ID NO: 52758 - DNA, 20 bp, Artificial Sequence
  Description of Artificial Sequence: Synthetic oligonucleotide
  Target: ATXN1; (-) strand; PAM type: NRG; PAM sequence: GAG
tattttctgtcgtgtgtgct

SEQ ID NO: 52759 - DNA, 20 bp, Artificial Sequence
  Description of Artificial Sequence: Synthetic oligonucleotide
  Target: ATXN1; (-) strand; PAM type: NRG; PAM sequence: CAG
atatacttattagtccagag

SEQ ID NO: 52760 - DNA, 20 bp, Artificial Sequence
  Description of Artificial Sequence: Synthetic oligonucleotide
  Target: ATXN1; (-) strand; PAM type: NRG; PAM sequence: GAG
gtgatatacttattagtcca

SEQ ID NO: 52761 - DNA, 20 bp, Artificial Sequence
  Description of Artificial Sequence: Synthetic oligonucleotide
  Target: ATXN1; (-) strand; PAM type: NRG; PAM sequence: CAG
ctgtgatatacttattagtc

SEQ ID NO: 52762 - DNA, 20 bp, Artificial Sequence
  Description of Artificial Sequence: Synthetic oligonucleotide
  Target: ATXN1; (-) strand; PAM type: NRG; PAM sequence: TAG
tgtgcctgtgatatacttat

SEQ ID NO: 52763 - DNA, 20 bp, Artificial Sequence
  Description of Artificial Sequence: Synthetic oligonucleotide
  Target: ATXN1; (-) strand; PAM type: NRG; PAM sequence: GAG
ttaatcaaaagttggctaca

SEQ ID NO: 52764 - DNA, 20 bp, Artificial Sequence
  Description of Artificial Sequence: Synthetic oligonucleotide
  Target: ATXN1; (-) strand; PAM type: NRG; PAM sequence: CAG
ctttaatcaaaagttggcta

SEQ ID NO: 52765 - DNA, 20 bp, Artificial Sequence
  Description of Artificial Sequence: Synthetic oligonucleotide
  Target: ATXN1; (-) strand; PAM type: NRG; PAM sequence: TGG
ctgtgtctttaatcaaaagt

SEQ ID NO: 52766 - DNA, 20 bp, Artificial Sequence
  Description of Artificial Sequence: Synthetic oligonucleotide
  Target: ATXN1; (-) strand; PAM type: NRG; PAM sequence: AAG
gagactgtgtctttaatcaa

SEQ ID NO: 52767 - DNA, 20 bp, Artificial Sequence
  Description of Artificial Sequence: Synthetic oligonucleotide
  Target: ATXN1; (-) strand; PAM type: NRG; PAM sequence: GAG
tgcgctgctccttaatggta

SEQ ID NO: 52768 - DNA, 20 bp, Artificial Sequence
  Description of Artificial Sequence: Synthetic oligonucleotide
  Target: ATXN1; (-) strand; PAM type: NRG; PAM sequence: TAG
gatgcgctgctccttaatgg

SEQ ID NO: 52769 - DNA, 20 bp, Artificial Sequence
  Description of Artificial Sequence: Synthetic oligonucleotide
  Target: ATXN1; (-) strand; PAM type: NRG; PAM sequence: TGG
atagatgcgctgctccttaa

SEQ ID NO: 52770 - DNA, 20 bp, Artificial Sequence
  Description of Artificial Sequence: Synthetic oligonucleotide
  Target: ATXN1; (-) strand; PAM type: NRG; PAM sequence: TAG
tggcttttattggtgtgata

SEQ ID NO: 52771 - DNA, 20 bp, Artificial Sequence
  Description of Artificial Sequence: Synthetic oligonucleotide
  Target: ATXN1; (-) strand; PAM type: NRG; PAM sequence: TGG
ctaggactcttggcttttat

SEQ ID NO: 52772 - DNA, 20 bp, Artificial Sequence
  Description of Artificial Sequence: Synthetic oligonucleotide
  Target: ATXN1; (-) strand; PAM type: NRG; PAM sequence: TGG
tagcaaactgctaggactct

SEQ ID NO: 52773 - DNA, 20 bp, Artificial Sequence
  Description of Artificial Sequence: Synthetic oligonucleotide
  Target: ATXN1; (-) strand; PAM type: NRG; PAM sequence: AGG
gtcgtttgtagcaaactgct

SEQ ID NO: 52774 - DNA, 20 bp, Artificial Sequence
  Description of Artificial Sequence: Synthetic oligonucleotide
  Target: ATXN1; (-) strand; PAM type: NRG; PAM sequence: TAG
agtcgtttgtagcaaactgc

SEQ ID NO: 52775 - DNA, 20 bp, Artificial Sequence
  Description of Artificial Sequence: Synthetic oligonucleotide
  Target: ATXN1; (-) strand; PAM type: NRG; PAM sequence: TAG
tctcactacgtagtcgtttg

SEQ ID NO: 52776 - DNA, 20 bp, Artificial Sequence
  Description of Artificial Sequence: Synthetic oligonucleotide
  Target: ATXN1; (-) strand; PAM type: NRG; PAM sequence: TAG
agttcctaactctcactacg

SEQ ID NO: 52777 - DNA, 20 bp, Artificial Sequence
  Description of Artificial Sequence: Synthetic oligonucleotide
  Target: ATXN1; (-) strand; PAM type: NRG; PAM sequence: TAG
ataaaatacagaatccagaa

SEQ ID NO: 52778 - DNA, 20 bp, Artificial Sequence
  Description of Artificial Sequence: Synthetic oligonucleotide
  Target: ATXN1; (-) strand; PAM type: NRG; PAM sequence: CAG
ttaggataaaatacagaatc

SEQ ID NO: 52779 - DNA, 20 bp, Artificial Sequence
  Description of Artificial Sequence: Synthetic oligonucleotide
  Target: ATXN1; (-) strand; PAM type: NRG; PAM sequence: CAG
aaggtctttaggataaaata

SEQ ID NO: 52780 - DNA, 20 bp, Artificial Sequence
  Description of Artificial Sequence: Synthetic oligonucleotide
  Target: ATXN1; (-) strand; PAM type: NRG; PAM sequence: AGG
aaatttaaataaaggtcttt

SEQ ID NO: 52781 - DNA, 20 bp, Artificial Sequence
  Description of Artificial Sequence: Synthetic oligonucleotide
  Target: ATXN1; (-) strand; PAM type: NRG; PAM sequence: TAG
aaaatttaaataaaggtctt

SEQ ID NO: 52782 - DNA, 20 bp, Artificial Sequence
  Description of Artificial Sequence: Synthetic oligonucleotide
  Target: ATXN1; (-) strand; PAM type: NRG; PAM sequence: AGG
aggctggaaaatttaaataa

SEQ ID NO: 52783 - DNA, 20 bp, Artificial Sequence
  Description of Artificial Sequence: Synthetic oligonucleotide
  Target: ATXN1; (-) strand; PAM type: NRG; PAM sequence: AAG
taggctggaaaatttaaata

SEQ ID NO: 52784 - DNA, 20 bp, Artificial Sequence
  Description of Artificial Sequence: Synthetic oligonucleotide
  Target: ATXN1; (-) strand; PAM type: NRG; PAM sequence: TGG
ggaatgggaaggagataggc

SEQ ID NO: 52785 - DNA, 20 bp, Artificial Sequence
  Description of Artificial Sequence: Synthetic oligonucleotide
  Target: ATXN1; (-) strand; PAM type: NRG; PAM sequence: AGG
gagtggaatgggaaggagat

SEQ ID NO: 52786 - DNA, 20 bp, Artificial Sequence
  Description of Artificial Sequence: Synthetic oligonucleotide
  Target: ATXN1; (-) strand; PAM type: NRG; PAM sequence: TAG
tgagtggaatgggaaggaga

SEQ ID NO: 52787 - DNA, 20 bp, Artificial Sequence
  Description of Artificial Sequence: Synthetic oligonucleotide
  Target: ATXN1; (-) strand; PAM type: NRG; PAM sequence: GAG
agactgagtggaatgggaag

SEQ ID NO: 52788 - DNA, 20 bp, Artificial Sequence
  Description of Artificial Sequence: Synthetic oligonucleotide
  Target: ATXN1; (-) strand; PAM type: NRG; PAM sequence: AGG
tgagactgagtggaatggga

SEQ ID NO: 52789 - DNA, 20 bp, Artificial Sequence
  Description of Artificial Sequence: Synthetic oligonucleotide
  Target: ATXN1; (-) strand; PAM type: NRG; PAM sequence: AAG
atgagactgagtggaatggg

SEQ ID NO: 52790 - DNA, 20 bp, Artificial Sequence
  Description of Artificial Sequence: Synthetic oligonucleotide
  Target: ATXN1; (-) strand; PAM type: NRG; PAM sequence: GGG
caaatgagactgagtggaat

SEQ ID NO: 52791 - DNA, 20 bp, Artificial Sequence
  Description of Artificial Sequence: Synthetic oligonucleotide
  Target: ATXN1; (-) strand; PAM type: NRG; PAM sequence: TGG
tcaaatgagactgagtggaa

SEQ ID NO: 52792 - DNA, 20 bp, Artificial Sequence
  Description of Artificial Sequence: Synthetic oligonucleotide
  Target: ATXN1; (-) strand; PAM type: NRG; PAM sequence: TGG
caatgtcaaatgagactgag

SEQ ID NO: 52793 - DNA, 20 bp, Artificial Sequence
  Description of Artificial Sequence: Synthetic oligonucleotide
  Target: ATXN1; (-) strand; PAM type: NRG; PAM sequence: GAG
aagcaatgtcaaatgagact

SEQ ID NO: 52794 - DNA, 20 bp, Artificial Sequence
  Description of Artificial Sequence: Synthetic oligonucleotide
  Target: ATXN1; (-) strand; PAM type: NRG; PAM sequence: GAG
tgggggaagcaatgtcaaat

SEQ ID NO: 52795 - DNA, 20 bp, Artificial Sequence
  Description of Artificial Sequence: Synthetic oligonucleotide
  Target: ATXN1; (-) strand; PAM type: NRG; PAM sequence: AAG
catcacagtggacttggggg

SEQ ID NO: 52796 - DNA, 20 bp, Artificial Sequence
  Description of Artificial Sequence: Synthetic oligonucleotide
  Target: ATXN1; (-) strand; PAM type: NRG; PAM sequence: GGG
tgacatcacagtggacttgg

SEQ ID NO: 52797 - DNA, 20 bp, Artificial Sequence
  Description of Artificial Sequence: Synthetic oligonucleotide
  Target: ATXN1; (-) strand; PAM type: NRG; PAM sequence: GGG
atgacatcacagtggacttg

SEQ ID NO: 52798 - DNA, 20 bp, Artificial Sequence
  Description of Artificial Sequence: Synthetic oligonucleotide
  Target: ATXN1; (-) strand; PAM type: NRG; PAM sequence: GGG
catgacatcacagtggactt

SEQ ID NO: 52799 - DNA, 20 bp, Artificial Sequence
  Description of Artificial Sequence: Synthetic oligonucleotide
  Target: ATXN1; (-) strand; PAM type: NRG; PAM sequence: TGG
gcatgacatcacagtggact

SEQ ID NO: 52800 - DNA, 20 bp, Artificial Sequence
  Description of Artificial Sequence: Synthetic oligonucleotide
  Target: ATXN1; (-) strand; PAM type: NRG; PAM sequence: TGG
caaggtgcatgacatcacag

SEQ ID NO: 52801 - DNA, 20 bp, Artificial Sequence
  Description of Artificial Sequence: Synthetic oligonucleotide
  Target: ATXN1; (-) strand; PAM type: NRG; PAM sequence: CAG
ccacaaggtgcatgacatca

SEQ ID NO: 52802 - DNA, 20 bp, Artificial Sequence
  Description of Artificial Sequence: Synthetic oligonucleotide
  Target: ATXN1; (-) strand; PAM type: NRG; PAM sequence: AGG
acagatcattgccatccaca

SEQ ID NO: 52803 - DNA, 20 bp, Artificial Sequence
  Description of Artificial Sequence: Synthetic oligonucleotide
  Target: ATXN1; (-) strand; PAM type: NRG; PAM sequence: AAG
cacagatcattgccatccac

SEQ ID NO: 52804 - DNA, 20 bp, Artificial Sequence
  Description of Artificial Sequence: Synthetic oligonucleotide
  Target: ATXN1; (-) strand; PAM type: NRG; PAM sequence: CAG
gagcattttgaattatagca

SEQ ID NO: 52805 - DNA, 20 bp, Artificial Sequence
  Description of Artificial Sequence: Synthetic oligonucleotide
  Target: ATXN1; (-) strand; PAM type: NRG; PAM sequence: TAG
cctgagagcattttgaatta

SEQ ID NO: 52806 - DNA, 20 bp, Artificial Sequence
  Description of Artificial Sequence: Synthetic oligonucleotide
  Target: ATXN1; (-) strand; PAM type: NRG; PAM sequence: GAG
ctttgctcccagctccctga

SEQ ID NO: 52807 - DNA, 20 bp, Artificial Sequence
  Description of Artificial Sequence: Synthetic oligonucleotide
  Target: ATXN1; (-) strand; PAM type: NRG; PAM sequence: GAG
ctctttgctcccagctccct

SEQ ID NO: 52808 - DNA, 20 bp, Artificial Sequence
  Description of Artificial Sequence: Synthetic oligonucleotide
  Target: ATXN1; (-) strand; PAM type: NRG; PAM sequence: CAG
atgtgttttctctttgctcc

SEQ ID NO: 52809 - DNA, 20 bp, Artificial Sequence
  Description of Artificial Sequence: Synthetic oligonucleotide
  Target: ATXN1; (-) strand; PAM type: NRG; PAM sequence: CAG
tgaaacctgtgcttttcaaa

SEQ ID NO: 52810 - DNA, 20 bp, Artificial Sequence
  Description of Artificial Sequence: Synthetic oligonucleotide
  Target: ATXN1; (-) strand; PAM type: NRG; PAM sequence: CAG
ctctgaaatcgcttccattc

SEQ ID NO: 52811 - DNA, 20 bp, Artificial Sequence
  Description of Artificial Sequence: Synthetic oligonucleotide
  Target: ATXN1; (-) strand; PAM type: NRG; PAM sequence: GAG
ggccgccagagtgcttgcaa

SEQ ID NO: 52812 - DNA, 20 bp, Artificial Sequence
  Description of Artificial Sequence: Synthetic oligonucleotide
  Target: ATXN1; (-) strand; PAM type: NRG; PAM sequence: AAG
tcggccgccagagtgcttgc

SEQ ID NO: 52813 - DNA, 20 bp, Artificial Sequence
  Description of Artificial Sequence: Synthetic oligonucleotide
  Target: ATXN1; (-) strand; PAM type: NRG; PAM sequence: GAG
tttggatgcttcggccgcca

SEQ ID NO: 52814 - DNA, 20 bp, Artificial Sequence
  Description of Artificial Sequence: Synthetic oligonucleotide
  Target: ATXN1; (-) strand; PAM type: NRG; PAM sequence: CAG
aatttggatgcttcggccgc

SEQ ID NO: 52815 - DNA, 20 bp, Artificial Sequence
  Description of Artificial Sequence: Synthetic oligonucleotide
  Target: ATXN1; (-) strand; PAM type: NRG; PAM sequence: CGG
aaccaggaatttggatgctt

SEQ ID NO: 52816 - DNA, 20 bp, Artificial Sequence
  Description of Artificial Sequence: Synthetic oligonucleotide
  Target: ATXN1; (-) strand; PAM type: NRG; PAM sequence: TGG
aaccacagcaaccaggaatt

SEQ ID NO: 52817 - DNA, 20 bp, Artificial Sequence
  Description of Artificial Sequence: Synthetic oligonucleotide
  Target: ATXN1; (-) strand; PAM type: NRG; PAM sequence: AGG
tccagccaaccacagcaacc

SEQ ID NO: 52818 - DNA, 20 bp, Artificial Sequence
  Description of Artificial Sequence: Synthetic oligonucleotide
  Target: ATXN1; (-) strand; PAM type: NRG; PAM sequence: CAG
ctccagccaaccacagcaac

SEQ ID NO: 52819 - DNA, 20 bp, Artificial Sequence
  Description of Artificial Sequence: Synthetic oligonucleotide
  Target: ATXN1; (-) strand; PAM type: NRG; PAM sequence: CAG
tagactcctccagccaacca

SEQ ID NO: 52820 - DNA, 20 bp, Artificial Sequence
  Description of Artificial Sequence: Synthetic oligonucleotide
  Target: ATXN1; (-) strand; PAM type: NRG; PAM sequence: CAG
gttggggttgtagactcctc

SEQ ID NO: 52821 - DNA, 20 bp, Artificial Sequence
  Description of Artificial Sequence: Synthetic oligonucleotide
  Target: ATXN1; (-) strand; PAM type: NRG; PAM sequence: TAG
aaaggcaggagttggggttg

SEQ ID NO: 52822 - DNA, 20 bp, Artificial Sequence
  Description of Artificial Sequence: Synthetic oligonucleotide
  Target: ATXN1; (-) strand; PAM type: NRG; PAM sequence: GGG
agagtcaaaggcaggagttg

SEQ ID NO: 52823 - DNA, 20 bp, Artificial Sequence
  Description of Artificial Sequence: Synthetic oligonucleotide
  Target: ATXN1; (-) strand; PAM type: NRG; PAM sequence: GGG
aagagtcaaaggcaggagtt

SEQ ID NO: 52824 - DNA, 20 bp, Artificial Sequence
  Description of Artificial Sequence: Synthetic oligonucleotide
  Target: ATXN1; (-) strand; PAM type: NRG; PAM sequence: TGG
taagagtcaaaggcaggagt

SEQ ID NO: 52825 - DNA, 20 bp, Artificial Sequence
  Description of Artificial Sequence: Synthetic oligonucleotide
  Target: ATXN1; (-) strand; PAM type: NRG; PAM sequence: GAG
atgataagagtcaaaggcag

SEQ ID NO: 52826 - DNA, 20 bp, Artificial Sequence
  Description of Artificial Sequence: Synthetic oligonucleotide
  Target: ATXN1; (-) strand; PAM type: NRG; PAM sequence: AGG
ctatgataagagtcaaaggc

SEQ ID NO: 52827 - DNA, 20 bp, Artificial Sequence
  Description of Artificial Sequence: Synthetic oligonucleotide
  Target: ATXN1; (-) strand; PAM type: NRG; PAM sequence: CAG
tctatgataagagtcaaagg

SEQ ID NO: 52828 - DNA, 20 bp, Artificial Sequence
  Description of Artificial Sequence: Synthetic oligonucleotide
  Target: ATXN1; (-) strand; PAM type: NRG; PAM sequence: AGG
cagtctatgataagagtcaa

SEQ ID NO: 52829 - DNA, 20 bp, Artificial Sequence
  Description of Artificial Sequence: Synthetic oligonucleotide
  Target: ATXN1; (-) strand; PAM type: NRG; PAM sequence: AAG
gcagtctatgataagagtca

SEQ ID NO: 52830 - DNA, 20 bp, Artificial Sequence
  Description of Artificial Sequence: Synthetic oligonucleotide
  Target: ATXN1; (-) strand; PAM type: NRG; PAM sequence: GAG
ctgcaagcagtctatgataa

SEQ ID NO: 52831 - DNA, 20 bp, Artificial Sequence
  Description of Artificial Sequence: Synthetic oligonucleotide
  Target: ATXN1; (-) strand; PAM type: NRG; PAM sequence: AAG
agctgcaagcagtctatgat

SEQ ID NO: 52832 - DNA, 20 bp, Artificial Sequence
  Description of Artificial Sequence: Synthetic oligonucleotide
  Target: ATXN1; (-) strand; PAM type: NRG; PAM sequence: CAG
aggacaggatgagctgcaag

SEQ ID NO: 52833 - DNA, 20 bp, Artificial Sequence
  Description of Artificial Sequence: Synthetic oligonucleotide
  Target: ATXN1; (-) strand; PAM type: NRG; PAM sequence: AAG
ccaaggacaggatgagctgc

SEQ ID NO: 52834 - DNA, 20 bp, Artificial Sequence
  Description of Artificial Sequence: Synthetic oligonucleotide
  Target: ATXN1; (-) strand; PAM type: NRG; PAM sequence: GAG
ggcaagtccaaggacaggat

SEQ ID NO: 52835 - DNA, 20 bp, Artificial Sequence
  Description of Artificial Sequence: Synthetic oligonucleotide
  Target: ATXN1; (-) strand; PAM type: NRG; PAM sequence: AGG
tattaggcaagtccaaggac

SEQ ID NO: 52836 - DNA, 20 bp, Artificial Sequence
  Description of Artificial Sequence: Synthetic oligonucleotide
  Target: ATXN1; (-) strand; PAM type: NRG; PAM sequence: CAG
atattaggcaagtccaagga

SEQ ID NO: 52837 - DNA, 20 bp, Artificial Sequence
  Description of Artificial Sequence: Synthetic oligonucleotide
  Target: ATXN1; (-) strand; PAM type: NRG; PAM sequence: AGG
acaaatattaggcaagtcca

SEQ ID NO: 52838 - DNA, 20 bp, Artificial Sequence
  Description of Artificial Sequence: Synthetic oligonucleotide
  Target: ATXN1; (-) strand; PAM type: NRG; PAM sequence: AAG
cacaaatattaggcaagtcc

SEQ ID NO: 52839 - DNA, 20 bp, Artificial Sequence
  Description of Artificial Sequence: Synthetic oligonucleotide
  Target: ATXN1; (-) strand; PAM type: NRG; PAM sequence: AAG
ggtatgcacaaatattaggc

SEQ ID NO: 52840 - DNA, 20 bp, Artificial Sequence
  Description of Artificial Sequence: Synthetic oligonucleotide
  Target: ATXN1; (-) strand; PAM type: NRG; PAM sequence: AGG
acatggtatgcacaaatatt

SEQ ID NO: 52841 - DNA, 20 bp, Artificial Sequence
  Description of Artificial Sequence: Synthetic oligonucleotide
  Target: ATXN1; (-) strand; PAM type: NRG; PAM sequence: TAG
cacatggtatgcacaaatat

SEQ ID NO: 52842 - DNA, 20 bp, Artificial Sequence
  Description of Artificial Sequence: Synthetic oligonucleotide
  Target: ATXN1; (-) strand; PAM type: NRG; PAM sequence: TGG
cattagcagtacttcgcaca

SEQ ID NO: 52843 - DNA, 20 bp, Artificial Sequence
  Description of Artificial Sequence: Synthetic oligonucleotide
  Target: ATXN1; (-) strand; PAM type: NRG; PAM sequence: CAG
atgagcgtaaaggacattag

SEQ ID NO: 52844 - DNA, 20 bp, Artificial Sequence
  Description of Artificial Sequence: Synthetic oligonucleotide
  Target: ATXN1; (-) strand; PAM type: NRG; PAM sequence: TAG
ttcatgagcgtaaaggacat

SEQ ID NO: 52845 - DNA, 20 bp, Artificial Sequence
  Description of Artificial Sequence: Synthetic oligonucleotide
  Target: ATXN1; (-) strand; PAM type: NRG; PAM sequence: AGG
cactgatttcatgagcgtaa

SEQ ID NO: 52846 - DNA, 20 bp, Artificial Sequence
  Description of Artificial Sequence: Synthetic oligonucleotide
  Target: ATXN1; (-) strand; PAM type: NRG; PAM sequence: AAG
gcactgatttcatgagcgta

SEQ ID NO: 52847 - DNA, 20 bp, Artificial Sequence
  Description of Artificial Sequence: Synthetic oligonucleotide
  Target: ATXN1; (-) strand; PAM type: NRG; PAM sequence: GAG
cagctgagcactgatttcat

SEQ ID NO: 52848 - DNA, 20 bp, Artificial Sequence
  Description of Artificial Sequence: Synthetic oligonucleotide
  Target: ATXN1; (-) strand; PAM type: NRG; PAM sequence: GAG
taaatttaatgtcttcagct

SEQ ID NO: 52849 - DNA, 20 bp, Artificial Sequence
  Description of Artificial Sequence: Synthetic oligonucleotide
  Target: ATXN1; (-) strand; PAM type: NRG; PAM sequence: CAG
gccagtaaatttaatgtctt

SEQ ID NO: 52850 - DNA, 20 bp, Artificial Sequence
  Description of Artificial Sequence: Synthetic oligonucleotide
  Target: ATXN1; (-) strand; PAM type: NRG; PAM sequence: CAG
cccgacttttctttcaccgc

SEQ ID NO: 52851 - DNA, 20 bp, Artificial Sequence
  Description of Artificial Sequence: Synthetic oligonucleotide
  Target: ATXN1; (-) strand; PAM type: NRG; PAM sequence: CAG
ttccttcccagcccccgttc

SEQ ID NO: 52852 - DNA, 20 bp, Artificial Sequence
  Description of Artificial Sequence: Synthetic oligonucleotide
  Target: ATXN1; (-) strand; PAM type: NRG; PAM sequence: CAG
tgcagtgcggccttccttcc

SEQ ID NO: 52853 - DNA, 20 bp, Artificial Sequence
  Description of Artificial Sequence: Synthetic oligonucleotide
  Target: ATXN1; (-) strand; PAM type: NRG; PAM sequence: CGG
ccaccaagagcactgcagtg

SEQ ID NO: 52854 - DNA, 20 bp, Artificial Sequence
  Description of Artificial Sequence: Synthetic oligonucleotide
  Target: ATXN1; (-) strand; PAM type: NRG; PAM sequence: CAG
taaccccaccaagagcactg

SEQ ID NO: 52855 - DNA, 20 bp, Artificial Sequence
  Description of Artificial Sequence: Synthetic oligonucleotide
  Target: ATXN1; (-) strand; PAM type: NRG; PAM sequence: GAG
agcagagttaaccccaccaa

SEQ ID NO: 52856 - DNA, 20 bp, Artificial Sequence
  Description of Artificial Sequence: Synthetic oligonucleotide
  Target: ATXN1; (-) strand; PAM type: NRG; PAM sequence: AAG
ggagcagagttaaccccacc

SEQ ID NO: 52857 - DNA, 20 bp, Artificial Sequence
  Description of Artificial Sequence: Synthetic oligonucleotide
  Target: ATXN1; (-) strand; PAM type: NRG; PAM sequence: GAG
tcatgaagcagtagggagca

SEQ ID NO: 52858 - DNA, 20 bp, Artificial Sequence
  Description of Artificial Sequence: Synthetic oligonucleotide
  Target: ATXN1; (-) strand; PAM type: NRG; PAM sequence: CAG
tttcatgaagcagtagggag

SEQ ID NO: 52859 - DNA, 20 bp, Artificial Sequence
  Description of Artificial Sequence: Synthetic oligonucleotide
  Target: ATXN1; (-) strand; PAM type: NRG; PAM sequence: GAG
gcatttcatgaagcagtagg

SEQ ID NO: 52860 - DNA, 20 bp, Artificial Sequence
  Description of Artificial Sequence: Synthetic oligonucleotide
  Target: ATXN1; (-) strand; PAM type: NRG; PAM sequence: GGG
tggcatttcatgaagcagta

SEQ ID NO: 52861 - DNA, 20 bp, Artificial Sequence
  Description of Artificial Sequence: Synthetic oligonucleotide
  Target: ATXN1; (-) strand; PAM type: NRG; PAM sequence: AGG
ctggcatttcatgaagcagt

SEQ ID NO: 52862 - DNA, 20 bp, Artificial Sequence
  Description of Artificial Sequence: Synthetic oligonucleotide
  Target: ATXN1; (-) strand; PAM type: NRG; PAM sequence: TAG
actggcatttcatgaagcag

SEQ ID NO: 52863 - DNA, 20 bp, Artificial Sequence
  Description of Artificial Sequence: Synthetic oligonucleotide
  Target: ATXN1; (-) strand; PAM type: NRG; PAM sequence: CAG
tacactggcatttcatgaag

SEQ ID NO: 52864 - DNA, 20 bp, Artificial Sequence
  Description of Artificial Sequence: Synthetic oligonucleotide
  Target: ATXN1; (-) strand; PAM type: NRG; PAM sequence: AAG
tcatacactggcatttcatg

SEQ ID NO: 52865 - DNA, 20 bp, Artificial Sequence
  Description of Artificial Sequence: Synthetic oligonucleotide
  Target: ATXN1; (-) strand; PAM type: NRG; PAM sequence: TGG
acatgctatggttcatacac

SEQ ID NO: 52866 - DNA, 20 bp, Artificial Sequence
  Description of Artificial Sequence: Synthetic oligonucleotide
  Target: ATXN1; (-) strand; PAM type: NRG; PAM sequence: TGG
aaaaggtccttcacatgcta

SEQ ID NO: 52867 - DNA, 20 bp, Artificial Sequence
  Description of Artificial Sequence: Synthetic oligonucleotide
  Target: ATXN1; (-) strand; PAM type: NRG; PAM sequence: AGG
agtgaacattgtgcagtaaa

SEQ ID NO: 52868 - DNA, 20 bp, Artificial Sequence
  Description of Artificial Sequence: Synthetic oligonucleotide
  Target: ATXN1; (-) strand; PAM type: NRG; PAM sequence: AAG
gagtgaacattgtgcagtaa

SEQ ID NO: 52869 - DNA, 20 bp, Artificial Sequence
  Description of Artificial Sequence: Synthetic oligonucleotide
  Target: ATXN1; (-) strand; PAM type: NRG; PAM sequence: CAG
ttctgagagtgaacattgtg

SEQ ID NO: 52870 - DNA, 20 bp, Artificial Sequence
  Description of Artificial Sequence: Synthetic oligonucleotide
  Target: ATXN1; (-) strand; PAM type: NRG; PAM sequence: GAG
ttatagtattttctttctga

SEQ ID NO: 52871 - DNA, 20 bp, Artificial Sequence
  Description of Artificial Sequence: Synthetic oligonucleotide
  Target: ATXN1; (-) strand; PAM type: NRG; PAM sequence: GAG
gtttatagtattttctttct

SEQ ID NO: 52872 - DNA, 20 bp, Artificial Sequence
  Description of Artificial Sequence: Synthetic oligonucleotide
  Target: ATXN1; (-) strand; PAM type: NRG; PAM sequence: TAG
atagctcaaacacaggttta

SEQ ID NO: 52873 - DNA, 20 bp, Artificial Sequence
  Description of Artificial Sequence: Synthetic oligonucleotide
  Target: ATXN1; (-) strand; PAM type: NRG; PAM sequence: AGG
aagagaaatagctcaaacac

SEQ ID NO: 52874 - DNA, 20 bp, Artificial Sequence
  Description of Artificial Sequence: Synthetic oligonucleotide
  Target: ATXN1; (-) strand; PAM type: NRG; PAM sequence: CAG
caagagaaatagctcaaaca

SEQ ID NO: 52875 - DNA, 20 bp, Artificial Sequence
  Description of Artificial Sequence: Synthetic oligonucleotide
  Target: ATXN1; (-) strand; PAM type: NRG; PAM sequence: TAG
tgcattgaaagcaagagaaa

SEQ ID NO: 52876 - DNA, 20 bp, Artificial Sequence
  Description of Artificial Sequence: Synthetic oligonucleotide
  Target: ATXN1; (-) strand; PAM type: NRG; PAM sequence: GAG
taaatctgcattgaaagcaa

SEQ ID NO: 52877 - DNA, 20 bp, Artificial Sequence
  Description of Artificial Sequence: Synthetic oligonucleotide
  Target: ATXN1; (-) strand; PAM type: NRG; PAM sequence: AAG
gctaaatctgcattgaaagc

SEQ ID NO: 52878 - DNA, 20 bp, Artificial Sequence
  Description of Artificial Sequence: Synthetic oligonucleotide
  Target: ATXN1; (-) strand; PAM type: NRG; PAM sequence: AAG
atcagctaaatctgcattga

SEQ ID NO: 52879 - DNA, 20 bp, Artificial Sequence
  Description of Artificial Sequence: Synthetic oligonucleotide
  Target: ATXN1; (-) strand; PAM type: NRG; PAM sequence: CAG
aagacctcacgttgaacaat

SEQ ID NO: 52880 - DNA, 20 bp, Artificial Sequence
  Description of Artificial Sequence: Synthetic oligonucleotide
  Target: ATXN1; (-) strand; PAM type: NRG; PAM sequence: AAG
tgaagagagagggttgtttt

SEQ ID NO: 52881 - DNA, 20 bp, Artificial Sequence
  Description of Artificial Sequence: Synthetic oligonucleotide
  Target: ATXN1; (-) strand; PAM type: NRG; PAM sequence: GGG
gataaggctgtgaagagaga

SEQ ID NO: 52882 - DNA, 20 bp, Artificial Sequence
  Description of Artificial Sequence: Synthetic oligonucleotide
  Target: ATXN1; (-) strand; PAM type: NRG; PAM sequence: AGG
agataaggctgtgaagagag

SEQ ID NO: 52883 - DNA, 20 bp, Artificial Sequence
  Description of Artificial Sequence: Synthetic oligonucleotide
  Target: ATXN1; (-) strand; PAM type: NRG; PAM sequence: GAG
aagataaggctgtgaagaga

SEQ ID NO: 52884 - DNA, 20 bp, Artificial Sequence
  Description of Artificial Sequence: Synthetic oligonucleotide
  Target: ATXN1; (-) strand; PAM type: NRG; PAM sequence: GAG
agaagataaggctgtgaaga

SEQ ID NO: 52885 - DNA, 20 bp, Artificial Sequence
  Description of Artificial Sequence: Synthetic oligonucleotide
  Target: ATXN1; (-) strand; PAM type: NRG; PAM sequence: GAG
aaagaagataaggctgtgaa

SEQ ID NO: 52886 - DNA, 20 bp, Artificial Sequence
  Description of Artificial Sequence: Synthetic oligonucleotide
  Target: ATXN1; (-) strand; PAM type: NRG; PAM sequence: AAG
gaaaagaagataaggctgtg

SEQ ID NO: 52887 - DNA, 20 bp, Artificial Sequence
  Description of Artificial Sequence: Synthetic oligonucleotide
  Target: ATXN1; (-) strand; PAM type: NRG; PAM sequence: AGG
aagagagagaaaagaagata

SEQ ID NO: 52888 - DNA, 20 bp, Artificial Sequence
  Description of Artificial Sequence: Synthetic oligonucleotide
  Target: ATXN1; (-) strand; PAM type: NRG; PAM sequence: AAG
aaagagagagaaaagaagat

SEQ ID NO: 52889 - DNA, 20 bp, Artificial Sequence
  Description of Artificial Sequence: Synthetic oligonucleotide
  Target: ATXN1; (-) strand; PAM type: NRG; PAM sequence: AAG
agaaaaaagagagagaaaag

SEQ ID NO: 52890 - DNA, 20 bp, Artificial Sequence
  Description of Artificial Sequence: Synthetic oligonucleotide
  Target: ATXN1; (-) strand; PAM type: NRG; PAM sequence: AAG
gggagaaaaaagagagagaa

SEQ ID NO: 52891 - DNA, 20 bp, Artificial Sequence
  Description of Artificial Sequence: Synthetic oligonucleotide
  Target: ATXN1; (-) strand; PAM type: NRG; PAM sequence: GAG
tcatagggagaaaaaagaga

SEQ ID NO: 52892 - DNA, 20 bp, Artificial Sequence
  Description of Artificial Sequence: Synthetic oligonucleotide
  Target: ATXN1; (-) strand; PAM type: NRG; PAM sequence: GAG
agtcatagggagaaaaaaga

SEQ ID NO: 52893 - DNA, 20 bp, Artificial Sequence
  Description of Artificial Sequence: Synthetic oligonucleotide
  Target: ATXN1; (-) strand; PAM type: NRG; PAM sequence: GAG
aaagtcatagggagaaaaaa

SEQ ID NO: 52894 - DNA, 20 bp, Artificial Sequence
  Description of Artificial Sequence: Synthetic oligonucleotide
  Target: ATXN1; (-) strand; PAM type: NRG; PAM sequence: AAG
ggaaagtcatagggagaaaa

SEQ ID NO: 52895 - DNA, 20 bp, Artificial Sequence
  Description of Artificial Sequence: Synthetic oligonucleotide
  Target: ATXN1; (-) strand; PAM type: NRG; PAM sequence: GAG
taatgaaggaaagtcatagg

SEQ ID NO: 52896 - DNA, 20 bp, Artificial Sequence
  Description of Artificial Sequence: Synthetic oligonucleotide
  Target: ATXN1; (-) strand; PAM type: NRG; PAM sequence: GGG
cttaatgaaggaaagtcata

SEQ ID NO: 52897 - DNA, 20 bp, Artificial Sequence
  Description of Artificial Sequence: Synthetic oligonucleotide
  Target: ATXN1; (-) strand; PAM type: NRG; PAM sequence: AGG
acttaatgaaggaaagtcat

SEQ ID NO: 52898 - DNA, 20 bp, Artificial Sequence
  Description of Artificial Sequence: Synthetic oligonucleotide
  Target: ATXN1; (-) strand; PAM type: NRG; PAM sequence: TAG
aacttaatgaaggaaagtca

SEQ ID NO: 52899 - DNA, 20 bp, Artificial Sequence
  Description of Artificial Sequence: Synthetic oligonucleotide
  Target: ATXN1; (-) strand; PAM type: NRG; PAM sequence: AAG
cattttaacttaatgaagga

SEQ ID NO: 52900 - DNA, 20 bp, Artificial Sequence
  Description of Artificial Sequence: Synthetic oligonucleotide
  Target: ATXN1; (-) strand; PAM type: NRG; PAM sequence: AGG
ctctcattttaacttaatga

SEQ ID NO: 52901 - DNA, 20 bp, Artificial Sequence
  Description of Artificial Sequence: Synthetic oligonucleotide
  Target: ATXN1; (-) strand; PAM type: NRG; PAM sequence: AAG
tctctcattttaacttaatg

SEQ ID NO: 52902 - DNA, 20 bp, Artificial Sequence
  Description of Artificial Sequence: Synthetic oligonucleotide
  Target: ATXN1; (-) strand; PAM type: NRG; PAM sequence: TAG
cttcacatgttccacttttt

SEQ ID NO: 52903 - DNA, 20 bp, Artificial Sequence
  Description of Artificial Sequence: Synthetic oligonucleotide
  Target: ATXN1; (-) strand; PAM type: NRG; PAM sequence: GAG
atttagagagaaaggaatct

SEQ ID NO: 52904 - DNA, 20 bp, Artificial Sequence
  Description of Artificial Sequence: Synthetic oligonucleotide
  Target: ATXN1; (-) strand; PAM type: NRG; PAM sequence: AGG
tatgattaatttagagagaa

SEQ ID NO: 52905 - DNA, 20 bp, Artificial Sequence
  Description of Artificial Sequence: Synthetic oligonucleotide
  Target: ATXN1; (-) strand; PAM type: NRG; PAM sequence: AAG
gtatgattaatttagagaga

SEQ ID NO: 52906 - DNA, 20 bp, Artificial Sequence
  Description of Artificial Sequence: Synthetic oligonucleotide
  Target: ATXN1; (-) strand; PAM type: NRG; PAM sequence: GAG
cttggtatgattaatttaga

SEQ ID NO: 52907 - DNA, 20 bp, Artificial Sequence
  Description of Artificial Sequence: Synthetic oligonucleotide
  Target: ATXN1; (-) strand; PAM type: NRG; PAM sequence: GAG
tccttggtatgattaattta

SEQ ID NO: 52908 - DNA, 20 bp, Artificial Sequence
  Description of Artificial Sequence: Synthetic oligonucleotide
  Target: ATXN1; (-) strand; PAM type: NRG; PAM sequence: TAG
tctccttggtatgattaatt

SEQ ID NO: 52909 - DNA, 20 bp, Artificial Sequence
  Description of Artificial Sequence: Synthetic oligonucleotide
  Target: ATXN1; (-) strand; PAM type: NRG; PAM sequence: TGG
tatttaacttgggttctcct

SEQ ID NO: 52910 - DNA, 20 bp, Artificial Sequence
  Description of Artificial Sequence: Synthetic oligonucleotide
  Target: ATXN1; (-) strand; PAM type: NRG; PAM sequence: GGG
ttgaaaaaattatttaactt

SEQ ID NO: 52911 - DNA, 20 bp, Artificial Sequence
  Description of Artificial Sequence: Synthetic oligonucleotide
  Target: ATXN1; (-) strand; PAM type: NRG; PAM sequence: TGG
cttgaaaaaattatttaact

SEQ ID NO: 52912 - DNA, 20 bp, Artificial Sequence
  Description of Artificial Sequence: Synthetic oligonucleotide
  Target: ATXN1; (-) strand; PAM type: NRG; PAM sequence: TAG
gctttatttaaagttttatt

SEQ ID NO: 52913 - DNA, 20 bp, Artificial Sequence
  Description of Artificial Sequence: Synthetic oligonucleotide
  Target: ATXN1; (-) strand; PAM type: NRG; PAM sequence: AAG
accaaataaagctttattta

SEQ ID NO: 52914 - DNA, 20 bp, Artificial Sequence
  Description of Artificial Sequence: Synthetic oligonucleotide
  Target: ATXN1; (-) strand; PAM type: NRG; PAM sequence: AAG
gctgtgagtaaaaccaaata

SEQ ID NO: 52915 - DNA, 20 bp, Artificial Sequence
  Description of Artificial Sequence: Synthetic oligonucleotide
  Target: ATXN1; (-) strand; PAM type: NRG; PAM sequence: GAG
ctcaattattggttggctgt

SEQ ID NO: 52916 - DNA, 20 bp, Artificial Sequence
  Description of Artificial Sequence: Synthetic oligonucleotide
  Target: ATXN1; (-) strand; PAM type: NRG; PAM sequence: TGG
gagatgactcaattattggt

SEQ ID NO: 52917 - DNA, 20 bp, Artificial Sequence
  Description of Artificial Sequence: Synthetic oligonucleotide
  Target: ATXN1; (-) strand; PAM type: NRG; PAM sequence: TGG
aatagagatgactcaattat

SEQ ID NO: 52918 - DNA, 20 bp, Artificial Sequence
  Description of Artificial Sequence: Synthetic oligonucleotide
  Target: ATXN1; (-) strand; PAM type: NRG; PAM sequence: GAG
ttcacattactttaaaaata

SEQ ID NO: 52919 - DNA, 20 bp, Artificial Sequence
  Description of Artificial Sequence: Synthetic oligonucleotide
  Target: ATXN1; (-) strand; PAM type: NRG; PAM sequence: TAG
tcttcacattactttaaaaa

SEQ ID NO: 52920 - DNA, 20 bp, Artificial Sequence
  Description of Artificial Sequence: Synthetic oligonucleotide
  Target: ATXN1; (-) strand; PAM type: NRG; PAM sequence: AGG
atgaatgcccggtatccgtt

SEQ ID NO: 52921 - DNA, 20 bp, Artificial Sequence
  Description of Artificial Sequence: Synthetic oligonucleotide
  Target: ATXN1; (-) strand; PAM type: NRG; PAM sequence: TAG
tatgaatgcccggtatccgt

SEQ ID NO: 52922 - DNA, 20 bp, Artificial Sequence
  Description of Artificial Sequence: Synthetic oligonucleotide
  Target: ATXN1; (-) strand; PAM type: NRG; PAM sequence: CGG
cctcaaaagttatgaatgcc

SEQ ID NO: 52923 - DNA, 20 bp, Artificial Sequence
  Description of Artificial Sequence: Synthetic oligonucleotide
  Target: ATXN1; (-) strand; PAM type: NRG; PAM sequence: AAG
gtgtctagtaatgccctcaa

SEQ ID NO: 52924 - DNA, 20 bp, Artificial Sequence
  Description of Artificial Sequence: Synthetic oligonucleotide
  Target: ATXN1; (-) strand; PAM type: NRG; PAM sequence: TAG
cattaaggaaatagggtgtc

SEQ ID NO: 52925 - DNA, 20 bp, Artificial Sequence
  Description of Artificial Sequence: Synthetic oligonucleotide
  Target: ATXN1; (-) strand; PAM type: NRG; PAM sequence: GGG
ctttttacattaaggaaata

SEQ ID NO: 52926 - DNA, 20 bp, Artificial Sequence
  Description of Artificial Sequence: Synthetic oligonucleotide
  Target: ATXN1; (-) strand; PAM type: NRG; PAM sequence: AGG
actttttacattaaggaaat

SEQ ID NO: 52927 - DNA, 20 bp, Artificial Sequence
  Description of Artificial Sequence: Synthetic oligonucleotide
  Target: ATXN1; (-) strand; PAM type: NRG; PAM sequence: TAG
tactttttacattaaggaaa

SEQ ID NO: 52928 - DNA, 20 bp, Artificial Sequence
  Description of Artificial Sequence: Synthetic oligonucleotide
  Target: ATXN1; (-) strand; PAM type: NRG; PAM sequence: AGG
ctactttactttttacatta

SEQ ID NO: 52929 - DNA, 20 bp, Artificial Sequence
  Description of Artificial Sequence: Synthetic oligonucleotide
  Target: ATXN1; (-) strand; PAM type: NRG; PAM sequence: AAG
tctactttactttttacatt

SEQ ID NO: 52930 - DNA, 20 bp, Artificial Sequence
  Description of Artificial Sequence: Synthetic oligonucleotide
  Target: ATXN1; (-) strand; PAM type: NRG; PAM sequence: AGG
ggggaggaaaatctttgaag

SEQ ID NO: 52931 - DNA, 20 bp, Artificial Sequence
  Description of Artificial Sequence: Synthetic oligonucleotide
  Target: ATXN1; (-) strand; PAM type: NRG; PAM sequence: GAG
tggggaggaaaatctttgaa

SEQ ID NO: 52932 - DNA, 20 bp, Artificial Sequence
  Description of Artificial Sequence: Synthetic oligonucleotide
  Target: ATXN1; (-) strand; PAM type: NRG; PAM sequence: AAG
gatggggaggaaaatctttg

SEQ ID NO: 52933 - DNA, 20 bp, Artificial Sequence
  Description of Artificial Sequence: Synthetic oligonucleotide
  Target: ATXN1; (-) strand; PAM type: NRG; PAM sequence: AGG
taattcctaattagatgggg

SEQ ID NO: 52934 - DNA, 20 bp, Artificial Sequence
  Description of Artificial Sequence: Synthetic oligonucleotide
  Target: ATXN1; (-) strand; PAM type: NRG; PAM sequence: GAG
ttaattcctaattagatggg

SEQ ID NO: 52935 - DNA, 20 bp, Artificial Sequence
  Description of Artificial Sequence: Synthetic oligonucleotide
  Target: ATXN1; (-) strand; PAM type: NRG; PAM sequence: GGG
tattaattcctaattagatg

SEQ ID NO: 52936 - DNA, 20 bp, Artificial Sequence
  Description of Artificial Sequence: Synthetic oligonucleotide
  Target: ATXN1; (-) strand; PAM type: NRG; PAM sequence: GGG
ctattaattcctaattagat

SEQ ID NO: 52937 - DNA, 20 bp, Artificial Sequence
  Description of Artificial Sequence: Synthetic oligonucleotide
  Target: ATXN1; (-) strand; PAM type: NRG; PAM sequence: TGG
actattaattcctaattaga

SEQ ID NO: 52938 - DNA, 20 bp, Artificial Sequence
  Description of Artificial Sequence: Synthetic oligonucleotide
  Target: ATXN1; (-) strand; PAM type: NRG; PAM sequence: TAG
aagtactattaattcctaat

SEQ ID NO: 52939 - DNA, 20 bp, Artificial Sequence
  Description of Artificial Sequence: Synthetic oligonucleotide
  Target: ATXN1; (-) strand; PAM type: NRG; PAM sequence: AAG
taaattttgcttctaagaga

SEQ ID NO: 52940 - DNA, 20 bp, Artificial Sequence
  Description of Artificial Sequence: Synthetic oligonucleotide
  Target: ATXN1; (-) strand; PAM type: NRG; PAM sequence: GAG
tgaataaattttgcttctaa

SEQ ID NO: 52941 - DNA, 20 bp, Artificial Sequence
  Description of Artificial Sequence: Synthetic oligonucleotide
  Target: ATXN1; (-) strand; PAM type: NRG; PAM sequence: AAG
tttgaataaattttgcttct

SEQ ID NO: 52942 - DNA, 20 bp, Artificial Sequence
  Description of Artificial Sequence: Synthetic oligonucleotide
  Target: ATXN1; (-) strand; PAM type: NRG; PAM sequence: AGG
atatttaagaatgttagcac

SEQ ID NO: 52943 - DNA, 20 bp, Artificial Sequence
  Description of Artificial Sequence: Synthetic oligonucleotide
  Target: ATXN1; (-) strand; PAM type: NRG; PAM sequence: CAG
gatatttaagaatgttagca

SEQ ID NO: 52944 - DNA, 20 bp, Artificial Sequence
  Description of Artificial Sequence: Synthetic oligonucleotide
  Target: ATXN1; (-) strand; PAM type: NRG; PAM sequence: TAG
tagcagatatttaagaatgt

SEQ ID NO: 52945 - DNA, 20 bp, Artificial Sequence
  Description of Artificial Sequence: Synthetic oligonucleotide
  Target: ATXN1; (-) strand; PAM type: NRG; PAM sequence: AAG
attacagctagcagatattt

SEQ ID NO: 52946 - DNA, 20 bp, Artificial Sequence
  Description of Artificial Sequence: Synthetic oligonucleotide
  Target: ATXN1; (-) strand; PAM type: NRG; PAM sequence: CAG
gatttctttattacagctag

SEQ ID NO: 52947 - DNA, 20 bp, Artificial Sequence
  Description of Artificial Sequence: Synthetic oligonucleotide
  Target: ATXN1; (-) strand; PAM type: NRG; PAM sequence: TAG
attgatttctttattacagc

SEQ ID NO: 52948 - DNA, 20 bp, Artificial Sequence
  Description of Artificial Sequence: Synthetic oligonucleotide
  Target: ATXN1; (-) strand; PAM type: NRG; PAM sequence: CAG
gtacattgatttctttatta

SEQ ID NO: 52949 - DNA, 20 bp, Artificial Sequence
  Description of Artificial Sequence: Synthetic oligonucleotide
  Target: ATXN1; (-) strand; PAM type: NRG; PAM sequence: AAG
ttgtgggagctaagaacata

SEQ ID NO: 52950 - DNA, 20 bp, Artificial Sequence
  Description of Artificial Sequence: Synthetic oligonucleotide
  Target: ATXN1; (-) strand; PAM type: NRG; PAM sequence: AAG
taggctaaattgtgggagct

SEQ ID NO: 52951 - DNA, 20 bp, Artificial Sequence
  Description of Artificial Sequence: Synthetic oligonucleotide
  Target: ATXN1; (-) strand; PAM type: NRG; PAM sequence: GAG
atatttaggctaaattgtgg

SEQ ID NO: 52952 - DNA, 20 bp, Artificial Sequence
  Description of Artificial Sequence: Synthetic oligonucleotide
  Target: ATXN1; (-) strand; PAM type: NRG; PAM sequence: GGG
aaatatttaggctaaattgt

SEQ ID NO: 52953 - DNA, 20 bp, Artificial Sequence
  Description of Artificial Sequence: Synthetic oligonucleotide
  Target: ATXN1; (-) strand; PAM type: NRG; PAM sequence: TGG
taaatatttaggctaaattg

SEQ ID NO: 52954 - DNA, 20 bp, Artificial Sequence
  Description of Artificial Sequence: Synthetic oligonucleotide
  Target: ATXN1; (-) strand; PAM type: NRG; PAM sequence: AGG
gcatgctagggtaaatattt

SEQ ID NO: 52955 - DNA, 20 bp, Artificial Sequence
  Description of Artificial Sequence: Synthetic oligonucleotide
  Target: ATXN1; (-) strand; PAM type: NRG; PAM sequence: TAG
agcatgctagggtaaatatt

SEQ ID NO: 52956 - DNA, 20 bp, Artificial Sequence
  Description of Artificial Sequence: Synthetic oligonucleotide
  Target: ATXN1; (-) strand; PAM type: NRG; PAM sequence: GGG
ggaccagtataagcatgcta

SEQ ID NO: 52957 - DNA, 20 bp, Artificial Sequence
  Description of Artificial Sequence: Synthetic oligonucleotide
  Target: ATXN1; (-) strand; PAM type: NRG; PAM sequence: AGG
tggaccagtataagcatgct

SEQ ID NO: 52958 - DNA, 20 bp, Artificial Sequence
  Description of Artificial Sequence: Synthetic oligonucleotide
  Target: ATXN1; (-) strand; PAM type: NRG; PAM sequence: TAG
ttggaccagtataagcatgc

SEQ ID NO: 52959 - DNA, 20 bp, Artificial Sequence
  Description of Artificial Sequence: Synthetic oligonucleotide
  Target: ATXN1; (-) strand; PAM type: NRG; PAM sequence: AAG
atgcttgcttggaccagtat

SEQ ID NO: 52960 - DNA, 20 bp, Artificial Sequence
  Description of Artificial Sequence: Synthetic oligonucleotide
  Target: ATXN1; (-) strand; PAM type: NRG; PAM sequence: CAG
gacctaatgcttgcttggac

SEQ ID NO: 52961 - DNA, 20 bp, Artificial Sequence
  Description of Artificial Sequence: Synthetic oligonucleotide
  Target: ATXN1; (-) strand; PAM type: NRG; PAM sequence: TGG
gctatgacctaatgcttgct

SEQ ID NO: 52962 - DNA, 20 bp, Artificial Sequence
  Description of Artificial Sequence: Synthetic oligonucleotide
  Target: ATXN1; (-) strand; PAM type: NRG; PAM sequence: AGG
ttcaaataaggaagaggaac

SEQ ID NO: 52963 - DNA, 20 bp, Artificial Sequence
  Description of Artificial Sequence: Synthetic oligonucleotide
  Target: ATXN1; (-) strand; PAM type: NRG; PAM sequence: CAG
cttcaaataaggaagaggaa

SEQ ID NO: 52964 - DNA, 20 bp, Artificial Sequence
  Description of Artificial Sequence: Synthetic oligonucleotide
  Target: ATXN1; (-) strand; PAM type: NRG; PAM sequence: AGG
aaaaccttcaaataaggaag

SEQ ID NO: 52965 - DNA, 20 bp, Artificial Sequence
  Description of Artificial Sequence: Synthetic oligonucleotide
  Target: ATXN1; (-) strand; PAM type: NRG; PAM sequence: GAG
aaaaaccttcaaataaggaa

SEQ ID NO: 52966 - DNA, 20 bp, Artificial Sequence
  Description of Artificial Sequence: Synthetic oligonucleotide
  Target: ATXN1; (-) strand; PAM type: NRG; PAM sequence: AAG
taaaaaaccttcaaataagg

SEQ ID NO: 52967 - DNA, 20 bp, Artificial Sequence
  Description of Artificial Sequence: Synthetic oligonucleotide
  Target: ATXN1; (-) strand; PAM type: NRG; PAM sequence: AGG
aggtaaaaaaccttcaaata

SEQ ID NO: 52968 - DNA, 20 bp, Artificial Sequence
  Description of Artificial Sequence: Synthetic oligonucleotide
  Target: ATXN1; (-) strand; PAM type: NRG; PAM sequence: AAG
aaggtaaaaaaccttcaaat

SEQ ID NO: 52969 - DNA, 20 bp, Artificial Sequence
  Description of Artificial Sequence: Synthetic oligonucleotide
  Target: ATXN1; (-) strand; PAM type: NRG; PAM sequence: AGG
aacttgtgaaatgctgagaa

SEQ ID NO: 52970 - DNA, 20 bp, Artificial Sequence
  Description of Artificial Sequence: Synthetic oligonucleotide
  Target: ATXN1; (-) strand; PAM type: NRG; PAM sequence: AAG
taacttgtgaaatgctgaga

SEQ ID NO: 52971 - DNA, 20 bp, Artificial Sequence
  Description of Artificial Sequence: Synthetic oligonucleotide
  Target: ATXN1; (-) strand; PAM type: NRG; PAM sequence: GAG
gaagtaacttgtgaaatgct

SEQ ID NO: 52972 - DNA, 20 bp, Artificial Sequence
  Description of Artificial Sequence: Synthetic oligonucleotide
  Target: ATXN1; (-) strand; PAM type: NRG; PAM sequence: AAG
aagagaacaaaggaaggagg

SEQ ID NO: 52973 - DNA, 20 bp, Artificial Sequence
  Description of Artificial Sequence: Synthetic oligonucleotide
  Target: ATXN1; (-) strand; PAM type: NRG; PAM sequence: AGG
cagaagagaacaaaggaagg

SEQ ID NO: 52974 - DNA, 20 bp, Artificial Sequence
  Description of Artificial Sequence: Synthetic oligonucleotide
  Target: ATXN1; (-) strand; PAM type: NRG; PAM sequence: GAG
gcagaagagaacaaaggaag

SEQ ID NO: 52975 - DNA, 20 bp, Artificial Sequence
  Description of Artificial Sequence: Synthetic oligonucleotide
  Target: ATXN1; (-) strand; PAM type: NRG; PAM sequence: AGG
aagcagaagagaacaaagga

SEQ ID NO: 52976 - DNA, 20 bp, Artificial Sequence
  Description of Artificial Sequence: Synthetic oligonucleotide
  Target: ATXN1; (-) strand; PAM type: NRG; PAM sequence: AAG
aaagcagaagagaacaaagg

SEQ ID NO: 52977 - DNA, 20 bp, Artificial Sequence
  Description of Artificial Sequence: Synthetic oligonucleotide
  Target: ATXN1; (-) strand; PAM type: NRG; PAM sequence: AGG
gcaaaagcagaagagaacaa

SEQ ID NO: 52978 - DNA, 20 bp, Artificial Sequence
  Description of Artificial Sequence: Synthetic oligonucleotide
  Target: ATXN1; (-) strand; PAM type: NRG; PAM sequence: AAG
agcaaaagcagaagagaaca

SEQ ID NO: 52979 - DNA, 20 bp, Artificial Sequence
  Description of Artificial Sequence: Synthetic oligonucleotide
  Target: ATXN1; (-) strand; PAM type: NRG; PAM sequence: GAG
taaaagcagcaaaagcagaa

SEQ ID NO: 52980 - DNA, 20 bp, Artificial Sequence
  Description of Artificial Sequence: Synthetic oligonucleotide
  Target: ATXN1; (-) strand; PAM type: NRG; PAM sequence: AAG
tttaaaagcagcaaaagcag

SEQ ID NO: 52981 - DNA, 20 bp, Artificial Sequence
  Description of Artificial Sequence: Synthetic oligonucleotide
  Target: ATXN1; (-) strand; PAM type: NRG; PAM sequence: CAG
ctttttaaaagcagcaaaag

SEQ ID NO: 52982 - DNA, 20 bp, Artificial Sequence
  Description of Artificial Sequence: Synthetic oligonucleotide
  Target: ATXN1; (-) strand; PAM type: NRG; PAM sequence: AAG
gaactttttaaaagcagcaa

SEQ ID NO: 52983 - DNA, 20 bp, Artificial Sequence
  Description of Artificial Sequence: Synthetic oligonucleotide
  Target: ATXN1; (-) strand; PAM type: NRG; PAM sequence: CAG
agcttagaactttttaaaag

SEQ ID NO: 52984 - DNA, 20 bp, Artificial Sequence
  Description of Artificial Sequence: Synthetic oligonucleotide
  Target: ATXN1; (-) strand; PAM type: NRG; PAM sequence: AAG
agcagcttagaactttttaa

SEQ ID NO: 52985 - DNA, 20 bp, Artificial Sequence
  Description of Artificial Sequence: Synthetic oligonucleotide
  Target: ATXN1; (-) strand; PAM type: NRG; PAM sequence: TAG
gtcccgaatggctagcagct

SEQ ID NO: 52986 - DNA, 20 bp, Artificial Sequence
  Description of Artificial Sequence: Synthetic oligonucleotide
  Target: ATXN1; (-) strand; PAM type: NRG; PAM sequence: CAG
tatttgtcccgaatggctag

SEQ ID NO: 52987 - DNA, 20 bp, Artificial Sequence
  Description of Artificial Sequence: Synthetic oligonucleotide
  Target: ATXN1; (-) strand; PAM type: NRG; PAM sequence: TAG
ctgtatttgtcccgaatggc

SEQ ID NO: 52988 - DNA, 20 bp, Artificial Sequence
  Description of Artificial Sequence: Synthetic oligonucleotide
  Target: ATXN1; (-) strand; PAM type: NRG; PAM sequence: TGG
cattctgtatttgtcccgaa

SEQ ID NO: 52989 - DNA, 20 bp, Artificial Sequence
  Description of Artificial Sequence: Synthetic oligonucleotide
  Target: ATXN1; (-) strand; PAM type: NRG; PAM sequence: GGG
cagtttccattggctggaat

SEQ ID NO: 52990 - DNA, 20 bp, Artificial Sequence
  Description of Artificial Sequence: Synthetic oligonucleotide
  Target: ATXN1; (-) strand; PAM type: NRG; PAM sequence: TGG
ccagtttccattggctggaa

SEQ ID NO: 52991 - DNA, 20 bp, Artificial Sequence
  Description of Artificial Sequence: Synthetic oligonucleotide
  Target: ATXN1; (-) strand; PAM type: NRG; PAM sequence: TGG
tatgtccagtttccattggc

SEQ ID NO: 52992 - DNA, 20 bp, Artificial Sequence
  Description of Artificial Sequence: Synthetic oligonucleotide
  Target: ATXN1; (-) strand; PAM type: NRG; PAM sequence: TGG
ctgctatgtccagtttccat

SEQ ID NO: 52993 - DNA, 20 bp, Artificial Sequence
  Description of Artificial Sequence: Synthetic oligonucleotide
  Target: ATXN1; (-) strand; PAM type: NRG; PAM sequence: CAG
gtccaccctactgctatgtc

SEQ ID NO: 52994 - DNA, 20 bp, Artificial Sequence
  Description of Artificial Sequence: Synthetic oligonucleotide
  Target: ATXN1; (-) strand; PAM type: NRG; PAM sequence: GGG
tacacggaacaaaggagaca

SEQ ID NO: 52995 - DNA, 20 bp, Artificial Sequence
  Description of Artificial Sequence: Synthetic oligonucleotide
  Target: ATXN1; (-) strand; PAM type: NRG; PAM sequence: AGG
gtacacggaacaaaggagac

SEQ ID NO: 52996 - DNA, 20 bp, Artificial Sequence
  Description of Artificial Sequence: Synthetic oligonucleotide
  Target: ATXN1; (-) strand; PAM type: NRG; PAM sequence: CAG
agtacacggaacaaaggaga

SEQ ID NO: 52997 - DNA, 20 bp, Artificial Sequence
  Description of Artificial Sequence: Synthetic oligonucleotide
  Target: ATXN1; (-) strand; PAM type: NRG; PAM sequence: GAG
caagagtacacggaacaaag

SEQ ID NO: 52998 - DNA, 20 bp, Artificial Sequence
  Description of Artificial Sequence: Synthetic oligonucleotide
  Target: ATXN1; (-) strand; PAM type: NRG; PAM sequence: AGG
cacaagagtacacggaacaa

SEQ ID NO: 52999 - DNA, 20 bp, Artificial Sequence
  Description of Artificial Sequence: Synthetic oligonucleotide
  Target: ATXN1; (-) strand; PAM type: NRG; PAM sequence: AAG
ccacaagagtacacggaaca

SEQ ID NO: 53000 - DNA, 20 bp, Artificial Sequence
  Description of Artificial Sequence: Synthetic oligonucleotide
  Target: ATXN1; (-) strand; PAM type: NRG; PAM sequence: CGG
agttttgccacaagagtaca

SEQ ID NO: 53001 - DNA, 20 bp, Artificial Sequence
  Description of Artificial Sequence: Synthetic oligonucleotide
  Target: ATXN1; (-) strand; PAM type: NRG; PAM sequence: GAG
tgccagcagttttgccacaa

SEQ ID NO: 53002 - DNA, 20 bp, Artificial Sequence
  Description of Artificial Sequence: Synthetic oligonucleotide
  Target: ATXN1; (-) strand; PAM type: NRG; PAM sequence: AAG
cttgccagcagttttgccac

SEQ ID NO: 53003 - DNA, 20 bp, Artificial Sequence
  Description of Artificial Sequence: Synthetic oligonucleotide
  Target: ATXN1; (-) strand; PAM type: NRG; PAM sequence: CAG
agaaagggtacacttgccag

SEQ ID NO: 53004 - DNA, 20 bp, Artificial Sequence
  Description of Artificial Sequence: Synthetic oligonucleotide
  Target: ATXN1; (-) strand; PAM type: NRG; PAM sequence: CAG
tgcagaaagggtacacttgc

SEQ ID NO: 53005 - DNA, 20 bp, Artificial Sequence
  Description of Artificial Sequence: Synthetic oligonucleotide
  Target: ATXN1; (-) strand; PAM type: NRG; PAM sequence: GGG
atttttactttctgcagaaa

SEQ ID NO: 53006 - DNA, 20 bp, Artificial Sequence
  Description of Artificial Sequence: Synthetic oligonucleotide
  Target: ATXN1; (-) strand; PAM type: NRG; PAM sequence: AGG
catttttactttctgcagaa

SEQ ID NO: 53007 - DNA, 20 bp, Artificial Sequence
  Description of Artificial Sequence: Synthetic oligonucleotide
  Target: ATXN1; (-) strand; PAM type: NRG; PAM sequence: AAG
ccatttttactttctgcaga

SEQ ID NO: 53008 - DNA, 20 bp, Artificial Sequence
  Description of Artificial Sequence: Synthetic oligonucleotide
  Target: ATXN1; (-) strand; PAM type: NRG; PAM sequence: CAG
aagaccatttttactttctg

SEQ ID NO: 53009 - DNA, 20 bp, Artificial Sequence
  Description of Artificial Sequence: Synthetic oligonucleotide
  Target: ATXN1; (-) strand; PAM type: NRG; PAM sequence: AAG
ataaatttaatttcctcagc

SEQ ID NO: 53010 - DNA, 20 bp, Artificial Sequence
  Description of Artificial Sequence: Synthetic oligonucleotide
  Target: ATXN1; (-) strand; PAM type: NRG; PAM sequence: CAG
gaacataaatttaatttcct

SEQ ID NO: 53011 - DNA, 20 bp, Artificial Sequence
  Description of Artificial Sequence: Synthetic oligonucleotide
  Target: ATXN1; (-) strand; PAM type: NRG; PAM sequence: TAG
tctttggtgctgtaaagaaa

SEQ ID NO: 53012 - DNA, 20 bp, Artificial Sequence
  Description of Artificial Sequence: Synthetic oligonucleotide
  Target: ATXN1; (-) strand; PAM type: NRG; PAM sequence: AAG
gcttgttctttggtgctgta

SEQ ID NO: 53013 - DNA, 20 bp, Artificial Sequence
  Description of Artificial Sequence: Synthetic oligonucleotide
  Target: ATXN1; (-) strand; PAM type: NRG; PAM sequence: TGG
tgttagaaatgcttgttctt

SEQ ID NO: 53014 - DNA, 20 bp, Artificial Sequence
  Description of Artificial Sequence: Synthetic oligonucleotide
  Target: ATXN1; (-) strand; PAM type: NRG; PAM sequence: TAG
atagtacacatcttaagtgt

SEQ ID NO: 53015 - DNA, 20 bp, Artificial Sequence
  Description of Artificial Sequence: Synthetic oligonucleotide
  Target: ATXN1; (-) strand; PAM type: NRG; PAM sequence: AAG
gattccatagtacacatctt

SEQ ID NO: 53016 - DNA, 20 bp, Artificial Sequence
  Description of Artificial Sequence: Synthetic oligonucleotide
  Target: ATXN1; (-) strand; PAM type: NRG; PAM sequence: TAG
cttttacaaatctgattcca

SEQ ID NO: 53017 - DNA, 20 bp, Artificial Sequence
  Description of Artificial Sequence: Synthetic oligonucleotide
  Target: ATXN1; (-) strand; PAM type: NRG; PAM sequence: TAG
acttcctcatggatgatcac

SEQ ID NO: 53018 - DNA, 20 bp, Artificial Sequence
  Description of Artificial Sequence: Synthetic oligonucleotide
  Target: ATXN1; (-) strand; PAM type: NRG; PAM sequence: TGG
tctgagctataacttcctca

SEQ ID NO: 53019 - DNA, 20 bp, Artificial Sequence
  Description of Artificial Sequence: Synthetic oligonucleotide
  Target: ATXN1; (-) strand; PAM type: NRG; PAM sequence: GAG
ggcatgcccattatctctct

SEQ ID NO: 53020 - DNA, 20 bp, Artificial Sequence
  Description of Artificial Sequence: Synthetic oligonucleotide
  Target: ATXN1; (-) strand; PAM type: NRG; PAM sequence: AGG
agtcattactctgtgatctc

SEQ ID NO: 53021 - DNA, 20 bp, Artificial Sequence
  Description of Artificial Sequence: Synthetic oligonucleotide
  Target: ATXN1; (-) strand; PAM type: NRG; PAM sequence: CAG
cagtcattactctgtgatct

SEQ ID NO: 53022 - DNA, 20 bp, Artificial Sequence
  Description of Artificial Sequence: Synthetic oligonucleotide
  Target: ATXN1; (-) strand; PAM type: NRG; PAM sequence: CAG
ttaaaatgaagccaagttaa

SEQ ID NO: 53023 - DNA, 20 bp, Artificial Sequence
  Description of Artificial Sequence: Synthetic oligonucleotide
  Target: ATXN1; (-) strand; PAM type: NRG; PAM sequence: AAG
caatcttttaaaatgaagcc

SEQ ID NO: 53024 - DNA, 20 bp, Artificial Sequence
  Description of Artificial Sequence: Synthetic oligonucleotide
  Target: ATXN1; (-) strand; PAM type: NRG; PAM sequence: AAG
caacacaatcttttaaaatg

SEQ ID NO: 53025 - DNA, 20 bp, Artificial Sequence
  Description of Artificial Sequence: Synthetic oligonucleotide
  Target: ATXN1; (-) strand; PAM type: NRG; PAM sequence: TAG
ttaagactttaagataaggg

SEQ ID NO: 53026 - DNA, 20 bp, Artificial Sequence
  Description of Artificial Sequence: Synthetic oligonucleotide
  Target: ATXN1; (-) strand; PAM type: NRG; PAM sequence: GGG
aagttaagactttaagataa

SEQ ID NO: 53027 - DNA, 20 bp, Artificial Sequence
  Description of Artificial Sequence: Synthetic oligonucleotide
  Target: ATXN1; (-) strand; PAM type: NRG; PAM sequence: AGG
gaagttaagactttaagata

SEQ ID NO: 53028 - DNA, 20 bp, Artificial Sequence
  Description of Artificial Sequence: Synthetic oligonucleotide
  Target: ATXN1; (-) strand; PAM type: NRG; PAM sequence: AAG
tgaagttaagactttaagat

SEQ ID NO: 53029 - DNA, 20 bp, Artificial Sequence
  Description of Artificial Sequence: Synthetic oligonucleotide
  Target: ATXN1; (-) strand; PAM type: NRG; PAM sequence: AAG
taacatgaagttaagacttt

SEQ ID NO: 53030 - DNA, 20 bp, Artificial Sequence
  Description of Artificial Sequence: Synthetic oligonucleotide
  Target: ATXN1; (-) strand; PAM type: NRG; PAM sequence: AAG
tgtttcattaacatgaagtt

SEQ ID NO: 53031 - DNA, 20 bp, Artificial Sequence
  Description of Artificial Sequence: Synthetic oligonucleotide
  Target: ATXN1; (-) strand; PAM type: NRG; PAM sequence: AAG
gtatttgtttcattaacatg

SEQ ID NO: 53032 - DNA, 20 bp, Artificial Sequence
  Description of Artificial Sequence: Synthetic oligonucleotide
  Target: ATXN1; (-) strand; PAM type: NRG; PAM sequence: GAG
ataaaggcatatccttagag

SEQ ID NO: 53033 - DNA, 20 bp, Artificial Sequence
  Description of Artificial Sequence: Synthetic oligonucleotide
  Target: ATXN1; (-) strand; PAM type: NRG; PAM sequence: AGG
tcataaaggcatatccttag

SEQ ID NO: 53034 - DNA, 20 bp, Artificial Sequence
  Description of Artificial Sequence: Synthetic oligonucleotide
  Target: ATXN1; (-) strand; PAM type: NRG; PAM sequence: GAG
atcataaaggcatatcctta

SEQ ID NO: 53035 - DNA, 20 bp, Artificial Sequence
  Description of Artificial Sequence: Synthetic oligonucleotide
  Target: ATXN1; (-) strand; PAM type: NRG; PAM sequence: TAG
gaatcataaaggcatatcct

SEQ ID NO: 53036 - DNA, 20 bp, Artificial Sequence
  Description of Artificial Sequence: Synthetic oligonucleotide
  Target: ATXN1; (-) strand; PAM type: NRG; PAM sequence: AGG
catattattttgaatcataa

SEQ ID NO: 53037 - DNA, 20 bp, Artificial Sequence
  Description of Artificial Sequence: Synthetic oligonucleotide
  Target: ATXN1; (-) strand; PAM type: NRG; PAM sequence: AAG
ccatattattttgaatcata

SEQ ID NO: 53038 - DNA, 20 bp, Artificial Sequence
  Description of Artificial Sequence: Synthetic oligonucleotide
  Target: ATXN1; (-) strand; PAM type: NRG; PAM sequence: CAG
ttaggcactggtggacacag

SEQ ID NO: 53039 - DNA, 20 bp, Artificial Sequence
  Description of Artificial Sequence: Synthetic oligonucleotide
  Target: ATXN1; (-) strand; PAM type: NRG; PAM sequence: CAG
cagttaggcactggtggaca

SEQ ID NO: 53040 - DNA, 20 bp, Artificial Sequence
  Description of Artificial Sequence: Synthetic oligonucleotide
  Target: ATXN1; (-) strand; PAM type: NRG; PAM sequence: TGG
aatgtccagttaggcactgg

SEQ ID NO: 53041 - DNA, 20 bp, Artificial Sequence
  Description of Artificial Sequence: Synthetic oligonucleotide
  Target: ATXN1; (-) strand; PAM type: NRG; PAM sequence: TGG
ttaaatgtccagttaggcac

SEQ ID NO: 53042 - DNA, 20 bp, Artificial Sequence
  Description of Artificial Sequence: Synthetic oligonucleotide
  Target: ATXN1; (-) strand; PAM type: NRG; PAM sequence: AGG
tgccatttaaatgtccagtt

SEQ ID NO: 53043 - DNA, 20 bp, Artificial Sequence
  Description of Artificial Sequence: Synthetic oligonucleotide
  Target: ATXN1; (-) strand; PAM type: NRG; PAM sequence: TAG
ctgccatttaaatgtccagt

SEQ ID NO: 53044 - DNA, 20 bp, Artificial Sequence
  Description of Artificial Sequence: Synthetic oligonucleotide
  Target: ATXN1; (-) strand; PAM type: NRG; PAM sequence: CAG
gcttctgccatttaaatgtc

SEQ ID NO: 53045 - DNA, 20 bp, Artificial Sequence
  Description of Artificial Sequence: Synthetic oligonucleotide
  Target: ATXN1; (-) strand; PAM type: NRG; PAM sequence: GAG
tcaatgtgccattggaagaa

SEQ ID NO: 53046 - DNA, 20 bp, Artificial Sequence
  Description of Artificial Sequence: Synthetic oligonucleotide
  Target: ATXN1; (-) strand; PAM type: NRG; PAM sequence: AAG
tttcaatgtgccattggaag

SEQ ID NO: 53047 - DNA, 20 bp, Artificial Sequence
  Description of Artificial Sequence: Synthetic oligonucleotide
  Target: ATXN1; (-) strand; PAM type: NRG; PAM sequence: AAG
tgatttcaatgtgccattgg

SEQ ID NO: 53048 - DNA, 20 bp, Artificial Sequence
  Description of Artificial Sequence: Synthetic oligonucleotide
  Target: ATXN1; (-) strand; PAM type: NRG; PAM sequence: TGG
cagtgatttcaatgtgccat

SEQ ID NO: 53049 - DNA, 20 bp, Artificial Sequence
  Description of Artificial Sequence: Synthetic oligonucleotide
  Target: ATXN1; (-) strand; PAM type: NRG; PAM sequence: CAG
actatgagaaggtcatctct

SEQ ID NO: 53050 - DNA, 20 bp, Artificial Sequence
  Description of Artificial Sequence: Synthetic oligonucleotide
  Target: ATXN1; (-) strand; PAM type: NRG; PAM sequence: AGG
aggacagccttactatgaga

SEQ ID NO: 53051 - DNA, 20 bp, Artificial Sequence
  Description of Artificial Sequence: Synthetic oligonucleotide
  Target: ATXN1; (-) strand; PAM type: NRG; PAM sequence: AAG
taggacagccttactatgag

SEQ ID NO: 53052 - DNA, 20 bp, Artificial Sequence
  Description of Artificial Sequence: Synthetic oligonucleotide
  Target: ATXN1; (-) strand; PAM type: NRG; PAM sequence: GAG
ccttaggacagccttactat

SEQ ID NO: 53053 - DNA, 20 bp, Artificial Sequence
  Description of Artificial Sequence: Synthetic oligonucleotide
  Target: ATXN1; (-) strand; PAM type: NRG; PAM sequence: CAG
tttcaacatattccttagga

SEQ ID NO: 53054 - DNA, 20 bp, Artificial Sequence
  Description of Artificial Sequence: Synthetic oligonucleotide
  Target: ATXN1; (-) strand; PAM type: NRG; PAM sequence: AGG
catgtttcaacatattcctt

SEQ ID NO: 53055 - DNA, 20 bp, Artificial Sequence
  Description of Artificial Sequence: Synthetic oligonucleotide
  Target: ATXN1; (-) strand; PAM type: NRG; PAM sequence: TAG
gcatgtttcaacatattcct

SEQ ID NO: 53056 - DNA, 20 bp, Artificial Sequence
  Description of Artificial Sequence: Synthetic oligonucleotide
  Target: ATXN1; (-) strand; PAM type: NRG; PAM sequence: GAG
ttgatacagatacttttgag

SEQ ID NO: 53057 - DNA, 20 bp, Artificial Sequence
  Description of Artificial Sequence: Synthetic oligonucleotide
  Target: ATXN1; (-) strand; PAM type: NRG; PAM sequence: AGG
agttgatacagatacttttg

SEQ ID NO: 53058 - DNA, 20 bp, Artificial Sequence
  Description of Artificial Sequence: Synthetic oligonucleotide
  Target: ATXN1; (-) strand; PAM type: NRG; PAM sequence: GAG
aagttgatacagatactttt

SEQ ID NO: 53059 - DNA, 20 bp, Artificial Sequence
  Description of Artificial Sequence: Synthetic oligonucleotide
  Target: ATXN1; (-) strand; PAM type: NRG; PAM sequence: CAG
tcagcatccaaaagttgata

SEQ ID NO: 53060 - DNA, 20 bp, Artificial Sequence
  Description of Artificial Sequence: Synthetic oligonucleotide
  Target: ATXN1; (-) strand; PAM type: NRG; PAM sequence: AAG
aaaccagcttcagcatccaa

SEQ ID NO: 53061 - DNA, 20 bp, Artificial Sequence
  Description of Artificial Sequence: Synthetic oligonucleotide
  Target: ATXN1; (-) strand; PAM type: NRG; PAM sequence: CAG
gttgtgagtaaaaccagctt

SEQ ID NO: 53062 - DNA, 20 bp, Artificial Sequence
  Description of Artificial Sequence: Synthetic oligonucleotide
  Target: ATXN1; (-) strand; PAM type: NRG; PAM sequence: CAG
ccagatgttgtgagtaaaac

SEQ ID NO: 53063 - DNA, 20 bp, Artificial Sequence
  Description of Artificial Sequence: Synthetic oligonucleotide
  Target: ATXN1; (-) strand; PAM type: NRG; PAM sequence: GAG
ataagcaaaccagatgttgt

SEQ ID NO: 53064 - DNA, 20 bp, Artificial Sequence
  Description of Artificial Sequence: Synthetic oligonucleotide
  Target: ATXN1; (-) strand; PAM type: NRG; PAM sequence: CAG
gatatgctatataagcaaac

SEQ ID NO: 53065 - DNA, 20 bp, Artificial Sequence
  Description of Artificial Sequence: Synthetic oligonucleotide
  Target: ATXN1; (-) strand; PAM type: NRG; PAM sequence: AAG
attgaattgatatgctatat

SEQ ID NO: 53066 - DNA, 20 bp, Artificial Sequence
  Description of Artificial Sequence: Synthetic oligonucleotide
  Target: ATXN1; (-) strand; PAM type: NRG; PAM sequence: AAG
ttcaacttcaccaactaaat

SEQ ID NO: 53067 - DNA, 20 bp, Artificial Sequence
  Description of Artificial Sequence: Synthetic oligonucleotide
  Target: ATXN1; (-) strand; PAM type: NRG; PAM sequence: TAG
aactgtgcccctgggaattt

SEQ ID NO: 53068 - DNA, 20 bp, Artificial Sequence
  Description of Artificial Sequence: Synthetic oligonucleotide
  Target: ATXN1; (-) strand; PAM type: NRG; PAM sequence: GGG
aactccacaactgtgcccct

SEQ ID NO: 53069 - DNA, 20 bp, Artificial Sequence
  Description of Artificial Sequence: Synthetic oligonucleotide
  Target: ATXN1; (-) strand; PAM type: NRG; PAM sequence: TGG
taactccacaactgtgcccc

SEQ ID NO: 53070 - DNA, 20 bp, Artificial Sequence
  Description of Artificial Sequence: Synthetic oligonucleotide
  Target: ATXN1; (-) strand; PAM type: NRG; PAM sequence: TAG
gatttaagagcacagctttc

SEQ ID NO: 53071 - DNA, 20 bp, Artificial Sequence
  Description of Artificial Sequence: Synthetic oligonucleotide
  Target: ATXN1; (-) strand; PAM type: NRG; PAM sequence: CAG
tggcctgggatttaagagca

SEQ ID NO: 53072 - DNA, 20 bp, Artificial Sequence
  Description of Artificial Sequence: Synthetic oligonucleotide
  Target: ATXN1; (-) strand; PAM type: NRG; PAM sequence: GAG
gctactggcctgggatttaa

SEQ ID NO: 53073 - DNA, 20 bp, Artificial Sequence
  Description of Artificial Sequence: Synthetic oligonucleotide
  Target: ATXN1; (-) strand; PAM type: NRG; PAM sequence: AAG
aagctactggcctgggattt

SEQ ID NO: 53074 - DNA, 20 bp, Artificial Sequence
  Description of Artificial Sequence: Synthetic oligonucleotide
  Target: ATXN1; (-) strand; PAM type: NRG; PAM sequence: GGG
tgatgaaaagctactggcct

SEQ ID NO: 53075 - DNA, 20 bp, Artificial Sequence
  Description of Artificial Sequence: Synthetic oligonucleotide
  Target: ATXN1; (-) strand; PAM type: NRG; PAM sequence: TGG
atgatgaaaagctactggcc

SEQ ID NO: 53076 - DNA, 20 bp, Artificial Sequence
  Description of Artificial Sequence: Synthetic oligonucleotide
  Target: ATXN1; (-) strand; PAM type: NRG; PAM sequence: TGG
gtctaatgatgaaaagctac

SEQ ID NO: 53077 - DNA, 20 bp, Artificial Sequence
  Description of Artificial Sequence: Synthetic oligonucleotide
  Target: ATXN1; (-) strand; PAM type: NRG; PAM sequence: AAG
ctacatagtctaatgatgaa

SEQ ID NO: 53078 - DNA, 20 bp, Artificial Sequence
  Description of Artificial Sequence: Synthetic oligonucleotide
  Target: ATXN1; (-) strand; PAM type: NRG; PAM sequence: TAG
caatggggcttctagctaca

SEQ ID NO: 53079 - DNA, 20 bp, Artificial Sequence
  Description of Artificial Sequence: Synthetic oligonucleotide
  Target: ATXN1; (-) strand; PAM type: NRG; PAM sequence: TAG
agaccctccaatggggcttc

SEQ ID NO: 53080 - DNA, 20 bp, Artificial Sequence
  Description of Artificial Sequence: Synthetic oligonucleotide
  Target: ATXN1; (-) strand; PAM type: NRG; PAM sequence: GGG
gcagctcagaccctccaatg

SEQ ID NO: 53081 - DNA, 20 bp, Artificial Sequence
  Description of Artificial Sequence: Synthetic oligonucleotide
  Target: ATXN1; (-) strand; PAM type: NRG; PAM sequence: GGG
tgcagctcagaccctccaat

SEQ ID NO: 53082 - DNA, 20 bp, Artificial Sequence
  Description of Artificial Sequence: Synthetic oligonucleotide
  Target: ATXN1; (-) strand; PAM type: NRG; PAM sequence: TGG
ctgcagctcagaccctccaa

SEQ ID NO: 53083 - DNA, 20 bp, Artificial Sequence
  Description of Artificial Sequence: Synthetic oligonucleotide
  Target: ATXN1; (-) strand; PAM type: NRG; PAM sequence: CAG
ttaaccgtgtgtctgcagct

SEQ ID NO: 53084 - DNA, 20 bp, Artificial Sequence
  Description of Artificial Sequence: Synthetic oligonucleotide
  Target: ATXN1; (-) strand; PAM type: NRG; PAM sequence: CAG
ctgggttaaccgtgtgtctg

SEQ ID NO: 53085 - DNA, 20 bp, Artificial Sequence
  Description of Artificial Sequence: Synthetic oligonucleotide
  Target: ATXN1; (-) strand; PAM type: NRG; PAM sequence: GGG
agatgagacctgatttgcct

SEQ ID NO: 53086 - DNA, 20 bp, Artificial Sequence
  Description of Artificial Sequence: Synthetic oligonucleotide
  Target: ATXN1; (-) strand; PAM type: NRG; PAM sequence: TGG
cagatgagacctgatttgcc

SEQ ID NO: 53087 - DNA, 20 bp, Artificial Sequence
  Description of Artificial Sequence: Synthetic oligonucleotide
  Target: ATXN1; (-) strand; PAM type: NRG; PAM sequence: GAG
gtatccagagatgcccagat

SEQ ID NO: 53088 - DNA, 20 bp, Artificial Sequence
  Description of Artificial Sequence: Synthetic oligonucleotide
  Target: ATXN1; (-) strand; PAM type: NRG; PAM sequence: CAG
cagacgtatccagagatgcc

SEQ ID NO: 53089 - DNA, 20 bp, Artificial Sequence
  Description of Artificial Sequence: Synthetic oligonucleotide
  Target: ATXN1; (-) strand; PAM type: NRG; PAM sequence: GAG
aggccacccagacgtatcca

SEQ ID NO: 53090 - DNA, 20 bp, Artificial Sequence
  Description of Artificial Sequence: Synthetic oligonucleotide
  Target: ATXN1; (-) strand; PAM type: NRG; PAM sequence: CAG
acaggccacccagacgtatc

SEQ ID NO: 53091 - DNA, 20 bp, Artificial Sequence
  Description of Artificial Sequence: Synthetic oligonucleotide
  Target: ATXN1; (-) strand; PAM type: NRG; PAM sequence: CAG
catccacttcacaggccacc

SEQ ID NO: 53092 - DNA, 20 bp, Artificial Sequence
  Description of Artificial Sequence: Synthetic oligonucleotide
  Target: ATXN1; (-) strand; PAM type: NRG; PAM sequence: AGG
agaacatccatccacttcac

SEQ ID NO: 53093 - DNA, 20 bp, Artificial Sequence
  Description of Artificial Sequence: Synthetic oligonucleotide
  Target: ATXN1; (-) strand; PAM type: NRG; PAM sequence: CAG
cagaacatccatccacttca

SEQ ID NO: 53094 - DNA, 20 bp, Artificial Sequence
  Description of Artificial Sequence: Synthetic oligonucleotide
  Target: ATXN1; (-) strand; PAM type: NRG; PAM sequence: CAG
caaacaggcctccacacaaa

SEQ ID NO: 53095 - DNA, 20 bp, Artificial Sequence
  Description of Artificial Sequence: Synthetic oligonucleotide
  Target: ATXN1; (-) strand; PAM type: NRG; PAM sequence: AGG
ttccaggaggctcatcaaac

SEQ ID NO: 53096 - DNA, 20 bp, Artificial Sequence
  Description of Artificial Sequence: Synthetic oligonucleotide
  Target: ATXN1; (-) strand; PAM type: NRG; PAM sequence: CAG
cttccaggaggctcatcaaa

SEQ ID NO: 53097 - DNA, 20 bp, Artificial Sequence
  Description of Artificial Sequence: Synthetic oligonucleotide
  Target: ATXN1; (-) strand; PAM type: NRG; PAM sequence: AGG
ctgtttctttttcttccagg

SEQ ID NO: 53098 - DNA, 20 bp, Artificial Sequence
  Description of Artificial Sequence: Synthetic oligonucleotide
  Target: ATXN1; (-) strand; PAM type: NRG; PAM sequence: GAG
cctgtttctttttcttccag

SEQ ID NO: 53099 - DNA, 20 bp, Artificial Sequence
  Description of Artificial Sequence: Synthetic oligonucleotide
  Target: ATXN1; (-) strand; PAM type: NRG; PAM sequence: AGG
tgcctgtttctttttcttcc

SEQ ID NO: 53100 - DNA, 20 bp, Artificial Sequence
  Description of Artificial Sequence: Synthetic oligonucleotide
  Target: ATXN1; (-) strand; PAM type: NRG; PAM sequence: CAG
ctgcctgtttctttttcttc

SEQ ID NO: 53101 - DNA, 20 bp, Artificial Sequence
  Description of Artificial Sequence: Synthetic oligonucleotide
  Target: ATXN1; (-) strand; PAM type: NRG; PAM sequence: AGG
atggcaccattatccctggc

SEQ ID NO: 53102 - DNA, 20 bp, Artificial Sequence
  Description of Artificial Sequence: Synthetic oligonucleotide
  Target: ATXN1; (-) strand; PAM type: NRG; PAM sequence: CAG
catggcaccattatccctgg

SEQ ID NO: 53103 - DNA, 20 bp, Artificial Sequence
  Description of Artificial Sequence: Synthetic oligonucleotide
  Target: ATXN1; (-) strand; PAM type: NRG; PAM sequence: TGG
ccacatggcaccattatccc

SEQ ID NO: 53104 - DNA, 20 bp, Artificial Sequence
  Description of Artificial Sequence: Synthetic oligonucleotide
  Target: ATXN1; (-) strand; PAM type: NRG; PAM sequence: TGG
actggacttcagataccaca

SEQ ID NO: 53105 - DNA, 20 bp, Artificial Sequence
  Description of Artificial Sequence: Synthetic oligonucleotide
  Target: ATXN1; (-) strand; PAM type: NRG; PAM sequence: CAG
gttgaagaattactggactt

SEQ ID NO: 53106 - DNA, 20 bp, Artificial Sequence
  Description of Artificial Sequence: Synthetic oligonucleotide
  Target: ATXN1; (-) strand; PAM type: NRG; PAM sequence: TGG
taagaaggttgaagaattac

SEQ ID NO: 53107 - DNA, 20 bp, Artificial Sequence
  Description of Artificial Sequence: Synthetic oligonucleotide
  Target: ATXN1; (-) strand; PAM type: NRG; PAM sequence: AAG
gcaagctgctaagaaggttg

SEQ ID NO: 53108 - DNA, 20 bp, Artificial Sequence
  Description of Artificial Sequence: Synthetic oligonucleotide
  Target: ATXN1; (-) strand; PAM type: NRG; PAM sequence: AGG
cacacagcaagctgctaaga

SEQ ID NO: 53109 - DNA, 20 bp, Artificial Sequence
  Description of Artificial Sequence: Synthetic oligonucleotide
  Target: ATXN1; (-) strand; PAM type: NRG; PAM sequence: AAG
tcacacagcaagctgctaag

SEQ ID NO: 53110 - DNA, 20 bp, Artificial Sequence
  Description of Artificial Sequence: Synthetic oligonucleotide
  Target: ATXN1; (-) strand; PAM type: NRG; PAM sequence: AAG
tcctcacacagcaagctgct

SEQ ID NO: 53111 - DNA, 20 bp, Artificial Sequence
  Description of Artificial Sequence: Synthetic oligonucleotide
  Target: ATXN1; (-) strand; PAM type: NRG; PAM sequence: AAG
cagttccttcctcacacagc

SEQ ID NO: 53112 - DNA, 20 bp, Artificial Sequence
  Description of Artificial Sequence: Synthetic oligonucleotide
  Target: ATXN1; (-) strand; PAM type: NRG; PAM sequence: CAG
gggtcagttccttcctcaca

SEQ ID NO: 53113 - DNA, 20 bp, Artificial Sequence
  Description of Artificial Sequence: Synthetic oligonucleotide
  Target: ATXN1; (-) strand; PAM type: NRG; PAM sequence: CAG
ttaacccaaccactctgggt

SEQ ID NO: 53114 - DNA, 20 bp, Artificial Sequence
  Description of Artificial Sequence: Synthetic oligonucleotide
  Target: ATXN1; (-) strand; PAM type: NRG; PAM sequence: GGG
caccttaacccaaccactct

SEQ ID NO: 53115 - DNA, 20 bp, Artificial Sequence
  Description of Artificial Sequence: Synthetic oligonucleotide
  Target: ATXN1; (-) strand; PAM type: NRG; PAM sequence: TGG
gcaccttaacccaaccactc

SEQ ID NO: 53116 - DNA, 20 bp, Artificial Sequence
  Description of Artificial Sequence: Synthetic oligonucleotide
  Target: ATXN1; (-) strand; PAM type: NRG; PAM sequence: CAG
ccccaatcccgcatgcctag

SEQ ID NO: 53117 - DNA, 20 bp, Artificial Sequence
  Description of Artificial Sequence: Synthetic oligonucleotide
  Target: ATXN1; (-) strand; PAM type: NRG; PAM sequence: TAG
tgcccccaatcccgcatgcc

SEQ ID NO: 53118 - DNA, 20 bp, Artificial Sequence
  Description of Artificial Sequence: Synthetic oligonucleotide
  Target: ATXN1; (-) strand; PAM type: NRG; PAM sequence: TAG
tccccaaggggctgggttgg

SEQ ID NO: 53119 - DNA, 20 bp, Artificial Sequence
  Description of Artificial Sequence: Synthetic oligonucleotide
  Target: ATXN1; (-) strand; PAM type: NRG; PAM sequence: TGG
ccctccccaaggggctgggt

SEQ ID NO: 53120 - DNA, 20 bp, Artificial Sequence
  Description of Artificial Sequence: Synthetic oligonucleotide
  Target: ATXN1; (-) strand; PAM type: NRG; PAM sequence: GGG
gcacccctccccaaggggct

SEQ ID NO: 53121 - DNA, 20 bp, Artificial Sequence
  Description of Artificial Sequence: Synthetic oligonucleotide
  Target: ATXN1; (-) strand; PAM type: NRG; PAM sequence: TGG
tgcacccctccccaaggggc

SEQ ID NO: 53122 - DNA, 20 bp, Artificial Sequence
  Description of Artificial Sequence: Synthetic oligonucleotide
  Target: ATXN1; (-) strand; PAM type: NRG; PAM sequence: GGG
ttcctgcacccctccccaag

SEQ ID NO: 53123 - DNA, 20 bp, Artificial Sequence
  Description of Artificial Sequence: Synthetic oligonucleotide
  Target: ATXN1; (-) strand; PAM type: NRG; PAM sequence: GGG
cttcctgcacccctccccaa

SEQ ID NO: 53124 - DNA, 20 bp, Artificial Sequence
  Description of Artificial Sequence: Synthetic oligonucleotide
  Target: ATXN1; (-) strand; PAM type: NRG; PAM sequence: AGG
tcttcctgcacccctcccca

SEQ ID NO: 53125 - DNA, 20 bp, Artificial Sequence
  Description of Artificial Sequence: Synthetic oligonucleotide
  Target: ATXN1; (-) strand; PAM type: NRG; PAM sequence: AAG
ctcttcctgcacccctcccc

SEQ ID NO: 53126 - DNA, 20 bp, Artificial Sequence
  Description of Artificial Sequence: Synthetic oligonucleotide
  Target: ATXN1; (-) strand; PAM type: NRG; PAM sequence: CGG
tcaggttctttatggcccca

SEQ ID NO: 53127 - DNA, 20 bp, Artificial Sequence
  Description of Artificial Sequence: Synthetic oligonucleotide
  Target: ATXN1; (-) strand; PAM type: NRG; PAM sequence: TGG
tggtggcctcaggttcttta

SEQ ID NO: 53128 - DNA, 20 bp, Artificial Sequence
  Description of Artificial Sequence: Synthetic oligonucleotide
  Target: ATXN1; (-) strand; PAM type: NRG; PAM sequence: AGG
ccacaaaacatggtggcctc

SEQ ID NO: 53129 - DNA, 20 bp, Artificial Sequence
  Description of Artificial Sequence: Synthetic oligonucleotide
  Target: ATXN1; (-) strand; PAM type: NRG; PAM sequence: CAG
accacaaaacatggtggcct

SEQ ID NO: 53130 - DNA, 20 bp, Artificial Sequence
  Description of Artificial Sequence: Synthetic oligonucleotide
  Target: ATXN1; (-) strand; PAM type: NRG; PAM sequence: TGG
tctgagaccacaaaacatgg

SEQ ID NO: 53131 - DNA, 20 bp, Artificial Sequence
  Description of Artificial Sequence: Synthetic oligonucleotide
  Target: ATXN1; (-) strand; PAM type: NRG; PAM sequence: TGG
tcttctgagaccacaaaaca

SEQ ID NO: 53132 - DNA, 20 bp, Artificial Sequence
  Description of Artificial Sequence: Synthetic oligonucleotide
  Target: ATXN1; (-) strand; PAM type: NRG; PAM sequence: GAG
agtggtgaaagttctcttct

SEQ ID NO: 53133 - DNA, 20 bp, Artificial Sequence
  Description of Artificial Sequence: Synthetic oligonucleotide
  Target: ATXN1; (-) strand; PAM type: NRG; PAM sequence: AAG
tctctattcctgagtggtga

SEQ ID NO: 53134 - DNA, 20 bp, Artificial Sequence
  Description of Artificial Sequence: Synthetic oligonucleotide
  Target: ATXN1; (-) strand; PAM type: NRG; PAM sequence: TGG
gtgtcctctctattcctgag

SEQ ID NO: 53135 - DNA, 20 bp, Artificial Sequence
  Description of Artificial Sequence: Synthetic oligonucleotide
  Target: ATXN1; (-) strand; PAM type: NRG; PAM sequence: GAG
tatgtgtcctctctattcct

SEQ ID NO: 53136 - DNA, 20 bp, Artificial Sequence
  Description of Artificial Sequence: Synthetic oligonucleotide
  Target: ATXN1; (-) strand; PAM type: NRG; PAM sequence: GGG
ttttgttgccaagtacagca

SEQ ID NO: 53137 - DNA, 20 bp, Artificial Sequence
  Description of Artificial Sequence: Synthetic oligonucleotide
  Target: ATXN1; (-) strand; PAM type: NRG; PAM sequence: AGG
attttgttgccaagtacagc

SEQ ID NO: 53138 - DNA, 20 bp, Artificial Sequence
  Description of Artificial Sequence: Synthetic oligonucleotide
  Target: ATXN1; (-) strand; PAM type: NRG; PAM sequence: CAG
tattttgttgccaagtacag

SEQ ID NO: 53139 - DNA, 20 bp, Artificial Sequence
  Description of Artificial Sequence: Synthetic oligonucleotide
  Target: ATXN1; (-) strand; PAM type: NRG; PAM sequence: CAG
ttttattttgttgccaagta

SEQ ID NO: 53140 - DNA, 20 bp, Artificial Sequence
  Description of Artificial Sequence: Synthetic oligonucleotide
  Target: ATXN1; (-) strand; PAM type: NRG; PAM sequence: AAG
tcttcttttattttgttgcc

SEQ ID NO: 53141 - DNA, 20 bp, Artificial Sequence
  Description of Artificial Sequence: Synthetic oligonucleotide
  Target: ATXN1; (-) strand; PAM type: NRG; PAM sequence: CGG
atgtcatgagggttgatgat

SEQ ID NO: 53142 - DNA, 20 bp, Artificial Sequence
  Description of Artificial Sequence: Synthetic oligonucleotide
  Target: ATXN1; (-) strand; PAM type: NRG; PAM sequence: GGG
tctgccctgtgatgtcatga

SEQ ID NO: 53143 - DNA, 20 bp, Artificial Sequence
  Description of Artificial Sequence: Synthetic oligonucleotide
  Target: ATXN1; (-) strand; PAM type: NRG; PAM sequence: AGG
ttctgccctgtgatgtcatg

SEQ ID NO: 53144 - DNA, 20 bp, Artificial Sequence
  Description of Artificial Sequence: Synthetic oligonucleotide
  Target: ATXN1; (-) strand; PAM type: NRG; PAM sequence: GAG
tttctgccctgtgatgtcat

SEQ ID NO: 53145 - DNA, 20 bp, Artificial Sequence
  Description of Artificial Sequence: Synthetic oligonucleotide
  Target: ATXN1; (-) strand; PAM type: NRG; PAM sequence: CAG
actgagatttcacaaggccc

SEQ ID NO: 53146 - DNA, 20 bp, Artificial Sequence
  Description of Artificial Sequence: Synthetic oligonucleotide
  Target: ATXN1; (-) strand; PAM type: NRG; PAM sequence: AGG
gaagtaactgagatttcaca

SEQ ID NO: 53147 - DNA, 20 bp, Artificial Sequence
  Description of Artificial Sequence: Synthetic oligonucleotide
  Target: ATXN1; (-) strand; PAM type: NRG; PAM sequence: AAG
cgaagtaactgagatttcac

SEQ ID NO: 53148 - DNA, 20 bp, Artificial Sequence
  Description of Artificial Sequence: Synthetic oligonucleotide
  Target: ATXN1; (-) strand; PAM type: NRG; PAM sequence: GAG
aaaggagacacgaagtaact

SEQ ID NO: 53149 - DNA, 20 bp, Artificial Sequence
  Description of Artificial Sequence: Synthetic oligonucleotide
  Target: ATXN1; (-) strand; PAM type: NRG; PAM sequence: AAG
gtttatttaaaggagacacg

SEQ ID NO: 53150 - DNA, 20 bp, Artificial Sequence
  Description of Artificial Sequence: Synthetic oligonucleotide
  Target: ATXN1; (-) strand; PAM type: NRG; PAM sequence: GAG
taactatagtttatttaaag

SEQ ID NO: 53151 - DNA, 20 bp, Artificial Sequence
  Description of Artificial Sequence: Synthetic oligonucleotide
  Target: ATXN1; (-) strand; PAM type: NRG; PAM sequence: AGG
aataactatagtttatttaa

SEQ ID NO: 53152 - DNA, 20 bp, Artificial Sequence
  Description of Artificial Sequence: Synthetic oligonucleotide
  Target: ATXN1; (-) strand; PAM type: NRG; PAM sequence: AAG
aaataactatagtttattta

SEQ ID NO: 53153 - DNA, 20 bp, Artificial Sequence
  Description of Artificial Sequence: Synthetic oligonucleotide
  Target: ATXN1; (-) strand; PAM type: NRG; PAM sequence: TAG
gccactatttaaaataacta

SEQ ID NO: 53154 - DNA, 20 bp, Artificial Sequence
  Description of Artificial Sequence: Synthetic oligonucleotide
  Target: ATXN1; (-) strand; PAM type: NRG; PAM sequence: AGG
tgtgaaagcaggctttggtg

SEQ ID NO: 53155 - DNA, 20 bp, Artificial Sequence
  Description of Artificial Sequence: Synthetic oligonucleotide
  Target: ATXN1; (-) strand; PAM type: NRG; PAM sequence: GAG
gtgtgaaagcaggctttggt

SEQ ID NO: 53156 - DNA, 20 bp, Artificial Sequence
  Description of Artificial Sequence: Synthetic oligonucleotide
  Target: ATXN1; (-) strand; PAM type: NRG; PAM sequence: TGG
atcagtgtgaaagcaggctt

SEQ ID NO: 53157 - DNA, 20 bp, Artificial Sequence
  Description of Artificial Sequence: Synthetic oligonucleotide
  Target: ATXN1; (-) strand; PAM type: NRG; PAM sequence: AGG
ggagaaatcagtgtgaaagc

SEQ ID NO: 53158 - DNA, 20 bp, Artificial Sequence
  Description of Artificial Sequence: Synthetic oligonucleotide
  Target: ATXN1; (-) strand; PAM type: NRG; PAM sequence: CAG
gggagaaatcagtgtgaaag

SEQ ID NO: 53159 - DNA, 20 bp, Artificial Sequence
  Description of Artificial Sequence: Synthetic oligonucleotide
  Target: ATXN1; (-) strand; PAM type: NRG; PAM sequence: AAG
aatgggagaaatcagtgtga

SEQ ID NO: 53160 - DNA, 20 bp, Artificial Sequence
  Description of Artificial Sequence: Synthetic oligonucleotide
  Target: ATXN1; (-) strand; PAM type: NRG; PAM sequence: CAG
gatatagaaatgggagaaat

SEQ ID NO: 53161 - DNA, 20 bp, Artificial Sequence
  Description of Artificial Sequence: Synthetic oligonucleotide
  Target: ATXN1; (-) strand; PAM type: NRG; PAM sequence: GAG
tggaatggatatagaaatgg

SEQ ID NO: 53162 - DNA, 20 bp, Artificial Sequence
  Description of Artificial Sequence: Synthetic oligonucleotide
  Target: ATXN1; (-) strand; PAM type: NRG; PAM sequence: GGG
aatggaatggatatagaaat

SEQ ID NO: 53163 - DNA, 20 bp, Artificial Sequence
  Description of Artificial Sequence: Synthetic oligonucleotide
  Target: ATXN1; (-) strand; PAM type: NRG; PAM sequence: TGG
taatggaatggatatagaaa

SEQ ID NO: 53164 - DNA, 20 bp, Artificial Sequence
  Description of Artificial Sequence: Synthetic oligonucleotide
  Target: ATXN1; (-) strand; PAM type: NRG; PAM sequence: TAG
acttaataatggaatggata

SEQ ID NO: 53165 - DNA, 20 bp, Artificial Sequence
  Description of Artificial Sequence: Synthetic oligonucleotide
  Target: ATXN1; (-) strand; PAM type: NRG; PAM sequence: TGG
taacatacttaataatggaa

SEQ ID NO: 53166 - DNA, 20 bp, Artificial Sequence
  Description of Artificial Sequence: Synthetic oligonucleotide
  Target: ATXN1; (-) strand; PAM type: NRG; PAM sequence: TGG
ttctttaacatacttaataa

SEQ ID NO: 53167 - DNA, 20 bp, Artificial Sequence
  Description of Artificial Sequence: Synthetic oligonucleotide
  Target: ATXN1; (-) strand; PAM type: NRG; PAM sequence: AAG
cttgatgaaggaaagtattt

SEQ ID NO: 53168 - DNA, 20 bp, Artificial Sequence
  Description of Artificial Sequence: Synthetic oligonucleotide
  Target: ATXN1; (-) strand; PAM type: NRG; PAM sequence: AAG
ggttctcacttgatgaagga

SEQ ID NO: 53169 - DNA, 20 bp, Artificial Sequence
  Description of Artificial Sequence: Synthetic oligonucleotide
  Target: ATXN1; (-) strand; PAM type: NRG; PAM sequence: AGG
ccagggttctcacttgatga

SEQ ID NO: 53170 - DNA, 20 bp, Artificial Sequence
  Description of Artificial Sequence: Synthetic oligonucleotide
  Target: ATXN1; (-) strand; PAM type: NRG; PAM sequence: AAG
tccagggttctcacttgatg

SEQ ID NO: 53171 - DNA, 20 bp, Artificial Sequence
  Description of Artificial Sequence: Synthetic oligonucleotide
  Target: ATXN1; (-) strand; PAM type: NRG; PAM sequence: GGG
ctcattctcatcttcttcca

SEQ ID NO: 53172 - DNA, 20 bp, Artificial Sequence
  Description of Artificial Sequence: Synthetic oligonucleotide
  Target: ATXN1; (-) strand; PAM type: NRG; PAM sequence: AGG
cctcattctcatcttcttcc

SEQ ID NO: 53173 - DNA, 20 bp, Artificial Sequence
  Description of Artificial Sequence: Synthetic oligonucleotide
  Target: ATXN1; (-) strand; PAM type: NRG; PAM sequence: CAG
tcctcattctcatcttcttc

SEQ ID NO: 53174 - DNA, 20 bp, Artificial Sequence
  Description of Artificial Sequence: Synthetic oligonucleotide
  Target: ATXN1; (-) strand; PAM type: NRG; PAM sequence: GAG
gcctgtcagatgataggcct

SEQ ID NO: 53175 - DNA, 20 bp, Artificial Sequence
  Description of Artificial Sequence: Synthetic oligonucleotide
  Target: ATXN1; (-) strand; PAM type: NRG; PAM sequence: AGG
cttagtgcctgtcagatgat

SEQ ID NO: 53176 - DNA, 20 bp, Artificial Sequence
  Description of Artificial Sequence: Synthetic oligonucleotide
  Target: ATXN1; (-) strand; PAM type: NRG; PAM sequence: TAG
acttagtgcctgtcagatga

SEQ ID NO: 53177 - DNA, 20 bp, Artificial Sequence
  Description of Artificial Sequence: Synthetic oligonucleotide
  Target: ATXN1; (-) strand; PAM type: NRG; PAM sequence: CAG
gatacacacttagtgcctgt

SEQ ID NO: 53178 - DNA, 20 bp, Artificial Sequence
  Description of Artificial Sequence: Synthetic oligonucleotide
  Target: ATXN1; (-) strand; PAM type: NRG; PAM sequence: TAG
caaaatacgtgatacacact

SEQ ID NO: 53179 - DNA, 20 bp, Artificial Sequence
  Description of Artificial Sequence: Synthetic oligonucleotide
  Target: ATXN1; (-) strand; PAM type: NRG; PAM sequence: AAG
taaaaccctgaaaaggttgt

SEQ ID NO: 53180 - DNA, 20 bp, Artificial Sequence
  Description of Artificial Sequence: Synthetic oligonucleotide
  Target: ATXN1; (-) strand; PAM type: NRG; PAM sequence: AGG
ttatcattaaaaccctgaaa

SEQ ID NO: 53181 - DNA, 20 bp, Artificial Sequence
  Description of Artificial Sequence: Synthetic oligonucleotide
  Target: ATXN1; (-) strand; PAM type: NRG; PAM sequence: AAG
cttatcattaaaaccctgaa

SEQ ID NO: 53182 - DNA, 20 bp, Artificial Sequence
  Description of Artificial Sequence: Synthetic oligonucleotide
  Target: ATXN1; (-) strand; PAM type: NRG; PAM sequence: AAG
aaatgtttttcaatttgcat

SEQ ID NO: 53183 - DNA, 20 bp, Artificial Sequence
  Description of Artificial Sequence: Synthetic oligonucleotide
  Target: ATXN1; (-) strand; PAM type: NRG; PAM sequence: GAG
ttcagctacttattagttgt

SEQ ID NO: 53184 - DNA, 20 bp, Artificial Sequence
  Description of Artificial Sequence: Synthetic oligonucleotide
  Target: ATXN1; (-) strand; PAM type: NRG; PAM sequence: TAG
gttctacttcagctacttat

SEQ ID NO: 53185 - DNA, 20 bp, Artificial Sequence
  Description of Artificial Sequence: Synthetic oligonucleotide
  Target: ATXN1; (-) strand; PAM type: NRG; PAM sequence: CAG
cttgggttcaagttctactt

SEQ ID NO: 53186 - DNA, 20 bp, Artificial Sequence
  Description of Artificial Sequence: Synthetic oligonucleotide
  Target: ATXN1; (-) strand; PAM type: NRG; PAM sequence: AAG
aattaaacacacttgggttc

SEQ ID NO: 53187 - DNA, 20 bp, Artificial Sequence
  Description of Artificial Sequence: Synthetic oligonucleotide
  Target: ATXN1; (-) strand; PAM type: NRG; PAM sequence: GGG
aattggaattaaacacactt

SEQ ID NO: 53188 - DNA, 20 bp, Artificial Sequence
  Description of Artificial Sequence: Synthetic oligonucleotide
  Target: ATXN1; (-) strand; PAM type: NRG; PAM sequence: TGG
aaattggaattaaacacact

SEQ ID NO: 53189 - DNA, 20 bp, Artificial Sequence
  Description of Artificial Sequence: Synthetic oligonucleotide
  Target: ATXN1; (-) strand; PAM type: NRG; PAM sequence: TGG
aaaaacaggttttttaaaat

SEQ ID NO: 53190 - DNA, 20 bp, Artificial Sequence
  Description of Artificial Sequence: Synthetic oligonucleotide
  Target: ATXN1; (-) strand; PAM type: NRG; PAM sequence: AGG
agacctcaactctaaaaaac

SEQ ID NO: 53191 - DNA, 20 bp, Artificial Sequence
  Description of Artificial Sequence: Synthetic oligonucleotide
  Target: ATXN1; (-) strand; PAM type: NRG; PAM sequence: CAG
gagacctcaactctaaaaaa

SEQ ID NO: 53192 - DNA, 20 bp, Artificial Sequence
  Description of Artificial Sequence: Synthetic oligonucleotide
  Target: ATXN1; (-) strand; PAM type: NRG; PAM sequence: GAG
accctccagcctggatgaca

SEQ ID NO: 53193 - DNA, 20 bp, Artificial Sequence
  Description of Artificial Sequence: Synthetic oligonucleotide
  Target: ATXN1; (-) strand; PAM type: NRG; PAM sequence: CAG
ctaccctccagcctggatga

SEQ ID NO: 53194 - DNA, 20 bp, Artificial Sequence
  Description of Artificial Sequence: Synthetic oligonucleotide
  Target: ATXN1; (-) strand; PAM type: NRG; PAM sequence: TGG
catgccactaccctccagcc

SEQ ID NO: 53195 - DNA, 20 bp, Artificial Sequence
  Description of Artificial Sequence: Synthetic oligonucleotide
  Target: ATXN1; (-) strand; PAM type: NRG; PAM sequence: CAG
aagaacatgccactaccctc

SEQ ID NO: 53196 - DNA, 20 bp, Artificial Sequence
  Description of Artificial Sequence: Synthetic oligonucleotide
  Target: ATXN1; (-) strand; PAM type: NRG; PAM sequence: AAG
gattgaggctgcagtgagct

SEQ ID NO: 53197 - DNA, 20 bp, Artificial Sequence
  Description of Artificial Sequence: Synthetic oligonucleotide
  Target: ATXN1; (-) strand; PAM type: NRG; PAM sequence: GAG
caggagattgaggctgcagt

SEQ ID NO: 53198 - DNA, 20 bp, Artificial Sequence
  Description of Artificial Sequence: Synthetic oligonucleotide
  Target: ATXN1; (-) strand; PAM type: NRG; PAM sequence: CAG
aacccaggagattgaggctg

SEQ ID NO: 53199 - DNA, 20 bp, Artificial Sequence
  Description of Artificial Sequence: Synthetic oligonucleotide
  Target: ATXN1; (-) strand; PAM type: NRG; PAM sequence: AGG
cgcttgaacccaggagattg

SEQ ID NO: 53200 - DNA, 20 bp, Artificial Sequence
  Description of Artificial Sequence: Synthetic oligonucleotide
  Target: ATXN1; (-) strand; PAM type: NRG; PAM sequence: GAG
tcgcttgaacccaggagatt

SEQ ID NO: 53201 - DNA, 20 bp, Artificial Sequence
  Description of Artificial Sequence: Synthetic oligonucleotide
  Target: ATXN1; (-) strand; PAM type: NRG; PAM sequence: GAG
ggaggatcgcttgaacccag

SEQ ID NO: 53202 - DNA, 20 bp, Artificial Sequence
  Description of Artificial Sequence: Synthetic oligonucleotide
  Target: ATXN1; (-) strand; PAM type: NRG; PAM sequence: AGG
caggaggatcgcttgaaccc

SEQ ID NO: 53203 - DNA, 20 bp, Artificial Sequence
  Description of Artificial Sequence: Synthetic oligonucleotide
  Target: ATXN1; (-) strand; PAM type: NRG; PAM sequence: CAG
acaggaggatcgcttgaacc

SEQ ID NO: 53204 - DNA, 20 bp, Artificial Sequence
  Description of Artificial Sequence: Synthetic oligonucleotide
  Target: ATXN1; (-) strand; PAM type: NRG; PAM sequence: AGG
actcagcagactgagacagg

SEQ ID NO: 53205 - DNA, 20 bp, Artificial Sequence
  Description of Artificial Sequence: Synthetic oligonucleotide
  Target: ATXN1; (-) strand; PAM type: NRG; PAM sequence: GAG
tactcagcagactgagacag

SEQ ID NO: 53206 - DNA, 20 bp, Artificial Sequence
  Description of Artificial Sequence: Synthetic oligonucleotide
  Target: ATXN1; (-) strand; PAM type: NRG; PAM sequence: AGG
gctactcagcagactgagac

SEQ ID NO: 53207 - DNA, 20 bp, Artificial Sequence
  Description of Artificial Sequence: Synthetic oligonucleotide
  Target: ATXN1; (-) strand; PAM type: NRG; PAM sequence: CAG
agctactcagcagactgaga

SEQ ID NO: 53208 - DNA, 20 bp, Artificial Sequence
  Description of Artificial Sequence: Synthetic oligonucleotide
  Target: ATXN1; (-) strand; PAM type: NRG; PAM sequence: GAG
tcccagctactcagcagact

SEQ ID NO: 53209 - DNA, 20 bp, Artificial Sequence
  Description of Artificial Sequence: Synthetic oligonucleotide
  Target: ATXN1; (-) strand; PAM type: NRG; PAM sequence: CAG
atgtagtcccagctactcag

SEQ ID NO: 53210 - DNA, 20 bp, Artificial Sequence
  Description of Artificial Sequence: Synthetic oligonucleotide
  Target: ATXN1; (-) strand; PAM type: NRG; PAM sequence: CAG
tccatgtagtcccagctact

SEQ ID NO: 53211 - DNA, 20 bp, Artificial Sequence
  Description of Artificial Sequence: Synthetic oligonucleotide
  Target: ATXN1; (-) strand; PAM type: NRG; PAM sequence: CAG
atggctcatccatgtagtcc

SEQ ID NO: 53212 - DNA, 20 bp, Artificial Sequence
  Description of Artificial Sequence: Synthetic oligonucleotide
  Target: ATXN1; (-) strand; PAM type: NRG; PAM sequence: TAG
agcatgatggctcatccatg

SEQ ID NO: 53213 - DNA, 20 bp, Artificial Sequence
  Description of Artificial Sequence: Synthetic oligonucleotide
  Target: ATXN1; (-) strand; PAM type: NRG; PAM sequence: TGG
tggaattaagcaaagcatga

SEQ ID NO: 53214 - DNA, 20 bp, Artificial Sequence
  Description of Artificial Sequence: Synthetic oligonucleotide
  Target: ATXN1; (-) strand; PAM type: NRG; PAM sequence: AAG
ttaaattttggaattaagca

SEQ ID NO: 53215 - DNA, 20 bp, Artificial Sequence
  Description of Artificial Sequence: Synthetic oligonucleotide
  Target: ATXN1; (-) strand; PAM type: NRG; PAM sequence: AAG
aagaattaaattttggaatt

SEQ ID NO: 53216 - DNA, 20 bp, Artificial Sequence
  Description of Artificial Sequence: Synthetic oligonucleotide
  Target: ATXN1; (-) strand; PAM type: NRG; PAM sequence: TGG
ccaaggtaagaattaaattt

SEQ ID NO: 53217 - DNA, 20 bp, Artificial Sequence
  Description of Artificial Sequence: Synthetic oligonucleotide
  Target: ATXN1; (-) strand; PAM type: NRG; PAM sequence: AAG
accctcttgggtgccaaggt

SEQ ID NO: 53218 - DNA, 20 bp, Artificial Sequence
  Description of Artificial Sequence: Synthetic oligonucleotide
  Target: ATXN1; (-) strand; PAM type: NRG; PAM sequence: AGG
aaacaccctcttgggtgcca

SEQ ID NO: 53219 - DNA, 20 bp, Artificial Sequence
  Description of Artificial Sequence: Synthetic oligonucleotide
  Target: ATXN1; (-) strand; PAM type: NRG; PAM sequence: AAG
caaacaccctcttgggtgcc

SEQ ID NO: 53220 - DNA, 20 bp, Artificial Sequence
  Description of Artificial Sequence: Synthetic oligonucleotide
  Target: ATXN1; (-) strand; PAM type: NRG; PAM sequence: GGG
tgtgtgccaaacaccctctt

SEQ ID NO: 53221 - DNA, 20 bp, Artificial Sequence
  Description of Artificial Sequence: Synthetic oligonucleotide
  Target: ATXN1; (-) strand; PAM type: NRG; PAM sequence: TGG
ctgtgtgccaaacaccctct

SEQ ID NO: 53222 - DNA, 20 bp, Artificial Sequence
  Description of Artificial Sequence: Synthetic oligonucleotide
  Target: ATXN1; (-) strand; PAM type: NRG; PAM sequence: AAG
ttcagtcaccaatttttatg

SEQ ID NO: 53223 - DNA, 20 bp, Artificial Sequence
  Description of Artificial Sequence: Synthetic oligonucleotide
  Target: ATXN1; (-) strand; PAM type: NRG; PAM sequence: CAG
atgtattctttttatttgtt

SEQ ID NO: 53224 - DNA, 20 bp, Artificial Sequence
  Description of Artificial Sequence: Synthetic oligonucleotide
  Target: ATXN1; (-) strand; PAM type: NRG; PAM sequence: TAG
ccatttgattgactaaacct

SEQ ID NO: 53225 - DNA, 20 bp, Artificial Sequence
  Description of Artificial Sequence: Synthetic oligonucleotide
  Target: ATXN1; (-) strand; PAM type: NRG; PAM sequence: AGG
accagtttaggtgaagaatg

SEQ ID NO: 53226 - DNA, 20 bp, Artificial Sequence
  Description of Artificial Sequence: Synthetic oligonucleotide
  Target: ATXN1; (-) strand; PAM type: NRG; PAM sequence: GAG
aaccagtttaggtgaagaat

SEQ ID NO: 53227 - DNA, 20 bp, Artificial Sequence
  Description of Artificial Sequence: Synthetic oligonucleotide
  Target: ATXN1; (-) strand; PAM type: NRG; PAM sequence: AAG
atacttaaccagtttaggtg

SEQ ID NO: 53228 - DNA, 20 bp, Artificial Sequence
  Description of Artificial Sequence: Synthetic oligonucleotide
  Target: ATXN1; (-) strand; PAM type: NRG; PAM sequence: AGG
gaggtatacttaaccagttt

SEQ ID NO: 53229 - DNA, 20 bp, Artificial Sequence
  Description of Artificial Sequence: Synthetic oligonucleotide
  Target: ATXN1; (-) strand; PAM type: NRG; PAM sequence: TAG
tgaggtatacttaaccagtt

SEQ ID NO: 53230 - DNA, 20 bp, Artificial Sequence
  Description of Artificial Sequence: Synthetic oligonucleotide
  Target: ATXN1; (-) strand; PAM type: NRG; PAM sequence: CAG
atgactgaggtatacttaac

SEQ ID NO: 53231 - DNA, 20 bp, Artificial Sequence
  Description of Artificial Sequence: Synthetic oligonucleotide
  Target: ATXN1; (-) strand; PAM type: NRG; PAM sequence: AGG
tctattaggttaaatgactg

SEQ ID NO: 53232 - DNA, 20 bp, Artificial Sequence
  Description of Artificial Sequence: Synthetic oligonucleotide
  Target: ATXN1; (-) strand; PAM type: NRG; PAM sequence: GAG
ttctattaggttaaatgact

SEQ ID NO: 53233 - DNA, 20 bp, Artificial Sequence
  Description of Artificial Sequence: Synthetic oligonucleotide
  Target: ATXN1; (-) strand; PAM type: NRG; PAM sequence: AGG
ttataatgactgtttctatt

SEQ ID NO: 53234 - DNA, 20 bp, Artificial Sequence
  Description of Artificial Sequence: Synthetic oligonucleotide
  Target: ATXN1; (-) strand; PAM type: NRG; PAM sequence: TAG
attataatgactgtttctat

SEQ ID NO: 53235 - DNA, 20 bp, Artificial Sequence
  Description of Artificial Sequence: Synthetic oligonucleotide
  Target: ATXN1; (-) strand; PAM type: NRG; PAM sequence: AGG
cgagtcatttattccttagc

SEQ ID NO: 53236 - DNA, 20 bp, Artificial Sequence
  Description of Artificial Sequence: Synthetic oligonucleotide
  Target: ATXN1; (-) strand; PAM type: NRG; PAM sequence: CAG
ccgagtcatttattccttag

SEQ ID NO: 53237 - DNA, 20 bp, Artificial Sequence
  Description of Artificial Sequence: Synthetic oligonucleotide
  Target: ATXN1; (-) strand; PAM type: NRG; PAM sequence: TAG
agtccgagtcatttattcct

SEQ ID NO: 53238 - DNA, 20 bp, Artificial Sequence
  Description of Artificial Sequence: Synthetic oligonucleotide
  Target: ATXN1; (-) strand; PAM type: NRG; PAM sequence: GAG
ataaatgtcaaagcaagtcc

SEQ ID NO: 53239 - DNA, 20 bp, Artificial Sequence
  Description of Artificial Sequence: Synthetic oligonucleotide
  Target: ATXN1; (-) strand; PAM type: NRG; PAM sequence: AAG
tagaaaataaatgtcaaagc

SEQ ID NO: 53240 - DNA, 20 bp, Artificial Sequence
  Description of Artificial Sequence: Synthetic oligonucleotide
  Target: ATXN1; (-) strand; PAM type: NRG; PAM sequence: AAG
gttttagaaaataaatgtca

SEQ ID NO: 53241 - DNA, 20 bp, Artificial Sequence
  Description of Artificial Sequence: Synthetic oligonucleotide
  Target: ATXN1; (-) strand; PAM type: NRG; PAM sequence: TAG
gggcaaaactgagtaagttt

SEQ ID NO: 53242 - DNA, 20 bp, Artificial Sequence
  Description of Artificial Sequence: Synthetic oligonucleotide
  Target: ATXN1; (-) strand; PAM type: NRG; PAM sequence: AAG
atatcggggcaaaactgagt

SEQ ID NO: 53243 - DNA, 20 bp, Artificial Sequence
  Description of Artificial Sequence: Synthetic oligonucleotide
  Target: ATXN1; (-) strand; PAM type: NRG; PAM sequence: GAG
ataaatatcggggcaaaact

SEQ ID NO: 53244 - DNA, 20 bp, Artificial Sequence
  Description of Artificial Sequence: Synthetic oligonucleotide
  Target: ATXN1; (-) strand; PAM type: NRG; PAM sequence: GGG
ctgctgatgtataaatatcg

SEQ ID NO: 53245 - DNA, 20 bp, Artificial Sequence
  Description of Artificial Sequence: Synthetic oligonucleotide
  Target: ATXN1; (-) strand; PAM type: NRG; PAM sequence: GGG
cctgctgatgtataaatatc

SEQ ID NO: 53246 - DNA, 20 bp, Artificial Sequence
  Description of Artificial Sequence: Synthetic oligonucleotide
  Target: ATXN1; (-) strand; PAM type: NRG; PAM sequence: CGG
tcctgctgatgtataaatat

SEQ ID NO: 53247 - DNA, 20 bp, Artificial Sequence
  Description of Artificial Sequence: Synthetic oligonucleotide
  Target: ATXN1; (-) strand; PAM type: NRG; PAM sequence: GGG
tggaacagagcagcttctcg

SEQ ID NO: 53248 - DNA, 20 bp, Artificial Sequence
  Description of Artificial Sequence: Synthetic oligonucleotide
  Target: ATXN1; (-) strand; PAM type: NRG; PAM sequence: GGG
gtggaacagagcagcttctc

SEQ ID NO: 53249 - DNA, 20 bp, Artificial Sequence
  Description of Artificial Sequence: Synthetic oligonucleotide
  Target: ATXN1; (-) strand; PAM type: NRG; PAM sequence: CGG
tgtggaacagagcagcttct

SEQ ID NO: 53250 - DNA, 20 bp, Artificial Sequence
  Description of Artificial Sequence: Synthetic oligonucleotide
  Target: ATXN1; (-) strand; PAM type: NRG; PAM sequence: CAG
ggcaattgtgtggaacagag

SEQ ID NO: 53251 - DNA, 20 bp, Artificial Sequence
  Description of Artificial Sequence: Synthetic oligonucleotide
  Target: ATXN1; (-) strand; PAM type: NRG; PAM sequence: GAG
taaggcaattgtgtggaaca

SEQ ID NO: 53252 - DNA, 20 bp, Artificial Sequence
  Description of Artificial Sequence: Synthetic oligonucleotide
  Target: ATXN1; (-) strand; PAM type: NRG; PAM sequence: CAG
gctaaggcaattgtgtggaa

SEQ ID NO: 53253 - DNA, 20 bp, Artificial Sequence
  Description of Artificial Sequence: Synthetic oligonucleotide
  Target: ATXN1; (-) strand; PAM type: NRG; PAM sequence: TGG
cagacgctaaggcaattgtg

SEQ ID NO: 53254 - DNA, 20 bp, Artificial Sequence
  Description of Artificial Sequence: Synthetic oligonucleotide
  Target: ATXN1; (-) strand; PAM type: NRG; PAM sequence: AGG
cataaagaggacagacgcta

SEQ ID NO: 53255 - DNA, 20 bp, Artificial Sequence
  Description of Artificial Sequence: Synthetic oligonucleotide
  Target: ATXN1; (-) strand; PAM type: NRG; PAM sequence: AAG
tcataaagaggacagacgct

SEQ ID NO: 53256 - DNA, 20 bp, Artificial Sequence
  Description of Artificial Sequence: Synthetic oligonucleotide
  Target: ATXN1; (-) strand; PAM type: NRG; PAM sequence: CAG
ttttagtttcataaagagga

SEQ ID NO: 53257 - DNA, 20 bp, Artificial Sequence
  Description of Artificial Sequence: Synthetic oligonucleotide
  Target: ATXN1; (-) strand; PAM type: NRG; PAM sequence: AGG
ttttttttagtttcataaag

SEQ ID NO: 53258 - DNA, 20 bp, Artificial Sequence
  Description of Artificial Sequence: Synthetic oligonucleotide
  Target: ATXN1; (-) strand; PAM type: NRG; PAM sequence: GAG
tttttttttagtttcataaa

SEQ ID NO: 53259 - DNA, 20 bp, Artificial Sequence
  Description of Artificial Sequence: Synthetic oligonucleotide
  Target: ATXN1; (-) strand; PAM type: NRG; PAM sequence: AAG
tttttttttttagtttcata

SEQ ID NO: 53260 - DNA, 20 bp, Artificial Sequence
  Description of Artificial Sequence: Synthetic oligonucleotide
  Target: ATXN1; (-) strand; PAM type: NRG; PAM sequence: TAG
ttactgtggttttttttttt

SEQ ID NO: 53261 - DNA, 20 bp, Artificial Sequence
  Description of Artificial Sequence: Synthetic oligonucleotide
  Target: ATXN1; (-) strand; PAM type: NRG; PAM sequence: TGG
cataacaactacagttactg

SEQ ID NO: 53262 - DNA, 20 bp, Artificial Sequence
  Description of Artificial Sequence: Synthetic oligonucleotide
  Target: ATXN1; (-) strand; PAM type: NRG; PAM sequence: CAG
gttggtgctcataacaacta

SEQ ID NO: 53263 - DNA, 20 bp, Artificial Sequence
  Description of Artificial Sequence: Synthetic oligonucleotide
  Target: ATXN1; (-) strand; PAM type: NRG; PAM sequence: TGG
tttaattagacttaaaatgt

SEQ ID NO: 53264 - DNA, 20 bp, Artificial Sequence
  Description of Artificial Sequence: Synthetic oligonucleotide
  Target: ATXN1; (-) strand; PAM type: NRG; PAM sequence: TAG
cagcaagtcaaatttttaat

SEQ ID NO: 53265 - DNA, 20 bp, Artificial Sequence
  Description of Artificial Sequence: Synthetic oligonucleotide
  Target: ATXN1; (-) strand; PAM type: NRG; PAM sequence: AAG
agccacggtgcctggccagc

SEQ ID NO: 53266 - DNA, 20 bp, Artificial Sequence
  Description of Artificial Sequence: Synthetic oligonucleotide
  Target: ATXN1; (-) strand; PAM type: NRG; PAM sequence: CAG
catgagccacggtgcctggc

SEQ ID NO: 53267 - DNA, 20 bp, Artificial Sequence
  Description of Artificial Sequence: Synthetic oligonucleotide
  Target: ATXN1; (-) strand; PAM type: NRG; PAM sequence: TGG
gaggcatgagccacggtgcc

SEQ ID NO: 53268 - DNA, 20 bp, Artificial Sequence
  Description of Artificial Sequence: Synthetic oligonucleotide
  Target: ATXN1; (-) strand; PAM type: NRG; PAM sequence: CGG
ttgattagaggcatgagcca

SEQ ID NO: 53269 - DNA, 20 bp, Artificial Sequence
  Description of Artificial Sequence: Synthetic oligonucleotide
  Target: ATXN1; (-) strand; PAM type: NRG; PAM sequence: GAG
agtgctttgattagaggcat

SEQ ID NO: 53270 - DNA, 20 bp, Artificial Sequence
  Description of Artificial Sequence: Synthetic oligonucleotide
  Target: ATXN1; (-) strand; PAM type: NRG; PAM sequence: AGG
tcccaaagtgctttgattag

SEQ ID NO: 53271 - DNA, 20 bp, Artificial Sequence
  Description of Artificial Sequence: Synthetic oligonucleotide
  Target: ATXN1; (-) strand; PAM type: NRG; PAM sequence: GAG
ctcccaaagtgctttgatta

SEQ ID NO: 53272 - DNA, 20 bp, Artificial Sequence
  Description of Artificial Sequence: Synthetic oligonucleotide
  Target: ATXN1; (-) strand; PAM type: NRG; PAM sequence: TAG
gcctcccaaagtgctttgat

SEQ ID NO: 53273 - DNA, 20 bp, Artificial Sequence
  Description of Artificial Sequence: Synthetic oligonucleotide
  Target: ATXN1; (-) strand; PAM type: NRG; PAM sequence: AAG
ccacctgcctctgcctccca

SEQ ID NO: 53274 - DNA, 20 bp, Artificial Sequence
  Description of Artificial Sequence: Synthetic oligonucleotide
  Target: ATXN1; (-) strand; PAM type: NRG; PAM sequence: AAG
ggtcttgaactcctgacctt

SEQ ID NO: 53275 - DNA, 20 bp, Artificial Sequence
  Description of Artificial Sequence: Synthetic oligonucleotide
  Target: ATXN1; (-) strand; PAM type: NRG; PAM sequence: TGG
tttcactatgttggccaggc

SEQ ID NO: 53276 - DNA, 20 bp, Artificial Sequence
  Description of Artificial Sequence: Synthetic oligonucleotide
  Target: ATXN1; (-) strand; PAM type: NRG; PAM sequence: AGG
agtgtttcactatgttggcc

SEQ ID NO: 53277 - DNA, 20 bp, Artificial Sequence
  Description of Artificial Sequence: Synthetic oligonucleotide
  Target: ATXN1; (-) strand; PAM type: NRG; PAM sequence: CAG
cagtgtttcactatgttggc

SEQ ID NO: 53278 - DNA, 20 bp, Artificial Sequence
  Description of Artificial Sequence: Synthetic oligonucleotide
  Target: ATXN1; (-) strand; PAM type: NRG; PAM sequence: TGG
gagacagtgtttcactatgt

SEQ ID NO: 53279 - DNA, 20 bp, Artificial Sequence
  Description of Artificial Sequence: Synthetic oligonucleotide
  Target: ATXN1; (-) strand; PAM type: NRG; PAM sequence: CAG
ttttgtatttttagtagaga

SEQ ID NO: 53280 - DNA, 20 bp, Artificial Sequence
  Description of Artificial Sequence: Synthetic oligonucleotide
  Target: ATXN1; (-) strand; PAM type: NRG; PAM sequence: GAG
taatttttgtatttttagta

SEQ ID NO: 53281 - DNA, 20 bp, Artificial Sequence
  Description of Artificial Sequence: Synthetic oligonucleotide
  Target: ATXN1; (-) strand; PAM type: NRG; PAM sequence: TAG
gttaatttttgtatttttag

SEQ ID NO: 53282 - DNA, 20 bp, Artificial Sequence
  Description of Artificial Sequence: Synthetic oligonucleotide
  Target: ATXN1; (-) strand; PAM type: NRG; PAM sequence: TAG
caggttaatttttgtatttt

SEQ ID NO: 53283 - DNA, 20 bp, Artificial Sequence
  Description of Artificial Sequence: Synthetic oligonucleotide
  Target: ATXN1; (-) strand; PAM type: NRG; PAM sequence: AGG
caggcgtgagccaccacgcc

SEQ ID NO: 53284 - DNA, 20 bp, Artificial Sequence
  Description of Artificial Sequence: Synthetic oligonucleotide
  Target: ATXN1; (-) strand; PAM type: NRG; PAM sequence: CAG
acaggcgtgagccaccacgc

SEQ ID NO: 53285 - DNA, 20 bp, Artificial Sequence
  Description of Artificial Sequence: Synthetic oligonucleotide
  Target: ATXN1; (-) strand; PAM type: NRG; PAM sequence: GAG
gtagctgagactacaggcgt

SEQ ID NO: 53286 - DNA, 20 bp, Artificial Sequence
  Description of Artificial Sequence: Synthetic oligonucleotide
  Target: ATXN1; (-) strand; PAM type: NRG; PAM sequence: AGG
tcccgagtagctgagactac

SEQ ID NO: 53287 - DNA, 20 bp, Artificial Sequence
  Description of Artificial Sequence: Synthetic oligonucleotide
  Target: ATXN1; (-) strand; PAM type: NRG; PAM sequence: CAG
ctcccgagtagctgagacta

SEQ ID NO: 53288 - DNA, 20 bp, Artificial Sequence
  Description of Artificial Sequence: Synthetic oligonucleotide
  Target: ATXN1; (-) strand; PAM type: NRG; PAM sequence: GAG
cctcagcctcccgagtagct

SEQ ID NO: 53289 - DNA, 20 bp, Artificial Sequence
  Description of Artificial Sequence: Synthetic oligonucleotide
  Target: ATXN1; (-) strand; PAM type: NRG; PAM sequence: TAG
ccctgcctcagcctcccgag

SEQ ID NO: 53290 - DNA, 20 bp, Artificial Sequence
  Description of Artificial Sequence: Synthetic oligonucleotide
  Target: ATXN1; (-) strand; PAM type: NRG; PAM sequence: GAG
ttcccctgcctcagcctccc

SEQ ID NO: 53291 - DNA, 20 bp, Artificial Sequence
  Description of Artificial Sequence: Synthetic oligonucleotide
  Target: ATXN1; (-) strand; PAM type: NRG; PAM sequence: CAG
ttcaagctattcccctgcct

SEQ ID NO: 53292 - DNA, 20 bp, Artificial Sequence
  Description of Artificial Sequence: Synthetic oligonucleotide
  Target: ATXN1; (-) strand; PAM type: NRG; PAM sequence: AAG
agcctccacctcccaggttc

SEQ ID NO: 53293 - DNA, 20 bp, Artificial Sequence
  Description of Artificial Sequence: Synthetic oligonucleotide
  Target: ATXN1; (-) strand; PAM type: NRG; PAM sequence: AGG
cactgtagcctccacctccc

SEQ ID NO: 53294 - DNA, 20 bp, Artificial Sequence
  Description of Artificial Sequence: Synthetic oligonucleotide
  Target: ATXN1; (-) strand; PAM type: NRG; PAM sequence: CAG
tcactgtagcctccacctcc

SEQ ID NO: 53295 - DNA, 20 bp, Artificial Sequence
  Description of Artificial Sequence: Synthetic oligonucleotide
  Target: ATXN1; (-) strand; PAM type: NRG; PAM sequence: TAG
ggcacgatcttagctcactg

SEQ ID NO: 53296 - DNA, 20 bp, Artificial Sequence
  Description of Artificial Sequence: Synthetic oligonucleotide
  Target: ATXN1; (-) strand; PAM type: NRG; PAM sequence: TAG
ggaatgcagtggcacgatct

SEQ ID NO: 53297 - DNA, 20 bp, Artificial Sequence
  Description of Artificial Sequence: Synthetic oligonucleotide
  Target: ATXN1; (-) strand; PAM type: NRG; PAM sequence: TGG
ttgcccaggctggaatgcag

SEQ ID NO: 53298 - DNA, 20 bp, Artificial Sequence
  Description of Artificial Sequence: Synthetic oligonucleotide
  Target: ATXN1; (-) strand; PAM type: NRG; PAM sequence: CAG
ctattgcccaggctggaatg

SEQ ID NO: 53299 - DNA, 20 bp, Artificial Sequence
  Description of Artificial Sequence: Synthetic oligonucleotide
  Target: ATXN1; (-) strand; PAM type: NRG; PAM sequence: TGG
tcttactctattgcccaggc

SEQ ID NO: 53300 - DNA, 20 bp, Artificial Sequence
  Description of Artificial Sequence: Synthetic oligonucleotide
  Target: ATXN1; (-) strand; PAM type: NRG; PAM sequence: AGG
ctagtcttactctattgccc

SEQ ID NO: 53301 - DNA, 20 bp, Artificial Sequence
  Description of Artificial Sequence: Synthetic oligonucleotide
  Target: ATXN1; (-) strand; PAM type: NRG; PAM sequence: CAG
cctagtcttactctattgcc

SEQ ID NO: 53302 - DNA, 20 bp, Artificial Sequence
  Description of Artificial Sequence: Synthetic oligonucleotide
  Target: ATXN1; (-) strand; PAM type: NRG; PAM sequence: TAG
ttttttttttttttgagacc

SEQ ID NO: 53303 - DNA, 20 bp, Artificial Sequence
  Description of Artificial Sequence: Synthetic oligonucleotide
  Target: ATXN1; (-) strand; PAM type: NRG; PAM sequence: GAG
tctttttttttttttttttt

SEQ ID NO: 53304 - DNA, 20 bp, Artificial Sequence
  Description of Artificial Sequence: Synthetic oligonucleotide
  Target: ATXN1; (-) strand; PAM type: NRG; PAM sequence: GAG
aattgcataaacggcaagtc

SEQ ID NO: 53305 - DNA, 20 bp, Artificial Sequence
  Description of Artificial Sequence: Synthetic oligonucleotide
  Target: ATXN1; (-) strand; PAM type: NRG; PAM sequence: AAG
tttgaaattgcataaacggc

SEQ ID NO: 53306 - DNA, 20 bp, Artificial Sequence
  Description of Artificial Sequence: Synthetic oligonucleotide
  Target: ATXN1; (-) strand; PAM type: NRG; PAM sequence: CGG
agcttttgaaattgcataaa

SEQ ID NO: 53307 - DNA, 20 bp, Artificial Sequence
  Description of Artificial Sequence: Synthetic oligonucleotide
  Target: ATXN1; (-) strand; PAM type: NRG; PAM sequence: CAG
aattttagacctacaaaagc

SEQ ID NO: 53308 - DNA, 20 bp, Artificial Sequence
  Description of Artificial Sequence: Synthetic oligonucleotide
  Target: ATXN1; (-) strand; PAM type: NRG; PAM sequence: AAG
caacaattttagacctacaa

SEQ ID NO: 53309 - DNA, 20 bp, Artificial Sequence
  Description of Artificial Sequence: Synthetic oligonucleotide
  Target: ATXN1; (-) strand; PAM type: NRG; PAM sequence: TAG
aaattgtcttacaacaattt

SEQ ID NO: 53310 - DNA, 20 bp, Artificial Sequence
  Description of Artificial Sequence: Synthetic oligonucleotide
  Target: ATXN1; (-) strand; PAM type: NRG; PAM sequence: AAG
cccagattctgcacgtctgg

SEQ ID NO: 53311 - DNA, 20 bp, Artificial Sequence
  Description of Artificial Sequence: Synthetic oligonucleotide
  Target: ATXN1; (-) strand; PAM type: NRG; PAM sequence: TGG
agccccagattctgcacgtc

SEQ ID NO: 53312 - DNA, 20 bp, Artificial Sequence
  Description of Artificial Sequence: Synthetic oligonucleotide
  Target: ATXN1; (-) strand; PAM type: NRG; PAM sequence: CAG
tggggggcaaagaagagccc

SEQ ID NO: 53313 - DNA, 20 bp, Artificial Sequence
  Description of Artificial Sequence: Synthetic oligonucleotide
  Target: ATXN1; (-) strand; PAM type: NRG; PAM sequence: GAG
gtggggtggggggcaaagaa

SEQ ID NO: 53314 - DNA, 20 bp, Artificial Sequence
  Description of Artificial Sequence: Synthetic oligonucleotide
  Target: ATXN1; (-) strand; PAM type: NRG; PAM sequence: AAG
ctgtggggtggggggcaaag

SEQ ID NO: 53315 - DNA, 20 bp, Artificial Sequence
  Description of Artificial Sequence: Synthetic oligonucleotide
  Target: ATXN1; (-) strand; PAM type: NRG; PAM sequence: AAG
aggctgtggggtggggggca

SEQ ID NO: 53316 - DNA, 20 bp, Artificial Sequence
  Description of Artificial Sequence: Synthetic oligonucleotide
  Target: ATXN1; (-) strand; PAM type: NRG; PAM sequence: GGG
atgtgaggctgtggggtggg

SEQ ID NO: 53317 - DNA, 20 bp, Artificial Sequence
  Description of Artificial Sequence: Synthetic oligonucleotide
  Target: ATXN1; (-) strand; PAM type: NRG; PAM sequence: GGG
catgtgaggctgtggggtgg

SEQ ID NO: 53318 - DNA, 20 bp, Artificial Sequence
  Description of Artificial Sequence: Synthetic oligonucleotide
  Target: ATXN1; (-) strand; PAM type: NRG; PAM sequence: GGG
acatgtgaggctgtggggtg

SEQ ID NO: 53319 - DNA, 20 bp, Artificial Sequence
  Description of Artificial Sequence: Synthetic oligonucleotide
  Target: ATXN1; (-) strand; PAM type: NRG; PAM sequence: GGG
gacatgtgaggctgtggggt

SEQ ID NO: 53320 - DNA, 20 bp, Artificial Sequence
  Description of Artificial Sequence: Synthetic oligonucleotide
  Target: ATXN1; (-) strand; PAM type: NRG; PAM sequence: TGG
agacatgtgaggctgtgggg

SEQ ID NO: 53321 - DNA, 20 bp, Artificial Sequence
  Description of Artificial Sequence: Synthetic oligonucleotide
  Target: ATXN1; (-) strand; PAM type: NRG; PAM sequence: GGG
ccaagacatgtgaggctgtg

SEQ ID NO: 53322 - DNA, 20 bp, Artificial Sequence
  Description of Artificial Sequence: Synthetic oligonucleotide
  Target: ATXN1; (-) strand; PAM type: NRG; PAM sequence: GGG
accaagacatgtgaggctgt

SEQ ID NO: 53323 - DNA, 20 bp, Artificial Sequence
  Description of Artificial Sequence: Synthetic oligonucleotide
  Target: ATXN1; (-) strand; PAM type: NRG; PAM sequence: TGG
aaccaagacatgtgaggctg

SEQ ID NO: 53324 - DNA, 20 bp, Artificial Sequence
  Description of Artificial Sequence: Synthetic oligonucleotide
  Target: ATXN1; (-) strand; PAM type: NRG; PAM sequence: AGG
gccgcaaaccaagacatgtg

SEQ ID NO: 53325 - DNA, 20 bp, Artificial Sequence
  Description of Artificial Sequence: Synthetic oligonucleotide
  Target: ATXN1; (-) strand; PAM type: NRG; PAM sequence: GAG
agccgcaaaccaagacatgt

SEQ ID NO: 53326 - DNA, 20 bp, Artificial Sequence
  Description of Artificial Sequence: Synthetic oligonucleotide
  Target: ATXN1; (-) strand; PAM type: NRG; PAM sequence: AAG
ctgtttaaaagccgcaaacc

SEQ ID NO: 53327 - DNA, 20 bp, Artificial Sequence
  Description of Artificial Sequence: Synthetic oligonucleotide
  Target: ATXN1; (-) strand; PAM type: NRG; PAM sequence: AAG
ctctagaactcgctgtttaa

SEQ ID NO: 53328 - DNA, 20 bp, Artificial Sequence
  Description of Artificial Sequence: Synthetic oligonucleotide
  Target: ATXN1; (-) strand; PAM type: NRG; PAM sequence: TAG
acagttttgtggaacttctc

SEQ ID NO: 53329 - DNA, 20 bp, Artificial Sequence
  Description of Artificial Sequence: Synthetic oligonucleotide
  Target: ATXN1; (-) strand; PAM type: NRG; PAM sequence: TGG
gcaggtggagcacagttttg

SEQ ID NO: 53330 - DNA, 20 bp, Artificial Sequence
  Description of Artificial Sequence: Synthetic oligonucleotide
  Target: ATXN1; (-) strand; PAM type: NRG; PAM sequence: CAG
gaaggccagcaggtggagca

SEQ ID NO: 53331 - DNA, 20 bp, Artificial Sequence
  Description of Artificial Sequence: Synthetic oligonucleotide
  Target: ATXN1; (-) strand; PAM type: NRG; PAM sequence: GAG
ccccagaaggccagcaggtg

SEQ ID NO: 53332 - DNA, 20 bp, Artificial Sequence
  Description of Artificial Sequence: Synthetic oligonucleotide
  Target: ATXN1; (-) strand; PAM type: NRG; PAM sequence: TGG
ttccccagaaggccagcagg

SEQ ID NO: 53333 - DNA, 20 bp, Artificial Sequence
  Description of Artificial Sequence: Synthetic oligonucleotide
  Target: ATXN1; (-) strand; PAM type: NRG; PAM sequence: AGG
agcttccccagaaggccagc

SEQ ID NO: 53334 - DNA, 20 bp, Artificial Sequence
  Description of Artificial Sequence: Synthetic oligonucleotide
  Target: ATXN1; (-) strand; PAM type: NRG; PAM sequence: CAG
cagcttccccagaaggccag

SEQ ID NO: 53335 - DNA, 20 bp, Artificial Sequence
  Description of Artificial Sequence: Synthetic oligonucleotide
  Target: ATXN1; (-) strand; PAM type: NRG; PAM sequence: CAG
acgcagcttccccagaaggc

SEQ ID NO: 53336 - DNA, 20 bp, Artificial Sequence
  Description of Artificial Sequence: Synthetic oligonucleotide
  Target: ATXN1; (-) strand; PAM type: NRG; PAM sequence: AGG
ccagacgcagcttccccaga

SEQ ID NO: 53337 - DNA, 20 bp, Artificial Sequence
  Description of Artificial Sequence: Synthetic oligonucleotide
  Target: ATXN1; (-) strand; PAM type: NRG; PAM sequence: AAG
cccagacgcagcttccccag

SEQ ID NO: 53338 - DNA, 20 bp, Artificial Sequence
  Description of Artificial Sequence: Synthetic oligonucleotide
  Target: ATXN1; (-) strand; PAM type: NRG; PAM sequence: CAG
cagcccagacgcagcttccc

SEQ ID NO: 53339 - DNA, 20 bp, Artificial Sequence
  Description of Artificial Sequence: Synthetic oligonucleotide
  Target: ATXN1; (-) strand; PAM type: NRG; PAM sequence: CAG
cagcatcatcagcccagacg

SEQ ID NO: 53340 - DNA, 20 bp, Artificial Sequence
  Description of Artificial Sequence: Synthetic oligonucleotide
  Target: ATXN1; (-) strand; PAM type: NRG; PAM sequence: CAG
cgcaaccagcatcatcagcc

SEQ ID NO: 53341 - DNA, 20 bp, Artificial Sequence
  Description of Artificial Sequence: Synthetic oligonucleotide
  Target: ATXN1; (-) strand; PAM type: NRG; PAM sequence: CAG
caacccgcaaccagcatcat

SEQ ID NO: 53342 - DNA, 20 bp, Artificial Sequence
  Description of Artificial Sequence: Synthetic oligonucleotide
  Target: ATXN1; (-) strand; PAM type: NRG; PAM sequence: CAG
gttttcgctcaacccgcaac

SEQ ID NO: 53343 - DNA, 20 bp, Artificial Sequence
  Description of Artificial Sequence: Synthetic oligonucleotide
  Target: ATXN1; (-) strand; PAM type: NRG; PAM sequence: TGG
ttcaagtaccaagcatgctt

SEQ ID NO: 53344 - DNA, 20 bp, Artificial Sequence
  Description of Artificial Sequence: Synthetic oligonucleotide
  Target: ATXN1; (-) strand; PAM type: NRG; PAM sequence: AAG
agggttaattttcaagtacc

SEQ ID NO: 53345 - DNA, 20 bp, Artificial Sequence
  Description of Artificial Sequence: Synthetic oligonucleotide
  Target: ATXN1; (-) strand; PAM type: NRG; PAM sequence: AAG
gtcttgaagggttaattttc

SEQ ID NO: 53346 - DNA, 20 bp, Artificial Sequence
  Description of Artificial Sequence: Synthetic oligonucleotide
  Target: ATXN1; (-) strand; PAM type: NRG; PAM sequence: GGG
gacacatgcccagtcttgaa

SEQ ID NO: 53347 - DNA, 20 bp, Artificial Sequence
  Description of Artificial Sequence: Synthetic oligonucleotide
  Target: ATXN1; (-) strand; PAM type: NRG; PAM sequence: AGG
ggacacatgcccagtcttga

SEQ ID NO: 53348 - DNA, 20 bp, Artificial Sequence
  Description of Artificial Sequence: Synthetic oligonucleotide
  Target: ATXN1; (-) strand; PAM type: NRG; PAM sequence: AAG
tggacacatgcccagtcttg

SEQ ID NO: 53349 - DNA, 20 bp, Artificial Sequence
  Description of Artificial Sequence: Synthetic oligonucleotide
  Target: ATXN1; (-) strand; PAM type: NRG; PAM sequence: CAG
agcatcactggacacatgcc

SEQ ID NO: 53350 - DNA, 20 bp, Artificial Sequence
  Description of Artificial Sequence: Synthetic oligonucleotide
  Target: ATXN1; (-) strand; PAM type: NRG; PAM sequence: TGG
tgccagcttcagagcatcac

SEQ ID NO: 53351 - DNA, 20 bp, Artificial Sequence
  Description of Artificial Sequence: Synthetic oligonucleotide
  Target: ATXN1; (-) strand; PAM type: NRG; PAM sequence: GAG
gctcatctttgccagcttca

SEQ ID NO: 53352 - DNA, 20 bp, Artificial Sequence
  Description of Artificial Sequence: Synthetic oligonucleotide
  Target: ATXN1; (-) strand; PAM type: NRG; PAM sequence: CAG
atgctcatctttgccagctt

SEQ ID NO: 53353 - DNA, 20 bp, Artificial Sequence
  Description of Artificial Sequence: Synthetic oligonucleotide
  Target: ATXN1; (-) strand; PAM type: NRG; PAM sequence: CAG
gatttgatgctcatctttgc

SEQ ID NO: 53354 - DNA, 20 bp, Artificial Sequence
  Description of Artificial Sequence: Synthetic oligonucleotide
  Target: ATXN1; (-) strand; PAM type: NRG; PAM sequence: TGG
tcatgctctccatgcacgtc

SEQ ID NO: 53355 - DNA, 20 bp, Artificial Sequence
  Description of Artificial Sequence: Synthetic oligonucleotide
  Target: ATXN1; (-) strand; PAM type: NRG; PAM sequence: CAG
agcctatcacgacggtcgtt

SEQ ID NO: 53356 - DNA, 20 bp, Artificial Sequence
  Description of Artificial Sequence: Synthetic oligonucleotide
  Target: ATXN1; (-) strand; PAM type: NRG; PAM sequence: CGG
ctctgccaagcctatcacga

SEQ ID NO: 53357 - DNA, 20 bp, Artificial Sequence
  Description of Artificial Sequence: Synthetic oligonucleotide
  Target: ATXN1; (-) strand; PAM type: NRG; PAM sequence: AAG
cctctgcttcatcctctgcc

SEQ ID NO: 53358 - DNA, 20 bp, Artificial Sequence
  Description of Artificial Sequence: Synthetic oligonucleotide
  Target: ATXN1; (-) strand; PAM type: NRG; PAM sequence: CGG
ccagcacccaggtagggctc

SEQ ID NO: 53359 - DNA, 20 bp, Artificial Sequence
  Description of Artificial Sequence: Synthetic oligonucleotide
  Target: ATXN1; (-) strand; PAM type: NRG; PAM sequence: GGG
gcagtgccagcacccaggta

SEQ ID NO: 53360 - DNA, 20 bp, Artificial Sequence
  Description of Artificial Sequence: Synthetic oligonucleotide
  Target: ATXN1; (-) strand; PAM type: NRG; PAM sequence: AGG
ggcagtgccagcacccaggt

SEQ ID NO: 53361 - DNA, 20 bp, Artificial Sequence
  Description of Artificial Sequence: Synthetic oligonucleotide
  Target: ATXN1; (-) strand; PAM type: NRG; PAM sequence: TAG
aggcagtgccagcacccagg

SEQ ID NO: 53362 - DNA, 20 bp, Artificial Sequence
  Description of Artificial Sequence: Synthetic oligonucleotide
  Target: ATXN1; (-) strand; PAM type: NRG; PAM sequence: AGG
ccgaggcagtgccagcaccc

SEQ ID NO: 53363 - DNA, 20 bp, Artificial Sequence
  Description of Artificial Sequence: Synthetic oligonucleotide
  Target: ATXN1; (-) strand; PAM type: NRG; PAM sequence: CAG
gccgaggcagtgccagcacc

SEQ ID NO: 53364 - DNA, 20 bp, Artificial Sequence
  Description of Artificial Sequence: Synthetic oligonucleotide
  Target: ATXN1; (-) strand; PAM type: NRG; PAM sequence: CAG
gcaagaggccgaggcagtgc

SEQ ID NO: 53365 - DNA, 20 bp, Artificial Sequence
  Description of Artificial Sequence: Synthetic oligonucleotide
  Target: ATXN1; (-) strand; PAM type: NRG; PAM sequence: CAG
tagtaagcaagaggccgagg

SEQ ID NO: 53366 - DNA, 20 bp, Artificial Sequence
  Description of Artificial Sequence: Synthetic oligonucleotide
  Target: ATXN1; (-) strand; PAM type: NRG; PAM sequence: AGG
tcatagtaagcaagaggccg

SEQ ID NO: 53367 - DNA, 20 bp, Artificial Sequence
  Description of Artificial Sequence: Synthetic oligonucleotide
  Target: ATXN1; (-) strand; PAM type: NRG; PAM sequence: GAG
gtcatagtaagcaagaggcc

SEQ ID NO: 53368 - DNA, 20 bp, Artificial Sequence
  Description of Artificial Sequence: Synthetic oligonucleotide
  Target: ATXN1; (-) strand; PAM type: NRG; PAM sequence: AGG
acggcgtcatagtaagcaag

SEQ ID NO: 53369 - DNA, 20 bp, Artificial Sequence
  Description of Artificial Sequence: Synthetic oligonucleotide
  Target: ATXN1; (-) strand; PAM type: NRG; PAM sequence: GAG
cacggcgtcatagtaagcaa

SEQ ID NO: 53370 - DNA, 20 bp, Artificial Sequence
  Description of Artificial Sequence: Synthetic oligonucleotide
  Target: ATXN1; (-) strand; PAM type: NRG; PAM sequence: AAG
cacacggcgtcatagtaagc

SEQ ID NO: 53371 - DNA, 20 bp, Artificial Sequence
  Description of Artificial Sequence: Synthetic oligonucleotide
  Target: ATXN1; (-) strand; PAM type: NRG; PAM sequence: AAG
gattcacacggcgtcatagt

SEQ ID NO: 53372 - DNA, 20 bp, Artificial Sequence
  Description of Artificial Sequence: Synthetic oligonucleotide
  Target: ATXN1; (-) strand; PAM type: NRG; PAM sequence: TAG
ctgtgattcacacggcgtca

SEQ ID NO: 53373 - DNA, 20 bp, Artificial Sequence
  Description of Artificial Sequence: Synthetic oligonucleotide
  Target: ATXN1; (-) strand; PAM type: NRG; PAM sequence: CGG
gctagatgctgtgattcaca

SEQ ID NO: 53374 - DNA, 20 bp, Artificial Sequence
  Description of Artificial Sequence: Synthetic oligonucleotide
  Target: ATXN1; (-) strand; PAM type: NRG; PAM sequence: TAG
taagggggaaggagggccgc

SEQ ID NO: 53375 - DNA, 20 bp, Artificial Sequence
  Description of Artificial Sequence: Synthetic oligonucleotide
  Target: ATXN1; (-) strand; PAM type: NRG; PAM sequence: GGG
gtcatagtaagggggaagga

SEQ ID NO: 53376 - DNA, 20 bp, Artificial Sequence
  Description of Artificial Sequence: Synthetic oligonucleotide
  Target: ATXN1; (-) strand; PAM type: NRG; PAM sequence: AGG
agtcatagtaagggggaagg

SEQ ID NO: 53377 - DNA, 20 bp, Artificial Sequence
  Description of Artificial Sequence: Synthetic oligonucleotide
  Target: ATXN1; (-) strand; PAM type: NRG; PAM sequence: GAG
aagtcatagtaagggggaag

SEQ ID NO: 53378 - DNA, 20 bp, Artificial Sequence
  Description of Artificial Sequence: Synthetic oligonucleotide
  Target: ATXN1; (-) strand; PAM type: NRG; PAM sequence: AGG
ggaagtcatagtaaggggga

SEQ ID NO: 53379 - DNA, 20 bp, Artificial Sequence
  Description of Artificial Sequence: Synthetic oligonucleotide
  Target: ATXN1; (-) strand; PAM type: NRG; PAM sequence: AAG
tggaagtcatagtaaggggg

SEQ ID NO: 53380 - DNA, 20 bp, Artificial Sequence
  Description of Artificial Sequence: Synthetic oligonucleotide
  Target: ATXN1; (-) strand; PAM type: NRG; PAM sequence: GGG
aattggaagtcatagtaagg

SEQ ID NO: 53381 - DNA, 20 bp, Artificial Sequence
  Description of Artificial Sequence: Synthetic oligonucleotide
  Target: ATXN1; (-) strand; PAM type: NRG; PAM sequence: GGG
aaattggaagtcatagtaag

SEQ ID NO: 53382 - DNA, 20 bp, Artificial Sequence
  Description of Artificial Sequence: Synthetic oligonucleotide
  Target: ATXN1; (-) strand; PAM type: NRG; PAM sequence: GGG
aaaattggaagtcatagtaa

SEQ ID NO: 53383 - DNA, 20 bp, Artificial Sequence
  Description of Artificial Sequence: Synthetic oligonucleotide
  Target: ATXN1; (-) strand; PAM type: NRG; PAM sequence: AGG
caaaattggaagtcatagta

SEQ ID NO: 53384 - DNA, 20 bp, Artificial Sequence
  Description of Artificial Sequence: Synthetic oligonucleotide
  Target: ATXN1; (-) strand; PAM type: NRG; PAM sequence: AAG
tcaaaattggaagtcatagt

SEQ ID NO: 53385 - DNA, 20 bp, Artificial Sequence
  Description of Artificial Sequence: Synthetic oligonucleotide
  Target: ATXN1; (-) strand; PAM type: NRG; PAM sequence: TAG
tatttcaaaattggaagtca

SEQ ID NO: 53386 - DNA, 20 bp, Artificial Sequence
  Description of Artificial Sequence: Synthetic oligonucleotide
  Target: ATXN1; (-) strand; PAM type: NRG; PAM sequence: AAG
tcacagtatttcaaaattgg

SEQ ID NO: 53387 - DNA, 20 bp, Artificial Sequence
  Description of Artificial Sequence: Synthetic oligonucleotide
  Target: ATXN1; (-) strand; PAM type: NRG; PAM sequence: TGG
gagtcacagtatttcaaaat

SEQ ID NO: 53388 - DNA, 20 bp, Artificial Sequence
  Description of Artificial Sequence: Synthetic oligonucleotide
  Target: ATXN1; (-) strand; PAM type: NRG; PAM sequence: CAG
ttaagtacacagcagagtca

SEQ ID NO: 53389 - DNA, 20 bp, Artificial Sequence
  Description of Artificial Sequence: Synthetic oligonucleotide
  Target: ATXN1; (-) strand; PAM type: NRG; PAM sequence: GAG
tgtcaattaagtacacagca

SEQ ID NO: 53390 - DNA, 20 bp, Artificial Sequence
  Description of Artificial Sequence: Synthetic oligonucleotide
  Target: ATXN1; (-) strand; PAM type: NRG; PAM sequence: CAG
gatgtcaattaagtacacag

SEQ ID NO: 53391 - DNA, 20 bp, Artificial Sequence
  Description of Artificial Sequence: Synthetic oligonucleotide
  Target: ATXN1; (-) strand; PAM type: NRG; PAM sequence: CAG
agagatgtcaattaagtaca

SEQ ID NO: 53392 - DNA, 20 bp, Artificial Sequence
  Description of Artificial Sequence: Synthetic oligonucleotide
  Target: ATXN1; (-) strand; PAM type: NRG; PAM sequence: AAG
ttcagaaagagatgtcaatt

SEQ ID NO: 53393 - DNA, 20 bp, Artificial Sequence
  Description of Artificial Sequence: Synthetic oligonucleotide
  Target: ATXN1; (-) strand; PAM type: NRG; PAM sequence: GAG
attgtaaattccttcagaaa

SEQ ID NO: 53394 - DNA, 20 bp, Artificial Sequence
  Description of Artificial Sequence: Synthetic oligonucleotide
  Target: ATXN1; (-) strand; PAM type: NRG; PAM sequence: AAG
ggattgtaaattccttcaga

SEQ ID NO: 53395 - DNA, 20 bp, Artificial Sequence
  Description of Artificial Sequence: Synthetic oligonucleotide
  Target: ATXN1; (-) strand; PAM type: NRG; PAM sequence: CAG
aactggattgtaaattcctt

SEQ ID NO: 53396 - DNA, 20 bp, Artificial Sequence
  Description of Artificial Sequence: Synthetic oligonucleotide
  Target: ATXN1; (-) strand; PAM type: NRG; PAM sequence: TGG
gtgggtcttacatcatcaac

SEQ ID NO: 53397 - DNA, 20 bp, Artificial Sequence
  Description of Artificial Sequence: Synthetic oligonucleotide
  Target: ATXN1; (-) strand; PAM type: NRG; PAM sequence: GGG
tctaattggcttatgatagt

SEQ ID NO: 53398 - DNA, 20 bp, Artificial Sequence
  Description of Artificial Sequence: Synthetic oligonucleotide
  Target: ATXN1; (-) strand; PAM type: NRG; PAM sequence: TGG
ctctaattggcttatgatag

SEQ ID NO: 53399 - DNA, 20 bp, Artificial Sequence
  Description of Artificial Sequence: Synthetic oligonucleotide
  Target: ATXN1; (-) strand; PAM type: NRG; PAM sequence: TAG
gttctctaattggcttatga

SEQ ID NO: 53400 - DNA, 20 bp, Artificial Sequence
  Description of Artificial Sequence: Synthetic oligonucleotide
  Target: ATXN1; (-) strand; PAM type: NRG; PAM sequence: TGG
cacttgtttggttctctaat

SEQ ID NO: 53401 - DNA, 20 bp, Artificial Sequence
  Description of Artificial Sequence: Synthetic oligonucleotide
  Target: ATXN1; (-) strand; PAM type: NRG; PAM sequence: TGG
gggtcccttcagcacttgtt

SEQ ID NO: 53402 - DNA, 20 bp, Artificial Sequence
  Description of Artificial Sequence: Synthetic oligonucleotide
  Target: ATXN1; (-) strand; PAM type: NRG; PAM sequence: CAG
tgcctccataggggtccctt

SEQ ID NO: 53403 - DNA, 20 bp, Artificial Sequence
  Description of Artificial Sequence: Synthetic oligonucleotide
  Target: ATXN1; (-) strand; PAM type: NRG; PAM sequence: GGG
caggttctctgcctccatag

SEQ ID NO: 53404 - DNA, 20 bp, Artificial Sequence
  Description of Artificial Sequence: Synthetic oligonucleotide
  Target: ATXN1; (-) strand; PAM type: NRG; PAM sequence: GGG
tcaggttctctgcctccata

SEQ ID NO: 53405 - DNA, 20 bp, Artificial Sequence
  Description of Artificial Sequence: Synthetic oligonucleotide
  Target: ATXN1; (-) strand; PAM type: NRG; PAM sequence: AGG
ttcaggttctctgcctccat

SEQ ID NO: 53406 - DNA, 20 bp, Artificial Sequence
  Description of Artificial Sequence: Synthetic oligonucleotide
  Target: ATXN1; (-) strand; PAM type: NRG; PAM sequence: TAG
tttcaggttctctgcctcca

SEQ ID NO: 53407 - DNA, 20 bp, Artificial Sequence
  Description of Artificial Sequence: Synthetic oligonucleotide
  Target: ATXN1; (-) strand; PAM type: NRG; PAM sequence: AGG
tagtcttcactgttcatttc

SEQ ID NO: 53408 - DNA, 20 bp, Artificial Sequence
  Description of Artificial Sequence: Synthetic oligonucleotide
  Target: ATXN1; (-) strand; PAM type: NRG; PAM sequence: CAG
ttagtcttcactgttcattt

SEQ ID NO: 53409 - DNA, 20 bp, Artificial Sequence
  Description of Artificial Sequence: Synthetic oligonucleotide
  Target: ATXN1; (-) strand; PAM type: NRG; PAM sequence: TAG
tcacctttgtaagtcagatt

SEQ ID NO: 53410 - DNA, 20 bp, Artificial Sequence
  Description of Artificial Sequence: Synthetic oligonucleotide
  Target: ATXN1; (-) strand; PAM type: NRG; PAM sequence: CAG
tgctcctcacctttgtaagt

SEQ ID NO: 53411 - DNA, 20 bp, Artificial Sequence
  Description of Artificial Sequence: Synthetic oligonucleotide
  Target: ATXN1; (-) strand; PAM type: NRG; PAM sequence: AAG
tccctgctcctcacctttgt

SEQ ID NO: 53412 - DNA, 20 bp, Artificial Sequence
  Description of Artificial Sequence: Synthetic oligonucleotide
  Target: ATXN1; (-) strand; PAM type: NRG; PAM sequence: AAG
tcccagtgcaagcattagga

SEQ ID NO: 53413 - DNA, 20 bp, Artificial Sequence
  Description of Artificial Sequence: Synthetic oligonucleotide
  Target: ATXN1; (-) strand; PAM type: NRG; PAM sequence: AGG
gaaatcccagtgcaagcatt

SEQ ID NO: 53414 - DNA, 20 bp, Artificial Sequence
  Description of Artificial Sequence: Synthetic oligonucleotide
  Target: ATXN1; (-) strand; PAM type: NRG; PAM sequence: TAG
agaaatcccagtgcaagcat

SEQ ID NO: 53415 - DNA, 20 bp, Artificial Sequence
  Description of Artificial Sequence: Synthetic oligonucleotide
  Target: ATXN1; (-) strand; PAM type: NRG; PAM sequence: AAG
ttcgtcagaaatcccagtgc

SEQ ID NO: 53416 - DNA, 20 bp, Artificial Sequence
  Description of Artificial Sequence: Synthetic oligonucleotide
  Target: ATXN1; (-) strand; PAM type: NRG; PAM sequence: CAG
gaggtattcgtcagaaatcc

SEQ ID NO: 53417 - DNA, 20 bp, Artificial Sequence
  Description of Artificial Sequence: Synthetic oligonucleotide
  Target: ATXN1; (-) strand; PAM type: NRG; PAM sequence: CAG
atagcctctgaggtattcgt

SEQ ID NO: 53418 - DNA, 20 bp, Artificial Sequence
  Description of Artificial Sequence: Synthetic oligonucleotide
  Target: ATXN1; (-) strand; PAM type: NRG; PAM sequence: AGG
aaagcccaacatagcctctg

SEQ ID NO: 53419 - DNA, 20 bp, Artificial Sequence
  Description of Artificial Sequence: Synthetic oligonucleotide
  Target: ATXN1; (-) strand; PAM type: NRG; PAM sequence: GAG
aaaagcccaacatagcctct

SEQ ID NO: 53420 - DNA, 20 bp, Artificial Sequence
  Description of Artificial Sequence: Synthetic oligonucleotide
  Target: ATXN1; (-) strand; PAM type: NRG; PAM sequence: TAG
acatcagaaaaagcccaaca

SEQ ID NO: 53421 - DNA, 20 bp, Artificial Sequence
  Description of Artificial Sequence: Synthetic oligonucleotide
  Target: ATXN1; (-) strand; PAM type: NRG; PAM sequence: AAG
aaatatcgctacatcagaaa

SEQ ID NO: 53422 - DNA, 20 bp, Artificial Sequence
  Description of Artificial Sequence: Synthetic oligonucleotide
  Target: ATXN1; (-) strand; PAM type: NRG; PAM sequence: CAG
tctccaaaatatcgctacat

SEQ ID NO: 53423 - DNA, 20 bp, Artificial Sequence
  Description of Artificial Sequence: Synthetic oligonucleotide
  Target: ATXN1; (-) strand; PAM type: NRG; PAM sequence: TGG
aacaggtttagacaaatcac

SEQ ID NO: 53424 - DNA, 20 bp, Artificial Sequence
  Description of Artificial Sequence: Synthetic oligonucleotide
  Target: ATXN1; (-) strand; PAM type: NRG; PAM sequence: TAG
aaagaatcctcaaacaggtt

SEQ ID NO: 53425 - DNA, 20 bp, Artificial Sequence
  Description of Artificial Sequence: Synthetic oligonucleotide
  Target: ATXN1; (-) strand; PAM type: NRG; PAM sequence: AGG
gttagaaagaatcctcaaac

SEQ ID NO: 53426 - DNA, 20 bp, Artificial Sequence
  Description of Artificial Sequence: Synthetic oligonucleotide
  Target: ATXN1; (-) strand; PAM type: NRG; PAM sequence: CAG
tgttagaaagaatcctcaaa

SEQ ID NO: 53427 - DNA, 20 bp, Artificial Sequence
  Description of Artificial Sequence: Synthetic oligonucleotide
  Target: ATXN1; (-) strand; PAM type: NRG; PAM sequence: AAG
gaagggaatgatatgttaga

SEQ ID NO: 53428 - DNA, 20 bp, Artificial Sequence
  Description of Artificial Sequence: Synthetic oligonucleotide
  Target: ATXN1; (-) strand; PAM type: NRG; PAM sequence: TAG
tagggaagggaatgatatgt

SEQ ID NO: 53429 - DNA, 20 bp, Artificial Sequence
  Description of Artificial Sequence: Synthetic oligonucleotide
  Target: ATXN1; (-) strand; PAM type: NRG; PAM sequence: GGG
tattatctttatgtagggaa

SEQ ID NO: 53430 - DNA, 20 bp, Artificial Sequence
  Description of Artificial Sequence: Synthetic oligonucleotide
  Target: ATXN1; (-) strand; PAM type: NRG; PAM sequence: AGG
atattatctttatgtaggga

SEQ ID NO: 53431 - DNA, 20 bp, Artificial Sequence
  Description of Artificial Sequence: Synthetic oligonucleotide
  Target: ATXN1; (-) strand; PAM type: NRG; PAM sequence: AAG
catattatctttatgtaggg

SEQ ID NO: 53432 - DNA, 20 bp, Artificial Sequence
  Description of Artificial Sequence: Synthetic oligonucleotide
  Target: ATXN1; (-) strand; PAM type: NRG; PAM sequence: GGG
ttgcatattatctttatgta

SEQ ID NO: 53433 - DNA, 20 bp, Artificial Sequence
  Description of Artificial Sequence: Synthetic oligonucleotide
  Target: ATXN1; (-) strand; PAM type: NRG; PAM sequence: AGG
tttgcatattatctttatgt

SEQ ID NO: 53434 - DNA, 20 bp, Artificial Sequence
  Description of Artificial Sequence: Synthetic oligonucleotide
  Target: ATXN1; (-) strand; PAM type: NRG; PAM sequence: TAG
ttttgcatattatctttatg

SEQ ID NO: 53435 - DNA, 20 bp, Artificial Sequence
  Description of Artificial Sequence: Synthetic oligonucleotide
  Target: ATXN1; (-) strand; PAM type: NRG; PAM sequence: TGG
aacaaatgattgcacccttt

SEQ ID NO: 53436 - DNA, 20 bp, Artificial Sequence
  Description of Artificial Sequence: Synthetic oligonucleotide
  Target: ATXN1; (-) strand; PAM type: NRG; PAM sequence: TAG
ttagaacataaagaagattc

SEQ ID NO: 53437 - DNA, 20 bp, Artificial Sequence
  Description of Artificial Sequence: Synthetic oligonucleotide
  Target: ATXN1; (-) strand; PAM type: NRG; PAM sequence: AAG
taagactttagaacataaag

SEQ ID NO: 53438 - DNA, 20 bp, Artificial Sequence
  Description of Artificial Sequence: Synthetic oligonucleotide
  Target: ATXN1; (-) strand; PAM type: NRG; PAM sequence: AAG
gattaagactttagaacata

SEQ ID NO: 53439 - DNA, 20 bp, Artificial Sequence
  Description of Artificial Sequence: Synthetic oligonucleotide
  Target: ATXN1; (-) strand; PAM type: NRG; PAM sequence: TAG
gaaatgcatgattaagactt

SEQ ID NO: 53440 - DNA, 20 bp, Artificial Sequence
  Description of Artificial Sequence: Synthetic oligonucleotide
  Target: ATXN1; (-) strand; PAM type: NRG; PAM sequence: AAG
tttgaaagaaatgcatgatt

SEQ ID NO: 53441 - DNA, 20 bp, Artificial Sequence
  Description of Artificial Sequence: Synthetic oligonucleotide
  Target: ATXN1; (-) strand; PAM type: NRG; PAM sequence: AAG
attggaggctcacaatttga

SEQ ID NO: 53442 - DNA, 20 bp, Artificial Sequence
  Description of Artificial Sequence: Synthetic oligonucleotide
  Target: ATXN1; (-) strand; PAM type: NRG; PAM sequence: AGG
acaagcttgtagttcattgg

SEQ ID NO: 53443 - DNA, 20 bp, Artificial Sequence
  Description of Artificial Sequence: Synthetic oligonucleotide
  Target: ATXN1; (-) strand; PAM type: NRG; PAM sequence: GAG
gacaagcttgtagttcattg

SEQ ID NO: 53444 - DNA, 20 bp, Artificial Sequence
  Description of Artificial Sequence: Synthetic oligonucleotide
  Target: ATXN1; (-) strand; PAM type: NRG; PAM sequence: TGG
ctgacaagcttgtagttcat

SEQ ID NO: 53445 - DNA, 20 bp, Artificial Sequence
  Description of Artificial Sequence: Synthetic oligonucleotide
  Target: ATXN1; (-) strand; PAM type: NRG; PAM sequence: TAG
atgtaattctgacaagcttg

SEQ ID NO: 53446 - DNA, 20 bp, Artificial Sequence
  Description of Artificial Sequence: Synthetic oligonucleotide
  Target: ATXN1; (-) strand; PAM type: NRG; PAM sequence: AAG
tgaatagatgtaattctgac

SEQ ID NO: 53447 - DNA, 20 bp, Artificial Sequence
  Description of Artificial Sequence: Synthetic oligonucleotide
  Target: ATXN1; (-) strand; PAM type: NRG; PAM sequence: TAG
gatgttgtatatgacctgaa

SEQ ID NO: 53448 - DNA, 20 bp, Artificial Sequence
  Description of Artificial Sequence: Synthetic oligonucleotide
  Target: ATXN1; (-) strand; PAM type: NRG; PAM sequence: CGG
ttcaaattcactttgctcca

SEQ ID NO: 53449 - DNA, 20 bp, Artificial Sequence
  Description of Artificial Sequence: Synthetic oligonucleotide
  Target: ATXN1; (-) strand; PAM type: NRG; PAM sequence: GAG
acgtactgctacactaagag

SEQ ID NO: 53450 - DNA, 20 bp, Artificial Sequence
  Description of Artificial Sequence: Synthetic oligonucleotide
  Target: ATXN1; (-) strand; PAM type: NRG; PAM sequence: AGG
atacgtactgctacactaag

SEQ ID NO: 53451 - DNA, 20 bp, Artificial Sequence
  Description of Artificial Sequence: Synthetic oligonucleotide
  Target: ATXN1; (-) strand; PAM type: NRG; PAM sequence: GAG
aatacgtactgctacactaa

SEQ ID NO: 53452 - DNA, 20 bp, Artificial Sequence
  Description of Artificial Sequence: Synthetic oligonucleotide
  Target: ATXN1; (-) strand; PAM type: NRG; PAM sequence: AAG
aaaatacgtactgctacact

SEQ ID NO: 53453 - DNA, 20 bp, Artificial Sequence
  Description of Artificial Sequence: Synthetic oligonucleotide
  Target: ATXN1; (-) strand; PAM type: NRG; PAM sequence: TGG
ctattttccatctttagcac

SEQ ID NO: 53454 - DNA, 20 bp, Artificial Sequence
  Description of Artificial Sequence: Synthetic oligonucleotide
  Target: ATXN1; (-) strand; PAM type: NRG; PAM sequence: TAG
acccacctattttccatctt

SEQ ID NO: 53455 - DNA, 20 bp, Artificial Sequence
  Description of Artificial Sequence: Synthetic oligonucleotide
  Target: ATXN1; (-) strand; PAM type: NRG; PAM sequence: TGG
caggcgtgagccactgtgcc

SEQ ID NO: 53456 - DNA, 20 bp, Artificial Sequence
  Description of Artificial Sequence: Synthetic oligonucleotide
  Target: ATXN1; (-) strand; PAM type: NRG; PAM sequence: GAG
agagctgggattacaggcgt

SEQ ID NO: 53457 - DNA, 20 bp, Artificial Sequence
  Description of Artificial Sequence: Synthetic oligonucleotide
  Target: ATXN1; (-) strand; PAM type: NRG; PAM sequence: AGG
tcccaaagagctgggattac

SEQ ID NO: 53458 - DNA, 20 bp, Artificial Sequence
  Description of Artificial Sequence: Synthetic oligonucleotide
  Target: ATXN1; (-) strand; PAM type: NRG; PAM sequence: CAG
ctcccaaagagctgggatta

SEQ ID NO: 53459 - DNA, 20 bp, Artificial Sequence
  Description of Artificial Sequence: Synthetic oligonucleotide
  Target: ATXN1; (-) strand; PAM type: NRG; PAM sequence: GGG
cattggcctcccaaagagct

SEQ ID NO: 53460 - DNA, 20 bp, Artificial Sequence
  Description of Artificial Sequence: Synthetic oligonucleotide
  Target: ATXN1; (-) strand; PAM type: NRG; PAM sequence: TGG
gcattggcctcccaaagagc

SEQ ID NO: 53461 - DNA, 20 bp, Artificial Sequence
  Description of Artificial Sequence: Synthetic oligonucleotide
  Target: ATXN1; (-) strand; PAM type: NRG; PAM sequence: GAG
gcctgcattggcctcccaaa

SEQ ID NO: 53462 - DNA, 20 bp, Artificial Sequence
  Description of Artificial Sequence: Synthetic oligonucleotide
  Target: ATXN1; (-) strand; PAM type: NRG; PAM sequence: AAG
ccgcctgcattggcctccca

SEQ ID NO: 53463 - DNA, 20 bp, Artificial Sequence
  Description of Artificial Sequence: Synthetic oligonucleotide
  Target: ATXN1; (-) strand; PAM type: NRG; PAM sequence: TGG
ctcaagtgatccgcctgcat

SEQ ID NO: 53464 - DNA, 20 bp, Artificial Sequence
  Description of Artificial Sequence: Synthetic oligonucleotide
  Target: ATXN1; (-) strand; PAM type: NRG; PAM sequence: AAG
ggtctcaaactcctggcctc

SEQ ID NO: 53465 - DNA, 20 bp, Artificial Sequence
  Description of Artificial Sequence: Synthetic oligonucleotide
  Target: ATXN1; (-) strand; PAM type: NRG; PAM sequence: TGG
ccaggatggtctcaaactcc

SEQ ID NO: 53466 - DNA, 20 bp, Artificial Sequence
  Description of Artificial Sequence: Synthetic oligonucleotide
  Target: ATXN1; (-) strand; PAM type: NRG; PAM sequence: TGG
tttcagcatgttggccagga

SEQ ID NO: 53467 - DNA, 20 bp, Artificial Sequence
  Description of Artificial Sequence: Synthetic oligonucleotide
  Target: ATXN1; (-) strand; PAM type: NRG; PAM sequence: AGG
gtggtttcagcatgttggcc

SEQ ID NO: 53468 - DNA, 20 bp, Artificial Sequence
  Description of Artificial Sequence: Synthetic oligonucleotide
  Target: ATXN1; (-) strand; PAM type: NRG; PAM sequence: CAG
cgtggtttcagcatgttggc

SEQ ID NO: 53469 - DNA, 20 bp, Artificial Sequence
  Description of Artificial Sequence: Synthetic oligonucleotide
  Target: ATXN1; (-) strand; PAM type: NRG; PAM sequence: TGG
gagacgtggtttcagcatgt

SEQ ID NO: 53470 - DNA, 20 bp, Artificial Sequence
  Description of Artificial Sequence: Synthetic oligonucleotide
  Target: ATXN1; (-) strand; PAM type: NRG; PAM sequence: CAG
ttttggtagagacgtggttt

SEQ ID NO: 53471 - DNA, 20 bp, Artificial Sequence
  Description of Artificial Sequence: Synthetic oligonucleotide
  Target: ATXN1; (-) strand; PAM type: NRG; PAM sequence: TGG
ttgtatttttggtagagacg

SEQ ID NO: 53472 - DNA, 20 bp, Artificial Sequence
  Description of Artificial Sequence: Synthetic oligonucleotide
  Target: ATXN1; (-) strand; PAM type: NRG; PAM sequence: GAG
taatttttgtatttttggta

SEQ ID NO: 53473 - DNA, 20 bp, Artificial Sequence
  Description of Artificial Sequence: Synthetic oligonucleotide
  Target: ATXN1; (-) strand; PAM type: NRG; PAM sequence: TAG
gctaatttttgtatttttgg

SEQ ID NO: 53474 - DNA, 20 bp, Artificial Sequence
  Description of Artificial Sequence: Synthetic oligonucleotide
  Target: ATXN1; (-) strand; PAM type: NRG; PAM sequence: TGG
acggctaatttttgtatttt

SEQ ID NO: 53475 - DNA, 20 bp, Artificial Sequence
  Description of Artificial Sequence: Synthetic oligonucleotide
  Target: ATXN1; (-) strand; PAM type: NRG; PAM sequence: CGG
caggcatgtgctactacaca

SEQ ID NO: 53476 - DNA, 20 bp, Artificial Sequence
  Description of Artificial Sequence: Synthetic oligonucleotide
  Target: ATXN1; (-) strand; PAM type: NRG; PAM sequence: AGG
tcccaagtagctgaaactac

SEQ ID NO: 53477 - DNA, 20 bp, Artificial Sequence
  Description of Artificial Sequence: Synthetic oligonucleotide
  Target: ATXN1; (-) strand; PAM type: NRG; PAM sequence: CAG
ctcccaagtagctgaaacta

SEQ ID NO: 53478 - DNA, 20 bp, Artificial Sequence
  Description of Artificial Sequence: Synthetic oligonucleotide
  Target: ATXN1; (-) strand; PAM type: NRG; PAM sequence: TAG
tcctgcctcagcctcccaag

SEQ ID NO: 53479 - DNA, 20 bp, Artificial Sequence
  Description of Artificial Sequence: Synthetic oligonucleotide
  Target: ATXN1; (-) strand; PAM type: NRG; PAM sequence: AAG
ttctcctgcctcagcctccc

SEQ ID NO: 53480 - DNA, 20 bp, Artificial Sequence
  Description of Artificial Sequence: Synthetic oligonucleotide
  Target: ATXN1; (-) strand; PAM type: NRG; PAM sequence: CAG
ttcaagcaattctcctgcct

SEQ ID NO: 53481 - DNA, 20 bp, Artificial Sequence
  Description of Artificial Sequence: Synthetic oligonucleotide
  Target: ATXN1; (-) strand; PAM type: NRG; PAM sequence: AAG
aacctccgcctcccaggttc

SEQ ID NO: 53482 - DNA, 20 bp, Artificial Sequence
  Description of Artificial Sequence: Synthetic oligonucleotide
  Target: ATXN1; (-) strand; PAM type: NRG; PAM sequence: AGG
cactgcaacctccgcctccc

SEQ ID NO: 53483 - DNA, 20 bp, Artificial Sequence
  Description of Artificial Sequence: Synthetic oligonucleotide
  Target: ATXN1; (-) strand; PAM type: NRG; PAM sequence: CAG
tcactgcaacctccgcctcc

SEQ ID NO: 53484 - DNA, 20 bp, Artificial Sequence
  Description of Artificial Sequence: Synthetic oligonucleotide
  Target: ATXN1; (-) strand; PAM type: NRG; PAM sequence: CAG
ggagtgccgtggtgtgatct

SEQ ID NO: 53485 - DNA, 20 bp, Artificial Sequence
  Description of Artificial Sequence: Synthetic oligonucleotide
  Target: ATXN1; (-) strand; PAM type: NRG; PAM sequence: TGG
tcacccaggctggagtgccg

SEQ ID NO: 53486 - DNA, 20 bp, Artificial Sequence
  Description of Artificial Sequence: Synthetic oligonucleotide
  Target: ATXN1; (-) strand; PAM type: NRG; PAM sequence: GAG
tcactctgtcacccaggctg

SEQ ID NO: 53487 - DNA, 20 bp, Artificial Sequence
  Description of Artificial Sequence: Synthetic oligonucleotide
  Target: ATXN1; (-) strand; PAM type: NRG; PAM sequence: TGG
tctcactctgtcacccaggc

SEQ ID NO: 53488 - DNA, 20 bp, Artificial Sequence
  Description of Artificial Sequence: Synthetic oligonucleotide
  Target: ATXN1; (-) strand; PAM type: NRG; PAM sequence: AGG
gaggtctcactctgtcaccc

SEQ ID NO: 53489 - DNA, 20 bp, Artificial Sequence
  Description of Artificial Sequence: Synthetic oligonucleotide
  Target: ATXN1; (-) strand; PAM type: NRG; PAM sequence: CAG
agaggtctcactctgtcacc

SEQ ID NO: 53490 - DNA, 20 bp, Artificial Sequence
  Description of Artificial Sequence: Synthetic oligonucleotide
  Target: ATXN1; (-) strand; PAM type: NRG; PAM sequence: AGG
tttttttttttttgacacag

SEQ ID NO: 53491 - DNA, 20 bp, Artificial Sequence
  Description of Artificial Sequence: Synthetic oligonucleotide
  Target: ATXN1; (-) strand; PAM type: NRG; PAM sequence: GAG
ttttttttttttttgacaca

SEQ ID NO: 53492 - DNA, 20 bp, Artificial Sequence
  Description of Artificial Sequence: Synthetic oligonucleotide
  Target: ATXN1; (-) strand; PAM type: NRG; PAM sequence: CAG
ttttttttttttttttgaca

SEQ ID NO: 53493 - DNA, 20 bp, Artificial Sequence
  Description of Artificial Sequence: Synthetic oligonucleotide
  Target: ATXN1; (-) strand; PAM type: NRG; PAM sequence: AGG
tgatttcagcaagcatcttt

SEQ ID NO: 53494 - DNA, 20 bp, Artificial Sequence
  Description of Artificial Sequence: Synthetic oligonucleotide
  Target: ATXN1; (-) strand; PAM type: NRG; PAM sequence: TAG
ctgatttcagcaagcatctt

SEQ ID NO: 53495 - DNA, 20 bp, Artificial Sequence
  Description of Artificial Sequence: Synthetic oligonucleotide
  Target: ATXN1; (-) strand; PAM type: NRG; PAM sequence: AAG
gactaatagctgatttcagc

SEQ ID NO: 53496 - DNA, 20 bp, Artificial Sequence
  Description of Artificial Sequence: Synthetic oligonucleotide
  Target: ATXN1; (-) strand; PAM type: NRG; PAM sequence: CAG
aacagactaatagctgattt

SEQ ID NO: 53497 - DNA, 20 bp, Artificial Sequence
  Description of Artificial Sequence: Synthetic oligonucleotide
  Target: ATXN1; (-) strand; PAM type: NRG; PAM sequence: TAG
tcctgaagagaacagactaa

SEQ ID NO: 53498 - DNA, 20 bp, Artificial Sequence
  Description of Artificial Sequence: Synthetic oligonucleotide
  Target: ATXN1; (-) strand; PAM type: NRG; PAM sequence: CAG
tgtcattttcctgaagagaa

SEQ ID NO: 53499 - DNA, 20 bp, Artificial Sequence
  Description of Artificial Sequence: Synthetic oligonucleotide
  Target: ATXN1; (-) strand; PAM type: NRG; PAM sequence: GAG
taatatgtcattttcctgaa

SEQ ID NO: 53500 - DNA, 20 bp, Artificial Sequence
  Description of Artificial Sequence: Synthetic oligonucleotide
  Target: ATXN1; (-) strand; PAM type: NRG; PAM sequence: AAG
cataatatgtcattttcctg

SEQ ID NO: 53501 - DNA, 20 bp, Artificial Sequence
  Description of Artificial Sequence: Synthetic oligonucleotide
  Target: ATXN1; (-) strand; PAM type: NRG; PAM sequence: TAG
gagtcaataagacataaaat

SEQ ID NO: 53502 - DNA, 20 bp, Artificial Sequence
  Description of Artificial Sequence: Synthetic oligonucleotide
  Target: ATXN1; (-) strand; PAM type: NRG; PAM sequence: AAG
agccataccttagagtcaat

SEQ ID NO: 53503 - DNA, 20 bp, Artificial Sequence
  Description of Artificial Sequence: Synthetic oligonucleotide
  Target: ATXN1; (-) strand; PAM type: NRG; PAM sequence: GAG
atagagatagccatacctta

SEQ ID NO: 53504 - DNA, 20 bp, Artificial Sequence
  Description of Artificial Sequence: Synthetic oligonucleotide
  Target: ATXN1; (-) strand; PAM type: NRG; PAM sequence: TAG
aaatagagatagccatacct

SEQ ID NO: 53505 - DNA, 20 bp, Artificial Sequence
  Description of Artificial Sequence: Synthetic oligonucleotide
  Target: ATXN1; (-) strand; PAM type: NRG; PAM sequence: TAG
gaggtagtagtaaatagaga

SEQ ID NO: 53506 - DNA, 20 bp, Artificial Sequence
  Description of Artificial Sequence: Synthetic oligonucleotide
  Target: ATXN1; (-) strand; PAM type: NRG; PAM sequence: GAG
atatgaggtagtagtaaata

SEQ ID NO: 53507 - DNA, 20 bp, Artificial Sequence
  Description of Artificial Sequence: Synthetic oligonucleotide
  Target: ATXN1; (-) strand; PAM type: NRG; PAM sequence: TAG
tcatatgaggtagtagtaaa

SEQ ID NO: 53508 - DNA, 20 bp, Artificial Sequence
  Description of Artificial Sequence: Synthetic oligonucleotide
  Target: ATXN1; (-) strand; PAM type: NRG; PAM sequence: TAG
attaaagtcatatgaggtag

SEQ ID NO: 53509 - DNA, 20 bp, Artificial Sequence
  Description of Artificial Sequence: Synthetic oligonucleotide
  Target: ATXN1; (-) strand; PAM type: NRG; PAM sequence: TAG
aatattaaagtcatatgagg

SEQ ID NO: 53510 - DNA, 20 bp, Artificial Sequence
  Description of Artificial Sequence: Synthetic oligonucleotide
  Target: ATXN1; (-) strand; PAM type: NRG; PAM sequence: AGG
atcaatattaaagtcatatg

SEQ ID NO: 53511 - DNA, 20 bp, Artificial Sequence
  Description of Artificial Sequence: Synthetic oligonucleotide
  Target: ATXN1; (-) strand; PAM type: NRG; PAM sequence: GAG
tatcaatattaaagtcatat

SEQ ID NO: 53512 - DNA, 20 bp, Artificial Sequence
  Description of Artificial Sequence: Synthetic oligonucleotide
  Target: ATXN1; (-) strand; PAM type: NRG; PAM sequence: AAG
ttaattcaatatcaatatta

SEQ ID NO: 53513 - DNA, 20 bp, Artificial Sequence
  Description of Artificial Sequence: Synthetic oligonucleotide
  Target: ATXN1; (-) strand; PAM type: NRG; PAM sequence: CAG
gcatacttactaatgtacta

SEQ ID NO: 53514 - DNA, 20 bp, Artificial Sequence
  Description of Artificial Sequence: Synthetic oligonucleotide
  Target: ATXN1; (-) strand; PAM type: NRG; PAM sequence: GGG
ctgagtaccacctataaaca

SEQ ID NO: 53515 - DNA, 20 bp, Artificial Sequence
  Description of Artificial Sequence: Synthetic oligonucleotide
  Target: ATXN1; (-) strand; PAM type: NRG; PAM sequence: AGG
tctgagtaccacctataaac

SEQ ID NO: 53516 - DNA, 20 bp, Artificial Sequence
  Description of Artificial Sequence: Synthetic oligonucleotide
  Target: ATXN1; (-) strand; PAM type: NRG; PAM sequence: CAG
ctctgagtaccacctataaa

SEQ ID NO: 53517 - DNA, 20 bp, Artificial Sequence
  Description of Artificial Sequence: Synthetic oligonucleotide
  Target: ATXN1; (-) strand; PAM type: NRG; PAM sequence: GAG
aacaaccctgggccttctct

SEQ ID NO: 53518 - DNA, 20 bp, Artificial Sequence
  Description of Artificial Sequence: Synthetic oligonucleotide
  Target: ATXN1; (-) strand; PAM type: NRG; PAM sequence: GGG
cagttggcaccaacaaccct

SEQ ID NO: 53519 - DNA, 20 bp, Artificial Sequence
  Description of Artificial Sequence: Synthetic oligonucleotide
  Target: ATXN1; (-) strand; PAM type: NRG; PAM sequence: TGG
ccagttggcaccaacaaccc

SEQ ID NO: 53520 - DNA, 20 bp, Artificial Sequence
  Description of Artificial Sequence: Synthetic oligonucleotide
  Target: ATXN1; (-) strand; PAM type: NRG; PAM sequence: TGG
agatataaactttttccagt

SEQ ID NO: 53521 - DNA, 20 bp, Artificial Sequence
  Description of Artificial Sequence: Synthetic oligonucleotide
  Target: ATXN1; (-) strand; PAM type: NRG; PAM sequence: CAG
aatcagatataaactttttc

SEQ ID NO: 53522 - DNA, 20 bp, Artificial Sequence
  Description of Artificial Sequence: Synthetic oligonucleotide
  Target: ATXN1; (-) strand; PAM type: NRG; PAM sequence: CAG
aatgttgctattaatataat

SEQ ID NO: 53523 - DNA, 20 bp, Artificial Sequence
  Description of Artificial Sequence: Synthetic oligonucleotide
  Target: ATXN1; (-) strand; PAM type: NRG; PAM sequence: CAG
actatgccagggcaaaatgc

SEQ ID NO: 53524 - DNA, 20 bp, Artificial Sequence
  Description of Artificial Sequence: Synthetic oligonucleotide
  Target: ATXN1; (-) strand; PAM type: NRG; PAM sequence: GGG
gaaggtaaaaaactatgcca

SEQ ID NO: 53525 - DNA, 20 bp, Artificial Sequence
  Description of Artificial Sequence: Synthetic oligonucleotide
  Target: ATXN1; (-) strand; PAM type: NRG; PAM sequence: AGG
agaaggtaaaaaactatgcc

SEQ ID NO: 53526 - DNA, 20 bp, Artificial Sequence
  Description of Artificial Sequence: Synthetic oligonucleotide
  Target: ATXN1; (-) strand; PAM type: NRG; PAM sequence: CAG
aagaaggtaaaaaactatgc

SEQ ID NO: 53527 - DNA, 20 bp, Artificial Sequence
  Description of Artificial Sequence: Synthetic oligonucleotide
  Target: ATXN1; (-) strand; PAM type: NRG; PAM sequence: AGG
tttttttttaaccttcaaga

SEQ ID NO: 53528 - DNA, 20 bp, Artificial Sequence
  Description of Artificial Sequence: Synthetic oligonucleotide
  Target: ATXN1; (-) strand; PAM type: NRG; PAM sequence: AAG
ttttttttttaaccttcaag

SEQ ID NO: 53529 - DNA, 20 bp, Artificial Sequence
  Description of Artificial Sequence: Synthetic oligonucleotide
  Target: ATXN1; (-) strand; PAM type: NRG; PAM sequence: AAG
attttttttttttaaccttc

SEQ ID NO: 53530 - DNA, 20 bp, Artificial Sequence
  Description of Artificial Sequence: Synthetic oligonucleotide
  Target: ATXN1; (-) strand; PAM type: NRG; PAM sequence: GAG
taaatcctgatgcagccagg

SEQ ID NO: 53531 - DNA, 20 bp, Artificial Sequence
  Description of Artificial Sequence: Synthetic oligonucleotide
  Target: ATXN1; (-) strand; PAM type: NRG; PAM sequence: GGG
cttaaatcctgatgcagcca

SEQ ID NO: 53532 - DNA, 20 bp, Artificial Sequence
  Description of Artificial Sequence: Synthetic oligonucleotide
  Target: ATXN1; (-) strand; PAM type: NRG; PAM sequence: AGG
tcttaaatcctgatgcagcc

SEQ ID NO: 53533 - DNA, 20 bp, Artificial Sequence
  Description of Artificial Sequence: Synthetic oligonucleotide
  Target: ATXN1; (-) strand; PAM type: NRG; PAM sequence: CAG
gtcttaaatcctgatgcagc

SEQ ID NO: 53534 - DNA, 20 bp, Artificial Sequence
  Description of Artificial Sequence: Synthetic oligonucleotide
  Target: ATXN1; (-) strand; PAM type: NRG; PAM sequence: CAG
caatgtcttaaatcctgatg

SEQ ID NO: 53535 - DNA, 20 bp, Artificial Sequence
  Description of Artificial Sequence: Synthetic oligonucleotide
  Target: ATXN1; (-) strand; PAM type: NRG; PAM sequence: AAG
cccaggccagctatgggcag

SEQ ID NO: 53536 - DNA, 20 bp, Artificial Sequence
  Description of Artificial Sequence: Synthetic oligonucleotide
  Target: ATXN1; (-) strand; PAM type: NRG; PAM sequence: CAG
tcccccaggccagctatggg

SEQ ID NO: 53537 - DNA, 20 bp, Artificial Sequence
  Description of Artificial Sequence: Synthetic oligonucleotide
  Target: ATXN1; (-) strand; PAM type: NRG; PAM sequence: GGG
ttctcccccaggccagctat

SEQ ID NO: 53538 - DNA, 20 bp, Artificial Sequence
  Description of Artificial Sequence: Synthetic oligonucleotide
  Target: ATXN1; (-) strand; PAM type: NRG; PAM sequence: TGG
tttctcccccaggccagcta

SEQ ID NO: 53539 - DNA, 20 bp, Artificial Sequence
  Description of Artificial Sequence: Synthetic oligonucleotide
  Target: ATXN1; (-) strand; PAM type: NRG; PAM sequence: CAG
cattcatttctcccccaggc

SEQ ID NO: 53540 - DNA, 20 bp, Artificial Sequence
  Description of Artificial Sequence: Synthetic oligonucleotide
  Target: ATXN1; (-) strand; PAM type: NRG; PAM sequence: AGG
gtgacattcatttctccccc

SEQ ID NO: 53541 - DNA, 20 bp, Artificial Sequence
  Description of Artificial Sequence: Synthetic oligonucleotide
  Target: ATXN1; (-) strand; PAM type: NRG; PAM sequence: CAG
ggtgacattcatttctcccc

SEQ ID NO: 53542 - DNA, 20 bp, Artificial Sequence
  Description of Artificial Sequence: Synthetic oligonucleotide
  Target: ATXN1; (-) strand; PAM type: NRG; PAM sequence: CGG
agccagccacatccatacta

SEQ ID NO: 53543 - DNA, 20 bp, Artificial Sequence
  Description of Artificial Sequence: Synthetic oligonucleotide
  Target: ATXN1; (-) strand; PAM type: NRG; PAM sequence: CAG
tctctcttcacactgtgagc

SEQ ID NO: 53544 - DNA, 20 bp, Artificial Sequence
  Description of Artificial Sequence: Synthetic oligonucleotide
  Target: ATXN1; (-) strand; PAM type: NRG; PAM sequence: GAG
gtcttctctcttcacactgt

SEQ ID NO: 53545 - DNA, 20 bp, Artificial Sequence
  Description of Artificial Sequence: Synthetic oligonucleotide
  Target: ATXN1; (-) strand; PAM type: NRG; PAM sequence: AGG
gctgtgaatgactggaaaca

SEQ ID NO: 53546 - DNA, 20 bp, Artificial Sequence
  Description of Artificial Sequence: Synthetic oligonucleotide
  Target: ATXN1; (-) strand; PAM type: NRG; PAM sequence: AAG
ggctgtgaatgactggaaac

SEQ ID NO: 53547 - DNA, 20 bp, Artificial Sequence
  Description of Artificial Sequence: Synthetic oligonucleotide
  Target: ATXN1; (-) strand; PAM type: NRG; PAM sequence: TGG
tcaacagggctgtgaatgac

SEQ ID NO: 53548 - DNA, 20 bp, Artificial Sequence
  Description of Artificial Sequence: Synthetic oligonucleotide
  Target: ATXN1; (-) strand; PAM type: NRG; PAM sequence: GGG
catgaaggtatatctcaaca

SEQ ID NO: 53549 - DNA, 20 bp, Artificial Sequence
  Description of Artificial Sequence: Synthetic oligonucleotide
  Target: ATXN1; (-) strand; PAM type: NRG; PAM sequence: AGG
gcatgaaggtatatctcaac

SEQ ID NO: 53550 - DNA, 20 bp, Artificial Sequence
  Description of Artificial Sequence: Synthetic oligonucleotide
  Target: ATXN1; (-) strand; PAM type: NRG; PAM sequence: CAG
ggcatgaaggtatatctcaa

SEQ ID NO: 53551 - DNA, 20 bp, Artificial Sequence
  Description of Artificial Sequence: Synthetic oligonucleotide
  Target: ATXN1; (-) strand; PAM type: NRG; PAM sequence: AGG
ggtgaaggaattaggcatga

SEQ ID NO: 53552 - DNA, 20 bp, Artificial Sequence
  Description of Artificial Sequence: Synthetic oligonucleotide
  Target: ATXN1; (-) strand; PAM type: NRG; PAM sequence: AAG
gggtgaaggaattaggcatg

SEQ ID NO: 53553 - DNA, 20 bp, Artificial Sequence
  Description of Artificial Sequence: Synthetic oligonucleotide
  Target: ATXN1; (-) strand; PAM type: NRG; PAM sequence: AGG
cttcagagggtgaaggaatt

SEQ ID NO: 53554 - DNA, 20 bp, Artificial Sequence
  Description of Artificial Sequence: Synthetic oligonucleotide
  Target: ATXN1; (-) strand; PAM type: NRG; PAM sequence: TAG
acttcagagggtgaaggaat

SEQ ID NO: 53555 - DNA, 20 bp, Artificial Sequence
  Description of Artificial Sequence: Synthetic oligonucleotide
  Target: ATXN1; (-) strand; PAM type: NRG; PAM sequence: AGG
tgttggacttcagagggtga

SEQ ID NO: 53556 - DNA, 20 bp, Artificial Sequence
  Description of Artificial Sequence: Synthetic oligonucleotide
  Target: ATXN1; (-) strand; PAM type: NRG; PAM sequence: AAG
atgttggacttcagagggtg

SEQ ID NO: 53557 - DNA, 20 bp, Artificial Sequence
  Description of Artificial Sequence: Synthetic oligonucleotide
  Target: ATXN1; (-) strand; PAM type: NRG; PAM sequence: GGG
aaataatgttggacttcaga

SEQ ID NO: 53558 - DNA, 20 bp, Artificial Sequence
  Description of Artificial Sequence: Synthetic oligonucleotide
  Target: ATXN1; (-) strand; PAM type: NRG; PAM sequence: AGG
taaataatgttggacttcag

SEQ ID NO: 53559 - DNA, 20 bp, Artificial Sequence
  Description of Artificial Sequence: Synthetic oligonucleotide
  Target: ATXN1; (-) strand; PAM type: NRG; PAM sequence: GAG
ttaaataatgttggacttca

SEQ ID NO: 53560 - DNA, 20 bp, Artificial Sequence
  Description of Artificial Sequence: Synthetic oligonucleotide
  Target: ATXN1; (-) strand; PAM type: NRG; PAM sequence: CAG
aattaaataatgttggactt

SEQ ID NO: 53561 - DNA, 20 bp, Artificial Sequence
  Description of Artificial Sequence: Synthetic oligonucleotide
  Target: ATXN1; (-) strand; PAM type: NRG; PAM sequence: TGG
tcttatcaattaaataatgt

SEQ ID NO: 53562 - DNA, 20 bp, Artificial Sequence
  Description of Artificial Sequence: Synthetic oligonucleotide
  Target: ATXN1; (-) strand; PAM type: NRG; PAM sequence: TGG
acaaaggacaagatgatatg

SEQ ID NO: 53563 - DNA, 20 bp, Artificial Sequence
  Description of Artificial Sequence: Synthetic oligonucleotide
  Target: ATXN1; (-) strand; PAM type: NRG; PAM sequence: AAG
acaacttaaacacaaaggac

SEQ ID NO: 53564 - DNA, 20 bp, Artificial Sequence
  Description of Artificial Sequence: Synthetic oligonucleotide
  Target: ATXN1; (-) strand; PAM type: NRG; PAM sequence: AGG
taagaacaacttaaacacaa

SEQ ID NO: 53565 - DNA, 20 bp, Artificial Sequence
  Description of Artificial Sequence: Synthetic oligonucleotide
  Target: ATXN1; (-) strand; PAM type: NRG; PAM sequence: AAG
ataagaacaacttaaacaca

SEQ ID NO: 53566 - DNA, 20 bp, Artificial Sequence
  Description of Artificial Sequence: Synthetic oligonucleotide
  Target: ATXN1; (-) strand; PAM type: NRG; PAM sequence: AAG
gataagacatacatattaat

SEQ ID NO: 53567 - DNA, 20 bp, Artificial Sequence
  Description of Artificial Sequence: Synthetic oligonucleotide
  Target: ATXN1; (-) strand; PAM type: NRG; PAM sequence: AAG
gacaatctactaagggagat

SEQ ID NO: 53568 - DNA, 20 bp, Artificial Sequence
  Description of Artificial Sequence: Synthetic oligonucleotide
  Target: ATXN1; (-) strand; PAM type: NRG; PAM sequence: GAG
aagctgacaatctactaagg

SEQ ID NO: 53569 - DNA, 20 bp, Artificial Sequence
  Description of Artificial Sequence: Synthetic oligonucleotide
  Target: ATXN1; (-) strand; PAM type: NRG; PAM sequence: GGG
agaagctgacaatctactaa

SEQ ID NO: 53570 - DNA, 20 bp, Artificial Sequence
  Description of Artificial Sequence: Synthetic oligonucleotide
  Target: ATXN1; (-) strand; PAM type: NRG; PAM sequence: AGG
aagaagctgacaatctacta

SEQ ID NO: 53571 - DNA, 20 bp, Artificial Sequence
  Description of Artificial Sequence: Synthetic oligonucleotide
  Target: ATXN1; (-) strand; PAM type: NRG; PAM sequence: AAG
caagaagctgacaatctact

SEQ ID NO: 53572 - DNA, 20 bp, Artificial Sequence
  Description of Artificial Sequence: Synthetic oligonucleotide
  Target: ATXN1; (-) strand; PAM type: NRG; PAM sequence: AAG
acattcaagataacctcaag

SEQ ID NO: 53573 - DNA, 20 bp, Artificial Sequence
  Description of Artificial Sequence: Synthetic oligonucleotide
  Target: ATXN1; (-) strand; PAM type: NRG; PAM sequence: AAG
aaaacattcaagataacctc

SEQ ID NO: 53574 - DNA, 20 bp, Artificial Sequence
  Description of Artificial Sequence: Synthetic oligonucleotide
  Target: ATXN1; (-) strand; PAM type: NRG; PAM sequence: AAG
agagctgagttaaaacattc

SEQ ID NO: 53575 - DNA, 20 bp, Artificial Sequence
  Description of Artificial Sequence: Synthetic oligonucleotide
  Target: ATXN1; (-) strand; PAM type: NRG; PAM sequence: GAG
atagtgcgagagagagagct

SEQ ID NO: 53576 - DNA, 20 bp, Artificial Sequence
  Description of Artificial Sequence: Synthetic oligonucleotide
  Target: ATXN1; (-) strand; PAM type: NRG; PAM sequence: GAG
gcaagatagtgcgagagaga

SEQ ID NO: 53577 - DNA, 20 bp, Artificial Sequence
  Description of Artificial Sequence: Synthetic oligonucleotide
  Target: ATXN1; (-) strand; PAM type: NRG; PAM sequence: GAG
aagcaagatagtgcgagaga

SEQ ID NO: 53578 - DNA, 20 bp, Artificial Sequence
  Description of Artificial Sequence: Synthetic oligonucleotide
  Target: ATXN1; (-) strand; PAM type: NRG; PAM sequence: GAG
ctaagcaagatagtgcgaga

SEQ ID NO: 53579 - DNA, 20 bp, Artificial Sequence
  Description of Artificial Sequence: Synthetic oligonucleotide
  Target: ATXN1; (-) strand; PAM type: NRG; PAM sequence: GAG
ccctaagcaagatagtgcga

SEQ ID NO: 53580 - DNA, 20 bp, Artificial Sequence
  Description of Artificial Sequence: Synthetic oligonucleotide
  Target: ATXN1; (-) strand; PAM type: NRG; PAM sequence: GAG
ttccctaagcaagatagtgc

SEQ ID NO: 53581 - DNA, 20 bp, Artificial Sequence
  Description of Artificial Sequence: Synthetic oligonucleotide
  Target: ATXN1; (-) strand; PAM type: NRG; PAM sequence: TAG
ggtgtcttccctaagcaaga

SEQ ID NO: 53582 - DNA, 20 bp, Artificial Sequence
  Description of Artificial Sequence: Synthetic oligonucleotide
  Target: ATXN1; (-) strand; PAM type: NRG; PAM sequence: AAG
attgggtgtcttccctaagc

SEQ ID NO: 53583 - DNA, 20 bp, Artificial Sequence
  Description of Artificial Sequence: Synthetic oligonucleotide
  Target: ATXN1; (-) strand; PAM type: NRG; PAM sequence: AAG
atttattgggtgtcttccct

SEQ ID NO: 53584 - DNA, 20 bp, Artificial Sequence
  Description of Artificial Sequence: Synthetic oligonucleotide
  Target: ATXN1; (-) strand; PAM type: NRG; PAM sequence: GGG
gtcttcaactaatatttatt

SEQ ID NO: 53585 - DNA, 20 bp, Artificial Sequence
  Description of Artificial Sequence: Synthetic oligonucleotide
  Target: ATXN1; (-) strand; PAM type: NRG; PAM sequence: TGG
tgtcttcaactaatatttat

SEQ ID NO: 53586 - DNA, 20 bp, Artificial Sequence
  Description of Artificial Sequence: Synthetic oligonucleotide
  Target: ATXN1; (-) strand; PAM type: NRG; PAM sequence: TGG
tatacagtacttcatgcact

SEQ ID NO: 53587 - DNA, 20 bp, Artificial Sequence
  Description of Artificial Sequence: Synthetic oligonucleotide
  Target: ATXN1; (-) strand; PAM type: NRG; PAM sequence: CAG
ccttatttagcaagcctata

SEQ ID NO: 53588 - DNA, 20 bp, Artificial Sequence
  Description of Artificial Sequence: Synthetic oligonucleotide
  Target: ATXN1; (-) strand; PAM type: NRG; PAM sequence: AAG
ttttactgcccttatttagc

SEQ ID NO: 53589 - DNA, 20 bp, Artificial Sequence
  Description of Artificial Sequence: Synthetic oligonucleotide
  Target: ATXN1; (-) strand; PAM type: NRG; PAM sequence: TAG
gcatttttactgcccttatt

SEQ ID NO: 53590 - DNA, 20 bp, Artificial Sequence
  Description of Artificial Sequence: Synthetic oligonucleotide
  Target: ATXN1; (-) strand; PAM type: NRG; PAM sequence: TGG
aatttgcctacaagatccaa

SEQ ID NO: 53591 - DNA, 20 bp, Artificial Sequence
  Description of Artificial Sequence: Synthetic oligonucleotide
  Target: ATXN1; (-) strand; PAM type: NRG; PAM sequence: AAG
caacctcagaatttgcctac

SEQ ID NO: 53592 - DNA, 20 bp, Artificial Sequence
  Description of Artificial Sequence: Synthetic oligonucleotide
  Target: ATXN1; (-) strand; PAM type: NRG; PAM sequence: CAG
aatttcatccgttacaacct

SEQ ID NO: 53593 - DNA, 20 bp, Artificial Sequence
  Description of Artificial Sequence: Synthetic oligonucleotide
  Target: ATXN1; (-) strand; PAM type: NRG; PAM sequence: CAG
atattctatagttcacaatt

SEQ ID NO: 53594 - DNA, 20 bp, Artificial Sequence
  Description of Artificial Sequence: Synthetic oligonucleotide
  Target: ATXN1; (-) strand; PAM type: NRG; PAM sequence: TAG
ttgacagggttcatattcta

SEQ ID NO: 53595 - DNA, 20 bp, Artificial Sequence
  Description of Artificial Sequence: Synthetic oligonucleotide
  Target: ATXN1; (-) strand; PAM type: NRG; PAM sequence: GGG
aaaggtttctcctattgaca

SEQ ID NO: 53596 - DNA, 20 bp, Artificial Sequence
  Description of Artificial Sequence: Synthetic oligonucleotide
  Target: ATXN1; (-) strand; PAM type: NRG; PAM sequence: AGG
gaaaggtttctcctattgac

SEQ ID NO: 53597 - DNA, 20 bp, Artificial Sequence
  Description of Artificial Sequence: Synthetic oligonucleotide
  Target: ATXN1; (-) strand; PAM type: NRG; PAM sequence: CAG
agaaaggtttctcctattga

SEQ ID NO: 53598 - DNA, 20 bp, Artificial Sequence
  Description of Artificial Sequence: Synthetic oligonucleotide
  Target: ATXN1; (-) strand; PAM type: NRG; PAM sequence: AGG
aaagaagaaggcttttagaa

SEQ ID NO: 53599 - DNA, 20 bp, Artificial Sequence
  Description of Artificial Sequence: Synthetic oligonucleotide
  Target: ATXN1; (-) strand; PAM type: NRG; PAM sequence: AAG
caaagaagaaggcttttaga

SEQ ID NO: 53600 - DNA, 20 bp, Artificial Sequence
  Description of Artificial Sequence: Synthetic oligonucleotide
  Target: ATXN1; (-) strand; PAM type: NRG; PAM sequence: TAG
acaacaaagaagaaggcttt

SEQ ID NO: 53601 - DNA, 20 bp, Artificial Sequence
  Description of Artificial Sequence: Synthetic oligonucleotide
  Target: ATXN1; (-) strand; PAM type: NRG; PAM sequence: AGG
aacatgcacaacaaagaaga

SEQ ID NO: 53602 - DNA, 20 bp, Artificial Sequence
  Description of Artificial Sequence: Synthetic oligonucleotide
  Target: ATXN1; (-) strand; PAM type: NRG; PAM sequence: AAG
aaacatgcacaacaaagaag

SEQ ID NO: 53603 - DNA, 20 bp, Artificial Sequence
  Description of Artificial Sequence: Synthetic oligonucleotide
  Target: ATXN1; (-) strand; PAM type: NRG; PAM sequence: AAG
taaaaacatgcacaacaaag

SEQ ID NO: 53604 - DNA, 20 bp, Artificial Sequence
  Description of Artificial Sequence: Synthetic oligonucleotide
  Target: ATXN1; (-) strand; PAM type: NRG; PAM sequence: AAG
ccctaaaaacatgcacaaca

SEQ ID NO: 53605 - DNA, 20 bp, Artificial Sequence
  Description of Artificial Sequence: Synthetic oligonucleotide
  Target: ATXN1; (-) strand; PAM type: NRG; PAM sequence: TGG
gagtttccgggtgaaagttc

SEQ ID NO: 53606 - DNA, 20 bp, Artificial Sequence
  Description of Artificial Sequence: Synthetic oligonucleotide
  Target: ATXN1; (-) strand; PAM type: NRG; PAM sequence: AAG
tgttttgagtttccgggtga

SEQ ID NO: 53607 - DNA, 20 bp, Artificial Sequence
  Description of Artificial Sequence: Synthetic oligonucleotide
  Target: ATXN1; (-) strand; PAM type: NRG; PAM sequence: GGG
atttcttgttttgagtttcc

SEQ ID NO: 53608 - DNA, 20 bp, Artificial Sequence
  Description of Artificial Sequence: Synthetic oligonucleotide
  Target: ATXN1; (-) strand; PAM type: NRG; PAM sequence: CGG
aatttcttgttttgagtttc

SEQ ID NO: 53609 - DNA, 20 bp, Artificial Sequence
  Description of Artificial Sequence: Synthetic oligonucleotide
  Target: ATXN1; (-) strand; PAM type: NRG; PAM sequence: GAG
caaactaaatttcttgtttt

SEQ ID NO: 53610 - DNA, 20 bp, Artificial Sequence
  Description of Artificial Sequence: Synthetic oligonucleotide
  Target: ATXN1; (-) strand; PAM type: NRG; PAM sequence: AAG
ttaatagtctctcacttgtt

SEQ ID NO: 53611 - DNA, 20 bp, Artificial Sequence
  Description of Artificial Sequence: Synthetic oligonucleotide
  Target: ATXN1; (-) strand; PAM type: NRG; PAM sequence: TAG
agacagtctgttaatcttaa

SEQ ID NO: 53612 - DNA, 20 bp, Artificial Sequence
  Description of Artificial Sequence: Synthetic oligonucleotide
  Target: ATXN1; (-) strand; PAM type: NRG; PAM sequence: CAG
acgcaggaggctgtccaaga

SEQ ID NO: 53613 - DNA, 20 bp, Artificial Sequence
  Description of Artificial Sequence: Synthetic oligonucleotide
  Target: ATXN1; (-) strand; PAM type: NRG; PAM sequence: AAG
ggacacgcaggaggctgtcc

SEQ ID NO: 53614 - DNA, 20 bp, Artificial Sequence
  Description of Artificial Sequence: Synthetic oligonucleotide
  Target: ATXN1; (-) strand; PAM type: NRG; PAM sequence: AGG
gatgataagggacacgcagg

SEQ ID NO: 53615 - DNA, 20 bp, Artificial Sequence
  Description of Artificial Sequence: Synthetic oligonucleotide
  Target: ATXN1; (-) strand; PAM type: NRG; PAM sequence: GAG
agatgataagggacacgcag

SEQ ID NO: 53616 - DNA, 20 bp, Artificial Sequence
  Description of Artificial Sequence: Synthetic oligonucleotide
  Target: ATXN1; (-) strand; PAM type: NRG; PAM sequence: AGG
ttagatgataagggacacgc

SEQ ID NO: 53617 - DNA, 20 bp, Artificial Sequence
  Description of Artificial Sequence: Synthetic oligonucleotide
  Target: ATXN1; (-) strand; PAM type: NRG; PAM sequence: CAG
tttagatgataagggacacg

SEQ ID NO: 53618 - DNA, 20 bp, Artificial Sequence
  Description of Artificial Sequence: Synthetic oligonucleotide
  Target: ATXN1; (-) strand; PAM type: NRG; PAM sequence: GGG
agtaaccctttagatgataa

SEQ ID NO: 53619 - DNA, 20 bp, Artificial Sequence
  Description of Artificial Sequence: Synthetic oligonucleotide
  Target: ATXN1; (-) strand; PAM type: NRG; PAM sequence: AGG
tagtaaccctttagatgata

SEQ ID NO: 53620 - DNA, 20 bp, Artificial Sequence
  Description of Artificial Sequence: Synthetic oligonucleotide
  Target: ATXN1; (-) strand; PAM type: NRG; PAM sequence: AAG
gtagtaaccctttagatgat

SEQ ID NO: 53621 - DNA, 20 bp, Artificial Sequence
  Description of Artificial Sequence: Synthetic oligonucleotide
  Target: ATXN1; (-) strand; PAM type: NRG; PAM sequence: TAG
gtagtctagtagtaaccctt

SEQ ID NO: 53622 - DNA, 20 bp, Artificial Sequence
  Description of Artificial Sequence: Synthetic oligonucleotide
  Target: ATXN1; (-) strand; PAM type: NRG; PAM sequence: TAG
cagaaaaggatgtagtctag

SEQ ID NO: 53623 - DNA, 20 bp, Artificial Sequence
  Description of Artificial Sequence: Synthetic oligonucleotide
  Target: ATXN1; (-) strand; PAM type: NRG; PAM sequence: TAG
aagcagaaaaggatgtagtc

SEQ ID NO: 53624 - DNA, 20 bp, Artificial Sequence
  Description of Artificial Sequence: Synthetic oligonucleotide
  Target: ATXN1; (-) strand; PAM type: NRG; PAM sequence: TAG
agataaagcagaaaaggatg

SEQ ID NO: 53625 - DNA, 20 bp, Artificial Sequence
  Description of Artificial Sequence: Synthetic oligonucleotide
  Target: ATXN1; (-) strand; PAM type: NRG; PAM sequence: AGG
cctctgagataaagcagaaa

SEQ ID NO: 53626 - DNA, 20 bp, Artificial Sequence
  Description of Artificial Sequence: Synthetic oligonucleotide
  Target: ATXN1; (-) strand; PAM type: NRG; PAM sequence: AAG
gcctctgagataaagcagaa

SEQ ID NO: 53627 - DNA, 20 bp, Artificial Sequence
  Description of Artificial Sequence: Synthetic oligonucleotide
  Target: ATXN1; (-) strand; PAM type: NRG; PAM sequence: CAG
aatgggcctctgagataaag

SEQ ID NO: 53628 - DNA, 20 bp, Artificial Sequence
  Description of Artificial Sequence: Synthetic oligonucleotide
  Target: ATXN1; (-) strand; PAM type: NRG; PAM sequence: AAG
tttaatgggcctctgagata

SEQ ID NO: 53629 - DNA, 20 bp, Artificial Sequence
  Description of Artificial Sequence: Synthetic oligonucleotide
  Target: ATXN1; (-) strand; PAM type: NRG; PAM sequence: GAG
acatgctttaatgggcctct

SEQ ID NO: 53630 - DNA, 20 bp, Artificial Sequence
  Description of Artificial Sequence: Synthetic oligonucleotide
  Target: ATXN1; (-) strand; PAM type: NRG; PAM sequence: GGG
gtctggttacatgctttaat

SEQ ID NO: 53631 - DNA, 20 bp, Artificial Sequence
  Description of Artificial Sequence: Synthetic oligonucleotide
  Target: ATXN1; (-) strand; PAM type: NRG; PAM sequence: TGG
agtctggttacatgctttaa

SEQ ID NO: 53632 - DNA, 20 bp, Artificial Sequence
  Description of Artificial Sequence: Synthetic oligonucleotide
  Target: ATXN1; (-) strand; PAM type: NRG; PAM sequence: TGG
tagtatgaatctgagcagtc

SEQ ID NO: 53633 - DNA, 20 bp, Artificial Sequence
  Description of Artificial Sequence: Synthetic oligonucleotide
  Target: ATXN1; (-) strand; PAM type: NRG; PAM sequence: CAG
tagtatagtatgaatctgag

SEQ ID NO: 53634 - DNA, 20 bp, Artificial Sequence
  Description of Artificial Sequence: Synthetic oligonucleotide
  Target: ATXN1; (-) strand; PAM type: NRG; PAM sequence: GAG
aattagtatagtatgaatct

SEQ ID NO: 53635 - DNA, 20 bp, Artificial Sequence
  Description of Artificial Sequence: Synthetic oligonucleotide
  Target: ATXN1; (-) strand; PAM type: NRG; PAM sequence: TAG
ttggaaagagaaaattagta

SEQ ID NO: 53636 - DNA, 20 bp, Artificial Sequence
  Description of Artificial Sequence: Synthetic oligonucleotide
  Target: ATXN1; (-) strand; PAM type: NRG; PAM sequence: TAG
ttcttttggaaagagaaaat

SEQ ID NO: 53637 - DNA, 20 bp, Artificial Sequence
  Description of Artificial Sequence: Synthetic oligonucleotide
  Target: ATXN1; (-) strand; PAM type: NRG; PAM sequence: GAG
tgtttggtttcttttggaaa

SEQ ID NO: 53638 - DNA, 20 bp, Artificial Sequence
  Description of Artificial Sequence: Synthetic oligonucleotide
  Target: ATXN1; (-) strand; PAM type: NRG; PAM sequence: AAG
gttgtttggtttcttttgga

SEQ ID NO: 53639 - DNA, 20 bp, Artificial Sequence
  Description of Artificial Sequence: Synthetic oligonucleotide
  Target: ATXN1; (-) strand; PAM type: NRG; PAM sequence: TGG
ttttgttgtttggtttcttt

SEQ ID NO: 53640 - DNA, 20 bp, Artificial Sequence
  Description of Artificial Sequence: Synthetic oligonucleotide
  Target: ATXN1; (-) strand; PAM type: NRG; PAM sequence: TGG
tggagttttattttgttgtt

SEQ ID NO: 53641 - DNA, 20 bp, Artificial Sequence
  Description of Artificial Sequence: Synthetic oligonucleotide
  Target: ATXN1; (-) strand; PAM type: NRG; PAM sequence: GAG
tttagtttagtcacttggtg

SEQ ID NO: 53642 - DNA, 20 bp, Artificial Sequence
  Description of Artificial Sequence: Synthetic oligonucleotide
  Target: ATXN1; (-) strand; PAM type: NRG; PAM sequence: TGG
aatttagtttagtcacttgg

SEQ ID NO: 53643 - DNA, 20 bp, Artificial Sequence
  Description of Artificial Sequence: Synthetic oligonucleotide
  Target: ATXN1; (-) strand; PAM type: NRG; PAM sequence: TGG
ttgaatttagtttagtcact

SEQ ID NO: 53644 - DNA, 20 bp, Artificial Sequence
  Description of Artificial Sequence: Synthetic oligonucleotide
  Target: ATXN1; (-) strand; PAM type: NRG; PAM sequence: TAG
atggatatttgaatttagtt

SEQ ID NO: 53645 - DNA, 20 bp, Artificial Sequence
  Description of Artificial Sequence: Synthetic oligonucleotide
  Target: ATXN1; (-) strand; PAM type: NRG; PAM sequence: TAG
attgtatggatatttgaatt

SEQ ID NO: 53646 - DNA, 20 bp, Artificial Sequence
  Description of Artificial Sequence: Synthetic oligonucleotide
  Target: ATXN1; (-) strand; PAM type: NRG; PAM sequence: TGG
ttgccgtggatagaattgta

SEQ ID NO: 53647 - DNA, 20 bp, Artificial Sequence
  Description of Artificial Sequence: Synthetic oligonucleotide
  Target: ATXN1; (-) strand; PAM type: NRG; PAM sequence: TAG
actgacgctgttgccgtgga

SEQ ID NO: 53648 - DNA, 20 bp, Artificial Sequence
  Description of Artificial Sequence: Synthetic oligonucleotide
  Target: ATXN1; (-) strand; PAM type: NRG; PAM sequence: TGG
agaaactgacgctgttgccg

SEQ ID NO: 53649 - DNA, 20 bp, Artificial Sequence
  Description of Artificial Sequence: Synthetic oligonucleotide
  Target: ATXN1; (-) strand; PAM type: NRG; PAM sequence: GAG
agcctggcaatgaaatttct

SEQ ID NO: 53650 - DNA, 20 bp, Artificial Sequence
  Description of Artificial Sequence: Synthetic oligonucleotide
  Target: ATXN1; (-) strand; PAM type: NRG; PAM sequence: TGG
tccattgaagtgggggagcc

SEQ ID NO: 53651 - DNA, 20 bp, Artificial Sequence
  Description of Artificial Sequence: Synthetic oligonucleotide
  Target: ATXN1; (-) strand; PAM type: NRG; PAM sequence: GAG
tattgtccattgaagtgggg

SEQ ID NO: 53652 - DNA, 20 bp, Artificial Sequence
  Description of Artificial Sequence: Synthetic oligonucleotide
  Target: ATXN1; (-) strand; PAM type: NRG; PAM sequence: GGG
tctattgtccattgaagtgg

SEQ ID NO: 53653 - DNA, 20 bp, Artificial Sequence
  Description of Artificial Sequence: Synthetic oligonucleotide
  Target: ATXN1; (-) strand; PAM type: NRG; PAM sequence: GGG
ttctattgtccattgaagtg

SEQ ID NO: 53654 - DNA, 20 bp, Artificial Sequence
  Description of Artificial Sequence: Synthetic oligonucleotide
  Target: ATXN1; (-) strand; PAM type: NRG; PAM sequence: GGG
cttctattgtccattgaagt

SEQ ID NO: 53655 - DNA, 20 bp, Artificial Sequence
  Description of Artificial Sequence: Synthetic oligonucleotide
  Target: ATXN1; (-) strand; PAM type: NRG; PAM sequence: TGG
tcttctattgtccattgaag

SEQ ID NO: 53656 - DNA, 20 bp, Artificial Sequence
  Description of Artificial Sequence: Synthetic oligonucleotide
  Target: ATXN1; (-) strand; PAM type: NRG; PAM sequence: AAG
ttttcttctattgtccattg

SEQ ID NO: 53657 - DNA, 20 bp, Artificial Sequence
  Description of Artificial Sequence: Synthetic oligonucleotide
  Target: ATXN1; (-) strand; PAM type: NRG; PAM sequence: AGG
cactgaagtttgcgacattg

SEQ ID NO: 53658 - DNA, 20 bp, Artificial Sequence
  Description of Artificial Sequence: Synthetic oligonucleotide
  Target: ATXN1; (-) strand; PAM type: NRG; PAM sequence: GAG
gcactgaagtttgcgacatt

SEQ ID NO: 53659 - DNA, 20 bp, Artificial Sequence
  Description of Artificial Sequence: Synthetic oligonucleotide
  Target: ATXN1; (-) strand; PAM type: NRG; PAM sequence: AAG
tagctccttgagcggcactg

SEQ ID NO: 53660 - DNA, 20 bp, Artificial Sequence
  Description of Artificial Sequence: Synthetic oligonucleotide
  Target: ATXN1; (-) strand; PAM type: NRG; PAM sequence: CGG
gatttaattagctccttgag

SEQ ID NO: 53661 - DNA, 20 bp, Artificial Sequence
  Description of Artificial Sequence: Synthetic oligonucleotide
  Target: ATXN1; (-) strand; PAM type: NRG; PAM sequence: GAG
ggagatttaattagctcctt

SEQ ID NO: 53662 - DNA, 20 bp, Artificial Sequence
  Description of Artificial Sequence: Synthetic oligonucleotide
  Target: ATXN1; (-) strand; PAM type: NRG; PAM sequence: TAG
ggcatcctaggagatttaat

SEQ ID NO: 53663 - DNA, 20 bp, Artificial Sequence
  Description of Artificial Sequence: Synthetic oligonucleotide
  Target: ATXN1; (-) strand; PAM type: NRG; PAM sequence: GAG
tgtgggtgagggcatcctag

SEQ ID NO: 53664 - DNA, 20 bp, Artificial Sequence
  Description of Artificial Sequence: Synthetic oligonucleotide
  Target: ATXN1; (-) strand; PAM type: NRG; PAM sequence: AGG
ggtgtgggtgagggcatcct

SEQ ID NO: 53665 - DNA, 20 bp, Artificial Sequence
  Description of Artificial Sequence: Synthetic oligonucleotide
  Target: ATXN1; (-) strand; PAM type: NRG; PAM sequence: TAG
gggtgtgggtgagggcatcc

SEQ ID NO: 53666 - DNA, 20 bp, Artificial Sequence
  Description of Artificial Sequence: Synthetic oligonucleotide
  Target: ATXN1; (-) strand; PAM type: NRG; PAM sequence: GGG
atttcttagggtgtgggtga

SEQ ID NO: 53667 - DNA, 20 bp, Artificial Sequence
  Description of Artificial Sequence: Synthetic oligonucleotide
  Target: ATXN1; (-) strand; PAM type: NRG; PAM sequence: AGG
aatttcttagggtgtgggtg

SEQ ID NO: 53668 - DNA, 20 bp, Artificial Sequence
  Description of Artificial Sequence: Synthetic oligonucleotide
  Target: ATXN1; (-) strand; PAM type: NRG; PAM sequence: GAG
aaatttcttagggtgtgggt

SEQ ID NO: 53669 - DNA, 20 bp, Artificial Sequence
  Description of Artificial Sequence: Synthetic oligonucleotide
  Target: ATXN1; (-) strand; PAM type: NRG; PAM sequence: GGG
cttcaaatttcttagggtgt

SEQ ID NO: 53670 - DNA, 20 bp, Artificial Sequence
  Description of Artificial Sequence: Synthetic oligonucleotide
  Target: ATXN1; (-) strand; PAM type: NRG; PAM sequence: TGG
ccttcaaatttcttagggtg

SEQ ID NO: 53671 - DNA, 20 bp, Artificial Sequence
  Description of Artificial Sequence: Synthetic oligonucleotide
  Target: ATXN1; (-) strand; PAM type: NRG; PAM sequence: GGG
cgtacccttcaaatttctta

SEQ ID NO: 53672 - DNA, 20 bp, Artificial Sequence
  Description of Artificial Sequence: Synthetic oligonucleotide
  Target: ATXN1; (-) strand; PAM type: NRG; PAM sequence: AGG
gcgtacccttcaaatttctt

SEQ ID NO: 53673 - DNA, 20 bp, Artificial Sequence
  Description of Artificial Sequence: Synthetic oligonucleotide
  Target: ATXN1; (-) strand; PAM type: NRG; PAM sequence: TAG
tgcgtacccttcaaatttct

SEQ ID NO: 53674 - DNA, 20 bp, Artificial Sequence
  Description of Artificial Sequence: Synthetic oligonucleotide
  Target: ATXN1; (-) strand; PAM type: NRG; PAM sequence: TGG
taatggtgttgaattgagtt

SEQ ID NO: 53675 - DNA, 20 bp, Artificial Sequence
  Description of Artificial Sequence: Synthetic oligonucleotide
  Target: ATXN1; (-) strand; PAM type: NRG; PAM sequence: GAG
tattttaatggtgttgaatt

SEQ ID NO: 53676 - DNA, 20 bp, Artificial Sequence
  Description of Artificial Sequence: Synthetic oligonucleotide
  Target: ATXN1; (-) strand; PAM type: NRG; PAM sequence: TGG
gtaaaggccttttattttaa

SEQ ID NO: 53677 - DNA, 20 bp, Artificial Sequence
  Description of Artificial Sequence: Synthetic oligonucleotide
  Target: ATXN1; (-) strand; PAM type: NRG; PAM sequence: AGG
agattaagctttatatgtaa

SEQ ID NO: 53678 - DNA, 20 bp, Artificial Sequence
  Description of Artificial Sequence: Synthetic oligonucleotide
  Target: ATXN1; (-) strand; PAM type: NRG; PAM sequence: AAG
aagattaagctttatatgta

SEQ ID NO: 53679 - DNA, 20 bp, Artificial Sequence
  Description of Artificial Sequence: Synthetic oligonucleotide
  Target: ATXN1; (-) strand; PAM type: NRG; PAM sequence: AAG
ggacaaagaaagtcaagatt

SEQ ID NO: 53680 - DNA, 20 bp, Artificial Sequence
  Description of Artificial Sequence: Synthetic oligonucleotide
  Target: ATXN1; (-) strand; PAM type: NRG; PAM sequence: AAG
agaaaaggacaaagaaagtc

SEQ ID NO: 53681 - DNA, 20 bp, Artificial Sequence
  Description of Artificial Sequence: Synthetic oligonucleotide
  Target: ATXN1; (-) strand; PAM type: NRG; PAM sequence: AAG
tggggagaaaaggacaaaga

SEQ ID NO: 53682 - DNA, 20 bp, Artificial Sequence
  Description of Artificial Sequence: Synthetic oligonucleotide
  Target: ATXN1; (-) strand; PAM type: NRG; PAM sequence: AAG
tttgtggggagaaaaggaca

SEQ ID NO: 53683 - DNA, 20 bp, Artificial Sequence
  Description of Artificial Sequence: Synthetic oligonucleotide
  Target: ATXN1; (-) strand; PAM type: NRG; PAM sequence: AGG
tactactttgtggggagaaa

SEQ ID NO: 53684 - DNA, 20 bp, Artificial Sequence
  Description of Artificial Sequence: Synthetic oligonucleotide
  Target: ATXN1; (-) strand; PAM type: NRG; PAM sequence: AAG
ctactactttgtggggagaa

SEQ ID NO: 53685 - DNA, 20 bp, Artificial Sequence
  Description of Artificial Sequence: Synthetic oligonucleotide
  Target: ATXN1; (-) strand; PAM type: NRG; PAM sequence: GAG
gaaatctactactttgtggg

SEQ ID NO: 53686 - DNA, 20 bp, Artificial Sequence
  Description of Artificial Sequence: Synthetic oligonucleotide
  Target: ATXN1; (-) strand; PAM type: NRG; PAM sequence: GGG
tggaaatctactactttgtg

SEQ ID NO: 53687 - DNA, 20 bp, Artificial Sequence
  Description of Artificial Sequence: Synthetic oligonucleotide
  Target: ATXN1; (-) strand; PAM type: NRG; PAM sequence: GGG
ttggaaatctactactttgt

SEQ ID NO: 53688 - DNA, 20 bp, Artificial Sequence
  Description of Artificial Sequence: Synthetic oligonucleotide
  Target: ATXN1; (-) strand; PAM type: NRG; PAM sequence: TGG
tttggaaatctactactttg

SEQ ID NO: 53689 - DNA, 20 bp, Artificial Sequence
  Description of Artificial Sequence: Synthetic oligonucleotide
  Target: ATXN1; (-) strand; PAM type: NRG; PAM sequence: TGG
ctcatgacctttggggaatt

SEQ ID NO: 53690 - DNA, 20 bp, Artificial Sequence
  Description of Artificial Sequence: Synthetic oligonucleotide
  Target: ATXN1; (-) strand; PAM type: NRG; PAM sequence: GGG
tgccaaactcatgacctttg

SEQ ID NO: 53691 - DNA, 20 bp, Artificial Sequence
  Description of Artificial Sequence: Synthetic oligonucleotide
  Target: ATXN1; (-) strand; PAM type: NRG; PAM sequence: GGG
ttgccaaactcatgaccttt

SEQ ID NO: 53692 - DNA, 20 bp, Artificial Sequence
  Description of Artificial Sequence: Synthetic oligonucleotide
  Target: ATXN1; (-) strand; PAM type: NRG; PAM sequence: TGG
attgccaaactcatgacctt

SEQ ID NO: 53693 - DNA, 20 bp, Artificial Sequence
  Description of Artificial Sequence: Synthetic oligonucleotide
  Target: ATXN1; (-) strand; PAM type: NRG; PAM sequence: GGG
tccccaaggcagtcactctg

SEQ ID NO: 53694 - DNA, 20 bp, Artificial Sequence
  Description of Artificial Sequence: Synthetic oligonucleotide
  Target: ATXN1; (-) strand; PAM type: NRG; PAM sequence: GGG
ctccccaaggcagtcactct

SEQ ID NO: 53695 - DNA, 20 bp, Artificial Sequence
  Description of Artificial Sequence: Synthetic oligonucleotide
  Target: ATXN1; (-) strand; PAM type: NRG; PAM sequence: TGG
tctccccaaggcagtcactc

SEQ ID NO: 53696 - DNA, 20 bp, Artificial Sequence
  Description of Artificial Sequence: Synthetic oligonucleotide
  Target: ATXN1; (-) strand; PAM type: NRG; PAM sequence: CAG
agcaaactctctccccaagg

SEQ ID NO: 53697 - DNA, 20 bp, Artificial Sequence
  Description of Artificial Sequence: Synthetic oligonucleotide
  Target: ATXN1; (-) strand; PAM type: NRG; PAM sequence: AGG
aggagcaaactctctcccca

SEQ ID NO: 53698 - DNA, 20 bp, Artificial Sequence
  Description of Artificial Sequence: Synthetic oligonucleotide
  Target: ATXN1; (-) strand; PAM type: NRG; PAM sequence: AAG
gaggagcaaactctctcccc

SEQ ID NO: 53699 - DNA, 20 bp, Artificial Sequence
  Description of Artificial Sequence: Synthetic oligonucleotide
  Target: ATXN1; (-) strand; PAM type: NRG; PAM sequence: GAG
ccacggcatggccaagagag

SEQ ID NO: 53700 - DNA, 20 bp, Artificial Sequence
  Description of Artificial Sequence: Synthetic oligonucleotide
  Target: ATXN1; (-) strand; PAM type: NRG; PAM sequence: AGG
ccccacggcatggccaagag

SEQ ID NO: 53701 - DNA, 20 bp, Artificial Sequence
  Description of Artificial Sequence: Synthetic oligonucleotide
  Target: ATXN1; (-) strand; PAM type: NRG; PAM sequence: GAG
cccccacggcatggccaaga

SEQ ID NO: 53702 - DNA, 20 bp, Artificial Sequence
  Description of Artificial Sequence: Synthetic oligonucleotide
  Target: ATXN1; (-) strand; PAM type: NRG; PAM sequence: GAG
agcccccacggcatggccaa

SEQ ID NO: 53703 - DNA, 20 bp, Artificial Sequence
  Description of Artificial Sequence: Synthetic oligonucleotide
  Target: ATXN1; (-) strand; PAM type: NRG; PAM sequence: AAG
acagcccccacggcatggcc

SEQ ID NO: 53704 - DNA, 20 bp, Artificial Sequence
  Description of Artificial Sequence: Synthetic oligonucleotide
  Target: ATXN1; (-) strand; PAM type: NRG; PAM sequence: TGG
agacaacagcccccacggca

SEQ ID NO: 53705 - DNA, 20 bp, Artificial Sequence
  Description of Artificial Sequence: Synthetic oligonucleotide
  Target: ATXN1; (-) strand; PAM type: NRG; PAM sequence: CGG
aagagagacaacagccccca

SEQ ID NO: 53706 - DNA, 20 bp, Artificial Sequence
  Description of Artificial Sequence: Synthetic oligonucleotide
  Target: ATXN1; (-) strand; PAM type: NRG; PAM sequence: CAG
gcagctcccaagagagacaa

SEQ ID NO: 53707 - DNA, 20 bp, Artificial Sequence
  Description of Artificial Sequence: Synthetic oligonucleotide
  Target: ATXN1; (-) strand; PAM type: NRG; PAM sequence: GAG
gatgcttgcagctcccaaga

SEQ ID NO: 53708 - DNA, 20 bp, Artificial Sequence
  Description of Artificial Sequence: Synthetic oligonucleotide
  Target: ATXN1; (-) strand; PAM type: NRG; PAM sequence: GAG
atgatgcttgcagctcccaa

SEQ ID NO: 53709 - DNA, 20 bp, Artificial Sequence
  Description of Artificial Sequence: Synthetic oligonucleotide
  Target: ATXN1; (-) strand; PAM type: NRG; PAM sequence: AAG
tgatgatgcttgcagctccc

SEQ ID NO: 53710 - DNA, 20 bp, Artificial Sequence
  Description of Artificial Sequence: Synthetic oligonucleotide
  Target: ATXN1; (-) strand; PAM type: NRG; PAM sequence: CAG
atccactttgatgatgcttg

SEQ ID NO: 53711 - DNA, 20 bp, Artificial Sequence
  Description of Artificial Sequence: Synthetic oligonucleotide
  Target: ATXN1; (-) strand; PAM type: NRG; PAM sequence: CAG
accatacttcttgctgtggc

SEQ ID NO: 53712 - DNA, 20 bp, Artificial Sequence
  Description of Artificial Sequence: Synthetic oligonucleotide
  Target: ATXN1; (-) strand; PAM type: NRG; PAM sequence: TGG
agagaccatacttcttgctg

SEQ ID NO: 53713 - DNA, 20 bp, Artificial Sequence
  Description of Artificial Sequence: Synthetic oligonucleotide
  Target: ATXN1; (-) strand; PAM type: NRG; PAM sequence: GAG
cactagaaaactataggaca

SEQ ID NO: 53714 - DNA, 20 bp, Artificial Sequence
  Description of Artificial Sequence: Synthetic oligonucleotide
  Target: ATXN1; (-) strand; PAM type: NRG; PAM sequence: CAG
aacactagaaaactatagga

SEQ ID NO: 53715 - DNA, 20 bp, Artificial Sequence
  Description of Artificial Sequence: Synthetic oligonucleotide
  Target: ATXN1; (-) strand; PAM type: NRG; PAM sequence: AGG
ccctaacactagaaaactat

SEQ ID NO: 53716 - DNA, 20 bp, Artificial Sequence
  Description of Artificial Sequence: Synthetic oligonucleotide
  Target: ATXN1; (-) strand; PAM type: NRG; PAM sequence: TAG
accctaacactagaaaacta

SEQ ID NO: 53717 - DNA, 20 bp, Artificial Sequence
  Description of Artificial Sequence: Synthetic oligonucleotide
  Target: ATXN1; (-) strand; PAM type: NRG; PAM sequence: TAG
agacctcatcaccctaacac

SEQ ID NO: 53718 - DNA, 20 bp, Artificial Sequence
  Description of Artificial Sequence: Synthetic oligonucleotide
  Target: ATXN1; (-) strand; PAM type: NRG; PAM sequence: GAG
tttcttcttgtgaatagata

SEQ ID NO: 53719 - DNA, 20 bp, Artificial Sequence
  Description of Artificial Sequence: Synthetic oligonucleotide
  Target: ATXN1; (-) strand; PAM type: NRG; PAM sequence: TAG
tttttcttcttgtgaataga

SEQ ID NO: 53720 - DNA, 20 bp, Artificial Sequence
  Description of Artificial Sequence: Synthetic oligonucleotide
  Target: ATXN1; (-) strand; PAM type: NRG; PAM sequence: TAG
actctttttcttcttgtgaa

SEQ ID NO: 53721 - DNA, 20 bp, Artificial Sequence
  Description of Artificial Sequence: Synthetic oligonucleotide
  Target: ATXN1; (-) strand; PAM type: NRG; PAM sequence: AGG
acatagtttgggaatggttt

SEQ ID NO: 53722 - DNA, 20 bp, Artificial Sequence
  Description of Artificial Sequence: Synthetic oligonucleotide
  Target: ATXN1; (-) strand; PAM type: NRG; PAM sequence: TAG
aacatagtttgggaatggtt

SEQ ID NO: 53723 - DNA, 20 bp, Artificial Sequence
  Description of Artificial Sequence: Synthetic oligonucleotide
  Target: ATXN1; (-) strand; PAM type: NRG; PAM sequence: TGG
tttctaacatagtttgggaa

SEQ ID NO: 53724 - DNA, 20 bp, Artificial Sequence
  Description of Artificial Sequence: Synthetic oligonucleotide
  Target: ATXN1; (-) strand; PAM type: NRG; PAM sequence: GGG
cttcatttctaacatagttt

SEQ ID NO: 53725 - DNA, 20 bp, Artificial Sequence
  Description of Artificial Sequence: Synthetic oligonucleotide
  Target: ATXN1; (-) strand; PAM type: NRG; PAM sequence: TGG
tcttcatttctaacatagtt

SEQ ID NO: 53726 - DNA, 20 bp, Artificial Sequence
  Description of Artificial Sequence: Synthetic oligonucleotide
  Target: ATXN1; (-) strand; PAM type: NRG; PAM sequence: TAG
ccctttcttcatttctaaca

SEQ ID NO: 53727 - DNA, 20 bp, Artificial Sequence
  Description of Artificial Sequence: Synthetic oligonucleotide
  Target: ATXN1; (-) strand; PAM type: NRG; PAM sequence: AAG
atttaaacgaagtgctcagc

SEQ ID NO: 53728 - DNA, 20 bp, Artificial Sequence
  Description of Artificial Sequence: Synthetic oligonucleotide
  Target: ATXN1; (-) strand; PAM type: NRG; PAM sequence: CAG
gcacatttaaacgaagtgct

SEQ ID NO: 53729 - DNA, 20 bp, Artificial Sequence
  Description of Artificial Sequence: Synthetic oligonucleotide
  Target: ATXN1; (-) strand; PAM type: NRG; PAM sequence: AAG
atgactggcacatttaaacg

SEQ ID NO: 53730 - DNA, 20 bp, Artificial Sequence
  Description of Artificial Sequence: Synthetic oligonucleotide
  Target: ATXN1; (-) strand; PAM type: NRG; PAM sequence: TGG
aaaatatgcagcataatgac

SEQ ID NO: 53731 - DNA, 20 bp, Artificial Sequence
  Description of Artificial Sequence: Synthetic oligonucleotide
  Target: ATXN1; (-) strand; PAM type: NRG; PAM sequence: CAG
aggattaaatataaaatatg

SEQ ID NO: 53732 - DNA, 20 bp, Artificial Sequence
  Description of Artificial Sequence: Synthetic oligonucleotide
  Target: ATXN1; (-) strand; PAM type: NRG; PAM sequence: AGG
ctactttgtagggttgtgtg

SEQ ID NO: 53733 - DNA, 20 bp, Artificial Sequence
  Description of Artificial Sequence: Synthetic oligonucleotide
  Target: ATXN1; (-) strand; PAM type: NRG; PAM sequence: GAG
tctactttgtagggttgtgt

SEQ ID NO: 53734 - DNA, 20 bp, Artificial Sequence
  Description of Artificial Sequence: Synthetic oligonucleotide
  Target: ATXN1; (-) strand; PAM type: NRG; PAM sequence: GGG
gtcatcatttctactttgta

SEQ ID NO: 53735 - DNA, 20 bp, Artificial Sequence
  Description of Artificial Sequence: Synthetic oligonucleotide
  Target: ATXN1; (-) strand; PAM type: NRG; PAM sequence: AGG
agtcatcatttctactttgt

SEQ ID NO: 53736 - DNA, 20 bp, Artificial Sequence
  Description of Artificial Sequence: Synthetic oligonucleotide
  Target: ATXN1; (-) strand; PAM type: NRG; PAM sequence: TAG
gagtcatcatttctactttg

SEQ ID NO: 53737 - DNA, 20 bp, Artificial Sequence
  Description of Artificial Sequence: Synthetic oligonucleotide
  Target: ATXN1; (-) strand; PAM type: NRG; PAM sequence: GAG
tttcagtttgtctttaaata

SEQ ID NO: 53738 - DNA, 20 bp, Artificial Sequence
  Description of Artificial Sequence: Synthetic oligonucleotide
  Target: ATXN1; (-) strand; PAM type: NRG; PAM sequence: TAG
agtttcagtttgtctttaaa

SEQ ID NO: 53739 - DNA, 20 bp, Artificial Sequence
  Description of Artificial Sequence: Synthetic oligonucleotide
  Target: ATXN1; (-) strand; PAM type: NRG; PAM sequence: CAG
gaggaagttcttttgagttt

SEQ ID NO: 53740 - DNA, 20 bp, Artificial Sequence
  Description of Artificial Sequence: Synthetic oligonucleotide
  Target: ATXN1; (-) strand; PAM type: NRG; PAM sequence: GAG
catttcgaggaagttctttt

SEQ ID NO: 53741 - DNA, 20 bp, Artificial Sequence
  Description of Artificial Sequence: Synthetic oligonucleotide
  Target: ATXN1; (-) strand; PAM type: NRG; PAM sequence: AAG
ctaactgtatcatttcgagg

SEQ ID NO: 53742 - DNA, 20 bp, Artificial Sequence
  Description of Artificial Sequence: Synthetic oligonucleotide
  Target: ATXN1; (-) strand; PAM type: NRG; PAM sequence: AGG
gtgctaactgtatcatttcg

SEQ ID NO: 53743 - DNA, 20 bp, Artificial Sequence
  Description of Artificial Sequence: Synthetic oligonucleotide
  Target: ATXN1; (-) strand; PAM type: NRG; PAM sequence: GAG
tgtgctaactgtatcatttc

SEQ ID NO: 53744 - DNA, 20 bp, Artificial Sequence
  Description of Artificial Sequence: Synthetic oligonucleotide
  Target: ATXN1; (-) strand; PAM type: NRG; PAM sequence: GGG
tttaagaactagacaggcct

SEQ ID NO: 53745 - DNA, 20 bp, Artificial Sequence
  Description of Artificial Sequence: Synthetic oligonucleotide
  Target: ATXN1; (-) strand; PAM type: NRG; PAM sequence: TGG
atttaagaactagacaggcc

SEQ ID NO: 53746 - DNA, 20 bp, Artificial Sequence
  Description of Artificial Sequence: Synthetic oligonucleotide
  Target: ATXN1; (-) strand; PAM type: NRG; PAM sequence: AGG
cacggatttaagaactagac

SEQ ID NO: 53747 - DNA, 20 bp, Artificial Sequence
  Description of Artificial Sequence: Synthetic oligonucleotide
  Target: ATXN1; (-) strand; PAM type: NRG; PAM sequence: CAG
acacggatttaagaactaga

SEQ ID NO: 53748 - DNA, 20 bp, Artificial Sequence
  Description of Artificial Sequence: Synthetic oligonucleotide
  Target: ATXN1; (-) strand; PAM type: NRG; PAM sequence: TAG
aagaacacggatttaagaac

SEQ ID NO: 53749 - DNA, 20 bp, Artificial Sequence
  Description of Artificial Sequence: Synthetic oligonucleotide
  Target: ATXN1; (-) strand; PAM type: NRG; PAM sequence: AAG
tatgggaagaacacggattt

SEQ ID NO: 53750 - DNA, 20 bp, Artificial Sequence
  Description of Artificial Sequence: Synthetic oligonucleotide
  Target: ATXN1; (-) strand; PAM type: NRG; PAM sequence: CGG
catggtatatgggaagaaca

SEQ ID NO: 53751 - DNA, 20 bp, Artificial Sequence
  Description of Artificial Sequence: Synthetic oligonucleotide
  Target: ATXN1; (-) strand; PAM type: NRG; PAM sequence: AAG
gaggcagcatggtatatggg

SEQ ID NO: 53752 - DNA, 20 bp, Artificial Sequence
  Description of Artificial Sequence: Synthetic oligonucleotide
  Target: ATXN1; (-) strand; PAM type: NRG; PAM sequence: GGG
tgagaggcagcatggtatat

SEQ ID NO: 53753 - DNA, 20 bp, Artificial Sequence
  Description of Artificial Sequence: Synthetic oligonucleotide
  Target: ATXN1; (-) strand; PAM type: NRG; PAM sequence: TGG
ttgagaggcagcatggtata

SEQ ID NO: 53754 - DNA, 20 bp, Artificial Sequence
  Description of Artificial Sequence: Synthetic oligonucleotide
  Target: ATXN1; (-) strand; PAM type: NRG; PAM sequence: TGG
tttccttttgagaggcagca

SEQ ID NO: 53755 - DNA, 20 bp, Artificial Sequence
  Description of Artificial Sequence: Synthetic oligonucleotide
  Target: ATXN1; (-) strand; PAM type: NRG; PAM sequence: CAG
cagtgtttccttttgagagg

SEQ ID NO: 53756 - DNA, 20 bp, Artificial Sequence
  Description of Artificial Sequence: Synthetic oligonucleotide
  Target: ATXN1; (-) strand; PAM type: NRG; PAM sequence: AGG
aaacagtgtttccttttgag

SEQ ID NO: 53757 - DNA, 20 bp, Artificial Sequence
  Description of Artificial Sequence: Synthetic oligonucleotide
  Target: ATXN1; (-) strand; PAM type: NRG; PAM sequence: GAG
aaaacagtgtttccttttga

SEQ ID NO: 53758 - DNA, 20 bp, Artificial Sequence
  Description of Artificial Sequence: Synthetic oligonucleotide
  Target: ATXN1; (-) strand; PAM type: NRG; PAM sequence: GAG
caaaaacagtgtttcctttt

SEQ ID NO: 53759 - DNA, 20 bp, Artificial Sequence
  Description of Artificial Sequence: Synthetic oligonucleotide
  Target: ATXN1; (-) strand; PAM type: NRG; PAM sequence: CAG
ccttaaaaaaaaaacaaaaa

SEQ ID NO: 53760 - DNA, 20 bp, Artificial Sequence
  Description of Artificial Sequence: Synthetic oligonucleotide
  Target: ATXN1; (-) strand; PAM type: NRG; PAM sequence: GAG
taacaaaaagaatgggtccc

SEQ ID NO: 53761 - DNA, 20 bp, Artificial Sequence
  Description of Artificial Sequence: Synthetic oligonucleotide
  Target: ATXN1; (-) strand; PAM type: NRG; PAM sequence: GGG
aagcctataacaaaaagaat

SEQ ID NO: 53762 - DNA, 20 bp, Artificial Sequence
  Description of Artificial Sequence: Synthetic oligonucleotide
  Target: ATXN1; (-) strand; PAM type: NRG; PAM sequence: TGG
caagcctataacaaaaagaa

SEQ ID NO: 53763 - DNA, 20 bp, Artificial Sequence
  Description of Artificial Sequence: Synthetic oligonucleotide
  Target: ATXN1; (-) strand; PAM type: NRG; PAM sequence: AAG
tagcacaagcctataacaaa

SEQ ID NO: 53764 - DNA, 20 bp, Artificial Sequence
  Description of Artificial Sequence: Synthetic oligonucleotide
  Target: ATXN1; (-) strand; PAM type: NRG; PAM sequence: AAG
aagatggatgtttatagcac

SEQ ID NO: 53765 - DNA, 20 bp, Artificial Sequence
  Description of Artificial Sequence: Synthetic oligonucleotide
  Target: ATXN1; (-) strand; PAM type: NRG; PAM sequence: TAG
aagagtaagatggatgttta

SEQ ID NO: 53766 - DNA, 20 bp, Artificial Sequence
  Description of Artificial Sequence: Synthetic oligonucleotide
  Target: ATXN1; (-) strand; PAM type: NRG; PAM sequence: TGG
aggtcaaactaagagtaaga

SEQ ID NO: 53767 - DNA, 20 bp, Artificial Sequence
  Description of Artificial Sequence: Synthetic oligonucleotide
  Target: ATXN1; (-) strand; PAM type: NRG; PAM sequence: AAG
acaaaggtcaaactaagagt

SEQ ID NO: 53768 - DNA, 20 bp, Artificial Sequence
  Description of Artificial Sequence: Synthetic oligonucleotide
  Target: ATXN1; (-) strand; PAM type: NRG; PAM sequence: GAG
cggcacaaaggtcaaactaa

SEQ ID NO: 53769 - DNA, 20 bp, Artificial Sequence
  Description of Artificial Sequence: Synthetic oligonucleotide
  Target: ATXN1; (-) strand; PAM type: NRG; PAM sequence: AAG
cacggcacaaaggtcaaact

SEQ ID NO: 53770 - DNA, 20 bp, Artificial Sequence
  Description of Artificial Sequence: Synthetic oligonucleotide
  Target: ATXN1; (-) strand; PAM type: NRG; PAM sequence: AGG
gacatgagcccacggcacaa

SEQ ID NO: 53771 - DNA, 20 bp, Artificial Sequence
  Description of Artificial Sequence: Synthetic oligonucleotide
  Target: ATXN1; (-) strand; PAM type: NRG; PAM sequence: AAG
agacatgagcccacggcaca

SEQ ID NO: 53772 - DNA, 20 bp, Artificial Sequence
  Description of Artificial Sequence: Synthetic oligonucleotide
  Target: ATXN1; (-) strand; PAM type: NRG; PAM sequence: CGG
gtattacagacatgagccca

SEQ ID NO: 53773 - DNA, 20 bp, Artificial Sequence
  Description of Artificial Sequence: Synthetic oligonucleotide
  Target: ATXN1; (-) strand; PAM type: NRG; PAM sequence: GAG
ggttcctgtattacagacat

SEQ ID NO: 53774 - DNA, 20 bp, Artificial Sequence
  Description of Artificial Sequence: Synthetic oligonucleotide
  Target: ATXN1; (-) strand; PAM type: NRG; PAM sequence: CAG
atgattgggttcctgtatta

SEQ ID NO: 53775 - DNA, 20 bp, Artificial Sequence
  Description of Artificial Sequence: Synthetic oligonucleotide
  Target: ATXN1; (-) strand; PAM type: NRG; PAM sequence: GGG
acagactttcagaaatgatt

SEQ ID NO: 53776 - DNA, 20 bp, Artificial Sequence
  Description of Artificial Sequence: Synthetic oligonucleotide
  Target: ATXN1; (-) strand; PAM type: NRG; PAM sequence: TGG
gacagactttcagaaatgat

SEQ ID NO: 53777 - DNA, 20 bp, Artificial Sequence
  Description of Artificial Sequence: Synthetic oligonucleotide
  Target: ATXN1; (-) strand; PAM type: NRG; PAM sequence: CAG
atcactgttagacagacttt

SEQ ID NO: 53778 - DNA, 20 bp, Artificial Sequence
  Description of Artificial Sequence: Synthetic oligonucleotide
  Target: ATXN1; (-) strand; PAM type: NRG; PAM sequence: CAG
cacacaatatcactgttaga

SEQ ID NO: 53779 - DNA, 20 bp, Artificial Sequence
  Description of Artificial Sequence: Synthetic oligonucleotide
  Target: ATXN1; (-) strand; PAM type: NRG; PAM sequence: TAG
gctgcacacaatatcactgt

SEQ ID NO: 53780 - DNA, 20 bp, Artificial Sequence
  Description of Artificial Sequence: Synthetic oligonucleotide
  Target: ATXN1; (-) strand; PAM type: NRG; PAM sequence: CAG
cagtcccagtatgggctcgt

SEQ ID NO: 53781 - DNA, 20 bp, Artificial Sequence
  Description of Artificial Sequence: Synthetic oligonucleotide
  Target: ATXN1; (-) strand; PAM type: NRG; PAM sequence: GGG
tgccgattcagtcccagtat

SEQ ID NO: 53782 - DNA, 20 bp, Artificial Sequence
  Description of Artificial Sequence: Synthetic oligonucleotide
  Target: ATXN1; (-) strand; PAM type: NRG; PAM sequence: TGG
ttgccgattcagtcccagta

SEQ ID NO: 53783 - DNA, 20 bp, Artificial Sequence
  Description of Artificial Sequence: Synthetic oligonucleotide
  Target: ATXN1; (-) strand; PAM type: NRG; PAM sequence: CAG
ccacattgccgattcagtcc

SEQ ID NO: 53784 - DNA, 20 bp, Artificial Sequence
  Description of Artificial Sequence: Synthetic oligonucleotide
  Target: ATXN1; (-) strand; PAM type: NRG; PAM sequence: CAG
ggaggcccacattgccgatt

SEQ ID NO: 53785 - DNA, 20 bp, Artificial Sequence
  Description of Artificial Sequence: Synthetic oligonucleotide
  Target: ATXN1; (-) strand; PAM type: NRG; PAM sequence: AGG
taacatgcagtgctttcagg

SEQ ID NO: 53786 - DNA, 20 bp, Artificial Sequence
  Description of Artificial Sequence: Synthetic oligonucleotide
  Target: ATXN1; (-) strand; PAM type: NRG; PAM sequence: GAG
ttaacatgcagtgctttcag

SEQ ID NO: 53787 - DNA, 20 bp, Artificial Sequence
  Description of Artificial Sequence: Synthetic oligonucleotide
  Target: ATXN1; (-) strand; PAM type: NRG; PAM sequence: AGG
gattaacatgcagtgctttc

SEQ ID NO: 53788 - DNA, 20 bp, Artificial Sequence
  Description of Artificial Sequence: Synthetic oligonucleotide
  Target: ATXN1; (-) strand; PAM type: NRG; PAM sequence: CAG
tgattaacatgcagtgcttt

SEQ ID NO: 53789 - DNA, 20 bp, Artificial Sequence
  Description of Artificial Sequence: Synthetic oligonucleotide
  Target: ATXN1; (-) strand; PAM type: NRG; PAM sequence: CAG
aaaaagtagtgattaacatg

SEQ ID NO: 53790 - DNA, 20 bp, Artificial Sequence
  Description of Artificial Sequence: Synthetic oligonucleotide
  Target: ATXN1; (-) strand; PAM type: NRG; PAM sequence: TAG
tgtcacaaagctcaaaaaag

SEQ ID NO: 53791 - DNA, 20 bp, Artificial Sequence
  Description of Artificial Sequence: Synthetic oligonucleotide
  Target: ATXN1; (-) strand; PAM type: NRG; PAM sequence: AAG
tcatgtcacaaagctcaaaa

SEQ ID NO: 53792 - DNA, 20 bp, Artificial Sequence
  Description of Artificial Sequence: Synthetic oligonucleotide
  Target: ATXN1; (-) strand; PAM type: NRG; PAM sequence: AAG
cacccaaacatcatgtcaca

SEQ ID NO: 53793 - DNA, 20 bp, Artificial Sequence
  Description of Artificial Sequence: Synthetic oligonucleotide
  Target: ATXN1; (-) strand; PAM type: NRG; PAM sequence: CAG
caccacacaggatttttctc

SEQ ID NO: 53794 - DNA, 20 bp, Artificial Sequence
  Description of Artificial Sequence: Synthetic oligonucleotide
  Target: ATXN1; (-) strand; PAM type: NRG; PAM sequence: AGG
agcccagaccaccaccacac

SEQ ID NO: 53795 - DNA, 20 bp, Artificial Sequence
  Description of Artificial Sequence: Synthetic oligonucleotide
  Target: ATXN1; (-) strand; PAM type: NRG; PAM sequence: CAG
aagcccagaccaccaccaca

SEQ ID NO: 53796 - DNA, 20 bp, Artificial Sequence
  Description of Artificial Sequence: Synthetic oligonucleotide
  Target: ATXN1; (-) strand; PAM type: NRG; PAM sequence: CAG
attgcgtcagtaaaaaagcc

SEQ ID NO: 53797 - DNA, 20 bp, Artificial Sequence
  Description of Artificial Sequence: Synthetic oligonucleotide
  Target: ATXN1; (-) strand; PAM type: NRG; PAM sequence: AAG
gggccattgcgtcagtaaaa

SEQ ID NO: 53798 - DNA, 20 bp, Artificial Sequence
  Description of Artificial Sequence: Synthetic oligonucleotide
  Target: ATXN1; (-) strand; PAM type: NRG; PAM sequence: CAG
tatcaggtgggccattgcgt

SEQ ID NO: 53799 - DNA, 20 bp, Artificial Sequence
  Description of Artificial Sequence: Synthetic oligonucleotide
  Target: ATXN1; (-) strand; PAM type: NRG; PAM sequence: GGG
aaatcaaaattatatcaggt

SEQ ID NO: 53800 - DNA, 20 bp, Artificial Sequence
  Description of Artificial Sequence: Synthetic oligonucleotide
  Target: ATXN1; (-) strand; PAM type: NRG; PAM sequence: TGG
gaaatcaaaattatatcagg

SEQ ID NO: 53801 - DNA, 20 bp, Artificial Sequence
  Description of Artificial Sequence: Synthetic oligonucleotide
  Target: ATXN1; (-) strand; PAM type: NRG; PAM sequence: AGG
atggaaatcaaaattatatc

SEQ ID NO: 53802 - DNA, 20 bp, Artificial Sequence
  Description of Artificial Sequence: Synthetic oligonucleotide
  Target: ATXN1; (-) strand; PAM type: NRG; PAM sequence: CAG
gatggaaatcaaaattatat

SEQ ID NO: 53803 - DNA, 20 bp, Artificial Sequence
  Description of Artificial Sequence: Synthetic oligonucleotide
  Target: ATXN1; (-) strand; PAM type: NRG; PAM sequence: TGG
aggctaagtttagtggctga

SEQ ID NO: 53804 - DNA, 20 bp, Artificial Sequence
  Description of Artificial Sequence: Synthetic oligonucleotide
  Target: ATXN1; (-) strand; PAM type: NRG; PAM sequence: TGG
tgtcttcaggctaagtttag

SEQ ID NO: 53805 - DNA, 20 bp, Artificial Sequence
  Description of Artificial Sequence: Synthetic oligonucleotide
  Target: ATXN1; (-) strand; PAM type: NRG; PAM sequence: TAG
ttttgtcttcaggctaagtt

SEQ ID NO: 53806 - DNA, 20 bp, Artificial Sequence
  Description of Artificial Sequence: Synthetic oligonucleotide
  Target: ATXN1; (-) strand; PAM type: NRG; PAM sequence: AAG
ggaaattttgtcttcaggct

SEQ ID NO: 53807 - DNA, 20 bp, Artificial Sequence
  Description of Artificial Sequence: Synthetic oligonucleotide
  Target: ATXN1; (-) strand; PAM type: NRG; PAM sequence: AGG
tcaaaggaaattttgtcttc

SEQ ID NO: 53808 - DNA, 20 bp, Artificial Sequence
  Description of Artificial Sequence: Synthetic oligonucleotide
  Target: ATXN1; (-) strand; PAM type: NRG; PAM sequence: CAG
ttcaaaggaaattttgtctt

SEQ ID NO: 53809 - DNA, 20 bp, Artificial Sequence
  Description of Artificial Sequence: Synthetic oligonucleotide
  Target: ATXN1; (-) strand; PAM type: NRG; PAM sequence: AGG
cctaagctgaatcctttcaa

SEQ ID NO: 53810 - DNA, 20 bp, Artificial Sequence
  Description of Artificial Sequence: Synthetic oligonucleotide
  Target: ATXN1; (-) strand; PAM type: NRG; PAM sequence: AAG
ccctaagctgaatcctttca

SEQ ID NO: 53811 - DNA, 20 bp, Artificial Sequence
  Description of Artificial Sequence: Synthetic oligonucleotide
  Target: ATXN1; (-) strand; PAM type: NRG; PAM sequence: AAG
tccttattatctgttcccct

SEQ ID NO: 53812 - DNA, 20 bp, Artificial Sequence
  Description of Artificial Sequence: Synthetic oligonucleotide
  Target: ATXN1; (-) strand; PAM type: NRG; PAM sequence: AAG
aaatatgttataggaatgta

SEQ ID NO: 53813 - DNA, 20 bp, Artificial Sequence
  Description of Artificial Sequence: Synthetic oligonucleotide
  Target: ATXN1; (-) strand; PAM type: NRG; PAM sequence: AGG
catttttagaaatatgttat

SEQ ID NO: 53814 - DNA, 20 bp, Artificial Sequence
  Description of Artificial Sequence: Synthetic oligonucleotide
  Target: ATXN1; (-) strand; PAM type: NRG; PAM sequence: TAG
tcatttttagaaatatgtta

SEQ ID NO: 53815 - DNA, 20 bp, Artificial Sequence
  Description of Artificial Sequence: Synthetic oligonucleotide
  Target: ATXN1; (-) strand; PAM type: NRG; PAM sequence: TAG
ctttgagaatgtttcatttt

SEQ ID NO: 53816 - DNA, 20 bp, Artificial Sequence
  Description of Artificial Sequence: Synthetic oligonucleotide
  Target: ATXN1; (-) strand; PAM type: NRG; PAM sequence: GAG
tttccttactttccagcttt

SEQ ID NO: 53817 - DNA, 20 bp, Artificial Sequence
  Description of Artificial Sequence: Synthetic oligonucleotide
  Target: ATXN1; (-) strand; PAM type: NRG; PAM sequence: CAG
gtttgattttccttactttc

SEQ ID NO: 53818 - DNA, 20 bp, Artificial Sequence
  Description of Artificial Sequence: Synthetic oligonucleotide
  Target: ATXN1; (-) strand; PAM type: NRG; PAM sequence: GAG
cattttcaaaaccccaagta

SEQ ID NO: 53819 - DNA, 20 bp, Artificial Sequence
  Description of Artificial Sequence: Synthetic oligonucleotide
  Target: ATXN1; (-) strand; PAM type: NRG; PAM sequence: TAG
tccattttcaaaaccccaag

SEQ ID NO: 53820 - DNA, 20 bp, Artificial Sequence
  Description of Artificial Sequence: Synthetic oligonucleotide
  Target: ATXN1; (-) strand; PAM type: NRG; PAM sequence: AAG
tgttccattttcaaaacccc

SEQ ID NO: 53821 - DNA, 20 bp, Artificial Sequence
  Description of Artificial Sequence: Synthetic oligonucleotide
  Target: ATXN1; (-) strand; PAM type: NRG; PAM sequence: AAG
cgcttcttatcctccaaatt

SEQ ID NO: 53822 - DNA, 20 bp, Artificial Sequence
  Description of Artificial Sequence: Synthetic oligonucleotide
  Target: ATXN1; (-) strand; PAM type: NRG; PAM sequence: AAG
ctccttgaggctatagaaag

SEQ ID NO: 53823 - DNA, 20 bp, Artificial Sequence
  Description of Artificial Sequence: Synthetic oligonucleotide
  Target: ATXN1; (-) strand; PAM type: NRG; PAM sequence: AAG
tagctccttgaggctataga

SEQ ID NO: 53824 - DNA, 20 bp, Artificial Sequence
  Description of Artificial Sequence: Synthetic oligonucleotide
  Target: ATXN1; (-) strand; PAM type: NRG; PAM sequence: TAG
taattagctccttgaggcta

SEQ ID NO: 53825 - DNA, 20 bp, Artificial Sequence
  Description of Artificial Sequence: Synthetic oligonucleotide
  Target: ATXN1; (-) strand; PAM type: NRG; PAM sequence: AGG
acattttaattagctccttg

SEQ ID NO: 53826 - DNA, 20 bp, Artificial Sequence
  Description of Artificial Sequence: Synthetic oligonucleotide
  Target: ATXN1; (-) strand; PAM type: NRG; PAM sequence: GAG
cacattttaattagctcctt

SEQ ID NO: 53827 - DNA, 20 bp, Artificial Sequence
  Description of Artificial Sequence: Synthetic oligonucleotide
  Target: ATXN1; (-) strand; PAM type: NRG; PAM sequence: TAG
ctgccgtgtcacattttaat

SEQ ID NO: 53828 - DNA, 20 bp, Artificial Sequence
  Description of Artificial Sequence: Synthetic oligonucleotide
  Target: ATXN1; (-) strand; PAM type: NRG; PAM sequence: AAG
gaggacctatcgatacctct

SEQ ID NO: 53829 - DNA, 20 bp, Artificial Sequence
  Description of Artificial Sequence: Synthetic oligonucleotide
  Target: ATXN1; (-) strand; PAM type: NRG; PAM sequence: AGG
atctgtgctgtggaaaaatg

SEQ ID NO: 53830 - DNA, 20 bp, Artificial Sequence
  Description of Artificial Sequence: Synthetic oligonucleotide
  Target: ATXN1; (-) strand; PAM type: NRG; PAM sequence: GAG
tatctgtgctgtggaaaaat

SEQ ID NO: 53831 - DNA, 20 bp, Artificial Sequence
  Description of Artificial Sequence: Synthetic oligonucleotide
  Target: ATXN1; (-) strand; PAM type: NRG; PAM sequence: TGG
gcgtgagattatctgtgctg

SEQ ID NO: 53832 - DNA, 20 bp, Artificial Sequence
  Description of Artificial Sequence: Synthetic oligonucleotide
  Target: ATXN1; (-) strand; PAM type: NRG; PAM sequence: GAG
atataggtgagagctggcgt

SEQ ID NO: 53833 - DNA, 20 bp, Artificial Sequence
  Description of Artificial Sequence: Synthetic oligonucleotide
  Target: ATXN1; (-) strand; PAM type: NRG; PAM sequence: TGG
cacttaatataggtgagagc

SEQ ID NO: 53834 - DNA, 20 bp, Artificial Sequence
  Description of Artificial Sequence: Synthetic oligonucleotide
  Target: ATXN1; (-) strand; PAM type: NRG; PAM sequence: GAG
ctaacacttaatataggtga

SEQ ID NO: 53835 - DNA, 20 bp, Artificial Sequence
  Description of Artificial Sequence: Synthetic oligonucleotide
  Target: ATXN1; (-) strand; PAM type: NRG; PAM sequence: GAG
gtctaacacttaatataggt

SEQ ID NO: 53836 - DNA, 20 bp, Artificial Sequence
  Description of Artificial Sequence: Synthetic oligonucleotide
  Target: ATXN1; (-) strand; PAM type: NRG; PAM sequence: AGG
aagtgtctaacacttaatat

SEQ ID NO: 53837 - DNA, 20 bp, Artificial Sequence
  Description of Artificial Sequence: Synthetic oligonucleotide
  Target: ATXN1; (-) strand; PAM type: NRG; PAM sequence: TAG
caagtgtctaacacttaata

SEQ ID NO: 53838 - DNA, 20 bp, Artificial Sequence
  Description of Artificial Sequence: Synthetic oligonucleotide
  Target: ATXN1; (-) strand; PAM type: NRG; PAM sequence: AAG
cagaaatccgttcctgtacc

SEQ ID NO: 53839 - DNA, 20 bp, Artificial Sequence
  Description of Artificial Sequence: Synthetic oligonucleotide
  Target: ATXN1; (-) strand; PAM type: NRG; PAM sequence: CAG
cagtgagagatagggaagag

SEQ ID NO: 53840 - DNA, 20 bp, Artificial Sequence
  Description of Artificial Sequence: Synthetic oligonucleotide
  Target: ATXN1; (-) strand; PAM type: NRG; PAM sequence: GAG
gaacagtgagagatagggaa

SEQ ID NO: 53841 - DNA, 20 bp, Artificial Sequence
  Description of Artificial Sequence: Synthetic oligonucleotide
  Target: ATXN1; (-) strand; PAM type: NRG; PAM sequence: AAG
ctgaacagtgagagataggg

SEQ ID NO: 53842 - DNA, 20 bp, Artificial Sequence
  Description of Artificial Sequence: Synthetic oligonucleotide
  Target: ATXN1; (-) strand; PAM type: NRG; PAM sequence: GGG
tccctgaacagtgagagata

SEQ ID NO: 53843 - DNA, 20 bp, Artificial Sequence
  Description of Artificial Sequence: Synthetic oligonucleotide
  Target: ATXN1; (-) strand; PAM type: NRG; PAM sequence: AGG
gtccctgaacagtgagagat

SEQ ID NO: 53844 - DNA, 20 bp, Artificial Sequence
  Description of Artificial Sequence: Synthetic oligonucleotide
  Target: ATXN1; (-) strand; PAM type: NRG; PAM sequence: TAG
ggtccctgaacagtgagaga

SEQ ID NO: 53845 - DNA, 20 bp, Artificial Sequence
  Description of Artificial Sequence: Synthetic oligonucleotide
  Target: ATXN1; (-) strand; PAM type: NRG; PAM sequence: GAG
caaaggtccctgaacagtga

SEQ ID NO: 53846 - DNA, 20 bp, Artificial Sequence
  Description of Artificial Sequence: Synthetic oligonucleotide
  Target: ATXN1; (-) strand; PAM type: NRG; PAM sequence: GAG
accaaaggtccctgaacagt

SEQ ID NO: 53847 - DNA, 20 bp, Artificial Sequence
  Description of Artificial Sequence: Synthetic oligonucleotide
  Target: ATXN1; (-) strand; PAM type: NRG; PAM sequence: CAG
actgaccaaaggtccctgaa

SEQ ID NO: 53848 - DNA, 20 bp, Artificial Sequence
  Description of Artificial Sequence: Synthetic oligonucleotide
  Target: ATXN1; (-) strand; PAM type: NRG; PAM sequence: AGG
tatgctgaggaactgaccaa

SEQ ID NO: 53849 - DNA, 20 bp, Artificial Sequence
  Description of Artificial Sequence: Synthetic oligonucleotide
  Target: ATXN1; (-) strand; PAM type: NRG; PAM sequence: AAG
atatgctgaggaactgacca

SEQ ID NO: 53850 - DNA, 20 bp, Artificial Sequence
  Description of Artificial Sequence: Synthetic oligonucleotide
  Target: ATXN1; (-) strand; PAM type: NRG; PAM sequence: AGG
atttagggtacaatatgctg

SEQ ID NO: 53851 - DNA, 20 bp, Artificial Sequence
  Description of Artificial Sequence: Synthetic oligonucleotide
  Target: ATXN1; (-) strand; PAM type: NRG; PAM sequence: GAG
catttagggtacaatatgct

SEQ ID NO: 53852 - DNA, 20 bp, Artificial Sequence
  Description of Artificial Sequence: Synthetic oligonucleotide
  Target: ATXN1; (-) strand; PAM type: NRG; PAM sequence: GGG
ctgtctcatcacctcattta

SEQ ID NO: 53853 - DNA, 20 bp, Artificial Sequence
  Description of Artificial Sequence: Synthetic oligonucleotide
  Target: ATXN1; (-) strand; PAM type: NRG; PAM sequence: AGG
gctgtctcatcacctcattt

SEQ ID NO: 53854 - DNA, 20 bp, Artificial Sequence
  Description of Artificial Sequence: Synthetic oligonucleotide
  Target: ATXN1; (-) strand; PAM type: NRG; PAM sequence: TAG
tgctgtctcatcacctcatt

SEQ ID NO: 53855 - DNA, 20 bp, Artificial Sequence
  Description of Artificial Sequence: Synthetic oligonucleotide
  Target: ATXN1; (-) strand; PAM type: NRG; PAM sequence: TGG
tcactctctgatagttcagt

SEQ ID NO: 53856 - DNA, 20 bp, Artificial Sequence
  Description of Artificial Sequence: Synthetic oligonucleotide
  Target: ATXN1; (-) strand; PAM type: NRG; PAM sequence: CAG
gacctcactctctgatagtt

SEQ ID NO: 53857 - DNA, 20 bp, Artificial Sequence
  Description of Artificial Sequence: Synthetic oligonucleotide
  Target: ATXN1; (-) strand; PAM type: NRG; PAM sequence: TAG
attacgacctcactctctga

SEQ ID NO: 53858 - DNA, 20 bp, Artificial Sequence
  Description of Artificial Sequence: Synthetic oligonucleotide
  Target: ATXN1; (-) strand; PAM type: NRG; PAM sequence: AAG
gggttttaacagtgaccgat

SEQ ID NO: 53859 - DNA, 20 bp, Artificial Sequence
  Description of Artificial Sequence: Synthetic oligonucleotide
  Target: ATXN1; (-) strand; PAM type: NRG; PAM sequence: CAG
atgggttggatgggttttaa

SEQ ID NO: 53860 - DNA, 20 bp, Artificial Sequence
  Description of Artificial Sequence: Synthetic oligonucleotide
  Target: ATXN1; (-) strand; PAM type: NRG; PAM sequence: GGG
cataccaaaatgggttggat

SEQ ID NO: 53861 - DNA, 20 bp, Artificial Sequence
  Description of Artificial Sequence: Synthetic oligonucleotide
  Target: ATXN1; (-) strand; PAM type: NRG; PAM sequence: TGG
tcataccaaaatgggttgga

SEQ ID NO: 53862 - DNA, 20 bp, Artificial Sequence
  Description of Artificial Sequence: Synthetic oligonucleotide
  Target: ATXN1; (-) strand; PAM type: NRG; PAM sequence: TGG
agaatcataccaaaatgggt

SEQ ID NO: 53863 - DNA, 20 bp, Artificial Sequence
  Description of Artificial Sequence: Synthetic oligonucleotide
  Target: ATXN1; (-) strand; PAM type: NRG; PAM sequence: GGG
tgcaagaatcataccaaaat

SEQ ID NO: 53864 - DNA, 20 bp, Artificial Sequence
  Description of Artificial Sequence: Synthetic oligonucleotide
  Target: ATXN1; (-) strand; PAM type: NRG; PAM sequence: TGG
ctgcaagaatcataccaaaa

SEQ ID NO: 53865 - DNA, 20 bp, Artificial Sequence
  Description of Artificial Sequence: Synthetic oligonucleotide
  Target: ATXN1; (-) strand; PAM type: NRG; PAM sequence: AAG
ggccaggccttagtaactgc

SEQ ID NO: 53866 - DNA, 20 bp, Artificial Sequence
  Description of Artificial Sequence: Synthetic oligonucleotide
  Target: ATXN1; (-) strand; PAM type: NRG; PAM sequence: TAG
agagaatgaaggccaggcct

SEQ ID NO: 53867 - DNA, 20 bp, Artificial Sequence
  Description of Artificial Sequence: Synthetic oligonucleotide
  Target: ATXN1; (-) strand; PAM type: NRG; PAM sequence: AGG
gtggagagagaatgaaggcc

SEQ ID NO: 53868 - DNA, 20 bp, Artificial Sequence
  Description of Artificial Sequence: Synthetic oligonucleotide
  Target: ATXN1; (-) strand; PAM type: NRG; PAM sequence: CAG
agtggagagagaatgaaggc

SEQ ID NO: 53869 - DNA, 20 bp, Artificial Sequence
  Description of Artificial Sequence: Synthetic oligonucleotide
  Target: ATXN1; (-) strand; PAM type: NRG; PAM sequence: AGG
tctgagtggagagagaatga

SEQ ID NO: 53870 - DNA, 20 bp, Artificial Sequence
  Description of Artificial Sequence: Synthetic oligonucleotide
  Target: ATXN1; (-) strand; PAM type: NRG; PAM sequence: AAG
ttctgagtggagagagaatg

SEQ ID NO: 53871 - DNA, 20 bp, Artificial Sequence
  Description of Artificial Sequence: Synthetic oligonucleotide
  Target: ATXN1; (-) strand; PAM type: NRG; PAM sequence: GAG
aagtgaattctgagtggaga

SEQ ID NO: 53872 - DNA, 20 bp, Artificial Sequence
  Description of Artificial Sequence: Synthetic oligonucleotide
  Target: ATXN1; (-) strand; PAM type: NRG; PAM sequence: GAG
taaagtgaattctgagtgga

SEQ ID NO: 53873 - DNA, 20 bp, Artificial Sequence
  Description of Artificial Sequence: Synthetic oligonucleotide
  Target: ATXN1; (-) strand; PAM type: NRG; PAM sequence: GAG
cttaaagtgaattctgagtg

SEQ ID NO: 53874 - DNA, 20 bp, Artificial Sequence
  Description of Artificial Sequence: Synthetic oligonucleotide
  Target: ATXN1; (-) strand; PAM type: NRG; PAM sequence: TGG
agcttaaagtgaattctgag

SEQ ID NO: 53875 - DNA, 20 bp, Artificial Sequence
  Description of Artificial Sequence: Synthetic oligonucleotide
  Target: ATXN1; (-) strand; PAM type: NRG; PAM sequence: GAG
aatagcttaaagtgaattct

SEQ ID NO: 53876 - DNA, 20 bp, Artificial Sequence
  Description of Artificial Sequence: Synthetic oligonucleotide
  Target: ATXN1; (-) strand; PAM type: NRG; PAM sequence: AAG
agctttcttataatagctta

SEQ ID NO: 53877 - DNA, 20 bp, Artificial Sequence
  Description of Artificial Sequence: Synthetic oligonucleotide
  Target: ATXN1; (-) strand; PAM type: NRG; PAM sequence: TAG
tatctttagctttcttataa

SEQ ID NO: 53878 - DNA, 20 bp, Artificial Sequence
  Description of Artificial Sequence: Synthetic oligonucleotide
  Target: ATXN1; (-) strand; PAM type: NRG; PAM sequence: TAG
tgcagaagctgttttatctt

SEQ ID NO: 53879 - DNA, 20 bp, Artificial Sequence
  Description of Artificial Sequence: Synthetic oligonucleotide
  Target: ATXN1; (-) strand; PAM type: NRG; PAM sequence: AAG
attagtgtttcattatgcag

SEQ ID NO: 53880 - DNA, 20 bp, Artificial Sequence
  Description of Artificial Sequence: Synthetic oligonucleotide
  Target: ATXN1; (-) strand; PAM type: NRG; PAM sequence: CAG
gggattagtgtttcattatg

SEQ ID NO: 53881 - DNA, 20 bp, Artificial Sequence
  Description of Artificial Sequence: Synthetic oligonucleotide
  Target: ATXN1; (-) strand; PAM type: NRG; PAM sequence: TAG
gggcgtcacactctggggat

SEQ ID NO: 53882 - DNA, 20 bp, Artificial Sequence
  Description of Artificial Sequence: Synthetic oligonucleotide
  Target: ATXN1; (-) strand; PAM type: NRG; PAM sequence: GGG
gtcgtgggcgtcacactctg

SEQ ID NO: 53883 - DNA, 20 bp, Artificial Sequence
  Description of Artificial Sequence: Synthetic oligonucleotide
  Target: ATXN1; (-) strand; PAM type: NRG; PAM sequence: GGG
tgtcgtgggcgtcacactct

SEQ ID NO: 53884 - DNA, 20 bp, Artificial Sequence
  Description of Artificial Sequence: Synthetic oligonucleotide
  Target: ATXN1; (-) strand; PAM type: NRG; PAM sequence: TGG
gtgtcgtgggcgtcacactc

SEQ ID NO: 53885 - DNA, 20 bp, Artificial Sequence
  Description of Artificial Sequence: Synthetic oligonucleotide
  Target: ATXN1; (-) strand; PAM type: NRG; PAM sequence: GGG
ctagcattcatttgtgtcgt

SEQ ID NO: 53886 - DNA, 20 bp, Artificial Sequence
  Description of Artificial Sequence: Synthetic oligonucleotide
  Target: ATXN1; (-) strand; PAM type: NRG; PAM sequence: TGG
tctagcattcatttgtgtcg

SEQ ID NO: 53887 - DNA, 20 bp, Artificial Sequence
  Description of Artificial Sequence: Synthetic oligonucleotide
  Target: ATXN1; (-) strand; PAM type: NRG; PAM sequence: TAG
acatttggttatcttctgtc

SEQ ID NO: 53888 - DNA, 20 bp, Artificial Sequence
  Description of Artificial Sequence: Synthetic oligonucleotide
  Target: ATXN1; (-) strand; PAM type: NRG; PAM sequence: TGG
tttgaataagtctagacatt

SEQ ID NO: 53889 - DNA, 20 bp, Artificial Sequence
  Description of Artificial Sequence: Synthetic oligonucleotide
  Target: ATXN1; (-) strand; PAM type: NRG; PAM sequence: TAG
gaagcaggtttgaataagtc

SEQ ID NO: 53890 - DNA, 20 bp, Artificial Sequence
  Description of Artificial Sequence: Synthetic oligonucleotide
  Target: ATXN1; (-) strand; PAM type: NRG; PAM sequence: AAG
tatgagaagcaggtttgaat

SEQ ID NO: 53891 - DNA, 20 bp, Artificial Sequence
  Description of Artificial Sequence: Synthetic oligonucleotide
  Target: ATXN1; (-) strand; PAM type: NRG; PAM sequence: AGG
aagtttgaactatgagaagc

SEQ ID NO: 53892 - DNA, 20 bp, Artificial Sequence
  Description of Artificial Sequence: Synthetic oligonucleotide
  Target: ATXN1; (-) strand; PAM type: NRG; PAM sequence: CAG
caagtttgaactatgagaag

SEQ ID NO: 53893 - DNA, 20 bp, Artificial Sequence
  Description of Artificial Sequence: Synthetic oligonucleotide
  Target: ATXN1; (-) strand; PAM type: NRG; PAM sequence: AAG
gtacaagtttgaactatgag

SEQ ID NO: 53894 - DNA, 20 bp, Artificial Sequence
  Description of Artificial Sequence: Synthetic oligonucleotide
  Target: ATXN1; (-) strand; PAM type: NRG; PAM sequence: GAG
tgagtacaagtttgaactat

SEQ ID NO: 53895 - DNA, 20 bp, Artificial Sequence
  Description of Artificial Sequence: Synthetic oligonucleotide
  Target: ATXN1; (-) strand; PAM type: NRG; PAM sequence: AAG
gctgatgaagcagtgagtac

SEQ ID NO: 53896 - DNA, 20 bp, Artificial Sequence
  Description of Artificial Sequence: Synthetic oligonucleotide
  Target: ATXN1; (-) strand; PAM type: NRG; PAM sequence: GAG
tcataagctgatgaagcagt

SEQ ID NO: 53897 - DNA, 20 bp, Artificial Sequence
  Description of Artificial Sequence: Synthetic oligonucleotide
  Target: ATXN1; (-) strand; PAM type: NRG; PAM sequence: CAG
tggttcataagctgatgaag

SEQ ID NO: 53898 - DNA, 20 bp, Artificial Sequence
  Description of Artificial Sequence: Synthetic oligonucleotide
  Target: ATXN1; (-) strand; PAM type: NRG; PAM sequence: AAG
ttatggttcataagctgatg

SEQ ID NO: 53899 - DNA, 20 bp, Artificial Sequence
  Description of Artificial Sequence: Synthetic oligonucleotide
  Target: ATXN1; (-) strand; PAM type: NRG; PAM sequence: AAG
taaatcagtttatggttcat

SEQ ID NO: 53900 - DNA, 20 bp, Artificial Sequence
  Description of Artificial Sequence: Synthetic oligonucleotide
  Target: ATXN1; (-) strand; PAM type: NRG; PAM sequence: TGG
tgtgtttttaaatcagttta

SEQ ID NO: 53901 - DNA, 20 bp, Artificial Sequence
  Description of Artificial Sequence: Synthetic oligonucleotide
  Target: ATXN1; (-) strand; PAM type: NRG; PAM sequence: CAG
ttgcatgtgtgtttttaaat

SEQ ID NO: 53902 - DNA, 20 bp, Artificial Sequence
  Description of Artificial Sequence: Synthetic oligonucleotide
  Target: ATXN1; (-) strand; PAM type: NRG; PAM sequence: CAG
gtttttttgttgttgttgtt

SEQ ID NO: 53903 - DNA, 20 bp, Artificial Sequence
  Description of Artificial Sequence: Synthetic oligonucleotide
  Target: ATXN1; (-) strand; PAM type: NRG; PAM sequence: TAG
tgaagaggctctactgggtt

SEQ ID NO: 53904 - DNA, 20 bp, Artificial Sequence
  Description of Artificial Sequence: Synthetic oligonucleotide
  Target: ATXN1; (-) strand; PAM type: NRG; PAM sequence: GGG
ctgagtgaagaggctctact

SEQ ID NO: 53905 - DNA, 20 bp, Artificial Sequence
  Description of Artificial Sequence: Synthetic oligonucleotide
  Target: ATXN1; (-) strand; PAM type: NRG; PAM sequence: TGG
cctgagtgaagaggctctac

SEQ ID NO: 53906 - DNA, 20 bp, Artificial Sequence
  Description of Artificial Sequence: Synthetic oligonucleotide
  Target: ATXN1; (-) strand; PAM type: NRG; PAM sequence: AGG
ataaaaaggcctgagtgaag

SEQ ID NO: 53907 - DNA, 20 bp, Artificial Sequence
  Description of Artificial Sequence: Synthetic oligonucleotide
  Target: ATXN1; (-) strand; PAM type: NRG; PAM sequence: GAG
aataaaaaggcctgagtgaa

SEQ ID NO: 53908 - DNA, 20 bp, Artificial Sequence
  Description of Artificial Sequence: Synthetic oligonucleotide
  Target: ATXN1; (-) strand; PAM type: NRG; PAM sequence: AAG
caaataaaaaggcctgagtg

SEQ ID NO: 53909 - DNA, 20 bp, Artificial Sequence
  Description of Artificial Sequence: Synthetic oligonucleotide
  Target: ATXN1; (-) strand; PAM type: NRG; PAM sequence: GAG
aaactcaaataaaaaggcct

SEQ ID NO: 53910 - DNA, 20 bp, Artificial Sequence
  Description of Artificial Sequence: Synthetic oligonucleotide
  Target: ATXN1; (-) strand; PAM type: NRG; PAM sequence: AGG
atagataaactcaaataaaa

SEQ ID NO: 53911 - DNA, 20 bp, Artificial Sequence
  Description of Artificial Sequence: Synthetic oligonucleotide
  Target: ATXN1; (-) strand; PAM type: NRG; PAM sequence: AAG
gatagataaactcaaataaa

SEQ ID NO: 53912 - DNA, 20 bp, Artificial Sequence
  Description of Artificial Sequence: Synthetic oligonucleotide
  Target: ATXN1; (-) strand; PAM type: NRG; PAM sequence: TAG
gaggcattactgcattcgga

SEQ ID NO: 53913 - DNA, 20 bp, Artificial Sequence
  Description of Artificial Sequence: Synthetic oligonucleotide
  Target: ATXN1; (-) strand; PAM type: NRG; PAM sequence: CGG
taaggaggcattactgcatt

SEQ ID NO: 53914 - DNA, 20 bp, Artificial Sequence
  Description of Artificial Sequence: Synthetic oligonucleotide
  Target: ATXN1; (-) strand; PAM type: NRG; PAM sequence: AGG
taagctgtgtctgcttaagg

SEQ ID NO: 53915 - DNA, 20 bp, Artificial Sequence
  Description of Artificial Sequence: Synthetic oligonucleotide
  Target: ATXN1; (-) strand; PAM type: NRG; PAM sequence: GAG
gtaagctgtgtctgcttaag

SEQ ID NO: 53916 - DNA, 20 bp, Artificial Sequence
  Description of Artificial Sequence: Synthetic oligonucleotide
  Target: ATXN1; (-) strand; PAM type: NRG; PAM sequence: AGG
cagtaagctgtgtctgctta

SEQ ID NO: 53917 - DNA, 20 bp, Artificial Sequence
  Description of Artificial Sequence: Synthetic oligonucleotide
  Target: ATXN1; (-) strand; PAM type: NRG; PAM sequence: AAG
tcagtaagctgtgtctgctt

SEQ ID NO: 53918 - DNA, 20 bp, Artificial Sequence
  Description of Artificial Sequence: Synthetic oligonucleotide
  Target: ATXN1; (-) strand; PAM type: NRG; PAM sequence: AAG
aaattgtgtatattttcagt

SEQ ID NO: 53919 - DNA, 20 bp, Artificial Sequence
  Description of Artificial Sequence: Synthetic oligonucleotide
  Target: ATXN1; (-) strand; PAM type: NRG; PAM sequence: CAG
ctacaaattgtgtatatttt

SEQ ID NO: 53920 - DNA, 20 bp, Artificial Sequence
  Description of Artificial Sequence: Synthetic oligonucleotide
  Target: ATXN1; (-) strand; PAM type: NRG; PAM sequence: CAG
acaaaggccatattctcttt

SEQ ID NO: 53921 - DNA, 20 bp, Artificial Sequence
  Description of Artificial Sequence: Synthetic oligonucleotide
  Target: ATXN1; (-) strand; PAM type: NRG; PAM sequence: AGG
ttgagtagaaagaaggacaa

SEQ ID NO: 53922 - DNA, 20 bp, Artificial Sequence
  Description of Artificial Sequence: Synthetic oligonucleotide
  Target: ATXN1; (-) strand; PAM type: NRG; PAM sequence: AAG
attgagtagaaagaaggaca

SEQ ID NO: 53923 - DNA, 20 bp, Artificial Sequence
  Description of Artificial Sequence: Synthetic oligonucleotide
  Target: ATXN1; (-) strand; PAM type: NRG; PAM sequence: AGG
caacatattgagtagaaaga

SEQ ID NO: 53924 - DNA, 20 bp, Artificial Sequence
  Description of Artificial Sequence: Synthetic oligonucleotide
  Target: ATXN1; (-) strand; PAM type: NRG; PAM sequence: AAG
ccaacatattgagtagaaag

SEQ ID NO: 53925 - DNA, 20 bp, Artificial Sequence
  Description of Artificial Sequence: Synthetic oligonucleotide
  Target: ATXN1; (-) strand; PAM type: NRG; PAM sequence: AAG
ccaccaacatattgagtaga

SEQ ID NO: 53926 - DNA, 20 bp, Artificial Sequence
  Description of Artificial Sequence: Synthetic oligonucleotide
  Target: ATXN1; (-) strand; PAM type: NRG; PAM sequence: TAG
cagtccaccaacatattgag

SEQ ID NO: 53927 - DNA, 20 bp, Artificial Sequence
  Description of Artificial Sequence: Synthetic oligonucleotide
  Target: ATXN1; (-) strand; PAM type: NRG; PAM sequence: GAG
ttccagtccaccaacatatt

SEQ ID NO: 53928 - DNA, 20 bp, Artificial Sequence
  Description of Artificial Sequence: Synthetic oligonucleotide
  Target: ATXN1; (-) strand; PAM type: NRG; PAM sequence: CAG
tgactacattggaaacattc

SEQ ID NO: 53929 - DNA, 20 bp, Artificial Sequence
  Description of Artificial Sequence: Synthetic oligonucleotide
  Target: ATXN1; (-) strand; PAM type: NRG; PAM sequence: TGG
gccagaaaaattgactacat

SEQ ID NO: 53930 - DNA, 20 bp, Artificial Sequence
  Description of Artificial Sequence: Synthetic oligonucleotide
  Target: ATXN1; (-) strand; PAM type: NRG; PAM sequence: CAG
ttaatttaattttaaagagc

SEQ ID NO: 53931 - DNA, 20 bp, Artificial Sequence
  Description of Artificial Sequence: Synthetic oligonucleotide
  Target: ATXN1; (-) strand; PAM type: NRG; PAM sequence: GAG
tttattaatttaattttaaa

SEQ ID NO: 53932 - DNA, 20 bp, Artificial Sequence
  Description of Artificial Sequence: Synthetic oligonucleotide
  Target: ATXN1; (-) strand; PAM type: NRG; PAM sequence: AAG
cttttattaatttaatttta

SEQ ID NO: 53933 - DNA, 20 bp, Artificial Sequence
  Description of Artificial Sequence: Synthetic oligonucleotide
  Target: ATXN1; (-) strand; PAM type: NRG; PAM sequence: TAG
ttgtgctgaacacaaatcta

SEQ ID NO: 53934 - DNA, 20 bp, Artificial Sequence
  Description of Artificial Sequence: Synthetic oligonucleotide
  Target: ATXN1; (-) strand; PAM type: NRG; PAM sequence: TAG
gaatccagtagctcaacttt

SEQ ID NO: 53935 - DNA, 20 bp, Artificial Sequence
  Description of Artificial Sequence: Synthetic oligonucleotide
  Target: ATXN1; (-) strand; PAM type: NRG; PAM sequence: TAG
cattttgttctagaatccag

SEQ ID NO: 53936 - DNA, 20 bp, Artificial Sequence
  Description of Artificial Sequence: Synthetic oligonucleotide
  Target: ATXN1; (-) strand; PAM type: NRG; PAM sequence: CAG
tgacattttgttctagaatc

SEQ ID NO: 53937 - DNA, 20 bp, Artificial Sequence
  Description of Artificial Sequence: Synthetic oligonucleotide
  Target: ATXN1; (-) strand; PAM type: NRG; PAM sequence: TAG
ttataagtgacattttgttc

SEQ ID NO: 53938 - DNA, 20 bp, Artificial Sequence
  Description of Artificial Sequence: Synthetic oligonucleotide
  Target: ATXN1; (-) strand; PAM type: NRG; PAM sequence: AAG
atatatactcagctaattat

SEQ ID NO: 53939 - DNA, 20 bp, Artificial Sequence
  Description of Artificial Sequence: Synthetic oligonucleotide
  Target: ATXN1; (-) strand; PAM type: NRG; PAM sequence: CAG
cctgagatgtcatatatact

SEQ ID NO: 53940 - DNA, 20 bp, Artificial Sequence
  Description of Artificial Sequence: Synthetic oligonucleotide
  Target: ATXN1; (-) strand; PAM type: NRG; PAM sequence: GAG
gggcccttggtacaatgcct

SEQ ID NO: 53941 - DNA, 20 bp, Artificial Sequence
  Description of Artificial Sequence: Synthetic oligonucleotide
  Target: ATXN1; (-) strand; PAM type: NRG; PAM sequence: TGG
gaggtaattttctgggccct

SEQ ID NO: 53942 - DNA, 20 bp, Artificial Sequence
  Description of Artificial Sequence: Synthetic oligonucleotide
  Target: ATXN1; (-) strand; PAM type: NRG; PAM sequence: GGG
atgaaatgaggtaattttct

SEQ ID NO: 53943 - DNA, 20 bp, Artificial Sequence
  Description of Artificial Sequence: Synthetic oligonucleotide
  Target: ATXN1; (-) strand; PAM type: NRG; PAM sequence: TGG
aatgaaatgaggtaattttc

SEQ ID NO: 53944 - DNA, 20 bp, Artificial Sequence
  Description of Artificial Sequence: Synthetic oligonucleotide
  Target: ATXN1; (-) strand; PAM type: NRG; PAM sequence: AGG
aaaattataaaaatgaaatg

SEQ ID NO: 53945 - DNA, 20 bp, Artificial Sequence
  Description of Artificial Sequence: Synthetic oligonucleotide
  Target: ATXN1; (-) strand; PAM type: NRG; PAM sequence: GAG
gaaaattataaaaatgaaat

SEQ ID NO: 53946 - DNA, 20 bp, Artificial Sequence
  Description of Artificial Sequence: Synthetic oligonucleotide
  Target: ATXN1; (-) strand; PAM type: NRG; PAM sequence: GGG
ggtatcctagctaggaaagt

SEQ ID NO: 53947 - DNA, 20 bp, Artificial Sequence
  Description of Artificial Sequence: Synthetic oligonucleotide
  Target: ATXN1; (-) strand; PAM type: NRG; PAM sequence: TGG
aggtatcctagctaggaaag

SEQ ID NO: 53948 - DNA, 20 bp, Artificial Sequence
  Description of Artificial Sequence: Synthetic oligonucleotide
  Target: ATXN1; (-) strand; PAM type: NRG; PAM sequence: AAG
ggtaggtatcctagctagga

SEQ ID NO: 53949 - DNA, 20 bp, Artificial Sequence
  Description of Artificial Sequence: Synthetic oligonucleotide
  Target: ATXN1; (-) strand; PAM type: NRG; PAM sequence: AGG
aattggtaggtatcctagct

SEQ ID NO: 53950 - DNA, 20 bp, Artificial Sequence
  Description of Artificial Sequence: Synthetic oligonucleotide
  Target: ATXN1; (-) strand; PAM type: NRG; PAM sequence: TAG
caattggtaggtatcctagc

SEQ ID NO: 53951 - DNA, 20 bp, Artificial Sequence
  Description of Artificial Sequence: Synthetic oligonucleotide
  Target: ATXN1; (-) strand; PAM type: NRG; PAM sequence: TAG
aacacaattggtaggtatcc

SEQ ID NO: 53952 - DNA, 20 bp, Artificial Sequence
  Description of Artificial Sequence: Synthetic oligonucleotide
  Target: ATXN1; (-) strand; PAM type: NRG; PAM sequence: AGG
tgcccaagaacacaattggt

SEQ ID NO: 53953 - DNA, 20 bp, Artificial Sequence
  Description of Artificial Sequence: Synthetic oligonucleotide
  Target: ATXN1; (-) strand; PAM type: NRG; PAM sequence: TAG
ttgcccaagaacacaattgg

SEQ ID NO: 53954 - DNA, 20 bp, Artificial Sequence
  Description of Artificial Sequence: Synthetic oligonucleotide
  Target: ATXN1; (-) strand; PAM type: NRG; PAM sequence: TGG
aatttgcccaagaacacaat

SEQ ID NO: 53955 - DNA, 20 bp, Artificial Sequence
  Description of Artificial Sequence: Synthetic oligonucleotide
  Target: ATXN1; (-) strand; PAM type: NRG; PAM sequence: AAG
agatagaagataatttgccc

SEQ ID NO: 53956 - DNA, 20 bp, Artificial Sequence
  Description of Artificial Sequence: Synthetic oligonucleotide
  Target: ATXN1; (-) strand; PAM type: NRG; PAM sequence: AAG
tgttgtacaaaccaagatag

SEQ ID NO: 53957 - DNA, 20 bp, Artificial Sequence
  Description of Artificial Sequence: Synthetic oligonucleotide
  Target: ATXN1; (-) strand; PAM type: NRG; PAM sequence: TAG
ttctgttgtacaaaccaaga

SEQ ID NO: 53958 - DNA, 20 bp, Artificial Sequence
  Description of Artificial Sequence: Synthetic oligonucleotide
  Target: ATXN1; (-) strand; PAM type: NRG; PAM sequence: AAG
cttcttctgttgtacaaacc

SEQ ID NO: 53959 - DNA, 20 bp, Artificial Sequence
  Description of Artificial Sequence: Synthetic oligonucleotide
  Target: ATXN1; (-) strand; PAM type: NRG; PAM sequence: TGG
actgcctaatattaattaat

SEQ ID NO: 53960 - DNA, 20 bp, Artificial Sequence
  Description of Artificial Sequence: Synthetic oligonucleotide
  Target: ATXN1; (-) strand; PAM type: NRG; PAM sequence: GAG
tccagtctgggcgacagagt

SEQ ID NO: 53961 - DNA, 20 bp, Artificial Sequence
  Description of Artificial Sequence: Synthetic oligonucleotide
  Target: ATXN1; (-) strand; PAM type: NRG; PAM sequence: GAG
tcactccagtctgggcgaca

SEQ ID NO: 53962 - DNA, 20 bp, Artificial Sequence
  Description of Artificial Sequence: Synthetic oligonucleotide
  Target: ATXN1; (-) strand; PAM type: NRG; PAM sequence: CAG
tttcactccagtctgggcga

SEQ ID NO: 53963 - DNA, 20 bp, Artificial Sequence
  Description of Artificial Sequence: Synthetic oligonucleotide
  Target: ATXN1; (-) strand; PAM type: NRG; PAM sequence: GGG
gcaccatttcactccagtct

SEQ ID NO: 53964 - DNA, 20 bp, Artificial Sequence
  Description of Artificial Sequence: Synthetic oligonucleotide
  Target: ATXN1; (-) strand; PAM type: NRG; PAM sequence: TGG
cgcaccatttcactccagtc

SEQ ID NO: 53965 - DNA, 20 bp, Artificial Sequence
  Description of Artificial Sequence: Synthetic oligonucleotide
  Target: ATXN1; (-) strand; PAM type: NRG; PAM sequence: CAG
gagatcgcaccatttcactc

SEQ ID NO: 53966 - DNA, 20 bp, Artificial Sequence
  Description of Artificial Sequence: Synthetic oligonucleotide
  Target: ATXN1; (-) strand; PAM type: NRG; PAM sequence: GAG
ggcagaggttgcagtgagcc

SEQ ID NO: 53967 - DNA, 20 bp, Artificial Sequence
  Description of Artificial Sequence: Synthetic oligonucleotide
  Target: ATXN1; (-) strand; PAM type: NRG; PAM sequence: GAG
caggaggcagaggttgcagt

SEQ ID NO: 53968 - DNA, 20 bp, Artificial Sequence
  Description of Artificial Sequence: Synthetic oligonucleotide
  Target: ATXN1; (-) strand; PAM type: NRG; PAM sequence: CAG
aacccaggaggcagaggttg

SEQ ID NO: 53969 - DNA, 20 bp, Artificial Sequence
  Description of Artificial Sequence: Synthetic oligonucleotide
  Target: ATXN1; (-) strand; PAM type: NRG; PAM sequence: AGG
ctcttgaacccaggaggcag

SEQ ID NO: 53970 - DNA, 20 bp, Artificial Sequence
  Description of Artificial Sequence: Synthetic oligonucleotide
  Target: ATXN1; (-) strand; PAM type: NRG; PAM sequence: GAG
tctcttgaacccaggaggca

SEQ ID NO: 53971 - DNA, 20 bp, Artificial Sequence
  Description of Artificial Sequence: Synthetic oligonucleotide
  Target: ATXN1; (-) strand; PAM type: NRG; PAM sequence: CAG
aatctcttgaacccaggagg

SEQ ID NO: 53972 - DNA, 20 bp, Artificial Sequence
  Description of Artificial Sequence: Synthetic oligonucleotide
  Target: ATXN1; (-) strand; PAM type: NRG; PAM sequence: AGG
gagaatctcttgaacccagg

SEQ ID NO: 53973 - DNA, 20 bp, Artificial Sequence
  Description of Artificial Sequence: Synthetic oligonucleotide
  Target: ATXN1; (-) strand; PAM type: NRG; PAM sequence: GAG
ggagaatctcttgaacccag

SEQ ID NO: 53974 - DNA, 20 bp, Artificial Sequence
  Description of Artificial Sequence: Synthetic oligonucleotide
  Target: ATXN1; (-) strand; PAM type: NRG; PAM sequence: AGG
caggagaatctcttgaaccc

SEQ ID NO: 53975 - DNA, 20 bp, Artificial Sequence
  Description of Artificial Sequence: Synthetic oligonucleotide
  Target: ATXN1; (-) strand; PAM type: NRG; PAM sequence: CAG
gcaggagaatctcttgaacc

SEQ ID NO: 53976 - DNA, 20 bp, Artificial Sequence
  Description of Artificial Sequence: Synthetic oligonucleotide
  Target: ATXN1; (-) strand; PAM type: NRG; PAM sequence: GAG
tactcgggaggctgaggcag

SEQ ID NO: 53977 - DNA, 20 bp, Artificial Sequence
  Description of Artificial Sequence: Synthetic oligonucleotide
  Target: ATXN1; (-) strand; PAM type: NRG; PAM sequence: AGG
gctactcgggaggctgaggc

SEQ ID NO: 53978 - DNA, 20 bp, Artificial Sequence
  Description of Artificial Sequence: Synthetic oligonucleotide
  Target: ATXN1; (-) strand; PAM type: NRG; PAM sequence: CAG
agctactcgggaggctgagg

SEQ ID NO: 53979 - DNA, 20 bp, Artificial Sequence
  Description of Artificial Sequence: Synthetic oligonucleotide
  Target: ATXN1; (-) strand; PAM type: NRG; PAM sequence: AGG
tccagctactcgggaggctg

SEQ ID NO: 53980 - DNA, 20 bp, Artificial Sequence
  Description of Artificial Sequence: Synthetic oligonucleotide
  Target: ATXN1; (-) strand; PAM type: NRG; PAM sequence: GAG
ttccagctactcgggaggct

SEQ ID NO: 53981 - DNA, 20 bp, Artificial Sequence
  Description of Artificial Sequence: Synthetic oligonucleotide
  Target: ATXN1; (-) strand; PAM type: NRG; PAM sequence: AGG
cgtagttccagctactcggg

SEQ ID NO: 53982 - DNA, 20 bp, Artificial Sequence
  Description of Artificial Sequence: Synthetic oligonucleotide
  Target: ATXN1; (-) strand; PAM type: NRG; PAM sequence: GAG
ccgtagttccagctactcgg

SEQ ID NO: 53983 - DNA, 20 bp, Artificial Sequence
  Description of Artificial Sequence: Synthetic oligonucleotide
  Target: ATXN1; (-) strand; PAM type: NRG; PAM sequence: GGG
tgccgtagttccagctactc

SEQ ID NO: 53984 - DNA, 20 bp, Artificial Sequence
  Description of Artificial Sequence: Synthetic oligonucleotide
  Target: ATXN1; (-) strand; PAM type: NRG; PAM sequence: CGG
gtgccgtagttccagctact

SEQ ID NO: 53985 - DNA, 20 bp, Artificial Sequence
  Description of Artificial Sequence: Synthetic oligonucleotide
  Target: ATXN1; (-) strand; PAM type: NRG; PAM sequence: CAG
ggtggcaggtgccgtagttc

SEQ ID NO: 53986 - DNA, 20 bp, Artificial Sequence
  Description of Artificial Sequence: Synthetic oligonucleotide
  Target: ATXN1; (-) strand; PAM type: NRG; PAM sequence: TAG
gggcatggtggcaggtgccg

SEQ ID NO: 53987 - DNA, 20 bp, Artificial Sequence
  Description of Artificial Sequence: Synthetic oligonucleotide
  Target: ATXN1; (-) strand; PAM type: NRG; PAM sequence: AGG
aattagccgggcatggtggc

SEQ ID NO: 53988 - DNA, 20 bp, Artificial Sequence
  Description of Artificial Sequence: Synthetic oligonucleotide
  Target: ATXN1; (-) strand; PAM type: NRG; PAM sequence: CAG
aaattagccgggcatggtgg

SEQ ID NO: 53989 - DNA, 20 bp, Artificial Sequence
  Description of Artificial Sequence: Synthetic oligonucleotide
  Target: ATXN1; (-) strand; PAM type: NRG; PAM sequence: TGG
aaaaaattagccgggcatgg

SEQ ID NO: 53990 - DNA, 20 bp, Artificial Sequence
  Description of Artificial Sequence: Synthetic oligonucleotide
  Target: ATXN1; (-) strand; PAM type: NRG; PAM sequence: TGG
tacaaaaaattagccgggca

SEQ ID NO: 53991 - DNA, 20 bp, Artificial Sequence
  Description of Artificial Sequence: Synthetic oligonucleotide
  Target: ATXN1; (-) strand; PAM type: NRG; PAM sequence: GGG
aaaaatacaaaaaattagcc

SEQ ID NO: 53992 - DNA, 20 bp, Artificial Sequence
  Description of Artificial Sequence: Synthetic oligonucleotide
  Target: ATXN1; (-) strand; PAM type: NRG; PAM sequence: CGG
taaaaatacaaaaaattagc

SEQ ID NO: 53993 - DNA, 20 bp, Artificial Sequence
  Description of Artificial Sequence: Synthetic oligonucleotide
  Target: ATXN1; (-) strand; PAM type: NRG; PAM sequence: TAG
ctcctaaaaatacaaaaaat

SEQ ID NO: 53994 - DNA, 20 bp, Artificial Sequence
  Description of Artificial Sequence: Synthetic oligonucleotide
  Target: ATXN1; (-) strand; PAM type: NRG; PAM sequence: TGG
cgagaccatcctggccaaca

SEQ ID NO: 53995 - DNA, 20 bp, Artificial Sequence
  Description of Artificial Sequence: Synthetic oligonucleotide
  Target: ATXN1; (-) strand; PAM type: NRG; PAM sequence: TGG
tcaggagttcgagaccatcc

SEQ ID NO: 53996 - DNA, 20 bp, Artificial Sequence
  Description of Artificial Sequence: Synthetic oligonucleotide
  Target: ATXN1; (-) strand; PAM type: NRG; PAM sequence: GAG
gcatctgaggtcaggagttc

SEQ ID NO: 53997 - DNA, 20 bp, Artificial Sequence
  Description of Artificial Sequence: Synthetic oligonucleotide
  Target: ATXN1; (-) strand; PAM type: NRG; PAM sequence: GAG
ggtggagcatctgaggtcag

SEQ ID NO: 53998 - DNA, 20 bp, Artificial Sequence
  Description of Artificial Sequence: Synthetic oligonucleotide
  Target: ATXN1; (-) strand; PAM type: NRG; PAM sequence: AGG
agggtggagcatctgaggtc

SEQ ID NO: 53999 - DNA, 20 bp, Artificial Sequence
  Description of Artificial Sequence: Synthetic oligonucleotide
  Target: ATXN1; (-) strand; PAM type: NRG; PAM sequence: CAG
gagggtggagcatctgaggt

SEQ ID NO: 54000 - DNA, 20 bp, Artificial Sequence
  Description of Artificial Sequence: Synthetic oligonucleotide
  Target: ATXN1; (-) strand; PAM type: NRG; PAM sequence: AGG
caaggagggtggagcatctg

SEQ ID NO: 54001 - DNA, 20 bp, Artificial Sequence
  Description of Artificial Sequence: Synthetic oligonucleotide
  Target: ATXN1; (-) strand; PAM type: NRG; PAM sequence: GAG
ccaaggagggtggagcatct

SEQ ID NO: 54002 - DNA, 20 bp, Artificial Sequence
  Description of Artificial Sequence: Synthetic oligonucleotide
  Target: ATXN1; (-) strand; PAM type: NRG; PAM sequence: GAG
ttgggaggccaaggagggtg

SEQ ID NO: 54003 - DNA, 20 bp, Artificial Sequence
  Description of Artificial Sequence: Synthetic oligonucleotide
  Target: ATXN1; (-) strand; PAM type: NRG; PAM sequence: TGG
ctttgggaggccaaggaggg

SEQ ID NO: 54004 - DNA, 20 bp, Artificial Sequence
  Description of Artificial Sequence: Synthetic oligonucleotide
  Target: ATXN1; (-) strand; PAM type: NRG; PAM sequence: GGG
gcactttgggaggccaagga

SEQ ID NO: 54005 - DNA, 20 bp, Artificial Sequence
  Description of Artificial Sequence: Synthetic oligonucleotide
  Target: ATXN1; (-) strand; PAM type: NRG; PAM sequence: AGG
agcactttgggaggccaagg

SEQ ID NO: 54006 - DNA, 20 bp, Artificial Sequence
  Description of Artificial Sequence: Synthetic oligonucleotide
  Target: ATXN1; (-) strand; PAM type: NRG; PAM sequence: GAG
cagcactttgggaggccaag

SEQ ID NO: 54007 - DNA, 20 bp, Artificial Sequence
  Description of Artificial Sequence: Synthetic oligonucleotide
  Target: ATXN1; (-) strand; PAM type: NRG; PAM sequence: AGG
cccagcactttgggaggcca

SEQ ID NO: 54008 - DNA, 20 bp, Artificial Sequence
  Description of Artificial Sequence: Synthetic oligonucleotide
  Target: ATXN1; (-) strand; PAM type: NRG; PAM sequence: AAG
tcccagcactttgggaggcc

SEQ ID NO: 54009 - DNA, 20 bp, Artificial Sequence
  Description of Artificial Sequence: Synthetic oligonucleotide
  Target: ATXN1; (-) strand; PAM type: NRG; PAM sequence: AGG
tgtaatcccagcactttggg

SEQ ID NO: 54010 - DNA, 20 bp, Artificial Sequence
  Description of Artificial Sequence: Synthetic oligonucleotide
  Target: ATXN1; (-) strand; PAM type: NRG; PAM sequence: GAG
ctgtaatcccagcactttgg

SEQ ID NO: 54011 - DNA, 20 bp, Artificial Sequence
  Description of Artificial Sequence: Synthetic oligonucleotide
  Target: ATXN1; (-) strand; PAM type: NRG; PAM sequence: GGG
gcctgtaatcccagcacttt

SEQ ID NO: 54012 - DNA, 20 bp, Artificial Sequence
  Description of Artificial Sequence: Synthetic oligonucleotide
  Target: ATXN1; (-) strand; PAM type: NRG; PAM sequence: TGG
cgcctgtaatcccagcactt

SEQ ID NO: 54013 - DNA, 20 bp, Artificial Sequence
  Description of Artificial Sequence: Synthetic oligonucleotide
  Target: ATXN1; (-) strand; PAM type: NRG; PAM sequence: CAG
gtggctcacgcctgtaatcc

SEQ ID NO: 54014 - DNA, 20 bp, Artificial Sequence
  Description of Artificial Sequence: Synthetic oligonucleotide
  Target: ATXN1; (-) strand; PAM type: NRG; PAM sequence: TGG
accacttgggctgggcgcgg

SEQ ID NO: 54015 - DNA, 20 bp, Artificial Sequence
  Description of Artificial Sequence: Synthetic oligonucleotide
  Target: ATXN1; (-) strand; PAM type: NRG; PAM sequence: CGG
ataaccacttgggctgggcg

SEQ ID NO: 54016 - DNA, 20 bp, Artificial Sequence
  Description of Artificial Sequence: Synthetic oligonucleotide
  Target: ATXN1; (-) strand; PAM type: NRG; PAM sequence: GGG
aaataataaccacttgggct

SEQ ID NO: 54017 - DNA, 20 bp, Artificial Sequence
  Description of Artificial Sequence: Synthetic oligonucleotide
  Target: ATXN1; (-) strand; PAM type: NRG; PAM sequence: TGG
gaaataataaccacttgggc

SEQ ID NO: 54018 - DNA, 20 bp, Artificial Sequence
  Description of Artificial Sequence: Synthetic oligonucleotide
  Target: ATXN1; (-) strand; PAM type: NRG; PAM sequence: GGG
tgttgaaataataaccactt

SEQ ID NO: 54019 - DNA, 20 bp, Artificial Sequence
  Description of Artificial Sequence: Synthetic oligonucleotide
  Target: ATXN1; (-) strand; PAM type: NRG; PAM sequence: TGG
gtgttgaaataataaccact

SEQ ID NO: 54020 - DNA, 20 bp, Artificial Sequence
  Description of Artificial Sequence: Synthetic oligonucleotide
  Target: ATXN1; (-) strand; PAM type: NRG; PAM sequence: AGG
ccagctgcttcgggtaaaca

SEQ ID NO: 54021 - DNA, 20 bp, Artificial Sequence
  Description of Artificial Sequence: Synthetic oligonucleotide
  Target: ATXN1; (-) strand; PAM type: NRG; PAM sequence: AAG
cccagctgcttcgggtaaac

SEQ ID NO: 54022 - DNA, 20 bp, Artificial Sequence
  Description of Artificial Sequence: Synthetic oligonucleotide
  Target: ATXN1; (-) strand; PAM type: NRG; PAM sequence: GGG
ccctatttcccagctgcttc

SEQ ID NO: 54023 - DNA, 20 bp, Artificial Sequence
  Description of Artificial Sequence: Synthetic oligonucleotide
  Target: ATXN1; (-) strand; PAM type: NRG; PAM sequence: CGG
gccctatttcccagctgctt

SEQ ID NO: 54024 - DNA, 20 bp, Artificial Sequence
  Description of Artificial Sequence: Synthetic oligonucleotide
  Target: ATXN1; (-) strand; PAM type: NRG; PAM sequence: CAG
ttatgcgaagccctatttcc

SEQ ID NO: 54025 - DNA, 20 bp, Artificial Sequence
  Description of Artificial Sequence: Synthetic oligonucleotide
  Target: ATXN1; (-) strand; PAM type: NRG; PAM sequence: AAG
ttctgctctggttttatgcg

SEQ ID NO: 54026 - DNA, 20 bp, Artificial Sequence
  Description of Artificial Sequence: Synthetic oligonucleotide
  Target: ATXN1; (-) strand; PAM type: NRG; PAM sequence: TGG
tttctctgctacttctgctc

SEQ ID NO: 54027 - DNA, 20 bp, Artificial Sequence
  Description of Artificial Sequence: Synthetic oligonucleotide
  Target: ATXN1; (-) strand; PAM type: NRG; PAM sequence: AGG
accaggcaggactcactcac

SEQ ID NO: 54028 - DNA, 20 bp, Artificial Sequence
  Description of Artificial Sequence: Synthetic oligonucleotide
  Target: ATXN1; (-) strand; PAM type: NRG; PAM sequence: CAG
aaccaggcaggactcactca

SEQ ID NO: 54029 - DNA, 20 bp, Artificial Sequence
  Description of Artificial Sequence: Synthetic oligonucleotide
  Target: ATXN1; (-) strand; PAM type: NRG; PAM sequence: AGG
gtgtgagccgagaaccaggc

SEQ ID NO: 54030 - DNA, 20 bp, Artificial Sequence
  Description of Artificial Sequence: Synthetic oligonucleotide
  Target: ATXN1; (-) strand; PAM type: NRG; PAM sequence: CAG
agtgtgagccgagaaccagg

SEQ ID NO: 54031 - DNA, 20 bp, Artificial Sequence
  Description of Artificial Sequence: Synthetic oligonucleotide
  Target: ATXN1; (-) strand; PAM type: NRG; PAM sequence: AGG
actagtgtgagccgagaacc

SEQ ID NO: 54032 - DNA, 20 bp, Artificial Sequence
  Description of Artificial Sequence: Synthetic oligonucleotide
  Target: ATXN1; (-) strand; PAM type: NRG; PAM sequence: CAG
gactagtgtgagccgagaac

SEQ ID NO: 54033 - DNA, 20 bp, Artificial Sequence
  Description of Artificial Sequence: Synthetic oligonucleotide
  Target: ATXN1; (-) strand; PAM type: NRG; PAM sequence: GAG
aggctggactagtgtgagcc

SEQ ID NO: 54034 - DNA, 20 bp, Artificial Sequence
  Description of Artificial Sequence: Synthetic oligonucleotide
  Target: ATXN1; (-) strand; PAM type: NRG; PAM sequence: GAG
tcccaaggctggactagtgt

SEQ ID NO: 54035 - DNA, 20 bp, Artificial Sequence
  Description of Artificial Sequence: Synthetic oligonucleotide
  Target: ATXN1; (-) strand; PAM type: NRG; PAM sequence: TAG
gctctttcccaaggctggac

SEQ ID NO: 54036 - DNA, 20 bp, Artificial Sequence
  Description of Artificial Sequence: Synthetic oligonucleotide
  Target: ATXN1; (-) strand; PAM type: NRG; PAM sequence: TGG
tcccagctctttcccaaggc

SEQ ID NO: 54037 - DNA, 20 bp, Artificial Sequence
  Description of Artificial Sequence: Synthetic oligonucleotide
  Target: ATXN1; (-) strand; PAM type: NRG; PAM sequence: AGG
ggtgtcccagctctttccca

SEQ ID NO: 54038 - DNA, 20 bp, Artificial Sequence
  Description of Artificial Sequence: Synthetic oligonucleotide
  Target: ATXN1; (-) strand; PAM type: NRG; PAM sequence: AAG
tggtgtcccagctctttccc

SEQ ID NO: 54039 - DNA, 20 bp, Artificial Sequence
  Description of Artificial Sequence: Synthetic oligonucleotide
  Target: ATXN1; (-) strand; PAM type: NRG; PAM sequence: CAG
ggtggttacctgtggtgtcc

SEQ ID NO: 54040 - DNA, 20 bp, Artificial Sequence
  Description of Artificial Sequence: Synthetic oligonucleotide
  Target: ATXN1; (-) strand; PAM type: NRG; PAM sequence: TGG
taaattaaggtggttacctg

SEQ ID NO: 54041 - DNA, 20 bp, Artificial Sequence
  Description of Artificial Sequence: Synthetic oligonucleotide
  Target: ATXN1; (-) strand; PAM type: NRG; PAM sequence: TGG
aggcaaagggtaaattaagg

SEQ ID NO: 54042 - DNA, 20 bp, Artificial Sequence
  Description of Artificial Sequence: Synthetic oligonucleotide
  Target: ATXN1; (-) strand; PAM type: NRG; PAM sequence: AGG
gacaggcaaagggtaaatta

SEQ ID NO: 54043 - DNA, 20 bp, Artificial Sequence
  Description of Artificial Sequence: Synthetic oligonucleotide
  Target: ATXN1; (-) strand; PAM type: NRG; PAM sequence: AAG
agacaggcaaagggtaaatt

SEQ ID NO: 54044 - DNA, 20 bp, Artificial Sequence
  Description of Artificial Sequence: Synthetic oligonucleotide
  Target: ATXN1; (-) strand; PAM type: NRG; PAM sequence: GGG
gtcttcgccagacaggcaaa

SEQ ID NO: 54045 - DNA, 20 bp, Artificial Sequence
  Description of Artificial Sequence: Synthetic oligonucleotide
  Target: ATXN1; (-) strand; PAM type: NRG; PAM sequence: AGG
tgtcttcgccagacaggcaa

SEQ ID NO: 54046 - DNA, 20 bp, Artificial Sequence
  Description of Artificial Sequence: Synthetic oligonucleotide
  Target: ATXN1; (-) strand; PAM type: NRG; PAM sequence: AAG
ttgtcttcgccagacaggca

SEQ ID NO: 54047 - DNA, 20 bp, Artificial Sequence
  Description of Artificial Sequence: Synthetic oligonucleotide
  Target: ATXN1; (-) strand; PAM type: NRG; PAM sequence: AGG
ttactttgtcttcgccagac

SEQ ID NO: 54048 - DNA, 20 bp, Artificial Sequence
  Description of Artificial Sequence: Synthetic oligonucleotide
  Target: ATXN1; (-) strand; PAM type: NRG; PAM sequence: CAG
tttactttgtcttcgccaga

SEQ ID NO: 54049 - DNA, 20 bp, Artificial Sequence
  Description of Artificial Sequence: Synthetic oligonucleotide
  Target: ATXN1; (-) strand; PAM type: NRG; PAM sequence: CAG
tcagtttactttgtcttcgc

SEQ ID NO: 54050 - DNA, 20 bp, Artificial Sequence
  Description of Artificial Sequence: Synthetic oligonucleotide
  Target: ATXN1; (-) strand; PAM type: NRG; PAM sequence: CAG
ccattaataaaagtggcact

SEQ ID NO: 54051 - DNA, 20 bp, Artificial Sequence
  Description of Artificial Sequence: Synthetic oligonucleotide
  Target: ATXN1; (-) strand; PAM type: NRG; PAM sequence: TGG
tggtttcccattaataaaag

SEQ ID NO: 54052 - DNA, 20 bp, Artificial Sequence
  Description of Artificial Sequence: Synthetic oligonucleotide
  Target: ATXN1; (-) strand; PAM type: NRG; PAM sequence: AAG
agatggtttcccattaataa

SEQ ID NO: 54053 - DNA, 20 bp, Artificial Sequence
  Description of Artificial Sequence: Synthetic oligonucleotide
  Target: ATXN1; (-) strand; PAM type: NRG; PAM sequence: TGG
tgtttttgctataagtaaga

SEQ ID NO: 54054 - DNA, 20 bp, Artificial Sequence
  Description of Artificial Sequence: Synthetic oligonucleotide
  Target: ATXN1; (-) strand; PAM type: NRG; PAM sequence: AAG
catttgtttttgctataagt

SEQ ID NO: 54055 - DNA, 20 bp, Artificial Sequence
  Description of Artificial Sequence: Synthetic oligonucleotide
  Target: ATXN1; (-) strand; PAM type: NRG; PAM sequence: AAG
tgagcatttgtttttgctat

SEQ ID NO: 54056 - DNA, 20 bp, Artificial Sequence
  Description of Artificial Sequence: Synthetic oligonucleotide
  Target: ATXN1; (-) strand; PAM type: NRG; PAM sequence: GAG
ccgcagaatgaatgaggttt

SEQ ID NO: 54057 - DNA, 20 bp, Artificial Sequence
  Description of Artificial Sequence: Synthetic oligonucleotide
  Target: ATXN1; (-) strand; PAM type: NRG; PAM sequence: AGG
agataaccgcagaatgaatg

SEQ ID NO: 54058 - DNA, 20 bp, Artificial Sequence
  Description of Artificial Sequence: Synthetic oligonucleotide
  Target: ATXN1; (-) strand; PAM type: NRG; PAM sequence: GAG
cagataaccgcagaatgaat

SEQ ID NO: 54059 - DNA, 20 bp, Artificial Sequence
  Description of Artificial Sequence: Synthetic oligonucleotide
  Target: ATXN1; (-) strand; PAM type: NRG; PAM sequence: CAG
atgaaggatccagataaccg

SEQ ID NO: 54060 - DNA, 20 bp, Artificial Sequence
  Description of Artificial Sequence: Synthetic oligonucleotide
  Target: ATXN1; (-) strand; PAM type: NRG; PAM sequence: CAG
tacctacagcatgaaggatc

SEQ ID NO: 54061 - DNA, 20 bp, Artificial Sequence
  Description of Artificial Sequence: Synthetic oligonucleotide
  Target: ATXN1; (-) strand; PAM type: NRG; PAM sequence: AGG
gttccctacctacagcatga

SEQ ID NO: 54062 - DNA, 20 bp, Artificial Sequence
  Description of Artificial Sequence: Synthetic oligonucleotide
  Target: ATXN1; (-) strand; PAM type: NRG; PAM sequence: AAG
tgttccctacctacagcatg

SEQ ID NO: 54063 - DNA, 20 bp, Artificial Sequence
  Description of Artificial Sequence: Synthetic oligonucleotide
  Target: ATXN1; (-) strand; PAM type: NRG; PAM sequence: CAG
cccattctgttccctaccta

SEQ ID NO: 54064 - DNA, 20 bp, Artificial Sequence
  Description of Artificial Sequence: Synthetic oligonucleotide
  Target: ATXN1; (-) strand; PAM type: NRG; PAM sequence: GAG
cgcggaggagggagctctca

SEQ ID NO: 54065 - DNA, 20 bp, Artificial Sequence
  Description of Artificial Sequence: Synthetic oligonucleotide
  Target: ATXN1; (-) strand; PAM type: NRG; PAM sequence: CAG
ggcgcggaggagggagctct

SEQ ID NO: 54066 - DNA, 20 bp, Artificial Sequence
  Description of Artificial Sequence: Synthetic oligonucleotide
  Target: ATXN1; (-) strand; PAM type: NRG; PAM sequence: GAG
cagcagaggcgcggaggagg

SEQ ID NO: 54067 - DNA, 20 bp, Artificial Sequence
  Description of Artificial Sequence: Synthetic oligonucleotide
  Target: ATXN1; (-) strand; PAM type: NRG; PAM sequence: GGG
cccagcagaggcgcggagga

SEQ ID NO: 54068 - DNA, 20 bp, Artificial Sequence
  Description of Artificial Sequence: Synthetic oligonucleotide
  Target: ATXN1; (-) strand; PAM type: NRG; PAM sequence: AGG
tcccagcagaggcgcggagg

SEQ ID NO: 54069 - DNA, 20 bp, Artificial Sequence
  Description of Artificial Sequence: Synthetic oligonucleotide
  Target: ATXN1; (-) strand; PAM type: NRG; PAM sequence: GAG
ctcccagcagaggcgcggag

SEQ ID NO: 54070 - DNA, 20 bp, Artificial Sequence
  Description of Artificial Sequence: Synthetic oligonucleotide
  Target: ATXN1; (-) strand; PAM type: NRG; PAM sequence: AGG
tgctcccagcagaggcgcgg

SEQ ID NO: 54071 - DNA, 20 bp, Artificial Sequence
  Description of Artificial Sequence: Synthetic oligonucleotide
  Target: ATXN1; (-) strand; PAM type: NRG; PAM sequence: GAG
ttgctcccagcagaggcgcg

SEQ ID NO: 54072 - DNA, 20 bp, Artificial Sequence
  Description of Artificial Sequence: Synthetic oligonucleotide
  Target: ATXN1; (-) strand; PAM type: NRG; PAM sequence: CGG
ttttgctcccagcagaggcg

SEQ ID NO: 54073 - DNA, 20 bp, Artificial Sequence
  Description of Artificial Sequence: Synthetic oligonucleotide
  Target: ATXN1; (-) strand; PAM type: NRG; PAM sequence: AGG
attatttttgctcccagcag

SEQ ID NO: 54074 - DNA, 20 bp, Artificial Sequence
  Description of Artificial Sequence: Synthetic oligonucleotide
  Target: ATXN1; (-) strand; PAM type: NRG; PAM sequence: GAG
gattatttttgctcccagca

SEQ ID NO: 54075 - DNA, 20 bp, Artificial Sequence
  Description of Artificial Sequence: Synthetic oligonucleotide
  Target: ATXN1; (-) strand; PAM type: NRG; PAM sequence: CAG
gagattatttttgctcccag

SEQ ID NO: 54076 - DNA, 20 bp, Artificial Sequence
  Description of Artificial Sequence: Synthetic oligonucleotide
  Target: ATXN1; (-) strand; PAM type: NRG; PAM sequence: CAG
tttgagattatttttgctcc

SEQ ID NO: 54077 - DNA, 20 bp, Artificial Sequence
  Description of Artificial Sequence: Synthetic oligonucleotide
  Target: ATXN1; (-) strand; PAM type: NRG; PAM sequence: GAG
ctccttctttttcctgtttt

SEQ ID NO: 54078 - DNA, 20 bp, Artificial Sequence
  Description of Artificial Sequence: Synthetic oligonucleotide
  Target: ATXN1; (-) strand; PAM type: NRG; PAM sequence: GGG
ccccactcattctgaaggga

SEQ ID NO: 54079 - DNA, 20 bp, Artificial Sequence
  Description of Artificial Sequence: Synthetic oligonucleotide
  Target: ATXN1; (-) strand; PAM type: NRG; PAM sequence: AGG
tccccactcattctgaaggg

SEQ ID NO: 54080 - DNA, 20 bp, Artificial Sequence
  Description of Artificial Sequence: Synthetic oligonucleotide
  Target: ATXN1; (-) strand; PAM type: NRG; PAM sequence: GAG
ctccccactcattctgaagg

SEQ ID NO: 54081 - DNA, 20 bp, Artificial Sequence
  Description of Artificial Sequence: Synthetic oligonucleotide
  Target: ATXN1; (-) strand; PAM type: NRG; PAM sequence: GGG
ttctccccactcattctgaa

SEQ ID NO: 54082 - DNA, 20 bp, Artificial Sequence
  Description of Artificial Sequence: Synthetic oligonucleotide
  Target: ATXN1; (-) strand; PAM type: NRG; PAM sequence: AGG
attctccccactcattctga

SEQ ID NO: 54083 - DNA, 20 bp, Artificial Sequence
  Description of Artificial Sequence: Synthetic oligonucleotide
  Target: ATXN1; (-) strand; PAM type: NRG; PAM sequence: AAG
aattctccccactcattctg

SEQ ID NO: 54084 - DNA, 20 bp, Artificial Sequence
  Description of Artificial Sequence: Synthetic oligonucleotide
  Target: ATXN1; (-) strand; PAM type: NRG; PAM sequence: TAG
tatatgtactggctcatatg

SEQ ID NO: 54085 - DNA, 20 bp, Artificial Sequence
  Description of Artificial Sequence: Synthetic oligonucleotide
  Target: ATXN1; (-) strand; PAM type: NRG; PAM sequence: TGG
cattattgacttatatgtac

SEQ ID NO: 54086 - DNA, 20 bp, Artificial Sequence
  Description of Artificial Sequence: Synthetic oligonucleotide
  Target: ATXN1; (-) strand; PAM type: NRG; PAM sequence: TAG
ttttttttttgaaagcttgg

SEQ ID NO: 54087 - DNA, 20 bp, Artificial Sequence
  Description of Artificial Sequence: Synthetic oligonucleotide
  Target: ATXN1; (-) strand; PAM type: NRG; PAM sequence: TGG
tttttttttttttgaaagct

SEQ ID NO: 54088 - DNA, 20 bp, Artificial Sequence
  Description of Artificial Sequence: Synthetic oligonucleotide
  Target: ATXN1; (-) strand; PAM type: NRG; PAM sequence: AAG
ttttttttttttttttttga

SEQ ID NO: 54089 - DNA, 20 bp, Artificial Sequence
  Description of Artificial Sequence: Synthetic oligonucleotide
  Target: ATXN1; (-) strand; PAM type: NRG; PAM sequence: GGG
atggatgatgaagaaagcct

SEQ ID NO: 54090 - DNA, 20 bp, Artificial Sequence
  Description of Artificial Sequence: Synthetic oligonucleotide
  Target: ATXN1; (-) strand; PAM type: NRG; PAM sequence: TGG
aatggatgatgaagaaagcc

SEQ ID NO: 54091 - DNA, 20 bp, Artificial Sequence
  Description of Artificial Sequence: Synthetic oligonucleotide
  Target: ATXN1; (-) strand; PAM type: NRG; PAM sequence: AAG
tgcaaaatggatgatgaaga

SEQ ID NO: 54092 - DNA, 20 bp, Artificial Sequence
  Description of Artificial Sequence: Synthetic oligonucleotide
  Target: ATXN1; (-) strand; PAM type: NRG; PAM sequence: AAG
tgactgcaaaatggatgatg

SEQ ID NO: 54093 - DNA, 20 bp, Artificial Sequence
  Description of Artificial Sequence: Synthetic oligonucleotide
  Target: ATXN1; (-) strand; PAM type: NRG; PAM sequence: TGG
tcagcacactgactgcaaaa

SEQ ID NO: 54094 - DNA, 20 bp, Artificial Sequence
  Description of Artificial Sequence: Synthetic oligonucleotide
  Target: ATXN1; (-) strand; PAM type: NRG; PAM sequence: CAG
agataatgaccatttgttat

SEQ ID NO: 54095 - DNA, 20 bp, Artificial Sequence
  Description of Artificial Sequence: Synthetic oligonucleotide
  Target: ATXN1; (-) strand; PAM type: NRG; PAM sequence: TAG
agacattactttccagaaac

SEQ ID NO: 54096 - DNA, 20 bp, Artificial Sequence
  Description of Artificial Sequence: Synthetic oligonucleotide
  Target: ATXN1; (-) strand; PAM type: NRG; PAM sequence: CAG
aattcatagacattactttc

SEQ ID NO: 54097 - DNA, 20 bp, Artificial Sequence
  Description of Artificial Sequence: Synthetic oligonucleotide
  Target: ATXN1; (-) strand; PAM type: NRG; PAM sequence: TAG
aattttttttttccaattca

SEQ ID NO: 54098 - DNA, 20 bp, Artificial Sequence
  Description of Artificial Sequence: Synthetic oligonucleotide
  Target: ATXN1; (-) strand; PAM type: NRG; PAM sequence: TAG
tgcattacttcaagtataca

SEQ ID NO: 54099 - DNA, 20 bp, Artificial Sequence
  Description of Artificial Sequence: Synthetic oligonucleotide
  Target: ATXN1; (-) strand; PAM type: NRG; PAM sequence: AAG
aaaataagttgcattacttc

SEQ ID NO: 54100 - DNA, 20 bp, Artificial Sequence
  Description of Artificial Sequence: Synthetic oligonucleotide
  Target: ATXN1; (-) strand; PAM type: NRG; PAM sequence: AAG
agagatccttctaagaaaat

SEQ ID NO: 54101 - DNA, 20 bp, Artificial Sequence
  Description of Artificial Sequence: Synthetic oligonucleotide
  Target: ATXN1; (-) strand; PAM type: NRG; PAM sequence: AAG
ctatattgagagatccttct

SEQ ID NO: 54102 - DNA, 20 bp, Artificial Sequence
  Description of Artificial Sequence: Synthetic oligonucleotide
  Target: ATXN1; (-) strand; PAM type: NRG; PAM sequence: GAG
attaatttaatctatattga

SEQ ID NO: 54103 - DNA, 20 bp, Artificial Sequence
  Description of Artificial Sequence: Synthetic oligonucleotide
  Target: ATXN1; (-) strand; PAM type: NRG; PAM sequence: GAG
acattaatttaatctatatt

SEQ ID NO: 54104 - DNA, 20 bp, Artificial Sequence
  Description of Artificial Sequence: Synthetic oligonucleotide
  Target: ATXN1; (-) strand; PAM type: NRG; PAM sequence: AAG
aatttagattttttaggagg

SEQ ID NO: 54105 - DNA, 20 bp, Artificial Sequence
  Description of Artificial Sequence: Synthetic oligonucleotide
  Target: ATXN1; (-) strand; PAM type: NRG; PAM sequence: AGG
tctaatttagattttttagg

SEQ ID NO: 54106 - DNA, 20 bp, Artificial Sequence
  Description of Artificial Sequence: Synthetic oligonucleotide
  Target: ATXN1; (-) strand; PAM type: NRG; PAM sequence: GAG
ctctaatttagattttttag

SEQ ID NO: 54107 - DNA, 20 bp, Artificial Sequence
  Description of Artificial Sequence: Synthetic oligonucleotide
  Target: ATXN1; (-) strand; PAM type: NRG; PAM sequence: AGG
ctctctaatttagatttttt

SEQ ID NO: 54108 - DNA, 20 bp, Artificial Sequence
  Description of Artificial Sequence: Synthetic oligonucleotide
  Target: ATXN1; (-) strand; PAM type: NRG; PAM sequence: TAG
tctctctaatttagattttt

SEQ ID NO: 54109 - DNA, 20 bp, Artificial Sequence
  Description of Artificial Sequence: Synthetic oligonucleotide
  Target: ATXN1; (-) strand; PAM type: NRG; PAM sequence: TAG
ccaataaaatctctctaatt

SEQ ID NO: 54110 - DNA, 20 bp, Artificial Sequence
  Description of Artificial Sequence: Synthetic oligonucleotide
  Target: ATXN1; (-) strand; PAM type: NRG; PAM sequence: GAG
gtgatgcagtattaattatt

SEQ ID NO: 54111 - DNA, 20 bp, Artificial Sequence
  Description of Artificial Sequence: Synthetic oligonucleotide
  Target: ATXN1; (-) strand; PAM type: NRG; PAM sequence: CAG
aggaaagtagatgtgtgatg

SEQ ID NO: 54112 - DNA, 20 bp, Artificial Sequence
  Description of Artificial Sequence: Synthetic oligonucleotide
  Target: ATXN1; (-) strand; PAM type: NRG; PAM sequence: TAG
atagaaggcagagaggaaag

SEQ ID NO: 54113 - DNA, 20 bp, Artificial Sequence
  Description of Artificial Sequence: Synthetic oligonucleotide
  Target: ATXN1; (-) strand; PAM type: NRG; PAM sequence: AAG
gggatagaaggcagagagga

SEQ ID NO: 54114 - DNA, 20 bp, Artificial Sequence
  Description of Artificial Sequence: Synthetic oligonucleotide
  Target: ATXN1; (-) strand; PAM type: NRG; PAM sequence: AGG
cacagggatagaaggcagag

SEQ ID NO: 54115 - DNA, 20 bp, Artificial Sequence
  Description of Artificial Sequence: Synthetic oligonucleotide
  Target: ATXN1; (-) strand; PAM type: NRG; PAM sequence: GAG
ccacagggatagaaggcaga

SEQ ID NO: 54116 - DNA, 20 bp, Artificial Sequence
  Description of Artificial Sequence: Synthetic oligonucleotide
  Target: ATXN1; (-) strand; PAM type: NRG; PAM sequence: GAG
ggccacagggatagaaggca

SEQ ID NO: 54117 - DNA, 20 bp, Artificial Sequence
  Description of Artificial Sequence: Synthetic oligonucleotide
  Target: ATXN1; (-) strand; PAM type: NRG; PAM sequence: CAG
aaggccacagggatagaagg

SEQ ID NO: 54118 - DNA, 20 bp, Artificial Sequence
  Description of Artificial Sequence: Synthetic oligonucleotide
  Target: ATXN1; (-) strand; PAM type: NRG; PAM sequence: AGG
taaaaggccacagggataga

SEQ ID NO: 54119 - DNA, 20 bp, Artificial Sequence
  Description of Artificial Sequence: Synthetic oligonucleotide
  Target: ATXN1; (-) strand; PAM type: NRG; PAM sequence: AAG
gtaaaaggccacagggatag

SEQ ID NO: 54120 - DNA, 20 bp, Artificial Sequence
  Description of Artificial Sequence: Synthetic oligonucleotide
  Target: ATXN1; (-) strand; PAM type: NRG; PAM sequence: TAG
tctgtaaaaggccacaggga

SEQ ID NO: 54121 - DNA, 20 bp, Artificial Sequence
  Description of Artificial Sequence: Synthetic oligonucleotide
  Target: ATXN1; (-) strand; PAM type: NRG; PAM sequence: GGG
tttgtctgtaaaaggccaca

SEQ ID NO: 54122 - DNA, 20 bp, Artificial Sequence
  Description of Artificial Sequence: Synthetic oligonucleotide
  Target: ATXN1; (-) strand; PAM type: NRG; PAM sequence: AGG
ctttgtctgtaaaaggccac

SEQ ID NO: 54123 - DNA, 20 bp, Artificial Sequence
  Description of Artificial Sequence: Synthetic oligonucleotide
  Target: ATXN1; (-) strand; PAM type: NRG; PAM sequence: CAG
gctttgtctgtaaaaggcca

SEQ ID NO: 54124 - DNA, 20 bp, Artificial Sequence
  Description of Artificial Sequence: Synthetic oligonucleotide
  Target: ATXN1; (-) strand; PAM type: NRG; PAM sequence: AGG
gcaaaagctttgtctgtaaa

SEQ ID NO: 54125 - DNA, 20 bp, Artificial Sequence
  Description of Artificial Sequence: Synthetic oligonucleotide
  Target: ATXN1; (-) strand; PAM type: NRG; PAM sequence: AAG
agcaaaagctttgtctgtaa

SEQ ID NO: 54126 - DNA, 20 bp, Artificial Sequence
  Description of Artificial Sequence: Synthetic oligonucleotide
  Target: ATXN1; (-) strand; PAM type: NRG; PAM sequence: AAG
gtgctccatggttatagcaa

SEQ ID NO: 54127 - DNA, 20 bp, Artificial Sequence
  Description of Artificial Sequence: Synthetic oligonucleotide
  Target: ATXN1; (-) strand; PAM type: NRG; PAM sequence: TAG
tattgtgtgctccatggtta

SEQ ID NO: 54128 - DNA, 20 bp, Artificial Sequence
  Description of Artificial Sequence: Synthetic oligonucleotide
  Target: ATXN1; (-) strand; PAM type: NRG; PAM sequence: TGG
ttgcactattgtgtgctcca

SEQ ID NO: 54129 - DNA, 20 bp, Artificial Sequence
  Description of Artificial Sequence: Synthetic oligonucleotide
  Target: ATXN1; (-) strand; PAM type: NRG; PAM sequence: TAG
ttgtactttcttatatttta

SEQ ID NO: 54130 - DNA, 20 bp, Artificial Sequence
  Description of Artificial Sequence: Synthetic oligonucleotide
  Target: ATXN1; (-) strand; PAM type: NRG; PAM sequence: AGG
tcacaacagccctgtaaggc

SEQ ID NO: 54131 - DNA, 20 bp, Artificial Sequence
  Description of Artificial Sequence: Synthetic oligonucleotide
  Target: ATXN1; (-) strand; PAM type: NRG; PAM sequence: CAG
ctcacaacagccctgtaagg

SEQ ID NO: 54132 - DNA, 20 bp, Artificial Sequence
  Description of Artificial Sequence: Synthetic oligonucleotide
  Target: ATXN1; (-) strand; PAM type: NRG; PAM sequence: AGG
gtcctcacaacagccctgta

SEQ ID NO: 54133 - DNA, 20 bp, Artificial Sequence
  Description of Artificial Sequence: Synthetic oligonucleotide
  Target: ATXN1; (-) strand; PAM type: NRG; PAM sequence: AAG
ggtcctcacaacagccctgt

SEQ ID NO: 54134 - DNA, 20 bp, Artificial Sequence
  Description of Artificial Sequence: Synthetic oligonucleotide
  Target: ATXN1; (-) strand; PAM type: NRG; PAM sequence: CAG
gtctgattaggtcctcacaa

SEQ ID NO: 54135 - DNA, 20 bp, Artificial Sequence
  Description of Artificial Sequence: Synthetic oligonucleotide
  Target: ATXN1; (-) strand; PAM type: NRG; PAM sequence: AGG
ttttcatgcattgtctgatt

SEQ ID NO: 54136 - DNA, 20 bp, Artificial Sequence
  Description of Artificial Sequence: Synthetic oligonucleotide
  Target: ATXN1; (-) strand; PAM type: NRG; PAM sequence: TAG
cttttcatgcattgtctgat

SEQ ID NO: 54137 - DNA, 20 bp, Artificial Sequence
  Description of Artificial Sequence: Synthetic oligonucleotide
  Target: ATXN1; (-) strand; PAM type: NRG; PAM sequence: TAG
tctgggccagggactatact

SEQ ID NO: 54138 - DNA, 20 bp, Artificial Sequence
  Description of Artificial Sequence: Synthetic oligonucleotide
  Target: ATXN1; (-) strand; PAM type: NRG; PAM sequence: GGG
tgaatacttaatctgggcca

SEQ ID NO: 54139 - DNA, 20 bp, Artificial Sequence
  Description of Artificial Sequence: Synthetic oligonucleotide
  Target: ATXN1; (-) strand; PAM type: NRG; PAM sequence: AGG
atgaatacttaatctgggcc

SEQ ID NO: 54140 - DNA, 20 bp, Artificial Sequence
  Description of Artificial Sequence: Synthetic oligonucleotide
  Target: ATXN1; (-) strand; PAM type: NRG; PAM sequence: CAG
tatgaatacttaatctgggc

SEQ ID NO: 54141 - DNA, 20 bp, Artificial Sequence
  Description of Artificial Sequence: Synthetic oligonucleotide
  Target: ATXN1; (-) strand; PAM type: NRG; PAM sequence: GGG
tatttatgaatacttaatct

SEQ ID NO: 54142 - DNA, 20 bp, Artificial Sequence
  Description of Artificial Sequence: Synthetic oligonucleotide
  Target: ATXN1; (-) strand; PAM type: NRG; PAM sequence: TGG
atatttatgaatacttaatc

SEQ ID NO: 54143 - DNA, 20 bp, Artificial Sequence
  Description of Artificial Sequence: Synthetic oligonucleotide
  Target: ATXN1; (-) strand; PAM type: NRG; PAM sequence: CAG
tataaaaggaataataatta

SEQ ID NO: 54144 - DNA, 20 bp, Artificial Sequence
  Description of Artificial Sequence: Synthetic oligonucleotide
  Target: ATXN1; (-) strand; PAM type: NRG; PAM sequence: AGG
gaaataaaagtttatataaa

SEQ ID NO: 54145 - DNA, 20 bp, Artificial Sequence
  Description of Artificial Sequence: Synthetic oligonucleotide
  Target: ATXN1; (-) strand; PAM type: NRG; PAM sequence: AAG
tgaaataaaagtttatataa

SEQ ID NO: 54146 - DNA, 20 bp, Artificial Sequence
  Description of Artificial Sequence: Synthetic oligonucleotide
  Target: ATXN1; (-) strand; PAM type: NRG; PAM sequence: AAG
aacatctccctatgaaataa

SEQ ID NO: 54147 - DNA, 20 bp, Artificial Sequence
  Description of Artificial Sequence: Synthetic oligonucleotide
  Target: ATXN1; (-) strand; PAM type: NRG; PAM sequence: AGG
gatgagtaggagatttcttt

SEQ ID NO: 54148 - DNA, 20 bp, Artificial Sequence
  Description of Artificial Sequence: Synthetic oligonucleotide
  Target: ATXN1; (-) strand; PAM type: NRG; PAM sequence: TAG
agatgagtaggagatttctt

SEQ ID NO: 54149 - DNA, 20 bp, Artificial Sequence
  Description of Artificial Sequence: Synthetic oligonucleotide
  Target: ATXN1; (-) strand; PAM type: NRG; PAM sequence: GAG
tgtacgagcaagatgagtag

SEQ ID NO: 54150 - DNA, 20 bp, Artificial Sequence
  Description of Artificial Sequence: Synthetic oligonucleotide
  Target: ATXN1; (-) strand; PAM type: NRG; PAM sequence: AGG
ggtgtacgagcaagatgagt

SEQ ID NO: 54151 - DNA, 20 bp, Artificial Sequence
  Description of Artificial Sequence: Synthetic oligonucleotide
  Target: ATXN1; (-) strand; PAM type: NRG; PAM sequence: TAG
gggtgtacgagcaagatgag

SEQ ID NO: 54152 - DNA, 20 bp, Artificial Sequence
  Description of Artificial Sequence: Synthetic oligonucleotide
  Target: ATXN1; (-) strand; PAM type: NRG; PAM sequence: GAG
ttagggtgtacgagcaagat

SEQ ID NO: 54153 - DNA, 20 bp, Artificial Sequence
  Description of Artificial Sequence: Synthetic oligonucleotide
  Target: ATXN1; (-) strand; PAM type: NRG; PAM sequence: AAG
aacgtttagggtgtacgagc

SEQ ID NO: 54154 - DNA, 20 bp, Artificial Sequence
  Description of Artificial Sequence: Synthetic oligonucleotide
  Target: ATXN1; (-) strand; PAM type: NRG; PAM sequence: GAG
tttaaacgtttagggtgtac

SEQ ID NO: 54155 - DNA, 20 bp, Artificial Sequence
  Description of Artificial Sequence: Synthetic oligonucleotide
  Target: ATXN1; (-) strand; PAM type: NRG; PAM sequence: GGG
gagattattttaaacgttta

SEQ ID NO: 54156 - DNA, 20 bp, Artificial Sequence
  Description of Artificial Sequence: Synthetic oligonucleotide
  Target: ATXN1; (-) strand; PAM type: NRG; PAM sequence: AGG
tgagattattttaaacgttt

SEQ ID NO: 54157 - DNA, 20 bp, Artificial Sequence
  Description of Artificial Sequence: Synthetic oligonucleotide
  Target: ATXN1; (-) strand; PAM type: NRG; PAM sequence: TAG
gtgagattattttaaacgtt

SEQ ID NO: 54158 - DNA, 20 bp, Artificial Sequence
  Description of Artificial Sequence: Synthetic oligonucleotide
  Target: ATXN1; (-) strand; PAM type: NRG; PAM sequence: GAG
tcagaggtattggatacagt

SEQ ID NO: 54159 - DNA, 20 bp, Artificial Sequence
  Description of Artificial Sequence: Synthetic oligonucleotide
  Target: ATXN1; (-) strand; PAM type: NRG; PAM sequence: CAG
ggggtcagaggtattggata

SEQ ID NO: 54160 - DNA, 20 bp, Artificial Sequence
  Description of Artificial Sequence: Synthetic oligonucleotide
  Target: ATXN1; (-) strand; PAM type: NRG; PAM sequence: TGG
ttcagaggggtcagaggtat

SEQ ID NO: 54161 - DNA, 20 bp, Artificial Sequence
  Description of Artificial Sequence: Synthetic oligonucleotide
  Target: ATXN1; (-) strand; PAM type: NRG; PAM sequence: AGG
atgggattcagaggggtcag

SEQ ID NO: 54162 - DNA, 20 bp, Artificial Sequence
  Description of Artificial Sequence: Synthetic oligonucleotide
  Target: ATXN1; (-) strand; PAM type: NRG; PAM sequence: GAG
gatgggattcagaggggtca

SEQ ID NO: 54163 - DNA, 20 bp, Artificial Sequence
  Description of Artificial Sequence: Synthetic oligonucleotide
  Target: ATXN1; (-) strand; PAM type: NRG; PAM sequence: CAG
gtgatgggattcagaggggt

SEQ ID NO: 54164 - DNA, 20 bp, Artificial Sequence
  Description of Artificial Sequence: Synthetic oligonucleotide
  Target: ATXN1; (-) strand; PAM type: NRG; PAM sequence: GGG
aaatgtgatgggattcagag

SEQ ID NO: 54165 - DNA, 20 bp, Artificial Sequence
  Description of Artificial Sequence: Synthetic oligonucleotide
  Target: ATXN1; (-) strand; PAM type: NRG; PAM sequence: GGG
aaaatgtgatgggattcaga

SEQ ID NO: 54166 - DNA, 20 bp, Artificial Sequence
  Description of Artificial Sequence: Synthetic oligonucleotide
  Target: ATXN1; (-) strand; PAM type: NRG; PAM sequence: AGG
gaaaatgtgatgggattcag

SEQ ID NO: 54167 - DNA, 20 bp, Artificial Sequence
  Description of Artificial Sequence: Synthetic oligonucleotide
  Target: ATXN1; (-) strand; PAM type: NRG; PAM sequence: GAG
tgaaaatgtgatgggattca

SEQ ID NO: 54168 - DNA, 20 bp, Artificial Sequence
  Description of Artificial Sequence: Synthetic oligonucleotide
  Target: ATXN1; (-) strand; PAM type: NRG; PAM sequence: CAG
ggtgaaaatgtgatgggatt

SEQ ID NO: 54169 - DNA, 20 bp, Artificial Sequence
  Description of Artificial Sequence: Synthetic oligonucleotide
  Target: ATXN1; (-) strand; PAM type: NRG; PAM sequence: GGG
ctaagcggtgaaaatgtgat

SEQ ID NO: 54170 - DNA, 20 bp, Artificial Sequence
  Description of Artificial Sequence: Synthetic oligonucleotide
  Target: ATXN1; (-) strand; PAM type: NRG; PAM sequence: TGG
actaagcggtgaaaatgtga

SEQ ID NO: 54171 - DNA, 20 bp, Artificial Sequence
  Description of Artificial Sequence: Synthetic oligonucleotide
  Target: ATXN1; (-) strand; PAM type: NRG; PAM sequence: CGG
gataggaaccatgaactaag

SEQ ID NO: 54172 - DNA, 20 bp, Artificial Sequence
  Description of Artificial Sequence: Synthetic oligonucleotide
  Target: ATXN1; (-) strand; PAM type: NRG; PAM sequence: AAG
agagataggaaccatgaact

SEQ ID NO: 54173 - DNA, 20 bp, Artificial Sequence
  Description of Artificial Sequence: Synthetic oligonucleotide
  Target: ATXN1; (-) strand; PAM type: NRG; PAM sequence: AGG
taacacagtgaggaagagat

SEQ ID NO: 54174 - DNA, 20 bp, Artificial Sequence
  Description of Artificial Sequence: Synthetic oligonucleotide
  Target: ATXN1; (-) strand; PAM type: NRG; PAM sequence: TAG
gtaacacagtgaggaagaga

SEQ ID NO: 54175 - DNA, 20 bp, Artificial Sequence
  Description of Artificial Sequence: Synthetic oligonucleotide
  Target: ATXN1; (-) strand; PAM type: NRG; PAM sequence: GAG
ggctgtaacacagtgaggaa

SEQ ID NO: 54176 - DNA, 20 bp, Artificial Sequence
  Description of Artificial Sequence: Synthetic oligonucleotide
  Target: ATXN1; (-) strand; PAM type: NRG; PAM sequence: AAG
tcggctgtaacacagtgagg

SEQ ID NO: 54177 - DNA, 20 bp, Artificial Sequence
  Description of Artificial Sequence: Synthetic oligonucleotide
  Target: ATXN1; (-) strand; PAM type: NRG; PAM sequence: AGG
agctcggctgtaacacagtg

SEQ ID NO: 54178 - DNA, 20 bp, Artificial Sequence
  Description of Artificial Sequence: Synthetic oligonucleotide
  Target: ATXN1; (-) strand; PAM type: NRG; PAM sequence: GAG
cagctcggctgtaacacagt

SEQ ID NO: 54179 - DNA, 20 bp, Artificial Sequence
  Description of Artificial Sequence: Synthetic oligonucleotide
  Target: ATXN1; (-) strand; PAM type: NRG; PAM sequence: CAG
gtaccagctcggctgtaaca

SEQ ID NO: 54180 - DNA, 20 bp, Artificial Sequence
  Description of Artificial Sequence: Synthetic oligonucleotide
  Target: ATXN1; (-) strand; PAM type: NRG; PAM sequence: CGG
aattccagtgtgtaccagct

SEQ ID NO: 54181 - DNA, 20 bp, Artificial Sequence
  Description of Artificial Sequence: Synthetic oligonucleotide
  Target: ATXN1; (-) strand; PAM type: NRG; PAM sequence: CAG
tcaggaattccagtgtgtac

SEQ ID NO: 54182 - DNA, 20 bp, Artificial Sequence
  Description of Artificial Sequence: Synthetic oligonucleotide
  Target: ATXN1; (-) strand; PAM type: NRG; PAM sequence: CAG
ctagaggaattcaggaattc

SEQ ID NO: 54183 - DNA, 20 bp, Artificial Sequence
  Description of Artificial Sequence: Synthetic oligonucleotide
  Target: ATXN1; (-) strand; PAM type: NRG; PAM sequence: AGG
aaggcctactagaggaattc

SEQ ID NO: 54184 - DNA, 20 bp, Artificial Sequence
  Description of Artificial Sequence: Synthetic oligonucleotide
  Target: ATXN1; (-) strand; PAM type: NRG; PAM sequence: CAG
aaaggcctactagaggaatt

SEQ ID NO: 54185 - DNA, 20 bp, Artificial Sequence
  Description of Artificial Sequence: Synthetic oligonucleotide
  Target: ATXN1; (-) strand; PAM type: NRG; PAM sequence: AGG
ggaaactaaaggcctactag

SEQ ID NO: 54186 - DNA, 20 bp, Artificial Sequence
  Description of Artificial Sequence: Synthetic oligonucleotide
  Target: ATXN1; (-) strand; PAM type: NRG; PAM sequence: GAG
tggaaactaaaggcctacta

SEQ ID NO: 54187 - DNA, 20 bp, Artificial Sequence
  Description of Artificial Sequence: Synthetic oligonucleotide
  Target: ATXN1; (-) strand; PAM type: NRG; PAM sequence: TAG
tatggaaactaaaggcctac

SEQ ID NO: 54188 - DNA, 20 bp, Artificial Sequence
  Description of Artificial Sequence: Synthetic oligonucleotide
  Target: ATXN1; (-) strand; PAM type: NRG; PAM sequence: AGG
ttctgctttatggaaactaa

SEQ ID NO: 54189 - DNA, 20 bp, Artificial Sequence
  Description of Artificial Sequence: Synthetic oligonucleotide
  Target: ATXN1; (-) strand; PAM type: NRG; PAM sequence: AAG
tttctgctttatggaaacta

SEQ ID NO: 54190 - DNA, 20 bp, Artificial Sequence
  Description of Artificial Sequence: Synthetic oligonucleotide
  Target: ATXN1; (-) strand; PAM type: NRG; PAM sequence: TGG
ggtatggggtttctgcttta

SEQ ID NO: 54191 - DNA, 20 bp, Artificial Sequence
  Description of Artificial Sequence: Synthetic oligonucleotide
  Target: ATXN1; (-) strand; PAM type: NRG; PAM sequence: GGG
atgcaatgatacacggtatg

SEQ ID NO: 54192 - DNA, 20 bp, Artificial Sequence
  Description of Artificial Sequence: Synthetic oligonucleotide
  Target: ATXN1; (-) strand; PAM type: NRG; PAM sequence: GGG
tatgcaatgatacacggtat

SEQ ID NO: 54193 - DNA, 20 bp, Artificial Sequence
  Description of Artificial Sequence: Synthetic oligonucleotide
  Target: ATXN1; (-) strand; PAM type: NRG; PAM sequence: TGG
gtatgcaatgatacacggta

SEQ ID NO: 54194 - DNA, 20 bp, Artificial Sequence
  Description of Artificial Sequence: Synthetic oligonucleotide
  Target: ATXN1; (-) strand; PAM type: NRG; PAM sequence: CGG
actgagtatgcaatgataca

SEQ ID NO: 54195 - DNA, 20 bp, Artificial Sequence
  Description of Artificial Sequence: Synthetic oligonucleotide
  Target: ATXN1; (-) strand; PAM type: NRG; PAM sequence: GAG
gataaaagccacattctact

SEQ ID NO: 54196 - DNA, 20 bp, Artificial Sequence
  Description of Artificial Sequence: Synthetic oligonucleotide
  Target: ATXN1; (-) strand; PAM type: NRG; PAM sequence: AAG
gcctacaccatgcaagataa

SEQ ID NO: 54197 - DNA, 20 bp, Artificial Sequence
  Description of Artificial Sequence: Synthetic oligonucleotide
  Target: ATXN1; (-) strand; PAM type: NRG; PAM sequence: AAG
attaaaagcctacaccatgc

SEQ ID NO: 54198 - DNA, 20 bp, Artificial Sequence
  Description of Artificial Sequence: Synthetic oligonucleotide
  Target: ATXN1; (-) strand; PAM type: NRG; PAM sequence: AAG
attcaataaatacttattaa

SEQ ID NO: 54199 - DNA, 20 bp, Artificial Sequence
  Description of Artificial Sequence: Synthetic oligonucleotide
  Target: ATXN1; (-) strand; PAM type: NRG; PAM sequence: AGG
ttaggtgcctgttgagcccc

SEQ ID NO: 54200 - DNA, 20 bp, Artificial Sequence
  Description of Artificial Sequence: Synthetic oligonucleotide
  Target: ATXN1; (-) strand; PAM type: NRG; PAM sequence: CAG
gttaggtgcctgttgagccc

SEQ ID NO: 54201 - DNA, 20 bp, Artificial Sequence
  Description of Artificial Sequence: Synthetic oligonucleotide
  Target: ATXN1; (-) strand; PAM type: NRG; PAM sequence: GAG
tgtagggttaggtgcctgtt

SEQ ID NO: 54202 - DNA, 20 bp, Artificial Sequence
  Description of Artificial Sequence: Synthetic oligonucleotide
  Target: ATXN1; (-) strand; PAM type: NRG; PAM sequence: AGG
attagaaatattgtagggtt

SEQ ID NO: 54203 - DNA, 20 bp, Artificial Sequence
  Description of Artificial Sequence: Synthetic oligonucleotide
  Target: ATXN1; (-) strand; PAM type: NRG; PAM sequence: TAG
cattagaaatattgtagggt

SEQ ID NO: 54204 - DNA, 20 bp, Artificial Sequence
  Description of Artificial Sequence: Synthetic oligonucleotide
  Target: ATXN1; (-) strand; PAM type: NRG; PAM sequence: GGG
aaaacattagaaatattgta

SEQ ID NO: 54205 - DNA, 20 bp, Artificial Sequence
  Description of Artificial Sequence: Synthetic oligonucleotide
  Target: ATXN1; (-) strand; PAM type: NRG; PAM sequence: AGG
caaaacattagaaatattgt

SEQ ID NO: 54206 - DNA, 20 bp, Artificial Sequence
  Description of Artificial Sequence: Synthetic oligonucleotide
  Target: ATXN1; (-) strand; PAM type: NRG; PAM sequence: TAG
acaaaacattagaaatattg

SEQ ID NO: 54207 - DNA, 20 bp, Artificial Sequence
  Description of Artificial Sequence: Synthetic oligonucleotide
  Target: ATXN1; (-) strand; PAM type: NRG; PAM sequence: TAG
aggggaagttgacaaaacat

SEQ ID NO: 54208 - DNA, 20 bp, Artificial Sequence
  Description of Artificial Sequence: Synthetic oligonucleotide
  Target: ATXN1; (-) strand; PAM type: NRG; PAM sequence: AAG
ataaaataatatcttagggg

SEQ ID NO: 54209 - DNA, 20 bp, Artificial Sequence
  Description of Artificial Sequence: Synthetic oligonucleotide
  Target: ATXN1; (-) strand; PAM type: NRG; PAM sequence: GGG
taaataaaataatatcttag

SEQ ID NO: 54210 - DNA, 20 bp, Artificial Sequence
  Description of Artificial Sequence: Synthetic oligonucleotide
  Target: ATXN1; (-) strand; PAM type: NRG; PAM sequence: GGG
ataaataaaataatatctta

SEQ ID NO: 54211 - DNA, 20 bp, Artificial Sequence
  Description of Artificial Sequence: Synthetic oligonucleotide
  Target: ATXN1; (-) strand; PAM type: NRG; PAM sequence: AGG
aataaataaaataatatctt

SEQ ID NO: 54212 - DNA, 20 bp, Artificial Sequence
  Description of Artificial Sequence: Synthetic oligonucleotide
  Target: ATXN1; (-) strand; PAM type: NRG; PAM sequence: TAG
aaataaataaaataatatct

SEQ ID NO: 54213 - DNA, 20 bp, Artificial Sequence
  Description of Artificial Sequence: Synthetic oligonucleotide
  Target: ATXN1; (-) strand; PAM type: NRG; PAM sequence: GAG
gccctccagcctcggcaaca

SEQ ID NO: 54214 - DNA, 20 bp, Artificial Sequence
  Description of Artificial Sequence: Synthetic oligonucleotide
  Target: ATXN1; (-) strand; PAM type: NRG; PAM sequence: CAG
ctgccctccagcctcggcaa

SEQ ID NO: 54215 - DNA, 20 bp, Artificial Sequence
  Description of Artificial Sequence: Synthetic oligonucleotide
  Target: ATXN1; (-) strand; PAM type: NRG; PAM sequence: CGG
acaccactgccctccagcct

SEQ ID NO: 54216 - DNA, 20 bp, Artificial Sequence
  Description of Artificial Sequence: Synthetic oligonucleotide
  Target: ATXN1; (-) strand; PAM type: NRG; PAM sequence: CAG
atgattacaccactgccctc

SEQ ID NO: 54217 - DNA, 20 bp, Artificial Sequence
  Description of Artificial Sequence: Synthetic oligonucleotide
  Target: ATXN1; (-) strand; PAM type: NRG; PAM sequence: CAG
agcccagcagttcaaggctg

SEQ ID NO: 54218 - DNA, 20 bp, Artificial Sequence
  Description of Artificial Sequence: Synthetic oligonucleotide
  Target: ATXN1; (-) strand; PAM type: NRG; PAM sequence: AGG
cacttgagcccagcagttca

SEQ ID NO: 54219 - DNA, 20 bp, Artificial Sequence
  Description of Artificial Sequence: Synthetic oligonucleotide
  Target: ATXN1; (-) strand; PAM type: NRG; PAM sequence: AAG
tcacttgagcccagcagttc

SEQ ID NO: 54220 - DNA, 20 bp, Artificial Sequence
  Description of Artificial Sequence: Synthetic oligonucleotide
  Target: ATXN1; (-) strand; PAM type: NRG; PAM sequence: CAG
ggagaatcacttgagcccag

SEQ ID NO: 54221 - DNA, 20 bp, Artificial Sequence
  Description of Artificial Sequence: Synthetic oligonucleotide
  Target: ATXN1; (-) strand; PAM type: NRG; PAM sequence: CAG
gtgggagaatcacttgagcc

SEQ ID NO: 54222 - DNA, 20 bp, Artificial Sequence
  Description of Artificial Sequence: Synthetic oligonucleotide
  Target: ATXN1; (-) strand; PAM type: NRG; PAM sequence: GAG
ctgaggtgggagaatcactt

SEQ ID NO: 54223 - DNA, 20 bp, Artificial Sequence
  Description of Artificial Sequence: Synthetic oligonucleotide
  Target: ATXN1; (-) strand; PAM type: NRG; PAM sequence: GAG
tactggggaagctgaggtgg

SEQ ID NO: 54224 - DNA, 20 bp, Artificial Sequence
  Description of Artificial Sequence: Synthetic oligonucleotide
  Target: ATXN1; (-) strand; PAM type: NRG; PAM sequence: GGG
ggtactggggaagctgaggt

SEQ ID NO: 54225 - DNA, 20 bp, Artificial Sequence
  Description of Artificial Sequence: Synthetic oligonucleotide
  Target: ATXN1; (-) strand; PAM type: NRG; PAM sequence: TGG
aggtactggggaagctgagg

SEQ ID NO: 54226 - DNA, 20 bp, Artificial Sequence
  Description of Artificial Sequence: Synthetic oligonucleotide
  Target: ATXN1; (-) strand; PAM type: NRG; PAM sequence: AGG
cccaggtactggggaagctg

SEQ ID NO: 54227 - DNA, 20 bp, Artificial Sequence
  Description of Artificial Sequence: Synthetic oligonucleotide
  Target: ATXN1; (-) strand; PAM type: NRG; PAM sequence: GAG
tcccaggtactggggaagct

SEQ ID NO: 54228 - DNA, 20 bp, Artificial Sequence
  Description of Artificial Sequence: Synthetic oligonucleotide
  Target: ATXN1; (-) strand; PAM type: NRG; PAM sequence: AAG
tgtagtcccaggtactgggg

SEQ ID NO: 54229 - DNA, 20 bp, Artificial Sequence
  Description of Artificial Sequence: Synthetic oligonucleotide
  Target: ATXN1; (-) strand; PAM type: NRG; PAM sequence: GGG
acctgtagtcccaggtactg

SEQ ID NO: 54230 - DNA, 20 bp, Artificial Sequence
  Description of Artificial Sequence: Synthetic oligonucleotide
  Target: ATXN1; (-) strand; PAM type: NRG; PAM sequence: GGG
tacctgtagtcccaggtact

SEQ ID NO: 54231 - DNA, 20 bp, Artificial Sequence
  Description of Artificial Sequence: Synthetic oligonucleotide
  Target: ATXN1; (-) strand; PAM type: NRG; PAM sequence: TGG
atacctgtagtcccaggtac

SEQ ID NO: 54232 - DNA, 20 bp, Artificial Sequence
  Description of Artificial Sequence: Synthetic oligonucleotide
  Target: ATXN1; (-) strand; PAM type: NRG; PAM sequence: AGG
tgatgcatacctgtagtccc

SEQ ID NO: 54233 - DNA, 20 bp, Artificial Sequence
  Description of Artificial Sequence: Synthetic oligonucleotide
  Target: ATXN1; (-) strand; PAM type: NRG; PAM sequence: CAG
gtgatgcatacctgtagtcc

SEQ ID NO: 54234 - DNA, 20 bp, Artificial Sequence
  Description of Artificial Sequence: Synthetic oligonucleotide
  Target: ATXN1; (-) strand; PAM type: NRG; PAM sequence: TAG
agcatggtgatgcatacctg

SEQ ID NO: 54235 - DNA, 20 bp, Artificial Sequence
  Description of Artificial Sequence: Synthetic oligonucleotide
  Target: ATXN1; (-) strand; PAM type: NRG; PAM sequence: TGG
tttttttaagtagcctagca

SEQ ID NO: 54236 - DNA, 20 bp, Artificial Sequence
  Description of Artificial Sequence: Synthetic oligonucleotide
  Target: ATXN1; (-) strand; PAM type: NRG; PAM sequence: TAG
aaatttttttttaagtagcc

SEQ ID NO: 54237 - DNA, 20 bp, Artificial Sequence
  Description of Artificial Sequence: Synthetic oligonucleotide
  Target: ATXN1; (-) strand; PAM type: NRG; PAM sequence: TAG
aaagaaaatttttttttaag

SEQ ID NO: 54238 - DNA, 20 bp, Artificial Sequence
  Description of Artificial Sequence: Synthetic oligonucleotide
  Target: ATXN1; (-) strand; PAM type: NRG; PAM sequence: AAG
tcaaaagaaaattttttttt

SEQ ID NO: 54239 - DNA, 20 bp, Artificial Sequence
  Description of Artificial Sequence: Synthetic oligonucleotide
  Target: ATXN1; (-) strand; PAM type: NRG; PAM sequence: AAG
atagtgagaccctgtctcaa

SEQ ID NO: 54240 - DNA, 20 bp, Artificial Sequence
  Description of Artificial Sequence: Synthetic oligonucleotide
  Target: ATXN1; (-) strand; PAM type: NRG; PAM sequence: GAG
accagcctgggcaacatagt

SEQ ID NO: 54241 - DNA, 20 bp, Artificial Sequence
  Description of Artificial Sequence: Synthetic oligonucleotide
  Target: ATXN1; (-) strand; PAM type: NRG; PAM sequence: TAG
aaagaccagcctgggcaaca

SEQ ID NO: 54242 - DNA, 20 bp, Artificial Sequence
  Description of Artificial Sequence: Synthetic oligonucleotide
  Target: ATXN1; (-) strand; PAM type: NRG; PAM sequence: GGG
cagaagttaaagaccagcct

SEQ ID NO: 54243 - DNA, 20 bp, Artificial Sequence
  Description of Artificial Sequence: Synthetic oligonucleotide
  Target: ATXN1; (-) strand; PAM type: NRG; PAM sequence: TGG
tcagaagttaaagaccagcc

SEQ ID NO: 54244 - DNA, 20 bp, Artificial Sequence
  Description of Artificial Sequence: Synthetic oligonucleotide
  Target: ATXN1; (-) strand; PAM type: NRG; PAM sequence: CAG
taaggtcagaagttaaagac

SEQ ID NO: 54245 - DNA, 20 bp, Artificial Sequence
  Description of Artificial Sequence: Synthetic oligonucleotide
  Target: ATXN1; (-) strand; PAM type: NRG; PAM sequence: AAG
ttgcctaaggtcagaagtta

SEQ ID NO: 54246 - DNA, 20 bp, Artificial Sequence
  Description of Artificial Sequence: Synthetic oligonucleotide
  Target: ATXN1; (-) strand; PAM type: NRG; PAM sequence: AAG
ggaggattgcctaaggtcag

SEQ ID NO: 54247 - DNA, 20 bp, Artificial Sequence
  Description of Artificial Sequence: Synthetic oligonucleotide
  Target: ATXN1; (-) strand; PAM type: NRG; PAM sequence: CAG
gcaggaggattgcctaaggt

SEQ ID NO: 54248 - DNA, 20 bp, Artificial Sequence
  Description of Artificial Sequence: Synthetic oligonucleotide
  Target: ATXN1; (-) strand; PAM type: NRG; PAM sequence: AGG
tgaggcaggaggattgccta

SEQ ID NO: 54249 - DNA, 20 bp, Artificial Sequence
  Description of Artificial Sequence: Synthetic oligonucleotide
  Target: ATXN1; (-) strand; PAM type: NRG; PAM sequence: AAG
ctgaggcaggaggattgcct

SEQ ID NO: 54250 - DNA, 20 bp, Artificial Sequence
  Description of Artificial Sequence: Synthetic oligonucleotide
  Target: ATXN1; (-) strand; PAM type: NRG; PAM sequence: AGG
acttgggaggctgaggcagg

SEQ ID NO: 54251 - DNA, 20 bp, Artificial Sequence
  Description of Artificial Sequence: Synthetic oligonucleotide
  Target: ATXN1; (-) strand; PAM type: NRG; PAM sequence: GAG
gacttgggaggctgaggcag

SEQ ID NO: 54252 - DNA, 20 bp, Artificial Sequence
  Description of Artificial Sequence: Synthetic oligonucleotide
  Target: ATXN1; (-) strand; PAM type: NRG; PAM sequence: AGG
gtgacttgggaggctgaggc

SEQ ID NO: 54253 - DNA, 20 bp, Artificial Sequence
  Description of Artificial Sequence: Synthetic oligonucleotide
  Target: ATXN1; (-) strand; PAM type: NRG; PAM sequence: CAG
agtgacttgggaggctgagg

SEQ ID NO: 54254 - DNA, 20 bp, Artificial Sequence
  Description of Artificial Sequence: Synthetic oligonucleotide
  Target: ATXN1; (-) strand; PAM type: NRG; PAM sequence: AGG
cccagtgacttgggaggctg

SEQ ID NO: 54255 - DNA, 20 bp, Artificial Sequence
  Description of Artificial Sequence: Synthetic oligonucleotide
  Target: ATXN1; (-) strand; PAM type: NRG; PAM sequence: GAG
tcccagtgacttgggaggct

SEQ ID NO: 54256 - DNA, 20 bp, Artificial Sequence
  Description of Artificial Sequence: Synthetic oligonucleotide
  Target: ATXN1; (-) strand; PAM type: NRG; PAM sequence: AGG
tgtaatcccagtgacttggg

SEQ ID NO: 54257 - DNA, 20 bp, Artificial Sequence
  Description of Artificial Sequence: Synthetic oligonucleotide
  Target: ATXN1; (-) strand; PAM type: NRG; PAM sequence: GAG
ctgtaatcccagtgacttgg

SEQ ID NO: 54258 - DNA, 20 bp, Artificial Sequence
  Description of Artificial Sequence: Synthetic oligonucleotide
  Target: ATXN1; (-) strand; PAM type: NRG; PAM sequence: GGG
gcctgtaatcccagtgactt

SEQ ID NO: 54259 - DNA, 20 bp, Artificial Sequence
  Description of Artificial Sequence: Synthetic oligonucleotide
  Target: ATXN1; (-) strand; PAM type: NRG; PAM sequence: TGG
cgcctgtaatcccagtgact

SEQ ID NO: 54260 - DNA, 20 bp, Artificial Sequence
  Description of Artificial Sequence: Synthetic oligonucleotide
  Target: ATXN1; (-) strand; PAM type: NRG; PAM sequence: CAG
gtggcttgcgcctgtaatcc

SEQ ID NO: 54261 - DNA, 20 bp, Artificial Sequence
  Description of Artificial Sequence: Synthetic oligonucleotide
  Target: ATXN1; (-) strand; PAM type: NRG; PAM sequence: TGG
attgattgggcttggtgtgg

SEQ ID NO: 54262 - DNA, 20 bp, Artificial Sequence
  Description of Artificial Sequence: Synthetic oligonucleotide
  Target: ATXN1; (-) strand; PAM type: NRG; PAM sequence: TGG
attattgattgggcttggtg

SEQ ID NO: 54263 - DNA, 20 bp, Artificial Sequence
  Description of Artificial Sequence: Synthetic oligonucleotide
  Target: ATXN1; (-) strand; PAM type: NRG; PAM sequence: TGG
aaattattattgattgggct

SEQ ID NO: 54264 - DNA, 20 bp, Artificial Sequence
  Description of Artificial Sequence: Synthetic oligonucleotide
  Target: ATXN1; (-) strand; PAM type: NRG; PAM sequence: GGG
cttggaaattattattgatt

SEQ ID NO: 54265 - DNA, 20 bp, Artificial Sequence
  Description of Artificial Sequence: Synthetic oligonucleotide
  Target: ATXN1; (-) strand; PAM type: NRG; PAM sequence: TGG
acttggaaattattattgat

SEQ ID NO: 54266 - DNA, 20 bp, Artificial Sequence
  Description of Artificial Sequence: Synthetic oligonucleotide
  Target: ATXN1; (-) strand; PAM type: NRG; PAM sequence: TGG
ttccattaaaagccataact

SEQ ID NO: 54267 - DNA, 20 bp, Artificial Sequence
  Description of Artificial Sequence: Synthetic oligonucleotide
  Target: ATXN1; (-) strand; PAM type: NRG; PAM sequence: AAG
cttattctgctttccattaa

SEQ ID NO: 54268 - DNA, 20 bp, Artificial Sequence
  Description of Artificial Sequence: Synthetic oligonucleotide
  Target: ATXN1; (-) strand; PAM type: NRG; PAM sequence: AAG
tgatgaagtagacatcagga

SEQ ID NO: 54269 - DNA, 20 bp, Artificial Sequence
  Description of Artificial Sequence: Synthetic oligonucleotide
  Target: ATXN1; (-) strand; PAM type: NRG; PAM sequence: AGG
tacttgatgaagtagacatc

SEQ ID NO: 54270 - DNA, 20 bp, Artificial Sequence
  Description of Artificial Sequence: Synthetic oligonucleotide
  Target: ATXN1; (-) strand; PAM type: NRG; PAM sequence: CAG
ctacttgatgaagtagacat

SEQ ID NO: 54271 - DNA, 20 bp, Artificial Sequence
  Description of Artificial Sequence: Synthetic oligonucleotide
  Target: ATXN1; (-) strand; PAM type: NRG; PAM sequence: TAG
cctctctctacttgatgaag

SEQ ID NO: 54272 - DNA, 20 bp, Artificial Sequence
  Description of Artificial Sequence: Synthetic oligonucleotide
  Target: ATXN1; (-) strand; PAM type: NRG; PAM sequence: AAG
ctccctctctctacttgatg

SEQ ID NO: 54273 - DNA, 20 bp, Artificial Sequence
  Description of Artificial Sequence: Synthetic oligonucleotide
  Target: ATXN1; (-) strand; PAM type: NRG; PAM sequence: AAG
tctcaagaaaaaaaaaaaat

SEQ ID NO: 54274 - DNA, 20 bp, Artificial Sequence
  Description of Artificial Sequence: Synthetic oligonucleotide
  Target: ATXN1; (-) strand; PAM type: NRG; PAM sequence: AAG
acagagcaagactccgtctc

SEQ ID NO: 54275 - DNA, 20 bp, Artificial Sequence
  Description of Artificial Sequence: Synthetic oligonucleotide
  Target: ATXN1; (-) strand; PAM type: NRG; PAM sequence: AAG
tccagcctgggtgacagagc

SEQ ID NO: 54276 - DNA, 20 bp, Artificial Sequence
  Description of Artificial Sequence: Synthetic oligonucleotide
  Target: ATXN1; (-) strand; PAM type: NRG; PAM sequence: GAG
gctctccagcctgggtgaca

SEQ ID NO: 54277 - DNA, 20 bp, Artificial Sequence
  Description of Artificial Sequence: Synthetic oligonucleotide
  Target: ATXN1; (-) strand; PAM type: NRG; PAM sequence: CAG
ctgctctccagcctgggtga

SEQ ID NO: 54278 - DNA, 20 bp, Artificial Sequence
  Description of Artificial Sequence: Synthetic oligonucleotide
  Target: ATXN1; (-) strand; PAM type: NRG; PAM sequence: GGG
gtgccactgctctccagcct

SEQ ID NO: 54279 - DNA, 20 bp, Artificial Sequence
  Description of Artificial Sequence: Synthetic oligonucleotide
  Target: ATXN1; (-) strand; PAM type: NRG; PAM sequence: TGG
cgtgccactgctctccagcc

SEQ ID NO: 54280 - DNA, 20 bp, Artificial Sequence
  Description of Artificial Sequence: Synthetic oligonucleotide
  Target: ATXN1; (-) strand; PAM type: NRG; PAM sequence: CAG
gagatcgtgccactgctctc

SEQ ID NO: 54281 - DNA, 20 bp, Artificial Sequence
  Description of Artificial Sequence: Synthetic oligonucleotide
  Target: ATXN1; (-) strand; PAM type: NRG; PAM sequence: GAG
ggcggagcttgcagtgagcc

SEQ ID NO: 54282 - DNA, 20 bp, Artificial Sequence
  Description of Artificial Sequence: Synthetic oligonucleotide
  Target: ATXN1; (-) strand; PAM type: NRG; PAM sequence: GAG
tgggaggcggagcttgcagt

SEQ ID NO: 54283 - DNA, 20 bp, Artificial Sequence
  Description of Artificial Sequence: Synthetic oligonucleotide
  Target: ATXN1; (-) strand; PAM type: NRG; PAM sequence: CAG
aacctgggaggcggagcttg

SEQ ID NO: 54284 - DNA, 20 bp, Artificial Sequence
  Description of Artificial Sequence: Synthetic oligonucleotide
  Target: ATXN1; (-) strand; PAM type: NRG; PAM sequence: GAG
tcgcttgaacctgggaggcg

SEQ ID NO: 54285 - DNA, 20 bp, Artificial Sequence
  Description of Artificial Sequence: Synthetic oligonucleotide
  Target: ATXN1; (-) strand; PAM type: NRG; PAM sequence: CGG
aatcgcttgaacctgggagg

SEQ ID NO: 54286 - DNA, 20 bp, Artificial Sequence
  Description of Artificial Sequence: Synthetic oligonucleotide
  Target: ATXN1; (-) strand; PAM type: NRG; PAM sequence: AGG
gacaatcgcttgaacctggg

SEQ ID NO: 54287 - DNA, 20 bp, Artificial Sequence
  Description of Artificial Sequence: Synthetic oligonucleotide
  Target: ATXN1; (-) strand; PAM type: NRG; PAM sequence: GAG
ggacaatcgcttgaacctgg

SEQ ID NO: 54288 - DNA, 20 bp, Artificial Sequence
  Description of Artificial Sequence: Synthetic oligonucleotide
  Target: ATXN1; (-) strand; PAM type: NRG; PAM sequence: GGG
caggacaatcgcttgaacct

SEQ ID NO: 54289 - DNA, 20 bp, Artificial Sequence
  Description of Artificial Sequence: Synthetic oligonucleotide
  Target: ATXN1; (-) strand; PAM type: NRG; PAM sequence: TGG
gcaggacaatcgcttgaacc

SEQ ID NO: 54290 - DNA, 20 bp, Artificial Sequence
  Description of Artificial Sequence: Synthetic oligonucleotide
  Target: ATXN1; (-) strand; PAM type: NRG; PAM sequence: AGG
gctactcgggaggctgaggc

SEQ ID NO: 54291 - DNA, 20 bp, Artificial Sequence
  Description of Artificial Sequence: Synthetic oligonucleotide
  Target: ATXN1; (-) strand; PAM type: NRG; PAM sequence: CAG
agctactcgggaggctgagg

SEQ ID NO: 54292 - DNA, 20 bp, Artificial Sequence
  Description of Artificial Sequence: Synthetic oligonucleotide
  Target: ATXN1; (-) strand; PAM type: NRG; PAM sequence: AGG
cctagctactcgggaggctg

SEQ ID NO: 54293 - DNA, 20 bp, Artificial Sequence
  Description of Artificial Sequence: Synthetic oligonucleotide
  Target: ATXN1; (-) strand; PAM type: NRG; PAM sequence: GAG
tcctagctactcgggaggct

SEQ ID NO: 54294 - DNA, 20 bp, Artificial Sequence
  Description of Artificial Sequence: Synthetic oligonucleotide
  Target: ATXN1; (-) strand; PAM type: NRG; PAM sequence: AGG
tgtagtcctagctactcggg

SEQ ID NO: 54295 - DNA, 20 bp, Artificial Sequence
  Description of Artificial Sequence: Synthetic oligonucleotide
  Target: ATXN1; (-) strand; PAM type: NRG; PAM sequence: GAG
ctgtagtcctagctactcgg

SEQ ID NO: 54296 - DNA, 20 bp, Artificial Sequence
  Description of Artificial Sequence: Synthetic oligonucleotide
  Target: ATXN1; (-) strand; PAM type: NRG; PAM sequence: GGG
gcctgtagtcctagctactc

SEQ ID NO: 54297 - DNA, 20 bp, Artificial Sequence
  Description of Artificial Sequence: Synthetic oligonucleotide
  Target: ATXN1; (-) strand; PAM type: NRG; PAM sequence: CGG
cgcctgtagtcctagctact

SEQ ID NO: 54298 - DNA, 20 bp, Artificial Sequence
  Description of Artificial Sequence: Synthetic oligonucleotide
  Target: ATXN1; (-) strand; PAM type: NRG; PAM sequence: TAG
gtggtgggcgcctgtagtcc

SEQ ID NO: 54299 - DNA, 20 bp, Artificial Sequence
  Description of Artificial Sequence: Synthetic oligonucleotide
  Target: ATXN1; (-) strand; PAM type: NRG; PAM sequence: TAG
ggtatggtggtgggcgcctg

SEQ ID NO: 54300 - DNA, 20 bp, Artificial Sequence
  Description of Artificial Sequence: Synthetic oligonucleotide
  Target: ATXN1; (-) strand; PAM type: NRG; PAM sequence: GGG
aattagccaggtatggtggt

SEQ ID NO: 54301 - DNA, 20 bp, Artificial Sequence
  Description of Artificial Sequence: Synthetic oligonucleotide
  Target: ATXN1; (-) strand; PAM type: NRG; PAM sequence: TGG
aaattagccaggtatggtgg

SEQ ID NO: 54302 - DNA, 20 bp, Artificial Sequence
  Description of Artificial Sequence: Synthetic oligonucleotide
  Target: ATXN1; (-) strand; PAM type: NRG; PAM sequence: TGG
aaaaaattagccaggtatgg

SEQ ID NO: 54303 - DNA, 20 bp, Artificial Sequence
  Description of Artificial Sequence: Synthetic oligonucleotide
  Target: ATXN1; (-) strand; PAM type: NRG; PAM sequence: TGG
tacaaaaaattagccaggta

SEQ ID NO: 54304 - DNA, 20 bp, Artificial Sequence
  Description of Artificial Sequence: Synthetic oligonucleotide
  Target: ATXN1; (-) strand; PAM type: NRG; PAM sequence: AGG
aaatatacaaaaaattagcc

SEQ ID NO: 54305 - DNA, 20 bp, Artificial Sequence
  Description of Artificial Sequence: Synthetic oligonucleotide
  Target: ATXN1; (-) strand; PAM type: NRG; PAM sequence: CAG
taaatatacaaaaaattagc

SEQ ID NO: 54306 - DNA, 20 bp, Artificial Sequence
  Description of Artificial Sequence: Synthetic oligonucleotide
  Target: ATXN1; (-) strand; PAM type: NRG; PAM sequence: TAG
ctagtaaatatacaaaaaat

SEQ ID NO: 54307 - DNA, 20 bp, Artificial Sequence
  Description of Artificial Sequence: Synthetic oligonucleotide
  Target: ATXN1; (-) strand; PAM type: NRG; PAM sequence: TAG
atatggcgaaaccccgtctc

SEQ ID NO: 54308 - DNA, 20 bp, Artificial Sequence
  Description of Artificial Sequence: Synthetic oligonucleotide
  Target: ATXN1; (-) strand; PAM type: NRG; PAM sequence: TGG
cgagaccatcctggctaata

SEQ ID NO: 54309 - DNA, 20 bp, Artificial Sequence
  Description of Artificial Sequence: Synthetic oligonucleotide
  Target: ATXN1; (-) strand; PAM type: NRG; PAM sequence: TGG
tcaggagatcgagaccatcc

SEQ ID NO: 54310 - DNA, 20 bp, Artificial Sequence
  Description of Artificial Sequence: Synthetic oligonucleotide
  Target: ATXN1; (-) strand; PAM type: NRG; PAM sequence: GAG
gatcacgaggtcaggagatc

SEQ ID NO: 54311 - DNA, 20 bp, Artificial Sequence
  Description of Artificial Sequence: Synthetic oligonucleotide
  Target: ATXN1; (-) strand; PAM type: NRG; PAM sequence: GAG
cagggggatcacgaggtcag

SEQ ID NO: 54312 - DNA, 20 bp, Artificial Sequence
  Description of Artificial Sequence: Synthetic oligonucleotide
  Target: ATXN1; (-) strand; PAM type: NRG; PAM sequence: AGG
ggcagggggatcacgaggtc

SEQ ID NO: 54313 - DNA, 20 bp, Artificial Sequence
  Description of Artificial Sequence: Synthetic oligonucleotide
  Target: ATXN1; (-) strand; PAM type: NRG; PAM sequence: CAG
aggcagggggatcacgaggt

SEQ ID NO: 54314 - DNA, 20 bp, Artificial Sequence
  Description of Artificial Sequence: Synthetic oligonucleotide
  Target: ATXN1; (-) strand; PAM type: NRG; PAM sequence: AGG
gccgaggcagggggatcacg

SEQ ID NO: 54315 - DNA, 20 bp, Artificial Sequence
  Description of Artificial Sequence: Synthetic oligonucleotide
  Target: ATXN1; (-) strand; PAM type: NRG; PAM sequence: GAG
ggccgaggcagggggatcac

SEQ ID NO: 54316 - DNA, 20 bp, Artificial Sequence
  Description of Artificial Sequence: Synthetic oligonucleotide
  Target: ATXN1; (-) strand; PAM type: NRG; PAM sequence: GGG
ctttgggaggccgaggcagg

SEQ ID NO: 54317 - DNA, 20 bp, Artificial Sequence
  Description of Artificial Sequence: Synthetic oligonucleotide
  Target: ATXN1; (-) strand; PAM type: NRG; PAM sequence: GGG
actttgggaggccgaggcag

SEQ ID NO: 54318 - DNA, 20 bp, Artificial Sequence
  Description of Artificial Sequence: Synthetic oligonucleotide
  Target: ATXN1; (-) strand; PAM type: NRG; PAM sequence: GGG
cactttgggaggccgaggca

SEQ ID NO: 54319 - DNA, 20 bp, Artificial Sequence
  Description of Artificial Sequence: Synthetic oligonucleotide
  Target: ATXN1; (-) strand; PAM type: NRG; PAM sequence: AGG
gcactttgggaggccgaggc

SEQ ID NO: 54320 - DNA, 20 bp, Artificial Sequence
  Description of Artificial Sequence: Synthetic oligonucleotide
  Target: ATXN1; (-) strand; PAM type: NRG; PAM sequence: CAG
agcactttgggaggccgagg

SEQ ID NO: 54321 - DNA, 20 bp, Artificial Sequence
  Description of Artificial Sequence: Synthetic oligonucleotide
  Target: ATXN1; (-) strand; PAM type: NRG; PAM sequence: AGG
cccagcactttgggaggccg

SEQ ID NO: 54322 - DNA, 20 bp, Artificial Sequence
  Description of Artificial Sequence: Synthetic oligonucleotide
  Target: ATXN1; (-) strand; PAM type: NRG; PAM sequence: GAG
tcccagcactttgggaggcc

SEQ ID NO: 54323 - DNA, 20 bp, Artificial Sequence
  Description of Artificial Sequence: Synthetic oligonucleotide
  Target: ATXN1; (-) strand; PAM type: NRG; PAM sequence: AGG
tatagtcccagcactttggg

SEQ ID NO: 54324 - DNA, 20 bp, Artificial Sequence
  Description of Artificial Sequence: Synthetic oligonucleotide
  Target: ATXN1; (-) strand; PAM type: NRG; PAM sequence: GAG
ctatagtcccagcactttgg

SEQ ID NO: 54325 - DNA, 20 bp, Artificial Sequence
  Description of Artificial Sequence: Synthetic oligonucleotide
  Target: ATXN1; (-) strand; PAM type: NRG; PAM sequence: GGG
gcctatagtcccagcacttt

SEQ ID NO: 54326 - DNA, 20 bp, Artificial Sequence
  Description of Artificial Sequence: Synthetic oligonucleotide
  Target: ATXN1; (-) strand; PAM type: NRG; PAM sequence: TGG
cgcctatagtcccagcactt

SEQ ID NO: 54327 - DNA, 20 bp, Artificial Sequence
  Description of Artificial Sequence: Synthetic oligonucleotide
  Target: ATXN1; (-) strand; PAM type: NRG; PAM sequence: CAG
gtggctcacgcctatagtcc

SEQ ID NO: 54328 - DNA, 20 bp, Artificial Sequence
  Description of Artificial Sequence: Synthetic oligonucleotide
  Target: ATXN1; (-) strand; PAM type: NRG; PAM sequence: TAG
cgtgtggtggctcacgccta

SEQ ID NO: 54329 - DNA, 20 bp, Artificial Sequence
  Description of Artificial Sequence: Synthetic oligonucleotide
  Target: ATXN1; (-) strand; PAM type: NRG; PAM sequence: TGG
aaagttgtggccacgtgtgg

SEQ ID NO: 54330 - DNA, 20 bp, Artificial Sequence
  Description of Artificial Sequence: Synthetic oligonucleotide
  Target: ATXN1; (-) strand; PAM type: NRG; PAM sequence: TGG
aaaaaagttgtggccacgtg

SEQ ID NO: 54331 - DNA, 20 bp, Artificial Sequence
  Description of Artificial Sequence: Synthetic oligonucleotide
  Target: ATXN1; (-) strand; PAM type: NRG; PAM sequence: TGG
ggccattaaaaaaaaagttg

SEQ ID NO: 54332 - DNA, 20 bp, Artificial Sequence
  Description of Artificial Sequence: Synthetic oligonucleotide
  Target: ATXN1; (-) strand; PAM type: NRG; PAM sequence: AAG
agattaggccattaaaaaaa

SEQ ID NO: 54333 - DNA, 20 bp, Artificial Sequence
  Description of Artificial Sequence: Synthetic oligonucleotide
  Target: ATXN1; (-) strand; PAM type: NRG; PAM sequence: AGG
cgtatgctgagaaacagatt

SEQ ID NO: 54334 - DNA, 20 bp, Artificial Sequence
  Description of Artificial Sequence: Synthetic oligonucleotide
  Target: ATXN1; (-) strand; PAM type: NRG; PAM sequence: TAG
tcgtatgctgagaaacagat

SEQ ID NO: 54335 - DNA, 20 bp, Artificial Sequence
  Description of Artificial Sequence: Synthetic oligonucleotide
  Target: ATXN1; (-) strand; PAM type: NRG; PAM sequence: CAG
agtgttcgtatgctgagaaa

SEQ ID NO: 54336 - DNA, 20 bp, Artificial Sequence
  Description of Artificial Sequence: Synthetic oligonucleotide
  Target: ATXN1; (-) strand; PAM type: NRG; PAM sequence: GAG
agatacagtgttcgtatgct

SEQ ID NO: 54337 - DNA, 20 bp, Artificial Sequence
  Description of Artificial Sequence: Synthetic oligonucleotide
  Target: ATXN1; (-) strand; PAM type: NRG; PAM sequence: CAG
agttgtctgggagtgagata

SEQ ID NO: 54338 - DNA, 20 bp, Artificial Sequence
  Description of Artificial Sequence: Synthetic oligonucleotide
  Target: ATXN1; (-) strand; PAM type: NRG; PAM sequence: GAG
ggcatcagttgtctgggagt

SEQ ID NO: 54339 - DNA, 20 bp, Artificial Sequence
  Description of Artificial Sequence: Synthetic oligonucleotide
  Target: ATXN1; (-) strand; PAM type: NRG; PAM sequence: GAG
gaatggcatcagttgtctgg

SEQ ID NO: 54340 - DNA, 20 bp, Artificial Sequence
  Description of Artificial Sequence: Synthetic oligonucleotide
  Target: ATXN1; (-) strand; PAM type: NRG; PAM sequence: GGG
atgaatggcatcagttgtct

SEQ ID NO: 54341 - DNA, 20 bp, Artificial Sequence
  Description of Artificial Sequence: Synthetic oligonucleotide
  Target: ATXN1; (-) strand; PAM type: NRG; PAM sequence: TGG
catgaatggcatcagttgtc

SEQ ID NO: 54342 - DNA, 20 bp, Artificial Sequence
  Description of Artificial Sequence: Synthetic oligonucleotide
  Target: ATXN1; (-) strand; PAM type: NRG; PAM sequence: CAG
tcttcaagcatgaatggcat

SEQ ID NO: 54343 - DNA, 20 bp, Artificial Sequence
  Description of Artificial Sequence: Synthetic oligonucleotide
  Target: ATXN1; (-) strand; PAM type: NRG; PAM sequence: TGG
atttcttcttcaagcatgaa

SEQ ID NO: 54344 - DNA, 20 bp, Artificial Sequence
  Description of Artificial Sequence: Synthetic oligonucleotide
  Target: ATXN1; (-) strand; PAM type: NRG; PAM sequence: AAG
tggtcatggatttcttcttc

SEQ ID NO: 54345 - DNA, 20 bp, Artificial Sequence
  Description of Artificial Sequence: Synthetic oligonucleotide
  Target: ATXN1; (-) strand; PAM type: NRG; PAM sequence: TGG
ccttctttggtacctggtca

SEQ ID NO: 54346 - DNA, 20 bp, Artificial Sequence
  Description of Artificial Sequence: Synthetic oligonucleotide
  Target: ATXN1; (-) strand; PAM type: NRG; PAM sequence: TGG
atttagccttctttggtacc

SEQ ID NO: 54347 - DNA, 20 bp, Artificial Sequence
  Description of Artificial Sequence: Synthetic oligonucleotide
  Target: ATXN1; (-) strand; PAM type: NRG; PAM sequence: TGG
cctttatatttagccttctt

SEQ ID NO: 54348 - DNA, 20 bp, Artificial Sequence
  Description of Artificial Sequence: Synthetic oligonucleotide
  Target: ATXN1; (-) strand; PAM type: NRG; PAM sequence: TAG
tagaaaactgcctttatatt

SEQ ID NO: 54349 - DNA, 20 bp, Artificial Sequence
  Description of Artificial Sequence: Synthetic oligonucleotide
  Target: ATXN1; (-) strand; PAM type: NRG; PAM sequence: TAG
tgaactagggtagtggcagg

SEQ ID NO: 54350 - DNA, 20 bp, Artificial Sequence
  Description of Artificial Sequence: Synthetic oligonucleotide
  Target: ATXN1; (-) strand; PAM type: NRG; PAM sequence: AGG
ggatgaactagggtagtggc

SEQ ID NO: 54351 - DNA, 20 bp, Artificial Sequence
  Description of Artificial Sequence: Synthetic oligonucleotide
  Target: ATXN1; (-) strand; PAM type: NRG; PAM sequence: CAG
aggatgaactagggtagtgg

SEQ ID NO: 54352 - DNA, 20 bp, Artificial Sequence
  Description of Artificial Sequence: Synthetic oligonucleotide
  Target: ATXN1; (-) strand; PAM type: NRG; PAM sequence: TGG
tcgaggatgaactagggtag

SEQ ID NO: 54353 - DNA, 20 bp, Artificial Sequence
  Description of Artificial Sequence: Synthetic oligonucleotide
  Target: ATXN1; (-) strand; PAM type: NRG; PAM sequence: TAG
tcttcgaggatgaactaggg

SEQ ID NO: 54354 - DNA, 20 bp, Artificial Sequence
  Description of Artificial Sequence: Synthetic oligonucleotide
  Target: ATXN1; (-) strand; PAM type: NRG; PAM sequence: GGG
aaatcttcgaggatgaacta

SEQ ID NO: 54355 - DNA, 20 bp, Artificial Sequence
  Description of Artificial Sequence: Synthetic oligonucleotide
  Target: ATXN1; (-) strand; PAM type: NRG; PAM sequence: AGG
caaatcttcgaggatgaact

SEQ ID NO: 54356 - DNA, 20 bp, Artificial Sequence
  Description of Artificial Sequence: Synthetic oligonucleotide
  Target: ATXN1; (-) strand; PAM type: NRG; PAM sequence: TAG
ccaaatcttcgaggatgaac

SEQ ID NO: 54357 - DNA, 20 bp, Artificial Sequence
  Description of Artificial Sequence: Synthetic oligonucleotide
  Target: ATXN1; (-) strand; PAM type: NRG; PAM sequence: AGG
acttttgaaccaaatcttcg

SEQ ID NO: 54358 - DNA, 20 bp, Artificial Sequence
  Description of Artificial Sequence: Synthetic oligonucleotide
  Target: ATXN1; (-) strand; PAM type: NRG; PAM sequence: GAG
aacttttgaaccaaatcttc

SEQ ID NO: 54359 - DNA, 20 bp, Artificial Sequence
  Description of Artificial Sequence: Synthetic oligonucleotide
  Target: ATXN1; (-) strand; PAM type: NRG; PAM sequence: AGG
taatatggagggcctttgag

SEQ ID NO: 54360 - DNA, 20 bp, Artificial Sequence
  Description of Artificial Sequence: Synthetic oligonucleotide
  Target: ATXN1; (-) strand; PAM type: NRG; PAM sequence: GAG
ataatatggagggcctttga

SEQ ID NO: 54361 - DNA, 20 bp, Artificial Sequence
  Description of Artificial Sequence: Synthetic oligonucleotide
  Target: ATXN1; (-) strand; PAM type: NRG; PAM sequence: GAG
gaataatatggagggccttt

SEQ ID NO: 54362 - DNA, 20 bp, Artificial Sequence
  Description of Artificial Sequence: Synthetic oligonucleotide
  Target: ATXN1; (-) strand; PAM type: NRG; PAM sequence: GGG
tcagggtggaataatatgga

SEQ ID NO: 54363 - DNA, 20 bp, Artificial Sequence
  Description of Artificial Sequence: Synthetic oligonucleotide
  Target: ATXN1; (-) strand; PAM type: NRG; PAM sequence: AGG
ttcagggtggaataatatgg

SEQ ID NO: 54364 - DNA, 20 bp, Artificial Sequence
  Description of Artificial Sequence: Synthetic oligonucleotide
  Target: ATXN1; (-) strand; PAM type: NRG; PAM sequence: GAG
gttcagggtggaataatatg

SEQ ID NO: 54365 - DNA, 20 bp, Artificial Sequence
  Description of Artificial Sequence: Synthetic oligonucleotide
  Target: ATXN1; (-) strand; PAM type: NRG; PAM sequence: TGG
aggttcagggtggaataata

SEQ ID NO: 54366 - DNA, 20 bp, Artificial Sequence
  Description of Artificial Sequence: Synthetic oligonucleotide
  Target: ATXN1; (-) strand; PAM type: NRG; PAM sequence: TGG
aagagctctgaggttcaggg

SEQ ID NO: 54367 - DNA, 20 bp, Artificial Sequence
  Description of Artificial Sequence: Synthetic oligonucleotide
  Target: ATXN1; (-) strand; PAM type: NRG; PAM sequence: GGG
ctcaagagctctgaggttca

SEQ ID NO: 54368 - DNA, 20 bp, Artificial Sequence
  Description of Artificial Sequence: Synthetic oligonucleotide
  Target: ATXN1; (-) strand; PAM type: NRG; PAM sequence: AGG
cctcaagagctctgaggttc

SEQ ID NO: 54369 - DNA, 20 bp, Artificial Sequence
  Description of Artificial Sequence: Synthetic oligonucleotide
  Target: ATXN1; (-) strand; PAM type: NRG; PAM sequence: CAG
acctcaagagctctgaggtt

SEQ ID NO: 54370 - DNA, 20 bp, Artificial Sequence
  Description of Artificial Sequence: Synthetic oligonucleotide
  Target: ATXN1; (-) strand; PAM type: NRG; PAM sequence: AGG
ttttaacctcaagagctctg

SEQ ID NO: 54371 - DNA, 20 bp, Artificial Sequence
  Description of Artificial Sequence: Synthetic oligonucleotide
  Target: ATXN1; (-) strand; PAM type: NRG; PAM sequence: GAG
tttttaacctcaagagctct

SEQ ID NO: 54372 - DNA, 20 bp, Artificial Sequence
  Description of Artificial Sequence: Synthetic oligonucleotide
  Target: ATXN1; (-) strand; PAM type: NRG; PAM sequence: GAG
ctcatagtttttaacctcaa

SEQ ID NO: 54373 - DNA, 20 bp, Artificial Sequence
  Description of Artificial Sequence: Synthetic oligonucleotide
  Target: ATXN1; (-) strand; PAM type: NRG; PAM sequence: AAG
ttctcatagtttttaacctc

SEQ ID NO: 54374 - DNA, 20 bp, Artificial Sequence
  Description of Artificial Sequence: Synthetic oligonucleotide
  Target: ATXN1; (-) strand; PAM type: NRG; PAM sequence: TAG
tactcatccattccttctca

SEQ ID NO: 54375 - DNA, 20 bp, Artificial Sequence
  Description of Artificial Sequence: Synthetic oligonucleotide
  Target: ATXN1; (-) strand; PAM type: NRG; PAM sequence: GGG
ttttgctacaccagagcgtt

SEQ ID NO: 54376 - DNA, 20 bp, Artificial Sequence
  Description of Artificial Sequence: Synthetic oligonucleotide
  Target: ATXN1; (-) strand; PAM type: NRG; PAM sequence: TGG
cttttgctacaccagagcgt

SEQ ID NO: 54377 - DNA, 20 bp, Artificial Sequence
  Description of Artificial Sequence: Synthetic oligonucleotide
  Target: ATXN1; (-) strand; PAM type: NRG; PAM sequence: GAG
ctcaatcttttgctacacca

SEQ ID NO: 54378 - DNA, 20 bp, Artificial Sequence
  Description of Artificial Sequence: Synthetic oligonucleotide
  Target: ATXN1; (-) strand; PAM type: NRG; PAM sequence: CAG
ttctcaatcttttgctacac

SEQ ID NO: 54379 - DNA, 20 bp, Artificial Sequence
  Description of Artificial Sequence: Synthetic oligonucleotide
  Target: ATXN1; (-) strand; PAM type: NRG; PAM sequence: CAG
atcttttcgtagctctacaa

SEQ ID NO: 54380 - DNA, 20 bp, Artificial Sequence
  Description of Artificial Sequence: Synthetic oligonucleotide
  Target: ATXN1; (-) strand; PAM type: NRG; PAM sequence: TAG
atgtgccaaatatcttttcg

SEQ ID NO: 54381 - DNA, 20 bp, Artificial Sequence
  Description of Artificial Sequence: Synthetic oligonucleotide
  Target: ATXN1; (-) strand; PAM type: NRG; PAM sequence: AAG
tttcatttaatgagcatttt

SEQ ID NO: 54382 - DNA, 20 bp, Artificial Sequence
  Description of Artificial Sequence: Synthetic oligonucleotide
  Target: ATXN1; (-) strand; PAM type: NRG; PAM sequence: GAG
cattaattctttcatttaat

SEQ ID NO: 54383 - DNA, 20 bp, Artificial Sequence
  Description of Artificial Sequence: Synthetic oligonucleotide
  Target: ATXN1; (-) strand; PAM type: NRG; PAM sequence: GGG
acacaaacattcagtaggaa

SEQ ID NO: 54384 - DNA, 20 bp, Artificial Sequence
  Description of Artificial Sequence: Synthetic oligonucleotide
  Target: ATXN1; (-) strand; PAM type: NRG; PAM sequence: AGG
gacacaaacattcagtagga

SEQ ID NO: 54385 - DNA, 20 bp, Artificial Sequence
  Description of Artificial Sequence: Synthetic oligonucleotide
  Target: ATXN1; (-) strand; PAM type: NRG; PAM sequence: AAG
agacacaaacattcagtagg

SEQ ID NO: 54386 - DNA, 20 bp, Artificial Sequence
  Description of Artificial Sequence: Synthetic oligonucleotide
  Target: ATXN1; (-) strand; PAM type: NRG; PAM sequence: AGG
tctagacacaaacattcagt

SEQ ID NO: 54387 - DNA, 20 bp, Artificial Sequence
  Description of Artificial Sequence: Synthetic oligonucleotide
  Target: ATXN1; (-) strand; PAM type: NRG; PAM sequence: TAG
ttctagacacaaacattcag

SEQ ID NO: 54388 - DNA, 20 bp, Artificial Sequence
  Description of Artificial Sequence: Synthetic oligonucleotide
  Target: ATXN1; (-) strand; PAM type: NRG; PAM sequence: CAG
atcttctagacacaaacatt

SEQ ID NO: 54389 - DNA, 20 bp, Artificial Sequence
  Description of Artificial Sequence: Synthetic oligonucleotide
  Target: ATXN1; (-) strand; PAM type: NRG; PAM sequence: TAG
gtttgagacagtgcatcttc

SEQ ID NO: 54390 - DNA, 20 bp, Artificial Sequence
  Description of Artificial Sequence: Synthetic oligonucleotide
  Target: ATXN1; (-) strand; PAM type: NRG; PAM sequence: CAG
ataatgggaatagtttgaga

SEQ ID NO: 54391 - DNA, 20 bp, Artificial Sequence
  Description of Artificial Sequence: Synthetic oligonucleotide
  Target: ATXN1; (-) strand; PAM type: NRG; PAM sequence: GAG
ttttataatgggaatagttt

SEQ ID NO: 54392 - DNA, 20 bp, Artificial Sequence
  Description of Artificial Sequence: Synthetic oligonucleotide
  Target: ATXN1; (-) strand; PAM type: NRG; PAM sequence: TAG
atttacttttataatgggaa

SEQ ID NO: 54393 - DNA, 20 bp, Artificial Sequence
  Description of Artificial Sequence: Synthetic oligonucleotide
  Target: ATXN1; (-) strand; PAM type: NRG; PAM sequence: GGG
acaatatttacttttataat

SEQ ID NO: 54394 - DNA, 20 bp, Artificial Sequence
  Description of Artificial Sequence: Synthetic oligonucleotide
  Target: ATXN1; (-) strand; PAM type: NRG; PAM sequence: TGG
aacaatatttacttttataa

SEQ ID NO: 54395 - DNA, 20 bp, Artificial Sequence
  Description of Artificial Sequence: Synthetic oligonucleotide
  Target: ATXN1; (-) strand; PAM type: NRG; PAM sequence: AGG
ggaagggactaattgtacac

SEQ ID NO: 54396 - DNA, 20 bp, Artificial Sequence
  Description of Artificial Sequence: Synthetic oligonucleotide
  Target: ATXN1; (-) strand; PAM type: NRG; PAM sequence: CAG
aggaagggactaattgtaca

SEQ ID NO: 54397 - DNA, 20 bp, Artificial Sequence
  Description of Artificial Sequence: Synthetic oligonucleotide
  Target: ATXN1; (-) strand; PAM type: NRG; PAM sequence: GGG
ggattaatagtctagaggaa

SEQ ID NO: 54398 - DNA, 20 bp, Artificial Sequence
  Description of Artificial Sequence: Synthetic oligonucleotide
  Target: ATXN1; (-) strand; PAM type: NRG; PAM sequence: AGG
gggattaatagtctagagga

SEQ ID NO: 54399 - DNA, 20 bp, Artificial Sequence
  Description of Artificial Sequence: Synthetic oligonucleotide
  Target: ATXN1; (-) strand; PAM type: NRG; PAM sequence: AAG
agggattaatagtctagagg

SEQ ID NO: 54400 - DNA, 20 bp, Artificial Sequence
  Description of Artificial Sequence: Synthetic oligonucleotide
  Target: ATXN1; (-) strand; PAM type: NRG; PAM sequence: AGG
gccagggattaatagtctag

SEQ ID NO: 54401 - DNA, 20 bp, Artificial Sequence
  Description of Artificial Sequence: Synthetic oligonucleotide
  Target: ATXN1; (-) strand; PAM type: NRG; PAM sequence: GAG
agccagggattaatagtcta

SEQ ID NO: 54402 - DNA, 20 bp, Artificial Sequence
  Description of Artificial Sequence: Synthetic oligonucleotide
  Target: ATXN1; (-) strand; PAM type: NRG; PAM sequence: TAG
ggagccagggattaatagtc

SEQ ID NO: 54403 - DNA, 20 bp, Artificial Sequence
  Description of Artificial Sequence: Synthetic oligonucleotide
  Target: ATXN1; (-) strand; PAM type: NRG; PAM sequence: TAG
tgccaggagccagggattaa

SEQ ID NO: 54404 - DNA, 20 bp, Artificial Sequence
  Description of Artificial Sequence: Synthetic oligonucleotide
  Target: ATXN1; (-) strand; PAM type: NRG; PAM sequence: GGG
ggagtttttgccaggagcca

SEQ ID NO: 54405 - DNA, 20 bp, Artificial Sequence
  Description of Artificial Sequence: Synthetic oligonucleotide
  Target: ATXN1; (-) strand; PAM type: NRG; PAM sequence: AGG
aggagtttttgccaggagcc

SEQ ID NO: 54406 - DNA, 20 bp, Artificial Sequence
  Description of Artificial Sequence: Synthetic oligonucleotide
  Target: ATXN1; (-) strand; PAM type: NRG; PAM sequence: CAG
aaggagtttttgccaggagc

SEQ ID NO: 54407 - DNA, 20 bp, Artificial Sequence
  Description of Artificial Sequence: Synthetic oligonucleotide
  Target: ATXN1; (-) strand; PAM type: NRG; PAM sequence: GAG
atgcaaggagtttttgccag

SEQ ID NO: 54408 - DNA, 20 bp, Artificial Sequence
  Description of Artificial Sequence: Synthetic oligonucleotide
  Target: ATXN1; (-) strand; PAM type: NRG; PAM sequence: AGG
aaatgcaaggagtttttgcc

SEQ ID NO: 54409 - DNA, 20 bp, Artificial Sequence
  Description of Artificial Sequence: Synthetic oligonucleotide
  Target: ATXN1; (-) strand; PAM type: NRG; PAM sequence: CAG
caaatgcaaggagtttttgc

SEQ ID NO: 54410 - DNA, 20 bp, Artificial Sequence
  Description of Artificial Sequence: Synthetic oligonucleotide
  Target: ATXN1; (-) strand; PAM type: NRG; PAM sequence: GAG
catttctgtacaaatgcaag

SEQ ID NO: 54411 - DNA, 20 bp, Artificial Sequence
  Description of Artificial Sequence: Synthetic oligonucleotide
  Target: ATXN1; (-) strand; PAM type: NRG; PAM sequence: AGG
tccatttctgtacaaatgca

SEQ ID NO: 54412 - DNA, 20 bp, Artificial Sequence
  Description of Artificial Sequence: Synthetic oligonucleotide
  Target: ATXN1; (-) strand; PAM type: NRG; PAM sequence: AAG
ttccatttctgtacaaatgc

SEQ ID NO: 54413 - DNA, 20 bp, Artificial Sequence
  Description of Artificial Sequence: Synthetic oligonucleotide
  Target: ATXN1; (-) strand; PAM type: NRG; PAM sequence: TGG
gaaagaagtatcgcttaatg

SEQ ID NO: 54414 - DNA, 20 bp, Artificial Sequence
  Description of Artificial Sequence: Synthetic oligonucleotide
  Target: ATXN1; (-) strand; PAM type: NRG; PAM sequence: AAG
gttgatgtgcttaaggaaag

SEQ ID NO: 54415 - DNA, 20 bp, Artificial Sequence
  Description of Artificial Sequence: Synthetic oligonucleotide
  Target: ATXN1; (-) strand; PAM type: NRG; PAM sequence: AAG
ggagttgatgtgcttaagga

SEQ ID NO: 54416 - DNA, 20 bp, Artificial Sequence
  Description of Artificial Sequence: Synthetic oligonucleotide
  Target: ATXN1; (-) strand; PAM type: NRG; PAM sequence: AGG
agagggagttgatgtgctta

SEQ ID NO: 54417 - DNA, 20 bp, Artificial Sequence
  Description of Artificial Sequence: Synthetic oligonucleotide
  Target: ATXN1; (-) strand; PAM type: NRG; PAM sequence: AAG
cagagggagttgatgtgctt

SEQ ID NO: 54418 - DNA, 20 bp, Artificial Sequence
  Description of Artificial Sequence: Synthetic oligonucleotide
  Target: ATXN1; (-) strand; PAM type: NRG; PAM sequence: GAG
attcctgaaagccacagagg

SEQ ID NO: 54419 - DNA, 20 bp, Artificial Sequence
  Description of Artificial Sequence: Synthetic oligonucleotide
  Target: ATXN1; (-) strand; PAM type: NRG; PAM sequence: GGG
gcattcctgaaagccacaga

SEQ ID NO: 54420 - DNA, 20 bp, Artificial Sequence
  Description of Artificial Sequence: Synthetic oligonucleotide
  Target: ATXN1; (-) strand; PAM type: NRG; PAM sequence: AGG
agcattcctgaaagccacag

SEQ ID NO: 54421 - DNA, 20 bp, Artificial Sequence
  Description of Artificial Sequence: Synthetic oligonucleotide
  Target: ATXN1; (-) strand; PAM type: NRG; PAM sequence: GAG
aagcattcctgaaagccaca

SEQ ID NO: 54422 - DNA, 20 bp, Artificial Sequence
  Description of Artificial Sequence: Synthetic oligonucleotide
  Target: ATXN1; (-) strand; PAM type: NRG; PAM sequence: CAG
ctaagcattcctgaaagcca

SEQ ID NO: 54423 - DNA, 20 bp, Artificial Sequence
  Description of Artificial Sequence: Synthetic oligonucleotide
  Target: ATXN1; (-) strand; PAM type: NRG; PAM sequence: AAG
caaaggctaagcattcctga

SEQ ID NO: 54424 - DNA, 20 bp, Artificial Sequence
  Description of Artificial Sequence: Synthetic oligonucleotide
  Target: ATXN1; (-) strand; PAM type: NRG; PAM sequence: AAG
tctactttattccaaaggct

SEQ ID NO: 54425 - DNA, 20 bp, Artificial Sequence
  Description of Artificial Sequence: Synthetic oligonucleotide
  Target: ATXN1; (-) strand; PAM type: NRG; PAM sequence: AGG
tactttctactttattccaa

SEQ ID NO: 54426 - DNA, 20 bp, Artificial Sequence
  Description of Artificial Sequence: Synthetic oligonucleotide
  Target: ATXN1; (-) strand; PAM type: NRG; PAM sequence: AAG
gtactttctactttattcca

SEQ ID NO: 54427 - DNA, 20 bp, Artificial Sequence
  Description of Artificial Sequence: Synthetic oligonucleotide
  Target: ATXN1; (-) strand; PAM type: NRG; PAM sequence: TGG
tgccaggccatgtattccag

SEQ ID NO: 54428 - DNA, 20 bp, Artificial Sequence
  Description of Artificial Sequence: Synthetic oligonucleotide
  Target: ATXN1; (-) strand; PAM type: NRG; PAM sequence: CAG
atgtgccaggccatgtattc

SEQ ID NO: 54429 - DNA, 20 bp, Artificial Sequence
  Description of Artificial Sequence: Synthetic oligonucleotide
  Target: ATXN1; (-) strand; PAM type: NRG; PAM sequence: AGG
tctttgatttgacatgtgcc

SEQ ID NO: 54430 - DNA, 20 bp, Artificial Sequence
  Description of Artificial Sequence: Synthetic oligonucleotide
  Target: ATXN1; (-) strand; PAM type: NRG; PAM sequence: CAG
ttctttgatttgacatgtgc

SEQ ID NO: 54431 - DNA, 20 bp, Artificial Sequence
  Description of Artificial Sequence: Synthetic oligonucleotide
  Target: ATXN1; (-) strand; PAM type: NRG; PAM sequence: CAG
tattgcatggtcagactgtt

SEQ ID NO: 54432 - DNA, 20 bp, Artificial Sequence
  Description of Artificial Sequence: Synthetic oligonucleotide
  Target: ATXN1; (-) strand; PAM type: NRG; PAM sequence: CAG
aaaaaggagtattgcatggt

SEQ ID NO: 54433 - DNA, 20 bp, Artificial Sequence
  Description of Artificial Sequence: Synthetic oligonucleotide
  Target: ATXN1; (-) strand; PAM type: NRG; PAM sequence: TGG
taaaaaaaaggagtattgca

SEQ ID NO: 54434 - DNA, 20 bp, Artificial Sequence
  Description of Artificial Sequence: Synthetic oligonucleotide
  Target: ATXN1; (-) strand; PAM type: NRG; PAM sequence: GAG
taaaataaaataaaaaaaag

SEQ ID NO: 54435 - DNA, 20 bp, Artificial Sequence
  Description of Artificial Sequence: Synthetic oligonucleotide
  Target: ATXN1; (-) strand; PAM type: NRG; PAM sequence: AGG
aataaaataaaataaaaaaa

SEQ ID NO: 54436 - DNA, 20 bp, Artificial Sequence
  Description of Artificial Sequence: Synthetic oligonucleotide
  Target: ATXN1; (-) strand; PAM type: NRG; PAM sequence: AAG
taataaaataaaataaaaaa

SEQ ID NO: 54437 - DNA, 20 bp, Artificial Sequence
  Description of Artificial Sequence: Synthetic oligonucleotide
  Target: ATXN1; (-) strand; PAM type: NRG; PAM sequence: AAG
cacatgtaacctaaaactta

SEQ ID NO: 54438 - DNA, 20 bp, Artificial Sequence
  Description of Artificial Sequence: Synthetic oligonucleotide
  Target: ATXN1; (-) strand; PAM type: NRG; PAM sequence: TGG
atgggtgcagcacaccagca

SEQ ID NO: 54439 - DNA, 20 bp, Artificial Sequence
  Description of Artificial Sequence: Synthetic oligonucleotide
  Target: ATXN1; (-) strand; PAM type: NRG; PAM sequence: CAG
agttaatgggtgcagcacac

SEQ ID NO: 54440 - DNA, 20 bp, Artificial Sequence
  Description of Artificial Sequence: Synthetic oligonucleotide
  Target: ATXN1; (-) strand; PAM type: NRG; PAM sequence: CAG
aaatgacgagttaatgggtg

SEQ ID NO: 54441 - DNA, 20 bp, Artificial Sequence
  Description of Artificial Sequence: Synthetic oligonucleotide
  Target: ATXN1; (-) strand; PAM type: NRG; PAM sequence: GGG
atgctaaatgacgagttaat

SEQ ID NO: 54442 - DNA, 20 bp, Artificial Sequence
  Description of Artificial Sequence: Synthetic oligonucleotide
  Target: ATXN1; (-) strand; PAM type: NRG; PAM sequence: TGG
aatgctaaatgacgagttaa

SEQ ID NO: 54443 - DNA, 20 bp, Artificial Sequence
  Description of Artificial Sequence: Synthetic oligonucleotide
  Target: ATXN1; (-) strand; PAM type: NRG; PAM sequence: GAG
tatacctaatgctaaatgac

SEQ ID NO: 54444 - DNA, 20 bp, Artificial Sequence
  Description of Artificial Sequence: Synthetic oligonucleotide
  Target: ATXN1; (-) strand; PAM type: NRG; PAM sequence: GAG
ggggggagggacagcattag

SEQ ID NO: 54445 - DNA, 20 bp, Artificial Sequence
  Description of Artificial Sequence: Synthetic oligonucleotide
  Target: ATXN1; (-) strand; PAM type: NRG; PAM sequence: AGG
gaggggggagggacagcatt

SEQ ID NO: 54446 - DNA, 20 bp, Artificial Sequence
  Description of Artificial Sequence: Synthetic oligonucleotide
  Target: ATXN1; (-) strand; PAM type: NRG; PAM sequence: TAG
ggaggggggagggacagcat

SEQ ID NO: 54447 - DNA, 20 bp, Artificial Sequence
  Description of Artificial Sequence: Synthetic oligonucleotide
  Target: ATXN1; (-) strand; PAM type: NRG; PAM sequence: CAG
gaggggggaggggggaggga

SEQ ID NO: 54448 - DNA, 20 bp, Artificial Sequence
  Description of Artificial Sequence: Synthetic oligonucleotide
  Target: ATXN1; (-) strand; PAM type: NRG; PAM sequence: GGG
gggggaggggggagggggga

SEQ ID NO: 54449 - DNA, 20 bp, Artificial Sequence
  Description of Artificial Sequence: Synthetic oligonucleotide
  Target: ATXN1; (-) strand; PAM type: NRG; PAM sequence: AGG
ggggggaggggggagggggg

SEQ ID NO: 54450 - DNA, 20 bp, Artificial Sequence
  Description of Artificial Sequence: Synthetic oligonucleotide
  Target: ATXN1; (-) strand; PAM type: NRG; PAM sequence: GAG
tggggggaggggggaggggg

SEQ ID NO: 54451 - DNA, 20 bp, Artificial Sequence
  Description of Artificial Sequence: Synthetic oligonucleotide
  Target: ATXN1; (-) strand; PAM type: NRG; PAM sequence: GGG
ggtggggggaggggggaggg

SEQ ID NO: 54452 - DNA, 20 bp, Artificial Sequence
  Description of Artificial Sequence: Synthetic oligonucleotide
  Target: ATXN1; (-) strand; PAM type: NRG; PAM sequence: GGG
gggtggggggaggggggagg

SEQ ID NO: 54453 - DNA, 20 bp, Artificial Sequence
  Description of Artificial Sequence: Synthetic oligonucleotide
  Target: ATXN1; (-) strand; PAM type: NRG; PAM sequence: GGG
ggggtggggggaggggggag

SEQ ID NO: 54454 - DNA, 20 bp, Artificial Sequence
  Description of Artificial Sequence: Synthetic oligonucleotide
  Target: ATXN1; (-) strand; PAM type: NRG; PAM sequence: GGG
tggggtggggggagggggga

SEQ ID NO: 54455 - DNA, 20 bp, Artificial Sequence
  Description of Artificial Sequence: Synthetic oligonucleotide
  Target: ATXN1; (-) strand; PAM type: NRG; PAM sequence: AGG
gtggggtggggggagggggg

SEQ ID NO: 54456 - DNA, 20 bp, Artificial Sequence
  Description of Artificial Sequence: Synthetic oligonucleotide
  Target: ATXN1; (-) strand; PAM type: NRG; PAM sequence: GAG
tgtggggtggggggaggggg

SEQ ID NO: 54457 - DNA, 20 bp, Artificial Sequence
  Description of Artificial Sequence: Synthetic oligonucleotide
  Target: ATXN1; (-) strand; PAM type: NRG; PAM sequence: GGG
gttgtggggtggggggaggg

SEQ ID NO: 54458 - DNA, 20 bp, Artificial Sequence
  Description of Artificial Sequence: Synthetic oligonucleotide
  Target: ATXN1; (-) strand; PAM type: NRG; PAM sequence: GGG
tgttgtggggtggggggagg

SEQ ID NO: 54459 - DNA, 20 bp, Artificial Sequence
  Description of Artificial Sequence: Synthetic oligonucleotide
  Target: ATXN1; (-) strand; PAM type: NRG; PAM sequence: GGG
ctgttgtggggtggggggag

SEQ ID NO: 54460 - DNA, 20 bp, Artificial Sequence
  Description of Artificial Sequence: Synthetic oligonucleotide
  Target: ATXN1; (-) strand; PAM type: NRG; PAM sequence: GGG
actgttgtggggtgggggga

SEQ ID NO: 54461 - DNA, 20 bp, Artificial Sequence
  Description of Artificial Sequence: Synthetic oligonucleotide
  Target: ATXN1; (-) strand; PAM type: NRG; PAM sequence: AGG
gactgttgtggggtgggggg

SEQ ID NO: 54462 - DNA, 20 bp, Artificial Sequence
  Description of Artificial Sequence: Synthetic oligonucleotide
  Target: ATXN1; (-) strand; PAM type: NRG; PAM sequence: GAG
ggactgttgtggggtggggg

SEQ ID NO: 54463 - DNA, 20 bp, Artificial Sequence
  Description of Artificial Sequence: Synthetic oligonucleotide
  Target: ATXN1; (-) strand; PAM type: NRG; PAM sequence: GGG
ggggactgttgtggggtggg

SEQ ID NO: 54464 - DNA, 20 bp, Artificial Sequence
  Description of Artificial Sequence: Synthetic oligonucleotide
  Target: ATXN1; (-) strand; PAM type: NRG; PAM sequence: GGG
tggggactgttgtggggtgg

SEQ ID NO: 54465 - DNA, 20 bp, Artificial Sequence
  Description of Artificial Sequence: Synthetic oligonucleotide
  Target: ATXN1; (-) strand; PAM type: NRG; PAM sequence: GGG
ctggggactgttgtggggtg

SEQ ID NO: 54466 - DNA, 20 bp, Artificial Sequence
  Description of Artificial Sequence: Synthetic oligonucleotide
  Target: ATXN1; (-) strand; PAM type: NRG; PAM sequence: GGG
tctggggactgttgtggggt

SEQ ID NO: 54467 - DNA, 20 bp, Artificial Sequence
  Description of Artificial Sequence: Synthetic oligonucleotide
  Target: ATXN1; (-) strand; PAM type: NRG; PAM sequence: TGG
ctctggggactgttgtgggg

SEQ ID NO: 54468 - DNA, 20 bp, Artificial Sequence
  Description of Artificial Sequence: Synthetic oligonucleotide
  Target: ATXN1; (-) strand; PAM type: NRG; PAM sequence: GGG
acactctggggactgttgtg

SEQ ID NO: 54469 - DNA, 20 bp, Artificial Sequence
  Description of Artificial Sequence: Synthetic oligonucleotide
  Target: ATXN1; (-) strand; PAM type: NRG; PAM sequence: GGG
cacactctggggactgttgt

SEQ ID NO: 54470 - DNA, 20 bp, Artificial Sequence
  Description of Artificial Sequence: Synthetic oligonucleotide
  Target: ATXN1; (-) strand; PAM type: NRG; PAM sequence: TGG
tcacactctggggactgttg

SEQ ID NO: 54471 - DNA, 20 bp, Artificial Sequence
  Description of Artificial Sequence: Synthetic oligonucleotide
  Target: ATXN1; (-) strand; PAM type: NRG; PAM sequence: GGG
aaggggaacatcacactctg

SEQ ID NO: 54472 - DNA, 20 bp, Artificial Sequence
  Description of Artificial Sequence: Synthetic oligonucleotide
  Target: ATXN1; (-) strand; PAM type: NRG; PAM sequence: GGG
gaaggggaacatcacactct

SEQ ID NO: 54473 - DNA, 20 bp, Artificial Sequence
  Description of Artificial Sequence: Synthetic oligonucleotide
  Target: ATXN1; (-) strand; PAM type: NRG; PAM sequence: TGG
ggaaggggaacatcacactc

SEQ ID NO: 54474 - DNA, 20 bp, Artificial Sequence
  Description of Artificial Sequence: Synthetic oligonucleotide
  Target: ATXN1; (-) strand; PAM type: NRG; PAM sequence: GGG
gaacacatggacacaggaag

SEQ ID NO: 54475 - DNA, 20 bp, Artificial Sequence
  Description of Artificial Sequence: Synthetic oligonucleotide
  Target: ATXN1; (-) strand; PAM type: NRG; PAM sequence: GGG
agaacacatggacacaggaa

SEQ ID NO: 54476 - DNA, 20 bp, Artificial Sequence
  Description of Artificial Sequence: Synthetic oligonucleotide
  Target: ATXN1; (-) strand; PAM type: NRG; PAM sequence: AGG
gagaacacatggacacagga

SEQ ID NO: 54477 - DNA, 20 bp, Artificial Sequence
  Description of Artificial Sequence: Synthetic oligonucleotide
  Target: ATXN1; (-) strand; PAM type: NRG; PAM sequence: AAG
tgagaacacatggacacagg

SEQ ID NO: 54478 - DNA, 20 bp, Artificial Sequence
  Description of Artificial Sequence: Synthetic oligonucleotide
  Target: ATXN1; (-) strand; PAM type: NRG; PAM sequence: AGG
caatgagaacacatggacac

SEQ ID NO: 54479 - DNA, 20 bp, Artificial Sequence
  Description of Artificial Sequence: Synthetic oligonucleotide
  Target: ATXN1; (-) strand; PAM type: NRG; PAM sequence: CAG
acaatgagaacacatggaca

SEQ ID NO: 54480 - DNA, 20 bp, Artificial Sequence
  Description of Artificial Sequence: Synthetic oligonucleotide
  Target: ATXN1; (-) strand; PAM type: NRG; PAM sequence: TGG
aattgaacaatgagaacaca

SEQ ID NO: 54481 - DNA, 20 bp, Artificial Sequence
  Description of Artificial Sequence: Synthetic oligonucleotide
  Target: ATXN1; (-) strand; PAM type: NRG; PAM sequence: GAG
tgcggtgggaattgaacaat

SEQ ID NO: 54482 - DNA, 20 bp, Artificial Sequence
  Description of Artificial Sequence: Synthetic oligonucleotide
  Target: ATXN1; (-) strand; PAM type: NRG; PAM sequence: GGG
agcgttaggagtattgcggt

SEQ ID NO: 54483 - DNA, 20 bp, Artificial Sequence
  Description of Artificial Sequence: Synthetic oligonucleotide
  Target: ATXN1; (-) strand; PAM type: NRG; PAM sequence: TGG
tagcgttaggagtattgcgg

SEQ ID NO: 54484 - DNA, 20 bp, Artificial Sequence
  Description of Artificial Sequence: Synthetic oligonucleotide
  Target: ATXN1; (-) strand; PAM type: NRG; PAM sequence: CGG
tattagcgttaggagtattg

SEQ ID NO: 54485 - DNA, 20 bp, Artificial Sequence
  Description of Artificial Sequence: Synthetic oligonucleotide
  Target: ATXN1; (-) strand; PAM type: NRG; PAM sequence: GAG
cctacaattattagcgttag

SEQ ID NO: 54486 - DNA, 20 bp, Artificial Sequence
  Description of Artificial Sequence: Synthetic oligonucleotide
  Target: ATXN1; (-) strand; PAM type: NRG; PAM sequence: AGG
cacctacaattattagcgtt

SEQ ID NO: 54487 - DNA, 20 bp, Artificial Sequence
  Description of Artificial Sequence: Synthetic oligonucleotide
  Target: ATXN1; (-) strand; PAM type: NRG; PAM sequence: TAG
acacctacaattattagcgt

SEQ ID NO: 54488 - DNA, 20 bp, Artificial Sequence
  Description of Artificial Sequence: Synthetic oligonucleotide
  Target: ATXN1; (-) strand; PAM type: NRG; PAM sequence: TAG
ccattaacacctacaattat

SEQ ID NO: 54489 - DNA, 20 bp, Artificial Sequence
  Description of Artificial Sequence: Synthetic oligonucleotide
  Target: ATXN1; (-) strand; PAM type: NRG; PAM sequence: TAG
cttgaaagctaaggaacaaa

SEQ ID NO: 54490 - DNA, 20 bp, Artificial Sequence
  Description of Artificial Sequence: Synthetic oligonucleotide
  Target: ATXN1; (-) strand; PAM type: NRG; PAM sequence: AGG
aagcgaatgcttgaaagcta

SEQ ID NO: 54491 - DNA, 20 bp, Artificial Sequence
  Description of Artificial Sequence: Synthetic oligonucleotide
  Target: ATXN1; (-) strand; PAM type: NRG; PAM sequence: AAG
caagcgaatgcttgaaagct

SEQ ID NO: 54492 - DNA, 20 bp, Artificial Sequence
  Description of Artificial Sequence: Synthetic oligonucleotide
  Target: ATXN1; (-) strand; PAM type: NRG; PAM sequence: AAG
gacatcaagcgaatgcttga

SEQ ID NO: 54493 - DNA, 20 bp, Artificial Sequence
  Description of Artificial Sequence: Synthetic oligonucleotide
  Target: ATXN1; (-) strand; PAM type: NRG; PAM sequence: AAG
aaatttcagaccatgacatc

SEQ ID NO: 54494 - DNA, 20 bp, Artificial Sequence
  Description of Artificial Sequence: Synthetic oligonucleotide
  Target: ATXN1; (-) strand; PAM type: NRG; PAM sequence: CAG
ggaacaccttggccaaattt

SEQ ID NO: 54495 - DNA, 20 bp, Artificial Sequence
  Description of Artificial Sequence: Synthetic oligonucleotide
  Target: ATXN1; (-) strand; PAM type: NRG; PAM sequence: TGG
gcctgaaaataggaacacct

SEQ ID NO: 54496 - DNA, 20 bp, Artificial Sequence
  Description of Artificial Sequence: Synthetic oligonucleotide
  Target: ATXN1; (-) strand; PAM type: NRG; PAM sequence: AGG
gcatatcgaggcctgaaaat

SEQ ID NO: 54497 - DNA, 20 bp, Artificial Sequence
  Description of Artificial Sequence: Synthetic oligonucleotide
  Target: ATXN1; (-) strand; PAM type: NRG; PAM sequence: TAG
ggcatatcgaggcctgaaaa

SEQ ID NO: 54498 - DNA, 20 bp, Artificial Sequence
  Description of Artificial Sequence: Synthetic oligonucleotide
  Target: ATXN1; (-) strand; PAM type: NRG; PAM sequence: AGG
aagcatctgtgggcatatcg

SEQ ID NO: 54499 - DNA, 20 bp, Artificial Sequence
  Description of Artificial Sequence: Synthetic oligonucleotide
  Target: ATXN1; (-) strand; PAM type: NRG; PAM sequence: GAG
gaagcatctgtgggcatatc

SEQ ID NO: 54500 - DNA, 20 bp, Artificial Sequence
  Description of Artificial Sequence: Synthetic oligonucleotide
  Target: ATXN1; (-) strand; PAM type: NRG; PAM sequence: GGG
ataaccagggaagcatctgt

SEQ ID NO: 54501 - DNA, 20 bp, Artificial Sequence
  Description of Artificial Sequence: Synthetic oligonucleotide
  Target: ATXN1; (-) strand; PAM type: NRG; PAM sequence: TGG
gataaccagggaagcatctg

SEQ ID NO: 54502 - DNA, 20 bp, Artificial Sequence
  Description of Artificial Sequence: Synthetic oligonucleotide
  Target: ATXN1; (-) strand; PAM type: NRG; PAM sequence: AAG
tcaatgaaggataaccaggg

SEQ ID NO: 54503 - DNA, 20 bp, Artificial Sequence
  Description of Artificial Sequence: Synthetic oligonucleotide
  Target: ATXN1; (-) strand; PAM type: NRG; PAM sequence: GGG
ggttcaatgaaggataacca

SEQ ID NO: 54504 - DNA, 20 bp, Artificial Sequence
  Description of Artificial Sequence: Synthetic oligonucleotide
  Target: ATXN1; (-) strand; PAM type: NRG; PAM sequence: AGG
tggttcaatgaaggataacc

SEQ ID NO: 54505 - DNA, 20 bp, Artificial Sequence
  Description of Artificial Sequence: Synthetic oligonucleotide
  Target: ATXN1; (-) strand; PAM type: NRG; PAM sequence: CAG
ttggttcaatgaaggataac

SEQ ID NO: 54506 - DNA, 20 bp, Artificial Sequence
  Description of Artificial Sequence: Synthetic oligonucleotide
  Target: ATXN1; (-) strand; PAM type: NRG; PAM sequence: AGG
tggaggagttggttcaatga

SEQ ID NO: 54507 - DNA, 20 bp, Artificial Sequence
  Description of Artificial Sequence: Synthetic oligonucleotide
  Target: ATXN1; (-) strand; PAM type: NRG; PAM sequence: AAG
gtggaggagttggttcaatg

SEQ ID NO: 54508 - DNA, 20 bp, Artificial Sequence
  Description of Artificial Sequence: Synthetic oligonucleotide
  Target: ATXN1; (-) strand; PAM type: NRG; PAM sequence: TGG
cagctagtaagtggaggagt

SEQ ID NO: 54509 - DNA, 20 bp, Artificial Sequence
  Description of Artificial Sequence: Synthetic oligonucleotide
  Target: ATXN1; (-) strand; PAM type: NRG; PAM sequence: GAG
cacacagctagtaagtggag

SEQ ID NO: 54510 - DNA, 20 bp, Artificial Sequence
  Description of Artificial Sequence: Synthetic oligonucleotide
  Target: ATXN1; (-) strand; PAM type: NRG; PAM sequence: AGG
gtcacacagctagtaagtgg

SEQ ID NO: 54511 - DNA, 20 bp, Artificial Sequence
  Description of Artificial Sequence: Synthetic oligonucleotide
  Target: ATXN1; (-) strand; PAM type: NRG; PAM sequence: GAG
agtcacacagctagtaagtg

SEQ ID NO: 54512 - DNA, 20 bp, Artificial Sequence
  Description of Artificial Sequence: Synthetic oligonucleotide
  Target: ATXN1; (-) strand; PAM type: NRG; PAM sequence: TGG
aaagtcacacagctagtaag

SEQ ID NO: 54513 - DNA, 20 bp, Artificial Sequence
  Description of Artificial Sequence: Synthetic oligonucleotide
  Target: ATXN1; (-) strand; PAM type: NRG; PAM sequence: AAG
tacaaagtcacacagctagt

SEQ ID NO: 54514 - DNA, 20 bp, Artificial Sequence
  Description of Artificial Sequence: Synthetic oligonucleotide
  Target: ATXN1; (-) strand; PAM type: NRG; PAM sequence: TAG
cttgtacaaagtcacacagc

SEQ ID NO: 54515 - DNA, 20 bp, Artificial Sequence
  Description of Artificial Sequence: Synthetic oligonucleotide
  Target: ATXN1; (-) strand; PAM type: NRG; PAM sequence: CAG
cttacttgtacaaagtcaca

SEQ ID NO: 54516 - DNA, 20 bp, Artificial Sequence
  Description of Artificial Sequence: Synthetic oligonucleotide
  Target: ATXN1; (-) strand; PAM type: NRG; PAM sequence: AAG
gtggttaccttacttgtaca

SEQ ID NO: 54517 - DNA, 20 bp, Artificial Sequence
  Description of Artificial Sequence: Synthetic oligonucleotide
  Target: ATXN1; (-) strand; PAM type: NRG; PAM sequence: TGG
aaattggggcttagggtggg

SEQ ID NO: 54518 - DNA, 20 bp, Artificial Sequence
  Description of Artificial Sequence: Synthetic oligonucleotide
  Target: ATXN1; (-) strand; PAM type: NRG; PAM sequence: GGG
aggaaattggggcttagggt

SEQ ID NO: 54519 - DNA, 20 bp, Artificial Sequence
  Description of Artificial Sequence: Synthetic oligonucleotide
  Target: ATXN1; (-) strand; PAM type: NRG; PAM sequence: TGG
aaggaaattggggcttaggg

SEQ ID NO: 54520 - DNA, 20 bp, Artificial Sequence
  Description of Artificial Sequence: Synthetic oligonucleotide
  Target: ATXN1; (-) strand; PAM type: NRG; PAM sequence: GGG
gaaaaggaaattggggctta

SEQ ID NO: 54521 - DNA, 20 bp, Artificial Sequence
  Description of Artificial Sequence: Synthetic oligonucleotide
  Target: ATXN1; (-) strand; PAM type: NRG; PAM sequence: AGG
agaaaaggaaattggggctt

SEQ ID NO: 54522 - DNA, 20 bp, Artificial Sequence
  Description of Artificial Sequence: Synthetic oligonucleotide
  Target: ATXN1; (-) strand; PAM type: NRG; PAM sequence: TAG
cagaaaaggaaattggggct

SEQ ID NO: 54523 - DNA, 20 bp, Artificial Sequence
  Description of Artificial Sequence: Synthetic oligonucleotide
  Target: ATXN1; (-) strand; PAM type: NRG; PAM sequence: GGG
ttcaacagaaaaggaaattg

SEQ ID NO: 54524 - DNA, 20 bp, Artificial Sequence
  Description of Artificial Sequence: Synthetic oligonucleotide
  Target: ATXN1; (-) strand; PAM type: NRG; PAM sequence: GGG
attcaacagaaaaggaaatt

SEQ ID NO: 54525 - DNA, 20 bp, Artificial Sequence
  Description of Artificial Sequence: Synthetic oligonucleotide
  Target: ATXN1; (-) strand; PAM type: NRG; PAM sequence: TGG
tattcaacagaaaaggaaat

SEQ ID NO: 54526 - DNA, 20 bp, Artificial Sequence
  Description of Artificial Sequence: Synthetic oligonucleotide
  Target: ATXN1; (-) strand; PAM type: NRG; PAM sequence: AGG
ttacccttattcaacagaaa

SEQ ID NO: 54527 - DNA, 20 bp, Artificial Sequence
  Description of Artificial Sequence: Synthetic oligonucleotide
  Target: ATXN1; (-) strand; PAM type: NRG; PAM sequence: AAG
attacccttattcaacagaa

SEQ ID NO: 54528 - DNA, 20 bp, Artificial Sequence
  Description of Artificial Sequence: Synthetic oligonucleotide
  Target: ATXN1; (-) strand; PAM type: NRG; PAM sequence: CAG
ccatcattacccttattcaa

SEQ ID NO: 54529 - DNA, 20 bp, Artificial Sequence
  Description of Artificial Sequence: Synthetic oligonucleotide
  Target: ATXN1; (-) strand; PAM type: NRG; PAM sequence: AAG
aaaaagctcatgacagttgt

SEQ ID NO: 54530 - DNA, 20 bp, Artificial Sequence
  Description of Artificial Sequence: Synthetic oligonucleotide
  Target: ATXN1; (-) strand; PAM type: NRG; PAM sequence: CAG
acaatacaaaaagctcatga

SEQ ID NO: 54531 - DNA, 20 bp, Artificial Sequence
  Description of Artificial Sequence: Synthetic oligonucleotide
  Target: ATXN1; (-) strand; PAM type: NRG; PAM sequence: AAG
aaagaagaaaacaatacaaa

SEQ ID NO: 54532 - DNA, 20 bp, Artificial Sequence
  Description of Artificial Sequence: Synthetic oligonucleotide
  Target: ATXN1; (-) strand; PAM type: NRG; PAM sequence: AAG
agcaagaacccatctcaaag

SEQ ID NO: 54533 - DNA, 20 bp, Artificial Sequence
  Description of Artificial Sequence: Synthetic oligonucleotide
  Target: ATXN1; (-) strand; PAM type: NRG; PAM sequence: AAG
catagcaagaacccatctca

SEQ ID NO: 54534 - DNA, 20 bp, Artificial Sequence
  Description of Artificial Sequence: Synthetic oligonucleotide
  Target: ATXN1; (-) strand; PAM type: NRG; PAM sequence: AAG
cctagcctaggcaacatagc

SEQ ID NO: 54535 - DNA, 20 bp, Artificial Sequence
  Description of Artificial Sequence: Synthetic oligonucleotide
  Target: ATXN1; (-) strand; PAM type: NRG; PAM sequence: TAG
tgagcctagcctaggcaaca

SEQ ID NO: 54536 - DNA, 20 bp, Artificial Sequence
  Description of Artificial Sequence: Synthetic oligonucleotide
  Target: ATXN1; (-) strand; PAM type: NRG; PAM sequence: AGG
ccagagtttgagcctagcct

SEQ ID NO: 54537 - DNA, 20 bp, Artificial Sequence
  Description of Artificial Sequence: Synthetic oligonucleotide
  Target: ATXN1; (-) strand; PAM type: NRG; PAM sequence: TAG
cccagagtttgagcctagcc

SEQ ID NO: 54538 - DNA, 20 bp, Artificial Sequence
  Description of Artificial Sequence: Synthetic oligonucleotide
  Target: ATXN1; (-) strand; PAM type: NRG; PAM sequence: TAG
tgagccccagagtttgagcc

SEQ ID NO: 54539 - DNA, 20 bp, Artificial Sequence
  Description of Artificial Sequence: Synthetic oligonucleotide
  Target: ATXN1; (-) strand; PAM type: NRG; PAM sequence: GAG
tcacttgagccccagagttt

SEQ ID NO: 54540 - DNA, 20 bp, Artificial Sequence
  Description of Artificial Sequence: Synthetic oligonucleotide
  Target: ATXN1; (-) strand; PAM type: NRG; PAM sequence: GAG
ggaggatcacttgagcccca

SEQ ID NO: 54541 - DNA, 20 bp, Artificial Sequence
  Description of Artificial Sequence: Synthetic oligonucleotide
  Target: ATXN1; (-) strand; PAM type: NRG; PAM sequence: CAG
caggaggatcacttgagccc

SEQ ID NO: 54542 - DNA, 20 bp, Artificial Sequence
  Description of Artificial Sequence: Synthetic oligonucleotide
  Target: ATXN1; (-) strand; PAM type: NRG; PAM sequence: GAG
ctgaggcaggaggatcactt

SEQ ID NO: 54543 - DNA, 20 bp, Artificial Sequence
  Description of Artificial Sequence: Synthetic oligonucleotide
  Target: ATXN1; (-) strand; PAM type: NRG; PAM sequence: AGG
acttgggtggctgaggcagg

SEQ ID NO: 54544 - DNA, 20 bp, Artificial Sequence
  Description of Artificial Sequence: Synthetic oligonucleotide
  Target: ATXN1; (-) strand; PAM type: NRG; PAM sequence: GAG
tacttgggtggctgaggcag

SEQ ID NO: 54545 - DNA, 20 bp, Artificial Sequence
  Description of Artificial Sequence: Synthetic oligonucleotide
  Target: ATXN1; (-) strand; PAM type: NRG; PAM sequence: AGG
gctacttgggtggctgaggc

SEQ ID NO: 54546 - DNA, 20 bp, Artificial Sequence
  Description of Artificial Sequence: Synthetic oligonucleotide
  Target: ATXN1; (-) strand; PAM type: NRG; PAM sequence: CAG
agctacttgggtggctgagg

SEQ ID NO: 54547 - DNA, 20 bp, Artificial Sequence
  Description of Artificial Sequence: Synthetic oligonucleotide
  Target: ATXN1; (-) strand; PAM type: NRG; PAM sequence: AGG
cccagctacttgggtggctg

SEQ ID NO: 54548 - DNA, 20 bp, Artificial Sequence
  Description of Artificial Sequence: Synthetic oligonucleotide
  Target: ATXN1; (-) strand; PAM type: NRG; PAM sequence: GAG
tcccagctacttgggtggct

SEQ ID NO: 54549 - DNA, 20 bp, Artificial Sequence
  Description of Artificial Sequence: Synthetic oligonucleotide
  Target: ATXN1; (-) strand; PAM type: NRG; PAM sequence: TGG
tgtactcccagctacttggg

SEQ ID NO: 54550 - DNA, 20 bp, Artificial Sequence
  Description of Artificial Sequence: Synthetic oligonucleotide
  Target: ATXN1; (-) strand; PAM type: NRG; PAM sequence: GGG
acctgtactcccagctactt

SEQ ID NO: 54551 - DNA, 20 bp, Artificial Sequence
  Description of Artificial Sequence: Synthetic oligonucleotide
  Target: ATXN1; (-) strand; PAM type: NRG; PAM sequence: TGG
cacctgtactcccagctact

SEQ ID NO: 54552 - DNA, 20 bp, Artificial Sequence
  Description of Artificial Sequence: Synthetic oligonucleotide
  Target: ATXN1; (-) strand; PAM type: NRG; PAM sequence: CAG
gtgtcatgcacctgtactcc

SEQ ID NO: 54553 - DNA, 20 bp, Artificial Sequence
  Description of Artificial Sequence: Synthetic oligonucleotide
  Target: ATXN1; (-) strand; PAM type: NRG; PAM sequence: CAG
agctcatgggaagccatgtg

SEQ ID NO: 54554 - DNA, 20 bp, Artificial Sequence
  Description of Artificial Sequence: Synthetic oligonucleotide
  Target: ATXN1; (-) strand; PAM type: NRG; PAM sequence: AAG
gttcatcaaaagctcatggg

SEQ ID NO: 54555 - DNA, 20 bp, Artificial Sequence
  Description of Artificial Sequence: Synthetic oligonucleotide
  Target: ATXN1; (-) strand; PAM type: NRG; PAM sequence: GGG
gcagttcatcaaaagctcat

SEQ ID NO: 54556 - DNA, 20 bp, Artificial Sequence
  Description of Artificial Sequence: Synthetic oligonucleotide
  Target: ATXN1; (-) strand; PAM type: NRG; PAM sequence: TGG
agcagttcatcaaaagctca

SEQ ID NO: 54557 - DNA, 20 bp, Artificial Sequence
  Description of Artificial Sequence: Synthetic oligonucleotide
  Target: ATXN1; (-) strand; PAM type: NRG; PAM sequence: AAG
tacatgcagcagttcatcaa

SEQ ID NO: 54558 - DNA, 20 bp, Artificial Sequence
  Description of Artificial Sequence: Synthetic oligonucleotide
  Target: ATXN1; (-) strand; PAM type: NRG; PAM sequence: CAG
gctaaaatatttacatgcag

SEQ ID NO: 54559 - DNA, 20 bp, Artificial Sequence
  Description of Artificial Sequence: Synthetic oligonucleotide
  Target: ATXN1; (-) strand; PAM type: NRG; PAM sequence: CAG
tgtgctaaaatatttacatg

SEQ ID NO: 54560 - DNA, 20 bp, Artificial Sequence
  Description of Artificial Sequence: Synthetic oligonucleotide
  Target: ATXN1; (-) strand; PAM type: NRG; PAM sequence: AAG
ttgaacatgtattatgtgcc

SEQ ID NO: 54561 - DNA, 20 bp, Artificial Sequence
  Description of Artificial Sequence: Synthetic oligonucleotide
  Target: ATXN1; (-) strand; PAM type: NRG; PAM sequence: TAG
aattataataatgattggaa

SEQ ID NO: 54562 - DNA, 20 bp, Artificial Sequence
  Description of Artificial Sequence: Synthetic oligonucleotide
  Target: ATXN1; (-) strand; PAM type: NRG; PAM sequence: TGG
ctattaattataataatgat

SEQ ID NO: 54563 - DNA, 20 bp, Artificial Sequence
  Description of Artificial Sequence: Synthetic oligonucleotide
  Target: ATXN1; (-) strand; PAM type: NRG; PAM sequence: TGG
aactatcataagaataggat

SEQ ID NO: 54564 - DNA, 20 bp, Artificial Sequence
  Description of Artificial Sequence: Synthetic oligonucleotide
  Target: ATXN1; (-) strand; PAM type: NRG; PAM sequence: AGG
gatagaactatcataagaat

SEQ ID NO: 54565 - DNA, 20 bp, Artificial Sequence
  Description of Artificial Sequence: Synthetic oligonucleotide
  Target: ATXN1; (-) strand; PAM type: NRG; PAM sequence: TAG
tgatagaactatcataagaa

SEQ ID NO: 54566 - DNA, 20 bp, Artificial Sequence
  Description of Artificial Sequence: Synthetic oligonucleotide
  Target: ATXN1; (-) strand; PAM type: NRG; PAM sequence: AAG
gacagtgatagaactatcat

SEQ ID NO: 54567 - DNA, 20 bp, Artificial Sequence
  Description of Artificial Sequence: Synthetic oligonucleotide
  Target: ATXN1; (-) strand; PAM type: NRG; PAM sequence: TAG
ggcaaatgagtagacagtga

SEQ ID NO: 54568 - DNA, 20 bp, Artificial Sequence
  Description of Artificial Sequence: Synthetic oligonucleotide
  Target: ATXN1; (-) strand; PAM type: NRG; PAM sequence: CAG
ttaccaggcaaatgagtaga

SEQ ID NO: 54569 - DNA, 20 bp, Artificial Sequence
  Description of Artificial Sequence: Synthetic oligonucleotide
  Target: ATXN1; (-) strand; PAM type: NRG; PAM sequence: TAG
atgattaccaggcaaatgag

SEQ ID NO: 54570 - DNA, 20 bp, Artificial Sequence
  Description of Artificial Sequence: Synthetic oligonucleotide
  Target: ATXN1; (-) strand; PAM type: NRG; PAM sequence: GAG
tatatgattaccaggcaaat

SEQ ID NO: 54571 - DNA, 20 bp, Artificial Sequence
  Description of Artificial Sequence: Synthetic oligonucleotide
  Target: ATXN1; (-) strand; PAM type: NRG; PAM sequence: AGG
acaaagagtatatgattacc

SEQ ID NO: 54572 - DNA, 20 bp, Artificial Sequence
  Description of Artificial Sequence: Synthetic oligonucleotide
  Target: ATXN1; (-) strand; PAM type: NRG; PAM sequence: CAG
tacaaagagtatatgattac

SEQ ID NO: 54573 - DNA, 20 bp, Artificial Sequence
  Description of Artificial Sequence: Synthetic oligonucleotide
  Target: ATXN1; (-) strand; PAM type: NRG; PAM sequence: GAG
atatatttataaaatacaaa

SEQ ID NO: 54574 - DNA, 20 bp, Artificial Sequence
  Description of Artificial Sequence: Synthetic oligonucleotide
  Target: ATXN1; (-) strand; PAM type: NRG; PAM sequence: AAG
gtatatatttataaaataca

SEQ ID NO: 54575 - DNA, 20 bp, Artificial Sequence
  Description of Artificial Sequence: Synthetic oligonucleotide
  Target: ATXN1; (-) strand; PAM type: NRG; PAM sequence: GGG
tcacaagaaaacagccattt

SEQ ID NO: 54576 - DNA, 20 bp, Artificial Sequence
  Description of Artificial Sequence: Synthetic oligonucleotide
  Target: ATXN1; (-) strand; PAM type: NRG; PAM sequence: TGG
atcacaagaaaacagccatt

SEQ ID NO: 54577 - DNA, 20 bp, Artificial Sequence
  Description of Artificial Sequence: Synthetic oligonucleotide
  Target: ATXN1; (-) strand; PAM type: NRG; PAM sequence: CAG
atggttgtatcacaagaaaa

SEQ ID NO: 54578 - DNA, 20 bp, Artificial Sequence
  Description of Artificial Sequence: Synthetic oligonucleotide
  Target: ATXN1; (-) strand; PAM type: NRG; PAM sequence: AAG
gtactccatggttgtatcac

SEQ ID NO: 54579 - DNA, 20 bp, Artificial Sequence
  Description of Artificial Sequence: Synthetic oligonucleotide
  Target: ATXN1; (-) strand; PAM type: NRG; PAM sequence: TGG
ccaccctggaaagtactcca

SEQ ID NO: 54580 - DNA, 20 bp, Artificial Sequence
  Description of Artificial Sequence: Synthetic oligonucleotide
  Target: ATXN1; (-) strand; PAM type: NRG; PAM sequence: AAG
actgccatacccaccctgga

SEQ ID NO: 54581 - DNA, 20 bp, Artificial Sequence
  Description of Artificial Sequence: Synthetic oligonucleotide
  Target: ATXN1; (-) strand; PAM type: NRG; PAM sequence: TGG
gcacactgccatacccaccc

SEQ ID NO: 54582 - DNA, 20 bp, Artificial Sequence
  Description of Artificial Sequence: Synthetic oligonucleotide
  Target: ATXN1; (-) strand; PAM type: NRG; PAM sequence: AGG
aaatagcactgcccagggcc

SEQ ID NO: 54583 - DNA, 20 bp, Artificial Sequence
  Description of Artificial Sequence: Synthetic oligonucleotide
  Target: ATXN1; (-) strand; PAM type: NRG; PAM sequence: CAG
aaaatagcactgcccagggc

SEQ ID NO: 54584 - DNA, 20 bp, Artificial Sequence
  Description of Artificial Sequence: Synthetic oligonucleotide
  Target: ATXN1; (-) strand; PAM type: NRG; PAM sequence: GGG
tctgaaaatagcactgccca

SEQ ID NO: 54585 - DNA, 20 bp, Artificial Sequence
  Description of Artificial Sequence: Synthetic oligonucleotide
  Target: ATXN1; (-) strand; PAM type: NRG; PAM sequence: AGG
ctctgaaaatagcactgccc

SEQ ID NO: 54586 - DNA, 20 bp, Artificial Sequence
  Description of Artificial Sequence: Synthetic oligonucleotide
  Target: ATXN1; (-) strand; PAM type: NRG; PAM sequence: CAG
actctgaaaatagcactgcc

SEQ ID NO: 54587 - DNA, 20 bp, Artificial Sequence
  Description of Artificial Sequence: Synthetic oligonucleotide
  Target: ATXN1; (-) strand; PAM type: NRG; PAM sequence: TAG
gccctcacacactctgaaaa

SEQ ID NO: 54588 - DNA, 20 bp, Artificial Sequence
  Description of Artificial Sequence: Synthetic oligonucleotide
  Target: ATXN1; (-) strand; PAM type: NRG; PAM sequence: TGG
atatgggatgtggtgcagcc

SEQ ID NO: 54589 - DNA, 20 bp, Artificial Sequence
  Description of Artificial Sequence: Synthetic oligonucleotide
  Target: ATXN1; (-) strand; PAM type: NRG; PAM sequence: CAG
gggaaatatgggatgtggtg

SEQ ID NO: 54590 - DNA, 20 bp, Artificial Sequence
  Description of Artificial Sequence: Synthetic oligonucleotide
  Target: ATXN1; (-) strand; PAM type: NRG; PAM sequence: TGG
tcaaagggaaatatgggatg

SEQ ID NO: 54591 - DNA, 20 bp, Artificial Sequence
  Description of Artificial Sequence: Synthetic oligonucleotide
  Target: ATXN1; (-) strand; PAM type: NRG; PAM sequence: GGG
atttcttcaaagggaaatat

SEQ ID NO: 54592 - DNA, 20 bp, Artificial Sequence
  Description of Artificial Sequence: Synthetic oligonucleotide
  Target: ATXN1; (-) strand; PAM type: NRG; PAM sequence: TGG
gatttcttcaaagggaaata

SEQ ID NO: 54593 - DNA, 20 bp, Artificial Sequence
  Description of Artificial Sequence: Synthetic oligonucleotide
  Target: ATXN1; (-) strand; PAM type: NRG; PAM sequence: GGG
cgttggctgatttcttcaaa

SEQ ID NO: 54594 - DNA, 20 bp, Artificial Sequence
  Description of Artificial Sequence: Synthetic oligonucleotide
  Target: ATXN1; (-) strand; PAM type: NRG; PAM sequence: AGG
acgttggctgatttcttcaa

SEQ ID NO: 54595 - DNA, 20 bp, Artificial Sequence
  Description of Artificial Sequence: Synthetic oligonucleotide
  Target: ATXN1; (-) strand; PAM type: NRG; PAM sequence: AAG
tacgttggctgatttcttca

SEQ ID NO: 54596 - DNA, 20 bp, Artificial Sequence
  Description of Artificial Sequence: Synthetic oligonucleotide
  Target: ATXN1; (-) strand; PAM type: NRG; PAM sequence: TGG
ggcacctttgcttgttacgt

SEQ ID NO: 54597 - DNA, 20 bp, Artificial Sequence
  Description of Artificial Sequence: Synthetic oligonucleotide
  Target: ATXN1; (-) strand; PAM type: NRG; PAM sequence: TGG
tggtaccctcaaggcctccc

SEQ ID NO: 54598 - DNA, 20 bp, Artificial Sequence
  Description of Artificial Sequence: Synthetic oligonucleotide
  Target: ATXN1; (-) strand; PAM type: NRG; PAM sequence: AGG
cctgtacactggtaccctca

SEQ ID NO: 54599 - DNA, 20 bp, Artificial Sequence
  Description of Artificial Sequence: Synthetic oligonucleotide
  Target: ATXN1; (-) strand; PAM type: NRG; PAM sequence: AAG
ccctgtacactggtaccctc

SEQ ID NO: 54600 - DNA, 20 bp, Artificial Sequence
  Description of Artificial Sequence: Synthetic oligonucleotide
  Target: ATXN1; (-) strand; PAM type: NRG; PAM sequence: TGG
tagcagtgtcccctgtacac

SEQ ID NO: 54601 - DNA, 20 bp, Artificial Sequence
  Description of Artificial Sequence: Synthetic oligonucleotide
  Target: ATXN1; (-) strand; PAM type: NRG; PAM sequence: CAG
cactcagcatgcacatgtag

SEQ ID NO: 54602 - DNA, 20 bp, Artificial Sequence
  Description of Artificial Sequence: Synthetic oligonucleotide
  Target: ATXN1; (-) strand; PAM type: NRG; PAM sequence: TAG
agccactcagcatgcacatg

SEQ ID NO: 54603 - DNA, 20 bp, Artificial Sequence
  Description of Artificial Sequence: Synthetic oligonucleotide
  Target: ATXN1; (-) strand; PAM type: NRG; PAM sequence: CAG
ggcagacccgggcagccact

SEQ ID NO: 54604 - DNA, 20 bp, Artificial Sequence
  Description of Artificial Sequence: Synthetic oligonucleotide
  Target: ATXN1; (-) strand; PAM type: NRG; PAM sequence: CAG
tacacaaaggcagacccggg

SEQ ID NO: 54605 - DNA, 20 bp, Artificial Sequence
  Description of Artificial Sequence: Synthetic oligonucleotide
  Target: ATXN1; (-) strand; PAM type: NRG; PAM sequence: GGG
tagtacacaaaggcagaccc

SEQ ID NO: 54606 - DNA, 20 bp, Artificial Sequence
  Description of Artificial Sequence: Synthetic oligonucleotide
  Target: ATXN1; (-) strand; PAM type: NRG; PAM sequence: CGG
ctagtacacaaaggcagacc

SEQ ID NO: 54607 - DNA, 20 bp, Artificial Sequence
  Description of Artificial Sequence: Synthetic oligonucleotide
  Target: ATXN1; (-) strand; PAM type: NRG; PAM sequence: CAG
attcccctagtacacaaagg

SEQ ID NO: 54608 - DNA, 20 bp, Artificial Sequence
  Description of Artificial Sequence: Synthetic oligonucleotide
  Target: ATXN1; (-) strand; PAM type: NRG; PAM sequence: AGG
cacattcccctagtacacaa

SEQ ID NO: 54609 - DNA, 20 bp, Artificial Sequence
  Description of Artificial Sequence: Synthetic oligonucleotide
  Target: ATXN1; (-) strand; PAM type: NRG; PAM sequence: AAG
acacattcccctagtacaca

SEQ ID NO: 54610 - DNA, 20 bp, Artificial Sequence
  Description of Artificial Sequence: Synthetic oligonucleotide
  Target: ATXN1; (-) strand; PAM type: NRG; PAM sequence: TAG
agcctcaccacacattcccc

SEQ ID NO: 54611 - DNA, 20 bp, Artificial Sequence
  Description of Artificial Sequence: Synthetic oligonucleotide
  Target: ATXN1; (-) strand; PAM type: NRG; PAM sequence: CAG
gtggccagctctgtcccctc

SEQ ID NO: 54612 - DNA, 20 bp, Artificial Sequence
  Description of Artificial Sequence: Synthetic oligonucleotide
  Target: ATXN1; (-) strand; PAM type: NRG; PAM sequence: CAG
gagtccttctcacaggtggc

SEQ ID NO: 54613 - DNA, 20 bp, Artificial Sequence
  Description of Artificial Sequence: Synthetic oligonucleotide
  Target: ATXN1; (-) strand; PAM type: NRG; PAM sequence: TGG
ctgagagtccttctcacagg

SEQ ID NO: 54614 - DNA, 20 bp, Artificial Sequence
  Description of Artificial Sequence: Synthetic oligonucleotide
  Target: ATXN1; (-) strand; PAM type: NRG; PAM sequence: AGG
gccctgagagtccttctcac

SEQ ID NO: 54615 - DNA, 20 bp, Artificial Sequence
  Description of Artificial Sequence: Synthetic oligonucleotide
  Target: ATXN1; (-) strand; PAM type: NRG; PAM sequence: CAG
agccctgagagtccttctca

SEQ ID NO: 54616 - DNA, 20 bp, Artificial Sequence
  Description of Artificial Sequence: Synthetic oligonucleotide
  Target: ATXN1; (-) strand; PAM type: NRG; PAM sequence: GAG
aatgatgacagcagccctga

SEQ ID NO: 54617 - DNA, 20 bp, Artificial Sequence
  Description of Artificial Sequence: Synthetic oligonucleotide
  Target: ATXN1; (-) strand; PAM type: NRG; PAM sequence: GAG
caaatgatgacagcagccct

SEQ ID NO: 54618 - DNA, 20 bp, Artificial Sequence
  Description of Artificial Sequence: Synthetic oligonucleotide
  Target: ATXN1; (-) strand; PAM type: NRG; PAM sequence: CAG
actctgccaaatgatgacag

SEQ ID NO: 54619 - DNA, 20 bp, Artificial Sequence
  Description of Artificial Sequence: Synthetic oligonucleotide
  Target: ATXN1; (-) strand; PAM type: NRG; PAM sequence: CAG
tggactctgccaaatgatga

SEQ ID NO: 54620 - DNA, 20 bp, Artificial Sequence
  Description of Artificial Sequence: Synthetic oligonucleotide
  Target: ATXN1; (-) strand; PAM type: NRG; PAM sequence: TGG
gttgggttggagtagaagga

SEQ ID NO: 54621 - DNA, 20 bp, Artificial Sequence
  Description of Artificial Sequence: Synthetic oligonucleotide
  Target: ATXN1; (-) strand; PAM type: NRG; PAM sequence: AGG
tgaggttgggttggagtaga

SEQ ID NO: 54622 - DNA, 20 bp, Artificial Sequence
  Description of Artificial Sequence: Synthetic oligonucleotide
  Target: ATXN1; (-) strand; PAM type: NRG; PAM sequence: AAG
gtgaggttgggttggagtag

SEQ ID NO: 54623 - DNA, 20 bp, Artificial Sequence
  Description of Artificial Sequence: Synthetic oligonucleotide
  Target: ATXN1; (-) strand; PAM type: NRG; PAM sequence: TAG
agagtgaggttgggttggag

SEQ ID NO: 54624 - DNA, 20 bp, Artificial Sequence
  Description of Artificial Sequence: Synthetic oligonucleotide
  Target: ATXN1; (-) strand; PAM type: NRG; PAM sequence: GAG
ctgagagtgaggttgggttg

SEQ ID NO: 54625 - DNA, 20 bp, Artificial Sequence
  Description of Artificial Sequence: Synthetic oligonucleotide
  Target: ATXN1; (-) strand; PAM type: NRG; PAM sequence: TGG
ccctgagagtgaggttgggt

SEQ ID NO: 54626 - DNA, 20 bp, Artificial Sequence
  Description of Artificial Sequence: Synthetic oligonucleotide
  Target: ATXN1; (-) strand; PAM type: NRG; PAM sequence: GGG
ccctccctgagagtgaggtt

SEQ ID NO: 54627 - DNA, 20 bp, Artificial Sequence
  Description of Artificial Sequence: Synthetic oligonucleotide
  Target: ATXN1; (-) strand; PAM type: NRG; PAM sequence: TGG
cccctccctgagagtgaggt

SEQ ID NO: 54628 - DNA, 20 bp, Artificial Sequence
  Description of Artificial Sequence: Synthetic oligonucleotide
  Target: ATXN1; (-) strand; PAM type: NRG; PAM sequence: AGG
ccgtcccctccctgagagtg

SEQ ID NO: 54629 - DNA, 20 bp, Artificial Sequence
  Description of Artificial Sequence: Synthetic oligonucleotide
  Target: ATXN1; (-) strand; PAM type: NRG; PAM sequence: GAG
tccgtcccctccctgagagt

SEQ ID NO: 54630 - DNA, 20 bp, Artificial Sequence
  Description of Artificial Sequence: Synthetic oligonucleotide
  Target: ATXN1; (-) strand; PAM type: NRG; PAM sequence: GAG
ctcatccgtcccctccctga

SEQ ID NO: 54631 - DNA, 20 bp, Artificial Sequence
  Description of Artificial Sequence: Synthetic oligonucleotide
  Target: ATXN1; (-) strand; PAM type: NRG; PAM sequence: GAG
tcctcatccgtcccctccct

SEQ ID NO: 54632 - DNA, 20 bp, Artificial Sequence
  Description of Artificial Sequence: Synthetic oligonucleotide
  Target: ATXN1; (-) strand; PAM type: NRG; PAM sequence: CGG
cctgtagatgataggatgag

SEQ ID NO: 54633 - DNA, 20 bp, Artificial Sequence
  Description of Artificial Sequence: Synthetic oligonucleotide
  Target: ATXN1; (-) strand; PAM type: NRG; PAM sequence: GAG
aaccctgtagatgataggat

SEQ ID NO: 54634 - DNA, 20 bp, Artificial Sequence
  Description of Artificial Sequence: Synthetic oligonucleotide
  Target: ATXN1; (-) strand; PAM type: NRG; PAM sequence: AGG
ttaaaaaccctgtagatgat

SEQ ID NO: 54635 - DNA, 20 bp, Artificial Sequence
  Description of Artificial Sequence: Synthetic oligonucleotide
  Target: ATXN1; (-) strand; PAM type: NRG; PAM sequence: TAG
tttaaaaaccctgtagatga

SEQ ID NO: 54636 - DNA, 20 bp, Artificial Sequence
  Description of Artificial Sequence: Synthetic oligonucleotide
  Target: ATXN1; (-) strand; PAM type: NRG; PAM sequence: TAG
cccacactttaaaaaccctg

SEQ ID NO: 54637 - DNA, 20 bp, Artificial Sequence
  Description of Artificial Sequence: Synthetic oligonucleotide
  Target: ATXN1; (-) strand; PAM type: NRG; PAM sequence: AGG
gccacccaggccagagaatg

SEQ ID NO: 54638 - DNA, 20 bp, Artificial Sequence
  Description of Artificial Sequence: Synthetic oligonucleotide
  Target: ATXN1; (-) strand; PAM type: NRG; PAM sequence: GAG
ggccacccaggccagagaat

SEQ ID NO: 54639 - DNA, 20 bp, Artificial Sequence
  Description of Artificial Sequence: Synthetic oligonucleotide
  Target: ATXN1; (-) strand; PAM type: NRG; PAM sequence: GAG
gatcatggccacccaggcca

SEQ ID NO: 54640 - DNA, 20 bp, Artificial Sequence
  Description of Artificial Sequence: Synthetic oligonucleotide
  Target: ATXN1; (-) strand; PAM type: NRG; PAM sequence: CAG
cggatcatggccacccaggc

SEQ ID NO: 54641 - DNA, 20 bp, Artificial Sequence
  Description of Artificial Sequence: Synthetic oligonucleotide
  Target: ATXN1; (-) strand; PAM type: NRG; PAM sequence: AGG
ccctcggatcatggccaccc

SEQ ID NO: 54642 - DNA, 20 bp, Artificial Sequence
  Description of Artificial Sequence: Synthetic oligonucleotide
  Target: ATXN1; (-) strand; PAM type: NRG; PAM sequence: CAG
gccctcggatcatggccacc

SEQ ID NO: 54643 - DNA, 20 bp, Artificial Sequence
  Description of Artificial Sequence: Synthetic oligonucleotide
  Target: ATXN1; (-) strand; PAM type: NRG; PAM sequence: TGG
aacaaaatgccctcggatca

SEQ ID NO: 54644 - DNA, 20 bp, Artificial Sequence
  Description of Artificial Sequence: Synthetic oligonucleotide
  Target: ATXN1; (-) strand; PAM type: NRG; PAM sequence: CGG
gcaccagaacaaaatgccct

SEQ ID NO: 54645 - DNA, 20 bp, Artificial Sequence
  Description of Artificial Sequence: Synthetic oligonucleotide
  Target: ATXN1; (-) strand; PAM type: NRG; PAM sequence: CAG
cagtctttgtatctgtgcac

SEQ ID NO: 54646 - DNA, 20 bp, Artificial Sequence
  Description of Artificial Sequence: Synthetic oligonucleotide
  Target: ATXN1; (-) strand; PAM type: NRG; PAM sequence: CAG
attactgtcctccccatccc

SEQ ID NO: 54647 - DNA, 20 bp, Artificial Sequence
  Description of Artificial Sequence: Synthetic oligonucleotide
  Target: ATXN1; (-) strand; PAM type: NRG; PAM sequence: AAG
gttcatgtgtccttgtataa

SEQ ID NO: 54648 - DNA, 20 bp, Artificial Sequence
  Description of Artificial Sequence: Synthetic oligonucleotide
  Target: ATXN1; (-) strand; PAM type: NRG; PAM sequence: TGG
tctctaaggcaccagtgtgg

SEQ ID NO: 54649 - DNA, 20 bp, Artificial Sequence
  Description of Artificial Sequence: Synthetic oligonucleotide
  Target: ATXN1; (-) strand; PAM type: NRG; PAM sequence: TGG
tgttctctaaggcaccagtg

SEQ ID NO: 54650 - DNA, 20 bp, Artificial Sequence
  Description of Artificial Sequence: Synthetic oligonucleotide
  Target: ATXN1; (-) strand; PAM type: NRG; PAM sequence: CAG
gcctatgttctctaaggcac

SEQ ID NO: 54651 - DNA, 20 bp, Artificial Sequence
  Description of Artificial Sequence: Synthetic oligonucleotide
  Target: ATXN1; (-) strand; PAM type: NRG; PAM sequence: AGG
ttcgttgcctatgttctcta

SEQ ID NO: 54652 - DNA, 20 bp, Artificial Sequence
  Description of Artificial Sequence: Synthetic oligonucleotide
  Target: ATXN1; (-) strand; PAM type: NRG; PAM sequence: AAG
attcgttgcctatgttctct

SEQ ID NO: 54653 - DNA, 20 bp, Artificial Sequence
  Description of Artificial Sequence: Synthetic oligonucleotide
  Target: ATXN1; (-) strand; PAM type: NRG; PAM sequence: GAG
cgatcacttatgctgcagca

SEQ ID NO: 54654 - DNA, 20 bp, Artificial Sequence
  Description of Artificial Sequence: Synthetic oligonucleotide
  Target: ATXN1; (-) strand; PAM type: NRG; PAM sequence: CAG
ttcgatcacttatgctgcag

SEQ ID NO: 54655 - DNA, 20 bp, Artificial Sequence
  Description of Artificial Sequence: Synthetic oligonucleotide
  Target: ATXN1; (-) strand; PAM type: NRG; PAM sequence: CAG
actttcgatcacttatgctg

SEQ ID NO: 54656 - DNA, 20 bp, Artificial Sequence
  Description of Artificial Sequence: Synthetic oligonucleotide
  Target: ATXN1; (-) strand; PAM type: NRG; PAM sequence: AGG
tctattcaaatcatttagtg

SEQ ID NO: 54657 - DNA, 20 bp, Artificial Sequence
  Description of Artificial Sequence: Synthetic oligonucleotide
  Target: ATXN1; (-) strand; PAM type: NRG; PAM sequence: GAG
ttctattcaaatcatttagt

SEQ ID NO: 54658 - DNA, 20 bp, Artificial Sequence
  Description of Artificial Sequence: Synthetic oligonucleotide
  Target: ATXN1; (-) strand; PAM type: NRG; PAM sequence: TAG
tcctttctattcaaatcatt

SEQ ID NO: 54659 - DNA, 20 bp, Artificial Sequence
  Description of Artificial Sequence: Synthetic oligonucleotide
  Target: ATXN1; (-) strand; PAM type: NRG; PAM sequence: TGG
tatggagaacagtggtgcta

SEQ ID NO: 54660 - DNA, 20 bp, Artificial Sequence
  Description of Artificial Sequence: Synthetic oligonucleotide
  Target: ATXN1; (-) strand; PAM type: NRG; PAM sequence: TGG
gctcacgttatggagaacag

SEQ ID NO: 54661 - DNA, 20 bp, Artificial Sequence
  Description of Artificial Sequence: Synthetic oligonucleotide
  Target: ATXN1; (-) strand; PAM type: NRG; PAM sequence: CAG
gcagctcacgttatggagaa

SEQ ID NO: 54662 - DNA, 20 bp, Artificial Sequence
  Description of Artificial Sequence: Synthetic oligonucleotide
  Target: ATXN1; (-) strand; PAM type: NRG; PAM sequence: GAG
acactgcagctcacgttatg

SEQ ID NO: 54663 - DNA, 20 bp, Artificial Sequence
  Description of Artificial Sequence: Synthetic oligonucleotide
  Target: ATXN1; (-) strand; PAM type: NRG; PAM sequence: TGG
gaacactgcagctcacgtta

SEQ ID NO: 54664 - DNA, 20 bp, Artificial Sequence
  Description of Artificial Sequence: Synthetic oligonucleotide
  Target: ATXN1; (-) strand; PAM type: NRG; PAM sequence: CAG
aaatgcagcatagaacactg

SEQ ID NO: 54665 - DNA, 20 bp, Artificial Sequence
  Description of Artificial Sequence: Synthetic oligonucleotide
  Target: ATXN1; (-) strand; PAM type: NRG; PAM sequence: TAG
cggggaagtaaaatgcagca

SEQ ID NO: 54666 - DNA, 20 bp, Artificial Sequence
  Description of Artificial Sequence: Synthetic oligonucleotide
  Target: ATXN1; (-) strand; PAM type: NRG; PAM sequence: CAG
cataccggggaagtaaaatg

SEQ ID NO: 54667 - DNA, 20 bp, Artificial Sequence
  Description of Artificial Sequence: Synthetic oligonucleotide
  Target: ATXN1; (-) strand; PAM type: NRG; PAM sequence: AAG
tagctgccctcataccgggg

SEQ ID NO: 54668 - DNA, 20 bp, Artificial Sequence
  Description of Artificial Sequence: Synthetic oligonucleotide
  Target: ATXN1; (-) strand; PAM type: NRG; PAM sequence: GGG
ctctagctgccctcataccg

SEQ ID NO: 54669 - DNA, 20 bp, Artificial Sequence
  Description of Artificial Sequence: Synthetic oligonucleotide
  Target: ATXN1; (-) strand; PAM type: NRG; PAM sequence: GGG
tctctagctgccctcatacc

SEQ ID NO: 54670 - DNA, 20 bp, Artificial Sequence
  Description of Artificial Sequence: Synthetic oligonucleotide
  Target: ATXN1; (-) strand; PAM type: NRG; PAM sequence: CGG
ctctctagctgccctcatac

SEQ ID NO: 54671 - DNA, 20 bp, Artificial Sequence
  Description of Artificial Sequence: Synthetic oligonucleotide
  Target: ATXN1; (-) strand; PAM type: NRG; PAM sequence: TAG
aagtcatcccaccatctctc

SEQ ID NO: 54672 - DNA, 20 bp, Artificial Sequence
  Description of Artificial Sequence: Synthetic oligonucleotide
  Target: ATXN1; (-) strand; PAM type: NRG; PAM sequence: AAG
aaggtccccagagacagtga

SEQ ID NO: 54673 - DNA, 20 bp, Artificial Sequence
  Description of Artificial Sequence: Synthetic oligonucleotide
  Target: ATXN1; (-) strand; PAM type: NRG; PAM sequence: CAG
tgtctgaaggtccccagaga

SEQ ID NO: 54674 - DNA, 20 bp, Artificial Sequence
  Description of Artificial Sequence: Synthetic oligonucleotide
  Target: ATXN1; (-) strand; PAM type: NRG; PAM sequence: GAG
aatttgtctgaaggtcccca

SEQ ID NO: 54675 - DNA, 20 bp, Artificial Sequence
  Description of Artificial Sequence: Synthetic oligonucleotide
  Target: ATXN1; (-) strand; PAM type: NRG; PAM sequence: CAG
ctaatttgtctgaaggtccc

SEQ ID NO: 54676 - DNA, 20 bp, Artificial Sequence
  Description of Artificial Sequence: Synthetic oligonucleotide
  Target: ATXN1; (-) strand; PAM type: NRG; PAM sequence: AGG
aagatagctaatttgtctga

SEQ ID NO: 54677 - DNA, 20 bp, Artificial Sequence
  Description of Artificial Sequence: Synthetic oligonucleotide
  Target: ATXN1; (-) strand; PAM type: NRG; PAM sequence: AAG
caagatagctaatttgtctg

SEQ ID NO: 54678 - DNA, 20 bp, Artificial Sequence
  Description of Artificial Sequence: Synthetic oligonucleotide
  Target: ATXN1; (-) strand; PAM type: NRG; PAM sequence: TAG
tcctgggactgttcacaaga

SEQ ID NO: 54679 - DNA, 20 bp, Artificial Sequence
  Description of Artificial Sequence: Synthetic oligonucleotide
  Target: ATXN1; (-) strand; PAM type: NRG; PAM sequence: AAG
ggcatcctgggactgttcac

SEQ ID NO: 54680 - DNA, 20 bp, Artificial Sequence
  Description of Artificial Sequence: Synthetic oligonucleotide
  Target: ATXN1; (-) strand; PAM type: NRG; PAM sequence: GGG
atttagaaagttggcatcct

SEQ ID NO: 54681 - DNA, 20 bp, Artificial Sequence
  Description of Artificial Sequence: Synthetic oligonucleotide
  Target: ATXN1; (-) strand; PAM type: NRG; PAM sequence: TGG
tatttagaaagttggcatcc

SEQ ID NO: 54682 - DNA, 20 bp, Artificial Sequence
  Description of Artificial Sequence: Synthetic oligonucleotide
  Target: ATXN1; (-) strand; PAM type: NRG; PAM sequence: TGG
ttgatgtttatttagaaagt

SEQ ID NO: 54683 - DNA, 20 bp, Artificial Sequence
  Description of Artificial Sequence: Synthetic oligonucleotide
  Target: ATXN1; (-) strand; PAM type: NRG; PAM sequence: AAG
cattttgatgtttatttaga

SEQ ID NO: 54684 - DNA, 20 bp, Artificial Sequence
  Description of Artificial Sequence: Synthetic oligonucleotide
  Target: ATXN1; (-) strand; PAM type: NRG; PAM sequence: TAG
aatgcattttgatgtttatt

SEQ ID NO: 54685 - DNA, 20 bp, Artificial Sequence
  Description of Artificial Sequence: Synthetic oligonucleotide
  Target: ATXN1; (-) strand; PAM type: NRG; PAM sequence: CAG
aacctcttaagtgatacaga

SEQ ID NO: 54686 - DNA, 20 bp, Artificial Sequence
  Description of Artificial Sequence: Synthetic oligonucleotide
  Target: ATXN1; (-) strand; PAM type: NRG; PAM sequence: CAG
tctcaacctcttaagtgata

SEQ ID NO: 54687 - DNA, 20 bp, Artificial Sequence
  Description of Artificial Sequence: Synthetic oligonucleotide
  Target: ATXN1; (-) strand; PAM type: NRG; PAM sequence: AAG
ccctccattctcaacctctt

SEQ ID NO: 54688 - DNA, 20 bp, Artificial Sequence
  Description of Artificial Sequence: Synthetic oligonucleotide
  Target: ATXN1; (-) strand; PAM type: NRG; PAM sequence: AGG
acacgcaaatgtttgcagtt

SEQ ID NO: 54689 - DNA, 20 bp, Artificial Sequence
  Description of Artificial Sequence: Synthetic oligonucleotide
  Target: ATXN1; (-) strand; PAM type: NRG; PAM sequence: TAG
aacacgcaaatgtttgcagt

SEQ ID NO: 54690 - DNA, 20 bp, Artificial Sequence
  Description of Artificial Sequence: Synthetic oligonucleotide
  Target: ATXN1; (-) strand; PAM type: NRG; PAM sequence: CAG
taaaaacacgcaaatgtttg

SEQ ID NO: 54691 - DNA, 20 bp, Artificial Sequence
  Description of Artificial Sequence: Synthetic oligonucleotide
  Target: ATXN1; (-) strand; PAM type: NRG; PAM sequence: AAG
ctctatattgtctaatagct

SEQ ID NO: 54692 - DNA, 20 bp, Artificial Sequence
  Description of Artificial Sequence: Synthetic oligonucleotide
  Target: ATXN1; (-) strand; PAM type: NRG; PAM sequence: TAG
taatactctatattgtctaa

SEQ ID NO: 54693 - DNA, 20 bp, Artificial Sequence
  Description of Artificial Sequence: Synthetic oligonucleotide
  Target: ATXN1; (-) strand; PAM type: NRG; PAM sequence: CAG
acctcttcagtcttctaaga

SEQ ID NO: 54694 - DNA, 20 bp, Artificial Sequence
  Description of Artificial Sequence: Synthetic oligonucleotide
  Target: ATXN1; (-) strand; PAM type: NRG; PAM sequence: AAG
cttcacctcttcagtcttct

SEQ ID NO: 54695 - DNA, 20 bp, Artificial Sequence
  Description of Artificial Sequence: Synthetic oligonucleotide
  Target: ATXN1; (-) strand; PAM type: NRG; PAM sequence: CAG
gaacaccagcttcacctctt

SEQ ID NO: 54696 - DNA, 20 bp, Artificial Sequence
  Description of Artificial Sequence: Synthetic oligonucleotide
  Target: ATXN1; (-) strand; PAM type: NRG; PAM sequence: CAG
tgtagacatactcagaacac

SEQ ID NO: 54697 - DNA, 20 bp, Artificial Sequence
  Description of Artificial Sequence: Synthetic oligonucleotide
  Target: ATXN1; (-) strand; PAM type: NRG; PAM sequence: CAG
gcaggctgtgtagacatact

SEQ ID NO: 54698 - DNA, 20 bp, Artificial Sequence
  Description of Artificial Sequence: Synthetic oligonucleotide
  Target: ATXN1; (-) strand; PAM type: NRG; PAM sequence: TAG
ctgcctctatgcaggctgtg

SEQ ID NO: 54699 - DNA, 20 bp, Artificial Sequence
  Description of Artificial Sequence: Synthetic oligonucleotide
  Target: ATXN1; (-) strand; PAM type: NRG; PAM sequence: AGG
atatacatctgcctctatgc

SEQ ID NO: 54700 - DNA, 20 bp, Artificial Sequence
  Description of Artificial Sequence: Synthetic oligonucleotide
  Target: ATXN1; (-) strand; PAM type: NRG; PAM sequence: CAG
tatatacatctgcctctatg

SEQ ID NO: 54701 - DNA, 20 bp, Artificial Sequence
  Description of Artificial Sequence: Synthetic oligonucleotide
  Target: ATXN1; (-) strand; PAM type: NRG; PAM sequence: GAG
agttttatccattttaggca

SEQ ID NO: 54702 - DNA, 20 bp, Artificial Sequence
  Description of Artificial Sequence: Synthetic oligonucleotide
  Target: ATXN1; (-) strand; PAM type: NRG; PAM sequence: CAG
cgagttttatccattttagg

SEQ ID NO: 54703 - DNA, 20 bp, Artificial Sequence
  Description of Artificial Sequence: Synthetic oligonucleotide
  Target: ATXN1; (-) strand; PAM type: NRG; PAM sequence: AGG
ttccgagttttatccatttt

SEQ ID NO: 54704 - DNA, 20 bp, Artificial Sequence
  Description of Artificial Sequence: Synthetic oligonucleotide
  Target: ATXN1; (-) strand; PAM type: NRG; PAM sequence: TAG
gttccgagttttatccattt

SEQ ID NO: 54705 - DNA, 20 bp, Artificial Sequence
  Description of Artificial Sequence: Synthetic oligonucleotide
  Target: ATXN1; (-) strand; PAM type: NRG; PAM sequence: GAG
aatgtggattgttttgttcc

SEQ ID NO: 54706 - DNA, 20 bp, Artificial Sequence
  Description of Artificial Sequence: Synthetic oligonucleotide
  Target: ATXN1; (-) strand; PAM type: NRG; PAM sequence: TGG
cttcagggtattactaaatg

SEQ ID NO: 54707 - DNA, 20 bp, Artificial Sequence
  Description of Artificial Sequence: Synthetic oligonucleotide
  Target: ATXN1; (-) strand; PAM type: NRG; PAM sequence: GGG
acaaattagagtcagcttca

SEQ ID NO: 54708 - DNA, 20 bp, Artificial Sequence
  Description of Artificial Sequence: Synthetic oligonucleotide
  Target: ATXN1; (-) strand; PAM type: NRG; PAM sequence: AGG
tacaaattagagtcagcttc

SEQ ID NO: 54709 - DNA, 20 bp, Artificial Sequence
  Description of Artificial Sequence: Synthetic oligonucleotide
  Target: ATXN1; (-) strand; PAM type: NRG; PAM sequence: CAG
atacaaattagagtcagctt

SEQ ID NO: 54710 - DNA, 20 bp, Artificial Sequence
  Description of Artificial Sequence: Synthetic oligonucleotide
  Target: ATXN1; (-) strand; PAM type: NRG; PAM sequence: CAG
cagtgaatacaaattagagt

SEQ ID NO: 54711 - DNA, 20 bp, Artificial Sequence
  Description of Artificial Sequence: Synthetic oligonucleotide
  Target: ATXN1; (-) strand; PAM type: NRG; PAM sequence: GAG
gtcacagtgaatacaaatta

SEQ ID NO: 54712 - DNA, 20 bp, Artificial Sequence
  Description of Artificial Sequence: Synthetic oligonucleotide
  Target: ATXN1; (-) strand; PAM type: NRG; PAM sequence: TAG
ttgtcacagtgaatacaaat

SEQ ID NO: 54713 - DNA, 20 bp, Artificial Sequence
  Description of Artificial Sequence: Synthetic oligonucleotide
  Target: ATXN1; (-) strand; PAM type: NRG; PAM sequence: CAG
ttgaaagtaaggagttgtca

SEQ ID NO: 54714 - DNA, 20 bp, Artificial Sequence
  Description of Artificial Sequence: Synthetic oligonucleotide
  Target: ATXN1; (-) strand; PAM type: NRG; PAM sequence: GAG
acttcagatttgaaagtaag

SEQ ID NO: 54715 - DNA, 20 bp, Artificial Sequence
  Description of Artificial Sequence: Synthetic oligonucleotide
  Target: ATXN1; (-) strand; PAM type: NRG; PAM sequence: AGG
ttacttcagatttgaaagta

SEQ ID NO: 54716 - DNA, 20 bp, Artificial Sequence
  Description of Artificial Sequence: Synthetic oligonucleotide
  Target: ATXN1; (-) strand; PAM type: NRG; PAM sequence: AAG
attacttcagatttgaaagt

SEQ ID NO: 54717 - DNA, 20 bp, Artificial Sequence
  Description of Artificial Sequence: Synthetic oligonucleotide
  Target: ATXN1; (-) strand; PAM type: NRG; PAM sequence: AAG
aataattacttcagatttga

SEQ ID NO: 54718 - DNA, 20 bp, Artificial Sequence
  Description of Artificial Sequence: Synthetic oligonucleotide
  Target: ATXN1; (-) strand; PAM type: NRG; PAM sequence: CAG
tcactttctaataattactt

SEQ ID NO: 54719 - DNA, 20 bp, Artificial Sequence
  Description of Artificial Sequence: Synthetic oligonucleotide
  Target: ATXN1; (-) strand; PAM type: NRG; PAM sequence: AAG
gccatctcccagcttcccaa

SEQ ID NO: 54720 - DNA, 20 bp, Artificial Sequence
  Description of Artificial Sequence: Synthetic oligonucleotide
  Target: ATXN1; (-) strand; PAM type: NRG; PAM sequence: CAG
tagactataaagccatctcc

SEQ ID NO: 54721 - DNA, 20 bp, Artificial Sequence
  Description of Artificial Sequence: Synthetic oligonucleotide
  Target: ATXN1; (-) strand; PAM type: NRG; PAM sequence: AAG
tagtggcaacttagactata

SEQ ID NO: 54722 - DNA, 20 bp, Artificial Sequence
  Description of Artificial Sequence: Synthetic oligonucleotide
  Target: ATXN1; (-) strand; PAM type: NRG; PAM sequence: TAG
cattctatctagtggcaact

SEQ ID NO: 54723 - DNA, 20 bp, Artificial Sequence
  Description of Artificial Sequence: Synthetic oligonucleotide
  Target: ATXN1; (-) strand; PAM type: NRG; PAM sequence: TGG
ttatgggtcattctatctag

SEQ ID NO: 54724 - DNA, 20 bp, Artificial Sequence
  Description of Artificial Sequence: Synthetic oligonucleotide
  Target: ATXN1; (-) strand; PAM type: NRG; PAM sequence: TAG
tttttatgggtcattctatc

SEQ ID NO: 54725 - DNA, 20 bp, Artificial Sequence
  Description of Artificial Sequence: Synthetic oligonucleotide
  Target: ATXN1; (-) strand; PAM type: NRG; PAM sequence: GGG
gccttccaagtaatttttat

SEQ ID NO: 54726 - DNA, 20 bp, Artificial Sequence
  Description of Artificial Sequence: Synthetic oligonucleotide
  Target: ATXN1; (-) strand; PAM type: NRG; PAM sequence: TGG
agccttccaagtaattttta

SEQ ID NO: 54727 - DNA, 20 bp, Artificial Sequence
  Description of Artificial Sequence: Synthetic oligonucleotide
  Target: ATXN1; (-) strand; PAM type: NRG; PAM sequence: AAG
ttatgagataatagccttcc

SEQ ID NO: 54728 - DNA, 20 bp, Artificial Sequence
  Description of Artificial Sequence: Synthetic oligonucleotide
  Target: ATXN1; (-) strand; PAM type: NRG; PAM sequence: TAG
aggccccggttatgagataa

SEQ ID NO: 54729 - DNA, 20 bp, Artificial Sequence
  Description of Artificial Sequence: Synthetic oligonucleotide
  Target: ATXN1; (-) strand; PAM type: NRG; PAM sequence: GAG
attttataggccccggttat

SEQ ID NO: 54730 - DNA, 20 bp, Artificial Sequence
  Description of Artificial Sequence: Synthetic oligonucleotide
  Target: ATXN1; (-) strand; PAM type: NRG; PAM sequence: CGG
ctgttagattttataggccc

SEQ ID NO: 54731 - DNA, 20 bp, Artificial Sequence
  Description of Artificial Sequence: Synthetic oligonucleotide
  Target: ATXN1; (-) strand; PAM type: NRG; PAM sequence: AGG
ctgtaactgttagattttat

SEQ ID NO: 54732 - DNA, 20 bp, Artificial Sequence
  Description of Artificial Sequence: Synthetic oligonucleotide
  Target: ATXN1; (-) strand; PAM type: NRG; PAM sequence: TAG
tctgtaactgttagatttta

SEQ ID NO: 54733 - DNA, 20 bp, Artificial Sequence
  Description of Artificial Sequence: Synthetic oligonucleotide
  Target: ATXN1; (-) strand; PAM type: NRG; PAM sequence: TAG
gagagagaatctgtaactgt

SEQ ID NO: 54734 - DNA, 20 bp, Artificial Sequence
  Description of Artificial Sequence: Synthetic oligonucleotide
  Target: ATXN1; (-) strand; PAM type: NRG; PAM sequence: GAG
gagagacagagagagagaga

SEQ ID NO: 54735 - DNA, 20 bp, Artificial Sequence
  Description of Artificial Sequence: Synthetic oligonucleotide
  Target: ATXN1; (-) strand; PAM type: NRG; PAM sequence: GAG
gagagagacagagagagaga

SEQ ID NO: 54736 - DNA, 20 bp, Artificial Sequence
  Description of Artificial Sequence: Synthetic oligonucleotide
  Target: ATXN1; (-) strand; PAM type: NRG; PAM sequence: GAG
gagagagagacagagagaga

SEQ ID NO: 54737 - DNA, 20 bp, Artificial Sequence
  Description of Artificial Sequence: Synthetic oligonucleotide
  Target: ATXN1; (-) strand; PAM type: NRG; PAM sequence: GAG
gagagagagagacagagaga

SEQ ID NO: 54738 - DNA, 20 bp, Artificial Sequence
  Description of Artificial Sequence: Synthetic oligonucleotide
  Target: ATXN1; (-) strand; PAM type: NRG; PAM sequence: GAG
acgagagagagagacagaga

SEQ ID NO: 54739 - DNA, 20 bp, Artificial Sequence
  Description of Artificial Sequence: Synthetic oligonucleotide
  Target: ATXN1; (-) strand; PAM type: NRG; PAM sequence: GAG
acacgagagagagagacaga

SEQ ID NO: 54740 - DNA, 20 bp, Artificial Sequence
  Description of Artificial Sequence: Synthetic oligonucleotide
  Target: ATXN1; (-) strand; PAM type: NRG; PAM sequence: GAG
acacacgagagagagagaca

SEQ ID NO: 54741 - DNA, 20 bp, Artificial Sequence
  Description of Artificial Sequence: Synthetic oligonucleotide
  Target: ATXN1; (-) strand; PAM type: NRG; PAM sequence: CAG
atacacacgagagagagaga

SEQ ID NO: 54742 - DNA, 20 bp, Artificial Sequence
  Description of Artificial Sequence: Synthetic oligonucleotide
  Target: ATXN1; (-) strand; PAM type: NRG; PAM sequence: GAG
taaaatacacacgagagaga

SEQ ID NO: 54743 - DNA, 20 bp, Artificial Sequence
  Description of Artificial Sequence: Synthetic oligonucleotide
  Target: ATXN1; (-) strand; PAM type: NRG; PAM sequence: GAG
attaaaatacacacgagaga

SEQ ID NO: 54744 - DNA, 20 bp, Artificial Sequence
  Description of Artificial Sequence: Synthetic oligonucleotide
  Target: ATXN1; (-) strand; PAM type: NRG; PAM sequence: GAG
taattaaaatacacacgaga

SEQ ID NO: 54745 - DNA, 20 bp, Artificial Sequence
  Description of Artificial Sequence: Synthetic oligonucleotide
  Target: ATXN1; (-) strand; PAM type: NRG; PAM sequence: GAG
tttaattaaaatacacacga

SEQ ID NO: 54746 - DNA, 20 bp, Artificial Sequence
  Description of Artificial Sequence: Synthetic oligonucleotide
  Target: ATXN1; (-) strand; PAM type: NRG; PAM sequence: GAG
tctttaattaaaatacacac

SEQ ID NO: 54747 - DNA, 20 bp, Artificial Sequence
  Description of Artificial Sequence: Synthetic oligonucleotide
  Target: ATXN1; (-) strand; PAM type: NRG; PAM sequence: AAG
gttttgtctcttagcagttt

SEQ ID NO: 54748 - DNA, 20 bp, Artificial Sequence
  Description of Artificial Sequence: Synthetic oligonucleotide
  Target: ATXN1; (-) strand; PAM type: NRG; PAM sequence: CAG
ttttcagttttgtctcttag

SEQ ID NO: 54749 - DNA, 20 bp, Artificial Sequence
  Description of Artificial Sequence: Synthetic oligonucleotide
  Target: ATXN1; (-) strand; PAM type: NRG; PAM sequence: TAG
atgttttcagttttgtctct

SEQ ID NO: 54750 - DNA, 20 bp, Artificial Sequence
  Description of Artificial Sequence: Synthetic oligonucleotide
  Target: ATXN1; (-) strand; PAM type: NRG; PAM sequence: CAG
ttggattacgtacatgtttt

SEQ ID NO: 54751 - DNA, 20 bp, Artificial Sequence
  Description of Artificial Sequence: Synthetic oligonucleotide
  Target: ATXN1; (-) strand; PAM type: NRG; PAM sequence: TGG
gcagagacattatgcaaaat

SEQ ID NO: 54752 - DNA, 20 bp, Artificial Sequence
  Description of Artificial Sequence: Synthetic oligonucleotide
  Target: ATXN1; (-) strand; PAM type: NRG; PAM sequence: GAG
aaatcaactacaaaaccgca

SEQ ID NO: 54753 - DNA, 20 bp, Artificial Sequence
  Description of Artificial Sequence: Synthetic oligonucleotide
  Target: ATXN1; (-) strand; PAM type: NRG; PAM sequence: CAG
gaaaatcaactacaaaaccg

SEQ ID NO: 54754 - DNA, 20 bp, Artificial Sequence
  Description of Artificial Sequence: Synthetic oligonucleotide
  Target: ATXN1; (-) strand; PAM type: NRG; PAM sequence: GGG
atgtaagtcagggtcagatg

SEQ ID NO: 54755 - DNA, 20 bp, Artificial Sequence
  Description of Artificial Sequence: Synthetic oligonucleotide
  Target: ATXN1; (-) strand; PAM type: NRG; PAM sequence: GGG
catgtaagtcagggtcagat

SEQ ID NO: 54756 - DNA, 20 bp, Artificial Sequence
  Description of Artificial Sequence: Synthetic oligonucleotide
  Target: ATXN1; (-) strand; PAM type: NRG; PAM sequence: TGG
acatgtaagtcagggtcaga

SEQ ID NO: 54757 - DNA, 20 bp, Artificial Sequence
  Description of Artificial Sequence: Synthetic oligonucleotide
  Target: ATXN1; (-) strand; PAM type: NRG; PAM sequence: CAG
tatcacatgtaagtcagggt

SEQ ID NO: 54758 - DNA, 20 bp, Artificial Sequence
  Description of Artificial Sequence: Synthetic oligonucleotide
  Target: ATXN1; (-) strand; PAM type: NRG; PAM sequence: GGG
tgtgtatcacatgtaagtca

SEQ ID NO: 54759 - DNA, 20 bp, Artificial Sequence
  Description of Artificial Sequence: Synthetic oligonucleotide
  Target: ATXN1; (-) strand; PAM type: NRG; PAM sequence: AGG
gtgtgtatcacatgtaagtc

SEQ ID NO: 54760 - DNA, 20 bp, Artificial Sequence
  Description of Artificial Sequence: Synthetic oligonucleotide
  Target: ATXN1; (-) strand; PAM type: NRG; PAM sequence: CAG
tgtgtgtatcacatgtaagt

SEQ ID NO: 54761 - DNA, 20 bp, Artificial Sequence
  Description of Artificial Sequence: Synthetic oligonucleotide
  Target: ATXN1; (-) strand; PAM type: NRG; PAM sequence: AAG
aatgtgtgtgtatcacatgt

SEQ ID NO: 54762 - DNA, 20 bp, Artificial Sequence
  Description of Artificial Sequence: Synthetic oligonucleotide
  Target: ATXN1; (-) strand; PAM type: NRG; PAM sequence: CAG
gcagttttcctaccataaac

SEQ ID NO: 54763 - DNA, 20 bp, Artificial Sequence
  Description of Artificial Sequence: Synthetic oligonucleotide
  Target: ATXN1; (-) strand; PAM type: NRG; PAM sequence: CAG
gtgccagtacccagccagag

SEQ ID NO: 54764 - DNA, 20 bp, Artificial Sequence
  Description of Artificial Sequence: Synthetic oligonucleotide
  Target: ATXN1; (-) strand; PAM type: NRG; PAM sequence: GAG
cgagtgccagtacccagcca

SEQ ID NO: 54765 - DNA, 20 bp, Artificial Sequence
  Description of Artificial Sequence: Synthetic oligonucleotide
  Target: ATXN1; (-) strand; PAM type: NRG; PAM sequence: CAG
ggcgagtgccagtacccagc

SEQ ID NO: 54766 - DNA, 20 bp, Artificial Sequence
  Description of Artificial Sequence: Synthetic oligonucleotide
  Target: ATXN1; (-) strand; PAM type: NRG; PAM sequence: CAG
caaaggcgagtgccagtacc

SEQ ID NO: 54767 - DNA, 20 bp, Artificial Sequence
  Description of Artificial Sequence: Synthetic oligonucleotide
  Target: ATXN1; (-) strand; PAM type: NRG; PAM sequence: CAG
tgaatcacaaaggcgagtgc

SEQ ID NO: 54768 - DNA, 20 bp, Artificial Sequence
  Description of Artificial Sequence: Synthetic oligonucleotide
  Target: ATXN1; (-) strand; PAM type: NRG; PAM sequence: GAG
catgcctgaatcacaaaggc

SEQ ID NO: 54769 - DNA, 20 bp, Artificial Sequence
  Description of Artificial Sequence: Synthetic oligonucleotide
  Target: ATXN1; (-) strand; PAM type: NRG; PAM sequence: AGG
gtttcatgcctgaatcacaa

SEQ ID NO: 54770 - DNA, 20 bp, Artificial Sequence
  Description of Artificial Sequence: Synthetic oligonucleotide
  Target: ATXN1; (-) strand; PAM type: NRG; PAM sequence: AAG
ggtttcatgcctgaatcaca

SEQ ID NO: 54771 - DNA, 20 bp, Artificial Sequence
  Description of Artificial Sequence: Synthetic oligonucleotide
  Target: ATXN1; (-) strand; PAM type: NRG; PAM sequence: TGG
aattccagctgggcacctca

SEQ ID NO: 54772 - DNA, 20 bp, Artificial Sequence
  Description of Artificial Sequence: Synthetic oligonucleotide
  Target: ATXN1; (-) strand; PAM type: NRG; PAM sequence: GGG
acttcttctgaattccagct

SEQ ID NO: 54773 - DNA, 20 bp, Artificial Sequence
  Description of Artificial Sequence: Synthetic oligonucleotide
  Target: ATXN1; (-) strand; PAM type: NRG; PAM sequence: TGG
tacttcttctgaattccagc

SEQ ID NO: 54774 - DNA, 20 bp, Artificial Sequence
  Description of Artificial Sequence: Synthetic oligonucleotide
  Target: ATXN1; (-) strand; PAM type: NRG; PAM sequence: CAG
aatgtacttcttctgaattc

SEQ ID NO: 54775 - DNA, 20 bp, Artificial Sequence
  Description of Artificial Sequence: Synthetic oligonucleotide
  Target: ATXN1; (-) strand; PAM type: NRG; PAM sequence: AAG
gaacctaataaataaataca

SEQ ID NO: 54776 - DNA, 20 bp, Artificial Sequence
  Description of Artificial Sequence: Synthetic oligonucleotide
  Target: ATXN1; (-) strand; PAM type: NRG; PAM sequence: AAG
accctggcaacttaagttgg

SEQ ID NO: 54777 - DNA, 20 bp, Artificial Sequence
  Description of Artificial Sequence: Synthetic oligonucleotide
  Target: ATXN1; (-) strand; PAM type: NRG; PAM sequence: TGG
gctaccctggcaacttaagt

SEQ ID NO: 54778 - DNA, 20 bp, Artificial Sequence
  Description of Artificial Sequence: Synthetic oligonucleotide
  Target: ATXN1; (-) strand; PAM type: NRG; PAM sequence: AAG
tcatgctaccctggcaactt

SEQ ID NO: 54779 - DNA, 20 bp, Artificial Sequence
  Description of Artificial Sequence: Synthetic oligonucleotide
  Target: ATXN1; (-) strand; PAM type: NRG; PAM sequence: TGG
ttaaaaagctcatgctaccc

SEQ ID NO: 54780 - DNA, 20 bp, Artificial Sequence
  Description of Artificial Sequence: Synthetic oligonucleotide
  Target: ATXN1; (-) strand; PAM type: NRG; PAM sequence: AAG
cagaaacaactgtttttaaa

SEQ ID NO: 54781 - DNA, 20 bp, Artificial Sequence
  Description of Artificial Sequence: Synthetic oligonucleotide
  Target: ATXN1; (-) strand; PAM type: NRG; PAM sequence: CAG
aaagcctaaaacaggaaggc

SEQ ID NO: 54782 - DNA, 20 bp, Artificial Sequence
  Description of Artificial Sequence: Synthetic oligonucleotide
  Target: ATXN1; (-) strand; PAM type: NRG; PAM sequence: AGG
gataaaagcctaaaacagga

SEQ ID NO: 54783 - DNA, 20 bp, Artificial Sequence
  Description of Artificial Sequence: Synthetic oligonucleotide
  Target: ATXN1; (-) strand; PAM type: NRG; PAM sequence: AAG
agataaaagcctaaaacagg

SEQ ID NO: 54784 - DNA, 20 bp, Artificial Sequence
  Description of Artificial Sequence: Synthetic oligonucleotide
  Target: ATXN1; (-) strand; PAM type: NRG; PAM sequence: AGG
attagataaaagcctaaaac

SEQ ID NO: 54785 - DNA, 20 bp, Artificial Sequence
  Description of Artificial Sequence: Synthetic oligonucleotide
  Target: ATXN1; (-) strand; PAM type: NRG; PAM sequence: CAG
tattagataaaagcctaaaa

SEQ ID NO: 54786 - DNA, 20 bp, Artificial Sequence
  Description of Artificial Sequence: Synthetic oligonucleotide
  Target: ATXN1; (-) strand; PAM type: NRG; PAM sequence: AAG
tctcacactctattagataa

SEQ ID NO: 54787 - DNA, 20 bp, Artificial Sequence
  Description of Artificial Sequence: Synthetic oligonucleotide
  Target: ATXN1; (-) strand; PAM type: NRG; PAM sequence: TAG
catgtcttctcacactctat

SEQ ID NO: 54788 - DNA, 20 bp, Artificial Sequence
  Description of Artificial Sequence: Synthetic oligonucleotide
  Target: ATXN1; (-) strand; PAM type: NRG; PAM sequence: TAG
agtttgaataatctcatcct

SEQ ID NO: 54789 - DNA, 20 bp, Artificial Sequence
  Description of Artificial Sequence: Synthetic oligonucleotide
  Target: ATXN1; (-) strand; PAM type: NRG; PAM sequence: CAG
ttgatatgtggggttggttt

SEQ ID NO: 54790 - DNA, 20 bp, Artificial Sequence
  Description of Artificial Sequence: Synthetic oligonucleotide
  Target: ATXN1; (-) strand; PAM type: NRG; PAM sequence: TGG
cacggtttgatatgtggggt

SEQ ID NO: 54791 - DNA, 20 bp, Artificial Sequence
  Description of Artificial Sequence: Synthetic oligonucleotide
  Target: ATXN1; (-) strand; PAM type: NRG; PAM sequence: GGG
acaccacggtttgatatgtg

SEQ ID NO: 54792 - DNA, 20 bp, Artificial Sequence
  Description of Artificial Sequence: Synthetic oligonucleotide
  Target: ATXN1; (-) strand; PAM type: NRG; PAM sequence: GGG
gacaccacggtttgatatgt

SEQ ID NO: 54793 - DNA, 20 bp, Artificial Sequence
  Description of Artificial Sequence: Synthetic oligonucleotide
  Target: ATXN1; (-) strand; PAM type: NRG; PAM sequence: TGG
tgacaccacggtttgatatg

SEQ ID NO: 54794 - DNA, 20 bp, Artificial Sequence
  Description of Artificial Sequence: Synthetic oligonucleotide
  Target: ATXN1; (-) strand; PAM type: NRG; PAM sequence: CGG
aagtgacgaaaatgacacca

SEQ ID NO: 54795 - DNA, 20 bp, Artificial Sequence
  Description of Artificial Sequence: Synthetic oligonucleotide
  Target: ATXN1; (-) strand; PAM type: NRG; PAM sequence: AAG
ctgtgtcctttctactgtta

SEQ ID NO: 54796 - DNA, 20 bp, Artificial Sequence
  Description of Artificial Sequence: Synthetic oligonucleotide
  Target: ATXN1; (-) strand; PAM type: NRG; PAM sequence: CAG
gacaaatgtaactgttagtt

SEQ ID NO: 54797 - DNA, 20 bp, Artificial Sequence
  Description of Artificial Sequence: Synthetic oligonucleotide
  Target: ATXN1; (-) strand; PAM type: NRG; PAM sequence: TAG
gaggggacaaatgtaactgt

SEQ ID NO: 54798 - DNA, 20 bp, Artificial Sequence
  Description of Artificial Sequence: Synthetic oligonucleotide
  Target: ATXN1; (-) strand; PAM type: NRG; PAM sequence: GGG
ttatttatccaaggcaggag

SEQ ID NO: 54799 - DNA, 20 bp, Artificial Sequence
  Description of Artificial Sequence: Synthetic oligonucleotide
  Target: ATXN1; (-) strand; PAM type: NRG; PAM sequence: GGG
attatttatccaaggcagga

SEQ ID NO: 54800 - DNA, 20 bp, Artificial Sequence
  Description of Artificial Sequence: Synthetic oligonucleotide
  Target: ATXN1; (-) strand; PAM type: NRG; PAM sequence: AGG
cattatttatccaaggcagg

SEQ ID NO: 54801 - DNA, 20 bp, Artificial Sequence
  Description of Artificial Sequence: Synthetic oligonucleotide
  Target: ATXN1; (-) strand; PAM type: NRG; PAM sequence: GAG
tcattatttatccaaggcag

SEQ ID NO: 54802 - DNA, 20 bp, Artificial Sequence
  Description of Artificial Sequence: Synthetic oligonucleotide
  Target: ATXN1; (-) strand; PAM type: NRG; PAM sequence: AGG
agtcattatttatccaaggc

SEQ ID NO: 54803 - DNA, 20 bp, Artificial Sequence
  Description of Artificial Sequence: Synthetic oligonucleotide
  Target: ATXN1; (-) strand; PAM type: NRG; PAM sequence: CAG
tagtcattatttatccaagg

SEQ ID NO: 54804 - DNA, 20 bp, Artificial Sequence
  Description of Artificial Sequence: Synthetic oligonucleotide
  Target: ATXN1; (-) strand; PAM type: NRG; PAM sequence: AGG
aattagtcattatttatcca

SEQ ID NO: 54805 - DNA, 20 bp, Artificial Sequence
  Description of Artificial Sequence: Synthetic oligonucleotide
  Target: ATXN1; (-) strand; PAM type: NRG; PAM sequence: AAG
aaattagtcattatttatcc

SEQ ID NO: 54806 - DNA, 20 bp, Artificial Sequence
  Description of Artificial Sequence: Synthetic oligonucleotide
  Target: ATXN1; (-) strand; PAM type: NRG; PAM sequence: TAG
ccaatctgttatttaaaaat

SEQ ID NO: 54807 - DNA, 20 bp, Artificial Sequence
  Description of Artificial Sequence: Synthetic oligonucleotide
  Target: ATXN1; (-) strand; PAM type: NRG; PAM sequence: GAG
ctttctgtctcctaatctca

SEQ ID NO: 54808 - DNA, 20 bp, Artificial Sequence
  Description of Artificial Sequence: Synthetic oligonucleotide
  Target: ATXN1; (-) strand; PAM type: NRG; PAM sequence: CAG
tgctttctgtctcctaatct

SEQ ID NO: 54809 - DNA, 20 bp, Artificial Sequence
  Description of Artificial Sequence: Synthetic oligonucleotide
  Target: ATXN1; (-) strand; PAM type: NRG; PAM sequence: AGG
caccaaacctaaaaggtctg

SEQ ID NO: 54810 - DNA, 20 bp, Artificial Sequence
  Description of Artificial Sequence: Synthetic oligonucleotide
  Target: ATXN1; (-) strand; PAM type: NRG; PAM sequence: GAG
gcaccaaacctaaaaggtct

SEQ ID NO: 54811 - DNA, 20 bp, Artificial Sequence
  Description of Artificial Sequence: Synthetic oligonucleotide
  Target: ATXN1; (-) strand; PAM type: NRG; PAM sequence: AGG
aggaaagcaccaaacctaaa

SEQ ID NO: 54812 - DNA, 20 bp, Artificial Sequence
  Description of Artificial Sequence: Synthetic oligonucleotide
  Target: ATXN1; (-) strand; PAM type: NRG; PAM sequence: AAG
caggaaagcaccaaacctaa

SEQ ID NO: 54813 - DNA, 20 bp, Artificial Sequence
  Description of Artificial Sequence: Synthetic oligonucleotide
  Target: ATXN1; (-) strand; PAM type: NRG; PAM sequence: AAG
gcccattcagaggaacagga

SEQ ID NO: 54814 - DNA, 20 bp, Artificial Sequence
  Description of Artificial Sequence: Synthetic oligonucleotide
  Target: ATXN1; (-) strand; PAM type: NRG; PAM sequence: AGG
aaatgcccattcagaggaac

SEQ ID NO: 54815 - DNA, 20 bp, Artificial Sequence
  Description of Artificial Sequence: Synthetic oligonucleotide
  Target: ATXN1; (-) strand; PAM type: NRG; PAM sequence: CAG
aaaatgcccattcagaggaa

SEQ ID NO: 54816 - DNA, 20 bp, Artificial Sequence
  Description of Artificial Sequence: Synthetic oligonucleotide
  Target: ATXN1; (-) strand; PAM type: NRG; PAM sequence: AGG
tttgaaaaatgcccattcag

SEQ ID NO: 54817 - DNA, 20 bp, Artificial Sequence
  Description of Artificial Sequence: Synthetic oligonucleotide
  Target: ATXN1; (-) strand; PAM type: NRG; PAM sequence: GAG
ttttgaaaaatgcccattca

SEQ ID NO: 54818 - DNA, 20 bp, Artificial Sequence
  Description of Artificial Sequence: Synthetic oligonucleotide
  Target: ATXN1; (-) strand; PAM type: NRG; PAM sequence: CAG
ggttttgaaaaatgcccatt

SEQ ID NO: 54819 - DNA, 20 bp, Artificial Sequence
  Description of Artificial Sequence: Synthetic oligonucleotide
  Target: ATXN1; (-) strand; PAM type: NRG; PAM sequence: TGG
acagccttttacattcaaaa

SEQ ID NO: 54820 - DNA, 20 bp, Artificial Sequence
  Description of Artificial Sequence: Synthetic oligonucleotide
  Target: ATXN1; (-) strand; PAM type: NRG; PAM sequence: CAG
aagcccagtgttgaactcta

SEQ ID NO: 54821 - DNA, 20 bp, Artificial Sequence
  Description of Artificial Sequence: Synthetic oligonucleotide
  Target: ATXN1; (-) strand; PAM type: NRG; PAM sequence: CAG
tcataaagtaggaagaagcc

SEQ ID NO: 54822 - DNA, 20 bp, Artificial Sequence
  Description of Artificial Sequence: Synthetic oligonucleotide
  Target: ATXN1; (-) strand; PAM type: NRG; PAM sequence: AAG
taacctcataaagtaggaag

SEQ ID NO: 54823 - DNA, 20 bp, Artificial Sequence
  Description of Artificial Sequence: Synthetic oligonucleotide
  Target: ATXN1; (-) strand; PAM type: NRG; PAM sequence: AAG
gtataacctcataaagtagg

SEQ ID NO: 54824 - DNA, 20 bp, Artificial Sequence
  Description of Artificial Sequence: Synthetic oligonucleotide
  Target: ATXN1; (-) strand; PAM type: NRG; PAM sequence: AGG
tgtgtataacctcataaagt

SEQ ID NO: 54825 - DNA, 20 bp, Artificial Sequence
  Description of Artificial Sequence: Synthetic oligonucleotide
  Target: ATXN1; (-) strand; PAM type: NRG; PAM sequence: TAG
ctgtgtataacctcataaag

SEQ ID NO: 54826 - DNA, 20 bp, Artificial Sequence
  Description of Artificial Sequence: Synthetic oligonucleotide
  Target: ATXN1; (-) strand; PAM type: NRG; PAM sequence: AAG
aacctgtgtataacctcata

SEQ ID NO: 54827 - DNA, 20 bp, Artificial Sequence
  Description of Artificial Sequence: Synthetic oligonucleotide
  Target: ATXN1; (-) strand; PAM type: NRG; PAM sequence: TGG
tacatatacatgcacagtca

SEQ ID NO: 54828 - DNA, 20 bp, Artificial Sequence
  Description of Artificial Sequence: Synthetic oligonucleotide
  Target: ATXN1; (-) strand; PAM type: NRG; PAM sequence: CAG
gcagtgtacatatacatgca

SEQ ID NO: 54829 - DNA, 20 bp, Artificial Sequence
  Description of Artificial Sequence: Synthetic oligonucleotide
  Target: ATXN1; (-) strand; PAM type: NRG; PAM sequence: CAG
ttttttccatattgcccctg

SEQ ID NO: 54830 - DNA, 20 bp, Artificial Sequence
  Description of Artificial Sequence: Synthetic oligonucleotide
  Target: ATXN1; (-) strand; PAM type: NRG; PAM sequence: TGG
tcaatcttggctgccagtcg

SEQ ID NO: 54831 - DNA, 20 bp, Artificial Sequence
  Description of Artificial Sequence: Synthetic oligonucleotide
  Target: ATXN1; (-) strand; PAM type: NRG; PAM sequence: CAG
taaaggtcaatcttggctgc

SEQ ID NO: 54832 - DNA, 20 bp, Artificial Sequence
  Description of Artificial Sequence: Synthetic oligonucleotide
  Target: ATXN1; (-) strand; PAM type: NRG; PAM sequence: TGG
atgggcttaaaggtcaatct

SEQ ID NO: 54833 - DNA, 20 bp, Artificial Sequence
  Description of Artificial Sequence: Synthetic oligonucleotide
  Target: ATXN1; (-) strand; PAM type: NRG; PAM sequence: AGG
tggccatgaaatgggcttaa

SEQ ID NO: 54834 - DNA, 20 bp, Artificial Sequence
  Description of Artificial Sequence: Synthetic oligonucleotide
  Target: ATXN1; (-) strand; PAM type: NRG; PAM sequence: AAG
gtggccatgaaatgggctta

SEQ ID NO: 54835 - DNA, 20 bp, Artificial Sequence
  Description of Artificial Sequence: Synthetic oligonucleotide
  Target: ATXN1; (-) strand; PAM type: NRG; PAM sequence: GGG
atatgcagtggccatgaaat

SEQ ID NO: 54836 - DNA, 20 bp, Artificial Sequence
  Description of Artificial Sequence: Synthetic oligonucleotide
  Target: ATXN1; (-) strand; PAM type: NRG; PAM sequence: TGG
catatgcagtggccatgaaa

SEQ ID NO: 54837 - DNA, 20 bp, Artificial Sequence
  Description of Artificial Sequence: Synthetic oligonucleotide
  Target: ATXN1; (-) strand; PAM type: NRG; PAM sequence: TGG
aataaaaaatgcatatgcag

SEQ ID NO: 54838 - DNA, 20 bp, Artificial Sequence
  Description of Artificial Sequence: Synthetic oligonucleotide
  Target: ATXN1; (-) strand; PAM type: NRG; PAM sequence: CAG
tataataaaaaatgcatatg

SEQ ID NO: 54839 - DNA, 20 bp, Artificial Sequence
  Description of Artificial Sequence: Synthetic oligonucleotide
  Target: ATXN1; (-) strand; PAM type: NRG; PAM sequence: TGG
tttgcaccaggtcctgggat

SEQ ID NO: 54840 - DNA, 20 bp, Artificial Sequence
  Description of Artificial Sequence: Synthetic oligonucleotide
  Target: ATXN1; (-) strand; PAM type: NRG; PAM sequence: GGG
ctatctttgcaccaggtcct

SEQ ID NO: 54841 - DNA, 20 bp, Artificial Sequence
  Description of Artificial Sequence: Synthetic oligonucleotide
  Target: ATXN1; (-) strand; PAM type: NRG; PAM sequence: TGG
gctatctttgcaccaggtcc

SEQ ID NO: 54842 - DNA, 20 bp, Artificial Sequence
  Description of Artificial Sequence: Synthetic oligonucleotide
  Target: ATXN1; (-) strand; PAM type: NRG; PAM sequence: AGG
ttactggctatctttgcacc

SEQ ID NO: 54843 - DNA, 20 bp, Artificial Sequence
  Description of Artificial Sequence: Synthetic oligonucleotide
  Target: ATXN1; (-) strand; PAM type: NRG; PAM sequence: CAG
cttactggctatctttgcac

SEQ ID NO: 54844 - DNA, 20 bp, Artificial Sequence
  Description of Artificial Sequence: Synthetic oligonucleotide
  Target: ATXN1; (-) strand; PAM type: NRG; PAM sequence: TGG
atgaagatcttacttcttac

SEQ ID NO: 54845 - DNA, 20 bp, Artificial Sequence
  Description of Artificial Sequence: Synthetic oligonucleotide
  Target: ATXN1; (-) strand; PAM type: NRG; PAM sequence: AAG
cttatatacttcaaaagatg

SEQ ID NO: 54846 - DNA, 20 bp, Artificial Sequence
  Description of Artificial Sequence: Synthetic oligonucleotide
  Target: ATXN1; (-) strand; PAM type: NRG; PAM sequence: AAG
aaaacccttatatacttcaa

SEQ ID NO: 54847 - DNA, 20 bp, Artificial Sequence
  Description of Artificial Sequence: Synthetic oligonucleotide
  Target: ATXN1; (-) strand; PAM type: NRG; PAM sequence: AGG
ggccattcttcttagcacag

SEQ ID NO: 54848 - DNA, 20 bp, Artificial Sequence
  Description of Artificial Sequence: Synthetic oligonucleotide
  Target: ATXN1; (-) strand; PAM type: NRG; PAM sequence: GAG
tggccattcttcttagcaca

SEQ ID NO: 54849 - DNA, 20 bp, Artificial Sequence
  Description of Artificial Sequence: Synthetic oligonucleotide
  Target: ATXN1; (-) strand; PAM type: NRG; PAM sequence: CAG
tttggccattcttcttagca

SEQ ID NO: 54850 - DNA, 20 bp, Artificial Sequence
  Description of Artificial Sequence: Synthetic oligonucleotide
  Target: ATXN1; (-) strand; PAM type: NRG; PAM sequence: TAG
tatgatttggccattcttct

SEQ ID NO: 54851 - DNA, 20 bp, Artificial Sequence
  Description of Artificial Sequence: Synthetic oligonucleotide
  Target: ATXN1; (-) strand; PAM type: NRG; PAM sequence: TGG
gaatgaagaggaatatgatt

SEQ ID NO: 54852 - DNA, 20 bp, Artificial Sequence
  Description of Artificial Sequence: Synthetic oligonucleotide
  Target: ATXN1; (-) strand; PAM type: NRG; PAM sequence: AGG
tgctccaacttggaatgaag

SEQ ID NO: 54853 - DNA, 20 bp, Artificial Sequence
  Description of Artificial Sequence: Synthetic oligonucleotide
  Target: ATXN1; (-) strand; PAM type: NRG; PAM sequence: GAG
ctgctccaacttggaatgaa

SEQ ID NO: 54854 - DNA, 20 bp, Artificial Sequence
  Description of Artificial Sequence: Synthetic oligonucleotide
  Target: ATXN1; (-) strand; PAM type: NRG; PAM sequence: AAG
ttctgctccaacttggaatg

SEQ ID NO: 54855 - DNA, 20 bp, Artificial Sequence
  Description of Artificial Sequence: Synthetic oligonucleotide
  Target: ATXN1; (-) strand; PAM type: NRG; PAM sequence: TGG
aaggctgttctgctccaact

SEQ ID NO: 54856 - DNA, 20 bp, Artificial Sequence
  Description of Artificial Sequence: Synthetic oligonucleotide
  Target: ATXN1; (-) strand; PAM type: NRG; PAM sequence: AGG
taacagttggcagcaaccta

SEQ ID NO: 54857 - DNA, 20 bp, Artificial Sequence
  Description of Artificial Sequence: Synthetic oligonucleotide
  Target: ATXN1; (-) strand; PAM type: NRG; PAM sequence: AAG
ataacagttggcagcaacct

SEQ ID NO: 54858 - DNA, 20 bp, Artificial Sequence
  Description of Artificial Sequence: Synthetic oligonucleotide
  Target: ATXN1; (-) strand; PAM type: NRG; PAM sequence: CAG
tctcgaaggataacagttgg

SEQ ID NO: 54859 - DNA, 20 bp, Artificial Sequence
  Description of Artificial Sequence: Synthetic oligonucleotide
  Target: ATXN1; (-) strand; PAM type: NRG; PAM sequence: TGG
ccctctcgaaggataacagt

SEQ ID NO: 54860 - DNA, 20 bp, Artificial Sequence
  Description of Artificial Sequence: Synthetic oligonucleotide
  Target: ATXN1; (-) strand; PAM type: NRG; PAM sequence: CAG
gtggccctctcgaaggataa

SEQ ID NO: 54861 - DNA, 20 bp, Artificial Sequence
  Description of Artificial Sequence: Synthetic oligonucleotide
  Target: ATXN1; (-) strand; PAM type: NRG; PAM sequence: AGG
aaaatatgtggccctctcga

SEQ ID NO: 54862 - DNA, 20 bp, Artificial Sequence
  Description of Artificial Sequence: Synthetic oligonucleotide
  Target: ATXN1; (-) strand; PAM type: NRG; PAM sequence: AAG
caaaatatgtggccctctcg

SEQ ID NO: 54863 - DNA, 20 bp, Artificial Sequence
  Description of Artificial Sequence: Synthetic oligonucleotide
  Target: ATXN1; (-) strand; PAM type: NRG; PAM sequence: TGG
ctctgaaacctcaaaatatg

SEQ ID NO: 54864 - DNA, 20 bp, Artificial Sequence
  Description of Artificial Sequence: Synthetic oligonucleotide
  Target: ATXN1; (-) strand; PAM type: NRG; PAM sequence: CAG
gtgtctgatatttctcaagg

SEQ ID NO: 54865 - DNA, 20 bp, Artificial Sequence
  Description of Artificial Sequence: Synthetic oligonucleotide
  Target: ATXN1; (-) strand; PAM type: NRG; PAM sequence: AGG
tgagtgtctgatatttctca

SEQ ID NO: 54866 - DNA, 20 bp, Artificial Sequence
  Description of Artificial Sequence: Synthetic oligonucleotide
  Target: ATXN1; (-) strand; PAM type: NRG; PAM sequence: AAG
ttgagtgtctgatatttctc

SEQ ID NO: 54867 - DNA, 20 bp, Artificial Sequence
  Description of Artificial Sequence: Synthetic oligonucleotide
  Target: ATXN1; (-) strand; PAM type: NRG; PAM sequence: GAG
agtgtgtcgccggagtactt

SEQ ID NO: 54868 - DNA, 20 bp, Artificial Sequence
  Description of Artificial Sequence: Synthetic oligonucleotide
  Target: ATXN1; (-) strand; PAM type: NRG; PAM sequence: GAG
atttgctcagtgtgtcgccg

SEQ ID NO: 54869 - DNA, 20 bp, Artificial Sequence
  Description of Artificial Sequence: Synthetic oligonucleotide
  Target: ATXN1; (-) strand; PAM type: NRG; PAM sequence: CGG
acatttgctcagtgtgtcgc

SEQ ID NO: 54870 - DNA, 20 bp, Artificial Sequence
  Description of Artificial Sequence: Synthetic oligonucleotide
  Target: ATXN1; (-) strand; PAM type: NRG; PAM sequence: CAG
tgctggcaaaaacatttgct

SEQ ID NO: 54871 - DNA, 20 bp, Artificial Sequence
  Description of Artificial Sequence: Synthetic oligonucleotide
  Target: ATXN1; (-) strand; PAM type: NRG; PAM sequence: TGG
acccacctatatctttctgc

SEQ ID NO: 54872 - DNA, 20 bp, Artificial Sequence
  Description of Artificial Sequence: Synthetic oligonucleotide
  Target: ATXN1; (-) strand; PAM type: NRG; PAM sequence: CGG
cctctccctcacctgcgcca

SEQ ID NO: 54873 - DNA, 20 bp, Artificial Sequence
  Description of Artificial Sequence: Synthetic oligonucleotide
  Target: ATXN1; (-) strand; PAM type: NRG; PAM sequence: CAG
gaaagtgcgcttactgtgca

SEQ ID NO: 54874 - DNA, 20 bp, Artificial Sequence
  Description of Artificial Sequence: Synthetic oligonucleotide
  Target: ATXN1; (-) strand; PAM type: NRG; PAM sequence: AAG
caggatgtctggagaagaga

SEQ ID NO: 54875 - DNA, 20 bp, Artificial Sequence
  Description of Artificial Sequence: Synthetic oligonucleotide
  Target: ATXN1; (-) strand; PAM type: NRG; PAM sequence: GAG
gcaccaggatgtctggagaa

SEQ ID NO: 54876 - DNA, 20 bp, Artificial Sequence
  Description of Artificial Sequence: Synthetic oligonucleotide
  Target: ATXN1; (-) strand; PAM type: NRG; PAM sequence: AAG
tggcaccaggatgtctggag

SEQ ID NO: 54877 - DNA, 20 bp, Artificial Sequence
  Description of Artificial Sequence: Synthetic oligonucleotide
  Target: ATXN1; (-) strand; PAM type: NRG; PAM sequence: GAG
ctgtggcaccaggatgtctg

SEQ ID NO: 54878 - DNA, 20 bp, Artificial Sequence
  Description of Artificial Sequence: Synthetic oligonucleotide
  Target: ATXN1; (-) strand; PAM type: NRG; PAM sequence: TGG
tactgtggcaccaggatgtc

SEQ ID NO: 54879 - DNA, 20 bp, Artificial Sequence
  Description of Artificial Sequence: Synthetic oligonucleotide
  Target: ATXN1; (-) strand; PAM type: NRG; PAM sequence: AGG
atgggaactactgtggcacc

SEQ ID NO: 54880 - DNA, 20 bp, Artificial Sequence
  Description of Artificial Sequence: Synthetic oligonucleotide
  Target: ATXN1; (-) strand; PAM type: NRG; PAM sequence: CAG
aatgggaactactgtggcac

SEQ ID NO: 54881 - DNA, 20 bp, Artificial Sequence
  Description of Artificial Sequence: Synthetic oligonucleotide
  Target: ATXN1; (-) strand; PAM type: NRG; PAM sequence: TGG
agagagaatgggaactactg

SEQ ID NO: 54882 - DNA, 20 bp, Artificial Sequence
  Description of Artificial Sequence: Synthetic oligonucleotide
  Target: ATXN1; (-) strand; PAM type: NRG; PAM sequence: GGG
tacagaagaggagagagaat

SEQ ID NO: 54883 - DNA, 20 bp, Artificial Sequence
  Description of Artificial Sequence: Synthetic oligonucleotide
  Target: ATXN1; (-) strand; PAM type: NRG; PAM sequence: TGG
ttacagaagaggagagagaa

SEQ ID NO: 54884 - DNA, 20 bp, Artificial Sequence
  Description of Artificial Sequence: Synthetic oligonucleotide
  Target: ATXN1; (-) strand; PAM type: NRG; PAM sequence: GAG
agaagttacagaagaggaga

SEQ ID NO: 54885 - DNA, 20 bp, Artificial Sequence
  Description of Artificial Sequence: Synthetic oligonucleotide
  Target: ATXN1; (-) strand; PAM type: NRG; PAM sequence: GAG
ttagaagttacagaagagga

SEQ ID NO: 54886 - DNA, 20 bp, Artificial Sequence
  Description of Artificial Sequence: Synthetic oligonucleotide
  Target: ATXN1; (-) strand; PAM type: NRG; PAM sequence: GAG
tcttagaagttacagaagag

SEQ ID NO: 54887 - DNA, 20 bp, Artificial Sequence
  Description of Artificial Sequence: Synthetic oligonucleotide
  Target: ATXN1; (-) strand; PAM type: NRG; PAM sequence: AGG
ggtcttagaagttacagaag

SEQ ID NO: 54888 - DNA, 20 bp, Artificial Sequence
  Description of Artificial Sequence: Synthetic oligonucleotide
  Target: ATXN1; (-) strand; PAM type: NRG; PAM sequence: GAG
aggtcttagaagttacagaa

SEQ ID NO: 54889 - DNA, 20 bp, Artificial Sequence
  Description of Artificial Sequence: Synthetic oligonucleotide
  Target: ATXN1; (-) strand; PAM type: NRG; PAM sequence: AAG
aaaggtcttagaagttacag

SEQ ID NO: 54890 - DNA, 20 bp, Artificial Sequence
  Description of Artificial Sequence: Synthetic oligonucleotide
  Target: ATXN1; (-) strand; PAM type: NRG; PAM sequence: CAG
ggcaaaggtcttagaagtta

SEQ ID NO: 54891 - DNA, 20 bp, Artificial Sequence
  Description of Artificial Sequence: Synthetic oligonucleotide
  Target: ATXN1; (-) strand; PAM type: NRG; PAM sequence: AAG
acttaaggcaaaggtcttag

SEQ ID NO: 54892 - DNA, 20 bp, Artificial Sequence
  Description of Artificial Sequence: Synthetic oligonucleotide
  Target: ATXN1; (-) strand; PAM type: NRG; PAM sequence: TAG
ttcacttaaggcaaaggtct

SEQ ID NO: 54893 - DNA, 20 bp, Artificial Sequence
  Description of Artificial Sequence: Synthetic oligonucleotide
  Target: ATXN1; (-) strand; PAM type: NRG; PAM sequence: AGG
gatccattcacttaaggcaa

SEQ ID NO: 54894 - DNA, 20 bp, Artificial Sequence
  Description of Artificial Sequence: Synthetic oligonucleotide
  Target: ATXN1; (-) strand; PAM type: NRG; PAM sequence: AAG
ggatccattcacttaaggca

SEQ ID NO: 54895 - DNA, 20 bp, Artificial Sequence
  Description of Artificial Sequence: Synthetic oligonucleotide
  Target: ATXN1; (-) strand; PAM type: NRG; PAM sequence: AGG
taggaggatccattcactta

SEQ ID NO: 54896 - DNA, 20 bp, Artificial Sequence
  Description of Artificial Sequence: Synthetic oligonucleotide
  Target: ATXN1; (-) strand; PAM type: NRG; PAM sequence: AAG
ttaggaggatccattcactt

SEQ ID NO: 54897 - DNA, 20 bp, Artificial Sequence
  Description of Artificial Sequence: Synthetic oligonucleotide
  Target: ATXN1; (-) strand; PAM type: NRG; PAM sequence: AGG
gcagttatggctgtcttagg

SEQ ID NO: 54898 - DNA, 20 bp, Artificial Sequence
  Description of Artificial Sequence: Synthetic oligonucleotide
  Target: ATXN1; (-) strand; PAM type: NRG; PAM sequence: GAG
tgcagttatggctgtcttag

SEQ ID NO: 54899 - DNA, 20 bp, Artificial Sequence
  Description of Artificial Sequence: Synthetic oligonucleotide
  Target: ATXN1; (-) strand; PAM type: NRG; PAM sequence: AGG
aatgcagttatggctgtctt

SEQ ID NO: 54900 - DNA, 20 bp, Artificial Sequence
  Description of Artificial Sequence: Synthetic oligonucleotide
  Target: ATXN1; (-) strand; PAM type: NRG; PAM sequence: TAG
aaatgcagttatggctgtct

SEQ ID NO: 54901 - DNA, 20 bp, Artificial Sequence
  Description of Artificial Sequence: Synthetic oligonucleotide
  Target: ATXN1; (-) strand; PAM type: NRG; PAM sequence: TGG
gacgtaaataaatgcagtta

SEQ ID NO: 54902 - DNA, 20 bp, Artificial Sequence
  Description of Artificial Sequence: Synthetic oligonucleotide
  Target: ATXN1; (-) strand; PAM type: NRG; PAM sequence: CAG
agcagggacgtaaataaatg

SEQ ID NO: 54903 - DNA, 20 bp, Artificial Sequence
  Description of Artificial Sequence: Synthetic oligonucleotide
  Target: ATXN1; (-) strand; PAM type: NRG; PAM sequence: GGG
acttttcaagtcaaagagca

SEQ ID NO: 54904 - DNA, 20 bp, Artificial Sequence
  Description of Artificial Sequence: Synthetic oligonucleotide
  Target: ATXN1; (-) strand; PAM type: NRG; PAM sequence: AGG
aacttttcaagtcaaagagc

SEQ ID NO: 54905 - DNA, 20 bp, Artificial Sequence
  Description of Artificial Sequence: Synthetic oligonucleotide
  Target: ATXN1; (-) strand; PAM type: NRG; PAM sequence: CAG
gaacttttcaagtcaaagag

SEQ ID NO: 54906 - DNA, 20 bp, Artificial Sequence
  Description of Artificial Sequence: Synthetic oligonucleotide
  Target: ATXN1; (-) strand; PAM type: NRG; PAM sequence: GAG
ggtgaacttttcaagtcaaa

SEQ ID NO: 54907 - DNA, 20 bp, Artificial Sequence
  Description of Artificial Sequence: Synthetic oligonucleotide
  Target: ATXN1; (-) strand; PAM type: NRG; PAM sequence: AAG
agggtgaacttttcaagtca

SEQ ID NO: 54908 - DNA, 20 bp, Artificial Sequence
  Description of Artificial Sequence: Synthetic oligonucleotide
  Target: ATXN1; (-) strand; PAM type: NRG; PAM sequence: AAG
caagaaagggtgaacttttc

SEQ ID NO: 54909 - DNA, 20 bp, Artificial Sequence
  Description of Artificial Sequence: Synthetic oligonucleotide
  Target: ATXN1; (-) strand; PAM type: NRG; PAM sequence: GGG
aagtctctctctccaagaaa

SEQ ID NO: 54910 - DNA, 20 bp, Artificial Sequence
  Description of Artificial Sequence: Synthetic oligonucleotide
  Target: ATXN1; (-) strand; PAM type: NRG; PAM sequence: AGG
caagtctctctctccaagaa

SEQ ID NO: 54911 - DNA, 20 bp, Artificial Sequence
  Description of Artificial Sequence: Synthetic oligonucleotide
  Target: ATXN1; (-) strand; PAM type: NRG; PAM sequence: AAG
ccaagtctctctctccaaga

SEQ ID NO: 54912 - DNA, 20 bp, Artificial Sequence
  Description of Artificial Sequence: Synthetic oligonucleotide
  Target: ATXN1; (-) strand; PAM type: NRG; PAM sequence: AAG
ttttccaagtctctctctcc

SEQ ID NO: 54913 - DNA, 20 bp, Artificial Sequence
  Description of Artificial Sequence: Synthetic oligonucleotide
  Target: ATXN1; (-) strand; PAM type: NRG; PAM sequence: AAG
ccttcatgcctctcttttcc

SEQ ID NO: 54914 - DNA, 20 bp, Artificial Sequence
  Description of Artificial Sequence: Synthetic oligonucleotide
  Target: ATXN1; (-) strand; PAM type: NRG; PAM sequence: GAG
aggcagaattgccagggctt

SEQ ID NO: 54915 - DNA, 20 bp, Artificial Sequence
  Description of Artificial Sequence: Synthetic oligonucleotide
  Target: ATXN1; (-) strand; PAM type: NRG; PAM sequence: GGG
tcactgaggcagaattgcca

SEQ ID NO: 54916 - DNA, 20 bp, Artificial Sequence
  Description of Artificial Sequence: Synthetic oligonucleotide
  Target: ATXN1; (-) strand; PAM type: NRG; PAM sequence: AGG
ttcactgaggcagaattgcc

SEQ ID NO: 54917 - DNA, 20 bp, Artificial Sequence
  Description of Artificial Sequence: Synthetic oligonucleotide
  Target: ATXN1; (-) strand; PAM type: NRG; PAM sequence: CAG
attcactgaggcagaattgc

SEQ ID NO: 54918 - DNA, 20 bp, Artificial Sequence
  Description of Artificial Sequence: Synthetic oligonucleotide
  Target: ATXN1; (-) strand; PAM type: NRG; PAM sequence: CAG
agaagtcggattcactgagg

SEQ ID NO: 54919 - DNA, 20 bp, Artificial Sequence
  Description of Artificial Sequence: Synthetic oligonucleotide
  Target: ATXN1; (-) strand; PAM type: NRG; PAM sequence: AGG
ggtagaagtcggattcactg

SEQ ID NO: 54920 - DNA, 20 bp, Artificial Sequence
  Description of Artificial Sequence: Synthetic oligonucleotide
  Target: ATXN1; (-) strand; PAM type: NRG; PAM sequence: GAG
aggtagaagtcggattcact

SEQ ID NO: 54921 - DNA, 20 bp, Artificial Sequence
  Description of Artificial Sequence: Synthetic oligonucleotide
  Target: ATXN1; (-) strand; PAM type: NRG; PAM sequence: CGG
ttcactgtggaggtagaagt

SEQ ID NO: 54922 - DNA, 20 bp, Artificial Sequence
  Description of Artificial Sequence: Synthetic oligonucleotide
  Target: ATXN1; (-) strand; PAM type: NRG; PAM sequence: AAG
agatttcactgtggaggtag

SEQ ID NO: 54923 - DNA, 20 bp, Artificial Sequence
  Description of Artificial Sequence: Synthetic oligonucleotide
  Target: ATXN1; (-) strand; PAM type: NRG; PAM sequence: TAG
gggagatttcactgtggagg

SEQ ID NO: 54924 - DNA, 20 bp, Artificial Sequence
  Description of Artificial Sequence: Synthetic oligonucleotide
  Target: ATXN1; (-) strand; PAM type: NRG; PAM sequence: AGG
ctagggagatttcactgtgg

SEQ ID NO: 54925 - DNA, 20 bp, Artificial Sequence
  Description of Artificial Sequence: Synthetic oligonucleotide
  Target: ATXN1; (-) strand; PAM type: NRG; PAM sequence: GAG
gctagggagatttcactgtg

SEQ ID NO: 54926 - DNA, 20 bp, Artificial Sequence
  Description of Artificial Sequence: Synthetic oligonucleotide
  Target: ATXN1; (-) strand; PAM type: NRG; PAM sequence: TGG
tagctagggagatttcactg

SEQ ID NO: 54927 - DNA, 20 bp, Artificial Sequence
  Description of Artificial Sequence: Synthetic oligonucleotide
  Target: ATXN1; (-) strand; PAM type: NRG; PAM sequence: GAG
ctgcccctcaactagctagg

SEQ ID NO: 54928 - DNA, 20 bp, Artificial Sequence
  Description of Artificial Sequence: Synthetic oligonucleotide
  Target: ATXN1; (-) strand; PAM type: NRG; PAM sequence: GGG
tgctgcccctcaactagcta

SEQ ID NO: 54929 - DNA, 20 bp, Artificial Sequence
  Description of Artificial Sequence: Synthetic oligonucleotide
  Target: ATXN1; (-) strand; PAM type: NRG; PAM sequence: AGG
ctgctgcccctcaactagct

SEQ ID NO: 54930 - DNA, 20 bp, Artificial Sequence
  Description of Artificial Sequence: Synthetic oligonucleotide
  Target: ATXN1; (-) strand; PAM type: NRG; PAM sequence: TAG
actgctgcccctcaactagc

SEQ ID NO: 54931 - DNA, 20 bp, Artificial Sequence
  Description of Artificial Sequence: Synthetic oligonucleotide
  Target: ATXN1; (-) strand; PAM type: NRG; PAM sequence: TAG
taatactgctgcccctcaac

SEQ ID NO: 54932 - DNA, 20 bp, Artificial Sequence
  Description of Artificial Sequence: Synthetic oligonucleotide
  Target: ATXN1; (-) strand; PAM type: NRG; PAM sequence: AGG
ttgcttgacaactcttagga

SEQ ID NO: 54933 - DNA, 20 bp, Artificial Sequence
  Description of Artificial Sequence: Synthetic oligonucleotide
  Target: ATXN1; (-) strand; PAM type: NRG; PAM sequence: AAG
tttgcttgacaactcttagg

SEQ ID NO: 54934 - DNA, 20 bp, Artificial Sequence
  Description of Artificial Sequence: Synthetic oligonucleotide
  Target: ATXN1; (-) strand; PAM type: NRG; PAM sequence: AGG
tgatttgcttgacaactctt

SEQ ID NO: 54935 - DNA, 20 bp, Artificial Sequence
  Description of Artificial Sequence: Synthetic oligonucleotide
  Target: ATXN1; (-) strand; PAM type: NRG; PAM sequence: TAG
ttgatttgcttgacaactct

SEQ ID NO: 54936 - DNA, 20 bp, Artificial Sequence
  Description of Artificial Sequence: Synthetic oligonucleotide
  Target: ATXN1; (-) strand; PAM type: NRG; PAM sequence: AGG
ttgggtggattccagttctc

SEQ ID NO: 54937 - DNA, 20 bp, Artificial Sequence
  Description of Artificial Sequence: Synthetic oligonucleotide
  Target: ATXN1; (-) strand; PAM type: NRG; PAM sequence: CAG
cttgggtggattccagttct

SEQ ID NO: 54938 - DNA, 20 bp, Artificial Sequence
  Description of Artificial Sequence: Synthetic oligonucleotide
  Target: ATXN1; (-) strand; PAM type: NRG; PAM sequence: CAG
ggtgtgtcttgggtggattc

SEQ ID NO: 54939 - DNA, 20 bp, Artificial Sequence
  Description of Artificial Sequence: Synthetic oligonucleotide
  Target: ATXN1; (-) strand; PAM type: NRG; PAM sequence: TGG
aggcataggtgtgtcttggg

SEQ ID NO: 54940 - DNA, 20 bp, Artificial Sequence
  Description of Artificial Sequence: Synthetic oligonucleotide
  Target: ATXN1; (-) strand; PAM type: NRG; PAM sequence: GGG
aaaaggcataggtgtgtctt

SEQ ID NO: 54941 - DNA, 20 bp, Artificial Sequence
  Description of Artificial Sequence: Synthetic oligonucleotide
  Target: ATXN1; (-) strand; PAM type: NRG; PAM sequence: TGG
taaaaggcataggtgtgtct

SEQ ID NO: 54942 - DNA, 20 bp, Artificial Sequence
  Description of Artificial Sequence: Synthetic oligonucleotide
  Target: ATXN1; (-) strand; PAM type: NRG; PAM sequence: AGG
atctttattgtaaaaggcat

SEQ ID NO: 54943 - DNA, 20 bp, Artificial Sequence
  Description of Artificial Sequence: Synthetic oligonucleotide
  Target: ATXN1; (-) strand; PAM type: NRG; PAM sequence: TAG
aatctttattgtaaaaggca

SEQ ID NO: 54944 - DNA, 20 bp, Artificial Sequence
  Description of Artificial Sequence: Synthetic oligonucleotide
  Target: ATXN1; (-) strand; PAM type: NRG; PAM sequence: AGG
cactgaatctttattgtaaa

SEQ ID NO: 54945 - DNA, 20 bp, Artificial Sequence
  Description of Artificial Sequence: Synthetic oligonucleotide
  Target: ATXN1; (-) strand; PAM type: NRG; PAM sequence: AAG
tcactgaatctttattgtaa

SEQ ID NO: 54946 - DNA, 20 bp, Artificial Sequence
  Description of Artificial Sequence: Synthetic oligonucleotide
  Target: ATXN1; (-) strand; PAM type: NRG; PAM sequence: AGG
aggaggctgttgtgaagggc

SEQ ID NO: 54947 - DNA, 20 bp, Artificial Sequence
  Description of Artificial Sequence: Synthetic oligonucleotide
  Target: ATXN1; (-) strand; PAM type: NRG; PAM sequence: CAG
gaggaggctgttgtgaaggg

SEQ ID NO: 54948 - DNA, 20 bp, Artificial Sequence
  Description of Artificial Sequence: Synthetic oligonucleotide
  Target: ATXN1; (-) strand; PAM type: NRG; PAM sequence: GGG
cttgaggaggctgttgtgaa

SEQ ID NO: 54949 - DNA, 20 bp, Artificial Sequence
  Description of Artificial Sequence: Synthetic oligonucleotide
  Target: ATXN1; (-) strand; PAM type: NRG; PAM sequence: AGG
acttgaggaggctgttgtga

SEQ ID NO: 54950 - DNA, 20 bp, Artificial Sequence
  Description of Artificial Sequence: Synthetic oligonucleotide
  Target: ATXN1; (-) strand; PAM type: NRG; PAM sequence: AAG
tacttgaggaggctgttgtg

SEQ ID NO: 54951 - DNA, 20 bp, Artificial Sequence
  Description of Artificial Sequence: Synthetic oligonucleotide
  Target: ATXN1; (-) strand; PAM type: NRG; PAM sequence: AGG
agcgttttccctacttgagg

SEQ ID NO: 54952 - DNA, 20 bp, Artificial Sequence
  Description of Artificial Sequence: Synthetic oligonucleotide
  Target: ATXN1; (-) strand; PAM type: NRG; PAM sequence: GAG
tagcgttttccctacttgag

SEQ ID NO: 54953 - DNA, 20 bp, Artificial Sequence
  Description of Artificial Sequence: Synthetic oligonucleotide
  Target: ATXN1; (-) strand; PAM type: NRG; PAM sequence: AGG
tgtagcgttttccctacttg

SEQ ID NO: 54954 - DNA, 20 bp, Artificial Sequence
  Description of Artificial Sequence: Synthetic oligonucleotide
  Target: ATXN1; (-) strand; PAM type: NRG; PAM sequence: GAG
ttgtagcgttttccctactt

SEQ ID NO: 54955 - DNA, 20 bp, Artificial Sequence
  Description of Artificial Sequence: Synthetic oligonucleotide
  Target: ATXN1; (-) strand; PAM type: NRG; PAM sequence: TAG
tgtcatgtatccattttttg

SEQ ID NO: 54956 - DNA, 20 bp, Artificial Sequence
  Description of Artificial Sequence: Synthetic oligonucleotide
  Target: ATXN1; (-) strand; PAM type: NRG; PAM sequence: TGG
tctgtgggtgaaggagttcc

SEQ ID NO: 54957 - DNA, 20 bp, Artificial Sequence
  Description of Artificial Sequence: Synthetic oligonucleotide
  Target: ATXN1; (-) strand; PAM type: NRG; PAM sequence: GAG
acatctctctgtgggtgaag

SEQ ID NO: 54958 - DNA, 20 bp, Artificial Sequence
  Description of Artificial Sequence: Synthetic oligonucleotide
  Target: ATXN1; (-) strand; PAM type: NRG; PAM sequence: AGG
aaacatctctctgtgggtga

SEQ ID NO: 54959 - DNA, 20 bp, Artificial Sequence
  Description of Artificial Sequence: Synthetic oligonucleotide
  Target: ATXN1; (-) strand; PAM type: NRG; PAM sequence: AAG
gaaacatctctctgtgggtg

SEQ ID NO: 54960 - DNA, 20 bp, Artificial Sequence
  Description of Artificial Sequence: Synthetic oligonucleotide
  Target: ATXN1; (-) strand; PAM type: NRG; PAM sequence: GGG
tcaaagaaacatctctctgt

SEQ ID NO: 54961 - DNA, 20 bp, Artificial Sequence
  Description of Artificial Sequence: Synthetic oligonucleotide
  Target: ATXN1; (-) strand; PAM type: NRG; PAM sequence: TGG
atcaaagaaacatctctctg

SEQ ID NO: 54962 - DNA, 20 bp, Artificial Sequence
  Description of Artificial Sequence: Synthetic oligonucleotide
  Target: ATXN1; (-) strand; PAM type: NRG; PAM sequence: AAG
ggcagagataaggcagatca

SEQ ID NO: 54963 - DNA, 20 bp, Artificial Sequence
  Description of Artificial Sequence: Synthetic oligonucleotide
  Target: ATXN1; (-) strand; PAM type: NRG; PAM sequence: CAG
aacagatggcagagataagg

SEQ ID NO: 54964 - DNA, 20 bp, Artificial Sequence
  Description of Artificial Sequence: Synthetic oligonucleotide
  Target: ATXN1; (-) strand; PAM type: NRG; PAM sequence: AGG
gaaaacagatggcagagata

SEQ ID NO: 54965 - DNA, 20 bp, Artificial Sequence
  Description of Artificial Sequence: Synthetic oligonucleotide
  Target: ATXN1; (-) strand; PAM type: NRG; PAM sequence: AAG
ggaaaacagatggcagagat

SEQ ID NO: 54966 - DNA, 20 bp, Artificial Sequence
  Description of Artificial Sequence: Synthetic oligonucleotide
  Target: ATXN1; (-) strand; PAM type: NRG; PAM sequence: GAG
ggttgggaaaacagatggca

SEQ ID NO: 54967 - DNA, 20 bp, Artificial Sequence
  Description of Artificial Sequence: Synthetic oligonucleotide
  Target: ATXN1; (-) strand; PAM type: NRG; PAM sequence: CAG
caggttgggaaaacagatgg

SEQ ID NO: 54968 - DNA, 20 bp, Artificial Sequence
  Description of Artificial Sequence: Synthetic oligonucleotide
  Target: ATXN1; (-) strand; PAM type: NRG; PAM sequence: TGG
gcccaggttgggaaaacaga

SEQ ID NO: 54969 - DNA, 20 bp, Artificial Sequence
  Description of Artificial Sequence: Synthetic oligonucleotide
  Target: ATXN1; (-) strand; PAM type: NRG; PAM sequence: CAG
attggcccaggttgggaaaa

SEQ ID NO: 54970 - DNA, 20 bp, Artificial Sequence
  Description of Artificial Sequence: Synthetic oligonucleotide
  Target: ATXN1; (-) strand; PAM type: NRG; PAM sequence: GGG
agaccacattggcccaggtt

SEQ ID NO: 54971 - DNA, 20 bp, Artificial Sequence
  Description of Artificial Sequence: Synthetic oligonucleotide
  Target: ATXN1; (-) strand; PAM type: NRG; PAM sequence: TGG
tagaccacattggcccaggt

SEQ ID NO: 54972 - DNA, 20 bp, Artificial Sequence
  Description of Artificial Sequence: Synthetic oligonucleotide
  Target: ATXN1; (-) strand; PAM type: NRG; PAM sequence: AGG
aaattagaccacattggccc

SEQ ID NO: 54973 - DNA, 20 bp, Artificial Sequence
  Description of Artificial Sequence: Synthetic oligonucleotide
  Target: ATXN1; (-) strand; PAM type: NRG; PAM sequence: CAG
gaaattagaccacattggcc

SEQ ID NO: 54974 - DNA, 20 bp, Artificial Sequence
  Description of Artificial Sequence: Synthetic oligonucleotide
  Target: ATXN1; (-) strand; PAM type: NRG; PAM sequence: TGG
gaactgaaattagaccacat

SEQ ID NO: 54975 - DNA, 20 bp, Artificial Sequence
  Description of Artificial Sequence: Synthetic oligonucleotide
  Target: ATXN1; (-) strand; PAM type: NRG; PAM sequence: TAG
aaatatgaaagaactgaaat

SEQ ID NO: 54976 - DNA, 20 bp, Artificial Sequence
  Description of Artificial Sequence: Synthetic oligonucleotide
  Target: ATXN1; (-) strand; PAM type: NRG; PAM sequence: AAG
tctgacttgtgaaaatatga

SEQ ID NO: 54977 - DNA, 20 bp, Artificial Sequence
  Description of Artificial Sequence: Synthetic oligonucleotide
  Target: ATXN1; (-) strand; PAM type: NRG; PAM sequence: TGG
tagtaaacctttaagattcc

SEQ ID NO: 54978 - DNA, 20 bp, Artificial Sequence
  Description of Artificial Sequence: Synthetic oligonucleotide
  Target: ATXN1; (-) strand; PAM type: NRG; PAM sequence: AAG
cttttcagtagtaaaccttt

SEQ ID NO: 54979 - DNA, 20 bp, Artificial Sequence
  Description of Artificial Sequence: Synthetic oligonucleotide
  Target: ATXN1; (-) strand; PAM type: NRG; PAM sequence: TAG
gaaaataaagtgcttttcag

SEQ ID NO: 54980 - DNA, 20 bp, Artificial Sequence
  Description of Artificial Sequence: Synthetic oligonucleotide
  Target: ATXN1; (-) strand; PAM type: NRG; PAM sequence: CAG
actgaaaataaagtgctttt

SEQ ID NO: 54981 - DNA, 20 bp, Artificial Sequence
  Description of Artificial Sequence: Synthetic oligonucleotide
  Target: ATXN1; (-) strand; PAM type: NRG; PAM sequence: AAG
aaagcaccttactgaaaata

SEQ ID NO: 54982 - DNA, 20 bp, Artificial Sequence
  Description of Artificial Sequence: Synthetic oligonucleotide
  Target: ATXN1; (-) strand; PAM type: NRG; PAM sequence: AAG
tatgacaattctatttttta

SEQ ID NO: 54983 - DNA, 20 bp, Artificial Sequence
  Description of Artificial Sequence: Synthetic oligonucleotide
  Target: ATXN1; (-) strand; PAM type: NRG; PAM sequence: CAG
atttcttacctgaatcagat

SEQ ID NO: 54984 - DNA, 20 bp, Artificial Sequence
  Description of Artificial Sequence: Synthetic oligonucleotide
  Target: ATXN1; (-) strand; PAM type: NRG; PAM sequence: CAG
ctgaaatttcttacctgaat

SEQ ID NO: 54985 - DNA, 20 bp, Artificial Sequence
  Description of Artificial Sequence: Synthetic oligonucleotide
  Target: ATXN1; (-) strand; PAM type: NRG; PAM sequence: GAG
tttatgaaaaatgaattcta

SEQ ID NO: 54986 - DNA, 20 bp, Artificial Sequence
  Description of Artificial Sequence: Synthetic oligonucleotide
  Target: ATXN1; (-) strand; PAM type: NRG; PAM sequence: TAG
cctttatgaaaaatgaattc

SEQ ID NO: 54987 - DNA, 20 bp, Artificial Sequence
  Description of Artificial Sequence: Synthetic oligonucleotide
  Target: ATXN1; (-) strand; PAM type: NRG; PAM sequence: TGG
ataaagactccccctacccc

SEQ ID NO: 54988 - DNA, 20 bp, Artificial Sequence
  Description of Artificial Sequence: Synthetic oligonucleotide
  Target: ATXN1; (-) strand; PAM type: NRG; PAM sequence: AAG
gagagaggtgtgtgattata

SEQ ID NO: 54989 - DNA, 20 bp, Artificial Sequence
  Description of Artificial Sequence: Synthetic oligonucleotide
  Target: ATXN1; (-) strand; PAM type: NRG; PAM sequence: AGG
agtgaaatgtattcagagag

SEQ ID NO: 54990 - DNA, 20 bp, Artificial Sequence
  Description of Artificial Sequence: Synthetic oligonucleotide
  Target: ATXN1; (-) strand; PAM type: NRG; PAM sequence: GAG
aagtgaaatgtattcagaga

SEQ ID NO: 54991 - DNA, 20 bp, Artificial Sequence
  Description of Artificial Sequence: Synthetic oligonucleotide
  Target: ATXN1; (-) strand; PAM type: NRG; PAM sequence: GAG
acaagtgaaatgtattcaga

SEQ ID NO: 54992 - DNA, 20 bp, Artificial Sequence
  Description of Artificial Sequence: Synthetic oligonucleotide
  Target: ATXN1; (-) strand; PAM type: NRG; PAM sequence: GAG
taacaagtgaaatgtattca

SEQ ID NO: 54993 - DNA, 20 bp, Artificial Sequence
  Description of Artificial Sequence: Synthetic oligonucleotide
  Target: ATXN1; (-) strand; PAM type: NRG; PAM sequence: CAG
gctaacaagtgaaatgtatt

SEQ ID NO: 54994 - DNA, 20 bp, Artificial Sequence
  Description of Artificial Sequence: Synthetic oligonucleotide
  Target: ATXN1; (-) strand; PAM type: NRG; PAM sequence: AAG
tttcagacctgatggctaac

SEQ ID NO: 54995 - DNA, 20 bp, Artificial Sequence
  Description of Artificial Sequence: Synthetic oligonucleotide
  Target: ATXN1; (-) strand; PAM type: NRG; PAM sequence: TGG
actacagttttcagacctga

SEQ ID NO: 54996 - DNA, 20 bp, Artificial Sequence
  Description of Artificial Sequence: Synthetic oligonucleotide
  Target: ATXN1; (-) strand; PAM type: NRG; PAM sequence: CAG
agagccagcactacagtttt

SEQ ID NO: 54997 - DNA, 20 bp, Artificial Sequence
  Description of Artificial Sequence: Synthetic oligonucleotide
  Target: ATXN1; (-) strand; PAM type: NRG; PAM sequence: CAG
actgaacagagccagcacta

SEQ ID NO: 54998 - DNA, 20 bp, Artificial Sequence
  Description of Artificial Sequence: Synthetic oligonucleotide
  Target: ATXN1; (-) strand; PAM type: NRG; PAM sequence: CAG
gaacaataactgaacagagc

SEQ ID NO: 54999 - DNA, 20 bp, Artificial Sequence
  Description of Artificial Sequence: Synthetic oligonucleotide
  Target: ATXN1; (-) strand; PAM type: NRG; PAM sequence: GAG
acttgaacaataactgaaca

SEQ ID NO: 55000 - DNA, 20 bp, Artificial Sequence
  Description of Artificial Sequence: Synthetic oligonucleotide
  Target: ATXN1; (-) strand; PAM type: NRG; PAM sequence: CAG
acacttgaacaataactgaa

SEQ ID NO: 55001 - DNA, 20 bp, Artificial Sequence
  Description of Artificial Sequence: Synthetic oligonucleotide
  Target: ATXN1; (-) strand; PAM type: NRG; PAM sequence: GAG
agaagaatttcagggtcgtt

SEQ ID NO: 55002 - DNA, 20 bp, Artificial Sequence
  Description of Artificial Sequence: Synthetic oligonucleotide
  Target: ATXN1; (-) strand; PAM type: NRG; PAM sequence: GGG
aatgacaaagaagaatttca

SEQ ID NO: 55003 - DNA, 20 bp, Artificial Sequence
  Description of Artificial Sequence: Synthetic oligonucleotide
  Target: ATXN1; (-) strand; PAM type: NRG; PAM sequence: AGG
aaatgacaaagaagaatttc

SEQ ID NO: 55004 - DNA, 20 bp, Artificial Sequence
  Description of Artificial Sequence: Synthetic oligonucleotide
  Target: ATXN1; (-) strand; PAM type: NRG; PAM sequence: CAG
aaaatgacaaagaagaattt

SEQ ID NO: 55005 - DNA, 20 bp, Artificial Sequence
  Description of Artificial Sequence: Synthetic oligonucleotide
  Target: ATXN1; (-) strand; PAM type: NRG; PAM sequence: AAG
cctgatgcaaaatgacaaag

SEQ ID NO: 55006 - DNA, 20 bp, Artificial Sequence
  Description of Artificial Sequence: Synthetic oligonucleotide
  Target: ATXN1; (-) strand; PAM type: NRG; PAM sequence: AAG
cagcctgatgcaaaatgaca

SEQ ID NO: 55007 - DNA, 20 bp, Artificial Sequence
  Description of Artificial Sequence: Synthetic oligonucleotide
  Target: ATXN1; (-) strand; PAM type: NRG; PAM sequence: CAG
caaagtgaaatcatgaaaaa

SEQ ID NO: 55008 - DNA, 20 bp, Artificial Sequence
  Description of Artificial Sequence: Synthetic oligonucleotide
  Target: ATXN1; (-) strand; PAM type: NRG; PAM sequence: AAG
aggccgtgaggatgggaaca

SEQ ID NO: 55009 - DNA, 20 bp, Artificial Sequence
  Description of Artificial Sequence: Synthetic oligonucleotide
  Target: ATXN1; (-) strand; PAM type: NRG; PAM sequence: GGG
tagtagaaggccgtgaggat

SEQ ID NO: 55010 - DNA, 20 bp, Artificial Sequence
  Description of Artificial Sequence: Synthetic oligonucleotide
  Target: ATXN1; (-) strand; PAM type: NRG; PAM sequence: TGG
gtagtagaaggccgtgagga

SEQ ID NO: 55011 - DNA, 20 bp, Artificial Sequence
  Description of Artificial Sequence: Synthetic oligonucleotide
  Target: ATXN1; (-) strand; PAM type: NRG; PAM sequence: AGG
ttgcgtagtagaaggccgtg

SEQ ID NO: 55012 - DNA, 20 bp, Artificial Sequence
  Description of Artificial Sequence: Synthetic oligonucleotide
  Target: ATXN1; (-) strand; PAM type: NRG; PAM sequence: GAG
cttgcgtagtagaaggccgt

SEQ ID NO: 55013 - DNA, 20 bp, Artificial Sequence
  Description of Artificial Sequence: Synthetic oligonucleotide
  Target: ATXN1; (-) strand; PAM type: NRG; PAM sequence: AGG
atgagaccttgcgtagtaga

SEQ ID NO: 55014 - DNA, 20 bp, Artificial Sequence
  Description of Artificial Sequence: Synthetic oligonucleotide
  Target: ATXN1; (-) strand; PAM type: NRG; PAM sequence: AAG
catgagaccttgcgtagtag

SEQ ID NO: 55015 - DNA, 20 bp, Artificial Sequence
  Description of Artificial Sequence: Synthetic oligonucleotide
  Target: ATXN1; (-) strand; PAM type: NRG; PAM sequence: TAG
tatcatgagaccttgcgtag

SEQ ID NO: 55016 - DNA, 20 bp, Artificial Sequence
  Description of Artificial Sequence: Synthetic oligonucleotide
  Target: ATXN1; (-) strand; PAM type: NRG; PAM sequence: TAG
ttatatcatgagaccttgcg

SEQ ID NO: 55017 - DNA, 20 bp, Artificial Sequence
  Description of Artificial Sequence: Synthetic oligonucleotide
  Target: ATXN1; (-) strand; PAM type: NRG; PAM sequence: GAG
ataaccttcatttatatcat

SEQ ID NO: 55018 - DNA, 20 bp, Artificial Sequence
  Description of Artificial Sequence: Synthetic oligonucleotide
  Target: ATXN1; (-) strand; PAM type: NRG; PAM sequence: AAG
ggagtgactggaaggaaaag

SEQ ID NO: 55019 - DNA, 20 bp, Artificial Sequence
  Description of Artificial Sequence: Synthetic oligonucleotide
  Target: ATXN1; (-) strand; PAM type: NRG; PAM sequence: AAG
agaggagtgactggaaggaa

SEQ ID NO: 55020 - DNA, 20 bp, Artificial Sequence
  Description of Artificial Sequence: Synthetic oligonucleotide
  Target: ATXN1; (-) strand; PAM type: NRG; PAM sequence: AGG
tgtaaagaggagtgactgga

SEQ ID NO: 55021 - DNA, 20 bp, Artificial Sequence
  Description of Artificial Sequence: Synthetic oligonucleotide
  Target: ATXN1; (-) strand; PAM type: NRG; PAM sequence: AAG
ctgtaaagaggagtgactgg

SEQ ID NO: 55022 - DNA, 20 bp, Artificial Sequence
  Description of Artificial Sequence: Synthetic oligonucleotide
  Target: ATXN1; (-) strand; PAM type: NRG; PAM sequence: TGG
tttctgtaaagaggagtgac

SEQ ID NO: 55023 - DNA, 20 bp, Artificial Sequence
  Description of Artificial Sequence: Synthetic oligonucleotide
  Target: ATXN1; (-) strand; PAM type: NRG; PAM sequence: GAG
taggagatttctgtaaagag

SEQ ID NO: 55024 - DNA, 20 bp, Artificial Sequence
  Description of Artificial Sequence: Synthetic oligonucleotide
  Target: ATXN1; (-) strand; PAM type: NRG; PAM sequence: AGG
tgtaggagatttctgtaaag

SEQ ID NO: 55025 - DNA, 20 bp, Artificial Sequence
  Description of Artificial Sequence: Synthetic oligonucleotide
  Target: ATXN1; (-) strand; PAM type: NRG; PAM sequence: GAG
atgtaggagatttctgtaaa

SEQ ID NO: 55026 - DNA, 20 bp, Artificial Sequence
  Description of Artificial Sequence: Synthetic oligonucleotide
  Target: ATXN1; (-) strand; PAM type: NRG; PAM sequence: AAG
ttatgtaggagatttctgta

SEQ ID NO: 55027 - DNA, 20 bp, Artificial Sequence
  Description of Artificial Sequence: Synthetic oligonucleotide
  Target: ATXN1; (-) strand; PAM type: NRG; PAM sequence: GAG
acagcatctcaattatgtag

SEQ ID NO: 55028 - DNA, 20 bp, Artificial Sequence
  Description of Artificial Sequence: Synthetic oligonucleotide
  Target: ATXN1; (-) strand; PAM type: NRG; PAM sequence: AGG
tgacagcatctcaattatgt

SEQ ID NO: 55029 - DNA, 20 bp, Artificial Sequence
  Description of Artificial Sequence: Synthetic oligonucleotide
  Target: ATXN1; (-) strand; PAM type: NRG; PAM sequence: TAG
atgacagcatctcaattatg

SEQ ID NO: 55030 - DNA, 20 bp, Artificial Sequence
  Description of Artificial Sequence: Synthetic oligonucleotide
  Target: ATXN1; (-) strand; PAM type: NRG; PAM sequence: CAG
gttggttgactgattgatga

SEQ ID NO: 55031 - DNA, 20 bp, Artificial Sequence
  Description of Artificial Sequence: Synthetic oligonucleotide
  Target: ATXN1; (-) strand; PAM type: NRG; PAM sequence: TGG
cccagttcagggggcttggt

SEQ ID NO: 55032 - DNA, 20 bp, Artificial Sequence
  Description of Artificial Sequence: Synthetic oligonucleotide
  Target: ATXN1; (-) strand; PAM type: NRG; PAM sequence: TGG
aggacccagttcagggggct

SEQ ID NO: 55033 - DNA, 20 bp, Artificial Sequence
  Description of Artificial Sequence: Synthetic oligonucleotide
  Target: ATXN1; (-) strand; PAM type: NRG; PAM sequence: GGG
tcacaaggacccagttcagg

SEQ ID NO: 55034 - DNA, 20 bp, Artificial Sequence
  Description of Artificial Sequence: Synthetic oligonucleotide
  Target: ATXN1; (-) strand; PAM type: NRG; PAM sequence: GGG
atcacaaggacccagttcag

SEQ ID NO: 55035 - DNA, 20 bp, Artificial Sequence
  Description of Artificial Sequence: Synthetic oligonucleotide
  Target: ATXN1; (-) strand; PAM type: NRG; PAM sequence: GGG
catcacaaggacccagttca

SEQ ID NO: 55036 - DNA, 20 bp, Artificial Sequence
  Description of Artificial Sequence: Synthetic oligonucleotide
  Target: ATXN1; (-) strand; PAM type: NRG; PAM sequence: AGG
acatcacaaggacccagttc

SEQ ID NO: 55037 - DNA, 20 bp, Artificial Sequence
  Description of Artificial Sequence: Synthetic oligonucleotide
  Target: ATXN1; (-) strand; PAM type: NRG; PAM sequence: CAG
aacatcacaaggacccagtt

SEQ ID NO: 55038 - DNA, 20 bp, Artificial Sequence
  Description of Artificial Sequence: Synthetic oligonucleotide
  Target: ATXN1; (-) strand; PAM type: NRG; PAM sequence: CAG
cctggaacatcacaaggacc

SEQ ID NO: 55039 - DNA, 20 bp, Artificial Sequence
  Description of Artificial Sequence: Synthetic oligonucleotide
  Target: ATXN1; (-) strand; PAM type: NRG; PAM sequence: AGG
taaacccctggaacatcaca

SEQ ID NO: 55040 - DNA, 20 bp, Artificial Sequence
  Description of Artificial Sequence: Synthetic oligonucleotide
  Target: ATXN1; (-) strand; PAM type: NRG; PAM sequence: AAG
ttaaacccctggaacatcac

SEQ ID NO: 55041 - DNA, 20 bp, Artificial Sequence
  Description of Artificial Sequence: Synthetic oligonucleotide
  Target: ATXN1; (-) strand; PAM type: NRG; PAM sequence: TGG
attccttgtaattaaacccc

SEQ ID NO: 55042 - DNA, 20 bp, Artificial Sequence
  Description of Artificial Sequence: Synthetic oligonucleotide
  Target: ATXN1; (-) strand; PAM type: NRG; PAM sequence: TAG
gtatctgagatgttaggagc

SEQ ID NO: 55043 - DNA, 20 bp, Artificial Sequence
  Description of Artificial Sequence: Synthetic oligonucleotide
  Target: ATXN1; (-) strand; PAM type: NRG; PAM sequence: GAG
catggtatctgagatgttag

SEQ ID NO: 55044 - DNA, 20 bp, Artificial Sequence
  Description of Artificial Sequence: Synthetic oligonucleotide
  Target: ATXN1; (-) strand; PAM type: NRG; PAM sequence: AGG
cccatggtatctgagatgtt

SEQ ID NO: 55045 - DNA, 20 bp, Artificial Sequence
  Description of Artificial Sequence: Synthetic oligonucleotide
  Target: ATXN1; (-) strand; PAM type: NRG; PAM sequence: TAG
gcccatggtatctgagatgt

SEQ ID NO: 55046 - DNA, 20 bp, Artificial Sequence
  Description of Artificial Sequence: Synthetic oligonucleotide
  Target: ATXN1; (-) strand; PAM type: NRG; PAM sequence: GAG
tcttcgagcccatggtatct

SEQ ID NO: 55047 - DNA, 20 bp, Artificial Sequence
  Description of Artificial Sequence: Synthetic oligonucleotide
  Target: ATXN1; (-) strand; PAM type: NRG; PAM sequence: TGG
gttacaagtcttcgagccca

SEQ ID NO: 55048 - DNA, 20 bp, Artificial Sequence
  Description of Artificial Sequence: Synthetic oligonucleotide
  Target: ATXN1; (-) strand; PAM type: NRG; PAM sequence: GAG
atcacatgttacaagtcttc

SEQ ID NO: 55049 - DNA, 20 bp, Artificial Sequence
  Description of Artificial Sequence: Synthetic oligonucleotide
  Target: ATXN1; (-) strand; PAM type: NRG; PAM sequence: AAG
gccctaatatcacatgttac

SEQ ID NO: 55050 - DNA, 20 bp, Artificial Sequence
  Description of Artificial Sequence: Synthetic oligonucleotide
  Target: ATXN1; (-) strand; PAM type: NRG; PAM sequence: AGG
cccaaatcccggaccagtag

SEQ ID NO: 55051 - DNA, 20 bp, Artificial Sequence
  Description of Artificial Sequence: Synthetic oligonucleotide
  Target: ATXN1; (-) strand; PAM type: NRG; PAM sequence: GAG
ccccaaatcccggaccagta

SEQ ID NO: 55052 - DNA, 20 bp, Artificial Sequence
  Description of Artificial Sequence: Synthetic oligonucleotide
  Target: ATXN1; (-) strand; PAM type: NRG; PAM sequence: TAG
aaccccaaatcccggaccag

SEQ ID NO: 55053 - DNA, 20 bp, Artificial Sequence
  Description of Artificial Sequence: Synthetic oligonucleotide
  Target: ATXN1; (-) strand; PAM type: NRG; PAM sequence: CAG
taaaaccccaaatcccggac

SEQ ID NO: 55054 - DNA, 20 bp, Artificial Sequence
  Description of Artificial Sequence: Synthetic oligonucleotide
  Target: ATXN1; (-) strand; PAM type: NRG; PAM sequence: CGG
gcccctaaaaccccaaatcc

SEQ ID NO: 55055 - DNA, 20 bp, Artificial Sequence
  Description of Artificial Sequence: Synthetic oligonucleotide
  Target: ATXN1; (-) strand; PAM type: NRG; PAM sequence: GAG
aattctctcatctgtgaaga

SEQ ID NO: 55056 - DNA, 20 bp, Artificial Sequence
  Description of Artificial Sequence: Synthetic oligonucleotide
  Target: ATXN1; (-) strand; PAM type: NRG; PAM sequence: GAG
aaaattctctcatctgtgaa

SEQ ID NO: 55057 - DNA, 20 bp, Artificial Sequence
  Description of Artificial Sequence: Synthetic oligonucleotide
  Target: ATXN1; (-) strand; PAM type: NRG; PAM sequence: AAG
gcaaaattctctcatctgtg

SEQ ID NO: 55058 - DNA, 20 bp, Artificial Sequence
  Description of Artificial Sequence: Synthetic oligonucleotide
  Target: ATXN1; (-) strand; PAM type: NRG; PAM sequence: AAG
tcattgcagccagtggcaag

SEQ ID NO: 55059 - DNA, 20 bp, Artificial Sequence
  Description of Artificial Sequence: Synthetic oligonucleotide
  Target: ATXN1; (-) strand; PAM type: NRG; PAM sequence: AAG
gcgtcattgcagccagtggc

SEQ ID NO: 55060 - DNA, 20 bp, Artificial Sequence
  Description of Artificial Sequence: Synthetic oligonucleotide
  Target: ATXN1; (-) strand; PAM type: NRG; PAM sequence: TGG
gggagcgtcattgcagccag

SEQ ID NO: 55061 - DNA, 20 bp, Artificial Sequence
  Description of Artificial Sequence: Synthetic oligonucleotide
  Target: ATXN1; (-) strand; PAM type: NRG; PAM sequence: CAG
ctggggagcgtcattgcagc

SEQ ID NO: 55062 - DNA, 20 bp, Artificial Sequence
  Description of Artificial Sequence: Synthetic oligonucleotide
  Target: ATXN1; (-) strand; PAM type: NRG; PAM sequence: CAG
ctcactggggagcgtcattg

SEQ ID NO: 55063 - DNA, 20 bp, Artificial Sequence
  Description of Artificial Sequence: Synthetic oligonucleotide
  Target: ATXN1; (-) strand; PAM type: NRG; PAM sequence: GAG
taggcctccacctcactggg

SEQ ID NO: 55064 - DNA, 20 bp, Artificial Sequence
  Description of Artificial Sequence: Synthetic oligonucleotide
  Target: ATXN1; (-) strand; PAM type: NRG; PAM sequence: GGG
tctaggcctccacctcactg

SEQ ID NO: 55065 - DNA, 20 bp, Artificial Sequence
  Description of Artificial Sequence: Synthetic oligonucleotide
  Target: ATXN1; (-) strand; PAM type: NRG; PAM sequence: GGG
ctctaggcctccacctcact

SEQ ID NO: 55066 - DNA, 20 bp, Artificial Sequence
  Description of Artificial Sequence: Synthetic oligonucleotide
  Target: ATXN1; (-) strand; PAM type: NRG; PAM sequence: TGG
tctctaggcctccacctcac

SEQ ID NO: 55067 - DNA, 20 bp, Artificial Sequence
  Description of Artificial Sequence: Synthetic oligonucleotide
  Target: ATXN1; (-) strand; PAM type: NRG; PAM sequence: AGG
agtcaccctcccctctctct

SEQ ID NO: 55068 - DNA, 20 bp, Artificial Sequence
  Description of Artificial Sequence: Synthetic oligonucleotide
  Target: ATXN1; (-) strand; PAM type: NRG; PAM sequence: TAG
aagtcaccctcccctctctc

SEQ ID NO: 55069 - DNA, 20 bp, Artificial Sequence
  Description of Artificial Sequence: Synthetic oligonucleotide
  Target: ATXN1; (-) strand; PAM type: NRG; PAM sequence: AAG
ggctaggccctgcccacctt

SEQ ID NO: 55070 - DNA, 20 bp, Artificial Sequence
  Description of Artificial Sequence: Synthetic oligonucleotide
  Target: ATXN1; (-) strand; PAM type: NRG; PAM sequence: AGG
gagagcctgtaatcaaggct

SEQ ID NO: 55071 - DNA, 20 bp, Artificial Sequence
  Description of Artificial Sequence: Synthetic oligonucleotide
  Target: ATXN1; (-) strand; PAM type: NRG; PAM sequence: TAG
tgagagcctgtaatcaaggc

SEQ ID NO: 55072 - DNA, 20 bp, Artificial Sequence
  Description of Artificial Sequence: Synthetic oligonucleotide
  Target: ATXN1; (-) strand; PAM type: NRG; PAM sequence: AGG
tccttgagagcctgtaatca

SEQ ID NO: 55073 - DNA, 20 bp, Artificial Sequence
  Description of Artificial Sequence: Synthetic oligonucleotide
  Target: ATXN1; (-) strand; PAM type: NRG; PAM sequence: AAG
atccttgagagcctgtaatc

SEQ ID NO: 55074 - DNA, 20 bp, Artificial Sequence
  Description of Artificial Sequence: Synthetic oligonucleotide
  Target: ATXN1; (-) strand; PAM type: NRG; PAM sequence: GAG
ctcccgaggttaatccttga

SEQ ID NO: 55075 - DNA, 20 bp, Artificial Sequence
  Description of Artificial Sequence: Synthetic oligonucleotide
  Target: ATXN1; (-) strand; PAM type: NRG; PAM sequence: GAG
tcctcccgaggttaatcctt

SEQ ID NO: 55076 - DNA, 20 bp, Artificial Sequence
  Description of Artificial Sequence: Synthetic oligonucleotide
  Target: ATXN1; (-) strand; PAM type: NRG; PAM sequence: AGG
ctctcctctctgtcctcccg

SEQ ID NO: 55077 - DNA, 20 bp, Artificial Sequence
  Description of Artificial Sequence: Synthetic oligonucleotide
  Target: ATXN1; (-) strand; PAM type: NRG; PAM sequence: GAG
tctctcctctctgtcctccc

SEQ ID NO: 55078 - DNA, 20 bp, Artificial Sequence
  Description of Artificial Sequence: Synthetic oligonucleotide
  Target: ATXN1; (-) strand; PAM type: NRG; PAM sequence: AAG
ttaatttctgtccactcaca

SEQ ID NO: 55079 - DNA, 20 bp, Artificial Sequence
  Description of Artificial Sequence: Synthetic oligonucleotide
  Target: ATXN1; (-) strand; PAM type: NRG; PAM sequence: TGG
caggagcactgtacttaact

SEQ ID NO: 55080 - DNA, 20 bp, Artificial Sequence
  Description of Artificial Sequence: Synthetic oligonucleotide
  Target: ATXN1; (-) strand; PAM type: NRG; PAM sequence: GAG
cctccaacttgcttctccag

SEQ ID NO: 55081 - DNA, 20 bp, Artificial Sequence
  Description of Artificial Sequence: Synthetic oligonucleotide
  Target: ATXN1; (-) strand; PAM type: NRG; PAM sequence: AGG
agcctccaacttgcttctcc

SEQ ID NO: 55082 - DNA, 20 bp, Artificial Sequence
  Description of Artificial Sequence: Synthetic oligonucleotide
  Target: ATXN1; (-) strand; PAM type: NRG; PAM sequence: CAG
cagcctccaacttgcttctc

SEQ ID NO: 55083 - DNA, 20 bp, Artificial Sequence
  Description of Artificial Sequence: Synthetic oligonucleotide
  Target: ATXN1; (-) strand; PAM type: NRG; PAM sequence: CAG
atgtgtatgcatgataccag

SEQ ID NO: 55084 - DNA, 20 bp, Artificial Sequence
  Description of Artificial Sequence: Synthetic oligonucleotide
  Target: ATXN1; (-) strand; PAM type: NRG; PAM sequence: CAG
tgcatgtgtatgcatgatac

SEQ ID NO: 55085 - DNA, 20 bp, Artificial Sequence
  Description of Artificial Sequence: Synthetic oligonucleotide
  Target: ATXN1; (-) strand; PAM type: NRG; PAM sequence: TAG
aataatcaggtaccactaaa

SEQ ID NO: 55086 - DNA, 20 bp, Artificial Sequence
  Description of Artificial Sequence: Synthetic oligonucleotide
  Target: ATXN1; (-) strand; PAM type: NRG; PAM sequence: AGG
tgtttgtgatcagaataatc

SEQ ID NO: 55087 - DNA, 20 bp, Artificial Sequence
  Description of Artificial Sequence: Synthetic oligonucleotide
  Target: ATXN1; (-) strand; PAM type: NRG; PAM sequence: CAG
ttgtttgtgatcagaataat

SEQ ID NO: 55088 - DNA, 20 bp, Artificial Sequence
  Description of Artificial Sequence: Synthetic oligonucleotide
  Target: ATXN1; (-) strand; PAM type: NRG; PAM sequence: CAG
aaaacaccattgtttgtgat

SEQ ID NO: 55089 - DNA, 20 bp, Artificial Sequence
  Description of Artificial Sequence: Synthetic oligonucleotide
  Target: ATXN1; (-) strand; PAM type: NRG; PAM sequence: AAG
gctcagatagacactctctg

SEQ ID NO: 55090 - DNA, 20 bp, Artificial Sequence
  Description of Artificial Sequence: Synthetic oligonucleotide
  Target: ATXN1; (-) strand; PAM type: NRG; PAM sequence: TAG
tttgcttcaagcagctcaga

SEQ ID NO: 55091 - DNA, 20 bp, Artificial Sequence
  Description of Artificial Sequence: Synthetic oligonucleotide
  Target: ATXN1; (-) strand; PAM type: NRG; PAM sequence: CAG
ttcgtttgcttcaagcagct

SEQ ID NO: 55092 - DNA, 20 bp, Artificial Sequence
  Description of Artificial Sequence: Synthetic oligonucleotide
  Target: ATXN1; (-) strand; PAM type: NRG; PAM sequence: CAG
taagtttcgtttgcttcaag

SEQ ID NO: 55093 - DNA, 20 bp, Artificial Sequence
  Description of Artificial Sequence: Synthetic oligonucleotide
  Target: ATXN1; (-) strand; PAM type: NRG; PAM sequence: AAG
ccataagtttcgtttgcttc

SEQ ID NO: 55094 - DNA, 20 bp, Artificial Sequence
  Description of Artificial Sequence: Synthetic oligonucleotide
  Target: ATXN1; (-) strand; PAM type: NRG; PAM sequence: AAG
gtaaggctagtccaatccat

SEQ ID NO: 55095 - DNA, 20 bp, Artificial Sequence
  Description of Artificial Sequence: Synthetic oligonucleotide
  Target: ATXN1; (-) strand; PAM type: NRG; PAM sequence: TAG
aactagcattctcgtaaggc

SEQ ID NO: 55096 - DNA, 20 bp, Artificial Sequence
  Description of Artificial Sequence: Synthetic oligonucleotide
  Target: ATXN1; (-) strand; PAM type: NRG; PAM sequence: AGG
ctgaaactagcattctcgta

SEQ ID NO: 55097 - DNA, 20 bp, Artificial Sequence
  Description of Artificial Sequence: Synthetic oligonucleotide
  Target: ATXN1; (-) strand; PAM type: NRG; PAM sequence: AAG
tctgaaactagcattctcgt

SEQ ID NO: 55098 - DNA, 20 bp, Artificial Sequence
  Description of Artificial Sequence: Synthetic oligonucleotide
  Target: ATXN1; (-) strand; PAM type: NRG; PAM sequence: TAG
cacagccatagctctgaaac

SEQ ID NO: 55099 - DNA, 20 bp, Artificial Sequence
  Description of Artificial Sequence: Synthetic oligonucleotide
  Target: ATXN1; (-) strand; PAM type: NRG; PAM sequence: TAG
aactgctataggcacagcca

SEQ ID NO: 55100 - DNA, 20 bp, Artificial Sequence
  Description of Artificial Sequence: Synthetic oligonucleotide
  Target: ATXN1; (-) strand; PAM type: NRG; PAM sequence: CAG
cctacaaactgctataggca

SEQ ID NO: 55101 - DNA, 20 bp, Artificial Sequence
  Description of Artificial Sequence: Synthetic oligonucleotide
  Target: ATXN1; (-) strand; PAM type: NRG; PAM sequence: AGG
aaattcctacaaactgctat

SEQ ID NO: 55102 - DNA, 20 bp, Artificial Sequence
  Description of Artificial Sequence: Synthetic oligonucleotide
  Target: ATXN1; (-) strand; PAM type: NRG; PAM sequence: TAG
taaattcctacaaactgcta

SEQ ID NO: 55103 - DNA, 20 bp, Artificial Sequence
  Description of Artificial Sequence: Synthetic oligonucleotide
  Target: ATXN1; (-) strand; PAM type: NRG; PAM sequence: AGG
aagtgctccaaggggttaaa

SEQ ID NO: 55104 - DNA, 20 bp, Artificial Sequence
  Description of Artificial Sequence: Synthetic oligonucleotide
  Target: ATXN1; (-) strand; PAM type: NRG; PAM sequence: AAG
aaagtgctccaaggggttaa

SEQ ID NO: 55105 - DNA, 20 bp, Artificial Sequence
  Description of Artificial Sequence: Synthetic oligonucleotide
  Target: ATXN1; (-) strand; PAM type: NRG; PAM sequence: GGG
ggatgtaaaagtgctccaag

SEQ ID NO: 55106 - DNA, 20 bp, Artificial Sequence
  Description of Artificial Sequence: Synthetic oligonucleotide
  Target: ATXN1; (-) strand; PAM type: NRG; PAM sequence: GGG
aggatgtaaaagtgctccaa

SEQ ID NO: 55107 - DNA, 20 bp, Artificial Sequence
  Description of Artificial Sequence: Synthetic oligonucleotide
  Target: ATXN1; (-) strand; PAM type: NRG; PAM sequence: AGG
aaggatgtaaaagtgctcca

SEQ ID NO: 55108 - DNA, 20 bp, Artificial Sequence
  Description of Artificial Sequence: Synthetic oligonucleotide
  Target: ATXN1; (-) strand; PAM type: NRG; PAM sequence: AAG
gaaggatgtaaaagtgctcc

SEQ ID NO: 55109 - DNA, 20 bp, Artificial Sequence
  Description of Artificial Sequence: Synthetic oligonucleotide
  Target: ATXN1; (-) strand; PAM type: NRG; PAM sequence: AAG
atgtgatgcgaaggatgtaa

SEQ ID NO: 55110 - DNA, 20 bp, Artificial Sequence
  Description of Artificial Sequence: Synthetic oligonucleotide
  Target: ATXN1; (-) strand; PAM type: NRG; PAM sequence: AGG
tggaggatcatgtgatgcga

SEQ ID NO: 55111 - DNA, 20 bp, Artificial Sequence
  Description of Artificial Sequence: Synthetic oligonucleotide
  Target: ATXN1; (-) strand; PAM type: NRG; PAM sequence: AAG
ctggaggatcatgtgatgcg

SEQ ID NO: 55112 - DNA, 20 bp, Artificial Sequence
  Description of Artificial Sequence: Synthetic oligonucleotide
  Target: ATXN1; (-) strand; PAM type: NRG; PAM sequence: AGG
agtcttataggattacctgg

SEQ ID NO: 55113 - DNA, 20 bp, Artificial Sequence
  Description of Artificial Sequence: Synthetic oligonucleotide
  Target: ATXN1; (-) strand; PAM type: NRG; PAM sequence: GAG
cagtcttataggattacctg

SEQ ID NO: 55114 - DNA, 20 bp, Artificial Sequence
  Description of Artificial Sequence: Synthetic oligonucleotide
  Target: ATXN1; (-) strand; PAM type: NRG; PAM sequence: TGG
tccagtcttataggattacc

SEQ ID NO: 55115 - DNA, 20 bp, Artificial Sequence
  Description of Artificial Sequence: Synthetic oligonucleotide
  Target: ATXN1; (-) strand; PAM type: NRG; PAM sequence: AGG
acctgttcttccagtcttat

SEQ ID NO: 55116 - DNA, 20 bp, Artificial Sequence
  Description of Artificial Sequence: Synthetic oligonucleotide
  Target: ATXN1; (-) strand; PAM type: NRG; PAM sequence: TAG
cacctgttcttccagtctta

SEQ ID NO: 55117 - DNA, 20 bp, Artificial Sequence
  Description of Artificial Sequence: Synthetic oligonucleotide
  Target: ATXN1; (-) strand; PAM type: NRG; PAM sequence: CAG
tcttttcacacctgttcttc

SEQ ID NO: 55118 - DNA, 20 bp, Artificial Sequence
  Description of Artificial Sequence: Synthetic oligonucleotide
  Target: ATXN1; (-) strand; PAM type: NRG; PAM sequence: TGG
cactgggtcttgataagaca

SEQ ID NO: 55119 - DNA, 20 bp, Artificial Sequence
  Description of Artificial Sequence: Synthetic oligonucleotide
  Target: ATXN1; (-) strand; PAM type: NRG; PAM sequence: AAG
taggcccactgggtcttgat

SEQ ID NO: 55120 - DNA, 20 bp, Artificial Sequence
  Description of Artificial Sequence: Synthetic oligonucleotide
  Target: ATXN1; (-) strand; PAM type: NRG; PAM sequence: GGG
acagatcacttaggcccact

SEQ ID NO: 55121 - DNA, 20 bp, Artificial Sequence
  Description of Artificial Sequence: Synthetic oligonucleotide
  Target: ATXN1; (-) strand; PAM type: NRG; PAM sequence: TGG
gacagatcacttaggcccac

SEQ ID NO: 55122 - DNA, 20 bp, Artificial Sequence
  Description of Artificial Sequence: Synthetic oligonucleotide
  Target: ATXN1; (-) strand; PAM type: NRG; PAM sequence: AGG
ctaccttagacagatcactt

SEQ ID NO: 55123 - DNA, 20 bp, Artificial Sequence
  Description of Artificial Sequence: Synthetic oligonucleotide
  Target: ATXN1; (-) strand; PAM type: NRG; PAM sequence: TAG
tctaccttagacagatcact

SEQ ID NO: 55124 - DNA, 20 bp, Artificial Sequence
  Description of Artificial Sequence: Synthetic oligonucleotide
  Target: ATXN1; (-) strand; PAM type: NRG; PAM sequence: CAG
tgccctctgtctaccttaga

SEQ ID NO: 55125 - DNA, 20 bp, Artificial Sequence
  Description of Artificial Sequence: Synthetic oligonucleotide
  Target: ATXN1; (-) strand; PAM type: NRG; PAM sequence: TAG
cacctgccctctgtctacct

SEQ ID NO: 55126 - DNA, 20 bp, Artificial Sequence
  Description of Artificial Sequence: Synthetic oligonucleotide
  Target: ATXN1; (-) strand; PAM type: NRG; PAM sequence: AGG
caaaatcagaaggcagatcc

SEQ ID NO: 55127 - DNA, 20 bp, Artificial Sequence
  Description of Artificial Sequence: Synthetic oligonucleotide
  Target: ATXN1; (-) strand; PAM type: NRG; PAM sequence: CAG
acaaaatcagaaggcagatc

SEQ ID NO: 55128 - DNA, 20 bp, Artificial Sequence
  Description of Artificial Sequence: Synthetic oligonucleotide
  Target: ATXN1; (-) strand; PAM type: NRG; PAM sequence: CAG
aaagaaacaaaatcagaagg

SEQ ID NO: 55129 - DNA, 20 bp, Artificial Sequence
  Description of Artificial Sequence: Synthetic oligonucleotide
  Target: ATXN1; (-) strand; PAM type: NRG; PAM sequence: AGG
acaaaagaaacaaaatcaga

SEQ ID NO: 55130 - DNA, 20 bp, Artificial Sequence
  Description of Artificial Sequence: Synthetic oligonucleotide
  Target: ATXN1; (-) strand; PAM type: NRG; PAM sequence: AAG
gacaaaagaaacaaaatcag

SEQ ID NO: 55131 - DNA, 20 bp, Artificial Sequence
  Description of Artificial Sequence: Synthetic oligonucleotide
  Target: ATXN1; (-) strand; PAM type: NRG; PAM sequence: CAG
catgacaaaagaaacaaaat

SEQ ID NO: 55132 - DNA, 20 bp, Artificial Sequence
  Description of Artificial Sequence: Synthetic oligonucleotide
  Target: ATXN1; (-) strand; PAM type: NRG; PAM sequence: AAG
tgttgtagcaaccatgacaa

SEQ ID NO: 55133 - DNA, 20 bp, Artificial Sequence
  Description of Artificial Sequence: Synthetic oligonucleotide
  Target: ATXN1; (-) strand; PAM type: NRG; PAM sequence: TAG
ctgtaggagcaatgatgttg

SEQ ID NO: 55134 - DNA, 20 bp, Artificial Sequence
  Description of Artificial Sequence: Synthetic oligonucleotide
  Target: ATXN1; (-) strand; PAM type: NRG; PAM sequence: GAG
gctcttgattctgcctgtag

SEQ ID NO: 55135 - DNA, 20 bp, Artificial Sequence
  Description of Artificial Sequence: Synthetic oligonucleotide
  Target: ATXN1; (-) strand; PAM type: NRG; PAM sequence: AGG
tagctcttgattctgcctgt

SEQ ID NO: 55136 - DNA, 20 bp, Artificial Sequence
  Description of Artificial Sequence: Synthetic oligonucleotide
  Target: ATXN1; (-) strand; PAM type: NRG; PAM sequence: TAG
gtagctcttgattctgcctg

SEQ ID NO: 55137 - DNA, 20 bp, Artificial Sequence
  Description of Artificial Sequence: Synthetic oligonucleotide
  Target: ATXN1; (-) strand; PAM type: NRG; PAM sequence: TAG
cctctcgtcccttgaacccg

SEQ ID NO: 55138 - DNA, 20 bp, Artificial Sequence
  Description of Artificial Sequence: Synthetic oligonucleotide
  Target: ATXN1; (-) strand; PAM type: NRG; PAM sequence: CGG
ttcatgcgcatgcacacacc

SEQ ID NO: 55139 - DNA, 20 bp, Artificial Sequence
  Description of Artificial Sequence: Synthetic oligonucleotide
  Target: ATXN1; (-) strand; PAM type: NRG; PAM sequence: AGG
caccgaatgtttgtgcacgc

SEQ ID NO: 55140 - DNA, 20 bp, Artificial Sequence
  Description of Artificial Sequence: Synthetic oligonucleotide
  Target: ATXN1; (-) strand; PAM type: NRG; PAM sequence: CAG
tcaccgaatgtttgtgcacg

SEQ ID NO: 55141 - DNA, 20 bp, Artificial Sequence
  Description of Artificial Sequence: Synthetic oligonucleotide
  Target: ATXN1; (-) strand; PAM type: NRG; PAM sequence: TGG
ttccagatgagctgcgtaaa

SEQ ID NO: 55142 - DNA, 20 bp, Artificial Sequence
  Description of Artificial Sequence: Synthetic oligonucleotide
  Target: ATXN1; (-) strand; PAM type: NRG; PAM sequence: GAG
tctgctgtgattttccagat

SEQ ID NO: 55143 - DNA, 20 bp, Artificial Sequence
  Description of Artificial Sequence: Synthetic oligonucleotide
  Target: ATXN1; (-) strand; PAM type: NRG; PAM sequence: CAG
tctcctctgctgtgattttc

SEQ ID NO: 55144 - DNA, 20 bp, Artificial Sequence
  Description of Artificial Sequence: Synthetic oligonucleotide
  Target: ATXN1; (-) strand; PAM type: NRG; PAM sequence: AGG
ctcccaacagacttccccat

SEQ ID NO: 55145 - DNA, 20 bp, Artificial Sequence
  Description of Artificial Sequence: Synthetic oligonucleotide
  Target: ATXN1; (-) strand; PAM type: NRG; PAM sequence: TAG
gctcccaacagacttcccca

SEQ ID NO: 55146 - DNA, 20 bp, Artificial Sequence
  Description of Artificial Sequence: Synthetic oligonucleotide
  Target: ATXN1; (-) strand; PAM type: NRG; PAM sequence: CAG
gggtaaaatcaggctcccaa

SEQ ID NO: 55147 - DNA, 20 bp, Artificial Sequence
  Description of Artificial Sequence: Synthetic oligonucleotide
  Target: ATXN1; (-) strand; PAM type: NRG; PAM sequence: AGG
aaagagagaggggtaaaatc

SEQ ID NO: 55148 - DNA, 20 bp, Artificial Sequence
  Description of Artificial Sequence: Synthetic oligonucleotide
  Target: ATXN1; (-) strand; PAM type: NRG; PAM sequence: CAG
caaagagagaggggtaaaat

SEQ ID NO: 55149 - DNA, 20 bp, Artificial Sequence
  Description of Artificial Sequence: Synthetic oligonucleotide
  Target: ATXN1; (-) strand; PAM type: NRG; PAM sequence: GGG
agcctggagcaaagagagag

SEQ ID NO: 55150 - DNA, 20 bp, Artificial Sequence
  Description of Artificial Sequence: Synthetic oligonucleotide
  Target: ATXN1; (-) strand; PAM type: NRG; PAM sequence: GGG
cagcctggagcaaagagaga

SEQ ID NO: 55151 - DNA, 20 bp, Artificial Sequence
  Description of Artificial Sequence: Synthetic oligonucleotide
  Target: ATXN1; (-) strand; PAM type: NRG; PAM sequence: AGG
gcagcctggagcaaagagag

SEQ ID NO: 55152 - DNA, 20 bp, Artificial Sequence
  Description of Artificial Sequence: Synthetic oligonucleotide
  Target: ATXN1; (-) strand; PAM type: NRG; PAM sequence: GAG
tgcagcctggagcaaagaga

SEQ ID NO: 55153 - DNA, 20 bp, Artificial Sequence
  Description of Artificial Sequence: Synthetic oligonucleotide
  Target: ATXN1; (-) strand; PAM type: NRG; PAM sequence: GAG
agtgcagcctggagcaaaga

SEQ ID NO: 55154 - DNA, 20 bp, Artificial Sequence
  Description of Artificial Sequence: Synthetic oligonucleotide
  Target: ATXN1; (-) strand; PAM type: NRG; PAM sequence: GAG
ccagtgcagcctggagcaaa

SEQ ID NO: 55155 - DNA, 20 bp, Artificial Sequence
  Description of Artificial Sequence: Synthetic oligonucleotide
  Target: ATXN1; (-) strand; PAM type: NRG; PAM sequence: AAG
tgccagtgcagcctggagca

SEQ ID NO: 55156 - DNA, 20 bp, Artificial Sequence
  Description of Artificial Sequence: Synthetic oligonucleotide
  Target: ATXN1; (-) strand; PAM type: NRG; PAM sequence: GAG
aggtttgccagtgcagcctg

SEQ ID NO: 55157 - DNA, 20 bp, Artificial Sequence
  Description of Artificial Sequence: Synthetic oligonucleotide
  Target: ATXN1; (-) strand; PAM type: NRG; PAM sequence: TGG
gaaggtttgccagtgcagcc

SEQ ID NO: 55158 - DNA, 20 bp, Artificial Sequence
  Description of Artificial Sequence: Synthetic oligonucleotide
  Target: ATXN1; (-) strand; PAM type: NRG; PAM sequence: CAG
tagccgaaggtttgccagtg

SEQ ID NO: 55159 - DNA, 20 bp, Artificial Sequence
  Description of Artificial Sequence: Synthetic oligonucleotide
  Target: ATXN1; (-) strand; PAM type: NRG; PAM sequence: CAG
ttaaatagccgaaggtttgc

SEQ ID NO: 55160 - DNA, 20 bp, Artificial Sequence
  Description of Artificial Sequence: Synthetic oligonucleotide
  Target: ATXN1; (-) strand; PAM type: NRG; PAM sequence: AGG
tactattattaaatagccga

SEQ ID NO: 55161 - DNA, 20 bp, Artificial Sequence
  Description of Artificial Sequence: Synthetic oligonucleotide
  Target: ATXN1; (-) strand; PAM type: NRG; PAM sequence: AAG
atactattattaaatagccg

SEQ ID NO: 55162 - DNA, 20 bp, Artificial Sequence
  Description of Artificial Sequence: Synthetic oligonucleotide
  Target: ATXN1; (-) strand; PAM type: NRG; PAM sequence: TAG
aactagatactattattaaa

SEQ ID NO: 55163 - DNA, 20 bp, Artificial Sequence
  Description of Artificial Sequence: Synthetic oligonucleotide
  Target: ATXN1; (-) strand; PAM type: NRG; PAM sequence: TAG
aaccctggatgtaaatcaac

SEQ ID NO: 55164 - DNA, 20 bp, Artificial Sequence
  Description of Artificial Sequence: Synthetic oligonucleotide
  Target: ATXN1; (-) strand; PAM type: NRG; PAM sequence: TGG
actagaaccctgggcaaccc

SEQ ID NO: 55165 - DNA, 20 bp, Artificial Sequence
  Description of Artificial Sequence: Synthetic oligonucleotide
  Target: ATXN1; (-) strand; PAM type: NRG; PAM sequence: GGG
agtgcacacactagaaccct

SEQ ID NO: 55166 - DNA, 20 bp, Artificial Sequence
  Description of Artificial Sequence: Synthetic oligonucleotide
  Target: ATXN1; (-) strand; PAM type: NRG; PAM sequence: TGG
cagtgcacacactagaaccc

SEQ ID NO: 55167 - DNA, 20 bp, Artificial Sequence
  Description of Artificial Sequence: Synthetic oligonucleotide
  Target: ATXN1; (-) strand; PAM type: NRG; PAM sequence: TAG
gtgcctggcagtgcacacac

SEQ ID NO: 55168 - DNA, 20 bp, Artificial Sequence
  Description of Artificial Sequence: Synthetic oligonucleotide
  Target: ATXN1; (-) strand; PAM type: NRG; PAM sequence: CAG
ctgtacttgtttgtgcctgg

SEQ ID NO: 55169 - DNA, 20 bp, Artificial Sequence
  Description of Artificial Sequence: Synthetic oligonucleotide
  Target: ATXN1; (-) strand; PAM type: NRG; PAM sequence: TGG
ggtctgtacttgtttgtgcc

SEQ ID NO: 55170 - DNA, 20 bp, Artificial Sequence
  Description of Artificial Sequence: Synthetic oligonucleotide
  Target: ATXN1; (-) strand; PAM type: NRG; PAM sequence: TGG
ctttgttgtggggcatgagc

SEQ ID NO: 55171 - DNA, 20 bp, Artificial Sequence
  Description of Artificial Sequence: Synthetic oligonucleotide
  Target: ATXN1; (-) strand; PAM type: NRG; PAM sequence: GAG
gccactttgttgtggggcat

SEQ ID NO: 55172 - DNA, 20 bp, Artificial Sequence
  Description of Artificial Sequence: Synthetic oligonucleotide
  Target: ATXN1; (-) strand; PAM type: NRG; PAM sequence: GGG
aaaatggccactttgttgtg

SEQ ID NO: 55173 - DNA, 20 bp, Artificial Sequence
  Description of Artificial Sequence: Synthetic oligonucleotide
  Target: ATXN1; (-) strand; PAM type: NRG; PAM sequence: GGG
taaaatggccactttgttgt

SEQ ID NO: 55174 - DNA, 20 bp, Artificial Sequence
  Description of Artificial Sequence: Synthetic oligonucleotide
  Target: ATXN1; (-) strand; PAM type: NRG; PAM sequence: TGG
ataaaatggccactttgttg

SEQ ID NO: 55175 - DNA, 20 bp, Artificial Sequence
  Description of Artificial Sequence: Synthetic oligonucleotide
  Target: ATXN1; (-) strand; PAM type: NRG; PAM sequence: TGG
ccagttgattccccataaaa

SEQ ID NO: 55176 - DNA, 20 bp, Artificial Sequence
  Description of Artificial Sequence: Synthetic oligonucleotide
  Target: ATXN1; (-) strand; PAM type: NRG; PAM sequence: CAG
gagacagcaatggagaattc

SEQ ID NO: 55177 - DNA, 20 bp, Artificial Sequence
  Description of Artificial Sequence: Synthetic oligonucleotide
  Target: ATXN1; (-) strand; PAM type: NRG; PAM sequence: GAG
ggcagacagagacagcaatg

SEQ ID NO: 55178 - DNA, 20 bp, Artificial Sequence
  Description of Artificial Sequence: Synthetic oligonucleotide
  Target: ATXN1; (-) strand; PAM type: NRG; PAM sequence: TGG
agggcagacagagacagcaa

SEQ ID NO: 55179 - DNA, 20 bp, Artificial Sequence
  Description of Artificial Sequence: Synthetic oligonucleotide
  Target: ATXN1; (-) strand; PAM type: NRG; PAM sequence: CAG
agtagcagggcagacagaga

SEQ ID NO: 55180 - DNA, 20 bp, Artificial Sequence
  Description of Artificial Sequence: Synthetic oligonucleotide
  Target: ATXN1; (-) strand; PAM type: NRG; PAM sequence: GAG
tctgagtagcagggcagaca

SEQ ID NO: 55181 - DNA, 20 bp, Artificial Sequence
  Description of Artificial Sequence: Synthetic oligonucleotide
  Target: ATXN1; (-) strand; PAM type: NRG; PAM sequence: CAG
cttctgagtagcagggcaga

SEQ ID NO: 55182 - DNA, 20 bp, Artificial Sequence
  Description of Artificial Sequence: Synthetic oligonucleotide
  Target: ATXN1; (-) strand; PAM type: NRG; PAM sequence: CAG
ccgtcttctgagtagcaggg

SEQ ID NO: 55183 - DNA, 20 bp, Artificial Sequence
  Description of Artificial Sequence: Synthetic oligonucleotide
  Target: ATXN1; (-) strand; PAM type: NRG; PAM sequence: GGG
ccaccgtcttctgagtagca

SEQ ID NO: 55184 - DNA, 20 bp, Artificial Sequence
  Description of Artificial Sequence: Synthetic oligonucleotide
  Target: ATXN1; (-) strand; PAM type: NRG; PAM sequence: AGG
tccaccgtcttctgagtagc

SEQ ID NO: 55185 - DNA, 20 bp, Artificial Sequence
  Description of Artificial Sequence: Synthetic oligonucleotide
  Target: ATXN1; (-) strand; PAM type: NRG; PAM sequence: CAG
ttccaccgtcttctgagtag

SEQ ID NO: 55186 - DNA, 20 bp, Artificial Sequence
  Description of Artificial Sequence: Synthetic oligonucleotide
  Target: ATXN1; (-) strand; PAM type: NRG; PAM sequence: TAG
tccttccaccgtcttctgag

SEQ ID NO: 55187 - DNA, 20 bp, Artificial Sequence
  Description of Artificial Sequence: Synthetic oligonucleotide
  Target: ATXN1; (-) strand; PAM type: NRG; PAM sequence: GAG
cattccttccaccgtcttct

SEQ ID NO: 55188 - DNA, 20 bp, Artificial Sequence
  Description of Artificial Sequence: Synthetic oligonucleotide
  Target: ATXN1; (-) strand; PAM type: NRG; PAM sequence: CAG
gctcttacagaagcttactt

SEQ ID NO: 55189 - DNA, 20 bp, Artificial Sequence
  Description of Artificial Sequence: Synthetic oligonucleotide
  Target: ATXN1; (-) strand; PAM type: NRG; PAM sequence: AAG
aggccagtgagctcttacag

SEQ ID NO: 55190 - DNA, 20 bp, Artificial Sequence
  Description of Artificial Sequence: Synthetic oligonucleotide
  Target: ATXN1; (-) strand; PAM type: NRG; PAM sequence: CAG
gccaggccagtgagctctta

SEQ ID NO: 55191 - DNA, 20 bp, Artificial Sequence
  Description of Artificial Sequence: Synthetic oligonucleotide
  Target: ATXN1; (-) strand; PAM type: NRG; PAM sequence: GAG
tctttcaaagccaggccagt

SEQ ID NO: 55192 - DNA, 20 bp, Artificial Sequence
  Description of Artificial Sequence: Synthetic oligonucleotide
  Target: ATXN1; (-) strand; PAM type: NRG; PAM sequence: CAG
cctctctttcaaagccaggc

SEQ ID NO: 55193 - DNA, 20 bp, Artificial Sequence
  Description of Artificial Sequence: Synthetic oligonucleotide
  Target: ATXN1; (-) strand; PAM type: NRG; PAM sequence: AGG
tgatcctctctttcaaagcc

SEQ ID NO: 55194 - DNA, 20 bp, Artificial Sequence
  Description of Artificial Sequence: Synthetic oligonucleotide
  Target: ATXN1; (-) strand; PAM type: NRG; PAM sequence: CAG
ctgatcctctctttcaaagc

SEQ ID NO: 55195 - DNA, 20 bp, Artificial Sequence
  Description of Artificial Sequence: Synthetic oligonucleotide
  Target: ATXN1; (-) strand; PAM type: NRG; PAM sequence: AAG
ccagctgatcctctctttca

SEQ ID NO: 55196 - DNA, 20 bp, Artificial Sequence
  Description of Artificial Sequence: Synthetic oligonucleotide
  Target: ATXN1; (-) strand; PAM type: NRG; PAM sequence: CAG
cctcatctattcagagatcc

SEQ ID NO: 55197 - DNA, 20 bp, Artificial Sequence
  Description of Artificial Sequence: Synthetic oligonucleotide
  Target: ATXN1; (-) strand; PAM type: NRG; PAM sequence: GAG
cctgactcctcatctattca

SEQ ID NO: 55198 - DNA, 20 bp, Artificial Sequence
  Description of Artificial Sequence: Synthetic oligonucleotide
  Target: ATXN1; (-) strand; PAM type: NRG; PAM sequence: CAG
accctgactcctcatctatt

SEQ ID NO: 55199 - DNA, 20 bp, Artificial Sequence
  Description of Artificial Sequence: Synthetic oligonucleotide
  Target: ATXN1; (-) strand; PAM type: NRG; PAM sequence: GAG
actcccttcagagagtcatg

SEQ ID NO: 55200 - DNA, 20 bp, Artificial Sequence
  Description of Artificial Sequence: Synthetic oligonucleotide
  Target: ATXN1; (-) strand; PAM type: NRG; PAM sequence: TGG
ggactcccttcagagagtca

SEQ ID NO: 55201 - DNA, 20 bp, Artificial Sequence
  Description of Artificial Sequence: Synthetic oligonucleotide
  Target: ATXN1; (-) strand; PAM type: NRG; PAM sequence: GAG
gcccttggactcccttcaga

SEQ ID NO: 55202 - DNA, 20 bp, Artificial Sequence
  Description of Artificial Sequence: Synthetic oligonucleotide
  Target: ATXN1; (-) strand; PAM type: NRG; PAM sequence: GAG
cagcccttggactcccttca

SEQ ID NO: 55203 - DNA, 20 bp, Artificial Sequence
  Description of Artificial Sequence: Synthetic oligonucleotide
  Target: ATXN1; (-) strand; PAM type: NRG; PAM sequence: CAG
tccagcccttggactccctt

SEQ ID NO: 55204 - DNA, 20 bp, Artificial Sequence
  Description of Artificial Sequence: Synthetic oligonucleotide
  Target: ATXN1; (-) strand; PAM type: NRG; PAM sequence: TGG
gttctgaatggtccagccct

SEQ ID NO: 55205 - DNA, 20 bp, Artificial Sequence
  Description of Artificial Sequence: Synthetic oligonucleotide
  Target: ATXN1; (-) strand; PAM type: NRG; PAM sequence: CAG
cctgaaggttctgaatggtc

SEQ ID NO: 55206 - DNA, 20 bp, Artificial Sequence
  Description of Artificial Sequence: Synthetic oligonucleotide
  Target: ATXN1; (-) strand; PAM type: NRG; PAM sequence: TGG
gtcttcctgaaggttctgaa

SEQ ID NO: 55207 - DNA, 20 bp, Artificial Sequence
  Description of Artificial Sequence: Synthetic oligonucleotide
  Target: ATXN1; (-) strand; PAM type: NRG; PAM sequence: AGG
gctgttctgagtcttcctga

SEQ ID NO: 55208 - DNA, 20 bp, Artificial Sequence
  Description of Artificial Sequence: Synthetic oligonucleotide
  Target: ATXN1; (-) strand; PAM type: NRG; PAM sequence: AAG
agctgttctgagtcttcctg

SEQ ID NO: 55209 - DNA, 20 bp, Artificial Sequence
  Description of Artificial Sequence: Synthetic oligonucleotide
  Target: ATXN1; (-) strand; PAM type: NRG; PAM sequence: GAG
aggcaggctggagctgttct

SEQ ID NO: 55210 - DNA, 20 bp, Artificial Sequence
  Description of Artificial Sequence: Synthetic oligonucleotide
  Target: ATXN1; (-) strand; PAM type: NRG; PAM sequence: GAG
cttccagctcaggcaggctg

SEQ ID NO: 55211 - DNA, 20 bp, Artificial Sequence
  Description of Artificial Sequence: Synthetic oligonucleotide
  Target: ATXN1; (-) strand; PAM type: NRG; PAM sequence: TGG
tgcttccagctcaggcaggc

SEQ ID NO: 55212 - DNA, 20 bp, Artificial Sequence
  Description of Artificial Sequence: Synthetic oligonucleotide
  Target: ATXN1; (-) strand; PAM type: NRG; PAM sequence: AGG
acactgcttccagctcaggc

SEQ ID NO: 55213 - DNA, 20 bp, Artificial Sequence
  Description of Artificial Sequence: Synthetic oligonucleotide
  Target: ATXN1; (-) strand; PAM type: NRG; PAM sequence: CAG
gacactgcttccagctcagg

SEQ ID NO: 55214 - DNA, 20 bp, Artificial Sequence
  Description of Artificial Sequence: Synthetic oligonucleotide
  Target: ATXN1; (-) strand; PAM type: NRG; PAM sequence: AGG
agtgacactgcttccagctc

SEQ ID NO: 55215 - DNA, 20 bp, Artificial Sequence
  Description of Artificial Sequence: Synthetic oligonucleotide
  Target: ATXN1; (-) strand; PAM type: NRG; PAM sequence: CAG
cagtgacactgcttccagct

SEQ ID NO: 55216 - DNA, 20 bp, Artificial Sequence
  Description of Artificial Sequence: Synthetic oligonucleotide
  Target: ATXN1; (-) strand; PAM type: NRG; PAM sequence: CAG
accaacagtgacactgcttc

SEQ ID NO: 55217 - DNA, 20 bp, Artificial Sequence
  Description of Artificial Sequence: Synthetic oligonucleotide
  Target: ATXN1; (-) strand; PAM type: NRG; PAM sequence: CAG
cagaggagacgcaacaccaa

SEQ ID NO: 55218 - DNA, 20 bp, Artificial Sequence
  Description of Artificial Sequence: Synthetic oligonucleotide
  Target: ATXN1; (-) strand; PAM type: NRG; PAM sequence: GAG
gttctggaaggtcctcagag

SEQ ID NO: 55219 - DNA, 20 bp, Artificial Sequence
  Description of Artificial Sequence: Synthetic oligonucleotide
  Target: ATXN1; (-) strand; PAM type: NRG; PAM sequence: AGG
tggttctggaaggtcctcag

SEQ ID NO: 55220 - DNA, 20 bp, Artificial Sequence
  Description of Artificial Sequence: Synthetic oligonucleotide
  Target: ATXN1; (-) strand; PAM type: NRG; PAM sequence: GAG
atggttctggaaggtcctca

SEQ ID NO: 55221 - DNA, 20 bp, Artificial Sequence
  Description of Artificial Sequence: Synthetic oligonucleotide
  Target: ATXN1; (-) strand; PAM type: NRG; PAM sequence: CAG
agatggttctggaaggtcct

SEQ ID NO: 55222 - DNA, 20 bp, Artificial Sequence
  Description of Artificial Sequence: Synthetic oligonucleotide
  Target: ATXN1; (-) strand; PAM type: NRG; PAM sequence: AGG
tgccattagatggttctgga

SEQ ID NO: 55223 - DNA, 20 bp, Artificial Sequence
  Description of Artificial Sequence: Synthetic oligonucleotide
  Target: ATXN1; (-) strand; PAM type: NRG; PAM sequence: AAG
atgccattagatggttctgg

SEQ ID NO: 55224 - DNA, 20 bp, Artificial Sequence
  Description of Artificial Sequence: Synthetic oligonucleotide
  Target: ATXN1; (-) strand; PAM type: NRG; PAM sequence: TGG
cccatgccattagatggttc

SEQ ID NO: 55225 - DNA, 20 bp, Artificial Sequence
  Description of Artificial Sequence: Synthetic oligonucleotide
  Target: ATXN1; (-) strand; PAM type: NRG; PAM sequence: TGG
ttctgacccatgccattaga

SEQ ID NO: 55226 - DNA, 20 bp, Artificial Sequence
  Description of Artificial Sequence: Synthetic oligonucleotide
  Target: ATXN1; (-) strand; PAM type: NRG; PAM sequence: TAG
gtagttctgacccatgccat

SEQ ID NO: 55227 - DNA, 20 bp, Artificial Sequence
  Description of Artificial Sequence: Synthetic oligonucleotide
  Target: ATXN1; (-) strand; PAM type: NRG; PAM sequence: TAG
gtgcaaaatgcagcagtcag

SEQ ID NO: 55228 - DNA, 20 bp, Artificial Sequence
  Description of Artificial Sequence: Synthetic oligonucleotide
  Target: ATXN1; (-) strand; PAM type: NRG; PAM sequence: CAG
tgagtgcaaaatgcagcagt

SEQ ID NO: 55229 - DNA, 20 bp, Artificial Sequence
  Description of Artificial Sequence: Synthetic oligonucleotide
  Target: ATXN1; (-) strand; PAM type: NRG; PAM sequence: CAG
gccctgagtgcaaaatgcag

SEQ ID NO: 55230 - DNA, 20 bp, Artificial Sequence
  Description of Artificial Sequence: Synthetic oligonucleotide
  Target: ATXN1; (-) strand; PAM type: NRG; PAM sequence: CAG
aaggccctgagtgcaaaatg

SEQ ID NO: 55231 - DNA, 20 bp, Artificial Sequence
  Description of Artificial Sequence: Synthetic oligonucleotide
  Target: ATXN1; (-) strand; PAM type: NRG; PAM sequence: GAG
tgccattcatggaaggccct

SEQ ID NO: 55232 - DNA, 20 bp, Artificial Sequence
  Description of Artificial Sequence: Synthetic oligonucleotide
  Target: ATXN1; (-) strand; PAM type: NRG; PAM sequence: AGG
cagaaactgccattcatgga

SEQ ID NO: 55233 - DNA, 20 bp, Artificial Sequence
  Description of Artificial Sequence: Synthetic oligonucleotide
  Target: ATXN1; (-) strand; PAM type: NRG; PAM sequence: AAG
ccagaaactgccattcatgg

SEQ ID NO: 55234 - DNA, 20 bp, Artificial Sequence
  Description of Artificial Sequence: Synthetic oligonucleotide
  Target: ATXN1; (-) strand; PAM type: NRG; PAM sequence: TGG
gtaccagaaactgccattca

SEQ ID NO: 55235 - DNA, 20 bp, Artificial Sequence
  Description of Artificial Sequence: Synthetic oligonucleotide
  Target: ATXN1; (-) strand; PAM type: NRG; PAM sequence: CAG
ggaatagtctgcaaaggtac

SEQ ID NO: 55236 - DNA, 20 bp, Artificial Sequence
  Description of Artificial Sequence: Synthetic oligonucleotide
  Target: ATXN1; (-) strand; PAM type: NRG; PAM sequence: AGG
tgttagggaatagtctgcaa

SEQ ID NO: 55237 - DNA, 20 bp, Artificial Sequence
  Description of Artificial Sequence: Synthetic oligonucleotide
  Target: ATXN1; (-) strand; PAM type: NRG; PAM sequence: AAG
atgttagggaatagtctgca

SEQ ID NO: 55238 - DNA, 20 bp, Artificial Sequence
  Description of Artificial Sequence: Synthetic oligonucleotide
  Target: ATXN1; (-) strand; PAM type: NRG; PAM sequence: TAG
gtaaagggcatgttagggaa

SEQ ID NO: 55239 - DNA, 20 bp, Artificial Sequence
  Description of Artificial Sequence: Synthetic oligonucleotide
  Target: ATXN1; (-) strand; PAM type: NRG; PAM sequence: GGG
tatgtgtaaagggcatgtta

SEQ ID NO: 55240 - DNA, 20 bp, Artificial Sequence
  Description of Artificial Sequence: Synthetic oligonucleotide
  Target: ATXN1; (-) strand; PAM type: NRG; PAM sequence: AGG
ttatgtgtaaagggcatgtt

SEQ ID NO: 55241 - DNA, 20 bp, Artificial Sequence
  Description of Artificial Sequence: Synthetic oligonucleotide
  Target: ATXN1; (-) strand; PAM type: NRG; PAM sequence: TAG
tttatgtgtaaagggcatgt

SEQ ID NO: 55242 - DNA, 20 bp, Artificial Sequence
  Description of Artificial Sequence: Synthetic oligonucleotide
  Target: ATXN1; (-) strand; PAM type: NRG; PAM sequence: GGG
tggctgaatttatgtgtaaa

SEQ ID NO: 55243 - DNA, 20 bp, Artificial Sequence
  Description of Artificial Sequence: Synthetic oligonucleotide
  Target: ATXN1; (-) strand; PAM type: NRG; PAM sequence: AGG
ttggctgaatttatgtgtaa

SEQ ID NO: 55244 - DNA, 20 bp, Artificial Sequence
  Description of Artificial Sequence: Synthetic oligonucleotide
  Target: ATXN1; (-) strand; PAM type: NRG; PAM sequence: AAG
gttggctgaatttatgtgta

SEQ ID NO: 55245 - DNA, 20 bp, Artificial Sequence
  Description of Artificial Sequence: Synthetic oligonucleotide
  Target: ATXN1; (-) strand; PAM type: NRG; PAM sequence: TGG
aatattgctctgatttcagt

SEQ ID NO: 55246 - DNA, 20 bp, Artificial Sequence
  Description of Artificial Sequence: Synthetic oligonucleotide
  Target: ATXN1; (-) strand; PAM type: NRG; PAM sequence: CAG
ctcaaatattgctctgattt

SEQ ID NO: 55247 - DNA, 20 bp, Artificial Sequence
  Description of Artificial Sequence: Synthetic oligonucleotide
  Target: ATXN1; (-) strand; PAM type: NRG; PAM sequence: TAG
tttagagggaaaaaaggcca

SEQ ID NO: 55248 - DNA, 20 bp, Artificial Sequence
  Description of Artificial Sequence: Synthetic oligonucleotide
  Target: ATXN1; (-) strand; PAM type: NRG; PAM sequence: AGG
tagcattttagagggaaaaa

SEQ ID NO: 55249 - DNA, 20 bp, Artificial Sequence
  Description of Artificial Sequence: Synthetic oligonucleotide
  Target: ATXN1; (-) strand; PAM type: NRG; PAM sequence: AAG
gtagcattttagagggaaaa

SEQ ID NO: 55250 - DNA, 20 bp, Artificial Sequence
  Description of Artificial Sequence: Synthetic oligonucleotide
  Target: ATXN1; (-) strand; PAM type: NRG; PAM sequence: GGG
gtgtttggtagcattttaga

SEQ ID NO: 55251 - DNA, 20 bp, Artificial Sequence
  Description of Artificial Sequence: Synthetic oligonucleotide
  Target: ATXN1; (-) strand; PAM type: NRG; PAM sequence: AGG
agtgtttggtagcattttag

SEQ ID NO: 55252 - DNA, 20 bp, Artificial Sequence
  Description of Artificial Sequence: Synthetic oligonucleotide
  Target: ATXN1; (-) strand; PAM type: NRG; PAM sequence: GAG
tagtgtttggtagcatttta

SEQ ID NO: 55253 - DNA, 20 bp, Artificial Sequence
  Description of Artificial Sequence: Synthetic oligonucleotide
  Target: ATXN1; (-) strand; PAM type: NRG; PAM sequence: TAG
tctagtgtttggtagcattt

SEQ ID NO: 55254 - DNA, 20 bp, Artificial Sequence
  Description of Artificial Sequence: Synthetic oligonucleotide
  Target: ATXN1; (-) strand; PAM type: NRG; PAM sequence: TAG
ctaagagatctagtgtttgg

SEQ ID NO: 55255 - DNA, 20 bp, Artificial Sequence
  Description of Artificial Sequence: Synthetic oligonucleotide
  Target: ATXN1; (-) strand; PAM type: NRG; PAM sequence: TGG
gaactaagagatctagtgtt

SEQ ID NO: 55256 - DNA, 20 bp, Artificial Sequence
  Description of Artificial Sequence: Synthetic oligonucleotide
  Target: ATXN1; (-) strand; PAM type: NRG; PAM sequence: TAG
tatgaaagaactaagagatc

SEQ ID NO: 55257 - DNA, 20 bp, Artificial Sequence
  Description of Artificial Sequence: Synthetic oligonucleotide
  Target: ATXN1; (-) strand; PAM type: NRG; PAM sequence: GAG
ttaaaatatgaaagaactaa

SEQ ID NO: 55258 - DNA, 20 bp, Artificial Sequence
  Description of Artificial Sequence: Synthetic oligonucleotide
  Target: ATXN1; (-) strand; PAM type: NRG; PAM sequence: AAG
ctttaaaatatgaaagaact

SEQ ID NO: 55259 - DNA, 20 bp, Artificial Sequence
  Description of Artificial Sequence: Synthetic oligonucleotide
  Target: ATXN1; (-) strand; PAM type: NRG; PAM sequence: AAG
ctgtgcactttaaaatatga

SEQ ID NO: 55260 - DNA, 20 bp, Artificial Sequence
  Description of Artificial Sequence: Synthetic oligonucleotide
  Target: ATXN1; (-) strand; PAM type: NRG; PAM sequence: AGG
gtttcacagaatctgaaatc

SEQ ID NO: 55261 - DNA, 20 bp, Artificial Sequence
  Description of Artificial Sequence: Synthetic oligonucleotide
  Target: ATXN1; (-) strand; PAM type: NRG; PAM sequence: CAG
tgtttcacagaatctgaaat

SEQ ID NO: 55262 - DNA, 20 bp, Artificial Sequence
  Description of Artificial Sequence: Synthetic oligonucleotide
  Target: ATXN1; (-) strand; PAM type: NRG; PAM sequence: CAG
ttaatttgtgctctgtttca

SEQ ID NO: 55263 - DNA, 20 bp, Artificial Sequence
  Description of Artificial Sequence: Synthetic oligonucleotide
  Target: ATXN1; (-) strand; PAM type: NRG; PAM sequence: AAG
cagaggggtcctgagacaga

SEQ ID NO: 55264 - DNA, 20 bp, Artificial Sequence
  Description of Artificial Sequence: Synthetic oligonucleotide
  Target: ATXN1; (-) strand; PAM type: NRG; PAM sequence: CAG
gctacagaggggtcctgaga

SEQ ID NO: 55265 - DNA, 20 bp, Artificial Sequence
  Description of Artificial Sequence: Synthetic oligonucleotide
  Target: ATXN1; (-) strand; PAM type: NRG; PAM sequence: GAG
agtagctacagaggggtcct

SEQ ID NO: 55266 - DNA, 20 bp, Artificial Sequence
  Description of Artificial Sequence: Synthetic oligonucleotide
  Target: ATXN1; (-) strand; PAM type: NRG; PAM sequence: GGG
tgaagttagtagctacagag

SEQ ID NO: 55267 - DNA, 20 bp, Artificial Sequence
  Description of Artificial Sequence: Synthetic oligonucleotide
  Target: ATXN1; (-) strand; PAM type: NRG; PAM sequence: GGG
gtgaagttagtagctacaga

SEQ ID NO: 55268 - DNA, 20 bp, Artificial Sequence
  Description of Artificial Sequence: Synthetic oligonucleotide
  Target: ATXN1; (-) strand; PAM type: NRG; PAM sequence: AGG
tgtgaagttagtagctacag

SEQ ID NO: 55269 - DNA, 20 bp, Artificial Sequence
  Description of Artificial Sequence: Synthetic oligonucleotide
  Target: ATXN1; (-) strand; PAM type: NRG; PAM sequence: GAG
atgtgaagttagtagctaca

SEQ ID NO: 55270 - DNA, 20 bp, Artificial Sequence
  Description of Artificial Sequence: Synthetic oligonucleotide
  Target: ATXN1; (-) strand; PAM type: NRG; PAM sequence: CAG
aaatgtgaagttagtagcta

SEQ ID NO: 55271 - DNA, 20 bp, Artificial Sequence
  Description of Artificial Sequence: Synthetic oligonucleotide
  Target: ATXN1; (-) strand; PAM type: NRG; PAM sequence: TAG
tttcccaaatgtgaagttag

SEQ ID NO: 55272 - DNA, 20 bp, Artificial Sequence
  Description of Artificial Sequence: Synthetic oligonucleotide
  Target: ATXN1; (-) strand; PAM type: NRG; PAM sequence: TAG
ctttttcccaaatgtgaagt

SEQ ID NO: 55273 - DNA, 20 bp, Artificial Sequence
  Description of Artificial Sequence: Synthetic oligonucleotide
  Target: ATXN1; (-) strand; PAM type: NRG; PAM sequence: AAG
tctactttttcccaaatgtg

SEQ ID NO: 55274 - DNA, 20 bp, Artificial Sequence
  Description of Artificial Sequence: Synthetic oligonucleotide
  Target: ATXN1; (-) strand; PAM type: NRG; PAM sequence: GGG
tggcacagtgggatggagta

SEQ ID NO: 55275 - DNA, 20 bp, Artificial Sequence
  Description of Artificial Sequence: Synthetic oligonucleotide
  Target: ATXN1; (-) strand; PAM type: NRG; PAM sequence: AGG
gtggcacagtgggatggagt

SEQ ID NO: 55276 - DNA, 20 bp, Artificial Sequence
  Description of Artificial Sequence: Synthetic oligonucleotide
  Target: ATXN1; (-) strand; PAM type: NRG; PAM sequence: TAG
cgtggcacagtgggatggag

SEQ ID NO: 55277 - DNA, 20 bp, Artificial Sequence
  Description of Artificial Sequence: Synthetic oligonucleotide
  Target: ATXN1; (-) strand; PAM type: NRG; PAM sequence: GAG
caacgtggcacagtgggatg

SEQ ID NO: 55278 - DNA, 20 bp, Artificial Sequence
  Description of Artificial Sequence: Synthetic oligonucleotide
  Target: ATXN1; (-) strand; PAM type: NRG; PAM sequence: TGG
aacaacgtggcacagtggga

SEQ ID NO: 55279 - DNA, 20 bp, Artificial Sequence
  Description of Artificial Sequence: Synthetic oligonucleotide
  Target: ATXN1; (-) strand; PAM type: NRG; PAM sequence: GGG
ggtaaacaacgtggcacagt

SEQ ID NO: 55280 - DNA, 20 bp, Artificial Sequence
  Description of Artificial Sequence: Synthetic oligonucleotide
  Target: ATXN1; (-) strand; PAM type: NRG; PAM sequence: TGG
tggtaaacaacgtggcacag

SEQ ID NO: 55281 - DNA, 20 bp, Artificial Sequence
  Description of Artificial Sequence: Synthetic oligonucleotide
  Target: ATXN1; (-) strand; PAM type: NRG; PAM sequence: CAG
ttttggtaaacaacgtggca

SEQ ID NO: 55282 - DNA, 20 bp, Artificial Sequence
  Description of Artificial Sequence: Synthetic oligonucleotide
  Target: ATXN1; (-) strand; PAM type: NRG; PAM sequence: TGG
gatacttttggtaaacaacg

SEQ ID NO: 55283 - DNA, 20 bp, Artificial Sequence
  Description of Artificial Sequence: Synthetic oligonucleotide
  Target: ATXN1; (-) strand; PAM type: NRG; PAM sequence: TGG
agtgcctggtgggatacttt

SEQ ID NO: 55284 - DNA, 20 bp, Artificial Sequence
  Description of Artificial Sequence: Synthetic oligonucleotide
  Target: ATXN1; (-) strand; PAM type: NRG; PAM sequence: GGG
gaggaatacaagtgcctggt

SEQ ID NO: 55285 - DNA, 20 bp, Artificial Sequence
  Description of Artificial Sequence: Synthetic oligonucleotide
  Target: ATXN1; (-) strand; PAM type: NRG; PAM sequence: TGG
tgaggaatacaagtgcctgg

SEQ ID NO: 55286 - DNA, 20 bp, Artificial Sequence
  Description of Artificial Sequence: Synthetic oligonucleotide
  Target: ATXN1; (-) strand; PAM type: NRG; PAM sequence: TGG
gggtgaggaatacaagtgcc

SEQ ID NO: 55287 - DNA, 20 bp, Artificial Sequence
  Description of Artificial Sequence: Synthetic oligonucleotide
  Target: ATXN1; (-) strand; PAM type: NRG; PAM sequence: AAG
tacacgtgggtgaggaatac

SEQ ID NO: 55288 - DNA, 20 bp, Artificial Sequence
  Description of Artificial Sequence: Synthetic oligonucleotide
  Target: ATXN1; (-) strand; PAM type: NRG; PAM sequence: AGG
taaagtaatacacgtgggtg

SEQ ID NO: 55289 - DNA, 20 bp, Artificial Sequence
  Description of Artificial Sequence: Synthetic oligonucleotide
  Target: ATXN1; (-) strand; PAM type: NRG; PAM sequence: GAG
ttaaagtaatacacgtgggt

SEQ ID NO: 55290 - DNA, 20 bp, Artificial Sequence
  Description of Artificial Sequence: Synthetic oligonucleotide
  Target: ATXN1; (-) strand; PAM type: NRG; PAM sequence: GGG
cattttaaagtaatacacgt

SEQ ID NO: 55291 - DNA, 20 bp, Artificial Sequence
  Description of Artificial Sequence: Synthetic oligonucleotide
  Target: ATXN1; (-) strand; PAM type: NRG; PAM sequence: TGG
gcattttaaagtaatacacg

SEQ ID NO: 55292 - DNA, 20 bp, Artificial Sequence
  Description of Artificial Sequence: Synthetic oligonucleotide
  Target: ATXN1; (-) strand; PAM type: NRG; PAM sequence: AAG
ctttaccgaaaggcatttta

SEQ ID NO: 55293 - DNA, 20 bp, Artificial Sequence
  Description of Artificial Sequence: Synthetic oligonucleotide
  Target: ATXN1; (-) strand; PAM type: NRG; PAM sequence: AGG
tcaaattctcctttaccgaa

SEQ ID NO: 55294 - DNA, 20 bp, Artificial Sequence
  Description of Artificial Sequence: Synthetic oligonucleotide
  Target: ATXN1; (-) strand; PAM type: NRG; PAM sequence: AAG
ttcaaattctcctttaccga

SEQ ID NO: 55295 - DNA, 20 bp, Artificial Sequence
  Description of Artificial Sequence: Synthetic oligonucleotide
  Target: ATXN1; (-) strand; PAM type: NRG; PAM sequence: CAG
atgttgggagcattcccaga

SEQ ID NO: 55296 - DNA, 20 bp, Artificial Sequence
  Description of Artificial Sequence: Synthetic oligonucleotide
  Target: ATXN1; (-) strand; PAM type: NRG; PAM sequence: CAG
tattatgttgggagcattcc

SEQ ID NO: 55297 - DNA, 20 bp, Artificial Sequence
  Description of Artificial Sequence: Synthetic oligonucleotide
  Target: ATXN1; (-) strand; PAM type: NRG; PAM sequence: GAG
gtttcagtatattatgttgg

SEQ ID NO: 55298 - DNA, 20 bp, Artificial Sequence
  Description of Artificial Sequence: Synthetic oligonucleotide
  Target: ATXN1; (-) strand; PAM type: NRG; PAM sequence: GGG
gtgtttcagtatattatgtt

SEQ ID NO: 55299 - DNA, 20 bp, Artificial Sequence
  Description of Artificial Sequence: Synthetic oligonucleotide
  Target: ATXN1; (-) strand; PAM type: NRG; PAM sequence: TGG
tgtgtttcagtatattatgt

SEQ ID NO: 55300 - DNA, 20 bp, Artificial Sequence
  Description of Artificial Sequence: Synthetic oligonucleotide
  Target: ATXN1; (-) strand; PAM type: NRG; PAM sequence: CAG
acagccagtcttctgtgttt

SEQ ID NO: 55301 - DNA, 20 bp, Artificial Sequence
  Description of Artificial Sequence: Synthetic oligonucleotide
  Target: ATXN1; (-) strand; PAM type: NRG; PAM sequence: CAG
aggtgatctggacctacagc

SEQ ID NO: 55302 - DNA, 20 bp, Artificial Sequence
  Description of Artificial Sequence: Synthetic oligonucleotide
  Target: ATXN1; (-) strand; PAM type: NRG; PAM sequence: CAG
taccaggtgatctggaccta

SEQ ID NO: 55303 - DNA, 20 bp, Artificial Sequence
  Description of Artificial Sequence: Synthetic oligonucleotide
  Target: ATXN1; (-) strand; PAM type: NRG; PAM sequence: TGG
tggttcactaccaggtgatc

SEQ ID NO: 55304 - DNA, 20 bp, Artificial Sequence
  Description of Artificial Sequence: Synthetic oligonucleotide
  Target: ATXN1; (-) strand; PAM type: NRG; PAM sequence: AGG
cctttccatggttcactacc

SEQ ID NO: 55305 - DNA, 20 bp, Artificial Sequence
  Description of Artificial Sequence: Synthetic oligonucleotide
  Target: ATXN1; (-) strand; PAM type: NRG; PAM sequence: CAG
acctttccatggttcactac

SEQ ID NO: 55306 - DNA, 20 bp, Artificial Sequence
  Description of Artificial Sequence: Synthetic oligonucleotide
  Target: ATXN1; (-) strand; PAM type: NRG; PAM sequence: TGG
gtgtgaataatacctttcca

SEQ ID NO: 55307 - DNA, 20 bp, Artificial Sequence
  Description of Artificial Sequence: Synthetic oligonucleotide
  Target: ATXN1; (-) strand; PAM type: NRG; PAM sequence: AGG
tagagaatccgcaggctcca

SEQ ID NO: 55308 - DNA, 20 bp, Artificial Sequence
  Description of Artificial Sequence: Synthetic oligonucleotide
  Target: ATXN1; (-) strand; PAM type: NRG; PAM sequence: AAG
ttagagaatccgcaggctcc

SEQ ID NO: 55309 - DNA, 20 bp, Artificial Sequence
  Description of Artificial Sequence: Synthetic oligonucleotide
  Target: ATXN1; (-) strand; PAM type: NRG; PAM sequence: AGG
agaaggcttagagaatccgc

SEQ ID NO: 55310 - DNA, 20 bp, Artificial Sequence
  Description of Artificial Sequence: Synthetic oligonucleotide
  Target: ATXN1; (-) strand; PAM type: NRG; PAM sequence: CAG
aagaaggcttagagaatccg

SEQ ID NO: 55311 - DNA, 20 bp, Artificial Sequence
  Description of Artificial Sequence: Synthetic oligonucleotide
  Target: ATXN1; (-) strand; PAM type: NRG; PAM sequence: GAG
agaatgattaagaaggctta

SEQ ID NO: 55312 - DNA, 20 bp, Artificial Sequence
  Description of Artificial Sequence: Synthetic oligonucleotide
  Target: ATXN1; (-) strand; PAM type: NRG; PAM sequence: TAG
gaagaatgattaagaaggct

SEQ ID NO: 55313 - DNA, 20 bp, Artificial Sequence
  Description of Artificial Sequence: Synthetic oligonucleotide
  Target: ATXN1; (-) strand; PAM type: NRG; PAM sequence: AGG
tacctgaagaatgattaaga

SEQ ID NO: 55314 - DNA, 20 bp, Artificial Sequence
  Description of Artificial Sequence: Synthetic oligonucleotide
  Target: ATXN1; (-) strand; PAM type: NRG; PAM sequence: AAG
atacctgaagaatgattaag

SEQ ID NO: 55315 - DNA, 20 bp, Artificial Sequence
  Description of Artificial Sequence: Synthetic oligonucleotide
  Target: ATXN1; (-) strand; PAM type: NRG; PAM sequence: AAG
gtaatacctgaagaatgatt

SEQ ID NO: 55316 - DNA, 20 bp, Artificial Sequence
  Description of Artificial Sequence: Synthetic oligonucleotide
  Target: ATXN1; (-) strand; PAM type: NRG; PAM sequence: AAG
gaaggacaaagtaatacctg

SEQ ID NO: 55317 - DNA, 20 bp, Artificial Sequence
  Description of Artificial Sequence: Synthetic oligonucleotide
  Target: ATXN1; (-) strand; PAM type: NRG; PAM sequence: AAG
atctgctgttttgaaggaca

SEQ ID NO: 55318 - DNA, 20 bp, Artificial Sequence
  Description of Artificial Sequence: Synthetic oligonucleotide
  Target: ATXN1; (-) strand; PAM type: NRG; PAM sequence: AGG
tctgaaatctgctgttttga

SEQ ID NO: 55319 - DNA, 20 bp, Artificial Sequence
  Description of Artificial Sequence: Synthetic oligonucleotide
  Target: ATXN1; (-) strand; PAM type: NRG; PAM sequence: AAG
gtctgaaatctgctgttttg

SEQ ID NO: 55320 - DNA, 20 bp, Artificial Sequence
  Description of Artificial Sequence: Synthetic oligonucleotide
  Target: ATXN1; (-) strand; PAM type: NRG; PAM sequence: CAG
atactgaagctttagggacc

SEQ ID NO: 55321 - DNA, 20 bp, Artificial Sequence
  Description of Artificial Sequence: Synthetic oligonucleotide
  Target: ATXN1; (-) strand; PAM type: NRG; PAM sequence: GGG
atgtctatactgaagcttta

SEQ ID NO: 55322 - DNA, 20 bp, Artificial Sequence
  Description of Artificial Sequence: Synthetic oligonucleotide
  Target: ATXN1; (-) strand; PAM type: NRG; PAM sequence: AGG
aatgtctatactgaagcttt

SEQ ID NO: 55323 - DNA, 20 bp, Artificial Sequence
  Description of Artificial Sequence: Synthetic oligonucleotide
  Target: ATXN1; (-) strand; PAM type: NRG; PAM sequence: TAG
aaatgtctatactgaagctt

SEQ ID NO: 55324 - DNA, 20 bp, Artificial Sequence
  Description of Artificial Sequence: Synthetic oligonucleotide
  Target: ATXN1; (-) strand; PAM type: NRG; PAM sequence: AAG
caagataaatgtctatactg

SEQ ID NO: 55325 - DNA, 20 bp, Artificial Sequence
  Description of Artificial Sequence: Synthetic oligonucleotide
  Target: ATXN1; (-) strand; PAM type: NRG; PAM sequence: AAG
cccatctctttgttacttac

SEQ ID NO: 55326 - DNA, 20 bp, Artificial Sequence
  Description of Artificial Sequence: Synthetic oligonucleotide
  Target: ATXN1; (-) strand; PAM type: NRG; PAM sequence: AGG
gtgggatagcatgagaactt

SEQ ID NO: 55327 - DNA, 20 bp, Artificial Sequence
  Description of Artificial Sequence: Synthetic oligonucleotide
  Target: ATXN1; (-) strand; PAM type: NRG; PAM sequence: TAG
ggtgggatagcatgagaact

SEQ ID NO: 55328 - DNA, 20 bp, Artificial Sequence
  Description of Artificial Sequence: Synthetic oligonucleotide
  Target: ATXN1; (-) strand; PAM type: NRG; PAM sequence: GAG
agcaggaggtgggatagcat

SEQ ID NO: 55329 - DNA, 20 bp, Artificial Sequence
  Description of Artificial Sequence: Synthetic oligonucleotide
  Target: ATXN1; (-) strand; PAM type: NRG; PAM sequence: TAG
aacacaagcaggaggtggga

SEQ ID NO: 55330 - DNA, 20 bp, Artificial Sequence
  Description of Artificial Sequence: Synthetic oligonucleotide
  Target: ATXN1; (-) strand; PAM type: NRG; PAM sequence: GGG
gagtaacacaagcaggaggt

SEQ ID NO: 55331 - DNA, 20 bp, Artificial Sequence
  Description of Artificial Sequence: Synthetic oligonucleotide
  Target: ATXN1; (-) strand; PAM type: NRG; PAM sequence: TGG
tgagtaacacaagcaggagg

SEQ ID NO: 55332 - DNA, 20 bp, Artificial Sequence
  Description of Artificial Sequence: Synthetic oligonucleotide
  Target: ATXN1; (-) strand; PAM type: NRG; PAM sequence: AGG
tagtgagtaacacaagcagg

SEQ ID NO: 55333 - DNA, 20 bp, Artificial Sequence
  Description of Artificial Sequence: Synthetic oligonucleotide
  Target: ATXN1; (-) strand; PAM type: NRG; PAM sequence: GAG
atagtgagtaacacaagcag

SEQ ID NO: 55334 - DNA, 20 bp, Artificial Sequence
  Description of Artificial Sequence: Synthetic oligonucleotide
  Target: ATXN1; (-) strand; PAM type: NRG; PAM sequence: AGG
gaatagtgagtaacacaagc

SEQ ID NO: 55335 - DNA, 20 bp, Artificial Sequence
  Description of Artificial Sequence: Synthetic oligonucleotide
  Target: ATXN1; (-) strand; PAM type: NRG; PAM sequence: CAG
tgaatagtgagtaacacaag

SEQ ID NO: 55336 - DNA, 20 bp, Artificial Sequence
  Description of Artificial Sequence: Synthetic oligonucleotide
  Target: ATXN1; (-) strand; PAM type: NRG; PAM sequence: AAG
ttttgaatagtgagtaacac

SEQ ID NO: 55337 - DNA, 20 bp, Artificial Sequence
  Description of Artificial Sequence: Synthetic oligonucleotide
  Target: ATXN1; (-) strand; PAM type: NRG; PAM sequence: GAG
attcttaaattttgaatagt

SEQ ID NO: 55338 - DNA, 20 bp, Artificial Sequence
  Description of Artificial Sequence: Synthetic oligonucleotide
  Target: ATXN1; (-) strand; PAM type: NRG; PAM sequence: TAG
tcttattcttaaattttgaa

SEQ ID NO: 55339 - DNA, 20 bp, Artificial Sequence
  Description of Artificial Sequence: Synthetic oligonucleotide
  Target: ATXN1; (-) strand; PAM type: NRG; PAM sequence: CAG
cggtcccatcccctttctcc

SEQ ID NO: 55340 - DNA, 20 bp, Artificial Sequence
  Description of Artificial Sequence: Synthetic oligonucleotide
  Target: ATXN1; (-) strand; PAM type: NRG; PAM sequence: CGG
agccgtgtttcagggatgct

SEQ ID NO: 55341 - DNA, 20 bp, Artificial Sequence
  Description of Artificial Sequence: Synthetic oligonucleotide
  Target: ATXN1; (-) strand; PAM type: NRG; PAM sequence: GGG
aagccctgagccgtgtttca

SEQ ID NO: 55342 - DNA, 20 bp, Artificial Sequence
  Description of Artificial Sequence: Synthetic oligonucleotide
  Target: ATXN1; (-) strand; PAM type: NRG; PAM sequence: AGG
caagccctgagccgtgtttc

SEQ ID NO: 55343 - DNA, 20 bp, Artificial Sequence
  Description of Artificial Sequence: Synthetic oligonucleotide
  Target: ATXN1; (-) strand; PAM type: NRG; PAM sequence: CAG
ccaagccctgagccgtgttt

SEQ ID NO: 55344 - DNA, 20 bp, Artificial Sequence
  Description of Artificial Sequence: Synthetic oligonucleotide
  Target: ATXN1; (-) strand; PAM type: NRG; PAM sequence: GAG
ataggagggaaccaagccct

SEQ ID NO: 55345 - DNA, 20 bp, Artificial Sequence
  Description of Artificial Sequence: Synthetic oligonucleotide
  Target: ATXN1; (-) strand; PAM type: NRG; PAM sequence: AAG
gatgggcataggagggaacc

SEQ ID NO: 55346 - DNA, 20 bp, Artificial Sequence
  Description of Artificial Sequence: Synthetic oligonucleotide
  Target: ATXN1; (-) strand; PAM type: NRG; PAM sequence: GGG
agcaggtgatgggcatagga

SEQ ID NO: 55347 - DNA, 20 bp, Artificial Sequence
  Description of Artificial Sequence: Synthetic oligonucleotide
  Target: ATXN1; (-) strand; PAM type: NRG; PAM sequence: AGG
gagcaggtgatgggcatagg

SEQ ID NO: 55348 - DNA, 20 bp, Artificial Sequence
  Description of Artificial Sequence: Synthetic oligonucleotide
  Target: ATXN1; (-) strand; PAM type: NRG; PAM sequence: GAG
ggagcaggtgatgggcatag

SEQ ID NO: 55349 - DNA, 20 bp, Artificial Sequence
  Description of Artificial Sequence: Synthetic oligonucleotide
  Target: ATXN1; (-) strand; PAM type: NRG; PAM sequence: AGG
agggagcaggtgatgggcat

SEQ ID NO: 55350 - DNA, 20 bp, Artificial Sequence
  Description of Artificial Sequence: Synthetic oligonucleotide
  Target: ATXN1; (-) strand; PAM type: NRG; PAM sequence: TAG
gagggagcaggtgatgggca

SEQ ID NO: 55351 - DNA, 20 bp, Artificial Sequence
  Description of Artificial Sequence: Synthetic oligonucleotide
  Target: ATXN1; (-) strand; PAM type: NRG; PAM sequence: GGG
tgagtgagggagcaggtgat

SEQ ID NO: 55352 - DNA, 20 bp, Artificial Sequence
  Description of Artificial Sequence: Synthetic oligonucleotide
  Target: ATXN1; (-) strand; PAM type: NRG; PAM sequence: TGG
ttgagtgagggagcaggtga

SEQ ID NO: 55353 - DNA, 20 bp, Artificial Sequence
  Description of Artificial Sequence: Synthetic oligonucleotide
  Target: ATXN1; (-) strand; PAM type: NRG; PAM sequence: AGG
ttgtggttgagtgagggagc

SEQ ID NO: 55354 - DNA, 20 bp, Artificial Sequence
  Description of Artificial Sequence: Synthetic oligonucleotide
  Target: ATXN1; (-) strand; PAM type: NRG; PAM sequence: CAG
tttgtggttgagtgagggag

SEQ ID NO: 55355 - DNA, 20 bp, Artificial Sequence
  Description of Artificial Sequence: Synthetic oligonucleotide
  Target: ATXN1; (-) strand; PAM type: NRG; PAM sequence: GAG
gtgtttgtggttgagtgagg

SEQ ID NO: 55356 - DNA, 20 bp, Artificial Sequence
  Description of Artificial Sequence: Synthetic oligonucleotide
  Target: ATXN1; (-) strand; PAM type: NRG; PAM sequence: GGG
ccgtgtttgtggttgagtga

SEQ ID NO: 55357 - DNA, 20 bp, Artificial Sequence
  Description of Artificial Sequence: Synthetic oligonucleotide
  Target: ATXN1; (-) strand; PAM type: NRG; PAM sequence: AGG
gccgtgtttgtggttgagtg

SEQ ID NO: 55358 - DNA, 20 bp, Artificial Sequence
  Description of Artificial Sequence: Synthetic oligonucleotide
  Target: ATXN1; (-) strand; PAM type: NRG; PAM sequence: GAG
agccgtgtttgtggttgagt

SEQ ID NO: 55359 - DNA, 20 bp, Artificial Sequence
  Description of Artificial Sequence: Synthetic oligonucleotide
  Target: ATXN1; (-) strand; PAM type: NRG; PAM sequence: GAG
ttgcagccgtgtttgtggtt

SEQ ID NO: 55360 - DNA, 20 bp, Artificial Sequence
  Description of Artificial Sequence: Synthetic oligonucleotide
  Target: ATXN1; (-) strand; PAM type: NRG; PAM sequence: TGG
tgatattgcagccgtgtttg

SEQ ID NO: 55361 - DNA, 20 bp, Artificial Sequence
  Description of Artificial Sequence: Synthetic oligonucleotide
  Target: ATXN1; (-) strand; PAM type: NRG; PAM sequence: CAG
gaacactgaccctgatattg

SEQ ID NO: 55362 - DNA, 20 bp, Artificial Sequence
  Description of Artificial Sequence: Synthetic oligonucleotide
  Target: ATXN1; (-) strand; PAM type: NRG; PAM sequence: TGG
gggtcatctgctacgggatg

SEQ ID NO: 55363 - DNA, 20 bp, Artificial Sequence
  Description of Artificial Sequence: Synthetic oligonucleotide
  Target: ATXN1; (-) strand; PAM type: NRG; PAM sequence: GGG
aacagagggtcatctgctac

SEQ ID NO: 55364 - DNA, 20 bp, Artificial Sequence
  Description of Artificial Sequence: Synthetic oligonucleotide
  Target: ATXN1; (-) strand; PAM type: NRG; PAM sequence: CGG
gaacagagggtcatctgcta

SEQ ID NO: 55365 - DNA, 20 bp, Artificial Sequence
  Description of Artificial Sequence: Synthetic oligonucleotide
  Target: ATXN1; (-) strand; PAM type: NRG; PAM sequence: GGG
tttgtttgttctggaacaga

SEQ ID NO: 55366 - DNA, 20 bp, Artificial Sequence
  Description of Artificial Sequence: Synthetic oligonucleotide
  Target: ATXN1; (-) strand; PAM type: NRG; PAM sequence: AGG
ctttgtttgttctggaacag

SEQ ID NO: 55367 - DNA, 20 bp, Artificial Sequence
  Description of Artificial Sequence: Synthetic oligonucleotide
  Target: ATXN1; (-) strand; PAM type: NRG; PAM sequence: GAG
actttgtttgttctggaaca

SEQ ID NO: 55368 - DNA, 20 bp, Artificial Sequence
  Description of Artificial Sequence: Synthetic oligonucleotide
  Target: ATXN1; (-) strand; PAM type: NRG; PAM sequence: CAG
acactttgtttgttctggaa

SEQ ID NO: 55369 - DNA, 20 bp, Artificial Sequence
  Description of Artificial Sequence: Synthetic oligonucleotide
  Target: ATXN1; (-) strand; PAM type: NRG; PAM sequence: TGG
ggtgcacactttgtttgttc

SEQ ID NO: 55370 - DNA, 20 bp, Artificial Sequence
  Description of Artificial Sequence: Synthetic oligonucleotide
  Target: ATXN1; (-) strand; PAM type: NRG; PAM sequence: GGG
ctaatgtcatcatgcttata

SEQ ID NO: 55371 - DNA, 20 bp, Artificial Sequence
  Description of Artificial Sequence: Synthetic oligonucleotide
  Target: ATXN1; (-) strand; PAM type: NRG; PAM sequence: AGG
tctaatgtcatcatgcttat

SEQ ID NO: 55372 - DNA, 20 bp, Artificial Sequence
  Description of Artificial Sequence: Synthetic oligonucleotide
  Target: ATXN1; (-) strand; PAM type: NRG; PAM sequence: TAG
ttctaatgtcatcatgctta

SEQ ID NO: 55373 - DNA, 20 bp, Artificial Sequence
  Description of Artificial Sequence: Synthetic oligonucleotide
  Target: ATXN1; (-) strand; PAM type: NRG; PAM sequence: AAG
gcatcttgaggctagctttg

SEQ ID NO: 55374 - DNA, 20 bp, Artificial Sequence
  Description of Artificial Sequence: Synthetic oligonucleotide
  Target: ATXN1; (-) strand; PAM type: NRG; PAM sequence: TAG
gtctgtgagcatcttgaggc

SEQ ID NO: 55375 - DNA, 20 bp, Artificial Sequence
  Description of Artificial Sequence: Synthetic oligonucleotide
  Target: ATXN1; (-) strand; PAM type: NRG; PAM sequence: AGG
atcagtctgtgagcatcttg

SEQ ID NO: 55376 - DNA, 20 bp, Artificial Sequence
  Description of Artificial Sequence: Synthetic oligonucleotide
  Target: ATXN1; (-) strand; PAM type: NRG; PAM sequence: GAG
tatcagtctgtgagcatctt

SEQ ID NO: 55377 - DNA, 20 bp, Artificial Sequence
  Description of Artificial Sequence: Synthetic oligonucleotide
  Target: ATXN1; (-) strand; PAM type: NRG; PAM sequence: GAG
agtggttaatatcagtctgt

SEQ ID NO: 55378 - DNA, 20 bp, Artificial Sequence
  Description of Artificial Sequence: Synthetic oligonucleotide
  Target: ATXN1; (-) strand; PAM type: NRG; PAM sequence: CAG
tggcagacagtggttaatat

SEQ ID NO: 55379 - DNA, 20 bp, Artificial Sequence
  Description of Artificial Sequence: Synthetic oligonucleotide
  Target: ATXN1; (-) strand; PAM type: NRG; PAM sequence: TGG
catatgcttgtggcagacag

SEQ ID NO: 55380 - DNA, 20 bp, Artificial Sequence
  Description of Artificial Sequence: Synthetic oligonucleotide
  Target: ATXN1; (-) strand; PAM type: NRG; PAM sequence: CAG
tgccatatgcttgtggcaga

SEQ ID NO: 55381 - DNA, 20 bp, Artificial Sequence
  Description of Artificial Sequence: Synthetic oligonucleotide
  Target: ATXN1; (-) strand; PAM type: NRG; PAM sequence: CAG
cttgtgccatatgcttgtgg

SEQ ID NO: 55382 - DNA, 20 bp, Artificial Sequence
  Description of Artificial Sequence: Synthetic oligonucleotide
  Target: ATXN1; (-) strand; PAM type: NRG; PAM sequence: TGG
tgtcttgtgccatatgcttg

SEQ ID NO: 55383 - DNA, 20 bp, Artificial Sequence
  Description of Artificial Sequence: Synthetic oligonucleotide
  Target: ATXN1; (-) strand; PAM type: NRG; PAM sequence: CAG
tctttccttgtgatctgctc

SEQ ID NO: 55384 - DNA, 20 bp, Artificial Sequence
  Description of Artificial Sequence: Synthetic oligonucleotide
  Target: ATXN1; (-) strand; PAM type: NRG; PAM sequence: GAG
ttgtgggccaatatgccaac

SEQ ID NO: 55385 - DNA, 20 bp, Artificial Sequence
  Description of Artificial Sequence: Synthetic oligonucleotide
  Target: ATXN1; (-) strand; PAM type: NRG; PAM sequence: GGG
tgcctctgtggcagtattgt

SEQ ID NO: 55386 - DNA, 20 bp, Artificial Sequence
  Description of Artificial Sequence: Synthetic oligonucleotide
  Target: ATXN1; (-) strand; PAM type: NRG; PAM sequence: TGG
ctgcctctgtggcagtattg

SEQ ID NO: 55387 - DNA, 20 bp, Artificial Sequence
  Description of Artificial Sequence: Synthetic oligonucleotide
  Target: ATXN1; (-) strand; PAM type: NRG; PAM sequence: CAG
tctaagctctgcctctgtgg

SEQ ID NO: 55388 - DNA, 20 bp, Artificial Sequence
  Description of Artificial Sequence: Synthetic oligonucleotide
  Target: ATXN1; (-) strand; PAM type: NRG; PAM sequence: TGG
ctctctaagctctgcctctg

SEQ ID NO: 55389 - DNA, 20 bp, Artificial Sequence
  Description of Artificial Sequence: Synthetic oligonucleotide
  Target: ATXN1; (-) strand; PAM type: NRG; PAM sequence: AAG
ccttgcctagcaccctctct

SEQ ID NO: 55390 - DNA, 20 bp, Artificial Sequence
  Description of Artificial Sequence: Synthetic oligonucleotide
  Target: ATXN1; (-) strand; PAM type: NRG; PAM sequence: TAG
tagcggatgaatgccttgcc

SEQ ID NO: 55391 - DNA, 20 bp, Artificial Sequence
  Description of Artificial Sequence: Synthetic oligonucleotide
  Target: ATXN1; (-) strand; PAM type: NRG; PAM sequence: CGG
ccctttccagagtgaaatag

SEQ ID NO: 55392 - DNA, 20 bp, Artificial Sequence
  Description of Artificial Sequence: Synthetic oligonucleotide
  Target: ATXN1; (-) strand; PAM type: NRG; PAM sequence: TAG
atcccctttccagagtgaaa

SEQ ID NO: 55393 - DNA, 20 bp, Artificial Sequence
  Description of Artificial Sequence: Synthetic oligonucleotide
  Target: ATXN1; (-) strand; PAM type: NRG; PAM sequence: GAG
cccaactgatcccctttcca

SEQ ID NO: 55394 - DNA, 20 bp, Artificial Sequence
  Description of Artificial Sequence: Synthetic oligonucleotide
  Target: ATXN1; (-) strand; PAM type: NRG; PAM sequence: CAG
cccccaactgatcccctttc

SEQ ID NO: 55395 - DNA, 20 bp, Artificial Sequence
  Description of Artificial Sequence: Synthetic oligonucleotide
  Target: ATXN1; (-) strand; PAM type: NRG; PAM sequence: CAG
ttctgtcctcaaaaggtttg

SEQ ID NO: 55396 - DNA, 20 bp, Artificial Sequence
  Description of Artificial Sequence: Synthetic oligonucleotide
  Target: ATXN1; (-) strand; PAM type: NRG; PAM sequence: AGG
tattgccttctgtcctcaaa

SEQ ID NO: 55397 - DNA, 20 bp, Artificial Sequence
  Description of Artificial Sequence: Synthetic oligonucleotide
  Target: ATXN1; (-) strand; PAM type: NRG; PAM sequence: AAG
atattgccttctgtcctcaa

SEQ ID NO: 55398 - DNA, 20 bp, Artificial Sequence
  Description of Artificial Sequence: Synthetic oligonucleotide
  Target: ATXN1; (-) strand; PAM type: NRG; PAM sequence: AAG
gctcattactcataaatttc

SEQ ID NO: 55399 - DNA, 20 bp, Artificial Sequence
  Description of Artificial Sequence: Synthetic oligonucleotide
  Target: ATXN1; (-) strand; PAM type: NRG; PAM sequence: TGG
tcaacttccttctcccaaaa

SEQ ID NO: 55400 - DNA, 20 bp, Artificial Sequence
  Description of Artificial Sequence: Synthetic oligonucleotide
  Target: ATXN1; (-) strand; PAM type: NRG; PAM sequence: CAG
agccctgtcaaaatgaatga

SEQ ID NO: 55401 - DNA, 20 bp, Artificial Sequence
  Description of Artificial Sequence: Synthetic oligonucleotide
  Target: ATXN1; (-) strand; PAM type: NRG; PAM sequence: AAG
tctcctccttttgtgttaat

SEQ ID NO: 55402 - DNA, 20 bp, Artificial Sequence
  Description of Artificial Sequence: Synthetic oligonucleotide
  Target: ATXN1; (-) strand; PAM type: NRG; PAM sequence: CAG
aagtgccccaccctccccac

SEQ ID NO: 55403 - DNA, 20 bp, Artificial Sequence
  Description of Artificial Sequence: Synthetic oligonucleotide
  Target: ATXN1; (-) strand; PAM type: NRG; PAM sequence: AAG
tcctctctgcaccttcccac

SEQ ID NO: 55404 - DNA, 20 bp, Artificial Sequence
  Description of Artificial Sequence: Synthetic oligonucleotide
  Target: ATXN1; (-) strand; PAM type: NRG; PAM sequence: TGG
ctcattctcatttgcctggc

SEQ ID NO: 55405 - DNA, 20 bp, Artificial Sequence
  Description of Artificial Sequence: Synthetic oligonucleotide
  Target: ATXN1; (-) strand; PAM type: NRG; PAM sequence: TGG
atttctcattctcatttgcc

SEQ ID NO: 55406 - DNA, 20 bp, Artificial Sequence
  Description of Artificial Sequence: Synthetic oligonucleotide
  Target: ATXN1; (-) strand; PAM type: NRG; PAM sequence: AGG
ttaccagcagctcctccata

SEQ ID NO: 55407 - DNA, 20 bp, Artificial Sequence
  Description of Artificial Sequence: Synthetic oligonucleotide
  Target: ATXN1; (-) strand; PAM type: NRG; PAM sequence: AAG
cttaccagcagctcctccat

SEQ ID NO: 55408 - DNA, 20 bp, Artificial Sequence
  Description of Artificial Sequence: Synthetic oligonucleotide
  Target: ATXN1; (-) strand; PAM type: NRG; PAM sequence: CAG
tggccagggtagcttaccag

SEQ ID NO: 55409 - DNA, 20 bp, Artificial Sequence
  Description of Artificial Sequence: Synthetic oligonucleotide
  Target: ATXN1; (-) strand; PAM type: NRG; PAM sequence: CAG
ctttggccagggtagcttac

SEQ ID NO: 55410 - DNA, 20 bp, Artificial Sequence
  Description of Artificial Sequence: Synthetic oligonucleotide
  Target: ATXN1; (-) strand; PAM type: NRG; PAM sequence: TAG
acattttcctttggccaggg

SEQ ID NO: 55411 - DNA, 20 bp, Artificial Sequence
  Description of Artificial Sequence: Synthetic oligonucleotide
  Target: ATXN1; (-) strand; PAM type: NRG; PAM sequence: GGG
tcaacattttcctttggcca

SEQ ID NO: 55412 - DNA, 20 bp, Artificial Sequence
  Description of Artificial Sequence: Synthetic oligonucleotide
  Target: ATXN1; (-) strand; PAM type: NRG; PAM sequence: AGG
atcaacattttcctttggcc

SEQ ID NO: 55413 - DNA, 20 bp, Artificial Sequence
  Description of Artificial Sequence: Synthetic oligonucleotide
  Target: ATXN1; (-) strand; PAM type: NRG; PAM sequence: CAG
aatcaacattttcctttggc

SEQ ID NO: 55414 - DNA, 20 bp, Artificial Sequence
  Description of Artificial Sequence: Synthetic oligonucleotide
  Target: ATXN1; (-) strand; PAM type: NRG; PAM sequence: TGG
gtccaatcaacattttcctt

SEQ ID NO: 55415 - DNA, 20 bp, Artificial Sequence
  Description of Artificial Sequence: Synthetic oligonucleotide
  Target: ATXN1; (-) strand; PAM type: NRG; PAM sequence: TGG
gtctgtttccctctgaaaat

SEQ ID NO: 55416 - DNA, 20 bp, Artificial Sequence
  Description of Artificial Sequence: Synthetic oligonucleotide
  Target: ATXN1; (-) strand; PAM type: NRG; PAM sequence: GAG
tcatccatctgcttgcagaa

SEQ ID NO: 55417 - DNA, 20 bp, Artificial Sequence
  Description of Artificial Sequence: Synthetic oligonucleotide
  Target: ATXN1; (-) strand; PAM type: NRG; PAM sequence: AAG
tgtcatccatctgcttgcag

SEQ ID NO: 55418 - DNA, 20 bp, Artificial Sequence
  Description of Artificial Sequence: Synthetic oligonucleotide
  Target: ATXN1; (-) strand; PAM type: NRG; PAM sequence: CAG
atttgtcatccatctgcttg

SEQ ID NO: 55419 - DNA, 20 bp, Artificial Sequence
  Description of Artificial Sequence: Synthetic oligonucleotide
  Target: ATXN1; (-) strand; PAM type: NRG; PAM sequence: GAG
aacaacacagcctcctccta

SEQ ID NO: 55420 - DNA, 20 bp, Artificial Sequence
  Description of Artificial Sequence: Synthetic oligonucleotide
  Target: ATXN1; (-) strand; PAM type: NRG; PAM sequence: TAG
tgaacaacacagcctcctcc

SEQ ID NO: 55421 - DNA, 20 bp, Artificial Sequence
  Description of Artificial Sequence: Synthetic oligonucleotide
  Target: ATXN1; (-) strand; PAM type: NRG; PAM sequence: CAG
catttcacacatgaacaaca

SEQ ID NO: 55422 - DNA, 20 bp, Artificial Sequence
  Description of Artificial Sequence: Synthetic oligonucleotide
  Target: ATXN1; (-) strand; PAM type: NRG; PAM sequence: AAG
ggcgcttttactccttggct

SEQ ID NO: 55423 - DNA, 20 bp, Artificial Sequence
  Description of Artificial Sequence: Synthetic oligonucleotide
  Target: ATXN1; (-) strand; PAM type: NRG; PAM sequence: TGG
ggcttggcgcttttactcct

SEQ ID NO: 55424 - DNA, 20 bp, Artificial Sequence
  Description of Artificial Sequence: Synthetic oligonucleotide
  Target: ATXN1; (-) strand; PAM type: NRG; PAM sequence: TGG
ctctgcttacatacatggct

SEQ ID NO: 55425 - DNA, 20 bp, Artificial Sequence
  Description of Artificial Sequence: Synthetic oligonucleotide
  Target: ATXN1; (-) strand; PAM type: NRG; PAM sequence: TGG
ggtggctctgcttacataca

SEQ ID NO: 55426 - DNA, 20 bp, Artificial Sequence
  Description of Artificial Sequence: Synthetic oligonucleotide
  Target: ATXN1; (-) strand; PAM type: NRG; PAM sequence: TGG
accaccacacacaggccagg

SEQ ID NO: 55427 - DNA, 20 bp, Artificial Sequence
  Description of Artificial Sequence: Synthetic oligonucleotide
  Target: ATXN1; (-) strand; PAM type: NRG; PAM sequence: AGG
cccaccaccacacacaggcc

SEQ ID NO: 55428 - DNA, 20 bp, Artificial Sequence
  Description of Artificial Sequence: Synthetic oligonucleotide
  Target: ATXN1; (-) strand; PAM type: NRG; PAM sequence: CAG
ccccaccaccacacacaggc

SEQ ID NO: 55429 - DNA, 20 bp, Artificial Sequence
  Description of Artificial Sequence: Synthetic oligonucleotide
  Target: ATXN1; (-) strand; PAM type: NRG; PAM sequence: AGG
tcggccccaccaccacacac

SEQ ID NO: 55430 - DNA, 20 bp, Artificial Sequence
  Description of Artificial Sequence: Synthetic oligonucleotide
  Target: ATXN1; (-) strand; PAM type: NRG; PAM sequence: CAG
ctcggccccaccaccacaca

SEQ ID NO: 55431 - DNA, 20 bp, Artificial Sequence
  Description of Artificial Sequence: Synthetic oligonucleotide
  Target: ATXN1; (-) strand; PAM type: NRG; PAM sequence: CGG
gacacacacacacacacact

SEQ ID NO: 55432 - DNA, 20 bp, Artificial Sequence
  Description of Artificial Sequence: Synthetic oligonucleotide
  Target: ATXN1; (-) strand; PAM type: NRG; PAM sequence: CAG
ctctcacacacacacacata

SEQ ID NO: 55433 - DNA, 20 bp, Artificial Sequence
  Description of Artificial Sequence: Synthetic oligonucleotide
  Target: ATXN1; (-) strand; PAM type: NRG; PAM sequence: CAG
tcagcaagagattttgctgc

SEQ ID NO: 55434 - DNA, 20 bp, Artificial Sequence
  Description of Artificial Sequence: Synthetic oligonucleotide
  Target: ATXN1; (-) strand; PAM type: NRG; PAM sequence: GAG
tgtcctggagttttcagcaa

SEQ ID NO: 55435 - DNA, 20 bp, Artificial Sequence
  Description of Artificial Sequence: Synthetic oligonucleotide
  Target: ATXN1; (-) strand; PAM type: NRG; PAM sequence: AAG
agtgtcctggagttttcagc

SEQ ID NO: 55436 - DNA, 20 bp, Artificial Sequence
  Description of Artificial Sequence: Synthetic oligonucleotide
  Target: ATXN1; (-) strand; PAM type: NRG; PAM sequence: CAG
ttaaagtgtcctggagtttt

SEQ ID NO: 55437 - DNA, 20 bp, Artificial Sequence
  Description of Artificial Sequence: Synthetic oligonucleotide
  Target: ATXN1; (-) strand; PAM type: NRG; PAM sequence: GAG
tgcttggttaaagtgtcctg

SEQ ID NO: 55438 - DNA, 20 bp, Artificial Sequence
  Description of Artificial Sequence: Synthetic oligonucleotide
  Target: ATXN1; (-) strand; PAM type: NRG; PAM sequence: TGG
gctgcttggttaaagtgtcc

SEQ ID NO: 55439 - DNA, 20 bp, Artificial Sequence
  Description of Artificial Sequence: Synthetic oligonucleotide
  Target: ATXN1; (-) strand; PAM type: NRG; PAM sequence: AAG
aaatgggggctgcttggtta

SEQ ID NO: 55440 - DNA, 20 bp, Artificial Sequence
  Description of Artificial Sequence: Synthetic oligonucleotide
  Target: ATXN1; (-) strand; PAM type: NRG; PAM sequence: TGG
atgtacaaatgggggctgct

SEQ ID NO: 55441 - DNA, 20 bp, Artificial Sequence
  Description of Artificial Sequence: Synthetic oligonucleotide
  Target: ATXN1; (-) strand; PAM type: NRG; PAM sequence: GGG
agacagagatgtacaaatgg

SEQ ID NO: 55442 - DNA, 20 bp, Artificial Sequence
  Description of Artificial Sequence: Synthetic oligonucleotide
  Target: ATXN1; (-) strand; PAM type: NRG; PAM sequence: GGG
tagacagagatgtacaaatg

SEQ ID NO: 55443 - DNA, 20 bp, Artificial Sequence
  Description of Artificial Sequence: Synthetic oligonucleotide
  Target: ATXN1; (-) strand; PAM type: NRG; PAM sequence: GGG
atagacagagatgtacaaat

SEQ ID NO: 55444 - DNA, 20 bp, Artificial Sequence
  Description of Artificial Sequence: Synthetic oligonucleotide
  Target: ATXN1; (-) strand; PAM type: NRG; PAM sequence: TGG
gatagacagagatgtacaaa

SEQ ID NO: 55445 - DNA, 20 bp, Artificial Sequence
  Description of Artificial Sequence: Synthetic oligonucleotide
  Target: ATXN1; (-) strand; PAM type: NRG; PAM sequence: GAG
cagagagacagagatagaca

SEQ ID NO: 55446 - DNA, 20 bp, Artificial Sequence
  Description of Artificial Sequence: Synthetic oligonucleotide
  Target: ATXN1; (-) strand; PAM type: NRG; PAM sequence: CAG
gacagagagacagagataga

SEQ ID NO: 55447 - DNA, 20 bp, Artificial Sequence
  Description of Artificial Sequence: Synthetic oligonucleotide
  Target: ATXN1; (-) strand; PAM type: NRG; PAM sequence: TAG
acaagacagagagacagaga

SEQ ID NO: 55448 - DNA, 20 bp, Artificial Sequence
  Description of Artificial Sequence: Synthetic oligonucleotide
  Target: ATXN1; (-) strand; PAM type: NRG; PAM sequence: GAG
aaaaacaagacagagagaca

SEQ ID NO: 55449 - DNA, 20 bp, Artificial Sequence
  Description of Artificial Sequence: Synthetic oligonucleotide
  Target: ATXN1; (-) strand; PAM type: NRG; PAM sequence: CAG
gaaaaaacaagacagagaga

SEQ ID NO: 55450 - DNA, 20 bp, Artificial Sequence
  Description of Artificial Sequence: Synthetic oligonucleotide
  Target: ATXN1; (-) strand; PAM type: NRG; PAM sequence: GAG
aaaggaaaaaacaagacaga

SEQ ID NO: 55451 - DNA, 20 bp, Artificial Sequence
  Description of Artificial Sequence: Synthetic oligonucleotide
  Target: ATXN1; (-) strand; PAM type: NRG; PAM sequence: GAG
agaaaggaaaaaacaagaca

SEQ ID NO: 55452 - DNA, 20 bp, Artificial Sequence
  Description of Artificial Sequence: Synthetic oligonucleotide
  Target: ATXN1; (-) strand; PAM type: NRG; PAM sequence: CAG
caagaaaggaaaaaacaaga

SEQ ID NO: 55453 - DNA, 20 bp, Artificial Sequence
  Description of Artificial Sequence: Synthetic oligonucleotide
  Target: ATXN1; (-) strand; PAM type: NRG; PAM sequence: AAG
gaaacaagaaaggaaaaaac

SEQ ID NO: 55454 - DNA, 20 bp, Artificial Sequence
  Description of Artificial Sequence: Synthetic oligonucleotide
  Target: ATXN1; (-) strand; PAM type: NRG; PAM sequence: AGG
gagggggagggaaacaagaa

SEQ ID NO: 55455 - DNA, 20 bp, Artificial Sequence
  Description of Artificial Sequence: Synthetic oligonucleotide
  Target: ATXN1; (-) strand; PAM type: NRG; PAM sequence: AAG
agagggggagggaaacaaga

SEQ ID NO: 55456 - DNA, 20 bp, Artificial Sequence
  Description of Artificial Sequence: Synthetic oligonucleotide
  Target: ATXN1; (-) strand; PAM type: NRG; PAM sequence: AAG
ggatagagggggagggaaac

SEQ ID NO: 55457 - DNA, 20 bp, Artificial Sequence
  Description of Artificial Sequence: Synthetic oligonucleotide
  Target: ATXN1; (-) strand; PAM type: NRG; PAM sequence: GGG
ggatgctggatagaggggga

SEQ ID NO: 55458 - DNA, 20 bp, Artificial Sequence
  Description of Artificial Sequence: Synthetic oligonucleotide
  Target: ATXN1; (-) strand; PAM type: NRG; PAM sequence: AGG
gggatgctggatagaggggg

SEQ ID NO: 55459 - DNA, 20 bp, Artificial Sequence
  Description of Artificial Sequence: Synthetic oligonucleotide
  Target: ATXN1; (-) strand; PAM type: NRG; PAM sequence: GAG
ggggatgctggatagagggg

SEQ ID NO: 55460 - DNA, 20 bp, Artificial Sequence
  Description of Artificial Sequence: Synthetic oligonucleotide
  Target: ATXN1; (-) strand; PAM type: NRG; PAM sequence: GGG
aaggggatgctggatagagg

SEQ ID NO: 55461 - DNA, 20 bp, Artificial Sequence
  Description of Artificial Sequence: Synthetic oligonucleotide
  Target: ATXN1; (-) strand; PAM type: NRG; PAM sequence: GGG
caaggggatgctggatagag

SEQ ID NO: 55462 - DNA, 20 bp, Artificial Sequence
  Description of Artificial Sequence: Synthetic oligonucleotide
  Target: ATXN1; (-) strand; PAM type: NRG; PAM sequence: GGG
gcaaggggatgctggataga

SEQ ID NO: 55463 - DNA, 20 bp, Artificial Sequence
  Description of Artificial Sequence: Synthetic oligonucleotide
  Target: ATXN1; (-) strand; PAM type: NRG; PAM sequence: AGG
agcaaggggatgctggatag

SEQ ID NO: 55464 - DNA, 20 bp, Artificial Sequence
  Description of Artificial Sequence: Synthetic oligonucleotide
  Target: ATXN1; (-) strand; PAM type: NRG; PAM sequence: GAG
cagcaaggggatgctggata

SEQ ID NO: 55465 - DNA, 20 bp, Artificial Sequence
  Description of Artificial Sequence: Synthetic oligonucleotide
  Target: ATXN1; (-) strand; PAM type: NRG; PAM sequence: TAG
agcagcaaggggatgctgga

SEQ ID NO: 55466 - DNA, 20 bp, Artificial Sequence
  Description of Artificial Sequence: Synthetic oligonucleotide
  Target: ATXN1; (-) strand; PAM type: NRG; PAM sequence: TGG
ttaaagcagcaaggggatgc

SEQ ID NO: 55467 - DNA, 20 bp, Artificial Sequence
  Description of Artificial Sequence: Synthetic oligonucleotide
  Target: ATXN1; (-) strand; PAM type: NRG; PAM sequence: GGG
gaaaaggttaaagcagcaag

SEQ ID NO: 55468 - DNA, 20 bp, Artificial Sequence
  Description of Artificial Sequence: Synthetic oligonucleotide
  Target: ATXN1; (-) strand; PAM type: NRG; PAM sequence: GGG
ggaaaaggttaaagcagcaa

SEQ ID NO: 55469 - DNA, 20 bp, Artificial Sequence
  Description of Artificial Sequence: Synthetic oligonucleotide
  Target: ATXN1; (-) strand; PAM type: NRG; PAM sequence: AGG
gggaaaaggttaaagcagca

SEQ ID NO: 55470 - DNA, 20 bp, Artificial Sequence
  Description of Artificial Sequence: Synthetic oligonucleotide
  Target: ATXN1; (-) strand; PAM type: NRG; PAM sequence: AAG
ggggaaaaggttaaagcagc

SEQ ID NO: 55471 - DNA, 20 bp, Artificial Sequence
  Description of Artificial Sequence: Synthetic oligonucleotide
  Target: ATXN1; (-) strand; PAM type: NRG; PAM sequence: CAG
gatgggggaaaaggttaaag

SEQ ID NO: 55472 - DNA, 20 bp, Artificial Sequence
  Description of Artificial Sequence: Synthetic oligonucleotide
  Target: ATXN1; (-) strand; PAM type: NRG; PAM sequence: AAG
agagatgggggaaaaggtta

SEQ ID NO: 55473 - DNA, 20 bp, Artificial Sequence
  Description of Artificial Sequence: Synthetic oligonucleotide
  Target: ATXN1; (-) strand; PAM type: NRG; PAM sequence: AGG
catctaagagatgggggaaa

SEQ ID NO: 55474 - DNA, 20 bp, Artificial Sequence
  Description of Artificial Sequence: Synthetic oligonucleotide
  Target: ATXN1; (-) strand; PAM type: NRG; PAM sequence: AAG
acatctaagagatgggggaa

SEQ ID NO: 55475 - DNA, 20 bp, Artificial Sequence
  Description of Artificial Sequence: Synthetic oligonucleotide
  Target: ATXN1; (-) strand; PAM type: NRG; PAM sequence: GGG
aagatacatctaagagatgg

SEQ ID NO: 55476 - DNA, 20 bp, Artificial Sequence
  Description of Artificial Sequence: Synthetic oligonucleotide
  Target: ATXN1; (-) strand; PAM type: NRG; PAM sequence: GGG
caagatacatctaagagatg

SEQ ID NO: 55477 - DNA, 20 bp, Artificial Sequence
  Description of Artificial Sequence: Synthetic oligonucleotide
  Target: ATXN1; (-) strand; PAM type: NRG; PAM sequence: GGG
acaagatacatctaagagat

SEQ ID NO: 55478 - DNA, 20 bp, Artificial Sequence
  Description of Artificial Sequence: Synthetic oligonucleotide
  Target: ATXN1; (-) strand; PAM type: NRG; PAM sequence: TGG
gacaagatacatctaagaga

SEQ ID NO: 55479 - DNA, 20 bp, Artificial Sequence
  Description of Artificial Sequence: Synthetic oligonucleotide
  Target: ATXN1; (-) strand; PAM type: NRG; PAM sequence: GAG
acaggacaagatacatctaa

SEQ ID NO: 55480 - DNA, 20 bp, Artificial Sequence
  Description of Artificial Sequence: Synthetic oligonucleotide
  Target: ATXN1; (-) strand; PAM type: NRG; PAM sequence: AAG
ccacaggacaagatacatct

SEQ ID NO: 55481 - DNA, 20 bp, Artificial Sequence
  Description of Artificial Sequence: Synthetic oligonucleotide
  Target: ATXN1; (-) strand; PAM type: NRG; PAM sequence: AAG
atcttatagttccacaggac

SEQ ID NO: 55482 - DNA, 20 bp, Artificial Sequence
  Description of Artificial Sequence: Synthetic oligonucleotide
  Target: ATXN1; (-) strand; PAM type: NRG; PAM sequence: AGG
tttggatcttatagttccac

SEQ ID NO: 55483 - DNA, 20 bp, Artificial Sequence
  Description of Artificial Sequence: Synthetic oligonucleotide
  Target: ATXN1; (-) strand; PAM type: NRG; PAM sequence: CAG
ttttggatcttatagttcca

SEQ ID NO: 55484 - DNA, 20 bp, Artificial Sequence
  Description of Artificial Sequence: Synthetic oligonucleotide
  Target: ATXN1; (-) strand; PAM type: NRG; PAM sequence: TAG
cccccagtttttggatctta

SEQ ID NO: 55485 - DNA, 20 bp, Artificial Sequence
  Description of Artificial Sequence: Synthetic oligonucleotide
  Target: ATXN1; (-) strand; PAM type: NRG; PAM sequence: TGG
tttttctttcccccagtttt

SEQ ID NO: 55486 - DNA, 20 bp, Artificial Sequence
  Description of Artificial Sequence: Synthetic oligonucleotide
  Target: ATXN1; (-) strand; PAM type: NRG; PAM sequence: CAG
ttttttttttttctttcccc

SEQ ID NO: 55487 - DNA, 20 bp, Artificial Sequence
  Description of Artificial Sequence: Synthetic oligonucleotide
  Target: ATXN1; (-) strand; PAM type: NRG; PAM sequence: TGG
atctcgatcctgcctctact

SEQ ID NO: 55488 - DNA, 20 bp, Artificial Sequence
  Description of Artificial Sequence: Synthetic oligonucleotide
  Target: ATXN1; (-) strand; PAM type: NRG; PAM sequence: TGG
tctgctggcagattattttc

SEQ ID NO: 55489 - DNA, 20 bp, Artificial Sequence
  Description of Artificial Sequence: Synthetic oligonucleotide
  Target: ATXN1; (-) strand; PAM type: NRG; PAM sequence: CAG
ctgagcttggcctctgctgg

SEQ ID NO: 55490 - DNA, 20 bp, Artificial Sequence
  Description of Artificial Sequence: Synthetic oligonucleotide
  Target: ATXN1; (-) strand; PAM type: NRG; PAM sequence: TGG
gttctgagcttggcctctgc

SEQ ID NO: 55491 - DNA, 20 bp, Artificial Sequence
  Description of Artificial Sequence: Synthetic oligonucleotide
  Target: ATXN1; (-) strand; PAM type: NRG; PAM sequence: TGG
tgaagggcttgttctgagct

SEQ ID NO: 55492 - DNA, 20 bp, Artificial Sequence
  Description of Artificial Sequence: Synthetic oligonucleotide
  Target: ATXN1; (-) strand; PAM type: NRG; PAM sequence: GAG
ggcattgaagggcttgttct

SEQ ID NO: 55493 - DNA, 20 bp, Artificial Sequence
  Description of Artificial Sequence: Synthetic oligonucleotide
  Target: ATXN1; (-) strand; PAM type: NRG; PAM sequence: GGG
tttaggtgagcggcattgaa

SEQ ID NO: 55494 - DNA, 20 bp, Artificial Sequence
  Description of Artificial Sequence: Synthetic oligonucleotide
  Target: ATXN1; (-) strand; PAM type: NRG; PAM sequence: AGG
ctttaggtgagcggcattga

SEQ ID NO: 55495 - DNA, 20 bp, Artificial Sequence
  Description of Artificial Sequence: Synthetic oligonucleotide
  Target: ATXN1; (-) strand; PAM type: NRG; PAM sequence: AAG
gctttaggtgagcggcattg

SEQ ID NO: 55496 - DNA, 20 bp, Artificial Sequence
  Description of Artificial Sequence: Synthetic oligonucleotide
  Target: ATXN1; (-) strand; PAM type: NRG; PAM sequence: CGG
ggggcggggctttaggtgag

SEQ ID NO: 55497 - DNA, 20 bp, Artificial Sequence
  Description of Artificial Sequence: Synthetic oligonucleotide
  Target: ATXN1; (-) strand; PAM type: NRG; PAM sequence: GAG
gagggggcggggctttaggt

SEQ ID NO: 55498 - DNA, 20 bp, Artificial Sequence
  Description of Artificial Sequence: Synthetic oligonucleotide
  Target: ATXN1; (-) strand; PAM type: NRG; PAM sequence: AGG
tggtgagggggcggggcttt

SEQ ID NO: 55499 - DNA, 20 bp, Artificial Sequence
  Description of Artificial Sequence: Synthetic oligonucleotide
  Target: ATXN1; (-) strand; PAM type: NRG; PAM sequence: TAG
ttggtgagggggcggggctt

SEQ ID NO: 55500 - DNA, 20 bp, Artificial Sequence
  Description of Artificial Sequence: Synthetic oligonucleotide
  Target: ATXN1; (-) strand; PAM type: NRG; PAM sequence: GGG
actttattggtgagggggcg

SEQ ID NO: 55501 - DNA, 20 bp, Artificial Sequence
  Description of Artificial Sequence: Synthetic oligonucleotide
  Target: ATXN1; (-) strand; PAM type: NRG; PAM sequence: GGG
gactttattggtgagggggc

SEQ ID NO: 55502 - DNA, 20 bp, Artificial Sequence
  Description of Artificial Sequence: Synthetic oligonucleotide
  Target: ATXN1; (-) strand; PAM type: NRG; PAM sequence: CGG
agactttattggtgaggggg

SEQ ID NO: 55503 - DNA, 20 bp, Artificial Sequence
  Description of Artificial Sequence: Synthetic oligonucleotide
  Target: ATXN1; (-) strand; PAM type: NRG; PAM sequence: GGG
aatagactttattggtgagg

SEQ ID NO: 55504 - DNA, 20 bp, Artificial Sequence
  Description of Artificial Sequence: Synthetic oligonucleotide
  Target: ATXN1; (-) strand; PAM type: NRG; PAM sequence: GGG
gaatagactttattggtgag

SEQ ID NO: 55505 - DNA, 20 bp, Artificial Sequence
  Description of Artificial Sequence: Synthetic oligonucleotide
  Target: ATXN1; (-) strand; PAM type: NRG; PAM sequence: GGG
agaatagactttattggtga

SEQ ID NO: 55506 - DNA, 20 bp, Artificial Sequence
  Description of Artificial Sequence: Synthetic oligonucleotide
  Target: ATXN1; (-) strand; PAM type: NRG; PAM sequence: AGG
gagaatagactttattggtg

SEQ ID NO: 55507 - DNA, 20 bp, Artificial Sequence
  Description of Artificial Sequence: Synthetic oligonucleotide
  Target: ATXN1; (-) strand; PAM type: NRG; PAM sequence: GAG
tgagaatagactttattggt

SEQ ID NO: 55508 - DNA, 20 bp, Artificial Sequence
  Description of Artificial Sequence: Synthetic oligonucleotide
  Target: ATXN1; (-) strand; PAM type: NRG; PAM sequence: TGG
tccatgagaatagactttat

SEQ ID NO: 55509 - DNA, 20 bp, Artificial Sequence
  Description of Artificial Sequence: Synthetic oligonucleotide
  Target: ATXN1; (-) strand; PAM type: NRG; PAM sequence: TAG
tacaatctggtccatgagaa

SEQ ID NO: 55510 - DNA, 20 bp, Artificial Sequence
  Description of Artificial Sequence: Synthetic oligonucleotide
  Target: ATXN1; (-) strand; PAM type: NRG; PAM sequence: GAG
cgacatacaatctggtccat

SEQ ID NO: 55511 - DNA, 20 bp, Artificial Sequence
  Description of Artificial Sequence: Synthetic oligonucleotide
  Target: ATXN1; (-) strand; PAM type: NRG; PAM sequence: TGG
ctcttctccgacatacaatc

SEQ ID NO: 55512 - DNA, 20 bp, Artificial Sequence
  Description of Artificial Sequence: Synthetic oligonucleotide
  Target: ATXN1; (-) strand; PAM type: NRG; PAM sequence: AAG
ctagaccgtgtccatccaca

SEQ ID NO: 55513 - DNA, 20 bp, Artificial Sequence
  Description of Artificial Sequence: Synthetic oligonucleotide
  Target: ATXN1; (-) strand; PAM type: NRG; PAM sequence: TAG
gagagttccatgtctggatc

SEQ ID NO: 55514 - DNA, 20 bp, Artificial Sequence
  Description of Artificial Sequence: Synthetic oligonucleotide
  Target: ATXN1; (-) strand; PAM type: NRG; PAM sequence: TGG
gacatggagagttccatgtc

SEQ ID NO: 55515 - DNA, 20 bp, Artificial Sequence
  Description of Artificial Sequence: Synthetic oligonucleotide
  Target: ATXN1; (-) strand; PAM type: NRG; PAM sequence: GAG
cccccagtcaaggacatgga

SEQ ID NO: 55516 - DNA, 20 bp, Artificial Sequence
  Description of Artificial Sequence: Synthetic oligonucleotide
  Target: ATXN1; (-) strand; PAM type: NRG; PAM sequence: GAG
ggcccccagtcaaggacatg

SEQ ID NO: 55517 - DNA, 20 bp, Artificial Sequence
  Description of Artificial Sequence: Synthetic oligonucleotide
  Target: ATXN1; (-) strand; PAM type: NRG; PAM sequence: TGG
atggcccccagtcaaggaca

SEQ ID NO: 55518 - DNA, 20 bp, Artificial Sequence
  Description of Artificial Sequence: Synthetic oligonucleotide
  Target: ATXN1; (-) strand; PAM type: NRG; PAM sequence: AGG
agaagcatggcccccagtca

SEQ ID NO: 55519 - DNA, 20 bp, Artificial Sequence
  Description of Artificial Sequence: Synthetic oligonucleotide
  Target: ATXN1; (-) strand; PAM type: NRG; PAM sequence: AAG
gagaagcatggcccccagtc

SEQ ID NO: 55520 - DNA, 20 bp, Artificial Sequence
  Description of Artificial Sequence: Synthetic oligonucleotide
  Target: ATXN1; (-) strand; PAM type: NRG; PAM sequence: CAG
ctggagagaagcatggcccc

SEQ ID NO: 55521 - DNA, 20 bp, Artificial Sequence
  Description of Artificial Sequence: Synthetic oligonucleotide
  Target: ATXN1; (-) strand; PAM type: NRG; PAM sequence: TGG
atctgtactggagagaagca

SEQ ID NO: 55522 - DNA, 20 bp, Artificial Sequence
  Description of Artificial Sequence: Synthetic oligonucleotide
  Target: ATXN1; (-) strand; PAM type: NRG; PAM sequence: AAG
gccacatctgtactggagag

SEQ ID NO: 55523 - DNA, 20 bp, Artificial Sequence
  Description of Artificial Sequence: Synthetic oligonucleotide
  Target: ATXN1; (-) strand; PAM type: NRG; PAM sequence: GAG
tctgccacatctgtactgga

SEQ ID NO: 55524 - DNA, 20 bp, Artificial Sequence
  Description of Artificial Sequence: Synthetic oligonucleotide
  Target: ATXN1; (-) strand; PAM type: NRG; PAM sequence: GAG
tgtctgccacatctgtactg

SEQ ID NO: 55525 - DNA, 20 bp, Artificial Sequence
  Description of Artificial Sequence: Synthetic oligonucleotide
  Target: ATXN1; (-) strand; PAM type: NRG; PAM sequence: TGG
gatgtctgccacatctgtac

SEQ ID NO: 55526 - DNA, 20 bp, Artificial Sequence
  Description of Artificial Sequence: Synthetic oligonucleotide
  Target: ATXN1; (-) strand; PAM type: NRG; PAM sequence: GGG
acaattcgaatgcttgggaa

SEQ ID NO: 55527 - DNA, 20 bp, Artificial Sequence
  Description of Artificial Sequence: Synthetic oligonucleotide
  Target: ATXN1; (-) strand; PAM type: NRG; PAM sequence: AGG
aacaattcgaatgcttggga

SEQ ID NO: 55528 - DNA, 20 bp, Artificial Sequence
  Description of Artificial Sequence: Synthetic oligonucleotide
  Target: ATXN1; (-) strand; PAM type: NRG; PAM sequence: AAG
gaacaattcgaatgcttggg

SEQ ID NO: 55529 - DNA, 20 bp, Artificial Sequence
  Description of Artificial Sequence: Synthetic oligonucleotide
  Target: ATXN1; (-) strand; PAM type: NRG; PAM sequence: GGG
aaagaacaattcgaatgctt

SEQ ID NO: 55530 - DNA, 20 bp, Artificial Sequence
  Description of Artificial Sequence: Synthetic oligonucleotide
  Target: ATXN1; (-) strand; PAM type: NRG; PAM sequence: TGG
aaaagaacaattcgaatgct

SEQ ID NO: 55531 - DNA, 20 bp, Artificial Sequence
  Description of Artificial Sequence: Synthetic oligonucleotide
  Target: ATXN1; (-) strand; PAM type: NRG; PAM sequence: AAG
ctggtttaccttaaccttaa

SEQ ID NO: 55532 - DNA, 20 bp, Artificial Sequence
  Description of Artificial Sequence: Synthetic oligonucleotide
  Target: ATXN1; (-) strand; PAM type: NRG; PAM sequence: TGG
gtgccaaggctgagaaaccc

SEQ ID NO: 55533 - DNA, 20 bp, Artificial Sequence
  Description of Artificial Sequence: Synthetic oligonucleotide
  Target: ATXN1; (-) strand; PAM type: NRG; PAM sequence: GAG
atgtcaacagtgccaaggct

SEQ ID NO: 55534 - DNA, 20 bp, Artificial Sequence
  Description of Artificial Sequence: Synthetic oligonucleotide
  Target: ATXN1; (-) strand; PAM type: NRG; PAM sequence: AGG
acaagatgtcaacagtgcca

SEQ ID NO: 55535 - DNA, 20 bp, Artificial Sequence
  Description of Artificial Sequence: Synthetic oligonucleotide
  Target: ATXN1; (-) strand; PAM type: NRG; PAM sequence: AAG
cacaagatgtcaacagtgcc

SEQ ID NO: 55536 - DNA, 20 bp, Artificial Sequence
  Description of Artificial Sequence: Synthetic oligonucleotide
  Target: ATXN1; (-) strand; PAM type: NRG; PAM sequence: CAG
catccagcacaagatgtcaa

SEQ ID NO: 55537 - DNA, 20 bp, Artificial Sequence
  Description of Artificial Sequence: Synthetic oligonucleotide
  Target: ATXN1; (-) strand; PAM type: NRG; PAM sequence: AAG
cacaaagaatcatccagcac

SEQ ID NO: 55538 - DNA, 20 bp, Artificial Sequence
  Description of Artificial Sequence: Synthetic oligonucleotide
  Target: ATXN1; (-) strand; PAM type: NRG; PAM sequence: CAG
ccccaccacaaagaatcatc

SEQ ID NO: 55539 - DNA, 20 bp, Artificial Sequence
  Description of Artificial Sequence: Synthetic oligonucleotide
  Target: ATXN1; (-) strand; PAM type: NRG; PAM sequence: AAG
acaggacagcccccaccaca

SEQ ID NO: 55540 - DNA, 20 bp, Artificial Sequence
  Description of Artificial Sequence: Synthetic oligonucleotide
  Target: ATXN1; (-) strand; PAM type: NRG; PAM sequence: CAG
acatcctgcaacacacagga

SEQ ID NO: 55541 - DNA, 20 bp, Artificial Sequence
  Description of Artificial Sequence: Synthetic oligonucleotide
  Target: ATXN1; (-) strand; PAM type: NRG; PAM sequence: AGG
ctaaacatcctgcaacacac

SEQ ID NO: 55542 - DNA, 20 bp, Artificial Sequence
  Description of Artificial Sequence: Synthetic oligonucleotide
  Target: ATXN1; (-) strand; PAM type: NRG; PAM sequence: CAG
gctaaacatcctgcaacaca

SEQ ID NO: 55543 - DNA, 20 bp, Artificial Sequence
  Description of Artificial Sequence: Synthetic oligonucleotide
  Target: ATXN1; (-) strand; PAM type: NRG; PAM sequence: AGG
gcatctagtgagtagaagtg

SEQ ID NO: 55544 - DNA, 20 bp, Artificial Sequence
  Description of Artificial Sequence: Synthetic oligonucleotide
  Target: ATXN1; (-) strand; PAM type: NRG; PAM sequence: GAG
agcatctagtgagtagaagt

SEQ ID NO: 55545 - DNA, 20 bp, Artificial Sequence
  Description of Artificial Sequence: Synthetic oligonucleotide
  Target: ATXN1; (-) strand; PAM type: NRG; PAM sequence: AAG
taccagcatctagtgagtag

SEQ ID NO: 55546 - DNA, 20 bp, Artificial Sequence
  Description of Artificial Sequence: Synthetic oligonucleotide
  Target: ATXN1; (-) strand; PAM type: NRG; PAM sequence: TAG
agctaccagcatctagtgag

SEQ ID NO: 55547 - DNA, 20 bp, Artificial Sequence
  Description of Artificial Sequence: Synthetic oligonucleotide
  Target: ATXN1; (-) strand; PAM type: NRG; PAM sequence: GAG
aggagctaccagcatctagt

SEQ ID NO: 55548 - DNA, 20 bp, Artificial Sequence
  Description of Artificial Sequence: Synthetic oligonucleotide
  Target: ATXN1; (-) strand; PAM type: NRG; PAM sequence: TAG
ggggaggagctaccagcatc

SEQ ID NO: 55549 - DNA, 20 bp, Artificial Sequence
  Description of Artificial Sequence: Synthetic oligonucleotide
  Target: ATXN1; (-) strand; PAM type: NRG; PAM sequence: CAG
cacgactggggaggagctac

SEQ ID NO: 55550 - DNA, 20 bp, Artificial Sequence
  Description of Artificial Sequence: Synthetic oligonucleotide
  Target: ATXN1; (-) strand; PAM type: NRG; PAM sequence: GAG
tgcttgtcacgactggggag

SEQ ID NO: 55551 - DNA, 20 bp, Artificial Sequence
  Description of Artificial Sequence: Synthetic oligonucleotide
  Target: ATXN1; (-) strand; PAM type: NRG; PAM sequence: AGG
tttgcttgtcacgactgggg

SEQ ID NO: 55552 - DNA, 20 bp, Artificial Sequence
  Description of Artificial Sequence: Synthetic oligonucleotide
  Target: ATXN1; (-) strand; PAM type: NRG; PAM sequence: GAG
ttttgcttgtcacgactggg

SEQ ID NO: 55553 - DNA, 20 bp, Artificial Sequence
  Description of Artificial Sequence: Synthetic oligonucleotide
  Target: ATXN1; (-) strand; PAM type: NRG; PAM sequence: GGG
atttttgcttgtcacgactg

SEQ ID NO: 55554 - DNA, 20 bp, Artificial Sequence
  Description of Artificial Sequence: Synthetic oligonucleotide
  Target: ATXN1; (-) strand; PAM type: NRG; PAM sequence: GGG
catttttgcttgtcacgact

SEQ ID NO: 55555 - DNA, 20 bp, Artificial Sequence
  Description of Artificial Sequence: Synthetic oligonucleotide
  Target: ATXN1; (-) strand; PAM type: NRG; PAM sequence: TGG
tcatttttgcttgtcacgac

SEQ ID NO: 55556 - DNA, 20 bp, Artificial Sequence
  Description of Artificial Sequence: Synthetic oligonucleotide
  Target: ATXN1; (-) strand; PAM type: NRG; PAM sequence: AAG
tggcaatgtctgaatgtctg

SEQ ID NO: 55557 - DNA, 20 bp, Artificial Sequence
  Description of Artificial Sequence: Synthetic oligonucleotide
  Target: ATXN1; (-) strand; PAM type: NRG; PAM sequence: TGG
tccctccgccgtgggcaagt

SEQ ID NO: 55558 - DNA, 20 bp, Artificial Sequence
  Description of Artificial Sequence: Synthetic oligonucleotide
  Target: ATXN1; (-) strand; PAM type: NRG; PAM sequence: AAG
ttgctccctccgccgtgggc

SEQ ID NO: 55559 - DNA, 20 bp, Artificial Sequence
  Description of Artificial Sequence: Synthetic oligonucleotide
  Target: ATXN1; (-) strand; PAM type: NRG; PAM sequence: GGG
aattttgctccctccgccgt

SEQ ID NO: 55560 - DNA, 20 bp, Artificial Sequence
  Description of Artificial Sequence: Synthetic oligonucleotide
  Target: ATXN1; (-) strand; PAM type: NRG; PAM sequence: TGG
taattttgctccctccgccg

SEQ ID NO: 55561 - DNA, 20 bp, Artificial Sequence
  Description of Artificial Sequence: Synthetic oligonucleotide
  Target: ATXN1; (-) strand; PAM type: NRG; PAM sequence: CAG
agtagttttccacttagaac

SEQ ID NO: 55562 - DNA, 20 bp, Artificial Sequence
  Description of Artificial Sequence: Synthetic oligonucleotide
  Target: ATXN1; (-) strand; PAM type: NRG; PAM sequence: TAG
taagagagtagttttccact

SEQ ID NO: 55563 - DNA, 20 bp, Artificial Sequence
  Description of Artificial Sequence: Synthetic oligonucleotide
  Target: ATXN1; (-) strand; PAM type: NRG; PAM sequence: TAG
accttcatgcaataagagag

SEQ ID NO: 55564 - DNA, 20 bp, Artificial Sequence
  Description of Artificial Sequence: Synthetic oligonucleotide
  Target: ATXN1; (-) strand; PAM type: NRG; PAM sequence: GAG
ttaaccttcatgcaataaga

SEQ ID NO: 55565 - DNA, 20 bp, Artificial Sequence
  Description of Artificial Sequence: Synthetic oligonucleotide
  Target: ATXN1; (-) strand; PAM type: NRG; PAM sequence: GAG
atttaaccttcatgcaataa

SEQ ID NO: 55566 - DNA, 20 bp, Artificial Sequence
  Description of Artificial Sequence: Synthetic oligonucleotide
  Target: ATXN1; (-) strand; PAM type: NRG; PAM sequence: AAG
gcatttaaccttcatgcaat

SEQ ID NO: 55567 - DNA, 20 bp, Artificial Sequence
  Description of Artificial Sequence: Synthetic oligonucleotide
  Target: ATXN1; (-) strand; PAM type: NRG; PAM sequence: GAG
tgtgagtgtgtgtcacatgt

SEQ ID NO: 55568 - DNA, 20 bp, Artificial Sequence
  Description of Artificial Sequence: Synthetic oligonucleotide
  Target: ATXN1; (-) strand; PAM type: NRG; PAM sequence: GAG
gtgtgtgtgtttatgaatgt

SEQ ID NO: 55569 - DNA, 20 bp, Artificial Sequence
  Description of Artificial Sequence: Synthetic oligonucleotide
  Target: ATXN1; (-) strand; PAM type: NRG; PAM sequence: GGG
acgaggaccactctgtctta

SEQ ID NO: 55570 - DNA, 20 bp, Artificial Sequence
  Description of Artificial Sequence: Synthetic oligonucleotide
  Target: ATXN1; (-) strand; PAM type: NRG; PAM sequence: AGG
aacgaggaccactctgtctt

SEQ ID NO: 55571 - DNA, 20 bp, Artificial Sequence
  Description of Artificial Sequence: Synthetic oligonucleotide
  Target: ATXN1; (-) strand; PAM type: NRG; PAM sequence: TAG
aaacgaggaccactctgtct

SEQ ID NO: 55572 - DNA, 20 bp, Artificial Sequence
  Description of Artificial Sequence: Synthetic oligonucleotide
  Target: ATXN1; (-) strand; PAM type: NRG; PAM sequence: AGG
gtgtggaaaaatcagaaacg

SEQ ID NO: 55573 - DNA, 20 bp, Artificial Sequence
  Description of Artificial Sequence: Synthetic oligonucleotide
  Target: ATXN1; (-) strand; PAM type: NRG; PAM sequence: GAG
agtgtggaaaaatcagaaac

SEQ ID NO: 55574 - DNA, 20 bp, Artificial Sequence
  Description of Artificial Sequence: Synthetic oligonucleotide
  Target: ATXN1; (-) strand; PAM type: NRG; PAM sequence: CAG
aaatgaaagtgtggaaaaat

SEQ ID NO: 55575 - DNA, 20 bp, Artificial Sequence
  Description of Artificial Sequence: Synthetic oligonucleotide
  Target: ATXN1; (-) strand; PAM type: NRG; PAM sequence: TGG
aaatcaggcaaatgaaagtg

SEQ ID NO: 55576 - DNA, 20 bp, Artificial Sequence
  Description of Artificial Sequence: Synthetic oligonucleotide
  Target: ATXN1; (-) strand; PAM type: NRG; PAM sequence: AAG
acaacaaatcaggcaaatga

SEQ ID NO: 55577 - DNA, 20 bp, Artificial Sequence
  Description of Artificial Sequence: Synthetic oligonucleotide
  Target: ATXN1; (-) strand; PAM type: NRG; PAM sequence: AGG
agaggcatttacaacaaatc

SEQ ID NO: 55578 - DNA, 20 bp, Artificial Sequence
  Description of Artificial Sequence: Synthetic oligonucleotide
  Target: ATXN1; (-) strand; PAM type: NRG; PAM sequence: CAG
tagaggcatttacaacaaat

SEQ ID NO: 55579 - DNA, 20 bp, Artificial Sequence
  Description of Artificial Sequence: Synthetic oligonucleotide
  Target: ATXN1; (-) strand; PAM type: NRG; PAM sequence: AGG
atgttctgctcaaactttag

SEQ ID NO: 55580 - DNA, 20 bp, Artificial Sequence
  Description of Artificial Sequence: Synthetic oligonucleotide
  Target: ATXN1; (-) strand; PAM type: NRG; PAM sequence: GAG
gatgttctgctcaaacttta

SEQ ID NO: 55581 - DNA, 20 bp, Artificial Sequence
  Description of Artificial Sequence: Synthetic oligonucleotide
  Target: ATXN1; (-) strand; PAM type: NRG; PAM sequence: TAG
ttgatgttctgctcaaactt

SEQ ID NO: 55582 - DNA, 20 bp, Artificial Sequence
  Description of Artificial Sequence: Synthetic oligonucleotide
  Target: ATXN1; (-) strand; PAM type: NRG; PAM sequence: CGG
agttgaggtcactttgaaaa

SEQ ID NO: 55583 - DNA, 20 bp, Artificial Sequence
  Description of Artificial Sequence: Synthetic oligonucleotide
  Target: ATXN1; (-) strand; PAM type: NRG; PAM sequence: AGG
tgaaacgctggaggcagttg

SEQ ID NO: 55584 - DNA, 20 bp, Artificial Sequence
  Description of Artificial Sequence: Synthetic oligonucleotide
  Target: ATXN1; (-) strand; PAM type: NRG; PAM sequence: GAG
ctgaaacgctggaggcagtt

SEQ ID NO: 55585 - DNA, 20 bp, Artificial Sequence
  Description of Artificial Sequence: Synthetic oligonucleotide
  Target: ATXN1; (-) strand; PAM type: NRG; PAM sequence: CAG
aacacctgaaacgctggagg

SEQ ID NO: 55586 - DNA, 20 bp, Artificial Sequence
  Description of Artificial Sequence: Synthetic oligonucleotide
  Target: ATXN1; (-) strand; PAM type: NRG; PAM sequence: AGG
ctcaacacctgaaacgctgg

SEQ ID NO: 55587 - DNA, 20 bp, Artificial Sequence
  Description of Artificial Sequence: Synthetic oligonucleotide
  Target: ATXN1; (-) strand; PAM type: NRG; PAM sequence: GAG
gctcaacacctgaaacgctg

SEQ ID NO: 55588 - DNA, 20 bp, Artificial Sequence
  Description of Artificial Sequence: Synthetic oligonucleotide
  Target: ATXN1; (-) strand; PAM type: NRG; PAM sequence: TGG
gagctcaacacctgaaacgc

SEQ ID NO: 55589 - DNA, 20 bp, Artificial Sequence
  Description of Artificial Sequence: Synthetic oligonucleotide
  Target: ATXN1; (-) strand; PAM type: NRG; PAM sequence: GAG
aacttccatcctggcttcta

SEQ ID NO: 55590 - DNA, 20 bp, Artificial Sequence
  Description of Artificial Sequence: Synthetic oligonucleotide
  Target: ATXN1; (-) strand; PAM type: NRG; PAM sequence: TAG
aaaacttccatcctggcttc

SEQ ID NO: 55591 - DNA, 20 bp, Artificial Sequence
  Description of Artificial Sequence: Synthetic oligonucleotide
  Target: ATXN1; (-) strand; PAM type: NRG; PAM sequence: TGG
ctgcctgaaaacttccatcc

SEQ ID NO: 55592 - DNA, 20 bp, Artificial Sequence
  Description of Artificial Sequence: Synthetic oligonucleotide
  Target: ATXN1; (-) strand; PAM type: NRG; PAM sequence: GAG
gaagctgaatgaaagcctgg

SEQ ID NO: 55593 - DNA, 20 bp, Artificial Sequence
  Description of Artificial Sequence: Synthetic oligonucleotide
  Target: ATXN1; (-) strand; PAM type: NRG; PAM sequence: GGG
tagaagctgaatgaaagcct

SEQ ID NO: 55594 - DNA, 20 bp, Artificial Sequence
  Description of Artificial Sequence: Synthetic oligonucleotide
  Target: ATXN1; (-) strand; PAM type: NRG; PAM sequence: TGG
atagaagctgaatgaaagcc

SEQ ID NO: 55595 - DNA, 20 bp, Artificial Sequence
  Description of Artificial Sequence: Synthetic oligonucleotide
  Target: ATXN1; (-) strand; PAM type: NRG; PAM sequence: AAG
gttttatagaagctgaatga

SEQ ID NO: 55596 - DNA, 20 bp, Artificial Sequence
  Description of Artificial Sequence: Synthetic oligonucleotide
  Target: ATXN1; (-) strand; PAM type: NRG; PAM sequence: AAG
tgtgcactgttgttttatag

SEQ ID NO: 55597 - DNA, 20 bp, Artificial Sequence
  Description of Artificial Sequence: Synthetic oligonucleotide
  Target: ATXN1; (-) strand; PAM type: NRG; PAM sequence: TAG
ctgtgtgcactgttgtttta

SEQ ID NO: 55598 - DNA, 20 bp, Artificial Sequence
  Description of Artificial Sequence: Synthetic oligonucleotide
  Target: ATXN1; (-) strand; PAM type: NRG; PAM sequence: AGG
cacagcagacactggtgatg

SEQ ID NO: 55599 - DNA, 20 bp, Artificial Sequence
  Description of Artificial Sequence: Synthetic oligonucleotide
  Target: ATXN1; (-) strand; PAM type: NRG; PAM sequence: GAG
acacagcagacactggtgat

SEQ ID NO: 55600 - DNA, 20 bp, Artificial Sequence
  Description of Artificial Sequence: Synthetic oligonucleotide
  Target: ATXN1; (-) strand; PAM type: NRG; PAM sequence: TGG
tgggtgcacacagcagacac

SEQ ID NO: 55601 - DNA, 20 bp, Artificial Sequence
  Description of Artificial Sequence: Synthetic oligonucleotide
  Target: ATXN1; (-) strand; PAM type: NRG; PAM sequence: CAG
tcttttttgggtgcacacag

SEQ ID NO: 55602 - DNA, 20 bp, Artificial Sequence
  Description of Artificial Sequence: Synthetic oligonucleotide
  Target: ATXN1; (-) strand; PAM type: NRG; PAM sequence: CAG
ctttcttttttgggtgcaca

SEQ ID NO: 55603 - DNA, 20 bp, Artificial Sequence
  Description of Artificial Sequence: Synthetic oligonucleotide
  Target: ATXN1; (-) strand; PAM type: NRG; PAM sequence: GGG
ctgcgtctgctttctttttt

SEQ ID NO: 55604 - DNA, 20 bp, Artificial Sequence
  Description of Artificial Sequence: Synthetic oligonucleotide
  Target: ATXN1; (-) strand; PAM type: NRG; PAM sequence: TGG
tctgcgtctgctttcttttt

SEQ ID NO: 55605 - DNA, 20 bp, Artificial Sequence
  Description of Artificial Sequence: Synthetic oligonucleotide
  Target: ATXN1; (-) strand; PAM type: NRG; PAM sequence: TGG
aagacaaccctagagcccta

SEQ ID NO: 55606 - DNA, 20 bp, Artificial Sequence
  Description of Artificial Sequence: Synthetic oligonucleotide
  Target: ATXN1; (-) strand; PAM type: NRG; PAM sequence: GAG
agcatttcaagacaacccta

SEQ ID NO: 55607 - DNA, 20 bp, Artificial Sequence
  Description of Artificial Sequence: Synthetic oligonucleotide
  Target: ATXN1; (-) strand; PAM type: NRG; PAM sequence: TAG
agagcatttcaagacaaccc

SEQ ID NO: 55608 - DNA, 20 bp, Artificial Sequence
  Description of Artificial Sequence: Synthetic oligonucleotide
  Target: ATXN1; (-) strand; PAM type: NRG; PAM sequence: AAG
gtttcagaacagagcatttc

SEQ ID NO: 55609 - DNA, 20 bp, Artificial Sequence
  Description of Artificial Sequence: Synthetic oligonucleotide
  Target: ATXN1; (-) strand; PAM type: NRG; PAM sequence: GAG
ttatagagtgtttcagaaca

SEQ ID NO: 55610 - DNA, 20 bp, Artificial Sequence
  Description of Artificial Sequence: Synthetic oligonucleotide
  Target: ATXN1; (-) strand; PAM type: NRG; PAM sequence: CAG
ttttatagagtgtttcagaa

SEQ ID NO: 55611 - DNA, 20 bp, Artificial Sequence
  Description of Artificial Sequence: Synthetic oligonucleotide
  Target: ATXN1; (-) strand; PAM type: NRG; PAM sequence: CAG
ggaatttttatagagtgttt

SEQ ID NO: 55612 - DNA, 20 bp, Artificial Sequence
  Description of Artificial Sequence: Synthetic oligonucleotide
  Target: ATXN1; (-) strand; PAM type: NRG; PAM sequence: GAG
atctgtgaggaatttttata

SEQ ID NO: 55613 - DNA, 20 bp, Artificial Sequence
  Description of Artificial Sequence: Synthetic oligonucleotide
  Target: ATXN1; (-) strand; PAM type: NRG; PAM sequence: TAG
aaatctgtgaggaattttta

SEQ ID NO: 55614 - DNA, 20 bp, Artificial Sequence
  Description of Artificial Sequence: Synthetic oligonucleotide
  Target: ATXN1; (-) strand; PAM type: NRG; PAM sequence: AGG
ctagtcactgaaaatctgtg

SEQ ID NO: 55615 - DNA, 20 bp, Artificial Sequence
  Description of Artificial Sequence: Synthetic oligonucleotide
  Target: ATXN1; (-) strand; PAM type: NRG; PAM sequence: GAG
tctagtcactgaaaatctgt

SEQ ID NO: 55616 - DNA, 20 bp, Artificial Sequence
  Description of Artificial Sequence: Synthetic oligonucleotide
  Target: ATXN1; (-) strand; PAM type: NRG; PAM sequence: TAG
ctcccacagccccatgcctc

SEQ ID NO: 55617 - DNA, 20 bp, Artificial Sequence
  Description of Artificial Sequence: Synthetic oligonucleotide
  Target: ATXN1; (-) strand; PAM type: NRG; PAM sequence: CAG
cagctgagcaccccctccca

SEQ ID NO: 55618 - DNA, 20 bp, Artificial Sequence
  Description of Artificial Sequence: Synthetic oligonucleotide
  Target: ATXN1; (-) strand; PAM type: NRG; PAM sequence: GAG
aataataaaagagtgcagct

SEQ ID NO: 55619 - DNA, 20 bp, Artificial Sequence
  Description of Artificial Sequence: Synthetic oligonucleotide
  Target: ATXN1; (-) strand; PAM type: NRG; PAM sequence: CAG
agctcaataataaaagagtg

SEQ ID NO: 55620 - DNA, 20 bp, Artificial Sequence
  Description of Artificial Sequence: Synthetic oligonucleotide
  Target: ATXN1; (-) strand; PAM type: NRG; PAM sequence: GAG
gaatcagctcaataataaaa

SEQ ID NO: 55621 - DNA, 20 bp, Artificial Sequence
  Description of Artificial Sequence: Synthetic oligonucleotide
  Target: ATXN1; (-) strand; PAM type: NRG; PAM sequence: AAG
ttgaatcagctcaataataa

SEQ ID NO: 55622 - DNA, 20 bp, Artificial Sequence
  Description of Artificial Sequence: Synthetic oligonucleotide
  Target: ATXN1; (-) strand; PAM type: NRG; PAM sequence: CAG
taaaatctgttcctttgaat

SEQ ID NO: 55623 - DNA, 20 bp, Artificial Sequence
  Description of Artificial Sequence: Synthetic oligonucleotide
  Target: ATXN1; (-) strand; PAM type: NRG; PAM sequence: AGG
tgaacattaaagtcagtatc

SEQ ID NO: 55624 - DNA, 20 bp, Artificial Sequence
  Description of Artificial Sequence: Synthetic oligonucleotide
  Target: ATXN1; (-) strand; PAM type: NRG; PAM sequence: CAG
atgaacattaaagtcagtat

SEQ ID NO: 55625 - DNA, 20 bp, Artificial Sequence
  Description of Artificial Sequence: Synthetic oligonucleotide
  Target: ATXN1; (-) strand; PAM type: NRG; PAM sequence: CAG
cagtccatgaacattaaagt

SEQ ID NO: 55626 - DNA, 20 bp, Artificial Sequence
  Description of Artificial Sequence: Synthetic oligonucleotide
  Target: ATXN1; (-) strand; PAM type: NRG; PAM sequence: AAG
gacccagtccatgaacatta

SEQ ID NO: 55627 - DNA, 20 bp, Artificial Sequence
  Description of Artificial Sequence: Synthetic oligonucleotide
  Target: ATXN1; (-) strand; PAM type: NRG; PAM sequence: CAG
ttttacagatagaaaagacc

SEQ ID NO: 55628 - DNA, 20 bp, Artificial Sequence
  Description of Artificial Sequence: Synthetic oligonucleotide
  Target: ATXN1; (-) strand; PAM type: NRG; PAM sequence: AAG
accatattttacagatagaa

SEQ ID NO: 55629 - DNA, 20 bp, Artificial Sequence
  Description of Artificial Sequence: Synthetic oligonucleotide
  Target: ATXN1; (-) strand; PAM type: NRG; PAM sequence: TAG
ttgcaaccatattttacaga

SEQ ID NO: 55630 - DNA, 20 bp, Artificial Sequence
  Description of Artificial Sequence: Synthetic oligonucleotide
  Target: ATXN1; (-) strand; PAM type: NRG; PAM sequence: CAG
agccttgcaaccatatttta

SEQ ID NO: 55631 - DNA, 20 bp, Artificial Sequence
  Description of Artificial Sequence: Synthetic oligonucleotide
  Target: ATXN1; (-) strand; PAM type: NRG; PAM sequence: AAG
aggccatgtcttgtccatga

SEQ ID NO: 55632 - DNA, 20 bp, Artificial Sequence
  Description of Artificial Sequence: Synthetic oligonucleotide
  Target: ATXN1; (-) strand; PAM type: NRG; PAM sequence: AGG
cctggtctaccagagacaag

SEQ ID NO: 55633 - DNA, 20 bp, Artificial Sequence
  Description of Artificial Sequence: Synthetic oligonucleotide
  Target: ATXN1; (-) strand; PAM type: NRG; PAM sequence: GAG
gcctggtctaccagagacaa

SEQ ID NO: 55634 - DNA, 20 bp, Artificial Sequence
  Description of Artificial Sequence: Synthetic oligonucleotide
  Target: ATXN1; (-) strand; PAM type: NRG; PAM sequence: AAG
aggcctggtctaccagagac

SEQ ID NO: 55635 - DNA, 20 bp, Artificial Sequence
  Description of Artificial Sequence: Synthetic oligonucleotide
  Target: ATXN1; (-) strand; PAM type: NRG; PAM sequence: GAG
aaaaaaggcctggtctacca

SEQ ID NO: 55636 - DNA, 20 bp, Artificial Sequence
  Description of Artificial Sequence: Synthetic oligonucleotide
  Target: ATXN1; (-) strand; PAM type: NRG; PAM sequence: CAG
aaaaaaaaggcctggtctac

SEQ ID NO: 55637 - DNA, 20 bp, Artificial Sequence
  Description of Artificial Sequence: Synthetic oligonucleotide
  Target: ATXN1; (-) strand; PAM type: NRG; PAM sequence: TGG
gaaaaaaaaaaaaaaaggcc

SEQ ID NO: 55638 - DNA, 20 bp, Artificial Sequence
  Description of Artificial Sequence: Synthetic oligonucleotide
  Target: ATXN1; (-) strand; PAM type: NRG; PAM sequence: AGG
tctcagaaaaaaaaaaaaaa

SEQ ID NO: 55639 - DNA, 20 bp, Artificial Sequence
  Description of Artificial Sequence: Synthetic oligonucleotide
  Target: ATXN1; (-) strand; PAM type: NRG; PAM sequence: AAG
atctcagaaaaaaaaaaaaa

SEQ ID NO: 55640 - DNA, 20 bp, Artificial Sequence
  Description of Artificial Sequence: Synthetic oligonucleotide
  Target: ATXN1; (-) strand; PAM type: NRG; PAM sequence: CAG
acaagagcaaaactacatct

SEQ ID NO: 55641 - DNA, 20 bp, Artificial Sequence
  Description of Artificial Sequence: Synthetic oligonucleotide
  Target: ATXN1; (-) strand; PAM type: NRG; PAM sequence: GAG
cactccagcctgggtgacaa

SEQ ID NO: 55642 - DNA, 20 bp, Artificial Sequence
  Description of Artificial Sequence: Synthetic oligonucleotide
  Target: ATXN1; (-) strand; PAM type: NRG; PAM sequence: AAG
tgcactccagcctgggtgac

SEQ ID NO: 55643 - DNA, 20 bp, Artificial Sequence
  Description of Artificial Sequence: Synthetic oligonucleotide
  Target: ATXN1; (-) strand; PAM type: NRG; PAM sequence: GGG
gccccattgcactccagcct

SEQ ID NO: 55644 - DNA, 20 bp, Artificial Sequence
  Description of Artificial Sequence: Synthetic oligonucleotide
  Target: ATXN1; (-) strand; PAM type: NRG; PAM sequence: TGG
tgccccattgcactccagcc

SEQ ID NO: 55645 - DNA, 20 bp, Artificial Sequence
  Description of Artificial Sequence: Synthetic oligonucleotide
  Target: ATXN1; (-) strand; PAM type: NRG; PAM sequence: CAG
gagattgccccattgcactc

SEQ ID NO: 55646 - DNA, 20 bp, Artificial Sequence
  Description of Artificial Sequence: Synthetic oligonucleotide
  Target: ATXN1; (-) strand; PAM type: NRG; PAM sequence: GAG
gccagaggttgcagtgagcc

SEQ ID NO: 55647 - DNA, 20 bp, Artificial Sequence
  Description of Artificial Sequence: Synthetic oligonucleotide
  Target: ATXN1; (-) strand; PAM type: NRG; PAM sequence: GAG
tgggagccagaggttgcagt

SEQ ID NO: 55648 - DNA, 20 bp, Artificial Sequence
  Description of Artificial Sequence: Synthetic oligonucleotide
  Target: ATXN1; (-) strand; PAM type: NRG; PAM sequence: CAG
aacctgggagccagaggttg

SEQ ID NO: 55649 - DNA, 20 bp, Artificial Sequence
  Description of Artificial Sequence: Synthetic oligonucleotide
  Target: ATXN1; (-) strand; PAM type: NRG; PAM sequence: AGG
cacttgaacctgggagccag

SEQ ID NO: 55650 - DNA, 20 bp, Artificial Sequence
  Description of Artificial Sequence: Synthetic oligonucleotide
  Target: ATXN1; (-) strand; PAM type: NRG; PAM sequence: GAG
tcacttgaacctgggagcca

SEQ ID NO: 55651 - DNA, 20 bp, Artificial Sequence
  Description of Artificial Sequence: Synthetic oligonucleotide
  Target: ATXN1; (-) strand; PAM type: NRG; PAM sequence: CAG
aatcacttgaacctgggagc

SEQ ID NO: 55652 - DNA, 20 bp, Artificial Sequence
  Description of Artificial Sequence: Synthetic oligonucleotide
  Target: ATXN1; (-) strand; PAM type: NRG; PAM sequence: GAG
ggagaatcacttgaacctgg

SEQ ID NO: 55653 - DNA, 20 bp, Artificial Sequence
  Description of Artificial Sequence: Synthetic oligonucleotide
  Target: ATXN1; (-) strand; PAM type: NRG; PAM sequence: GGG
caggagaatcacttgaacct

SEQ ID NO: 55654 - DNA, 20 bp, Artificial Sequence
  Description of Artificial Sequence: Synthetic oligonucleotide
  Target: ATXN1; (-) strand; PAM type: NRG; PAM sequence: TGG
gcaggagaatcacttgaacc

SEQ ID NO: 55655 - DNA, 20 bp, Artificial Sequence
  Description of Artificial Sequence: Synthetic oligonucleotide
  Target: ATXN1; (-) strand; PAM type: NRG; PAM sequence: GAG
tactccagaggctgaggcag

SEQ ID NO: 55656 - DNA, 20 bp, Artificial Sequence
  Description of Artificial Sequence: Synthetic oligonucleotide
  Target: ATXN1; (-) strand; PAM type: NRG; PAM sequence: AGG
actactccagaggctgaggc

SEQ ID NO: 55657 - DNA, 20 bp, Artificial Sequence
  Description of Artificial Sequence: Synthetic oligonucleotide
  Target: ATXN1; (-) strand; PAM type: NRG; PAM sequence: CAG
tactactccagaggctgagg

SEQ ID NO: 55658 - DNA, 20 bp, Artificial Sequence
  Description of Artificial Sequence: Synthetic oligonucleotide
  Target: ATXN1; (-) strand; PAM type: NRG; PAM sequence: AGG
ccctactactccagaggctg

SEQ ID NO: 55659 - DNA, 20 bp, Artificial Sequence
  Description of Artificial Sequence: Synthetic oligonucleotide
  Target: ATXN1; (-) strand; PAM type: NRG; PAM sequence: GAG
tccctactactccagaggct

SEQ ID NO: 55660 - DNA, 20 bp, Artificial Sequence
  Description of Artificial Sequence: Synthetic oligonucleotide
  Target: ATXN1; (-) strand; PAM type: NRG; PAM sequence: AGG
tgtaatccctactactccag

SEQ ID NO: 55661 - DNA, 20 bp, Artificial Sequence
  Description of Artificial Sequence: Synthetic oligonucleotide
  Target: ATXN1; (-) strand; PAM type: NRG; PAM sequence: GAG
ctgtaatccctactactcca

SEQ ID NO: 55662 - DNA, 20 bp, Artificial Sequence
  Description of Artificial Sequence: Synthetic oligonucleotide
  Target: ATXN1; (-) strand; PAM type: NRG; PAM sequence: CAG
gcctgtaatccctactactc

SEQ ID NO: 55663 - DNA, 20 bp, Artificial Sequence
  Description of Artificial Sequence: Synthetic oligonucleotide
  Target: ATXN1; (-) strand; PAM type: NRG; PAM sequence: GAG
aatgtgctgggcatggtggt

SEQ ID NO: 55664 - DNA, 20 bp, Artificial Sequence
  Description of Artificial Sequence: Synthetic oligonucleotide
  Target: ATXN1; (-) strand; PAM type: NRG; PAM sequence: TGG
caaaaatgtgctgggcatgg

SEQ ID NO: 55665 - DNA, 20 bp, Artificial Sequence
  Description of Artificial Sequence: Synthetic oligonucleotide
  Target: ATXN1; (-) strand; PAM type: NRG; PAM sequence: TGG
acacaaaaatgtgctgggca

SEQ ID NO: 55666 - DNA, 20 bp, Artificial Sequence
  Description of Artificial Sequence: Synthetic oligonucleotide
  Target: ATXN1; (-) strand; PAM type: NRG; PAM sequence: GGG
taaaaacacaaaaatgtgct

SEQ ID NO: 55667 - DNA, 20 bp, Artificial Sequence
  Description of Artificial Sequence: Synthetic oligonucleotide
  Target: ATXN1; (-) strand; PAM type: NRG; PAM sequence: TGG
ctaaaaacacaaaaatgtgc

SEQ ID NO: 55668 - DNA, 20 bp, Artificial Sequence
  Description of Artificial Sequence: Synthetic oligonucleotide
  Target: ATXN1; (-) strand; PAM type: NRG; PAM sequence: TGG
tgagaccagcctggccaaca

SEQ ID NO: 55669 - DNA, 20 bp, Artificial Sequence
  Description of Artificial Sequence: Synthetic oligonucleotide
  Target: ATXN1; (-) strand; PAM type: NRG; PAM sequence: TGG
tcaggagtttgagaccagcc

SEQ ID NO: 55670 - DNA, 20 bp, Artificial Sequence
  Description of Artificial Sequence: Synthetic oligonucleotide
  Target: ATXN1; (-) strand; PAM type: NRG; PAM sequence: CAG
tgaggtcaggagtttgagac

SEQ ID NO: 55671 - DNA, 20 bp, Artificial Sequence
  Description of Artificial Sequence: Synthetic oligonucleotide
  Target: ATXN1; (-) strand; PAM type: NRG; PAM sequence: GAG
tcgcctgaggtcaggagttt

SEQ ID NO: 55672 - DNA, 20 bp, Artificial Sequence
  Description of Artificial Sequence: Synthetic oligonucleotide
  Target: ATXN1; (-) strand; PAM type: NRG; PAM sequence: GAG
ggtggatcgcctgaggtcag

SEQ ID NO: 55673 - DNA, 20 bp, Artificial Sequence
  Description of Artificial Sequence: Synthetic oligonucleotide
  Target: ATXN1; (-) strand; PAM type: NRG; PAM sequence: AGG
caggtggatcgcctgaggtc

SEQ ID NO: 55674 - DNA, 20 bp, Artificial Sequence
  Description of Artificial Sequence: Synthetic oligonucleotide
  Target: ATXN1; (-) strand; PAM type: NRG; PAM sequence: CAG
gcaggtggatcgcctgaggt

SEQ ID NO: 55675 - DNA, 20 bp, Artificial Sequence
  Description of Artificial Sequence: Synthetic oligonucleotide
  Target: ATXN1; (-) strand; PAM type: NRG; PAM sequence: AGG
cgaggcaggtggatcgcctg

SEQ ID NO: 55676 - DNA, 20 bp, Artificial Sequence
  Description of Artificial Sequence: Synthetic oligonucleotide
  Target: ATXN1; (-) strand; PAM type: NRG; PAM sequence: GAG
ccgaggcaggtggatcgcct

SEQ ID NO: 55677 - DNA, 20 bp, Artificial Sequence
  Description of Artificial Sequence: Synthetic oligonucleotide
  Target: ATXN1; (-) strand; PAM type: NRG; PAM sequence: TGG
ctttgggaggccgaggcagg

SEQ ID NO: 55678 - DNA, 20 bp, Artificial Sequence
  Description of Artificial Sequence: Synthetic oligonucleotide
  Target: ATXN1; (-) strand; PAM type: NRG; PAM sequence: AGG
acactttgggaggccgaggc

SEQ ID NO: 55679 - DNA, 20 bp, Artificial Sequence
  Description of Artificial Sequence: Synthetic oligonucleotide
  Target: ATXN1; (-) strand; PAM type: NRG; PAM sequence: CAG
aacactttgggaggccgagg

SEQ ID NO: 55680 - DNA, 20 bp, Artificial Sequence
  Description of Artificial Sequence: Synthetic oligonucleotide
  Target: ATXN1; (-) strand; PAM type: NRG; PAM sequence: AGG
ctcaacactttgggaggccg

SEQ ID NO: 55681 - DNA, 20 bp, Artificial Sequence
  Description of Artificial Sequence: Synthetic oligonucleotide
  Target: ATXN1; (-) strand; PAM type: NRG; PAM sequence: GAG
tctcaacactttgggaggcc

SEQ ID NO: 55682 - DNA, 20 bp, Artificial Sequence
  Description of Artificial Sequence: Synthetic oligonucleotide
  Target: ATXN1; (-) strand; PAM type: NRG; PAM sequence: AGG
tataatctcaacactttggg

SEQ ID NO: 55683 - DNA, 20 bp, Artificial Sequence
  Description of Artificial Sequence: Synthetic oligonucleotide
  Target: ATXN1; (-) strand; PAM type: NRG; PAM sequence: GAG
ctataatctcaacactttgg

SEQ ID NO: 55684 - DNA, 20 bp, Artificial Sequence
  Description of Artificial Sequence: Synthetic oligonucleotide
  Target: ATXN1; (-) strand; PAM type: NRG; PAM sequence: GGG
gtctataatctcaacacttt

SEQ ID NO: 55685 - DNA, 20 bp, Artificial Sequence
  Description of Artificial Sequence: Synthetic oligonucleotide
  Target: ATXN1; (-) strand; PAM type: NRG; PAM sequence: TGG
tgtctataatctcaacactt

SEQ ID NO: 55686 - DNA, 20 bp, Artificial Sequence
  Description of Artificial Sequence: Synthetic oligonucleotide
  Target: ATXN1; (-) strand; PAM type: NRG; PAM sequence: TGG
tcctggtcagctgagcatgg

SEQ ID NO: 55687 - DNA, 20 bp, Artificial Sequence
  Description of Artificial Sequence: Synthetic oligonucleotide
  Target: ATXN1; (-) strand; PAM type: NRG; PAM sequence: TGG
tagtcctggtcagctgagca

SEQ ID NO: 55688 - DNA, 20 bp, Artificial Sequence
  Description of Artificial Sequence: Synthetic oligonucleotide
  Target: ATXN1; (-) strand; PAM type: NRG; PAM sequence: GAG
attactagtcctggtcagct

SEQ ID NO: 55689 - DNA, 20 bp, Artificial Sequence
  Description of Artificial Sequence: Synthetic oligonucleotide
  Target: ATXN1; (-) strand; PAM type: NRG; PAM sequence: CAG
ttgctattactagtcctggt

SEQ ID NO: 55690 - DNA, 20 bp, Artificial Sequence
  Description of Artificial Sequence: Synthetic oligonucleotide
  Target: ATXN1; (-) strand; PAM type: NRG; PAM sequence: TGG
gtatttgctattactagtcc

SEQ ID NO: 55691 - DNA, 20 bp, Artificial Sequence
  Description of Artificial Sequence: Synthetic oligonucleotide
  Target: ATXN1; (-) strand; PAM type: NRG; PAM sequence: TAG
aacccagtatttgctattac

SEQ ID NO: 55692 - DNA, 20 bp, Artificial Sequence
  Description of Artificial Sequence: Synthetic oligonucleotide
  Target: ATXN1; (-) strand; PAM type: NRG; PAM sequence: CAG
caattacttttgcaccaacc

SEQ ID NO: 55693 - DNA, 20 bp, Artificial Sequence
  Description of Artificial Sequence: Synthetic oligonucleotide
  Target: ATXN1; (-) strand; PAM type: NRG; PAM sequence: TGG
gattttgccattactttcaa

SEQ ID NO: 55694 - DNA, 20 bp, Artificial Sequence
  Description of Artificial Sequence: Synthetic oligonucleotide
  Target: ATXN1; (-) strand; PAM type: NRG; PAM sequence: AAG
gaaatattatgttggtgcaa

SEQ ID NO: 55695 - DNA, 20 bp, Artificial Sequence
  Description of Artificial Sequence: Synthetic oligonucleotide
  Target: ATXN1; (-) strand; PAM type: NRG; PAM sequence: TGG
gcgcttaagaaatattatgt

SEQ ID NO: 55696 - DNA, 20 bp, Artificial Sequence
  Description of Artificial Sequence: Synthetic oligonucleotide
  Target: ATXN1; (-) strand; PAM type: NRG; PAM sequence: AAG
ttggaacagtgcaagcgctt

SEQ ID NO: 55697 - DNA, 20 bp, Artificial Sequence
  Description of Artificial Sequence: Synthetic oligonucleotide
  Target: ATXN1; (-) strand; PAM type: NRG; PAM sequence: AAG
tcaagctcttggaacagtgc

SEQ ID NO: 55698 - DNA, 20 bp, Artificial Sequence
  Description of Artificial Sequence: Synthetic oligonucleotide
  Target: ATXN1; (-) strand; PAM type: NRG; PAM sequence: CAG
tgaatgtcaagctcttggaa

SEQ ID NO: 55699 - DNA, 20 bp, Artificial Sequence
  Description of Artificial Sequence: Synthetic oligonucleotide
  Target: ATXN1; (-) strand; PAM type: NRG; PAM sequence: TGG
ttaaatgaatgtcaagctct

SEQ ID NO: 55700 - DNA, 20 bp, Artificial Sequence
  Description of Artificial Sequence: Synthetic oligonucleotide
  Target: ATXN1; (-) strand; PAM type: NRG; PAM sequence: AAG
gtgataattaaatgaatgtc

SEQ ID NO: 55701 - DNA, 20 bp, Artificial Sequence
  Description of Artificial Sequence: Synthetic oligonucleotide
  Target: ATXN1; (-) strand; PAM type: NRG; PAM sequence: AAG
ataatgatagctacctcaaa

SEQ ID NO: 55702 - DNA, 20 bp, Artificial Sequence
  Description of Artificial Sequence: Synthetic oligonucleotide
  Target: ATXN1; (-) strand; PAM type: NRG; PAM sequence: TAG
caaacttggcttaataatga

SEQ ID NO: 55703 - DNA, 20 bp, Artificial Sequence
  Description of Artificial Sequence: Synthetic oligonucleotide
  Target: ATXN1; (-) strand; PAM type: NRG; PAM sequence: TGG
cctttcctcatttgcaaact

SEQ ID NO: 55704 - DNA, 20 bp, Artificial Sequence
  Description of Artificial Sequence: Synthetic oligonucleotide
  Target: ATXN1; (-) strand; PAM type: NRG; PAM sequence: AAG
gcttgtgctgtaattggggt

SEQ ID NO: 55705 - DNA, 20 bp, Artificial Sequence
  Description of Artificial Sequence: Synthetic oligonucleotide
  Target: ATXN1; (-) strand; PAM type: NRG; PAM sequence: GGG
atcagcttgtgctgtaattg

SEQ ID NO: 55706 - DNA, 20 bp, Artificial Sequence
  Description of Artificial Sequence: Synthetic oligonucleotide
  Target: ATXN1; (-) strand; PAM type: NRG; PAM sequence: GGG
catcagcttgtgctgtaatt

SEQ ID NO: 55707 - DNA, 20 bp, Artificial Sequence
  Description of Artificial Sequence: Synthetic oligonucleotide
  Target: ATXN1; (-) strand; PAM type: NRG; PAM sequence: TGG
gcatcagcttgtgctgtaat

SEQ ID NO: 55708 - DNA, 20 bp, Artificial Sequence
  Description of Artificial Sequence: Synthetic oligonucleotide
  Target: ATXN1; (-) strand; PAM type: NRG; PAM sequence: CAG
ttcaaatctccctctggcat

SEQ ID NO: 55709 - DNA, 20 bp, Artificial Sequence
  Description of Artificial Sequence: Synthetic oligonucleotide
  Target: ATXN1; (-) strand; PAM type: NRG; PAM sequence: TGG
cctgggttcaaatctccctc

SEQ ID NO: 55710 - DNA, 20 bp, Artificial Sequence
  Description of Artificial Sequence: Synthetic oligonucleotide
  Target: ATXN1; (-) strand; PAM type: NRG; PAM sequence: GGG
tagctggagtgagccagcct

SEQ ID NO: 55711 - DNA, 20 bp, Artificial Sequence
  Description of Artificial Sequence: Synthetic oligonucleotide
  Target: ATXN1; (-) strand; PAM type: NRG; PAM sequence: TGG
ttagctggagtgagccagcc

SEQ ID NO: 55712 - DNA, 20 bp, Artificial Sequence
  Description of Artificial Sequence: Synthetic oligonucleotide
  Target: ATXN1; (-) strand; PAM type: NRG; PAM sequence: CAG
gggtgttagctggagtgagc

SEQ ID NO: 55713 - DNA, 20 bp, Artificial Sequence
  Description of Artificial Sequence: Synthetic oligonucleotide
  Target: ATXN1; (-) strand; PAM type: NRG; PAM sequence: GAG
ggttgggtgttagctggagt

SEQ ID NO: 55714 - DNA, 20 bp, Artificial Sequence
  Description of Artificial Sequence: Synthetic oligonucleotide
  Target: ATXN1; (-) strand; PAM type: NRG; PAM sequence: GAG
tgatggttgggtgttagctg

SEQ ID NO: 55715 - DNA, 20 bp, Artificial Sequence
  Description of Artificial Sequence: Synthetic oligonucleotide
  Target: ATXN1; (-) strand; PAM type: NRG; PAM sequence: TGG
tgtgatggttgggtgttagc

SEQ ID NO: 55716 - DNA, 20 bp, Artificial Sequence
  Description of Artificial Sequence: Synthetic oligonucleotide
  Target: ATXN1; (-) strand; PAM type: NRG; PAM sequence: TAG
tgcatgtgatggttgggtgt

SEQ ID NO: 55717 - DNA, 20 bp, Artificial Sequence
  Description of Artificial Sequence: Synthetic oligonucleotide
  Target: ATXN1; (-) strand; PAM type: NRG; PAM sequence: GGG
tggccctgcatgtgatggtt

SEQ ID NO: 55718 - DNA, 20 bp, Artificial Sequence
  Description of Artificial Sequence: Synthetic oligonucleotide
  Target: ATXN1; (-) strand; PAM type: NRG; PAM sequence: TGG
gtggccctgcatgtgatggt

SEQ ID NO: 55719 - DNA, 20 bp, Artificial Sequence
  Description of Artificial Sequence: Synthetic oligonucleotide
  Target: ATXN1; (-) strand; PAM type: NRG; PAM sequence: TGG
cagggtggccctgcatgtga

SEQ ID NO: 55720 - DNA, 20 bp, Artificial Sequence
  Description of Artificial Sequence: Synthetic oligonucleotide
  Target: ATXN1; (-) strand; PAM type: NRG; PAM sequence: TGG
aatgtgttagcagagcaggg

SEQ ID NO: 55721 - DNA, 20 bp, Artificial Sequence
  Description of Artificial Sequence: Synthetic oligonucleotide
  Target: ATXN1; (-) strand; PAM type: NRG; PAM sequence: GGG
gtgaatgtgttagcagagca

SEQ ID NO: 55722 - DNA, 20 bp, Artificial Sequence
  Description of Artificial Sequence: Synthetic oligonucleotide
  Target: ATXN1; (-) strand; PAM type: NRG; PAM sequence: AGG
tgtgaatgtgttagcagagc

SEQ ID NO: 55723 - DNA, 20 bp, Artificial Sequence
  Description of Artificial Sequence: Synthetic oligonucleotide
  Target: ATXN1; (-) strand; PAM type: NRG; PAM sequence: CAG
gtgtgaatgtgttagcagag

SEQ ID NO: 55724 - DNA, 20 bp, Artificial Sequence
  Description of Artificial Sequence: Synthetic oligonucleotide
  Target: ATXN1; (-) strand; PAM type: NRG; PAM sequence: GAG
gttgtgtgaatgtgttagca

SEQ ID NO: 55725 - DNA, 20 bp, Artificial Sequence
  Description of Artificial Sequence: Synthetic oligonucleotide
  Target: ATXN1; (-) strand; PAM type: NRG; PAM sequence: CAG
gagttgtgtgaatgtgttag

SEQ ID NO: 55726 - DNA, 20 bp, Artificial Sequence
  Description of Artificial Sequence: Synthetic oligonucleotide
  Target: ATXN1; (-) strand; PAM type: NRG; PAM sequence: TAG
agtgagttgtgtgaatgtgt

SEQ ID NO: 55727 - DNA, 20 bp, Artificial Sequence
  Description of Artificial Sequence: Synthetic oligonucleotide
  Target: ATXN1; (-) strand; PAM type: NRG; PAM sequence: GAG
tcggtctggtgatgtgtagt

SEQ ID NO: 55728 - DNA, 20 bp, Artificial Sequence
  Description of Artificial Sequence: Synthetic oligonucleotide
  Target: ATXN1; (-) strand; PAM type: NRG; PAM sequence: TAG
cacgtcggtctggtgatgtg

SEQ ID NO: 55729 - DNA, 20 bp, Artificial Sequence
  Description of Artificial Sequence: Synthetic oligonucleotide
  Target: ATXN1; (-) strand; PAM type: NRG; PAM sequence: TGG
gagaaagcatcacgtcggtc

SEQ ID NO: 55730 - DNA, 20 bp, Artificial Sequence
  Description of Artificial Sequence: Synthetic oligonucleotide
  Target: ATXN1; (-) strand; PAM type: NRG; PAM sequence: CGG
gttaggagaaagcatcacgt

SEQ ID NO: 55731 - DNA, 20 bp, Artificial Sequence
  Description of Artificial Sequence: Synthetic oligonucleotide
  Target: ATXN1; (-) strand; PAM type: NRG; PAM sequence: AAG
tattatttatggttaggaga

SEQ ID NO: 55732 - DNA, 20 bp, Artificial Sequence
  Description of Artificial Sequence: Synthetic oligonucleotide
  Target: ATXN1; (-) strand; PAM type: NRG; PAM sequence: GAG
cctttattatttatggttag

SEQ ID NO: 55733 - DNA, 20 bp, Artificial Sequence
  Description of Artificial Sequence: Synthetic oligonucleotide
  Target: ATXN1; (-) strand; PAM type: NRG; PAM sequence: AGG
tccctttattatttatggtt

SEQ ID NO: 55734 - DNA, 20 bp, Artificial Sequence
  Description of Artificial Sequence: Synthetic oligonucleotide
  Target: ATXN1; (-) strand; PAM type: NRG; PAM sequence: TAG
gtccctttattatttatggt

SEQ ID NO: 55735 - DNA, 20 bp, Artificial Sequence
  Description of Artificial Sequence: Synthetic oligonucleotide
  Target: ATXN1; (-) strand; PAM type: NRG; PAM sequence: TGG
ctgagtccctttattattta

SEQ ID NO: 55736 - DNA, 20 bp, Artificial Sequence
  Description of Artificial Sequence: Synthetic oligonucleotide
  Target: ATXN1; (-) strand; PAM type: NRG; PAM sequence: GAG
tctccccacttggggcttct

SEQ ID NO: 55737 - DNA, 20 bp, Artificial Sequence
  Description of Artificial Sequence: Synthetic oligonucleotide
  Target: ATXN1; (-) strand; PAM type: NRG; PAM sequence: GGG
cattaacctctccccacttg

SEQ ID NO: 55738 - DNA, 20 bp, Artificial Sequence
  Description of Artificial Sequence: Synthetic oligonucleotide
  Target: ATXN1; (-) strand; PAM type: NRG; PAM sequence: GGG
ccattaacctctccccactt

SEQ ID NO: 55739 - DNA, 20 bp, Artificial Sequence
  Description of Artificial Sequence: Synthetic oligonucleotide
  Target: ATXN1; (-) strand; PAM type: NRG; PAM sequence: TGG
cccattaacctctccccact

SEQ ID NO: 55740 - DNA, 20 bp, Artificial Sequence
  Description of Artificial Sequence: Synthetic oligonucleotide
  Target: ATXN1; (-) strand; PAM type: NRG; PAM sequence: AAG
ctcccatcccctcttccgca

SEQ ID NO: 55741 - DNA, 20 bp, Artificial Sequence
  Description of Artificial Sequence: Synthetic oligonucleotide
  Target: ATXN1; (-) strand; PAM type: NRG; PAM sequence: CAG
ccttcctctacttcagggcc

SEQ ID NO: 55742 - DNA, 20 bp, Artificial Sequence
  Description of Artificial Sequence: Synthetic oligonucleotide
  Target: ATXN1; (-) strand; PAM type: NRG; PAM sequence: GGG
aaaatccttcctctacttca

SEQ ID NO: 55743 - DNA, 20 bp, Artificial Sequence
  Description of Artificial Sequence: Synthetic oligonucleotide
  Target: ATXN1; (-) strand; PAM type: NRG; PAM sequence: AGG
caaaatccttcctctacttc

SEQ ID NO: 55744 - DNA, 20 bp, Artificial Sequence
  Description of Artificial Sequence: Synthetic oligonucleotide
  Target: ATXN1; (-) strand; PAM type: NRG; PAM sequence: CAG
tcaaaatccttcctctactt

SEQ ID NO: 55745 - DNA, 20 bp, Artificial Sequence
  Description of Artificial Sequence: Synthetic oligonucleotide
  Target: ATXN1; (-) strand; PAM type: NRG; PAM sequence: CAG
atatttccctccatctgacc

SEQ ID NO: 55746 - DNA, 20 bp, Artificial Sequence
  Description of Artificial Sequence: Synthetic oligonucleotide
  Target: ATXN1; (-) strand; PAM type: NRG; PAM sequence: CAG
cgcccccactgctccactgg

SEQ ID NO: 55747 - DNA, 20 bp, Artificial Sequence
  Description of Artificial Sequence: Synthetic oligonucleotide
  Target: ATXN1; (-) strand; PAM type: NRG; PAM sequence: TGG
cgccgcccccactgctccac

SEQ ID NO: 55748 - DNA, 20 bp, Artificial Sequence
  Description of Artificial Sequence: Synthetic oligonucleotide
  Target: ATXN1; (-) strand; PAM type: NRG; PAM sequence: AGG
aggtcgccagggtgtccagc

SEQ ID NO: 55749 - DNA, 20 bp, Artificial Sequence
  Description of Artificial Sequence: Synthetic oligonucleotide
  Target: ATXN1; (-) strand; PAM type: NRG; PAM sequence: CAG
caggtcgccagggtgtccag

SEQ ID NO: 55750 - DNA, 20 bp, Artificial Sequence
  Description of Artificial Sequence: Synthetic oligonucleotide
  Target: ATXN1; (-) strand; PAM type: NRG; PAM sequence: CAG
gaacaggtcgccagggtgtc

SEQ ID NO: 55751 - DNA, 20 bp, Artificial Sequence
  Description of Artificial Sequence: Synthetic oligonucleotide
  Target: ATXN1; (-) strand; PAM type: NRG; PAM sequence: GGG
ggtgcaggaacaggtcgcca

SEQ ID NO: 55752 - DNA, 20 bp, Artificial Sequence
  Description of Artificial Sequence: Synthetic oligonucleotide
  Target: ATXN1; (-) strand; PAM type: NRG; PAM sequence: AGG
aggtgcaggaacaggtcgcc

SEQ ID NO: 55753 - DNA, 20 bp, Artificial Sequence
  Description of Artificial Sequence: Synthetic oligonucleotide
  Target: ATXN1; (-) strand; PAM type: NRG; PAM sequence: CAG
caggtgcaggaacaggtcgc

SEQ ID NO: 55754 - DNA, 20 bp, Artificial Sequence
  Description of Artificial Sequence: Synthetic oligonucleotide
  Target: ATXN1; (-) strand; PAM type: NRG; PAM sequence: AGG
gagggaacaggtgcaggaac

SEQ ID NO: 55755 - DNA, 20 bp, Artificial Sequence
  Description of Artificial Sequence: Synthetic oligonucleotide
  Target: ATXN1; (-) strand; PAM type: NRG; PAM sequence: CAG
ggagggaacaggtgcaggaa

SEQ ID NO: 55756 - DNA, 20 bp, Artificial Sequence
  Description of Artificial Sequence: Synthetic oligonucleotide
  Target: ATXN1; (-) strand; PAM type: NRG; PAM sequence: AGG
agtgaggagggaacaggtgc

SEQ ID NO: 55757 - DNA, 20 bp, Artificial Sequence
  Description of Artificial Sequence: Synthetic oligonucleotide
  Target: ATXN1; (-) strand; PAM type: NRG; PAM sequence: CAG
tagtgaggagggaacaggtg

SEQ ID NO: 55758 - DNA, 20 bp, Artificial Sequence
  Description of Artificial Sequence: Synthetic oligonucleotide
  Target: ATXN1; (-) strand; PAM type: NRG; PAM sequence: AGG
tcacctagtgaggagggaac

SEQ ID NO: 55759 - DNA, 20 bp, Artificial Sequence
  Description of Artificial Sequence: Synthetic oligonucleotide
  Target: ATXN1; (-) strand; PAM type: NRG; PAM sequence: CAG
atcacctagtgaggagggaa

SEQ ID NO: 55760 - DNA, 20 bp, Artificial Sequence
  Description of Artificial Sequence: Synthetic oligonucleotide
  Target: ATXN1; (-) strand; PAM type: NRG; PAM sequence: GGG
cctccatcacctagtgagga

SEQ ID NO: 55761 - DNA, 20 bp, Artificial Sequence
  Description of Artificial Sequence: Synthetic oligonucleotide
  Target: ATXN1; (-) strand; PAM type: NRG; PAM sequence: AGG
gcctccatcacctagtgagg

SEQ ID NO: 55762 - DNA, 20 bp, Artificial Sequence
  Description of Artificial Sequence: Synthetic oligonucleotide
  Target: ATXN1; (-) strand; PAM type: NRG; PAM sequence: GAG
tgcctccatcacctagtgag

SEQ ID NO: 55763 - DNA, 20 bp, Artificial Sequence
  Description of Artificial Sequence: Synthetic oligonucleotide
  Target: ATXN1; (-) strand; PAM type: NRG; PAM sequence: AGG
tctgcctccatcacctagtg

SEQ ID NO: 55764 - DNA, 20 bp, Artificial Sequence
  Description of Artificial Sequence: Synthetic oligonucleotide
  Target: ATXN1; (-) strand; PAM type: NRG; PAM sequence: GAG
ctctgcctccatcacctagt

SEQ ID NO: 55765 - DNA, 20 bp, Artificial Sequence
  Description of Artificial Sequence: Synthetic oligonucleotide
  Target: ATXN1; (-) strand; PAM type: NRG; PAM sequence: TAG
tcctctctgcctccatcacc

SEQ ID NO: 55766 - DNA, 20 bp, Artificial Sequence
  Description of Artificial Sequence: Synthetic oligonucleotide
  Target: ATXN1; (-) strand; PAM type: NRG; PAM sequence: CAG
gccctcatgtctcctctctt

SEQ ID NO: 55767 - DNA, 20 bp, Artificial Sequence
  Description of Artificial Sequence: Synthetic oligonucleotide
  Target: ATXN1; (-) strand; PAM type: NRG; PAM sequence: CAG
gatgcaccagggccaccgca

SEQ ID NO: 55768 - DNA, 20 bp, Artificial Sequence
  Description of Artificial Sequence: Synthetic oligonucleotide
  Target: ATXN1; (-) strand; PAM type: NRG; PAM sequence: GGG
tcttaggaaatgatgcacca

SEQ ID NO: 55769 - DNA, 20 bp, Artificial Sequence
  Description of Artificial Sequence: Synthetic oligonucleotide
  Target: ATXN1; (-) strand; PAM type: NRG; PAM sequence: AGG
ttcttaggaaatgatgcacc

SEQ ID NO: 55770 - DNA, 20 bp, Artificial Sequence
  Description of Artificial Sequence: Synthetic oligonucleotide
  Target: ATXN1; (-) strand; PAM type: NRG; PAM sequence: CAG
gttcttaggaaatgatgcac

SEQ ID NO: 55771 - DNA, 20 bp, Artificial Sequence
  Description of Artificial Sequence: Synthetic oligonucleotide
  Target: ATXN1; (-) strand; PAM type: NRG; PAM sequence: AGG
aatttaaatttagggttctt

SEQ ID NO: 55772 - DNA, 20 bp, Artificial Sequence
  Description of Artificial Sequence: Synthetic oligonucleotide
  Target: ATXN1; (-) strand; PAM type: NRG; PAM sequence: TAG
gaatttaaatttagggttct

SEQ ID NO: 55773 - DNA, 20 bp, Artificial Sequence
  Description of Artificial Sequence: Synthetic oligonucleotide
  Target: ATXN1; (-) strand; PAM type: NRG; PAM sequence: GGG
gggcagagaatttaaattta

SEQ ID NO: 55774 - DNA, 20 bp, Artificial Sequence
  Description of Artificial Sequence: Synthetic oligonucleotide
  Target: ATXN1; (-) strand; PAM type: NRG; PAM sequence: AGG
agggcagagaatttaaattt

SEQ ID NO: 55775 - DNA, 20 bp, Artificial Sequence
  Description of Artificial Sequence: Synthetic oligonucleotide
  Target: ATXN1; (-) strand; PAM type: NRG; PAM sequence: TAG
tagggcagagaatttaaatt

SEQ ID NO: 55776 - DNA, 20 bp, Artificial Sequence
  Description of Artificial Sequence: Synthetic oligonucleotide
  Target: ATXN1; (-) strand; PAM type: NRG; PAM sequence: GAG
ggggaagaaatagtagggca

SEQ ID NO: 55777 - DNA, 20 bp, Artificial Sequence
  Description of Artificial Sequence: Synthetic oligonucleotide
  Target: ATXN1; (-) strand; PAM type: NRG; PAM sequence: CAG
atggggaagaaatagtaggg

SEQ ID NO: 55778 - DNA, 20 bp, Artificial Sequence
  Description of Artificial Sequence: Synthetic oligonucleotide
  Target: ATXN1; (-) strand; PAM type: NRG; PAM sequence: GGG
tctatggggaagaaatagta

SEQ ID NO: 55779 - DNA, 20 bp, Artificial Sequence
  Description of Artificial Sequence: Synthetic oligonucleotide
  Target: ATXN1; (-) strand; PAM type: NRG; PAM sequence: AGG
gtctatggggaagaaatagt

SEQ ID NO: 55780 - DNA, 20 bp, Artificial Sequence
  Description of Artificial Sequence: Synthetic oligonucleotide
  Target: ATXN1; (-) strand; PAM type: NRG; PAM sequence: TAG
tgtctatggggaagaaatag

SEQ ID NO: 55781 - DNA, 20 bp, Artificial Sequence
  Description of Artificial Sequence: Synthetic oligonucleotide
  Target: ATXN1; (-) strand; PAM type: NRG; PAM sequence: TAG
ctctgtctatggggaagaaa

SEQ ID NO: 55782 - DNA, 20 bp, Artificial Sequence
  Description of Artificial Sequence: Synthetic oligonucleotide
  Target: ATXN1; (-) strand; PAM type: NRG; PAM sequence: AAG
agggatctctgtctatgggg

SEQ ID NO: 55783 - DNA, 20 bp, Artificial Sequence
  Description of Artificial Sequence: Synthetic oligonucleotide
  Target: ATXN1; (-) strand; PAM type: NRG; PAM sequence: GGG
ctaagggatctctgtctatg

SEQ ID NO: 55784 - DNA, 20 bp, Artificial Sequence
  Description of Artificial Sequence: Synthetic oligonucleotide
  Target: ATXN1; (-) strand; PAM type: NRG; PAM sequence: GGG
actaagggatctctgtctat

SEQ ID NO: 55785 - DNA, 20 bp, Artificial Sequence
  Description of Artificial Sequence: Synthetic oligonucleotide
  Target: ATXN1; (-) strand; PAM type: NRG; PAM sequence: TGG
aactaagggatctctgtcta

SEQ ID NO: 55786 - DNA, 20 bp, Artificial Sequence
  Description of Artificial Sequence: Synthetic oligonucleotide
  Target: ATXN1; (-) strand; PAM type: NRG; PAM sequence: GGG
aaggagtttgaaagaactaa

SEQ ID NO: 55787 - DNA, 20 bp, Artificial Sequence
  Description of Artificial Sequence: Synthetic oligonucleotide
  Target: ATXN1; (-) strand; PAM type: NRG; PAM sequence: AGG
aaaggagtttgaaagaacta

SEQ ID NO: 55788 - DNA, 20 bp, Artificial Sequence
  Description of Artificial Sequence: Synthetic oligonucleotide
  Target: ATXN1; (-) strand; PAM type: NRG; PAM sequence: AAG
aaaaggagtttgaaagaact

SEQ ID NO: 55789 - DNA, 20 bp, Artificial Sequence
  Description of Artificial Sequence: Synthetic oligonucleotide
  Target: ATXN1; (-) strand; PAM type: NRG; PAM sequence: AAG
gtaaggaaaaaggagtttga

SEQ ID NO: 55790 - DNA, 20 bp, Artificial Sequence
  Description of Artificial Sequence: Synthetic oligonucleotide
  Target: ATXN1; (-) strand; PAM type: NRG; PAM sequence: GAG
tacagtcagtaaggaaaaag

SEQ ID NO: 55791 - DNA, 20 bp, Artificial Sequence
  Description of Artificial Sequence: Synthetic oligonucleotide
  Target: ATXN1; (-) strand; PAM type: NRG; PAM sequence: AGG
tctacagtcagtaaggaaaa

SEQ ID NO: 55792 - DNA, 20 bp, Artificial Sequence
  Description of Artificial Sequence: Synthetic oligonucleotide
  Target: ATXN1; (-) strand; PAM type: NRG; PAM sequence: AAG
ctctacagtcagtaaggaaa

SEQ ID NO: 55793 - DNA, 20 bp, Artificial Sequence
  Description of Artificial Sequence: Synthetic oligonucleotide
  Target: ATXN1; (-) strand; PAM type: NRG; PAM sequence: AGG
tggggtctctacagtcagta

SEQ ID NO: 55794 - DNA, 20 bp, Artificial Sequence
  Description of Artificial Sequence: Synthetic oligonucleotide
  Target: ATXN1; (-) strand; PAM type: NRG; PAM sequence: AAG
ttggggtctctacagtcagt

SEQ ID NO: 55795 - DNA, 20 bp, Artificial Sequence
  Description of Artificial Sequence: Synthetic oligonucleotide
  Target: ATXN1; (-) strand; PAM type: NRG; PAM sequence: CAG
aaacttggggtctctacagt

SEQ ID NO: 55796 - DNA, 20 bp, Artificial Sequence
  Description of Artificial Sequence: Synthetic oligonucleotide
  Target: ATXN1; (-) strand; PAM type: NRG; PAM sequence: CAG
tgagaaacttggggtctcta

SEQ ID NO: 55797 - DNA, 20 bp, Artificial Sequence
  Description of Artificial Sequence: Synthetic oligonucleotide
  Target: ATXN1; (-) strand; PAM type: NRG; PAM sequence: GGG
cagtgccagtgagaaacttg

SEQ ID NO: 55798 - DNA, 20 bp, Artificial Sequence
  Description of Artificial Sequence: Synthetic oligonucleotide
  Target: ATXN1; (-) strand; PAM type: NRG; PAM sequence: GGG
gcagtgccagtgagaaactt

SEQ ID NO: 55799 - DNA, 20 bp, Artificial Sequence
  Description of Artificial Sequence: Synthetic oligonucleotide
  Target: ATXN1; (-) strand; PAM type: NRG; PAM sequence: TGG
tgcagtgccagtgagaaact

SEQ ID NO: 55800 - DNA, 20 bp, Artificial Sequence
  Description of Artificial Sequence: Synthetic oligonucleotide
  Target: ATXN1; (-) strand; PAM type: NRG; PAM sequence: GAG
atatattttgcagtgccagt

SEQ ID NO: 55801 - DNA, 20 bp, Artificial Sequence
  Description of Artificial Sequence: Synthetic oligonucleotide
  Target: ATXN1; (-) strand; PAM type: NRG; PAM sequence: CAG
ctgcatatattttgcagtgc

SEQ ID NO: 55802 - DNA, 20 bp, Artificial Sequence
  Description of Artificial Sequence: Synthetic oligonucleotide
  Target: ATXN1; (-) strand; PAM type: NRG; PAM sequence: CAG
aaatttctgcatatattttg

SEQ ID NO: 55803 - DNA, 20 bp, Artificial Sequence
  Description of Artificial Sequence: Synthetic oligonucleotide
  Target: ATXN1; (-) strand; PAM type: NRG; PAM sequence: AGG
tttttttttttaatgctaaa

SEQ ID NO: 55804 - DNA, 20 bp, Artificial Sequence
  Description of Artificial Sequence: Synthetic oligonucleotide
  Target: ATXN1; (-) strand; PAM type: NRG; PAM sequence: AAG
gtttttttttttaatgctaa

SEQ ID NO: 55805 - DNA, 20 bp, Artificial Sequence
  Description of Artificial Sequence: Synthetic oligonucleotide
  Target: ATXN1; (-) strand; PAM type: NRG; PAM sequence: TGG
tactctgatgctattgctac

SEQ ID NO: 55806 - DNA, 20 bp, Artificial Sequence
  Description of Artificial Sequence: Synthetic oligonucleotide
  Target: ATXN1; (-) strand; PAM type: NRG; PAM sequence: GAG
cactgcactccagcctggag

SEQ ID NO: 55807 - DNA, 20 bp, Artificial Sequence
  Description of Artificial Sequence: Synthetic oligonucleotide
  Target: ATXN1; (-) strand; PAM type: NRG; PAM sequence: AGG
accactgcactccagcctgg

SEQ ID NO: 55808 - DNA, 20 bp, Artificial Sequence
  Description of Artificial Sequence: Synthetic oligonucleotide
  Target: ATXN1; (-) strand; PAM type: NRG; PAM sequence: GAG
taccactgcactccagcctg

SEQ ID NO: 55809 - DNA, 20 bp, Artificial Sequence
  Description of Artificial Sequence: Synthetic oligonucleotide
  Target: ATXN1; (-) strand; PAM type: NRG; PAM sequence: TGG
cgtaccactgcactccagcc

SEQ ID NO: 55810 - DNA, 20 bp, Artificial Sequence
  Description of Artificial Sequence: Synthetic oligonucleotide
  Target: ATXN1; (-) strand; PAM type: NRG; PAM sequence: CAG
gagatcgtaccactgcactc

SEQ ID NO: 55811 - DNA, 20 bp, Artificial Sequence
  Description of Artificial Sequence: Synthetic oligonucleotide
  Target: ATXN1; (-) strand; PAM type: NRG; PAM sequence: GAG
ggcggaggttgcagtcagct

SEQ ID NO: 55812 - DNA, 20 bp, Artificial Sequence
  Description of Artificial Sequence: Synthetic oligonucleotide
  Target: ATXN1; (-) strand; PAM type: NRG; PAM sequence: CAG
tgggaggcggaggttgcagt

SEQ ID NO: 55813 - DNA, 20 bp, Artificial Sequence
  Description of Artificial Sequence: Synthetic oligonucleotide
  Target: ATXN1; (-) strand; PAM type: NRG; PAM sequence: CAG
aacctgggaggcggaggttg

SEQ ID NO: 55814 - DNA, 20 bp, Artificial Sequence
  Description of Artificial Sequence: Synthetic oligonucleotide
  Target: ATXN1; (-) strand; PAM type: NRG; PAM sequence: AGG
cacttgaacctgggaggcgg

SEQ ID NO: 55815 - DNA, 20 bp, Artificial Sequence
  Description of Artificial Sequence: Synthetic oligonucleotide
  Target: ATXN1; (-) strand; PAM type: NRG; PAM sequence: GAG
tcacttgaacctgggaggcg

SEQ ID NO: 55816 - DNA, 20 bp, Artificial Sequence
  Description of Artificial Sequence: Synthetic oligonucleotide
  Target: ATXN1; (-) strand; PAM type: NRG; PAM sequence: CGG
aatcacttgaacctgggagg

SEQ ID NO: 55817 - DNA, 20 bp, Artificial Sequence
  Description of Artificial Sequence: Synthetic oligonucleotide
  Target: ATXN1; (-) strand; PAM type: NRG; PAM sequence: AGG
gagaatcacttgaacctggg

SEQ ID NO: 55818 - DNA, 20 bp, Artificial Sequence
  Description of Artificial Sequence: Synthetic oligonucleotide
  Target: ATXN1; (-) strand; PAM type: NRG; PAM sequence: GAG
tgagaatcacttgaacctgg

SEQ ID NO: 55819 - DNA, 20 bp, Artificial Sequence
  Description of Artificial Sequence: Synthetic oligonucleotide
  Target: ATXN1; (-) strand; PAM type: NRG; PAM sequence: GGG
catgagaatcacttgaacct

SEQ ID NO: 55820 - DNA, 20 bp, Artificial Sequence
  Description of Artificial Sequence: Synthetic oligonucleotide
  Target: ATXN1; (-) strand; PAM type: NRG; PAM sequence: TGG
gcatgagaatcacttgaacc

SEQ ID NO: 55821 - DNA, 20 bp, Artificial Sequence
  Description of Artificial Sequence: Synthetic oligonucleotide
  Target: ATXN1; (-) strand; PAM type: NRG; PAM sequence: GAG
tacttgggaggctaaggcat

SEQ ID NO: 55822 - DNA, 20 bp, Artificial Sequence
  Description of Artificial Sequence: Synthetic oligonucleotide
  Target: ATXN1; (-) strand; PAM type: NRG; PAM sequence: AGG
cccagctacttgggaggcta

SEQ ID NO: 55823 - DNA, 20 bp, Artificial Sequence
  Description of Artificial Sequence: Synthetic oligonucleotide
  Target: ATXN1; (-) strand; PAM type: NRG; PAM sequence: AAG
tcccagctacttgggaggct

SEQ ID NO: 55824 - DNA, 20 bp, Artificial Sequence
  Description of Artificial Sequence: Synthetic oligonucleotide
  Target: ATXN1; (-) strand; PAM type: NRG; PAM sequence: AGG
tgtaatcccagctacttggg

SEQ ID NO: 55825 - DNA, 20 bp, Artificial Sequence
  Description of Artificial Sequence: Synthetic oligonucleotide
  Target: ATXN1; (-) strand; PAM type: NRG; PAM sequence: GAG
ctgtaatcccagctacttgg

SEQ ID NO: 55826 - DNA, 20 bp, Artificial Sequence
  Description of Artificial Sequence: Synthetic oligonucleotide
  Target: ATXN1; (-) strand; PAM type: NRG; PAM sequence: GGG
acctgtaatcccagctactt

SEQ ID NO: 55827 - DNA, 20 bp, Artificial Sequence
  Description of Artificial Sequence: Synthetic oligonucleotide
  Target: ATXN1; (-) strand; PAM type: NRG; PAM sequence: TGG
cacctgtaatcccagctact

SEQ ID NO: 55828 - DNA, 20 bp, Artificial Sequence
  Description of Artificial Sequence: Synthetic oligonucleotide
  Target: ATXN1; (-) strand; PAM type: NRG; PAM sequence: CAG
gtggtgggcacctgtaatcc

SEQ ID NO: 55829 - DNA, 20 bp, Artificial Sequence
  Description of Artificial Sequence: Synthetic oligonucleotide
  Target: ATXN1; (-) strand; PAM type: NRG; PAM sequence: GGG
aattagccaggcgtggtggt

SEQ ID NO: 55830 - DNA, 20 bp, Artificial Sequence
  Description of Artificial Sequence: Synthetic oligonucleotide
  Target: ATXN1; (-) strand; PAM type: NRG; PAM sequence: TGG
aaattagccaggcgtggtgg

SEQ ID NO: 55831 - DNA, 20 bp, Artificial Sequence
  Description of Artificial Sequence: Synthetic oligonucleotide
  Target: ATXN1; (-) strand; PAM type: NRG; PAM sequence: TGG
caaaaattagccaggcgtgg

SEQ ID NO: 55832 - DNA, 20 bp, Artificial Sequence
  Description of Artificial Sequence: Synthetic oligonucleotide
  Target: ATXN1; (-) strand; PAM type: NRG; PAM sequence: TGG
atacaaaaattagccaggcg

SEQ ID NO: 55833 - DNA, 20 bp, Artificial Sequence
  Description of Artificial Sequence: Synthetic oligonucleotide
  Target: ATXN1; (-) strand; PAM type: NRG; PAM sequence: AGG
taaaaatacaaaaattagcc

SEQ ID NO: 55834 - DNA, 20 bp, Artificial Sequence
  Description of Artificial Sequence: Synthetic oligonucleotide
  Target: ATXN1; (-) strand; PAM type: NRG; PAM sequence: CAG
ctaaaaatacaaaaattagc

SEQ ID NO: 55835 - DNA, 20 bp, Artificial Sequence
  Description of Artificial Sequence: Synthetic oligonucleotide
  Target: ATXN1; (-) strand; PAM type: NRG; PAM sequence: TAG
tctactaaaaatacaaaaat

SEQ ID NO: 55836 - DNA, 20 bp, Artificial Sequence
  Description of Artificial Sequence: Synthetic oligonucleotide
  Target: ATXN1; (-) strand; PAM type: NRG; PAM sequence: TGG
tgagaccagcctggccaaca

SEQ ID NO: 55837 - DNA, 20 bp, Artificial Sequence
  Description of Artificial Sequence: Synthetic oligonucleotide
  Target: ATXN1; (-) strand; PAM type: NRG; PAM sequence: TGG
ccaggagtttgagaccagcc

SEQ ID NO: 55838 - DNA, 20 bp, Artificial Sequence
  Description of Artificial Sequence: Synthetic oligonucleotide
  Target: ATXN1; (-) strand; PAM type: NRG; PAM sequence: CAG
tgaggccaggagtttgagac

SEQ ID NO: 55839 - DNA, 20 bp, Artificial Sequence
  Description of Artificial Sequence: Synthetic oligonucleotide
  Target: ATXN1; (-) strand; PAM type: NRG; PAM sequence: GAG
tcacctgaggccaggagttt

SEQ ID NO: 55840 - DNA, 20 bp, Artificial Sequence
  Description of Artificial Sequence: Synthetic oligonucleotide
  Target: ATXN1; (-) strand; PAM type: NRG; PAM sequence: GAG
ggtggatcacctgaggccag

SEQ ID NO: 55841 - DNA, 20 bp, Artificial Sequence
  Description of Artificial Sequence: Synthetic oligonucleotide
  Target: ATXN1; (-) strand; PAM type: NRG; PAM sequence: AGG
tgggtggatcacctgaggcc

SEQ ID NO: 55842 - DNA, 20 bp, Artificial Sequence
  Description of Artificial Sequence: Synthetic oligonucleotide
  Target: ATXN1; (-) strand; PAM type: NRG; PAM sequence: CAG
atgggtggatcacctgaggc

SEQ ID NO: 55843 - DNA, 20 bp, Artificial Sequence
  Description of Artificial Sequence: Synthetic oligonucleotide
  Target: ATXN1; (-) strand; PAM type: NRG; PAM sequence: AGG
cgagatgggtggatcacctg

SEQ ID NO: 55844 - DNA, 20 bp, Artificial Sequence
  Description of Artificial Sequence: Synthetic oligonucleotide
  Target: ATXN1; (-) strand; PAM type: NRG; PAM sequence: GAG
ccgagatgggtggatcacct

SEQ ID NO: 55845 - DNA, 20 bp, Artificial Sequence
  Description of Artificial Sequence: Synthetic oligonucleotide
  Target: ATXN1; (-) strand; PAM type: NRG; PAM sequence: TGG
ttttgggaggccgagatggg

SEQ ID NO: 55846 - DNA, 20 bp, Artificial Sequence
  Description of Artificial Sequence: Synthetic oligonucleotide
  Target: ATXN1; (-) strand; PAM type: NRG; PAM sequence: GGG
gcattttgggaggccgagat

SEQ ID NO: 55847 - DNA, 20 bp, Artificial Sequence
  Description of Artificial Sequence: Synthetic oligonucleotide
  Target: ATXN1; (-) strand; PAM type: NRG; PAM sequence: TGG
agcattttgggaggccgaga

SEQ ID NO: 55848 - DNA, 20 bp, Artificial Sequence
  Description of Artificial Sequence: Synthetic oligonucleotide
  Target: ATXN1; (-) strand; PAM type: NRG; PAM sequence: GAG
tctcagcattttgggaggcc

SEQ ID NO: 55849 - DNA, 20 bp, Artificial Sequence
  Description of Artificial Sequence: Synthetic oligonucleotide
  Target: ATXN1; (-) strand; PAM type: NRG; PAM sequence: AGG
tgtaatctcagcattttggg

SEQ ID NO: 55850 - DNA, 20 bp, Artificial Sequence
  Description of Artificial Sequence: Synthetic oligonucleotide
  Target: ATXN1; (-) strand; PAM type: NRG; PAM sequence: GAG
ctgtaatctcagcattttgg

SEQ ID NO: 55851 - DNA, 20 bp, Artificial Sequence
  Description of Artificial Sequence: Synthetic oligonucleotide
  Target: ATXN1; (-) strand; PAM type: NRG; PAM sequence: GGG
acctgtaatctcagcatttt

SEQ ID NO: 55852 - DNA, 20 bp, Artificial Sequence
  Description of Artificial Sequence: Synthetic oligonucleotide
  Target: ATXN1; (-) strand; PAM type: NRG; PAM sequence: TGG
cacctgtaatctcagcattt

SEQ ID NO: 55853 - DNA, 20 bp, Artificial Sequence
  Description of Artificial Sequence: Synthetic oligonucleotide
  Target: ATXN1; (-) strand; PAM type: NRG; PAM sequence: CAG
gtggctcacacctgtaatct

SEQ ID NO: 55854 - DNA, 20 bp, Artificial Sequence
  Description of Artificial Sequence: Synthetic oligonucleotide
  Target: ATXN1; (-) strand; PAM type: NRG; PAM sequence: TGG
aaaactccagccaggctcag

SEQ ID NO: 55855 - DNA, 20 bp, Artificial Sequence
  Description of Artificial Sequence: Synthetic oligonucleotide
  Target: ATXN1; (-) strand; PAM type: NRG; PAM sequence: CAG
gagaaaactccagccaggct

SEQ ID NO: 55856 - DNA, 20 bp, Artificial Sequence
  Description of Artificial Sequence: Synthetic oligonucleotide
  Target: ATXN1; (-) strand; PAM type: NRG; PAM sequence: AGG
gataagagaaaactccagcc

SEQ ID NO: 55857 - DNA, 20 bp, Artificial Sequence
  Description of Artificial Sequence: Synthetic oligonucleotide
  Target: ATXN1; (-) strand; PAM type: NRG; PAM sequence: CAG
tgataagagaaaactccagc

SEQ ID NO: 55858 - DNA, 20 bp, Artificial Sequence
  Description of Artificial Sequence: Synthetic oligonucleotide
  Target: ATXN1; (-) strand; PAM type: NRG; PAM sequence: CAG
tctatgataagagaaaactc

SEQ ID NO: 55859 - DNA, 20 bp, Artificial Sequence
  Description of Artificial Sequence: Synthetic oligonucleotide
  Target: ATXN1; (-) strand; PAM type: NRG; PAM sequence: GAG
acagaatgcttctatgataa

SEQ ID NO: 55860 - DNA, 20 bp, Artificial Sequence
  Description of Artificial Sequence: Synthetic oligonucleotide
  Target: ATXN1; (-) strand; PAM type: NRG; PAM sequence: AAG
acacagaatgcttctatgat

SEQ ID NO: 55861 - DNA, 20 bp, Artificial Sequence
  Description of Artificial Sequence: Synthetic oligonucleotide
  Target: ATXN1; (-) strand; PAM type: NRG; PAM sequence: CAG
gcctaaaactcatagaaaca

SEQ ID NO: 55862 - DNA, 20 bp, Artificial Sequence
  Description of Artificial Sequence: Synthetic oligonucleotide
  Target: ATXN1; (-) strand; PAM type: NRG; PAM sequence: TAG
tcgaatgggcctaaaactca

SEQ ID NO: 55863 - DNA, 20 bp, Artificial Sequence
  Description of Artificial Sequence: Synthetic oligonucleotide
  Target: ATXN1; (-) strand; PAM type: NRG; PAM sequence: GGG
ggtttttatgtggatcgaat

SEQ ID NO: 55864 - DNA, 20 bp, Artificial Sequence
  Description of Artificial Sequence: Synthetic oligonucleotide
  Target: ATXN1; (-) strand; PAM type: NRG; PAM sequence: TGG
cggtttttatgtggatcgaa

SEQ ID NO: 55865 - DNA, 20 bp, Artificial Sequence
  Description of Artificial Sequence: Synthetic oligonucleotide
  Target: ATXN1; (-) strand; PAM type: NRG; PAM sequence: TGG
tacctgctgcggtttttatg

SEQ ID NO: 55866 - DNA, 20 bp, Artificial Sequence
  Description of Artificial Sequence: Synthetic oligonucleotide
  Target: ATXN1; (-) strand; PAM type: NRG; PAM sequence: CGG
ggaggtggtaatacctgctg

SEQ ID NO: 55867 - DNA, 20 bp, Artificial Sequence
  Description of Artificial Sequence: Synthetic oligonucleotide
  Target: ATXN1; (-) strand; PAM type: NRG; PAM sequence: TGG
cccgtttgtcaagagggagg

SEQ ID NO: 55868 - DNA, 20 bp, Artificial Sequence
  Description of Artificial Sequence: Synthetic oligonucleotide
  Target: ATXN1; (-) strand; PAM type: NRG; PAM sequence: AGG
gcccccgtttgtcaagaggg

SEQ ID NO: 55869 - DNA, 20 bp, Artificial Sequence
  Description of Artificial Sequence: Synthetic oligonucleotide
  Target: ATXN1; (-) strand; PAM type: NRG; PAM sequence: GAG
tgcccccgtttgtcaagagg

SEQ ID NO: 55870 - DNA, 20 bp, Artificial Sequence
  Description of Artificial Sequence: Synthetic oligonucleotide
  Target: ATXN1; (-) strand; PAM type: NRG; PAM sequence: GGG
catgcccccgtttgtcaaga

SEQ ID NO: 55871 - DNA, 20 bp, Artificial Sequence
  Description of Artificial Sequence: Synthetic oligonucleotide
  Target: ATXN1; (-) strand; PAM type: NRG; PAM sequence: AGG
ccatgcccccgtttgtcaag

SEQ ID NO: 55872 - DNA, 20 bp, Artificial Sequence
  Description of Artificial Sequence: Synthetic oligonucleotide
  Target: ATXN1; (-) strand; PAM type: NRG; PAM sequence: GAG
tccatgcccccgtttgtcaa

SEQ ID NO: 55873 - DNA, 20 bp, Artificial Sequence
  Description of Artificial Sequence: Synthetic oligonucleotide
  Target: ATXN1; (-) strand; PAM type: NRG; PAM sequence: AAG
cctccatgcccccgtttgtc

SEQ ID NO: 55874 - DNA, 20 bp, Artificial Sequence
  Description of Artificial Sequence: Synthetic oligonucleotide
  Target: ATXN1; (-) strand; PAM type: NRG; PAM sequence: AAG
tcaccacgtgatcttcagaa

SEQ ID NO: 55875 - DNA, 20 bp, Artificial Sequence
  Description of Artificial Sequence: Synthetic oligonucleotide
  Target: ATXN1; (-) strand; PAM type: NRG; PAM sequence: CAG
cacagtcaccacgtgatctt

SEQ ID NO: 55876 - DNA, 20 bp, Artificial Sequence
  Description of Artificial Sequence: Synthetic oligonucleotide
  Target: ATXN1; (-) strand; PAM type: NRG; PAM sequence: CAG
ggtttgagctccacgtccca

SEQ ID NO: 55877 - DNA, 20 bp, Artificial Sequence
  Description of Artificial Sequence: Synthetic oligonucleotide
  Target: ATXN1; (-) strand; PAM type: NRG; PAM sequence: GAG
gaatccacagacttgggttt

SEQ ID NO: 55878 - DNA, 20 bp, Artificial Sequence
  Description of Artificial Sequence: Synthetic oligonucleotide
  Target: ATXN1; (-) strand; PAM type: NRG; PAM sequence: GGG
agctaggaatccacagactt

SEQ ID NO: 55879 - DNA, 20 bp, Artificial Sequence
  Description of Artificial Sequence: Synthetic oligonucleotide
  Target: ATXN1; (-) strand; PAM type: NRG; PAM sequence: TGG
cagctaggaatccacagact

SEQ ID NO: 55880 - DNA, 20 bp, Artificial Sequence
  Description of Artificial Sequence: Synthetic oligonucleotide
  Target: ATXN1; (-) strand; PAM type: NRG; PAM sequence: CAG
tgcctccagctaggaatcca

SEQ ID NO: 55881 - DNA, 20 bp, Artificial Sequence
  Description of Artificial Sequence: Synthetic oligonucleotide
  Target: ATXN1; (-) strand; PAM type: NRG; PAM sequence: AGG
ggtagaatttgcctccagct

SEQ ID NO: 55882 - DNA, 20 bp, Artificial Sequence
  Description of Artificial Sequence: Synthetic oligonucleotide
  Target: ATXN1; (-) strand; PAM type: NRG; PAM sequence: TAG
tggtagaatttgcctccagc

SEQ ID NO: 55883 - DNA, 20 bp, Artificial Sequence
  Description of Artificial Sequence: Synthetic oligonucleotide
  Target: ATXN1; (-) strand; PAM type: NRG; PAM sequence: CAG
gatgtggtagaatttgcctc

SEQ ID NO: 55884 - DNA, 20 bp, Artificial Sequence
  Description of Artificial Sequence: Synthetic oligonucleotide
  Target: ATXN1; (-) strand; PAM type: NRG; PAM sequence: TAG
tacttaaaaatgtgatgtgg

SEQ ID NO: 55885 - DNA, 20 bp, Artificial Sequence
  Description of Artificial Sequence: Synthetic oligonucleotide
  Target: ATXN1; (-) strand; PAM type: NRG; PAM sequence: TGG
gtgtacttaaaaatgtgatg

SEQ ID NO: 55886 - DNA, 20 bp, Artificial Sequence
  Description of Artificial Sequence: Synthetic oligonucleotide
  Target: ATXN1; (-) strand; PAM type: NRG; PAM sequence: AGG
gcctgagtggcaagcttttc

SEQ ID NO: 55887 - DNA, 20 bp, Artificial Sequence
  Description of Artificial Sequence: Synthetic oligonucleotide
  Target: ATXN1; (-) strand; PAM type: NRG; PAM sequence: CAG
tgcctgagtggcaagctttt

SEQ ID NO: 55888 - DNA, 20 bp, Artificial Sequence
  Description of Artificial Sequence: Synthetic oligonucleotide
  Target: ATXN1; (-) strand; PAM type: NRG; PAM sequence: AAG
tgtgattttgcctgagtggc

SEQ ID NO: 55889 - DNA, 20 bp, Artificial Sequence
  Description of Artificial Sequence: Synthetic oligonucleotide
  Target: ATXN1; (-) strand; PAM type: NRG; PAM sequence: TGG
ttattgtgattttgcctgag

SEQ ID NO: 55890 - DNA, 20 bp, Artificial Sequence
  Description of Artificial Sequence: Synthetic oligonucleotide
  Target: ATXN1; (-) strand; PAM type: NRG; PAM sequence: GAG
gtcttattgtgattttgcct

SEQ ID NO: 55891 - DNA, 20 bp, Artificial Sequence
  Description of Artificial Sequence: Synthetic oligonucleotide
  Target: ATXN1; (-) strand; PAM type: NRG; PAM sequence: GAG
tttagtcgcttacggattct

SEQ ID NO: 55892 - DNA, 20 bp, Artificial Sequence
  Description of Artificial Sequence: Synthetic oligonucleotide
  Target: ATXN1; (-) strand; PAM type: NRG; PAM sequence: CGG
caggcaaatttagtcgctta

SEQ ID NO: 55893 - DNA, 20 bp, Artificial Sequence
  Description of Artificial Sequence: Synthetic oligonucleotide
  Target: ATXN1; (-) strand; PAM type: NRG; PAM sequence: TAG
aatgtcactccaggcaaatt

SEQ ID NO: 55894 - DNA, 20 bp, Artificial Sequence
  Description of Artificial Sequence: Synthetic oligonucleotide
  Target: ATXN1; (-) strand; PAM type: NRG; PAM sequence: AGG
cacaaaaataatgtcactcc

SEQ ID NO: 55895 - DNA, 20 bp, Artificial Sequence
  Description of Artificial Sequence: Synthetic oligonucleotide
  Target: ATXN1; (-) strand; PAM type: NRG; PAM sequence: CAG
ccacaaaaataatgtcactc

SEQ ID NO: 55896 - DNA, 20 bp, Artificial Sequence
  Description of Artificial Sequence: Synthetic oligonucleotide
  Target: ATXN1; (-) strand; PAM type: NRG; PAM sequence: CAG
ctaacatttaactctattct

SEQ ID NO: 55897 - DNA, 20 bp, Artificial Sequence
  Description of Artificial Sequence: Synthetic oligonucleotide
  Target: ATXN1; (-) strand; PAM type: NRG; PAM sequence: CAG
agcaatgtatcagtaaactt

SEQ ID NO: 55898 - DNA, 20 bp, Artificial Sequence
  Description of Artificial Sequence: Synthetic oligonucleotide
  Target: ATXN1; (-) strand; PAM type: NRG; PAM sequence: CAG
ttggggtccaagcaatgtat

SEQ ID NO: 55899 - DNA, 20 bp, Artificial Sequence
  Description of Artificial Sequence: Synthetic oligonucleotide
  Target: ATXN1; (-) strand; PAM type: NRG; PAM sequence: AAG
gtgcagggactttggggtcc

SEQ ID NO: 55900 - DNA, 20 bp, Artificial Sequence
  Description of Artificial Sequence: Synthetic oligonucleotide
  Target: ATXN1; (-) strand; PAM type: NRG; PAM sequence: GGG
taaggagtgcagggactttg

SEQ ID NO: 55901 - DNA, 20 bp, Artificial Sequence
  Description of Artificial Sequence: Synthetic oligonucleotide
  Target: ATXN1; (-) strand; PAM type: NRG; PAM sequence: GGG
ctaaggagtgcagggacttt

SEQ ID NO: 55902 - DNA, 20 bp, Artificial Sequence
  Description of Artificial Sequence: Synthetic oligonucleotide
  Target: ATXN1; (-) strand; PAM type: NRG; PAM sequence: TGG
tctaaggagtgcagggactt

SEQ ID NO: 55903 - DNA, 20 bp, Artificial Sequence
  Description of Artificial Sequence: Synthetic oligonucleotide
  Target: ATXN1; (-) strand; PAM type: NRG; PAM sequence: GGG
acacttgtctaaggagtgca

SEQ ID NO: 55904 - DNA, 20 bp, Artificial Sequence
  Description of Artificial Sequence: Synthetic oligonucleotide
  Target: ATXN1; (-) strand; PAM type: NRG; PAM sequence: AGG
aacacttgtctaaggagtgc

SEQ ID NO: 55905 - DNA, 20 bp, Artificial Sequence
  Description of Artificial Sequence: Synthetic oligonucleotide
  Target: ATXN1; (-) strand; PAM type: NRG; PAM sequence: CAG
caacacttgtctaaggagtg

SEQ ID NO: 55906 - DNA, 20 bp, Artificial Sequence
  Description of Artificial Sequence: Synthetic oligonucleotide
  Target: ATXN1; (-) strand; PAM type: NRG; PAM sequence: GAG
ccctccaacacttgtctaag

SEQ ID NO: 55907 - DNA, 20 bp, Artificial Sequence
  Description of Artificial Sequence: Synthetic oligonucleotide
  Target: ATXN1; (-) strand; PAM type: NRG; PAM sequence: AGG
ttccctccaacacttgtcta

SEQ ID NO: 55908 - DNA, 20 bp, Artificial Sequence
  Description of Artificial Sequence: Synthetic oligonucleotide
  Target: ATXN1; (-) strand; PAM type: NRG; PAM sequence: AAG
tttccctccaacacttgtct

SEQ ID NO: 55909 - DNA, 20 bp, Artificial Sequence
  Description of Artificial Sequence: Synthetic oligonucleotide
  Target: ATXN1; (-) strand; PAM type: NRG; PAM sequence: TGG
atgccacttcacccctgatg

SEQ ID NO: 55910 - DNA, 20 bp, Artificial Sequence
  Description of Artificial Sequence: Synthetic oligonucleotide
  Target: ATXN1; (-) strand; PAM type: NRG; PAM sequence: TGG
gacatcttggagtatactag

SEQ ID NO: 55911 - DNA, 20 bp, Artificial Sequence
  Description of Artificial Sequence: Synthetic oligonucleotide
  Target: ATXN1; (-) strand; PAM type: NRG; PAM sequence: TAG
cgcgacatcttggagtatac

SEQ ID NO: 55912 - DNA, 20 bp, Artificial Sequence
  Description of Artificial Sequence: Synthetic oligonucleotide
  Target: ATXN1; (-) strand; PAM type: NRG; PAM sequence: GAG
cagggactcgcgacatcttg

SEQ ID NO: 55913 - DNA, 20 bp, Artificial Sequence
  Description of Artificial Sequence: Synthetic oligonucleotide
  Target: ATXN1; (-) strand; PAM type: NRG; PAM sequence: TGG
ttcagggactcgcgacatct

SEQ ID NO: 55914 - DNA, 20 bp, Artificial Sequence
  Description of Artificial Sequence: Synthetic oligonucleotide
  Target: ATXN1; (-) strand; PAM type: NRG; PAM sequence: GGG
tcagagatgtgggggattca

SEQ ID NO: 55915 - DNA, 20 bp, Artificial Sequence
  Description of Artificial Sequence: Synthetic oligonucleotide
  Target: ATXN1; (-) strand; PAM type: NRG; PAM sequence: AGG
atcagagatgtgggggattc

SEQ ID NO: 55916 - DNA, 20 bp, Artificial Sequence
  Description of Artificial Sequence: Synthetic oligonucleotide
  Target: ATXN1; (-) strand; PAM type: NRG; PAM sequence: CAG
aatcagagatgtgggggatt

SEQ ID NO: 55917 - DNA, 20 bp, Artificial Sequence
  Description of Artificial Sequence: Synthetic oligonucleotide
  Target: ATXN1; (-) strand; PAM type: NRG; PAM sequence: GGG
agaccaaatcagagatgtgg

SEQ ID NO: 55918 - DNA, 20 bp, Artificial Sequence
  Description of Artificial Sequence: Synthetic oligonucleotide
  Target: ATXN1; (-) strand; PAM type: NRG; PAM sequence: GGG
aagaccaaatcagagatgtg

SEQ ID NO: 55919 - DNA, 20 bp, Artificial Sequence
  Description of Artificial Sequence: Synthetic oligonucleotide
  Target: ATXN1; (-) strand; PAM type: NRG; PAM sequence: GGG
gaagaccaaatcagagatgt

SEQ ID NO: 55920 - DNA, 20 bp, Artificial Sequence
  Description of Artificial Sequence: Synthetic oligonucleotide
  Target: ATXN1; (-) strand; PAM type: NRG; PAM sequence: TGG
ggaagaccaaatcagagatg

SEQ ID NO: 55921 - DNA, 20 bp, Artificial Sequence
  Description of Artificial Sequence: Synthetic oligonucleotide
  Target: ATXN1; (-) strand; PAM type: NRG; PAM sequence: GAG
gttgctggaagaccaaatca

SEQ ID NO: 55922 - DNA, 20 bp, Artificial Sequence
  Description of Artificial Sequence: Synthetic oligonucleotide
  Target: ATXN1; (-) strand; PAM type: NRG; PAM sequence: CAG
tagttgctggaagaccaaat

SEQ ID NO: 55923 - DNA, 20 bp, Artificial Sequence
  Description of Artificial Sequence: Synthetic oligonucleotide
  Target: ATXN1; (-) strand; PAM type: NRG; PAM sequence: AAG
cttattccaatagttgctgg

SEQ ID NO: 55924 - DNA, 20 bp, Artificial Sequence
  Description of Artificial Sequence: Synthetic oligonucleotide
  Target: ATXN1; (-) strand; PAM type: NRG; PAM sequence: TGG
agccttattccaatagttgc

SEQ ID NO: 55925 - DNA, 20 bp, Artificial Sequence
  Description of Artificial Sequence: Synthetic oligonucleotide
  Target: ATXN1; (-) strand; PAM type: NRG; PAM sequence: TAG
atcatatagccttattccaa

SEQ ID NO: 55926 - DNA, 20 bp, Artificial Sequence
  Description of Artificial Sequence: Synthetic oligonucleotide
  Target: ATXN1; (-) strand; PAM type: NRG; PAM sequence: TAG
ttgttgttgcacaaatcata

SEQ ID NO: 55927 - DNA, 20 bp, Artificial Sequence
  Description of Artificial Sequence: Synthetic oligonucleotide
  Target: ATXN1; (-) strand; PAM type: NRG; PAM sequence: CGG
aataactagtggtcgcagta

SEQ ID NO: 55928 - DNA, 20 bp, Artificial Sequence
  Description of Artificial Sequence: Synthetic oligonucleotide
  Target: ATXN1; (-) strand; PAM type: NRG; PAM sequence: CAG
ctgttaataactagtggtcg

SEQ ID NO: 55929 - DNA, 20 bp, Artificial Sequence
  Description of Artificial Sequence: Synthetic oligonucleotide
  Target: ATXN1; (-) strand; PAM type: NRG; PAM sequence: TGG
gctgggctgttaataactag

SEQ ID NO: 55930 - DNA, 20 bp, Artificial Sequence
  Description of Artificial Sequence: Synthetic oligonucleotide
  Target: ATXN1; (-) strand; PAM type: NRG; PAM sequence: TAG
caggctgggctgttaataac

SEQ ID NO: 55931 - DNA, 20 bp, Artificial Sequence
  Description of Artificial Sequence: Synthetic oligonucleotide
  Target: ATXN1; (-) strand; PAM type: NRG; PAM sequence: GGG
agctttgtgtaccacaggct

SEQ ID NO: 55932 - DNA, 20 bp, Artificial Sequence
  Description of Artificial Sequence: Synthetic oligonucleotide
  Target: ATXN1; (-) strand; PAM type: NRG; PAM sequence: TGG
cagctttgtgtaccacaggc

SEQ ID NO: 55933 - DNA, 20 bp, Artificial Sequence
  Description of Artificial Sequence: Synthetic oligonucleotide
  Target: ATXN1; (-) strand; PAM type: NRG; PAM sequence: AGG
ctgtcagctttgtgtaccac

SEQ ID NO: 55934 - DNA, 20 bp, Artificial Sequence
  Description of Artificial Sequence: Synthetic oligonucleotide
  Target: ATXN1; (-) strand; PAM type: NRG; PAM sequence: CAG
actgtcagctttgtgtacca

SEQ ID NO: 55935 - DNA, 20 bp, Artificial Sequence
  Description of Artificial Sequence: Synthetic oligonucleotide
  Target: ATXN1; (-) strand; PAM type: NRG; PAM sequence: CAG
taattactcataataactgt

SEQ ID NO: 55936 - DNA, 20 bp, Artificial Sequence
  Description of Artificial Sequence: Synthetic oligonucleotide
  Target: ATXN1; (-) strand; PAM type: NRG; PAM sequence: CAG
gtctggaaatagtgtgtata

SEQ ID NO: 55937 - DNA, 20 bp, Artificial Sequence
  Description of Artificial Sequence: Synthetic oligonucleotide
  Target: ATXN1; (-) strand; PAM type: NRG; PAM sequence: TAG
ttcaaaaacatgtctggaaa

SEQ ID NO: 55938 - DNA, 20 bp, Artificial Sequence
  Description of Artificial Sequence: Synthetic oligonucleotide
  Target: ATXN1; (-) strand; PAM type: NRG; PAM sequence: TGG
ccttgtttcaaaaacatgtc

SEQ ID NO: 55939 - DNA, 20 bp, Artificial Sequence
  Description of Artificial Sequence: Synthetic oligonucleotide
  Target: ATXN1; (-) strand; PAM type: NRG; PAM sequence: AAG
attattggtggtaaaaggca

SEQ ID NO: 55940 - DNA, 20 bp, Artificial Sequence
  Description of Artificial Sequence: Synthetic oligonucleotide
  Target: ATXN1; (-) strand; PAM type: NRG; PAM sequence: AGG
gacaaattattggtggtaaa

SEQ ID NO: 55941 - DNA, 20 bp, Artificial Sequence
  Description of Artificial Sequence: Synthetic oligonucleotide
  Target: ATXN1; (-) strand; PAM type: NRG; PAM sequence: AAG
agacaaattattggtggtaa

SEQ ID NO: 55942 - DNA, 20 bp, Artificial Sequence
  Description of Artificial Sequence: Synthetic oligonucleotide
  Target: ATXN1; (-) strand; PAM type: NRG; PAM sequence: TGG
acaacaagacaaattattgg

SEQ ID NO: 55943 - DNA, 20 bp, Artificial Sequence
  Description of Artificial Sequence: Synthetic oligonucleotide
  Target: ATXN1; (-) strand; PAM type: NRG; PAM sequence: TGG
catacaacaagacaaattat

SEQ ID NO: 55944 - DNA, 20 bp, Artificial Sequence
  Description of Artificial Sequence: Synthetic oligonucleotide
  Target: ATXN1; (-) strand; PAM type: NRG; PAM sequence: AAG
tgtaagtaacaacatacaac

SEQ ID NO: 55945 - DNA, 20 bp, Artificial Sequence
  Description of Artificial Sequence: Synthetic oligonucleotide
  Target: ATXN1; (-) strand; PAM type: NRG; PAM sequence: AAG
aaatcatggaacatctgtgt

SEQ ID NO: 55946 - DNA, 20 bp, Artificial Sequence
  Description of Artificial Sequence: Synthetic oligonucleotide
  Target: ATXN1; (-) strand; PAM type: NRG; PAM sequence: TGG
gagccatatgcaaaaaatca

SEQ ID NO: 55947 - DNA, 20 bp, Artificial Sequence
  Description of Artificial Sequence: Synthetic oligonucleotide
  Target: ATXN1; (-) strand; PAM type: NRG; PAM sequence: GAG
ggaaaaagctttctttggct

SEQ ID NO: 55948 - DNA, 20 bp, Artificial Sequence
  Description of Artificial Sequence: Synthetic oligonucleotide
  Target: ATXN1; (-) strand; PAM type: NRG; PAM sequence: TGG
gaaggggaaaaagctttctt

SEQ ID NO: 55949 - DNA, 20 bp, Artificial Sequence
  Description of Artificial Sequence: Synthetic oligonucleotide
  Target: ATXN1; (-) strand; PAM type: NRG; PAM sequence: AAG
cccaaaaatggaaggggaaa

SEQ ID NO: 55950 - DNA, 20 bp, Artificial Sequence
  Description of Artificial Sequence: Synthetic oligonucleotide
  Target: ATXN1; (-) strand; PAM type: NRG; PAM sequence: GGG
atctttcccaaaaatggaag

SEQ ID NO: 55951 - DNA, 20 bp, Artificial Sequence
  Description of Artificial Sequence: Synthetic oligonucleotide
  Target: ATXN1; (-) strand; PAM type: NRG; PAM sequence: GGG
catctttcccaaaaatggaa

SEQ ID NO: 55952 - DNA, 20 bp, Artificial Sequence
  Description of Artificial Sequence: Synthetic oligonucleotide
  Target: ATXN1; (-) strand; PAM type: NRG; PAM sequence: AGG
gcatctttcccaaaaatgga

SEQ ID NO: 55953 - DNA, 20 bp, Artificial Sequence
  Description of Artificial Sequence: Synthetic oligonucleotide
  Target: ATXN1; (-) strand; PAM type: NRG; PAM sequence: AAG
tgcatctttcccaaaaatgg

SEQ ID NO: 55954 - DNA, 20 bp, Artificial Sequence
  Description of Artificial Sequence: Synthetic oligonucleotide
  Target: ATXN1; (-) strand; PAM type: NRG; PAM sequence: TGG
agttgcatctttcccaaaaa

SEQ ID NO: 55955 - DNA, 20 bp, Artificial Sequence
  Description of Artificial Sequence: Synthetic oligonucleotide
  Target: ATXN1; (-) strand; PAM type: NRG; PAM sequence: CAG
tctcctctcccttacacagt

SEQ ID NO: 55956 - DNA, 20 bp, Artificial Sequence
  Description of Artificial Sequence: Synthetic oligonucleotide
  Target: ATXN1; (-) strand; PAM type: NRG; PAM sequence: CAG
acattctcctctcccttaca

SEQ ID NO: 55957 - DNA, 20 bp, Artificial Sequence
  Description of Artificial Sequence: Synthetic oligonucleotide
  Target: ATXN1; (-) strand; PAM type: NRG; PAM sequence: TAG
catagacattatgtaaaaac

SEQ ID NO: 55958 - DNA, 20 bp, Artificial Sequence
  Description of Artificial Sequence: Synthetic oligonucleotide
  Target: ATXN1; (-) strand; PAM type: NRG; PAM sequence: TAG
ctgcacccctatcatcgcca

SEQ ID NO: 55959 - DNA, 20 bp, Artificial Sequence
  Description of Artificial Sequence: Synthetic oligonucleotide
  Target: ATXN1; (-) strand; PAM type: NRG; PAM sequence: CAG
cacacacacaccagcagcac

SEQ ID NO: 55960 - DNA, 20 bp, Artificial Sequence
  Description of Artificial Sequence: Synthetic oligonucleotide
  Target: ATXN1; (-) strand; PAM type: NRG; PAM sequence: CAG
cacacacacacacacaccag

SEQ ID NO: 55961 - DNA, 20 bp, Artificial Sequence
  Description of Artificial Sequence: Synthetic oligonucleotide
  Target: ATXN1; (-) strand; PAM type: NRG; PAM sequence: CAG
gcgcacacacacacacacac

SEQ ID NO: 55962 - DNA, 20 bp, Artificial Sequence
  Description of Artificial Sequence: Synthetic oligonucleotide
  Target: ATXN1; (-) strand; PAM type: NRG; PAM sequence: GGG
atggttggcaagattgggtg

SEQ ID NO: 55963 - DNA, 20 bp, Artificial Sequence
  Description of Artificial Sequence: Synthetic oligonucleotide
  Target: ATXN1; (-) strand; PAM type: NRG; PAM sequence: GGG
tatggttggcaagattgggt

SEQ ID NO: 55964 - DNA, 20 bp, Artificial Sequence
  Description of Artificial Sequence: Synthetic oligonucleotide
  Target: ATXN1; (-) strand; PAM type: NRG; PAM sequence: TGG
atatggttggcaagattggg

SEQ ID NO: 55965 - DNA, 20 bp, Artificial Sequence
  Description of Artificial Sequence: Synthetic oligonucleotide
  Target: ATXN1; (-) strand; PAM type: NRG; PAM sequence: GGG
gaaatatggttggcaagatt

SEQ ID NO: 55966 - DNA, 20 bp, Artificial Sequence
  Description of Artificial Sequence: Synthetic oligonucleotide
  Target: ATXN1; (-) strand; PAM type: NRG; PAM sequence: TGG
tgaaatatggttggcaagat

SEQ ID NO: 55967 - DNA, 20 bp, Artificial Sequence
  Description of Artificial Sequence: Synthetic oligonucleotide
  Target: ATXN1; (-) strand; PAM type: NRG; PAM sequence: AAG
ttagatgaaatatggttggc

SEQ ID NO: 55968 - DNA, 20 bp, Artificial Sequence
  Description of Artificial Sequence: Synthetic oligonucleotide
  Target: ATXN1; (-) strand; PAM type: NRG; PAM sequence: TGG
agagttagatgaaatatggt

SEQ ID NO: 55969 - DNA, 20 bp, Artificial Sequence
  Description of Artificial Sequence: Synthetic oligonucleotide
  Target: ATXN1; (-) strand; PAM type: NRG; PAM sequence: TGG
caagagagttagatgaaata

SEQ ID NO: 55970 - DNA, 20 bp, Artificial Sequence
  Description of Artificial Sequence: Synthetic oligonucleotide
  Target: ATXN1; (-) strand; PAM type: NRG; PAM sequence: TAG
aatgactcagtcaagagagt

SEQ ID NO: 55971 - DNA, 20 bp, Artificial Sequence
  Description of Artificial Sequence: Synthetic oligonucleotide
  Target: ATXN1; (-) strand; PAM type: NRG; PAM sequence: GAG
taggaatgactcagtcaaga

SEQ ID NO: 55972 - DNA, 20 bp, Artificial Sequence
  Description of Artificial Sequence: Synthetic oligonucleotide
  Target: ATXN1; (-) strand; PAM type: NRG; PAM sequence: GAG
cataggaatgactcagtcaa

SEQ ID NO: 55973 - DNA, 20 bp, Artificial Sequence
  Description of Artificial Sequence: Synthetic oligonucleotide
  Target: ATXN1; (-) strand; PAM type: NRG; PAM sequence: AAG
cccataggaatgactcagtc

SEQ ID NO: 55974 - DNA, 20 bp, Artificial Sequence
  Description of Artificial Sequence: Synthetic oligonucleotide
  Target: ATXN1; (-) strand; PAM type: NRG; PAM sequence: CAG
ctaatcccataggaatgact

SEQ ID NO: 55975 - DNA, 20 bp, Artificial Sequence
  Description of Artificial Sequence: Synthetic oligonucleotide
  Target: ATXN1; (-) strand; PAM type: NRG; PAM sequence: AGG
gcagtactccctaatcccat

SEQ ID NO: 55976 - DNA, 20 bp, Artificial Sequence
  Description of Artificial Sequence: Synthetic oligonucleotide
  Target: ATXN1; (-) strand; PAM type: NRG; PAM sequence: TAG
cgcagtactccctaatccca

SEQ ID NO: 55977 - DNA, 20 bp, Artificial Sequence
  Description of Artificial Sequence: Synthetic oligonucleotide
  Target: ATXN1; (-) strand; PAM type: NRG; PAM sequence: CAG
ccacgaaccttggatgtacg

SEQ ID NO: 55978 - DNA, 20 bp, Artificial Sequence
  Description of Artificial Sequence: Synthetic oligonucleotide
  Target: ATXN1; (-) strand; PAM type: NRG; PAM sequence: TGG
tcagcaaacaccacgaacct

SEQ ID NO: 55979 - DNA, 20 bp, Artificial Sequence
  Description of Artificial Sequence: Synthetic oligonucleotide
  Target: ATXN1; (-) strand; PAM type: NRG; PAM sequence: CAG
cttttgataatgtgttatct

SEQ ID NO: 55980 - DNA, 20 bp, Artificial Sequence
  Description of Artificial Sequence: Synthetic oligonucleotide
  Target: ATXN1; (-) strand; PAM type: NRG; PAM sequence: AGG
atattcaaccctttttagag

SEQ ID NO: 55981 - DNA, 20 bp, Artificial Sequence
  Description of Artificial Sequence: Synthetic oligonucleotide
  Target: ATXN1; (-) strand; PAM type: NRG; PAM sequence: GAG
aatattcaaccctttttaga

SEQ ID NO: 55982 - DNA, 20 bp, Artificial Sequence
  Description of Artificial Sequence: Synthetic oligonucleotide
  Target: ATXN1; (-) strand; PAM type: NRG; PAM sequence: GAG
taaatattcaacccttttta

SEQ ID NO: 55983 - DNA, 20 bp, Artificial Sequence
  Description of Artificial Sequence: Synthetic oligonucleotide
  Target: ATXN1; (-) strand; PAM type: NRG; PAM sequence: TAG
tgtaaatattcaaccctttt

SEQ ID NO: 55984 - DNA, 20 bp, Artificial Sequence
  Description of Artificial Sequence: Synthetic oligonucleotide
  Target: ATXN1; (-) strand; PAM type: NRG; PAM sequence: AAG
agttgtaaagactgccaaga

SEQ ID NO: 55985 - DNA, 20 bp, Artificial Sequence
  Description of Artificial Sequence: Synthetic oligonucleotide
  Target: ATXN1; (-) strand; PAM type: NRG; PAM sequence: AAG
tgtcagttgtaaagactgcc

SEQ ID NO: 55986 - DNA, 20 bp, Artificial Sequence
  Description of Artificial Sequence: Synthetic oligonucleotide
  Target: ATXN1; (-) strand; PAM type: NRG; PAM sequence: AAG
ctctgctgttgtcagttgta

SEQ ID NO: 55987 - DNA, 20 bp, Artificial Sequence
  Description of Artificial Sequence: Synthetic oligonucleotide
  Target: ATXN1; (-) strand; PAM type: NRG; PAM sequence: CAG
tgagagggctctgctgttgt

SEQ ID NO: 55988 - DNA, 20 bp, Artificial Sequence
  Description of Artificial Sequence: Synthetic oligonucleotide
  Target: ATXN1; (-) strand; PAM type: NRG; PAM sequence: GGG
aaggtcatagaaacatgaga

SEQ ID NO: 55989 - DNA, 20 bp, Artificial Sequence
  Description of Artificial Sequence: Synthetic oligonucleotide
  Target: ATXN1; (-) strand; PAM type: NRG; PAM sequence: AGG
gaaggtcatagaaacatgag

SEQ ID NO: 55990 - DNA, 20 bp, Artificial Sequence
  Description of Artificial Sequence: Synthetic oligonucleotide
  Target: ATXN1; (-) strand; PAM type: NRG; PAM sequence: GAG
ggaaggtcatagaaacatga

SEQ ID NO: 55991 - DNA, 20 bp, Artificial Sequence
  Description of Artificial Sequence: Synthetic oligonucleotide
  Target: ATXN1; (-) strand; PAM type: NRG; PAM sequence: GAG
gaggaaggtcatagaaacat

SEQ ID NO: 55992 - DNA, 20 bp, Artificial Sequence
  Description of Artificial Sequence: Synthetic oligonucleotide
  Target: ATXN1; (-) strand; PAM type: NRG; PAM sequence: TAG
gactgtgctgaggaaggtca

SEQ ID NO: 55993 - DNA, 20 bp, Artificial Sequence
  Description of Artificial Sequence: Synthetic oligonucleotide
  Target: ATXN1; (-) strand; PAM type: NRG; PAM sequence: AGG
attccggactgtgctgagga

SEQ ID NO: 55994 - DNA, 20 bp, Artificial Sequence
  Description of Artificial Sequence: Synthetic oligonucleotide
  Target: ATXN1; (-) strand; PAM type: NRG; PAM sequence: AAG
cattccggactgtgctgagg

SEQ ID NO: 55995 - DNA, 20 bp, Artificial Sequence
  Description of Artificial Sequence: Synthetic oligonucleotide
  Target: ATXN1; (-) strand; PAM type: NRG; PAM sequence: AGG
gtgcattccggactgtgctg

SEQ ID NO: 55996 - DNA, 20 bp, Artificial Sequence
  Description of Artificial Sequence: Synthetic oligonucleotide
  Target: ATXN1; (-) strand; PAM type: NRG; PAM sequence: GAG
tgtgcattccggactgtgct

SEQ ID NO: 55997 - DNA, 20 bp, Artificial Sequence
  Description of Artificial Sequence: Synthetic oligonucleotide
  Target: ATXN1; (-) strand; PAM type: NRG; PAM sequence: CGG
gataccgtacatgtgcattc

SEQ ID NO: 55998 - DNA, 20 bp, Artificial Sequence
  Description of Artificial Sequence: Synthetic oligonucleotide
  Target: ATXN1; (-) strand; PAM type: NRG; PAM sequence: GGG
tcccaagaaaacatggaggc

SEQ ID NO: 55999 - DNA, 20 bp, Artificial Sequence
  Description of Artificial Sequence: Synthetic oligonucleotide
  Target: ATXN1; (-) strand; PAM type: NRG; PAM sequence: CGG
ttcccaagaaaacatggagg

SEQ ID NO: 56000 - DNA, 20 bp, Artificial Sequence
  Description of Artificial Sequence: Synthetic oligonucleotide
  Target: ATXN1; (-) strand; PAM type: NRG; PAM sequence: AGG
tccttcccaagaaaacatgg

SEQ ID NO: 56001 - DNA, 20 bp, Artificial Sequence
  Description of Artificial Sequence: Synthetic oligonucleotide
  Target: ATXN1; (-) strand; PAM type: NRG; PAM sequence: GAG
ctccttcccaagaaaacatg

SEQ ID NO: 56002 - DNA, 20 bp, Artificial Sequence
  Description of Artificial Sequence: Synthetic oligonucleotide
  Target: ATXN1; (-) strand; PAM type: NRG; PAM sequence: TGG
ccctccttcccaagaaaaca

SEQ ID NO: 56003 - DNA, 20 bp, Artificial Sequence
  Description of Artificial Sequence: Synthetic oligonucleotide
  Target: ATXN1; (-) strand; PAM type: NRG; PAM sequence: AAG
ctgcacagaccctccttccc

SEQ ID NO: 56004 - DNA, 20 bp, Artificial Sequence
  Description of Artificial Sequence: Synthetic oligonucleotide
  Target: ATXN1; (-) strand; PAM type: NRG; PAM sequence: CAG
aaaaaaaccccacatctgca

SEQ ID NO: 56005 - DNA, 20 bp, Artificial Sequence
  Description of Artificial Sequence: Synthetic oligonucleotide
  Target: ATXN1; (-) strand; PAM type: NRG; PAM sequence: TGG
ttctaaaaacctggtatgct

SEQ ID NO: 56006 - DNA, 20 bp, Artificial Sequence
  Description of Artificial Sequence: Synthetic oligonucleotide
  Target: ATXN1; (-) strand; PAM type: NRG; PAM sequence: TGG
atttctctattctaaaaacc

SEQ ID NO: 56007 - DNA, 20 bp, Artificial Sequence
  Description of Artificial Sequence: Synthetic oligonucleotide
  Target: ATXN1; (-) strand; PAM type: NRG; PAM sequence: CAG
tcctccctgataatttcagc

SEQ ID NO: 56008 - DNA, 20 bp, Artificial Sequence
  Description of Artificial Sequence: Synthetic oligonucleotide
  Target: ATXN1; (-) strand; PAM type: NRG; PAM sequence: CAG
ctcttcctccctgataattt

SEQ ID NO: 56009 - DNA, 20 bp, Artificial Sequence
  Description of Artificial Sequence: Synthetic oligonucleotide
  Target: ATXN1; (-) strand; PAM type: NRG; PAM sequence: TAG
taaaagagatgtatattttt

SEQ ID NO: 56010 - DNA, 20 bp, Artificial Sequence
  Description of Artificial Sequence: Synthetic oligonucleotide
  Target: ATXN1; (-) strand; PAM type: NRG; PAM sequence: GAG
ttggtggtattgcaataaaa

SEQ ID NO: 56011 - DNA, 20 bp, Artificial Sequence
  Description of Artificial Sequence: Synthetic oligonucleotide
  Target: ATXN1; (-) strand; PAM type: NRG; PAM sequence: AAG
aattggtggtattgcaataa

SEQ ID NO: 56012 - DNA, 20 bp, Artificial Sequence
  Description of Artificial Sequence: Synthetic oligonucleotide
  Target: ATXN1; (-) strand; PAM type: NRG; PAM sequence: TGG
cagaatgttctctcaattgg

SEQ ID NO: 56013 - DNA, 20 bp, Artificial Sequence
  Description of Artificial Sequence: Synthetic oligonucleotide
  Target: ATXN1; (-) strand; PAM type: NRG; PAM sequence: TGG
cagcagaatgttctctcaat

SEQ ID NO: 56014 - DNA, 20 bp, Artificial Sequence
  Description of Artificial Sequence: Synthetic oligonucleotide
  Target: ATXN1; (-) strand; PAM type: NRG; PAM sequence: CAG
ttggcagacatcccccccag

SEQ ID NO: 56015 - DNA, 20 bp, Artificial Sequence
  Description of Artificial Sequence: Synthetic oligonucleotide
  Target: ATXN1; (-) strand; PAM type: NRG; PAM sequence: CAG
tccttggcagacatcccccc

SEQ ID NO: 56016 - DNA, 20 bp, Artificial Sequence
  Description of Artificial Sequence: Synthetic oligonucleotide
  Target: ATXN1; (-) strand; PAM type: NRG; PAM sequence: CAG
actgaattagaagtccttgg

SEQ ID NO: 56017 - DNA, 20 bp, Artificial Sequence
  Description of Artificial Sequence: Synthetic oligonucleotide
  Target: ATXN1; (-) strand; PAM type: NRG; PAM sequence: TGG
caaactgaattagaagtcct

SEQ ID NO: 56018 - DNA, 20 bp, Artificial Sequence
  Description of Artificial Sequence: Synthetic oligonucleotide
  Target: ATXN1; (-) strand; PAM type: NRG; PAM sequence: AAG
ggtggaacaaactgaattag

SEQ ID NO: 56019 - DNA, 20 bp, Artificial Sequence
  Description of Artificial Sequence: Synthetic oligonucleotide
  Target: ATXN1; (-) strand; PAM type: NRG; PAM sequence: TAG
acgggtggaacaaactgaat

SEQ ID NO: 56020 - DNA, 20 bp, Artificial Sequence
  Description of Artificial Sequence: Synthetic oligonucleotide
  Target: ATXN1; (-) strand; PAM type: NRG; PAM sequence: TGG
gagtttaaaaataaaacggg

SEQ ID NO: 56021 - DNA, 20 bp, Artificial Sequence
  Description of Artificial Sequence: Synthetic oligonucleotide
  Target: ATXN1; (-) strand; PAM type: NRG; PAM sequence: GGG
ctcgagtttaaaaataaaac

SEQ ID NO: 56022 - DNA, 20 bp, Artificial Sequence
  Description of Artificial Sequence: Synthetic oligonucleotide
  Target: ATXN1; (-) strand; PAM type: NRG; PAM sequence: CGG
actcgagtttaaaaataaaa

SEQ ID NO: 56023 - DNA, 20 bp, Artificial Sequence
  Description of Artificial Sequence: Synthetic oligonucleotide
  Target: ATXN1; (-) strand; PAM type: NRG; PAM sequence: GAG
caggaataaaatctgcactc

SEQ ID NO: 56024 - DNA, 20 bp, Artificial Sequence
  Description of Artificial Sequence: Synthetic oligonucleotide
  Target: ATXN1; (-) strand; PAM type: NRG; PAM sequence: AGG
caccaatcttataacattcc

SEQ ID NO: 56025 - DNA, 20 bp, Artificial Sequence
  Description of Artificial Sequence: Synthetic oligonucleotide
  Target: ATXN1; (-) strand; PAM type: NRG; PAM sequence: CAG
acaccaatcttataacattc

SEQ ID NO: 56026 - DNA, 20 bp, Artificial Sequence
  Description of Artificial Sequence: Synthetic oligonucleotide
  Target: ATXN1; (-) strand; PAM type: NRG; PAM sequence: AAG
gttgttataaagcacttctg

SEQ ID NO: 56027 - DNA, 20 bp, Artificial Sequence
  Description of Artificial Sequence: Synthetic oligonucleotide
  Target: ATXN1; (-) strand; PAM type: NRG; PAM sequence: AAG
gtcttttccaagttgttata

SEQ ID NO: 56028 - DNA, 20 bp, Artificial Sequence
  Description of Artificial Sequence: Synthetic oligonucleotide
  Target: ATXN1; (-) strand; PAM type: NRG; PAM sequence: AAG
aattttagagggtcttttcc

SEQ ID NO: 56029 - DNA, 20 bp, Artificial Sequence
  Description of Artificial Sequence: Synthetic oligonucleotide
  Target: ATXN1; (-) strand; PAM type: NRG; PAM sequence: GGG
tgtacttggagaattttaga

SEQ ID NO: 56030 - DNA, 20 bp, Artificial Sequence
  Description of Artificial Sequence: Synthetic oligonucleotide
  Target: ATXN1; (-) strand; PAM type: NRG; PAM sequence: AGG
atgtacttggagaattttag

SEQ ID NO: 56031 - DNA, 20 bp, Artificial Sequence
  Description of Artificial Sequence: Synthetic oligonucleotide
  Target: ATXN1; (-) strand; PAM type: NRG; PAM sequence: GAG
aatgtacttggagaatttta

SEQ ID NO: 56032 - DNA, 20 bp, Artificial Sequence
  Description of Artificial Sequence: Synthetic oligonucleotide
  Target: ATXN1; (-) strand; PAM type: NRG; PAM sequence: TAG
aaaatgtacttggagaattt

SEQ ID NO: 56033 - DNA, 20 bp, Artificial Sequence
  Description of Artificial Sequence: Synthetic oligonucleotide
  Target: ATXN1; (-) strand; PAM type: NRG; PAM sequence: GAG
tcacccctaaaatgtacttg

SEQ ID NO: 56034 - DNA, 20 bp, Artificial Sequence
  Description of Artificial Sequence: Synthetic oligonucleotide
  Target: ATXN1; (-) strand; PAM type: NRG; PAM sequence: TGG
cttcacccctaaaatgtact

SEQ ID NO: 56035 - DNA, 20 bp, Artificial Sequence
  Description of Artificial Sequence: Synthetic oligonucleotide
  Target: ATXN1; (-) strand; PAM type: NRG; PAM sequence: GAG
gcagctttcttcagaaaaga

SEQ ID NO: 56036 - DNA, 20 bp, Artificial Sequence
  Description of Artificial Sequence: Synthetic oligonucleotide
  Target: ATXN1; (-) strand; PAM type: NRG; PAM sequence: GAG
aggcagctttcttcagaaaa

SEQ ID NO: 56037 - DNA, 20 bp, Artificial Sequence
  Description of Artificial Sequence: Synthetic oligonucleotide
  Target: ATXN1; (-) strand; PAM type: NRG; PAM sequence: AAG
caaggcagctttcttcagaa

SEQ ID NO: 56038 - DNA, 20 bp, Artificial Sequence
  Description of Artificial Sequence: Synthetic oligonucleotide
  Target: ATXN1; (-) strand; PAM type: NRG; PAM sequence: CAG
aaaatcaaggcagctttctt

SEQ ID NO: 56039 - DNA, 20 bp, Artificial Sequence
  Description of Artificial Sequence: Synthetic oligonucleotide
  Target: ATXN1; (-) strand; PAM type: NRG; PAM sequence: CAG
ttacttctgcaaaatcaagg

SEQ ID NO: 56040 - DNA, 20 bp, Artificial Sequence
  Description of Artificial Sequence: Synthetic oligonucleotide
  Target: ATXN1; (-) strand; PAM type: NRG; PAM sequence: AGG
gttttacttctgcaaaatca

SEQ ID NO: 56041 - DNA, 20 bp, Artificial Sequence
  Description of Artificial Sequence: Synthetic oligonucleotide
  Target: ATXN1; (-) strand; PAM type: NRG; PAM sequence: AAG
agttttacttctgcaaaatc

SEQ ID NO: 56042 - DNA, 20 bp, Artificial Sequence
  Description of Artificial Sequence: Synthetic oligonucleotide
  Target: ATXN1; (-) strand; PAM type: NRG; PAM sequence: GAG
atgctttcaaaattatactc

SEQ ID NO: 56043 - DNA, 20 bp, Artificial Sequence
  Description of Artificial Sequence: Synthetic oligonucleotide
  Target: ATXN1; (-) strand; PAM type: NRG; PAM sequence: TAG
atagttaaatacccaataga

SEQ ID NO: 56044 - DNA, 20 bp, Artificial Sequence
  Description of Artificial Sequence: Synthetic oligonucleotide
  Target: ATXN1; (-) strand; PAM type: NRG; PAM sequence: TAG
gaaaatagttaaatacccaa

SEQ ID NO: 56045 - DNA, 20 bp, Artificial Sequence
  Description of Artificial Sequence: Synthetic oligonucleotide
  Target: ATXN1; (-) strand; PAM type: NRG; PAM sequence: TAG
ttataatactccctggaaaa

SEQ ID NO: 56046 - DNA, 20 bp, Artificial Sequence
  Description of Artificial Sequence: Synthetic oligonucleotide
  Target: ATXN1; (-) strand; PAM type: NRG; PAM sequence: TGG
caaattgttataatactccc

SEQ ID NO: 56047 - DNA, 20 bp, Artificial Sequence
  Description of Artificial Sequence: Synthetic oligonucleotide
  Target: ATXN1; (-) strand; PAM type: NRG; PAM sequence: GAG
tagttgtgagaattaaatga

SEQ ID NO: 56048 - DNA, 20 bp, Artificial Sequence
  Description of Artificial Sequence: Synthetic oligonucleotide
  Target: ATXN1; (-) strand; PAM type: NRG; PAM sequence: GAG
ggtagttgtgagaattaaat

SEQ ID NO: 56049 - DNA, 20 bp, Artificial Sequence
  Description of Artificial Sequence: Synthetic oligonucleotide
  Target: ATXN1; (-) strand; PAM type: NRG; PAM sequence: GAG
gggggtgatgaggtagttgt

SEQ ID NO: 56050 - DNA, 20 bp, Artificial Sequence
  Description of Artificial Sequence: Synthetic oligonucleotide
  Target: ATXN1; (-) strand; PAM type: NRG; PAM sequence: TAG
cgtaaatgggggtgatgagg

SEQ ID NO: 56051 - DNA, 20 bp, Artificial Sequence
  Description of Artificial Sequence: Synthetic oligonucleotide
  Target: ATXN1; (-) strand; PAM type: NRG; PAM sequence: AGG
gcccgtaaatgggggtgatg

SEQ ID NO: 56052 - DNA, 20 bp, Artificial Sequence
  Description of Artificial Sequence: Synthetic oligonucleotide
  Target: ATXN1; (-) strand; PAM type: NRG; PAM sequence: GAG
tgcccgtaaatgggggtgat

SEQ ID NO: 56053 - DNA, 20 bp, Artificial Sequence
  Description of Artificial Sequence: Synthetic oligonucleotide
  Target: ATXN1; (-) strand; PAM type: NRG; PAM sequence: GGG
agtttcttgcccgtaaatgg

SEQ ID NO: 56054 - DNA, 20 bp, Artificial Sequence
  Description of Artificial Sequence: Synthetic oligonucleotide
  Target: ATXN1; (-) strand; PAM type: NRG; PAM sequence: GGG
tagtttcttgcccgtaaatg

SEQ ID NO: 56055 - DNA, 20 bp, Artificial Sequence
  Description of Artificial Sequence: Synthetic oligonucleotide
  Target: ATXN1; (-) strand; PAM type: NRG; PAM sequence: GGG
ttagtttcttgcccgtaaat

SEQ ID NO: 56056 - DNA, 20 bp, Artificial Sequence
  Description of Artificial Sequence: Synthetic oligonucleotide
  Target: ATXN1; (-) strand; PAM type: NRG; PAM sequence: TGG
cttagtttcttgcccgtaaa

SEQ ID NO: 56057 - DNA, 20 bp, Artificial Sequence
  Description of Artificial Sequence: Synthetic oligonucleotide
  Target: ATXN1; (-) strand; PAM type: NRG; PAM sequence: TAG
tctggcagttctccctgcct

SEQ ID NO: 56058 - DNA, 20 bp, Artificial Sequence
  Description of Artificial Sequence: Synthetic oligonucleotide
  Target: ATXN1; (-) strand; PAM type: NRG; PAM sequence: CAG
ggatttgaactcaactctgg

SEQ ID NO: 56059 - DNA, 20 bp, Artificial Sequence
  Description of Artificial Sequence: Synthetic oligonucleotide
  Target: ATXN1; (-) strand; PAM type: NRG; PAM sequence: TGG
tctggatttgaactcaactc

SEQ ID NO: 56060 - DNA, 20 bp, Artificial Sequence
  Description of Artificial Sequence: Synthetic oligonucleotide
  Target: ATXN1; (-) strand; PAM type: NRG; PAM sequence: TGG
attttgatatcgtggagatc

SEQ ID NO: 56061 - DNA, 20 bp, Artificial Sequence
  Description of Artificial Sequence: Synthetic oligonucleotide
  Target: ATXN1; (-) strand; PAM type: NRG; PAM sequence: GAG
agaaggattttgatatcgtg

SEQ ID NO: 56062 - DNA, 20 bp, Artificial Sequence
  Description of Artificial Sequence: Synthetic oligonucleotide
  Target: ATXN1; (-) strand; PAM type: NRG; PAM sequence: TGG
gaagaaggattttgatatcg

SEQ ID NO: 56063 - DNA, 20 bp, Artificial Sequence
  Description of Artificial Sequence: Synthetic oligonucleotide
  Target: ATXN1; (-) strand; PAM type: NRG; PAM sequence: AGG
cagttgcatagtggcgaaga

SEQ ID NO: 56064 - DNA, 20 bp, Artificial Sequence
  Description of Artificial Sequence: Synthetic oligonucleotide
  Target: ATXN1; (-) strand; PAM type: NRG; PAM sequence: AAG
acagttgcatagtggcgaag

SEQ ID NO: 56065 - DNA, 20 bp, Artificial Sequence
  Description of Artificial Sequence: Synthetic oligonucleotide
  Target: ATXN1; (-) strand; PAM type: NRG; PAM sequence: AAG
agcacagttgcatagtggcg

SEQ ID NO: 56066 - DNA, 20 bp, Artificial Sequence
  Description of Artificial Sequence: Synthetic oligonucleotide
  Target: ATXN1; (-) strand; PAM type: NRG; PAM sequence: TGG
acgaaagcacagttgcatag

SEQ ID NO: 56067 - DNA, 20 bp, Artificial Sequence
  Description of Artificial Sequence: Synthetic oligonucleotide
  Target: ATXN1; (-) strand; PAM type: NRG; PAM sequence: TAG
tacacgaaagcacagttgca

SEQ ID NO: 56068 - DNA, 20 bp, Artificial Sequence
  Description of Artificial Sequence: Synthetic oligonucleotide
  Target: ATXN1; (-) strand; PAM type: NRG; PAM sequence: CAG
gatatgaatacacgaaagca

SEQ ID NO: 56069 - DNA, 20 bp, Artificial Sequence
  Description of Artificial Sequence: Synthetic oligonucleotide
  Target: ATXN1; (-) strand; PAM type: NRG; PAM sequence: AAG
tcctggatatgaatacacga

SEQ ID NO: 56070 - DNA, 20 bp, Artificial Sequence
  Description of Artificial Sequence: Synthetic oligonucleotide
  Target: ATXN1; (-) strand; PAM type: NRG; PAM sequence: TGG
attgatagtttatgatgtcc

SEQ ID NO: 56071 - DNA, 20 bp, Artificial Sequence
  Description of Artificial Sequence: Synthetic oligonucleotide
  Target: ATXN1; (-) strand; PAM type: NRG; PAM sequence: TAG
taatacatcgtctgtattga

SEQ ID NO: 56072 - DNA, 20 bp, Artificial Sequence
  Description of Artificial Sequence: Synthetic oligonucleotide
  Target: ATXN1; (-) strand; PAM type: NRG; PAM sequence: AAG
taaatagtagcctgatggcc

SEQ ID NO: 56073 - DNA, 20 bp, Artificial Sequence
  Description of Artificial Sequence: Synthetic oligonucleotide
  Target: ATXN1; (-) strand; PAM type: NRG; PAM sequence: TGG
aatgataaatagtagcctga

SEQ ID NO: 56074 - DNA, 20 bp, Artificial Sequence
  Description of Artificial Sequence: Synthetic oligonucleotide
  Target: ATXN1; (-) strand; PAM type: NRG; PAM sequence: TAG
cctgttagaatgataaatag

SEQ ID NO: 56075 - DNA, 20 bp, Artificial Sequence
  Description of Artificial Sequence: Synthetic oligonucleotide
  Target: ATXN1; (-) strand; PAM type: NRG; PAM sequence: TAG
catcctgttagaatgataaa

SEQ ID NO: 56076 - DNA, 20 bp, Artificial Sequence
  Description of Artificial Sequence: Synthetic oligonucleotide
  Target: ATXN1; (-) strand; PAM type: NRG; PAM sequence: TAG
tgcttttgcccccatcctgt

SEQ ID NO: 56077 - DNA, 20 bp, Artificial Sequence
  Description of Artificial Sequence: Synthetic oligonucleotide
  Target: ATXN1; (-) strand; PAM type: NRG; PAM sequence: AGG
ctcatcagaaaagcaggcta

SEQ ID NO: 56078 - DNA, 20 bp, Artificial Sequence
  Description of Artificial Sequence: Synthetic oligonucleotide
  Target: ATXN1; (-) strand; PAM type: NRG; PAM sequence: AAG
tctcatcagaaaagcaggct

SEQ ID NO: 56079 - DNA, 20 bp, Artificial Sequence
  Description of Artificial Sequence: Synthetic oligonucleotide
  Target: ATXN1; (-) strand; PAM type: NRG; PAM sequence: AGG
cgatctctcatcagaaaagc

SEQ ID NO: 56080 - DNA, 20 bp, Artificial Sequence
  Description of Artificial Sequence: Synthetic oligonucleotide
  Target: ATXN1; (-) strand; PAM type: NRG; PAM sequence: CAG
gcgatctctcatcagaaaag

SEQ ID NO: 56081 - DNA, 20 bp, Artificial Sequence
  Description of Artificial Sequence: Synthetic oligonucleotide
  Target: ATXN1; (-) strand; PAM type: NRG; PAM sequence: AAG
cccgcgatctctcatcagaa

SEQ ID NO: 56082 - DNA, 20 bp, Artificial Sequence
  Description of Artificial Sequence: Synthetic oligonucleotide
  Target: ATXN1; (-) strand; PAM type: NRG; PAM sequence: CAG
gctcccccgcgatctctcat

SEQ ID NO: 56083 - DNA, 20 bp, Artificial Sequence
  Description of Artificial Sequence: Synthetic oligonucleotide
  Target: ATXN1; (-) strand; PAM type: NRG; PAM sequence: TGG
cctcttttgcaaactgcctt

SEQ ID NO: 56084 - DNA, 20 bp, Artificial Sequence
  Description of Artificial Sequence: Synthetic oligonucleotide
  Target: ATXN1; (-) strand; PAM type: NRG; PAM sequence: TGG
caaaactcctgcgcagagac

SEQ ID NO: 56085 - DNA, 20 bp, Artificial Sequence
  Description of Artificial Sequence: Synthetic oligonucleotide
  Target: ATXN1; (-) strand; PAM type: NRG; PAM sequence: GAG
accaccaaaactcctgcgca

SEQ ID NO: 56086 - DNA, 20 bp, Artificial Sequence
  Description of Artificial Sequence: Synthetic oligonucleotide
  Target: ATXN1; (-) strand; PAM type: NRG; PAM sequence: CAG
ttaccaccaaaactcctgcg

SEQ ID NO: 56087 - DNA, 20 bp, Artificial Sequence
  Description of Artificial Sequence: Synthetic oligonucleotide
  Target: ATXN1; (-) strand; PAM type: NRG; PAM sequence: TGG
ccaccatttccatcactctc

SEQ ID NO: 56088 - DNA, 20 bp, Artificial Sequence
  Description of Artificial Sequence: Synthetic oligonucleotide
  Target: ATXN1; (-) strand; PAM type: NRG; PAM sequence: TAG
atttggtatttcaaaataaa

SEQ ID NO: 56089 - DNA, 20 bp, Artificial Sequence
  Description of Artificial Sequence: Synthetic oligonucleotide
  Target: ATXN1; (-) strand; PAM type: NRG; PAM sequence: TGG
gtttttatattagtaccatt

SEQ ID NO: 56090 - DNA, 20 bp, Artificial Sequence
  Description of Artificial Sequence: Synthetic oligonucleotide
  Target: ATXN1; (-) strand; PAM type: NRG; PAM sequence: TAG
ggttgaacaagtttttatat

SEQ ID NO: 56091 - DNA, 20 bp, Artificial Sequence
  Description of Artificial Sequence: Synthetic oligonucleotide
  Target: ATXN1; (-) strand; PAM type: NRG; PAM sequence: AAG
gttgccaaagtaggttgaac

SEQ ID NO: 56092 - DNA, 20 bp, Artificial Sequence
  Description of Artificial Sequence: Synthetic oligonucleotide
  Target: ATXN1; (-) strand; PAM type: NRG; PAM sequence: AGG
atatttaatgttgccaaagt

SEQ ID NO: 56093 - DNA, 20 bp, Artificial Sequence
  Description of Artificial Sequence: Synthetic oligonucleotide
  Target: ATXN1; (-) strand; PAM type: NRG; PAM sequence: TAG
catatttaatgttgccaaag

SEQ ID NO: 56094 - DNA, 20 bp, Artificial Sequence
  Description of Artificial Sequence: Synthetic oligonucleotide
  Target: ATXN1; (-) strand; PAM type: NRG; PAM sequence: AAG
cttcatatttaatgttgcca

SEQ ID NO: 56095 - DNA, 20 bp, Artificial Sequence
  Description of Artificial Sequence: Synthetic oligonucleotide
  Target: ATXN1; (-) strand; PAM type: NRG; PAM sequence: AGG
acttttggaggaggggaaga

SEQ ID NO: 56096 - DNA, 20 bp, Artificial Sequence
  Description of Artificial Sequence: Synthetic oligonucleotide
  Target: ATXN1; (-) strand; PAM type: NRG; PAM sequence: AAG
tacttttggaggaggggaag

SEQ ID NO: 56097 - DNA, 20 bp, Artificial Sequence
  Description of Artificial Sequence: Synthetic oligonucleotide
  Target: ATXN1; (-) strand; PAM type: NRG; PAM sequence: AAG
aaatacttttggaggagggg

SEQ ID NO: 56098 - DNA, 20 bp, Artificial Sequence
  Description of Artificial Sequence: Synthetic oligonucleotide
  Target: ATXN1; (-) strand; PAM type: NRG; PAM sequence: GGG
agtaaatacttttggaggag

SEQ ID NO: 56099 - DNA, 20 bp, Artificial Sequence
  Description of Artificial Sequence: Synthetic oligonucleotide
  Target: ATXN1; (-) strand; PAM type: NRG; PAM sequence: GGG
aagtaaatacttttggagga

SEQ ID NO: 56100 - DNA, 20 bp, Artificial Sequence
  Description of Artificial Sequence: Synthetic oligonucleotide
  Target: ATXN1; (-) strand; PAM type: NRG; PAM sequence: AGG
gaagtaaatacttttggagg

SEQ ID NO: 56101 - DNA, 20 bp, Artificial Sequence
  Description of Artificial Sequence: Synthetic oligonucleotide
  Target: ATXN1; (-) strand; PAM type: NRG; PAM sequence: GAG
tgaagtaaatacttttggag

SEQ ID NO: 56102 - DNA, 20 bp, Artificial Sequence
  Description of Artificial Sequence: Synthetic oligonucleotide
  Target: ATXN1; (-) strand; PAM type: NRG; PAM sequence: AGG
tttgaagtaaatacttttgg

SEQ ID NO: 56103 - DNA, 20 bp, Artificial Sequence
  Description of Artificial Sequence: Synthetic oligonucleotide
  Target: ATXN1; (-) strand; PAM type: NRG; PAM sequence: GAG
ttttgaagtaaatacttttg

SEQ ID NO: 56104 - DNA, 20 bp, Artificial Sequence
  Description of Artificial Sequence: Synthetic oligonucleotide
  Target: ATXN1; (-) strand; PAM type: NRG; PAM sequence: TGG
atttttgaagtaaatacttt

SEQ ID NO: 56105 - DNA, 20 bp, Artificial Sequence
  Description of Artificial Sequence: Synthetic oligonucleotide
  Target: ATXN1; (-) strand; PAM type: NRG; PAM sequence: AAG
acagaggaaatcgatttttg

SEQ ID NO: 56106 - DNA, 20 bp, Artificial Sequence
  Description of Artificial Sequence: Synthetic oligonucleotide
  Target: ATXN1; (-) strand; PAM type: NRG; PAM sequence: AGG
gcagcaataaccagtgacag

SEQ ID NO: 56107 - DNA, 20 bp, Artificial Sequence
  Description of Artificial Sequence: Synthetic oligonucleotide
  Target: ATXN1; (-) strand; PAM type: NRG; PAM sequence: GAG
tgcagcaataaccagtgaca

SEQ ID NO: 56108 - DNA, 20 bp, Artificial Sequence
  Description of Artificial Sequence: Synthetic oligonucleotide
  Target: ATXN1; (-) strand; PAM type: NRG; PAM sequence: CAG
aatgcagcaataaccagtga

SEQ ID NO: 56109 - DNA, 20 bp, Artificial Sequence
  Description of Artificial Sequence: Synthetic oligonucleotide
  Target: ATXN1; (-) strand; PAM type: NRG; PAM sequence: CAG
gagcaaaatgcagcaataac

SEQ ID NO: 56110 - DNA, 20 bp, Artificial Sequence
  Description of Artificial Sequence: Synthetic oligonucleotide
  Target: ATXN1; (-) strand; PAM type: NRG; PAM sequence: CAG
cagaaccactgagcaaaatg

SEQ ID NO: 56111 - DNA, 20 bp, Artificial Sequence
  Description of Artificial Sequence: Synthetic oligonucleotide
  Target: ATXN1; (-) strand; PAM type: NRG; PAM sequence: GAG
tgcggtttctcagaaccact

SEQ ID NO: 56112 - DNA, 20 bp, Artificial Sequence
  Description of Artificial Sequence: Synthetic oligonucleotide
  Target: ATXN1; (-) strand; PAM type: NRG; PAM sequence: CAG
tgattttccatgcggtttct

SEQ ID NO: 56113 - DNA, 20 bp, Artificial Sequence
  Description of Artificial Sequence: Synthetic oligonucleotide
  Target: ATXN1; (-) strand; PAM type: NRG; PAM sequence: CGG
taacattgtgattttccatg

SEQ ID NO: 56114 - DNA, 20 bp, Artificial Sequence
  Description of Artificial Sequence: Synthetic oligonucleotide
  Target: ATXN1; (-) strand; PAM type: NRG; PAM sequence: GAG
ccctgcagggtcaatttaac

SEQ ID NO: 56115 - DNA, 20 bp, Artificial Sequence
  Description of Artificial Sequence: Synthetic oligonucleotide
  Target: ATXN1; (-) strand; PAM type: NRG; PAM sequence: GGG
actggtggtagagccctgca

SEQ ID NO: 56116 - DNA, 20 bp, Artificial Sequence
  Description of Artificial Sequence: Synthetic oligonucleotide
  Target: ATXN1; (-) strand; PAM type: NRG; PAM sequence: AGG
tactggtggtagagccctgc

SEQ ID NO: 56117 - DNA, 20 bp, Artificial Sequence
  Description of Artificial Sequence: Synthetic oligonucleotide
  Target: ATXN1; (-) strand; PAM type: NRG; PAM sequence: CAG
gtactggtggtagagccctg

SEQ ID NO: 56118 - DNA, 20 bp, Artificial Sequence
  Description of Artificial Sequence: Synthetic oligonucleotide
  Target: ATXN1; (-) strand; PAM type: NRG; PAM sequence: GAG
tgatgcatgtactggtggta

SEQ ID NO: 56119 - DNA, 20 bp, Artificial Sequence
  Description of Artificial Sequence: Synthetic oligonucleotide
  Target: ATXN1; (-) strand; PAM type: NRG; PAM sequence: TAG
gatgatgcatgtactggtgg

SEQ ID NO: 56120 - DNA, 20 bp, Artificial Sequence
  Description of Artificial Sequence: Synthetic oligonucleotide
  Target: ATXN1; (-) strand; PAM type: NRG; PAM sequence: TGG
tgggatgatgcatgtactgg

SEQ ID NO: 56121 - DNA, 20 bp, Artificial Sequence
  Description of Artificial Sequence: Synthetic oligonucleotide
  Target: ATXN1; (-) strand; PAM type: NRG; PAM sequence: TGG
tcttgggatgatgcatgtac

SEQ ID NO: 56122 - DNA, 20 bp, Artificial Sequence
  Description of Artificial Sequence: Synthetic oligonucleotide
  Target: ATXN1; (-) strand; PAM type: NRG; PAM sequence: GGG
gccttgcctttttacctctt

SEQ ID NO: 56123 - DNA, 20 bp, Artificial Sequence
  Description of Artificial Sequence: Synthetic oligonucleotide
  Target: ATXN1; (-) strand; PAM type: NRG; PAM sequence: TGG
agccttgcctttttacctct

SEQ ID NO: 56124 - DNA, 20 bp, Artificial Sequence
  Description of Artificial Sequence: Synthetic oligonucleotide
  Target: ATXN1; (-) strand; PAM type: NRG; PAM sequence: CAG
tattctcagcatgagcctgg

SEQ ID NO: 56125 - DNA, 20 bp, Artificial Sequence
  Description of Artificial Sequence: Synthetic oligonucleotide
  Target: ATXN1; (-) strand; PAM type: NRG; PAM sequence: TGG
tgatattctcagcatgagcc

SEQ ID NO: 56126 - DNA, 20 bp, Artificial Sequence
  Description of Artificial Sequence: Synthetic oligonucleotide
  Target: ATXN1; (-) strand; PAM type: NRG; PAM sequence: GAG
catgatgatattctcagcat

SEQ ID NO: 56127 - DNA, 20 bp, Artificial Sequence
  Description of Artificial Sequence: Synthetic oligonucleotide
  Target: ATXN1; (-) strand; PAM type: NRG; PAM sequence: CAG
tgatttcatgatgatattct

SEQ ID NO: 56128 - DNA, 20 bp, Artificial Sequence
  Description of Artificial Sequence: Synthetic oligonucleotide
  Target: ATXN1; (-) strand; PAM type: NRG; PAM sequence: GAG
caaatgagctatggaacaga

SEQ ID NO: 56129 - DNA, 20 bp, Artificial Sequence
  Description of Artificial Sequence: Synthetic oligonucleotide
  Target: ATXN1; (-) strand; PAM type: NRG; PAM sequence: GAG
tgcaaatgagctatggaaca

SEQ ID NO: 56130 - DNA, 20 bp, Artificial Sequence
  Description of Artificial Sequence: Synthetic oligonucleotide
  Target: ATXN1; (-) strand; PAM type: NRG; PAM sequence: CAG
catgcaaatgagctatggaa

SEQ ID NO: 56131 - DNA, 20 bp, Artificial Sequence
  Description of Artificial Sequence: Synthetic oligonucleotide
  Target: ATXN1; (-) strand; PAM type: NRG; PAM sequence: TGG
aaaaccatgcaaatgagcta

SEQ ID NO: 56132 - DNA, 20 bp, Artificial Sequence
  Description of Artificial Sequence: Synthetic oligonucleotide
  Target: ATXN1; (-) strand; PAM type: NRG; PAM sequence: GAG
ccaatgaaaaccatgcaaat

SEQ ID NO: 56133 - DNA, 20 bp, Artificial Sequence
  Description of Artificial Sequence: Synthetic oligonucleotide
  Target: ATXN1; (-) strand; PAM type: NRG; PAM sequence: AGG
gaaattgacatttagtatag

SEQ ID NO: 56134 - DNA, 20 bp, Artificial Sequence
  Description of Artificial Sequence: Synthetic oligonucleotide
  Target: ATXN1; (-) strand; PAM type: NRG; PAM sequence: GAG
ggaaattgacatttagtata

SEQ ID NO: 56135 - DNA, 20 bp, Artificial Sequence
  Description of Artificial Sequence: Synthetic oligonucleotide
  Target: ATXN1; (-) strand; PAM type: NRG; PAM sequence: TAG
aaggaaattgacatttagta

SEQ ID NO: 56136 - DNA, 20 bp, Artificial Sequence
  Description of Artificial Sequence: Synthetic oligonucleotide
  Target: ATXN1; (-) strand; PAM type: NRG; PAM sequence: TAG
aagaaaaggaaattgacatt

SEQ ID NO: 56137 - DNA, 20 bp, Artificial Sequence
  Description of Artificial Sequence: Synthetic oligonucleotide
  Target: ATXN1; (-) strand; PAM type: NRG; PAM sequence: AGG
aataagctttaggaaagaaa

SEQ ID NO: 56138 - DNA, 20 bp, Artificial Sequence
  Description of Artificial Sequence: Synthetic oligonucleotide
  Target: ATXN1; (-) strand; PAM type: NRG; PAM sequence: AAG
taataagctttaggaaagaa

SEQ ID NO: 56139 - DNA, 20 bp, Artificial Sequence
  Description of Artificial Sequence: Synthetic oligonucleotide
  Target: ATXN1; (-) strand; PAM type: NRG; PAM sequence: AAG
acagctaataagctttagga

SEQ ID NO: 56140 - DNA, 20 bp, Artificial Sequence
  Description of Artificial Sequence: Synthetic oligonucleotide
  Target: ATXN1; (-) strand; PAM type: NRG; PAM sequence: AGG
acacacagctaataagcttt

SEQ ID NO: 56141 - DNA, 20 bp, Artificial Sequence
  Description of Artificial Sequence: Synthetic oligonucleotide
  Target: ATXN1; (-) strand; PAM type: NRG; PAM sequence: TAG
cacacacagctaataagctt

SEQ ID NO: 56142 - DNA, 20 bp, Artificial Sequence
  Description of Artificial Sequence: Synthetic oligonucleotide
  Target: ATXN1; (-) strand; PAM type: NRG; PAM sequence: AAG
aaacatcacacacagctaat

SEQ ID NO: 56143 - DNA, 20 bp, Artificial Sequence
  Description of Artificial Sequence: Synthetic oligonucleotide
  Target: ATXN1; (-) strand; PAM type: NRG; PAM sequence: CAG
caagctgtaaacatcacaca

SEQ ID NO: 56144 - DNA, 20 bp, Artificial Sequence
  Description of Artificial Sequence: Synthetic oligonucleotide
  Target: ATXN1; (-) strand; PAM type: NRG; PAM sequence: AAG
attaaatctgtttggtcttc

SEQ ID NO: 56145 - DNA, 20 bp, Artificial Sequence
  Description of Artificial Sequence: Synthetic oligonucleotide
  Target: ATXN1; (-) strand; PAM type: NRG; PAM sequence: TGG
ttttaactattaaatctgtt

SEQ ID NO: 56146 - DNA, 20 bp, Artificial Sequence
  Description of Artificial Sequence: Synthetic oligonucleotide
  Target: ATXN1; (-) strand; PAM type: NRG; PAM sequence: TAG
ttgcatgcttttaaattata

SEQ ID NO: 56147 - DNA, 20 bp, Artificial Sequence
  Description of Artificial Sequence: Synthetic oligonucleotide
  Target: ATXN1; (-) strand; PAM type: NRG; PAM sequence: GAG
tacatgtttgatctacatca

SEQ ID NO: 56148 - DNA, 20 bp, Artificial Sequence
  Description of Artificial Sequence: Synthetic oligonucleotide
  Target: ATXN1; (-) strand; PAM type: NRG; PAM sequence: CAG
tctacatgtttgatctacat

SEQ ID NO: 56149 - DNA, 20 bp, Artificial Sequence
  Description of Artificial Sequence: Synthetic oligonucleotide
  Target: ATXN1; (-) strand; PAM type: NRG; PAM sequence: CAG
acttggaaagcatattttaa

SEQ ID NO: 56150 - DNA, 20 bp, Artificial Sequence
  Description of Artificial Sequence: Synthetic oligonucleotide
  Target: ATXN1; (-) strand; PAM type: NRG; PAM sequence: AAG
ccgcatcttccaaacttgga

SEQ ID NO: 56151 - DNA, 20 bp, Artificial Sequence
  Description of Artificial Sequence: Synthetic oligonucleotide
  Target: ATXN1; (-) strand; PAM type: NRG; PAM sequence: TGG
gcctccgcatcttccaaact

SEQ ID NO: 56152 - DNA, 20 bp, Artificial Sequence
  Description of Artificial Sequence: Synthetic oligonucleotide
  Target: ATXN1; (-) strand; PAM type: NRG; PAM sequence: AGG
tgtgtgcacagacatgcatg

SEQ ID NO: 56153 - DNA, 20 bp, Artificial Sequence
  Description of Artificial Sequence: Synthetic oligonucleotide
  Target: ATXN1; (-) strand; PAM type: NRG; PAM sequence: GAG
atgtgtgcacagacatgcat

SEQ ID NO: 56154 - DNA, 20 bp, Artificial Sequence
  Description of Artificial Sequence: Synthetic oligonucleotide
  Target: ATXN1; (-) strand; PAM type: NRG; PAM sequence: CAG
tggtggtgcttatgtgtgca

SEQ ID NO: 56155 - DNA, 20 bp, Artificial Sequence
  Description of Artificial Sequence: Synthetic oligonucleotide
  Target: ATXN1; (-) strand; PAM type: NRG; PAM sequence: TGG
aggttaagcaaattttgtgg

SEQ ID NO: 56156 - DNA, 20 bp, Artificial Sequence
  Description of Artificial Sequence: Synthetic oligonucleotide
  Target: ATXN1; (-) strand; PAM type: NRG; PAM sequence: TGG
aataggttaagcaaattttg

SEQ ID NO: 56157 - DNA, 20 bp, Artificial Sequence
  Description of Artificial Sequence: Synthetic oligonucleotide
  Target: ATXN1; (-) strand; PAM type: NRG; PAM sequence: AAG
aaagaaaaaagaaataggtt

SEQ ID NO: 56158 - DNA, 20 bp, Artificial Sequence
  Description of Artificial Sequence: Synthetic oligonucleotide
  Target: ATXN1; (-) strand; PAM type: NRG; PAM sequence: AGG
gaagaaaagaaaaaagaaat

SEQ ID NO: 56159 - DNA, 20 bp, Artificial Sequence
  Description of Artificial Sequence: Synthetic oligonucleotide
  Target: ATXN1; (-) strand; PAM type: NRG; PAM sequence: TAG
agaagaaaagaaaaaagaaa

SEQ ID NO: 56160 - DNA, 20 bp, Artificial Sequence
  Description of Artificial Sequence: Synthetic oligonucleotide
  Target: ATXN1; (-) strand; PAM type: NRG; PAM sequence: AAG
aagaagagaagaaaagaaaa

SEQ ID NO: 56161 - DNA, 20 bp, Artificial Sequence
  Description of Artificial Sequence: Synthetic oligonucleotide
  Target: ATXN1; (-) strand; PAM type: NRG; PAM sequence: AAG
gaagaagaagaagagaagaa

SEQ ID NO: 56162 - DNA, 20 bp, Artificial Sequence
  Description of Artificial Sequence: Synthetic oligonucleotide
  Target: ATXN1; (-) strand; PAM type: NRG; PAM sequence: AAG
aaaaagaagaagaagaagag

SEQ ID NO: 56163 - DNA, 20 bp, Artificial Sequence
  Description of Artificial Sequence: Synthetic oligonucleotide
  Target: ATXN1; (-) strand; PAM type: NRG; PAM sequence: GAG
aaaaaaaagaagaagaagaa

SEQ ID NO: 56164 - DNA, 20 bp, Artificial Sequence
  Description of Artificial Sequence: Synthetic oligonucleotide
  Target: ATXN1; (-) strand; PAM type: NRG; PAM sequence: AAG
aaaaaaaaaagaagaagaag

SEQ ID NO: 56165 - DNA, 20 bp, Artificial Sequence
  Description of Artificial Sequence: Synthetic oligonucleotide
  Target: ATXN1; (-) strand; PAM type: NRG; PAM sequence: AAG
caaaaaaaaaaaagaagaag

SEQ ID NO: 56166 - DNA, 20 bp, Artificial Sequence
  Description of Artificial Sequence: Synthetic oligonucleotide
  Target: ATXN1; (-) strand; PAM type: NRG; PAM sequence: AAG
ttgcaaaaaaaaaaaagaag

SEQ ID NO: 56167 - DNA, 20 bp, Artificial Sequence
  Description of Artificial Sequence: Synthetic oligonucleotide
  Target: ATXN1; (-) strand; PAM type: NRG; PAM sequence: AAG
tcattgcaaaaaaaaaaaag

SEQ ID NO: 56168 - DNA, 20 bp, Artificial Sequence
  Description of Artificial Sequence: Synthetic oligonucleotide
  Target: ATXN1; (-) strand; PAM type: NRG; PAM sequence: AAG
agatcattgcaaaaaaaaaa

SEQ ID NO: 56169 - DNA, 20 bp, Artificial Sequence
  Description of Artificial Sequence: Synthetic oligonucleotide
  Target: ATXN1; (-) strand; PAM type: NRG; PAM sequence: TAG
gcaaatgtctctgcttcttc

SEQ ID NO: 56170 - DNA, 20 bp, Artificial Sequence
  Description of Artificial Sequence: Synthetic oligonucleotide
  Target: ATXN1; (-) strand; PAM type: NRG; PAM sequence: AAG
tcaagcccttcatagtttat

SEQ ID NO: 56171 - DNA, 20 bp, Artificial Sequence
  Description of Artificial Sequence: Synthetic oligonucleotide
  Target: ATXN1; (-) strand; PAM type: NRG; PAM sequence: TAG
ggctgggttcaagcccttca

SEQ ID NO: 56172 - DNA, 20 bp, Artificial Sequence
  Description of Artificial Sequence: Synthetic oligonucleotide
  Target: ATXN1; (-) strand; PAM type: NRG; PAM sequence: AAG
tgtactcagtggctgggttc

SEQ ID NO: 56173 - DNA, 20 bp, Artificial Sequence
  Description of Artificial Sequence: Synthetic oligonucleotide
  Target: ATXN1; (-) strand; PAM type: NRG; PAM sequence: GGG
aaaatgtgtactcagtggct

SEQ ID NO: 56174 - DNA, 20 bp, Artificial Sequence
  Description of Artificial Sequence: Synthetic oligonucleotide
  Target: ATXN1; (-) strand; PAM type: NRG; PAM sequence: TGG
taaaatgtgtactcagtggc

SEQ ID NO: 56175 - DNA, 20 bp, Artificial Sequence
  Description of Artificial Sequence: Synthetic oligonucleotide
  Target: ATXN1; (-) strand; PAM type: NRG; PAM sequence: TGG
tgagtaaaatgtgtactcag

SEQ ID NO: 56176 - DNA, 20 bp, Artificial Sequence
  Description of Artificial Sequence: Synthetic oligonucleotide
  Target: ATXN1; (-) strand; PAM type: NRG; PAM sequence: CAG
ttgtgagtaaaatgtgtact

SEQ ID NO: 56177 - DNA, 20 bp, Artificial Sequence
  Description of Artificial Sequence: Synthetic oligonucleotide
  Target: ATXN1; (-) strand; PAM type: NRG; PAM sequence: GAG
ttccatgcagatttcattgt

SEQ ID NO: 56178 - DNA, 20 bp, Artificial Sequence
  Description of Artificial Sequence: Synthetic oligonucleotide
  Target: ATXN1; (-) strand; PAM type: NRG; PAM sequence: CAG
gacattggcaggcttccatg

SEQ ID NO: 56179 - DNA, 20 bp, Artificial Sequence
  Description of Artificial Sequence: Synthetic oligonucleotide
  Target: ATXN1; (-) strand; PAM type: NRG; PAM sequence: AGG
atgtcagcccagacattggc

SEQ ID NO: 56180 - DNA, 20 bp, Artificial Sequence
  Description of Artificial Sequence: Synthetic oligonucleotide
  Target: ATXN1; (-) strand; PAM type: NRG; PAM sequence: CAG
aatgtcagcccagacattgg

SEQ ID NO: 56181 - DNA, 20 bp, Artificial Sequence
  Description of Artificial Sequence: Synthetic oligonucleotide
  Target: ATXN1; (-) strand; PAM type: NRG; PAM sequence: TGG
ttgaatgtcagcccagacat

SEQ ID NO: 56182 - DNA, 20 bp, Artificial Sequence
  Description of Artificial Sequence: Synthetic oligonucleotide
  Target: ATXN1; (-) strand; PAM type: NRG; PAM sequence: CAG
ggaatgtttgaatgtcagcc

SEQ ID NO: 56183 - DNA, 20 bp, Artificial Sequence
  Description of Artificial Sequence: Synthetic oligonucleotide
  Target: ATXN1; (-) strand; PAM type: NRG; PAM sequence: CAG
aacttggaatgtttgaatgt

SEQ ID NO: 56184 - DNA, 20 bp, Artificial Sequence
  Description of Artificial Sequence: Synthetic oligonucleotide
  Target: ATXN1; (-) strand; PAM type: NRG; PAM sequence: TGG
gattgaaatacatagaaact

SEQ ID NO: 56185 - DNA, 20 bp, Artificial Sequence
  Description of Artificial Sequence: Synthetic oligonucleotide
  Target: ATXN1; (-) strand; PAM type: NRG; PAM sequence: TAG
ttttgagagattgaaataca

SEQ ID NO: 56186 - DNA, 20 bp, Artificial Sequence
  Description of Artificial Sequence: Synthetic oligonucleotide
  Target: ATXN1; (-) strand; PAM type: NRG; PAM sequence: GAG
ttttaaaacattagttttga

SEQ ID NO: 56187 - DNA, 20 bp, Artificial Sequence
  Description of Artificial Sequence: Synthetic oligonucleotide
  Target: ATXN1; (-) strand; PAM type: NRG; PAM sequence: GAG
agttttaaaacattagtttt

SEQ ID NO: 56188 - DNA, 20 bp, Artificial Sequence
  Description of Artificial Sequence: Synthetic oligonucleotide
  Target: ATXN1; (-) strand; PAM type: NRG; PAM sequence: TAG
tatcaagagttttaaaacat

SEQ ID NO: 56189 - DNA, 20 bp, Artificial Sequence
  Description of Artificial Sequence: Synthetic oligonucleotide
  Target: ATXN1; (-) strand; PAM type: NRG; PAM sequence: GAG
agtgcctcagaaaatatcaa

SEQ ID NO: 56190 - DNA, 20 bp, Artificial Sequence
  Description of Artificial Sequence: Synthetic oligonucleotide
  Target: ATXN1; (-) strand; PAM type: NRG; PAM sequence: AAG
gtagtgcctcagaaaatatc

SEQ ID NO: 56191 - DNA, 20 bp, Artificial Sequence
  Description of Artificial Sequence: Synthetic oligonucleotide
  Target: ATXN1; (-) strand; PAM type: NRG; PAM sequence: CAG
gattgaactgtgtagtgcct

SEQ ID NO: 56192 - DNA, 20 bp, Artificial Sequence
  Description of Artificial Sequence: Synthetic oligonucleotide
  Target: ATXN1; (-) strand; PAM type: NRG; PAM sequence: TAG
gaggtgaggattgaactgtg

SEQ ID NO: 56193 - DNA, 20 bp, Artificial Sequence
  Description of Artificial Sequence: Synthetic oligonucleotide
  Target: ATXN1; (-) strand; PAM type: NRG; PAM sequence: AGG
tcactctgaactgagaggtg

SEQ ID NO: 56194 - DNA, 20 bp, Artificial Sequence
  Description of Artificial Sequence: Synthetic oligonucleotide
  Target: ATXN1; (-) strand; PAM type: NRG; PAM sequence: GAG
ttcactctgaactgagaggt

SEQ ID NO: 56195 - DNA, 20 bp, Artificial Sequence
  Description of Artificial Sequence: Synthetic oligonucleotide
  Target: ATXN1; (-) strand; PAM type: NRG; PAM sequence: AGG
tatattcactctgaactgag

SEQ ID NO: 56196 - DNA, 20 bp, Artificial Sequence
  Description of Artificial Sequence: Synthetic oligonucleotide
  Target: ATXN1; (-) strand; PAM type: NRG; PAM sequence: GAG
gtatattcactctgaactga

SEQ ID NO: 56197 - DNA, 20 bp, Artificial Sequence
  Description of Artificial Sequence: Synthetic oligonucleotide
  Target: ATXN1; (-) strand; PAM type: NRG; PAM sequence: GAG
ctgtatattcactctgaact

SEQ ID NO: 56198 - DNA, 20 bp, Artificial Sequence
  Description of Artificial Sequence: Synthetic oligonucleotide
  Target: ATXN1; (-) strand; PAM type: NRG; PAM sequence: CAG
ttctttgcacttctttcaag

SEQ ID NO: 56199 - DNA, 20 bp, Artificial Sequence
  Description of Artificial Sequence: Synthetic oligonucleotide
  Target: ATXN1; (-) strand; PAM type: NRG; PAM sequence: AAG
accttctttgcacttctttc

SEQ ID NO: 56200 - DNA, 20 bp, Artificial Sequence
  Description of Artificial Sequence: Synthetic oligonucleotide
  Target: ATXN1; (-) strand; PAM type: NRG; PAM sequence: AAG
agctacatgctgcacagcaa

SEQ ID NO: 56201 - DNA, 20 bp, Artificial Sequence
  Description of Artificial Sequence: Synthetic oligonucleotide
  Target: ATXN1; (-) strand; PAM type: NRG; PAM sequence: CAG
agatcgagctacatgctgca

SEQ ID NO: 56202 - DNA, 20 bp, Artificial Sequence
  Description of Artificial Sequence: Synthetic oligonucleotide
  Target: ATXN1; (-) strand; PAM type: NRG; PAM sequence: GAG
ttgtattgttgcggtagatc

SEQ ID NO: 56203 - DNA, 20 bp, Artificial Sequence
  Description of Artificial Sequence: Synthetic oligonucleotide
  Target: ATXN1; (-) strand; PAM type: NRG; PAM sequence: TAG
tattcattgtattgttgcgg

SEQ ID NO: 56204 - DNA, 20 bp, Artificial Sequence
  Description of Artificial Sequence: Synthetic oligonucleotide
  Target: ATXN1; (-) strand; PAM type: NRG; PAM sequence: CGG
acctattcattgtattgttg

SEQ ID NO: 56205 - DNA, 20 bp, Artificial Sequence
  Description of Artificial Sequence: Synthetic oligonucleotide
  Target: ATXN1; (-) strand; PAM type: NRG; PAM sequence: AGG
tttctagatctgatgcacaa

SEQ ID NO: 56206 - DNA, 20 bp, Artificial Sequence
  Description of Artificial Sequence: Synthetic oligonucleotide
  Target: ATXN1; (-) strand; PAM type: NRG; PAM sequence: AAG
gtttctagatctgatgcaca

SEQ ID NO: 56207 - DNA, 20 bp, Artificial Sequence
  Description of Artificial Sequence: Synthetic oligonucleotide
  Target: ATXN1; (-) strand; PAM type: NRG; PAM sequence: TAG
ttcttttctcaccctgtttc

SEQ ID NO: 56208 - DNA, 20 bp, Artificial Sequence
  Description of Artificial Sequence: Synthetic oligonucleotide
  Target: ATXN1; (-) strand; PAM type: NRG; PAM sequence: AAG
aaatatttatagatttttaa

SEQ ID NO: 56209 - DNA, 20 bp, Artificial Sequence
  Description of Artificial Sequence: Synthetic oligonucleotide
  Target: ATXN1; (-) strand; PAM type: NRG; PAM sequence: TAG
aactaatatttaaatattta

SEQ ID NO: 56210 - DNA, 20 bp, Artificial Sequence
  Description of Artificial Sequence: Synthetic oligonucleotide
  Target: ATXN1; (-) strand; PAM type: NRG; PAM sequence: AGG
attccataaagcatggctat

SEQ ID NO: 56211 - DNA, 20 bp, Artificial Sequence
  Description of Artificial Sequence: Synthetic oligonucleotide
  Target: ATXN1; (-) strand; PAM type: NRG; PAM sequence: TAG
tattccataaagcatggcta

SEQ ID NO: 56212 - DNA, 20 bp, Artificial Sequence
  Description of Artificial Sequence: Synthetic oligonucleotide
  Target: ATXN1; (-) strand; PAM type: NRG; PAM sequence: TGG
atgctttattccataaagca

SEQ ID NO: 56213 - DNA, 20 bp, Artificial Sequence
  Description of Artificial Sequence: Synthetic oligonucleotide
  Target: ATXN1; (-) strand; PAM type: NRG; PAM sequence: AAG
attctatgctttattccata

SEQ ID NO: 56214 - DNA, 20 bp, Artificial Sequence
  Description of Artificial Sequence: Synthetic oligonucleotide
  Target: ATXN1; (-) strand; PAM type: NRG; PAM sequence: AAG
agatgccacatgaaatgcaa

SEQ ID NO: 56215 - DNA, 20 bp, Artificial Sequence
  Description of Artificial Sequence: Synthetic oligonucleotide
  Target: ATXN1; (-) strand; PAM type: NRG; PAM sequence: CAG
gtagcagtagataatgtact

SEQ ID NO: 56216 - DNA, 20 bp, Artificial Sequence
  Description of Artificial Sequence: Synthetic oligonucleotide
  Target: ATXN1; (-) strand; PAM type: NRG; PAM sequence: TAG
gaactaataactagtagcag

SEQ ID NO: 56217 - DNA, 20 bp, Artificial Sequence
  Description of Artificial Sequence: Synthetic oligonucleotide
  Target: ATXN1; (-) strand; PAM type: NRG; PAM sequence: CAG
tgtgaactaataactagtag

SEQ ID NO: 56218 - DNA, 20 bp, Artificial Sequence
  Description of Artificial Sequence: Synthetic oligonucleotide
  Target: ATXN1; (-) strand; PAM type: NRG; PAM sequence: TAG
agctgtgaactaataactag

SEQ ID NO: 56219 - DNA, 20 bp, Artificial Sequence
  Description of Artificial Sequence: Synthetic oligonucleotide
  Target: ATXN1; (-) strand; PAM type: NRG; PAM sequence: TAG
cagagctgtgaactaataac

SEQ ID NO: 56220 - DNA, 20 bp, Artificial Sequence
  Description of Artificial Sequence: Synthetic oligonucleotide
  Target: ATXN1; (-) strand; PAM type: NRG; PAM sequence: GAG
tcaccaattacctcttggca

SEQ ID NO: 56221 - DNA, 20 bp, Artificial Sequence
  Description of Artificial Sequence: Synthetic oligonucleotide
  Target: ATXN1; (-) strand; PAM type: NRG; PAM sequence: CAG
gatcaccaattacctcttgg

SEQ ID NO: 56222 - DNA, 20 bp, Artificial Sequence
  Description of Artificial Sequence: Synthetic oligonucleotide
  Target: ATXN1; (-) strand; PAM type: NRG; PAM sequence: TGG
gtggatcaccaattacctct

SEQ ID NO: 56223 - DNA, 20 bp, Artificial Sequence
  Description of Artificial Sequence: Synthetic oligonucleotide
  Target: ATXN1; (-) strand; PAM type: NRG; PAM sequence: TGG
aaagaagtattcagaaggtg

SEQ ID NO: 56224 - DNA, 20 bp, Artificial Sequence
  Description of Artificial Sequence: Synthetic oligonucleotide
  Target: ATXN1; (-) strand; PAM type: NRG; PAM sequence: AGG
cccaaaaagaagtattcaga

SEQ ID NO: 56225 - DNA, 20 bp, Artificial Sequence
  Description of Artificial Sequence: Synthetic oligonucleotide
  Target: ATXN1; (-) strand; PAM type: NRG; PAM sequence: AAG
tcccaaaaagaagtattcag

SEQ ID NO: 56226 - DNA, 20 bp, Artificial Sequence
  Description of Artificial Sequence: Synthetic oligonucleotide
  Target: ATXN1; (-) strand; PAM type: NRG; PAM sequence: CAG
agttcccaaaaagaagtatt

SEQ ID NO: 56227 - DNA, 20 bp, Artificial Sequence
  Description of Artificial Sequence: Synthetic oligonucleotide
  Target: ATXN1; (-) strand; PAM type: NRG; PAM sequence: AAG
gtgctaaagttcccaaaaag

SEQ ID NO: 56228 - DNA, 20 bp, Artificial Sequence
  Description of Artificial Sequence: Synthetic oligonucleotide
  Target: ATXN1; (-) strand; PAM type: NRG; PAM sequence: AAG
attgtgctaaagttcccaaa

SEQ ID NO: 56229 - DNA, 20 bp, Artificial Sequence
  Description of Artificial Sequence: Synthetic oligonucleotide
  Target: ATXN1; (-) strand; PAM type: NRG; PAM sequence: AAG
ggtatcagctaattgtgcta

SEQ ID NO: 56230 - DNA, 20 bp, Artificial Sequence
  Description of Artificial Sequence: Synthetic oligonucleotide
  Target: ATXN1; (-) strand; PAM type: NRG; PAM sequence: CAG
ccaggtgaaatttgaggtat

SEQ ID NO: 56231 - DNA, 20 bp, Artificial Sequence
  Description of Artificial Sequence: Synthetic oligonucleotide
  Target: ATXN1; (-) strand; PAM type: NRG; PAM sequence: AGG
tgcggtccaggtgaaatttg

SEQ ID NO: 56232 - DNA, 20 bp, Artificial Sequence
  Description of Artificial Sequence: Synthetic oligonucleotide
  Target: ATXN1; (-) strand; PAM type: NRG; PAM sequence: GAG
ttgcggtccaggtgaaattt

SEQ ID NO: 56233 - DNA, 20 bp, Artificial Sequence
  Description of Artificial Sequence: Synthetic oligonucleotide
  Target: ATXN1; (-) strand; PAM type: NRG; PAM sequence: AGG
agctgtttctgttgcggtcc

SEQ ID NO: 56234 - DNA, 20 bp, Artificial Sequence
  Description of Artificial Sequence: Synthetic oligonucleotide
  Target: ATXN1; (-) strand; PAM type: NRG; PAM sequence: CAG
cagctgtttctgttgcggtc

SEQ ID NO: 56235 - DNA, 20 bp, Artificial Sequence
  Description of Artificial Sequence: Synthetic oligonucleotide
  Target: ATXN1; (-) strand; PAM type: NRG; PAM sequence: CGG
ttgaacagctgtttctgttg

SEQ ID NO: 56236 - DNA, 20 bp, Artificial Sequence
  Description of Artificial Sequence: Synthetic oligonucleotide
  Target: ATXN1; (-) strand; PAM type: NRG; PAM sequence: CAG
aaatttaatttaatgttgaa

SEQ ID NO: 56237 - DNA, 20 bp, Artificial Sequence
  Description of Artificial Sequence: Synthetic oligonucleotide
  Target: ATXN1; (-) strand; PAM type: NRG; PAM sequence: AAG
agttcttcttatcctcctta

SEQ ID NO: 56238 - DNA, 20 bp, Artificial Sequence
  Description of Artificial Sequence: Synthetic oligonucleotide
  Target: ATXN1; (-) strand; PAM type: NRG; PAM sequence: CAG
taaaatctccttggagcact

SEQ ID NO: 56239 - DNA, 20 bp, Artificial Sequence
  Description of Artificial Sequence: Synthetic oligonucleotide
  Target: ATXN1; (-) strand; PAM type: NRG; PAM sequence: GAG
ccacctctaaaatctccttg

SEQ ID NO: 56240 - DNA, 20 bp, Artificial Sequence
  Description of Artificial Sequence: Synthetic oligonucleotide
  Target: ATXN1; (-) strand; PAM type: NRG; PAM sequence: TGG
gcccacctctaaaatctcct

SEQ ID NO: 56241 - DNA, 20 bp, Artificial Sequence
  Description of Artificial Sequence: Synthetic oligonucleotide
  Target: ATXN1; (-) strand; PAM type: NRG; PAM sequence: AGG
ctctctttgcttgtaggggc

SEQ ID NO: 56242 - DNA, 20 bp, Artificial Sequence
  Description of Artificial Sequence: Synthetic oligonucleotide
  Target: ATXN1; (-) strand; PAM type: NRG; PAM sequence: CAG
tctctctttgcttgtagggg

SEQ ID NO: 56243 - DNA, 20 bp, Artificial Sequence
  Description of Artificial Sequence: Synthetic oligonucleotide
  Target: ATXN1; (-) strand; PAM type: NRG; PAM sequence: GGG
acatctctctttgcttgtag

SEQ ID NO: 56244 - DNA, 20 bp, Artificial Sequence
  Description of Artificial Sequence: Synthetic oligonucleotide
  Target: ATXN1; (-) strand; PAM type: NRG; PAM sequence: GGG
gacatctctctttgcttgta

SEQ ID NO: 56245 - DNA, 20 bp, Artificial Sequence
  Description of Artificial Sequence: Synthetic oligonucleotide
  Target: ATXN1; (-) strand; PAM type: NRG; PAM sequence: AGG
ggacatctctctttgcttgt

SEQ ID NO: 56246 - DNA, 20 bp, Artificial Sequence
  Description of Artificial Sequence: Synthetic oligonucleotide
  Target: ATXN1; (-) strand; PAM type: NRG; PAM sequence: TAG
gggacatctctctttgcttg

SEQ ID NO: 56247 - DNA, 20 bp, Artificial Sequence
  Description of Artificial Sequence: Synthetic oligonucleotide
  Target: ATXN1; (-) strand; PAM type: NRG; PAM sequence: GGG
aaaggggtgcttaaccagga

SEQ ID NO: 56248 - DNA, 20 bp, Artificial Sequence
  Description of Artificial Sequence: Synthetic oligonucleotide
  Target: ATXN1; (-) strand; PAM type: NRG; PAM sequence: AGG
caaaggggtgcttaaccagg

SEQ ID NO: 56249 - DNA, 20 bp, Artificial Sequence
  Description of Artificial Sequence: Synthetic oligonucleotide
  Target: ATXN1; (-) strand; PAM type: NRG; PAM sequence: GAG
acaaaggggtgcttaaccag

SEQ ID NO: 56250 - DNA, 20 bp, Artificial Sequence
  Description of Artificial Sequence: Synthetic oligonucleotide
  Target: ATXN1; (-) strand; PAM type: NRG; PAM sequence: AGG
tgacaaaggggtgcttaacc

SEQ ID NO: 56251 - DNA, 20 bp, Artificial Sequence
  Description of Artificial Sequence: Synthetic oligonucleotide
  Target: ATXN1; (-) strand; PAM type: NRG; PAM sequence: CAG
gtgacaaaggggtgcttaac

SEQ ID NO: 56252 - DNA, 20 bp, Artificial Sequence
  Description of Artificial Sequence: Synthetic oligonucleotide
  Target: ATXN1; (-) strand; PAM type: NRG; PAM sequence: GGG
ctgggctgcacgtgacaaag

SEQ ID NO: 56253 - DNA, 20 bp, Artificial Sequence
  Description of Artificial Sequence: Synthetic oligonucleotide
  Target: ATXN1; (-) strand; PAM type: NRG; PAM sequence: GGG
tctgggctgcacgtgacaaa

SEQ ID NO: 56254 - DNA, 20 bp, Artificial Sequence
  Description of Artificial Sequence: Synthetic oligonucleotide
  Target: ATXN1; (-) strand; PAM type: NRG; PAM sequence: AGG
ctctgggctgcacgtgacaa

SEQ ID NO: 56255 - DNA, 20 bp, Artificial Sequence
  Description of Artificial Sequence: Synthetic oligonucleotide
  Target: ATXN1; (-) strand; PAM type: NRG; PAM sequence: AAG
cctctgggctgcacgtgaca

SEQ ID NO: 56256 - DNA, 20 bp, Artificial Sequence
  Description of Artificial Sequence: Synthetic oligonucleotide
  Target: ATXN1; (-) strand; PAM type: NRG; PAM sequence: GGG
gctttatcacaacttcctct

SEQ ID NO: 56257 - DNA, 20 bp, Artificial Sequence
  Description of Artificial Sequence: Synthetic oligonucleotide
  Target: ATXN1; (-) strand; PAM type: NRG; PAM sequence: TGG
tgctttatcacaacttcctc

SEQ ID NO: 56258 - DNA, 20 bp, Artificial Sequence
  Description of Artificial Sequence: Synthetic oligonucleotide
  Target: ATXN1; (-) strand; PAM type: NRG; PAM sequence: CGG
caatgtgcttgtagccccaa

SEQ ID NO: 56259 - DNA, 20 bp, Artificial Sequence
  Description of Artificial Sequence: Synthetic oligonucleotide
  Target: ATXN1; (-) strand; PAM type: NRG; PAM sequence: TAG
ccatcaagacaatgtgcttg

SEQ ID NO: 56260 - DNA, 20 bp, Artificial Sequence
  Description of Artificial Sequence: Synthetic oligonucleotide
  Target: ATXN1; (-) strand; PAM type: NRG; PAM sequence: AAG
ctgtacagctgaattccatc

SEQ ID NO: 56261 - DNA, 20 bp, Artificial Sequence
  Description of Artificial Sequence: Synthetic oligonucleotide
  Target: ATXN1; (-) strand; PAM type: NRG; PAM sequence: CAG
tttgacagtaaggagctgta

SEQ ID NO: 56262 - DNA, 20 bp, Artificial Sequence
  Description of Artificial Sequence: Synthetic oligonucleotide
  Target: ATXN1; (-) strand; PAM type: NRG; PAM sequence: GAG
ggatcgtatttgacagtaag

SEQ ID NO: 56263 - DNA, 20 bp, Artificial Sequence
  Description of Artificial Sequence: Synthetic oligonucleotide
  Target: ATXN1; (-) strand; PAM type: NRG; PAM sequence: AGG
atggatcgtatttgacagta

SEQ ID NO: 56264 - DNA, 20 bp, Artificial Sequence
  Description of Artificial Sequence: Synthetic oligonucleotide
  Target: ATXN1; (-) strand; PAM type: NRG; PAM sequence: AAG
aatggatcgtatttgacagt

SEQ ID NO: 56265 - DNA, 20 bp, Artificial Sequence
  Description of Artificial Sequence: Synthetic oligonucleotide
  Target: ATXN1; (-) strand; PAM type: NRG; PAM sequence: CAG
acagaatggatcgtatttga

SEQ ID NO: 56266 - DNA, 20 bp, Artificial Sequence
  Description of Artificial Sequence: Synthetic oligonucleotide
  Target: ATXN1; (-) strand; PAM type: NRG; PAM sequence: TGG
taaaggaatttaaaacagaa

SEQ ID NO: 56267 - DNA, 20 bp, Artificial Sequence
  Description of Artificial Sequence: Synthetic oligonucleotide
  Target: ATXN1; (-) strand; PAM type: NRG; PAM sequence: CAG
acagttaaaggaatttaaaa

SEQ ID NO: 56268 - DNA, 20 bp, Artificial Sequence
  Description of Artificial Sequence: Synthetic oligonucleotide
  Target: ATXN1; (-) strand; PAM type: NRG; PAM sequence: AGG
atgctgcctgtcacagttaa

SEQ ID NO: 56269 - DNA, 20 bp, Artificial Sequence
  Description of Artificial Sequence: Synthetic oligonucleotide
  Target: ATXN1; (-) strand; PAM type: NRG; PAM sequence: AAG
catgctgcctgtcacagtta

SEQ ID NO: 56270 - DNA, 20 bp, Artificial Sequence
  Description of Artificial Sequence: Synthetic oligonucleotide
  Target: ATXN1; (-) strand; PAM type: NRG; PAM sequence: CAG
tttcatcatgctgcctgtca

SEQ ID NO: 56271 - DNA, 20 bp, Artificial Sequence
  Description of Artificial Sequence: Synthetic oligonucleotide
  Target: ATXN1; (-) strand; PAM type: NRG; PAM sequence: GAG
actatttctggccttccttt

SEQ ID NO: 56272 - DNA, 20 bp, Artificial Sequence
  Description of Artificial Sequence: Synthetic oligonucleotide
  Target: ATXN1; (-) strand; PAM type: NRG; PAM sequence: TGG
cactctggcttcactatttc

SEQ ID NO: 56273 - DNA, 20 bp, Artificial Sequence
  Description of Artificial Sequence: Synthetic oligonucleotide
  Target: ATXN1; (-) strand; PAM type: NRG; PAM sequence: TGG
aggtctgcagactgtcactc

SEQ ID NO: 56274 - DNA, 20 bp, Artificial Sequence
  Description of Artificial Sequence: Synthetic oligonucleotide
  Target: ATXN1; (-) strand; PAM type: NRG; PAM sequence: CAG
gctgctgagacccaggtctg

SEQ ID NO: 56275 - DNA, 20 bp, Artificial Sequence
  Description of Artificial Sequence: Synthetic oligonucleotide
  Target: ATXN1; (-) strand; PAM type: NRG; PAM sequence: AGG
gggcggagctgctgagaccc

SEQ ID NO: 56276 - DNA, 20 bp, Artificial Sequence
  Description of Artificial Sequence: Synthetic oligonucleotide
  Target: ATXN1; (-) strand; PAM type: NRG; PAM sequence: CAG
tgggcggagctgctgagacc

SEQ ID NO: 56277 - DNA, 20 bp, Artificial Sequence
  Description of Artificial Sequence: Synthetic oligonucleotide
  Target: ATXN1; (-) strand; PAM type: NRG; PAM sequence: GAG
aactcctgggcggagctgct

SEQ ID NO: 56278 - DNA, 20 bp, Artificial Sequence
  Description of Artificial Sequence: Synthetic oligonucleotide
  Target: ATXN1; (-) strand; PAM type: NRG; PAM sequence: GAG
ccggcaggaactcctgggcg

SEQ ID NO: 56279 - DNA, 20 bp, Artificial Sequence
  Description of Artificial Sequence: Synthetic oligonucleotide
  Target: ATXN1; (-) strand; PAM type: NRG; PAM sequence: CGG
ctccggcaggaactcctggg

SEQ ID NO: 56280 - DNA, 20 bp, Artificial Sequence
  Description of Artificial Sequence: Synthetic oligonucleotide
  Target: ATXN1; (-) strand; PAM type: NRG; PAM sequence: GGG
gagctccggcaggaactcct

SEQ ID NO: 56281 - DNA, 20 bp, Artificial Sequence
  Description of Artificial Sequence: Synthetic oligonucleotide
  Target: ATXN1; (-) strand; PAM type: NRG; PAM sequence: TGG
tgagctccggcaggaactcc

SEQ ID NO: 56282 - DNA, 20 bp, Artificial Sequence
  Description of Artificial Sequence: Synthetic oligonucleotide
  Target: ATXN1; (-) strand; PAM type: NRG; PAM sequence: AGG
tggctcgcctgagctccggc

SEQ ID NO: 56283 - DNA, 20 bp, Artificial Sequence
  Description of Artificial Sequence: Synthetic oligonucleotide
  Target: ATXN1; (-) strand; PAM type: NRG; PAM sequence: CAG
gtggctcgcctgagctccgg

SEQ ID NO: 56284 - DNA, 20 bp, Artificial Sequence
  Description of Artificial Sequence: Synthetic oligonucleotide
  Target: ATXN1; (-) strand; PAM type: NRG; PAM sequence: CGG
tccgtggctcgcctgagctc

SEQ ID NO: 56285 - DNA, 20 bp, Artificial Sequence
  Description of Artificial Sequence: Synthetic oligonucleotide
  Target: ATXN1; (-) strand; PAM type: NRG; PAM sequence: GAG
agccgatccgtggctcgcct

SEQ ID NO: 56286 - DNA, 20 bp, Artificial Sequence
  Description of Artificial Sequence: Synthetic oligonucleotide
  Target: ATXN1; (-) strand; PAM type: NRG; PAM sequence: TGG
agcggcacagagccgatccg

SEQ ID NO: 56287 - DNA, 20 bp, Artificial Sequence
  Description of Artificial Sequence: Synthetic oligonucleotide
  Target: ATXN1; (-) strand; PAM type: NRG; PAM sequence: GAG
ggtgaggaggtagcggcaca

SEQ ID NO: 56288 - DNA, 20 bp, Artificial Sequence
  Description of Artificial Sequence: Synthetic oligonucleotide
  Target: ATXN1; (-) strand; PAM type: NRG; PAM sequence: CAG
caggtgaggaggtagcggca

SEQ ID NO: 56289 - DNA, 20 bp, Artificial Sequence
  Description of Artificial Sequence: Synthetic oligonucleotide
  Target: ATXN1; (-) strand; PAM type: NRG; PAM sequence: CGG
tttggcaggtgaggaggtag

SEQ ID NO: 56290 - DNA, 20 bp, Artificial Sequence
  Description of Artificial Sequence: Synthetic oligonucleotide
  Target: ATXN1; (-) strand; PAM type: NRG; PAM sequence: TAG
tcgtttggcaggtgaggagg

SEQ ID NO: 56291 - DNA, 20 bp, Artificial Sequence
  Description of Artificial Sequence: Synthetic oligonucleotide
  Target: ATXN1; (-) strand; PAM type: NRG; PAM sequence: AGG
ccctcgtttggcaggtgagg

SEQ ID NO: 56292 - DNA, 20 bp, Artificial Sequence
  Description of Artificial Sequence: Synthetic oligonucleotide
  Target: ATXN1; (-) strand; PAM type: NRG; PAM sequence: GAG
accctcgtttggcaggtgag

SEQ ID NO: 56293 - DNA, 20 bp, Artificial Sequence
  Description of Artificial Sequence: Synthetic oligonucleotide
  Target: ATXN1; (-) strand; PAM type: NRG; PAM sequence: AGG
tgaccctcgtttggcaggtg

SEQ ID NO: 56294 - DNA, 20 bp, Artificial Sequence
  Description of Artificial Sequence: Synthetic oligonucleotide
  Target: ATXN1; (-) strand; PAM type: NRG; PAM sequence: GAG
gtgaccctcgtttggcaggt

SEQ ID NO: 56295 - DNA, 20 bp, Artificial Sequence
  Description of Artificial Sequence: Synthetic oligonucleotide
  Target: ATXN1; (-) strand; PAM type: NRG; PAM sequence: AGG
cgtcgtgaccctcgtttggc

SEQ ID NO: 56296 - DNA, 20 bp, Artificial Sequence
  Description of Artificial Sequence: Synthetic oligonucleotide
  Target: ATXN1; (-) strand; PAM type: NRG; PAM sequence: CAG
gcgtcgtgaccctcgtttgg

SEQ ID NO: 56297 - DNA, 20 bp, Artificial Sequence
  Description of Artificial Sequence: Synthetic oligonucleotide
  Target: ATXN1; (-) strand; PAM type: NRG; PAM sequence: TGG
gacgcgtcgtgaccctcgtt

SEQ ID NO: 56298 - DNA, 20 bp, Artificial Sequence
  Description of Artificial Sequence: Synthetic oligonucleotide
  Target: ATXN1; (-) strand; PAM type: NRG; PAM sequence: AGG
caaaaattctctgaggttag

SEQ ID NO: 56299 - DNA, 20 bp, Artificial Sequence
  Description of Artificial Sequence: Synthetic oligonucleotide
  Target: ATXN1; (-) strand; PAM type: NRG; PAM sequence: GAG
acaaaaattctctgaggtta

SEQ ID NO: 56300 - DNA, 20 bp, Artificial Sequence
  Description of Artificial Sequence: Synthetic oligonucleotide
  Target: ATXN1; (-) strand; PAM type: NRG; PAM sequence: TAG
tcacaaaaattctctgaggt

SEQ ID NO: 56301 - DNA, 20 bp, Artificial Sequence
  Description of Artificial Sequence: Synthetic oligonucleotide
  Target: ATXN1; (-) strand; PAM type: NRG; PAM sequence: AGG
aatttcacaaaaattctctg

SEQ ID NO: 56302 - DNA, 20 bp, Artificial Sequence
  Description of Artificial Sequence: Synthetic oligonucleotide
  Target: ATXN1; (-) strand; PAM type: NRG; PAM sequence: GAG
caatttcacaaaaattctct

SEQ ID NO: 56303 - DNA, 20 bp, Artificial Sequence
  Description of Artificial Sequence: Synthetic oligonucleotide
  Target: ATXN1; (-) strand; PAM type: NRG; PAM sequence: AAG
gtttgctgagtgcttgttgt

SEQ ID NO: 56304 - DNA, 20 bp, Artificial Sequence
  Description of Artificial Sequence: Synthetic oligonucleotide
  Target: ATXN1; (-) strand; PAM type: NRG; PAM sequence: GAG
gtttggcatccatgtttgct

SEQ ID NO: 56305 - DNA, 20 bp, Artificial Sequence
  Description of Artificial Sequence: Synthetic oligonucleotide
  Target: ATXN1; (-) strand; PAM type: NRG; PAM sequence: TGG
tgaattatgagataatagtt

SEQ ID NO: 56306 - DNA, 20 bp, Artificial Sequence
  Description of Artificial Sequence: Synthetic oligonucleotide
  Target: ATXN1; (-) strand; PAM type: NRG; PAM sequence: TAG
cacattgaattatgagataa

SEQ ID NO: 56307 - DNA, 20 bp, Artificial Sequence
  Description of Artificial Sequence: Synthetic oligonucleotide
  Target: ATXN1; (-) strand; PAM type: NRG; PAM sequence: GAG
atttgggcacattgaattat

SEQ ID NO: 56308 - DNA, 20 bp, Artificial Sequence
  Description of Artificial Sequence: Synthetic oligonucleotide
  Target: ATXN1; (-) strand; PAM type: NRG; PAM sequence: GGG
tacttgtttcagtctgattt

SEQ ID NO: 56309 - DNA, 20 bp, Artificial Sequence
  Description of Artificial Sequence: Synthetic oligonucleotide
  Target: ATXN1; (-) strand; PAM type: NRG; PAM sequence: TGG
ttacttgtttcagtctgatt

SEQ ID NO: 56310 - DNA, 20 bp, Artificial Sequence
  Description of Artificial Sequence: Synthetic oligonucleotide
  Target: ATXN1; (-) strand; PAM type: NRG; PAM sequence: CAG
atttggggttttacttgttt

SEQ ID NO: 56311 - DNA, 20 bp, Artificial Sequence
  Description of Artificial Sequence: Synthetic oligonucleotide
  Target: ATXN1; (-) strand; PAM type: NRG; PAM sequence: GGG
tatggtgtcaaattaatttg

SEQ ID NO: 56312 - DNA, 20 bp, Artificial Sequence
  Description of Artificial Sequence: Synthetic oligonucleotide
  Target: ATXN1; (-) strand; PAM type: NRG; PAM sequence: GGG
atatggtgtcaaattaattt

SEQ ID NO: 56313 - DNA, 20 bp, Artificial Sequence
  Description of Artificial Sequence: Synthetic oligonucleotide
  Target: ATXN1; (-) strand; PAM type: NRG; PAM sequence: TGG
catatggtgtcaaattaatt

SEQ ID NO: 56314 - DNA, 20 bp, Artificial Sequence
  Description of Artificial Sequence: Synthetic oligonucleotide
  Target: ATXN1; (-) strand; PAM type: NRG; PAM sequence: TGG
aaaatgtaacccatagcata

SEQ ID NO: 56315 - DNA, 20 bp, Artificial Sequence
  Description of Artificial Sequence: Synthetic oligonucleotide
  Target: ATXN1; (-) strand; PAM type: NRG; PAM sequence: TAG
cttttggaaaatgtaaccca

SEQ ID NO: 56316 - DNA, 20 bp, Artificial Sequence
  Description of Artificial Sequence: Synthetic oligonucleotide
  Target: ATXN1; (-) strand; PAM type: NRG; PAM sequence: TGG
tgccaatttccgaaggcttt

SEQ ID NO: 56317 - DNA, 20 bp, Artificial Sequence
  Description of Artificial Sequence: Synthetic oligonucleotide
  Target: ATXN1; (-) strand; PAM type: NRG; PAM sequence: AGG
ttataaatgccaatttccga

SEQ ID NO: 56318 - DNA, 20 bp, Artificial Sequence
  Description of Artificial Sequence: Synthetic oligonucleotide
  Target: ATXN1; (-) strand; PAM type: NRG; PAM sequence: AAG
attataaatgccaatttccg

SEQ ID NO: 56319 - DNA, 20 bp, Artificial Sequence
  Description of Artificial Sequence: Synthetic oligonucleotide
  Target: ATXN1; (-) strand; PAM type: NRG; PAM sequence: AGG
catgtttctgtacatggaga

SEQ ID NO: 56320 - DNA, 20 bp, Artificial Sequence
  Description of Artificial Sequence: Synthetic oligonucleotide
  Target: ATXN1; (-) strand; PAM type: NRG; PAM sequence: AAG
acatgtttctgtacatggag

SEQ ID NO: 56321 - DNA, 20 bp, Artificial Sequence
  Description of Artificial Sequence: Synthetic oligonucleotide
  Target: ATXN1; (-) strand; PAM type: NRG; PAM sequence: GAG
tgcacatgtttctgtacatg

SEQ ID NO: 56322 - DNA, 20 bp, Artificial Sequence
  Description of Artificial Sequence: Synthetic oligonucleotide
  Target: ATXN1; (-) strand; PAM type: NRG; PAM sequence: TGG
tgtgcacatgtttctgtaca

SEQ ID NO: 56323 - DNA, 20 bp, Artificial Sequence
  Description of Artificial Sequence: Synthetic oligonucleotide
  Target: ATXN1; (-) strand; PAM type: NRG; PAM sequence: GGG
tagataattaagacttaact

SEQ ID NO: 56324 - DNA, 20 bp, Artificial Sequence
  Description of Artificial Sequence: Synthetic oligonucleotide
  Target: ATXN1; (-) strand; PAM type: NRG; PAM sequence: TGG
ctagataattaagacttaac

SEQ ID NO: 56325 - DNA, 20 bp, Artificial Sequence
  Description of Artificial Sequence: Synthetic oligonucleotide
  Target: ATXN1; (-) strand; PAM type: NRG; PAM sequence: AAG
taatcttccactagataatt

SEQ ID NO: 56326 - DNA, 20 bp, Artificial Sequence
  Description of Artificial Sequence: Synthetic oligonucleotide
  Target: ATXN1; (-) strand; PAM type: NRG; PAM sequence: TAG
aatcttggataatcttccac

SEQ ID NO: 56327 - DNA, 20 bp, Artificial Sequence
  Description of Artificial Sequence: Synthetic oligonucleotide
  Target: ATXN1; (-) strand; PAM type: NRG; PAM sequence: TGG
gggagaaacagtaagaatct

SEQ ID NO: 56328 - DNA, 20 bp, Artificial Sequence
  Description of Artificial Sequence: Synthetic oligonucleotide
  Target: ATXN1; (-) strand; PAM type: NRG; PAM sequence: AAG
caggaaaagggagaaacagt

SEQ ID NO: 56329 - DNA, 20 bp, Artificial Sequence
  Description of Artificial Sequence: Synthetic oligonucleotide
  Target: ATXN1; (-) strand; PAM type: NRG; PAM sequence: CAG
gcaacaggaaaagggagaaa

SEQ ID NO: 56330 - DNA, 20 bp, Artificial Sequence
  Description of Artificial Sequence: Synthetic oligonucleotide
  Target: ATXN1; (-) strand; PAM type: NRG; PAM sequence: GAG
aaatgggcaacaggaaaagg

SEQ ID NO: 56331 - DNA, 20 bp, Artificial Sequence
  Description of Artificial Sequence: Synthetic oligonucleotide
  Target: ATXN1; (-) strand; PAM type: NRG; PAM sequence: GGG
aaaaatgggcaacaggaaaa

SEQ ID NO: 56332 - DNA, 20 bp, Artificial Sequence
  Description of Artificial Sequence: Synthetic oligonucleotide
  Target: ATXN1; (-) strand; PAM type: NRG; PAM sequence: AGG
taaaaatgggcaacaggaaa

SEQ ID NO: 56333 - DNA, 20 bp, Artificial Sequence
  Description of Artificial Sequence: Synthetic oligonucleotide
  Target: ATXN1; (-) strand; PAM type: NRG; PAM sequence: AAG
ctaaaaatgggcaacaggaa

SEQ ID NO: 56334 - DNA, 20 bp, Artificial Sequence
  Description of Artificial Sequence: Synthetic oligonucleotide
  Target: ATXN1; (-) strand; PAM type: NRG; PAM sequence: AGG
aaaggctaaaaatgggcaac

SEQ ID NO: 56335 - DNA, 20 bp, Artificial Sequence
  Description of Artificial Sequence: Synthetic oligonucleotide
  Target: ATXN1; (-) strand; PAM type: NRG; PAM sequence: CAG
aaaaggctaaaaatgggcaa

SEQ ID NO: 56336 - DNA, 20 bp, Artificial Sequence
  Description of Artificial Sequence: Synthetic oligonucleotide
  Target: ATXN1; (-) strand; PAM type: NRG; PAM sequence: GGG
tgccaaaaaaggctaaaaat

SEQ ID NO: 56337 - DNA, 20 bp, Artificial Sequence
  Description of Artificial Sequence: Synthetic oligonucleotide
  Target: ATXN1; (-) strand; PAM type: NRG; PAM sequence: TGG
ttgccaaaaaaggctaaaaa

SEQ ID NO: 56338 - DNA, 20 bp, Artificial Sequence
  Description of Artificial Sequence: Synthetic oligonucleotide
  Target: ATXN1; (-) strand; PAM type: NRG; PAM sequence: AGG
agtggaggaattgccaaaaa

SEQ ID NO: 56339 - DNA, 20 bp, Artificial Sequence
  Description of Artificial Sequence: Synthetic oligonucleotide
  Target: ATXN1; (-) strand; PAM type: NRG; PAM sequence: AAG
tagtggaggaattgccaaaa

SEQ ID NO: 56340 - DNA, 20 bp, Artificial Sequence
  Description of Artificial Sequence: Synthetic oligonucleotide
  Target: ATXN1; (-) strand; PAM type: NRG; PAM sequence: AGG
tctcttttctttaatagtgg

SEQ ID NO: 56341 - DNA, 20 bp, Artificial Sequence
  Description of Artificial Sequence: Synthetic oligonucleotide
  Target: ATXN1; (-) strand; PAM type: NRG; PAM sequence: GAG
atctcttttctttaatagtg

SEQ ID NO: 56342 - DNA, 20 bp, Artificial Sequence
  Description of Artificial Sequence: Synthetic oligonucleotide
  Target: ATXN1; (-) strand; PAM type: NRG; PAM sequence: TGG
ccatctcttttctttaatag

SEQ ID NO: 56343 - DNA, 20 bp, Artificial Sequence
  Description of Artificial Sequence: Synthetic oligonucleotide
  Target: ATXN1; (-) strand; PAM type: NRG; PAM sequence: TAG
atgccatctcttttctttaa

SEQ ID NO: 56344 - DNA, 20 bp, Artificial Sequence
  Description of Artificial Sequence: Synthetic oligonucleotide
  Target: ATXN1; (-) strand; PAM type: NRG; PAM sequence: GGG
attacagtgaagaaggaaag

SEQ ID NO: 56345 - DNA, 20 bp, Artificial Sequence
  Description of Artificial Sequence: Synthetic oligonucleotide
  Target: ATXN1; (-) strand; PAM type: NRG; PAM sequence: GGG
aattacagtgaagaaggaaa

SEQ ID NO: 56346 - DNA, 20 bp, Artificial Sequence
  Description of Artificial Sequence: Synthetic oligonucleotide
  Target: ATXN1; (-) strand; PAM type: NRG; PAM sequence: AGG
aaattacagtgaagaaggaa

SEQ ID NO: 56347 - DNA, 20 bp, Artificial Sequence
  Description of Artificial Sequence: Synthetic oligonucleotide
  Target: ATXN1; (-) strand; PAM type: NRG; PAM sequence: AAG
gaaattacagtgaagaagga

SEQ ID NO: 56348 - DNA, 20 bp, Artificial Sequence
  Description of Artificial Sequence: Synthetic oligonucleotide
  Target: ATXN1; (-) strand; PAM type: NRG; PAM sequence: AGG
aattgaaattacagtgaaga

SEQ ID NO: 56349 - DNA, 20 bp, Artificial Sequence
  Description of Artificial Sequence: Synthetic oligonucleotide
  Target: ATXN1; (-) strand; PAM type: NRG; PAM sequence: AAG
taattgaaattacagtgaag

SEQ ID NO: 56350 - DNA, 20 bp, Artificial Sequence
  Description of Artificial Sequence: Synthetic oligonucleotide
  Target: ATXN1; (-) strand; PAM type: NRG; PAM sequence: AAG
agataattgaaattacagtg

SEQ ID NO: 56351 - DNA, 20 bp, Artificial Sequence
  Description of Artificial Sequence: Synthetic oligonucleotide
  Target: ATXN1; (-) strand; PAM type: NRG; PAM sequence: CAG
agcacagataattgaaatta

SEQ ID NO: 56352 - DNA, 20 bp, Artificial Sequence
  Description of Artificial Sequence: Synthetic oligonucleotide
  Target: ATXN1; (-) strand; PAM type: NRG; PAM sequence: CAG
caacggaggctgaggtagca

SEQ ID NO: 56353 - DNA, 20 bp, Artificial Sequence
  Description of Artificial Sequence: Synthetic oligonucleotide
  Target: ATXN1; (-) strand; PAM type: NRG; PAM sequence: TAG
catgccaacggaggctgagg

SEQ ID NO: 56354 - DNA, 20 bp, Artificial Sequence
  Description of Artificial Sequence: Synthetic oligonucleotide
  Target: ATXN1; (-) strand; PAM type: NRG; PAM sequence: AGG
atccatgccaacggaggctg

SEQ ID NO: 56355 - DNA, 20 bp, Artificial Sequence
  Description of Artificial Sequence: Synthetic oligonucleotide
  Target: ATXN1; (-) strand; PAM type: NRG; PAM sequence: GAG
catccatgccaacggaggct

SEQ ID NO: 56356 - DNA, 20 bp, Artificial Sequence
  Description of Artificial Sequence: Synthetic oligonucleotide
  Target: ATXN1; (-) strand; PAM type: NRG; PAM sequence: AGG
tcgcccatccatgccaacgg

SEQ ID NO: 56357 - DNA, 20 bp, Artificial Sequence
  Description of Artificial Sequence: Synthetic oligonucleotide
  Target: ATXN1; (-) strand; PAM type: NRG; PAM sequence: GAG
ctcgcccatccatgccaacg

SEQ ID NO: 56358 - DNA, 20 bp, Artificial Sequence
  Description of Artificial Sequence: Synthetic oligonucleotide
  Target: ATXN1; (-) strand; PAM type: NRG; PAM sequence: CGG
tcctcgcccatccatgccaa

SEQ ID NO: 56359 - DNA, 20 bp, Artificial Sequence
  Description of Artificial Sequence: Synthetic oligonucleotide
  Target: ATXN1; (-) strand; PAM type: NRG; PAM sequence: TAG
tccaattctgaggacaaaga

SEQ ID NO: 56360 - DNA, 20 bp, Artificial Sequence
  Description of Artificial Sequence: Synthetic oligonucleotide
  Target: ATXN1; (-) strand; PAM type: NRG; PAM sequence: AAG
tccatccaattctgaggaca

SEQ ID NO: 56361 - DNA, 20 bp, Artificial Sequence
  Description of Artificial Sequence: Synthetic oligonucleotide
  Target: ATXN1; (-) strand; PAM type: NRG; PAM sequence: AGG
atgttttccatccaattctg

SEQ ID NO: 56362 - DNA, 20 bp, Artificial Sequence
  Description of Artificial Sequence: Synthetic oligonucleotide
  Target: ATXN1; (-) strand; PAM type: NRG; PAM sequence: GAG
aatgttttccatccaattct

SEQ ID NO: 56363 - DNA, 20 bp, Artificial Sequence
  Description of Artificial Sequence: Synthetic oligonucleotide
  Target: ATXN1; (-) strand; PAM type: NRG; PAM sequence: CAG
cacatcatttcccaataaca

SEQ ID NO: 56364 - DNA, 20 bp, Artificial Sequence
  Description of Artificial Sequence: Synthetic oligonucleotide
  Target: ATXN1; (-) strand; PAM type: NRG; PAM sequence: AAG
ttagaagggaaagagaaatt

SEQ ID NO: 56365 - DNA, 20 bp, Artificial Sequence
  Description of Artificial Sequence: Synthetic oligonucleotide
  Target: ATXN1; (-) strand; PAM type: NRG; PAM sequence: GAG
gcaaagttttagaagggaaa

SEQ ID NO: 56366 - DNA, 20 bp, Artificial Sequence
  Description of Artificial Sequence: Synthetic oligonucleotide
  Target: ATXN1; (-) strand; PAM type: NRG; PAM sequence: AAG
aagcaaagttttagaaggga

SEQ ID NO: 56367 - DNA, 20 bp, Artificial Sequence
  Description of Artificial Sequence: Synthetic oligonucleotide
  Target: ATXN1; (-) strand; PAM type: NRG; PAM sequence: GGG
cagtaagcaaagttttagaa

SEQ ID NO: 56368 - DNA, 20 bp, Artificial Sequence
  Description of Artificial Sequence: Synthetic oligonucleotide
  Target: ATXN1; (-) strand; PAM type: NRG; PAM sequence: AGG
tcagtaagcaaagttttaga

SEQ ID NO: 56369 - DNA, 20 bp, Artificial Sequence
  Description of Artificial Sequence: Synthetic oligonucleotide
  Target: ATXN1; (-) strand; PAM type: NRG; PAM sequence: AAG
ttcagtaagcaaagttttag

SEQ ID NO: 56370 - DNA, 20 bp, Artificial Sequence
  Description of Artificial Sequence: Synthetic oligonucleotide
  Target: ATXN1; (-) strand; PAM type: NRG; PAM sequence: TAG
ccattcagtaagcaaagttt

SEQ ID NO: 56371 - DNA, 20 bp, Artificial Sequence
  Description of Artificial Sequence: Synthetic oligonucleotide
  Target: ATXN1; (-) strand; PAM type: NRG; PAM sequence: AAG
acatttccattcagtaagca

SEQ ID NO: 56372 - DNA, 20 bp, Artificial Sequence
  Description of Artificial Sequence: Synthetic oligonucleotide
  Target: ATXN1; (-) strand; PAM type: NRG; PAM sequence: AAG
caggaacatttccattcagt

SEQ ID NO: 56373 - DNA, 20 bp, Artificial Sequence
  Description of Artificial Sequence: Synthetic oligonucleotide
  Target: ATXN1; (-) strand; PAM type: NRG; PAM sequence: CAG
atctcaggaacatttccatt

SEQ ID NO: 56374 - DNA, 20 bp, Artificial Sequence
  Description of Artificial Sequence: Synthetic oligonucleotide
  Target: ATXN1; (-) strand; PAM type: NRG; PAM sequence: AGG
gaaccaaataaacagatctc

SEQ ID NO: 56375 - DNA, 20 bp, Artificial Sequence
  Description of Artificial Sequence: Synthetic oligonucleotide
  Target: ATXN1; (-) strand; PAM type: NRG; PAM sequence: CAG
agaaccaaataaacagatct

SEQ ID NO: 56376 - DNA, 20 bp, Artificial Sequence
  Description of Artificial Sequence: Synthetic oligonucleotide
  Target: ATXN1; (-) strand; PAM type: NRG; PAM sequence: CAG
taaatatagaaccaaataaa

SEQ ID NO: 56377 - DNA, 20 bp, Artificial Sequence
  Description of Artificial Sequence: Synthetic oligonucleotide
  Target: ATXN1; (-) strand; PAM type: NRG; PAM sequence: TAG
aaaagggaggtacataaata

SEQ ID NO: 56378 - DNA, 20 bp, Artificial Sequence
  Description of Artificial Sequence: Synthetic oligonucleotide
  Target: ATXN1; (-) strand; PAM type: NRG; PAM sequence: AGG
tattctctattttaaaaggg

SEQ ID NO: 56379 - DNA, 20 bp, Artificial Sequence
  Description of Artificial Sequence: Synthetic oligonucleotide
  Target: ATXN1; (-) strand; PAM type: NRG; PAM sequence: GAG
gtattctctattttaaaagg

SEQ ID NO: 56380 - DNA, 20 bp, Artificial Sequence
  Description of Artificial Sequence: Synthetic oligonucleotide
  Target: ATXN1; (-) strand; PAM type: NRG; PAM sequence: GGG
atgtattctctattttaaaa

SEQ ID NO: 56381 - DNA, 20 bp, Artificial Sequence
  Description of Artificial Sequence: Synthetic oligonucleotide
  Target: ATXN1; (-) strand; PAM type: NRG; PAM sequence: AGG
catgtattctctattttaaa

SEQ ID NO: 56382 - DNA, 20 bp, Artificial Sequence
  Description of Artificial Sequence: Synthetic oligonucleotide
  Target: ATXN1; (-) strand; PAM type: NRG; PAM sequence: AAG
acatgtattctctattttaa

SEQ ID NO: 56383 - DNA, 20 bp, Artificial Sequence
  Description of Artificial Sequence: Synthetic oligonucleotide
  Target: ATXN1; (-) strand; PAM type: NRG; PAM sequence: AAG
taatacacactgagtcatca

SEQ ID NO: 56384 - DNA, 20 bp, Artificial Sequence
  Description of Artificial Sequence: Synthetic oligonucleotide
  Target: ATXN1; (-) strand; PAM type: NRG; PAM sequence: GAG
tgttaccgataatacacact

SEQ ID NO: 56385 - DNA, 20 bp, Artificial Sequence
  Description of Artificial Sequence: Synthetic oligonucleotide
  Target: ATXN1; (-) strand; PAM type: NRG; PAM sequence: TGG
tggtatggcaacatcatgaa

SEQ ID NO: 56386 - DNA, 20 bp, Artificial Sequence
  Description of Artificial Sequence: Synthetic oligonucleotide
  Target: ATXN1; (-) strand; PAM type: NRG; PAM sequence: TGG
gaaaattatgctgtgtggta

SEQ ID NO: 56387 - DNA, 20 bp, Artificial Sequence
  Description of Artificial Sequence: Synthetic oligonucleotide
  Target: ATXN1; (-) strand; PAM type: NRG; PAM sequence: TGG
agatagaaaattatgctgtg

SEQ ID NO: 56388 - DNA, 20 bp, Artificial Sequence
  Description of Artificial Sequence: Synthetic oligonucleotide
  Target: ATXN1; (-) strand; PAM type: NRG; PAM sequence: TAG
aagaatcaatcagaagcaga

SEQ ID NO: 56389 - DNA, 20 bp, Artificial Sequence
  Description of Artificial Sequence: Synthetic oligonucleotide
  Target: ATXN1; (-) strand; PAM type: NRG; PAM sequence: CAG
aatgaagaatcaatcagaag

SEQ ID NO: 56390 - DNA, 20 bp, Artificial Sequence
  Description of Artificial Sequence: Synthetic oligonucleotide
  Target: ATXN1; (-) strand; PAM type: NRG; PAM sequence: AAG
gagaatgaagaatcaatcag

SEQ ID NO: 56391 - DNA, 20 bp, Artificial Sequence
  Description of Artificial Sequence: Synthetic oligonucleotide
  Target: ATXN1; (-) strand; PAM type: NRG; PAM sequence: CAG
agggagaatgaagaatcaat

SEQ ID NO: 56392 - DNA, 20 bp, Artificial Sequence
  Description of Artificial Sequence: Synthetic oligonucleotide
  Target: ATXN1; (-) strand; PAM type: NRG; PAM sequence: AAG
actgagatcaagggagaatg

SEQ ID NO: 56393 - DNA, 20 bp, Artificial Sequence
  Description of Artificial Sequence: Synthetic oligonucleotide
  Target: ATXN1; (-) strand; PAM type: NRG; PAM sequence: GAG
atgacaaactgagatcaagg

SEQ ID NO: 56394 - DNA, 20 bp, Artificial Sequence
  Description of Artificial Sequence: Synthetic oligonucleotide
  Target: ATXN1; (-) strand; PAM type: NRG; PAM sequence: GGG
aaatgacaaactgagatcaa

SEQ ID NO: 56395 - DNA, 20 bp, Artificial Sequence
  Description of Artificial Sequence: Synthetic oligonucleotide
  Target: ATXN1; (-) strand; PAM type: NRG; PAM sequence: AGG
taaatgacaaactgagatca

SEQ ID NO: 56396 - DNA, 20 bp, Artificial Sequence
  Description of Artificial Sequence: Synthetic oligonucleotide
  Target: ATXN1; (-) strand; PAM type: NRG; PAM sequence: AAG
ttaaatgacaaactgagatc

SEQ ID NO: 56397 - DNA, 20 bp, Artificial Sequence
  Description of Artificial Sequence: Synthetic oligonucleotide
  Target: ATXN1; (-) strand; PAM type: NRG; PAM sequence: GAG
gatgtattaaatgacaaact

SEQ ID NO: 56398 - DNA, 20 bp, Artificial Sequence
  Description of Artificial Sequence: Synthetic oligonucleotide
  Target: ATXN1; (-) strand; PAM type: NRG; PAM sequence: TAG
gatttgttgagtgaaaaact

SEQ ID NO: 56399 - DNA, 20 bp, Artificial Sequence
  Description of Artificial Sequence: Synthetic oligonucleotide
  Target: ATXN1; (-) strand; PAM type: NRG; PAM sequence: GAG
ccatcagtatttgatttgtt

SEQ ID NO: 56400 - DNA, 20 bp, Artificial Sequence
  Description of Artificial Sequence: Synthetic oligonucleotide
  Target: ATXN1; (-) strand; PAM type: NRG; PAM sequence: CAG
gtgtatagcagattctccat

SEQ ID NO: 56401 - DNA, 20 bp, Artificial Sequence
  Description of Artificial Sequence: Synthetic oligonucleotide
  Target: ATXN1; (-) strand; PAM type: NRG; PAM sequence: CAG
gcacagtgcctggtgtatag

SEQ ID NO: 56402 - DNA, 20 bp, Artificial Sequence
  Description of Artificial Sequence: Synthetic oligonucleotide
  Target: ATXN1; (-) strand; PAM type: NRG; PAM sequence: TAG
gcagcacagtgcctggtgta

SEQ ID NO: 56403 - DNA, 20 bp, Artificial Sequence
  Description of Artificial Sequence: Synthetic oligonucleotide
  Target: ATXN1; (-) strand; PAM type: NRG; PAM sequence: TGG
gctcctagcagcacagtgcc

SEQ ID NO: 56404 - DNA, 20 bp, Artificial Sequence
  Description of Artificial Sequence: Synthetic oligonucleotide
  Target: ATXN1; (-) strand; PAM type: NRG; PAM sequence: CAG
atcctcagctcctagcagca

SEQ ID NO: 56405 - DNA, 20 bp, Artificial Sequence
  Description of Artificial Sequence: Synthetic oligonucleotide
  Target: ATXN1; (-) strand; PAM type: NRG; PAM sequence: CAG
gttcaatcctcagctcctag

SEQ ID NO: 56406 - DNA, 20 bp, Artificial Sequence
  Description of Artificial Sequence: Synthetic oligonucleotide
  Target: ATXN1; (-) strand; PAM type: NRG; PAM sequence: TAG
cccgttcaatcctcagctcc

SEQ ID NO: 56407 - DNA, 20 bp, Artificial Sequence
  Description of Artificial Sequence: Synthetic oligonucleotide
  Target: ATXN1; (-) strand; PAM type: NRG; PAM sequence: CAG
gtttctccccgttcaatcct

SEQ ID NO: 56408 - DNA, 20 bp, Artificial Sequence
  Description of Artificial Sequence: Synthetic oligonucleotide
  Target: ATXN1; (-) strand; PAM type: NRG; PAM sequence: GAG
agaagcactatgagagcagg

SEQ ID NO: 56409 - DNA, 20 bp, Artificial Sequence
  Description of Artificial Sequence: Synthetic oligonucleotide
  Target: ATXN1; (-) strand; PAM type: NRG; PAM sequence: GGG
taagaagcactatgagagca

SEQ ID NO: 56410 - DNA, 20 bp, Artificial Sequence
  Description of Artificial Sequence: Synthetic oligonucleotide
  Target: ATXN1; (-) strand; PAM type: NRG; PAM sequence: AGG
ctaagaagcactatgagagc

SEQ ID NO: 56411 - DNA, 20 bp, Artificial Sequence
  Description of Artificial Sequence: Synthetic oligonucleotide
  Target: ATXN1; (-) strand; PAM type: NRG; PAM sequence: CAG
actaagaagcactatgagag

SEQ ID NO: 56412 - DNA, 20 bp, Artificial Sequence
  Description of Artificial Sequence: Synthetic oligonucleotide
  Target: ATXN1; (-) strand; PAM type: NRG; PAM sequence: GAG
ccaactaagaagcactatga

SEQ ID NO: 56413 - DNA, 20 bp, Artificial Sequence
  Description of Artificial Sequence: Synthetic oligonucleotide
  Target: ATXN1; (-) strand; PAM type: NRG; PAM sequence: GAG
ccccaactaagaagcactat

SEQ ID NO: 56414 - DNA, 20 bp, Artificial Sequence
  Description of Artificial Sequence: Synthetic oligonucleotide
  Target: ATXN1; (-) strand; PAM type: NRG; PAM sequence: AAG
gtcttttctccccaactaag

SEQ ID NO: 56415 - DNA, 20 bp, Artificial Sequence
  Description of Artificial Sequence: Synthetic oligonucleotide
  Target: ATXN1; (-) strand; PAM type: NRG; PAM sequence: AAG
aatgtcttttctccccaact

SEQ ID NO: 56416 - DNA, 20 bp, Artificial Sequence
  Description of Artificial Sequence: Synthetic oligonucleotide
  Target: ATXN1; (-) strand; PAM type: NRG; PAM sequence: AGG
cattttttacatataaaaat

SEQ ID NO: 56417 - DNA, 20 bp, Artificial Sequence
  Description of Artificial Sequence: Synthetic oligonucleotide
  Target: ATXN1; (-) strand; PAM type: NRG; PAM sequence: TAG
acattttttacatataaaaa

SEQ ID NO: 56418 - DNA, 20 bp, Artificial Sequence
  Description of Artificial Sequence: Synthetic oligonucleotide
  Target: ATXN1; (-) strand; PAM type: NRG; PAM sequence: GAG
taggagccacagcttctctg

SEQ ID NO: 56419 - DNA, 20 bp, Artificial Sequence
  Description of Artificial Sequence: Synthetic oligonucleotide
  Target: ATXN1; (-) strand; PAM type: NRG; PAM sequence: TGG
tctaggagccacagcttctc

SEQ ID NO: 56420 - DNA, 20 bp, Artificial Sequence
  Description of Artificial Sequence: Synthetic oligonucleotide
  Target: ATXN1; (-) strand; PAM type: NRG; PAM sequence: CAG
taccttctttctaggagcca

SEQ ID NO: 56421 - DNA, 20 bp, Artificial Sequence
  Description of Artificial Sequence: Synthetic oligonucleotide
  Target: ATXN1; (-) strand; PAM type: NRG; PAM sequence: GAG
aaaacctaccttctttctag

SEQ ID NO: 56422 - DNA, 20 bp, Artificial Sequence
  Description of Artificial Sequence: Synthetic oligonucleotide
  Target: ATXN1; (-) strand; PAM type: NRG; PAM sequence: AGG
ctaaaacctaccttctttct

SEQ ID NO: 56423 - DNA, 20 bp, Artificial Sequence
  Description of Artificial Sequence: Synthetic oligonucleotide
  Target: ATXN1; (-) strand; PAM type: NRG; PAM sequence: TAG
cctaaaacctaccttctttc

SEQ ID NO: 56424 - DNA, 20 bp, Artificial Sequence
  Description of Artificial Sequence: Synthetic oligonucleotide
  Target: ATXN1; (-) strand; PAM type: NRG; PAM sequence: TAG
ccggcccactatcaccattc

SEQ ID NO: 56425 - DNA, 20 bp, Artificial Sequence
  Description of Artificial Sequence: Synthetic oligonucleotide
  Target: ATXN1; (-) strand; PAM type: NRG; PAM sequence: CGG
cgaatgcactctctctcttc

SEQ ID NO: 56426 - DNA, 20 bp, Artificial Sequence
  Description of Artificial Sequence: Synthetic oligonucleotide
  Target: ATXN1; (-) strand; PAM type: NRG; PAM sequence: CAG
tcctactgatgcaatctcct

SEQ ID NO: 56427 - DNA, 20 bp, Artificial Sequence
  Description of Artificial Sequence: Synthetic oligonucleotide
  Target: ATXN1; (-) strand; PAM type: NRG; PAM sequence: AAG
tctgcatctaatgtgtcacc

SEQ ID NO: 56428 - DNA, 20 bp, Artificial Sequence
  Description of Artificial Sequence: Synthetic oligonucleotide
  Target: ATXN1; (-) strand; PAM type: NRG; PAM sequence: AAG
atgcctaaaagtcctccttg

SEQ ID NO: 56429 - DNA, 20 bp, Artificial Sequence
  Description of Artificial Sequence: Synthetic oligonucleotide
  Target: ATXN1; (-) strand; PAM type: NRG; PAM sequence: AAG
tacccaagacagatgcctaa

SEQ ID NO: 56430 - DNA, 20 bp, Artificial Sequence
  Description of Artificial Sequence: Synthetic oligonucleotide
  Target: ATXN1; (-) strand; PAM type: NRG; PAM sequence: CAG
catcatctagttacccaaga

SEQ ID NO: 56431 - DNA, 20 bp, Artificial Sequence
  Description of Artificial Sequence: Synthetic oligonucleotide
  Target: ATXN1; (-) strand; PAM type: NRG; PAM sequence: AAG
ttggcatcatctagttaccc

SEQ ID NO: 56432 - DNA, 20 bp, Artificial Sequence
  Description of Artificial Sequence: Synthetic oligonucleotide
  Target: ATXN1; (-) strand; PAM type: NRG; PAM sequence: TAG
tctcagccattggcatcatc

SEQ ID NO: 56433 - DNA, 20 bp, Artificial Sequence
  Description of Artificial Sequence: Synthetic oligonucleotide
  Target: ATXN1; (-) strand; PAM type: NRG; PAM sequence: TGG
gaattccccatctcagccat

SEQ ID NO: 56434 - DNA, 20 bp, Artificial Sequence
  Description of Artificial Sequence: Synthetic oligonucleotide
  Target: ATXN1; (-) strand; PAM type: NRG; PAM sequence: CAG
tacccaagaattccccatct

SEQ ID NO: 56435 - DNA, 20 bp, Artificial Sequence
  Description of Artificial Sequence: Synthetic oligonucleotide
  Target: ATXN1; (-) strand; PAM type: NRG; PAM sequence: AAG
ccaccaaacctcatctaccc

SEQ ID NO: 56436 - DNA, 20 bp, Artificial Sequence
  Description of Artificial Sequence: Synthetic oligonucleotide
  Target: ATXN1; (-) strand; PAM type: NRG; PAM sequence: AAG
actcagcacgttcaaagtca

SEQ ID NO: 56437 - DNA, 20 bp, Artificial Sequence
  Description of Artificial Sequence: Synthetic oligonucleotide
  Target: ATXN1; (-) strand; PAM type: NRG; PAM sequence: AAG
acctgaactcagcacgttca

SEQ ID NO: 56438 - DNA, 20 bp, Artificial Sequence
  Description of Artificial Sequence: Synthetic oligonucleotide
  Target: ATXN1; (-) strand; PAM type: NRG; PAM sequence: CAG
atcacaatgtcacctgaact

SEQ ID NO: 56439 - DNA, 20 bp, Artificial Sequence
  Description of Artificial Sequence: Synthetic oligonucleotide
  Target: ATXN1; (-) strand; PAM type: NRG; PAM sequence: GGG
cctactctgcacctcctttg

SEQ ID NO: 56440 - DNA, 20 bp, Artificial Sequence
  Description of Artificial Sequence: Synthetic oligonucleotide
  Target: ATXN1; (-) strand; PAM type: NRG; PAM sequence: GGG
acctactctgcacctccttt

SEQ ID NO: 56441 - DNA, 20 bp, Artificial Sequence
  Description of Artificial Sequence: Synthetic oligonucleotide
  Target: ATXN1; (-) strand; PAM type: NRG; PAM sequence: TGG
tacctactctgcacctcctt

SEQ ID NO: 56442 - DNA, 20 bp, Artificial Sequence
  Description of Artificial Sequence: Synthetic oligonucleotide
  Target: ATXN1; (-) strand; PAM type: NRG; PAM sequence: CAG
catcttcgggcctgtgtctc

SEQ ID NO: 56443 - DNA, 20 bp, Artificial Sequence
  Description of Artificial Sequence: Synthetic oligonucleotide
  Target: ATXN1; (-) strand; PAM type: NRG; PAM sequence: GGG
ccagacctctcatcatcttc

SEQ ID NO: 56444 - DNA, 20 bp, Artificial Sequence
  Description of Artificial Sequence: Synthetic oligonucleotide
  Target: ATXN1; (-) strand; PAM type: NRG; PAM sequence: CGG
gccagacctctcatcatctt

SEQ ID NO: 56445 - DNA, 20 bp, Artificial Sequence
  Description of Artificial Sequence: Synthetic oligonucleotide
  Target: ATXN1; (-) strand; PAM type: NRG; PAM sequence: CAG
ctgcatccatgtttctaggc

SEQ ID NO: 56446 - DNA, 20 bp, Artificial Sequence
  Description of Artificial Sequence: Synthetic oligonucleotide
  Target: ATXN1; (-) strand; PAM type: NRG; PAM sequence: AGG
actcctgcatccatgtttct

SEQ ID NO: 56447 - DNA, 20 bp, Artificial Sequence
  Description of Artificial Sequence: Synthetic oligonucleotide
  Target: ATXN1; (-) strand; PAM type: NRG; PAM sequence: TAG
gactcctgcatccatgtttc

SEQ ID NO: 56448 - DNA, 20 bp, Artificial Sequence
  Description of Artificial Sequence: Synthetic oligonucleotide
  Target: ATXN1; (-) strand; PAM type: NRG; PAM sequence: TGG
ccaaactcacagtgccttga

SEQ ID NO: 56449 - DNA, 20 bp, Artificial Sequence
  Description of Artificial Sequence: Synthetic oligonucleotide
  Target: ATXN1; (-) strand; PAM type: NRG; PAM sequence: CAG
gatgatctcatccaaactca

SEQ ID NO: 56450 - DNA, 20 bp, Artificial Sequence
  Description of Artificial Sequence: Synthetic oligonucleotide
  Target: ATXN1; (-) strand; PAM type: NRG; PAM sequence: TAG
tctccacttaagtgttctgc

SEQ ID NO: 56451 - DNA, 20 bp, Artificial Sequence
  Description of Artificial Sequence: Synthetic oligonucleotide
  Target: ATXN1; (-) strand; PAM type: NRG; PAM sequence: AAG
accactttgcttctccactt

SEQ ID NO: 56452 - DNA, 20 bp, Artificial Sequence
  Description of Artificial Sequence: Synthetic oligonucleotide
  Target: ATXN1; (-) strand; PAM type: NRG; PAM sequence: TAG
gttcctcatggcttagtctc

SEQ ID NO: 56453 - DNA, 20 bp, Artificial Sequence
  Description of Artificial Sequence: Synthetic oligonucleotide
  Target: ATXN1; (-) strand; PAM type: NRG; PAM sequence: TAG
tgttggagttcctcatggct

SEQ ID NO: 56454 - DNA, 20 bp, Artificial Sequence
  Description of Artificial Sequence: Synthetic oligonucleotide
  Target: ATXN1; (-) strand; PAM type: NRG; PAM sequence: TGG
ctaagtgttggagttcctca

SEQ ID NO: 56455 - DNA, 20 bp, Artificial Sequence
  Description of Artificial Sequence: Synthetic oligonucleotide
  Target: ATXN1; (-) strand; PAM type: NRG; PAM sequence: GAG
ttctacgcctctaagtgttg

SEQ ID NO: 56456 - DNA, 20 bp, Artificial Sequence
  Description of Artificial Sequence: Synthetic oligonucleotide
  Target: ATXN1; (-) strand; PAM type: NRG; PAM sequence: TGG
ctttctacgcctctaagtgt

SEQ ID NO: 56457 - DNA, 20 bp, Artificial Sequence
  Description of Artificial Sequence: Synthetic oligonucleotide
  Target: ATXN1; (-) strand; PAM type: NRG; PAM sequence: AAG
tacctgctttctacgcctct

SEQ ID NO: 56458 - DNA, 20 bp, Artificial Sequence
  Description of Artificial Sequence: Synthetic oligonucleotide
  Target: ATXN1; (-) strand; PAM type: NRG; PAM sequence: AGG
cccctccttcctaagtcttc

SEQ ID NO: 56459 - DNA, 20 bp, Artificial Sequence
  Description of Artificial Sequence: Synthetic oligonucleotide
  Target: ATXN1; (-) strand; PAM type: NRG; PAM sequence: CAG
gcccctccttcctaagtctt

SEQ ID NO: 56460 - DNA, 20 bp, Artificial Sequence
  Description of Artificial Sequence: Synthetic oligonucleotide
  Target: ATXN1; (-) strand; PAM type: NRG; PAM sequence: AAG
ctttctggcccctccttcct

SEQ ID NO: 56461 - DNA, 20 bp, Artificial Sequence
  Description of Artificial Sequence: Synthetic oligonucleotide
  Target: ATXN1; (-) strand; PAM type: NRG; PAM sequence: TGG
cgggtgccatcatccctttc

SEQ ID NO: 56462 - DNA, 20 bp, Artificial Sequence
  Description of Artificial Sequence: Synthetic oligonucleotide
  Target: ATXN1; (-) strand; PAM type: NRG; PAM sequence: GGG
tcctgaacaccactgtcttc

SEQ ID NO: 56463 - DNA, 20 bp, Artificial Sequence
  Description of Artificial Sequence: Synthetic oligonucleotide
  Target: ATXN1; (-) strand; PAM type: NRG; PAM sequence: CGG
ttcctgaacaccactgtctt

SEQ ID NO: 56464 - DNA, 20 bp, Artificial Sequence
  Description of Artificial Sequence: Synthetic oligonucleotide
  Target: ATXN1; (-) strand; PAM type: NRG; PAM sequence: TGG
gtctaaataccttcctccct

SEQ ID NO: 56465 - DNA, 20 bp, Artificial Sequence
  Description of Artificial Sequence: Synthetic oligonucleotide
  Target: ATXN1; (-) strand; PAM type: NRG; PAM sequence: CAG
ttctcatctcactttctcca

SEQ ID NO: 56466 - DNA, 20 bp, Artificial Sequence
  Description of Artificial Sequence: Synthetic oligonucleotide
  Target: ATXN1; (-) strand; PAM type: NRG; PAM sequence: GAG
cagttgtgtgtttttaatag

SEQ ID NO: 56467 - DNA, 20 bp, Artificial Sequence
  Description of Artificial Sequence: Synthetic oligonucleotide
  Target: ATXN1; (-) strand; PAM type: NRG; PAM sequence: AGG
accagttgtgtgtttttaat

SEQ ID NO: 56468 - DNA, 20 bp, Artificial Sequence
  Description of Artificial Sequence: Synthetic oligonucleotide
  Target: ATXN1; (-) strand; PAM type: NRG; PAM sequence: TAG
gaccagttgtgtgtttttaa

SEQ ID NO: 56469 - DNA, 20 bp, Artificial Sequence
  Description of Artificial Sequence: Synthetic oligonucleotide
  Target: ATXN1; (-) strand; PAM type: NRG; PAM sequence: CAG
gccatcccatgtcattggac

SEQ ID NO: 56470 - DNA, 20 bp, Artificial Sequence
  Description of Artificial Sequence: Synthetic oligonucleotide
  Target: ATXN1; (-) strand; PAM type: NRG; PAM sequence: TGG
tccatgccatcccatgtcat

SEQ ID NO: 56471 - DNA, 20 bp, Artificial Sequence
  Description of Artificial Sequence: Synthetic oligonucleotide
  Target: ATXN1; (-) strand; PAM type: NRG; PAM sequence: CAG
cctgtctcctgcttggtcat

SEQ ID NO: 56472 - DNA, 20 bp, Artificial Sequence
  Description of Artificial Sequence: Synthetic oligonucleotide
  Target: ATXN1; (-) strand; PAM type: NRG; PAM sequence: TGG
gtccacccctgtctcctgct

SEQ ID NO: 56473 - DNA, 20 bp, Artificial Sequence
  Description of Artificial Sequence: Synthetic oligonucleotide
  Target: ATXN1; (-) strand; PAM type: NRG; PAM sequence: CGG
agcttgctctttttcccctg

SEQ ID NO: 56474 - DNA, 20 bp, Artificial Sequence
  Description of Artificial Sequence: Synthetic oligonucleotide
  Target: ATXN1; (-) strand; PAM type: NRG; PAM sequence: CAG
ggacattccttagctggctt

SEQ ID NO: 56475 - DNA, 20 bp, Artificial Sequence
  Description of Artificial Sequence: Synthetic oligonucleotide
  Target: ATXN1; (-) strand; PAM type: NRG; PAM sequence: TGG
gcccgaggacattccttagc

SEQ ID NO: 56476 - DNA, 20 bp, Artificial Sequence
  Description of Artificial Sequence: Synthetic oligonucleotide
  Target: ATXN1; (-) strand; PAM type: NRG; PAM sequence: TAG
gatggcccgaggacattcct

SEQ ID NO: 56477 - DNA, 20 bp, Artificial Sequence
  Description of Artificial Sequence: Synthetic oligonucleotide
  Target: ATXN1; (-) strand; PAM type: NRG; PAM sequence: AGG
ctccgctaggagatggcccg

SEQ ID NO: 56478 - DNA, 20 bp, Artificial Sequence
  Description of Artificial Sequence: Synthetic oligonucleotide
  Target: ATXN1; (-) strand; PAM type: NRG; PAM sequence: GAG
cctccgctaggagatggccc

SEQ ID NO: 56479 - DNA, 20 bp, Artificial Sequence
  Description of Artificial Sequence: Synthetic oligonucleotide
  Target: ATXN1; (-) strand; PAM type: NRG; PAM sequence: TGG
ctaccgcctccgctaggaga

SEQ ID NO: 56480 - DNA, 20 bp, Artificial Sequence
  Description of Artificial Sequence: Synthetic oligonucleotide
  Target: ATXN1; (-) strand; PAM type: NRG; PAM sequence: GAG
ggctctaccgcctccgctag

SEQ ID NO: 56481 - DNA, 20 bp, Artificial Sequence
  Description of Artificial Sequence: Synthetic oligonucleotide
  Target: ATXN1; (-) strand; PAM type: NRG; PAM sequence: AGG
acggctctaccgcctccgct

SEQ ID NO: 56482 - DNA, 20 bp, Artificial Sequence
  Description of Artificial Sequence: Synthetic oligonucleotide
  Target: ATXN1; (-) strand; PAM type: NRG; PAM sequence: TAG
cacggctctaccgcctccgc

SEQ ID NO: 56483 - DNA, 20 bp, Artificial Sequence
  Description of Artificial Sequence: Synthetic oligonucleotide
  Target: ATXN1; (-) strand; PAM type: NRG; PAM sequence: CGG
acttcctgtaccttcaacca

SEQ ID NO: 56484 - DNA, 20 bp, Artificial Sequence
  Description of Artificial Sequence: Synthetic oligonucleotide
  Target: ATXN1; (-) strand; PAM type: NRG; PAM sequence: CAG
aaggggaacctgggccctaa

SEQ ID NO: 56485 - DNA, 20 bp, Artificial Sequence
  Description of Artificial Sequence: Synthetic oligonucleotide
  Target: ATXN1; (-) strand; PAM type: NRG; PAM sequence: GGG
ctcatggttaaggggaacct

SEQ ID NO: 56486 - DNA, 20 bp, Artificial Sequence
  Description of Artificial Sequence: Synthetic oligonucleotide
  Target: ATXN1; (-) strand; PAM type: NRG; PAM sequence: TGG
tctcatggttaaggggaacc

SEQ ID NO: 56487 - DNA, 20 bp, Artificial Sequence
  Description of Artificial Sequence: Synthetic oligonucleotide
  Target: ATXN1; (-) strand; PAM type: NRG; PAM sequence: GGG
cttcaggtctcatggttaag

SEQ ID NO: 56488 - DNA, 20 bp, Artificial Sequence
  Description of Artificial Sequence: Synthetic oligonucleotide
  Target: ATXN1; (-) strand; PAM type: NRG; PAM sequence: GGG
gcttcaggtctcatggttaa

SEQ ID NO: 56489 - DNA, 20 bp, Artificial Sequence
  Description of Artificial Sequence: Synthetic oligonucleotide
  Target: ATXN1; (-) strand; PAM type: NRG; PAM sequence: AGG
tgcttcaggtctcatggtta

SEQ ID NO: 56490 - DNA, 20 bp, Artificial Sequence
  Description of Artificial Sequence: Synthetic oligonucleotide
  Target: ATXN1; (-) strand; PAM type: NRG; PAM sequence: AAG
ttgcttcaggtctcatggtt

SEQ ID NO: 56491 - DNA, 20 bp, Artificial Sequence
  Description of Artificial Sequence: Synthetic oligonucleotide
  Target: ATXN1; (-) strand; PAM type: NRG; PAM sequence: TGG
gtaacttgcttcaggtctca

SEQ ID NO: 56492 - DNA, 20 bp, Artificial Sequence
  Description of Artificial Sequence: Synthetic oligonucleotide
  Target: ATXN1; (-) strand; PAM type: NRG; PAM sequence: AGG
gaaataaagtaacttgcttc

SEQ ID NO: 56493 - DNA, 20 bp, Artificial Sequence
  Description of Artificial Sequence: Synthetic oligonucleotide
  Target: ATXN1; (-) strand; PAM type: NRG; PAM sequence: CAG
agaaataaagtaacttgctt

SEQ ID NO: 56494 - DNA, 20 bp, Artificial Sequence
  Description of Artificial Sequence: Synthetic oligonucleotide
  Target: ATXN1; (-) strand; PAM type: NRG; PAM sequence: AAG
aattgagccctagagaaata

SEQ ID NO: 56495 - DNA, 20 bp, Artificial Sequence
  Description of Artificial Sequence: Synthetic oligonucleotide
  Target: ATXN1; (-) strand; PAM type: NRG; PAM sequence: GAG
ggtgagaaaattgagcccta

SEQ ID NO: 56496 - DNA, 20 bp, Artificial Sequence
  Description of Artificial Sequence: Synthetic oligonucleotide
  Target: ATXN1; (-) strand; PAM type: NRG; PAM sequence: TAG
caggtgagaaaattgagccc

SEQ ID NO: 56497 - DNA, 20 bp, Artificial Sequence
  Description of Artificial Sequence: Synthetic oligonucleotide
  Target: ATXN1; (-) strand; PAM type: NRG; PAM sequence: GAG
gttttacaggtgagaaaatt

SEQ ID NO: 56498 - DNA, 20 bp, Artificial Sequence
  Description of Artificial Sequence: Synthetic oligonucleotide
  Target: ATXN1; (-) strand; PAM type: NRG; PAM sequence: GAG
gttactcttgttttacaggt

SEQ ID NO: 56499 - DNA, 20 bp, Artificial Sequence
  Description of Artificial Sequence: Synthetic oligonucleotide
  Target: ATXN1; (-) strand; PAM type: NRG; PAM sequence: AGG
cactgttactcttgttttac

SEQ ID NO: 56500 - DNA, 20 bp, Artificial Sequence
  Description of Artificial Sequence: Synthetic oligonucleotide
  Target: ATXN1; (-) strand; PAM type: NRG; PAM sequence: CAG
gcactgttactcttgtttta

SEQ ID NO: 56501 - DNA, 20 bp, Artificial Sequence
  Description of Artificial Sequence: Synthetic oligonucleotide
  Target: ATXN1; (-) strand; PAM type: NRG; PAM sequence: GAG
ctcacagcaacctagtaggt

SEQ ID NO: 56502 - DNA, 20 bp, Artificial Sequence
  Description of Artificial Sequence: Synthetic oligonucleotide
  Target: ATXN1; (-) strand; PAM type: NRG; PAM sequence: AGG
gaacctcacagcaacctagt

SEQ ID NO: 56503 - DNA, 20 bp, Artificial Sequence
  Description of Artificial Sequence: Synthetic oligonucleotide
  Target: ATXN1; (-) strand; PAM type: NRG; PAM sequence: TAG
agaacctcacagcaacctag

SEQ ID NO: 56504 - DNA, 20 bp, Artificial Sequence
  Description of Artificial Sequence: Synthetic oligonucleotide
  Target: ATXN1; (-) strand; PAM type: NRG; PAM sequence: TAG
aaaagaacctcacagcaacc

SEQ ID NO: 56505 - DNA, 20 bp, Artificial Sequence
  Description of Artificial Sequence: Synthetic oligonucleotide
  Target: ATXN1; (-) strand; PAM type: NRG; PAM sequence: CAG
gaaaaagaaaaagaacctca

SEQ ID NO: 56506 - DNA, 20 bp, Artificial Sequence
  Description of Artificial Sequence: Synthetic oligonucleotide
  Target: ATXN1; (-) strand; PAM type: NRG; PAM sequence: AAG
aaaaaaaaaagaaaaagaaa

SEQ ID NO: 56507 - DNA, 20 bp, Artificial Sequence
  Description of Artificial Sequence: Synthetic oligonucleotide
  Target: ATXN1; (-) strand; PAM type: NRG; PAM sequence: AAG
gtctccaaaaaaaaaagaaa

SEQ ID NO: 56508 - DNA, 20 bp, Artificial Sequence
  Description of Artificial Sequence: Synthetic oligonucleotide
  Target: ATXN1; (-) strand; PAM type: NRG; PAM sequence: AAG
gactctgtctccaaaaaaaa

SEQ ID NO: 56509 - DNA, 20 bp, Artificial Sequence
  Description of Artificial Sequence: Synthetic oligonucleotide
  Target: ATXN1; (-) strand; PAM type: NRG; PAM sequence: GAG
tccagcctgggtgacagagt

SEQ ID NO: 56510 - DNA, 20 bp, Artificial Sequence
  Description of Artificial Sequence: Synthetic oligonucleotide
  Target: ATXN1; (-) strand; PAM type: NRG; PAM sequence: GAG
gcactccagcctgggtgaca

SEQ ID NO: 56511 - DNA, 20 bp, Artificial Sequence
  Description of Artificial Sequence: Synthetic oligonucleotide
  Target: ATXN1; (-) strand; PAM type: NRG; PAM sequence: CAG
ctgcactccagcctgggtga

SEQ ID NO: 56512 - DNA, 20 bp, Artificial Sequence
  Description of Artificial Sequence: Synthetic oligonucleotide
  Target: ATXN1; (-) strand; PAM type: NRG; PAM sequence: GGG
gcaccactgcactccagcct

SEQ ID NO: 56513 - DNA, 20 bp, Artificial Sequence
  Description of Artificial Sequence: Synthetic oligonucleotide
  Target: ATXN1; (-) strand; PAM type: NRG; PAM sequence: TGG
tgcaccactgcactccagcc

SEQ ID NO: 56514 - DNA, 20 bp, Artificial Sequence
  Description of Artificial Sequence: Synthetic oligonucleotide
  Target: ATXN1; (-) strand; PAM type: NRG; PAM sequence: CAG
aagattgcaccactgcactc

SEQ ID NO: 56515 - DNA, 20 bp, Artificial Sequence
  Description of Artificial Sequence: Synthetic oligonucleotide
  Target: ATXN1; (-) strand; PAM type: NRG; PAM sequence: AAG
ggtggagattgcagtgagcc

SEQ ID NO: 56516 - DNA, 20 bp, Artificial Sequence
  Description of Artificial Sequence: Synthetic oligonucleotide
  Target: ATXN1; (-) strand; PAM type: NRG; PAM sequence: GAG
cgggaggtggagattgcagt

SEQ ID NO: 56517 - DNA, 20 bp, Artificial Sequence
  Description of Artificial Sequence: Synthetic oligonucleotide
  Target: ATXN1; (-) strand; PAM type: NRG; PAM sequence: CAG
aacccgggaggtggagattg

SEQ ID NO: 56518 - DNA, 20 bp, Artificial Sequence
  Description of Artificial Sequence: Synthetic oligonucleotide
  Target: ATXN1; (-) strand; PAM type: NRG; PAM sequence: GAG
tagctggaacccgggaggtg

SEQ ID NO: 56519 - DNA, 20 bp, Artificial Sequence
  Description of Artificial Sequence: Synthetic oligonucleotide
  Target: ATXN1; (-) strand; PAM type: NRG; PAM sequence: TGG
aatagctggaacccgggagg

SEQ ID NO: 56520 - DNA, 20 bp, Artificial Sequence
  Description of Artificial Sequence: Synthetic oligonucleotide
  Target: ATXN1; (-) strand; PAM type: NRG; PAM sequence: AGG
gagaatagctggaacccggg

SEQ ID NO: 56521 - DNA, 20 bp, Artificial Sequence
  Description of Artificial Sequence: Synthetic oligonucleotide
  Target: ATXN1; (-) strand; PAM type: NRG; PAM sequence: GAG
ggagaatagctggaacccgg

SEQ ID NO: 56522 - DNA, 20 bp, Artificial Sequence
  Description of Artificial Sequence: Synthetic oligonucleotide
  Target: ATXN1; (-) strand; PAM type: NRG; PAM sequence: GGG
caggagaatagctggaaccc

SEQ ID NO: 56523 - DNA, 20 bp, Artificial Sequence
  Description of Artificial Sequence: Synthetic oligonucleotide
  Target: ATXN1; (-) strand; PAM type: NRG; PAM sequence: CGG
gcaggagaatagctggaacc

SEQ ID NO: 56524 - DNA, 20 bp, Artificial Sequence
  Description of Artificial Sequence: Synthetic oligonucleotide
  Target: ATXN1; (-) strand; PAM type: NRG; PAM sequence: TGG
ggctaaggcaggagaatagc

SEQ ID NO: 56525 - DNA, 20 bp, Artificial Sequence
  Description of Artificial Sequence: Synthetic oligonucleotide
  Target: ATXN1; (-) strand; PAM type: NRG; PAM sequence: TAG
aggaggctaaggcaggagaa

SEQ ID NO: 56526 - DNA, 20 bp, Artificial Sequence
  Description of Artificial Sequence: Synthetic oligonucleotide
  Target: ATXN1; (-) strand; PAM type: NRG; PAM sequence: GAG
cactcaggaggctaaggcag

SEQ ID NO: 56527 - DNA, 20 bp, Artificial Sequence
  Description of Artificial Sequence: Synthetic oligonucleotide
  Target: ATXN1; (-) strand; PAM type: NRG; PAM sequence: AGG
gccactcaggaggctaaggc

SEQ ID NO: 56528 - DNA, 20 bp, Artificial Sequence
  Description of Artificial Sequence: Synthetic oligonucleotide
  Target: ATXN1; (-) strand; PAM type: NRG; PAM sequence: CAG
agccactcaggaggctaagg

SEQ ID NO: 56529 - DNA, 20 bp, Artificial Sequence
  Description of Artificial Sequence: Synthetic oligonucleotide
  Target: ATXN1; (-) strand; PAM type: NRG; PAM sequence: AGG
cccagccactcaggaggcta

SEQ ID NO: 56530 - DNA, 20 bp, Artificial Sequence
  Description of Artificial Sequence: Synthetic oligonucleotide
  Target: ATXN1; (-) strand; PAM type: NRG; PAM sequence: AAG
tcccagccactcaggaggct

SEQ ID NO: 56531 - DNA, 20 bp, Artificial Sequence
  Description of Artificial Sequence: Synthetic oligonucleotide
  Target: ATXN1; (-) strand; PAM type: NRG; PAM sequence: AGG
tgtagtcccagccactcagg

SEQ ID NO: 56532 - DNA, 20 bp, Artificial Sequence
  Description of Artificial Sequence: Synthetic oligonucleotide
  Target: ATXN1; (-) strand; PAM type: NRG; PAM sequence: GAG
ctgtagtcccagccactcag

SEQ ID NO: 56533 - DNA, 20 bp, Artificial Sequence
  Description of Artificial Sequence: Synthetic oligonucleotide
  Target: ATXN1; (-) strand; PAM type: NRG; PAM sequence: AGG
gcctgtagtcccagccactc

SEQ ID NO: 56534 - DNA, 20 bp, Artificial Sequence
  Description of Artificial Sequence: Synthetic oligonucleotide
  Target: ATXN1; (-) strand; PAM type: NRG; PAM sequence: CAG
cgcctgtagtcccagccact

SEQ ID NO: 56535 - DNA, 20 bp, Artificial Sequence
  Description of Artificial Sequence: Synthetic oligonucleotide
  Target: ATXN1; (-) strand; PAM type: NRG; PAM sequence: CAG
gtggcaggcgcctgtagtcc

SEQ ID NO: 56536 - DNA, 20 bp, Artificial Sequence
  Description of Artificial Sequence: Synthetic oligonucleotide
  Target: ATXN1; (-) strand; PAM type: NRG; PAM sequence: TAG
gttgtggtggcaggcgcctg

SEQ ID NO: 56537 - DNA, 20 bp, Artificial Sequence
  Description of Artificial Sequence: Synthetic oligonucleotide
  Target: ATXN1; (-) strand; PAM type: NRG; PAM sequence: AGG
aattagccagttgtggtggc

SEQ ID NO: 56538 - DNA, 20 bp, Artificial Sequence
  Description of Artificial Sequence: Synthetic oligonucleotide
  Target: ATXN1; (-) strand; PAM type: NRG; PAM sequence: CAG
aaattagccagttgtggtgg

SEQ ID NO: 56539 - DNA, 20 bp, Artificial Sequence
  Description of Artificial Sequence: Synthetic oligonucleotide
  Target: ATXN1; (-) strand; PAM type: NRG; PAM sequence: TGG
caaaaattagccagttgtgg

SEQ ID NO: 56540 - DNA, 20 bp, Artificial Sequence
  Description of Artificial Sequence: Synthetic oligonucleotide
  Target: ATXN1; (-) strand; PAM type: NRG; PAM sequence: TGG
atacaaaaattagccagttg

SEQ ID NO: 56541 - DNA, 20 bp, Artificial Sequence
  Description of Artificial Sequence: Synthetic oligonucleotide
  Target: ATXN1; (-) strand; PAM type: NRG; PAM sequence: CAG
ctaaaaatacaaaaattagc

SEQ ID NO: 56542 - DNA, 20 bp, Artificial Sequence
  Description of Artificial Sequence: Synthetic oligonucleotide
  Target: ATXN1; (-) strand; PAM type: NRG; PAM sequence: TAG
tctactaaaaatacaaaaat

SEQ ID NO: 56543 - DNA, 20 bp, Artificial Sequence
  Description of Artificial Sequence: Synthetic oligonucleotide
  Target: ATXN1; (-) strand; PAM type: NRG; PAM sequence: TGG
tgagtccaggctggccaacg

SEQ ID NO: 56544 - DNA, 20 bp, Artificial Sequence
  Description of Artificial Sequence: Synthetic oligonucleotide
  Target: ATXN1; (-) strand; PAM type: NRG; PAM sequence: TGG
tcaggagtttgagtccaggc

SEQ ID NO: 56545 - DNA, 20 bp, Artificial Sequence
  Description of Artificial Sequence: Synthetic oligonucleotide
  Target: ATXN1; (-) strand; PAM type: NRG; PAM sequence: AGG
gaggtcaggagtttgagtcc

SEQ ID NO: 56546 - DNA, 20 bp, Artificial Sequence
  Description of Artificial Sequence: Synthetic oligonucleotide
  Target: ATXN1; (-) strand; PAM type: NRG; PAM sequence: CAG
tgaggtcaggagtttgagtc

SEQ ID NO: 56547 - DNA, 20 bp, Artificial Sequence
  Description of Artificial Sequence: Synthetic oligonucleotide
  Target: ATXN1; (-) strand; PAM type: NRG; PAM sequence: GAG
tcacctgaggtcaggagttt

SEQ ID NO: 56548 - DNA, 20 bp, Artificial Sequence
  Description of Artificial Sequence: Synthetic oligonucleotide
  Target: ATXN1; (-) strand; PAM type: NRG; PAM sequence: GAG
ggcagatcacctgaggtcag

SEQ ID NO: 56549 - DNA, 20 bp, Artificial Sequence
  Description of Artificial Sequence: Synthetic oligonucleotide
  Target: ATXN1; (-) strand; PAM type: NRG; PAM sequence: AGG
caggcagatcacctgaggtc

SEQ ID NO: 56550 - DNA, 20 bp, Artificial Sequence
  Description of Artificial Sequence: Synthetic oligonucleotide
  Target: ATXN1; (-) strand; PAM type: NRG; PAM sequence: CAG
gcaggcagatcacctgaggt

SEQ ID NO: 56551 - DNA, 20 bp, Artificial Sequence
  Description of Artificial Sequence: Synthetic oligonucleotide
  Target: ATXN1; (-) strand; PAM type: NRG; PAM sequence: AGG
tgaagcaggcagatcacctg

SEQ ID NO: 56552 - DNA, 20 bp, Artificial Sequence
  Description of Artificial Sequence: Synthetic oligonucleotide
  Target: ATXN1; (-) strand; PAM type: NRG; PAM sequence: GAG
ctgaagcaggcagatcacct

SEQ ID NO: 56553 - DNA, 20 bp, Artificial Sequence
  Description of Artificial Sequence: Synthetic oligonucleotide
  Target: ATXN1; (-) strand; PAM type: NRG; PAM sequence: CAG
ctttgggaggctgaagcagg

SEQ ID NO: 56554 - DNA, 20 bp, Artificial Sequence
  Description of Artificial Sequence: Synthetic oligonucleotide
  Target: ATXN1; (-) strand; PAM type: NRG; PAM sequence: AGG
gcactttgggaggctgaagc

SEQ ID NO: 56555 - DNA, 20 bp, Artificial Sequence
  Description of Artificial Sequence: Synthetic oligonucleotide
  Target: ATXN1; (-) strand; PAM type: NRG; PAM sequence: CAG
agcactttgggaggctgaag

SEQ ID NO: 56556 - DNA, 20 bp, Artificial Sequence
  Description of Artificial Sequence: Synthetic oligonucleotide
  Target: ATXN1; (-) strand; PAM type: NRG; PAM sequence: AAG
cccagcactttgggaggctg

SEQ ID NO: 56557 - DNA, 20 bp, Artificial Sequence
  Description of Artificial Sequence: Synthetic oligonucleotide
  Target: ATXN1; (-) strand; PAM type: NRG; PAM sequence: AGG
tgtaatcccagcactttggg

SEQ ID NO: 56558 - DNA, 20 bp, Artificial Sequence
  Description of Artificial Sequence: Synthetic oligonucleotide
  Target: ATXN1; (-) strand; PAM type: NRG; PAM sequence: GAG
ctgtaatcccagcactttgg

SEQ ID NO: 56559 - DNA, 20 bp, Artificial Sequence
  Description of Artificial Sequence: Synthetic oligonucleotide
  Target: ATXN1; (-) strand; PAM type: NRG; PAM sequence: GGG
gcctgtaatcccagcacttt

SEQ ID NO: 56560 - DNA, 20 bp, Artificial Sequence
  Description of Artificial Sequence: Synthetic oligonucleotide
  Target: ATXN1; (-) strand; PAM type: NRG; PAM sequence: TGG
cgcctgtaatcccagcactt

SEQ ID NO: 56561 - DNA, 20 bp, Artificial Sequence
  Description of Artificial Sequence: Synthetic oligonucleotide
  Target: ATXN1; (-) strand; PAM type: NRG; PAM sequence: CAG
gtggctcacgcctgtaatcc

SEQ ID NO: 56562 - DNA, 20 bp, Artificial Sequence
  Description of Artificial Sequence: Synthetic oligonucleotide
  Target: ATXN1; (-) strand; PAM type: NRG; PAM sequence: TGG
tcacagaaggccaggtgtgg

SEQ ID NO: 56563 - DNA, 20 bp, Artificial Sequence
  Description of Artificial Sequence: Synthetic oligonucleotide
  Target: ATXN1; (-) strand; PAM type: NRG; PAM sequence: TGG
acctcacagaaggccaggtg

SEQ ID NO: 56564 - DNA, 20 bp, Artificial Sequence
  Description of Artificial Sequence: Synthetic oligonucleotide
  Target: ATXN1; (-) strand; PAM type: NRG; PAM sequence: AGG
taagaacctcacagaaggcc

SEQ ID NO: 56565 - DNA, 20 bp, Artificial Sequence
  Description of Artificial Sequence: Synthetic oligonucleotide
  Target: ATXN1; (-) strand; PAM type: NRG; PAM sequence: CAG
ttaagaacctcacagaaggc

SEQ ID NO: 56566 - DNA, 20 bp, Artificial Sequence
  Description of Artificial Sequence: Synthetic oligonucleotide
  Target: ATXN1; (-) strand; PAM type: NRG; PAM sequence: AGG
catgttaagaacctcacaga

SEQ ID NO: 56567 - DNA, 20 bp, Artificial Sequence
  Description of Artificial Sequence: Synthetic oligonucleotide
  Target: ATXN1; (-) strand; PAM type: NRG; PAM sequence: AAG
acatgttaagaacctcacag

SEQ ID NO: 56568 - DNA, 20 bp, Artificial Sequence
  Description of Artificial Sequence: Synthetic oligonucleotide
  Target: ATXN1; (-) strand; PAM type: NRG; PAM sequence: CAG
cttacatgttaagaacctca

SEQ ID NO: 56569 - DNA, 20 bp, Artificial Sequence
  Description of Artificial Sequence: Synthetic oligonucleotide
  Target: ATXN1; (-) strand; PAM type: NRG; PAM sequence: AAG
ggctaagtggcttacatgtt

SEQ ID NO: 56570 - DNA, 20 bp, Artificial Sequence
  Description of Artificial Sequence: Synthetic oligonucleotide
  Target: ATXN1; (-) strand; PAM type: NRG; PAM sequence: TGG
gagtcagccactgggctaag

SEQ ID NO: 56571 - DNA, 20 bp, Artificial Sequence
  Description of Artificial Sequence: Synthetic oligonucleotide
  Target: ATXN1; (-) strand; PAM type: NRG; PAM sequence: AAG
tatgagtcagccactgggct

SEQ ID NO: 56572 - DNA, 20 bp, Artificial Sequence
  Description of Artificial Sequence: Synthetic oligonucleotide
  Target: ATXN1; (-) strand; PAM type: NRG; PAM sequence: GGG
actactatgagtcagccact

SEQ ID NO: 56573 - DNA, 20 bp, Artificial Sequence
  Description of Artificial Sequence: Synthetic oligonucleotide
  Target: ATXN1; (-) strand; PAM type: NRG; PAM sequence: TGG
aactactatgagtcagccac

SEQ ID NO: 56574 - DNA, 20 bp, Artificial Sequence
  Description of Artificial Sequence: Synthetic oligonucleotide
  Target: ATXN1; (-) strand; PAM type: NRG; PAM sequence: CAG
attcagcaactactatgagt

SEQ ID NO: 56575 - DNA, 20 bp, Artificial Sequence
  Description of Artificial Sequence: Synthetic oligonucleotide
  Target: ATXN1; (-) strand; PAM type: NRG; PAM sequence: GAG
atttattcagcaactactat

SEQ ID NO: 56576 - DNA, 20 bp, Artificial Sequence
  Description of Artificial Sequence: Synthetic oligonucleotide
  Target: ATXN1; (-) strand; PAM type: NRG; PAM sequence: CAG
atataaaattagcatttatt

SEQ ID NO: 56577 - DNA, 20 bp, Artificial Sequence
  Description of Artificial Sequence: Synthetic oligonucleotide
  Target: ATXN1; (-) strand; PAM type: NRG; PAM sequence: TAG
tgagggtgttaatataaaat

SEQ ID NO: 56578 - DNA, 20 bp, Artificial Sequence
  Description of Artificial Sequence: Synthetic oligonucleotide
  Target: ATXN1; (-) strand; PAM type: NRG; PAM sequence: GGG
attgatttaatgggttatga

SEQ ID NO: 56579 - DNA, 20 bp, Artificial Sequence
  Description of Artificial Sequence: Synthetic oligonucleotide
  Target: ATXN1; (-) strand; PAM type: NRG; PAM sequence: AGG
tattgatttaatgggttatg

SEQ ID NO: 56580 - DNA, 20 bp, Artificial Sequence
  Description of Artificial Sequence: Synthetic oligonucleotide
  Target: ATXN1; (-) strand; PAM type: NRG; PAM sequence: GAG
atattgatttaatgggttat

SEQ ID NO: 56581 - DNA, 20 bp, Artificial Sequence
  Description of Artificial Sequence: Synthetic oligonucleotide
  Target: ATXN1; (-) strand; PAM type: NRG; PAM sequence: GGG
tcaataaatattgatttaat

SEQ ID NO: 56582 - DNA, 20 bp, Artificial Sequence
  Description of Artificial Sequence: Synthetic oligonucleotide
  Target: ATXN1; (-) strand; PAM type: NRG; PAM sequence: TGG
ctcaataaatattgatttaa

SEQ ID NO: 56583 - DNA, 20 bp, Artificial Sequence
  Description of Artificial Sequence: Synthetic oligonucleotide
  Target: ATXN1; (-) strand; PAM type: NRG; PAM sequence: TGG
ctagtacagtgcctggcaga

SEQ ID NO: 56584 - DNA, 20 bp, Artificial Sequence
  Description of Artificial Sequence: Synthetic oligonucleotide
  Target: ATXN1; (-) strand; PAM type: NRG; PAM sequence: CAG
gcatctagtacagtgcctgg

SEQ ID NO: 56585 - DNA, 20 bp, Artificial Sequence
  Description of Artificial Sequence: Synthetic oligonucleotide
  Target: ATXN1; (-) strand; PAM type: NRG; PAM sequence: TGG
tcagcatctagtacagtgcc

SEQ ID NO: 56586 - DNA, 20 bp, Artificial Sequence
  Description of Artificial Sequence: Synthetic oligonucleotide
  Target: ATXN1; (-) strand; PAM type: NRG; PAM sequence: CAG
gtctttgtcagcatctagta

SEQ ID NO: 56587 - DNA, 20 bp, Artificial Sequence
  Description of Artificial Sequence: Synthetic oligonucleotide
  Target: ATXN1; (-) strand; PAM type: NRG; PAM sequence: TAG
ggggtgtctttgtcagcatc

SEQ ID NO: 56588 - DNA, 20 bp, Artificial Sequence
  Description of Artificial Sequence: Synthetic oligonucleotide
  Target: ATXN1; (-) strand; PAM type: NRG; PAM sequence: CAG
gttgttgggggtgtctttgt

SEQ ID NO: 56589 - DNA, 20 bp, Artificial Sequence
  Description of Artificial Sequence: Synthetic oligonucleotide
  Target: ATXN1; (-) strand; PAM type: NRG; PAM sequence: GGG
aggtaattatttgttgttgg

SEQ ID NO: 56590 - DNA, 20 bp, Artificial Sequence
  Description of Artificial Sequence: Synthetic oligonucleotide
  Target: ATXN1; (-) strand; PAM type: NRG; PAM sequence: GGG
taggtaattatttgttgttg

SEQ ID NO: 56591 - DNA, 20 bp, Artificial Sequence
  Description of Artificial Sequence: Synthetic oligonucleotide
  Target: ATXN1; (-) strand; PAM type: NRG; PAM sequence: GGG
ataggtaattatttgttgtt

SEQ ID NO: 56592 - DNA, 20 bp, Artificial Sequence
  Description of Artificial Sequence: Synthetic oligonucleotide
  Target: ATXN1; (-) strand; PAM type: NRG; PAM sequence: TGG
gataggtaattatttgttgt

SEQ ID NO: 56593 - DNA, 20 bp, Artificial Sequence
  Description of Artificial Sequence: Synthetic oligonucleotide
  Target: ATXN1; (-) strand; PAM type: NRG; PAM sequence: AGG
tcttttatttccatgaggat

SEQ ID NO: 56594 - DNA, 20 bp, Artificial Sequence
  Description of Artificial Sequence: Synthetic oligonucleotide
  Target: ATXN1; (-) strand; PAM type: NRG; PAM sequence: TAG
atcttttatttccatgagga

SEQ ID NO: 56595 - DNA, 20 bp, Artificial Sequence
  Description of Artificial Sequence: Synthetic oligonucleotide
  Target: ATXN1; (-) strand; PAM type: NRG; PAM sequence: AGG
ataaatcttttatttccatg

SEQ ID NO: 56596 - DNA, 20 bp, Artificial Sequence
  Description of Artificial Sequence: Synthetic oligonucleotide
  Target: ATXN1; (-) strand; PAM type: NRG; PAM sequence: GAG
tataaatcttttatttccat

SEQ ID NO: 56597 - DNA, 20 bp, Artificial Sequence
  Description of Artificial Sequence: Synthetic oligonucleotide
  Target: ATXN1; (-) strand; PAM type: NRG; PAM sequence: TGG
tagcatctatcaccatttaa

SEQ ID NO: 56598 - DNA, 20 bp, Artificial Sequence
  Description of Artificial Sequence: Synthetic oligonucleotide
  Target: ATXN1; (-) strand; PAM type: NRG; PAM sequence: TAG
cccttttctgcttaactttt

SEQ ID NO: 56599 - DNA, 20 bp, Artificial Sequence
  Description of Artificial Sequence: Synthetic oligonucleotide
  Target: ATXN1; (-) strand; PAM type: NRG; PAM sequence: TAG
tggtcaccagaccaccaccc

SEQ ID NO: 56600 - DNA, 20 bp, Artificial Sequence
  Description of Artificial Sequence: Synthetic oligonucleotide
  Target: ATXN1; (-) strand; PAM type: NRG; PAM sequence: CAG
aagcttgaaaaaatggtcac

SEQ ID NO: 56601 - DNA, 20 bp, Artificial Sequence
  Description of Artificial Sequence: Synthetic oligonucleotide
  Target: ATXN1; (-) strand; PAM type: NRG; PAM sequence: TGG
gactgacaagcttgaaaaaa

SEQ ID NO: 56602 - DNA, 20 bp, Artificial Sequence
  Description of Artificial Sequence: Synthetic oligonucleotide
  Target: ATXN1; (-) strand; PAM type: NRG; PAM sequence: AAG
tgaggtcttttttgactgac

SEQ ID NO: 56603 - DNA, 20 bp, Artificial Sequence
  Description of Artificial Sequence: Synthetic oligonucleotide
  Target: ATXN1; (-) strand; PAM type: NRG; PAM sequence: AGG
caaaagttactgtctctgtg

SEQ ID NO: 56604 - DNA, 20 bp, Artificial Sequence
  Description of Artificial Sequence: Synthetic oligonucleotide
  Target: ATXN1; (-) strand; PAM type: NRG; PAM sequence: GAG
ccaaaagttactgtctctgt

SEQ ID NO: 56605 - DNA, 20 bp, Artificial Sequence
  Description of Artificial Sequence: Synthetic oligonucleotide
  Target: ATXN1; (-) strand; PAM type: NRG; PAM sequence: AAG
ttcttcaggcttttccccaa

SEQ ID NO: 56606 - DNA, 20 bp, Artificial Sequence
  Description of Artificial Sequence: Synthetic oligonucleotide
  Target: ATXN1; (-) strand; PAM type: NRG; PAM sequence: AGG
ctttctatttccctttcttc

SEQ ID NO: 56607 - DNA, 20 bp, Artificial Sequence
  Description of Artificial Sequence: Synthetic oligonucleotide
  Target: ATXN1; (-) strand; PAM type: NRG; PAM sequence: CAG
gctttctatttccctttctt

SEQ ID NO: 56608 - DNA, 20 bp, Artificial Sequence
  Description of Artificial Sequence: Synthetic oligonucleotide
  Target: ATXN1; (-) strand; PAM type: NRG; PAM sequence: CAG
tgtcaggaaggctcttcccc

SEQ ID NO: 56609 - DNA, 20 bp, Artificial Sequence
  Description of Artificial Sequence: Synthetic oligonucleotide
  Target: ATXN1; (-) strand; PAM type: NRG; PAM sequence: AGG
ttctgttctttctgtcagga

SEQ ID NO: 56610 - DNA, 20 bp, Artificial Sequence
  Description of Artificial Sequence: Synthetic oligonucleotide
  Target: ATXN1; (-) strand; PAM type: NRG; PAM sequence: AAG
cttctgttctttctgtcagg

SEQ ID NO: 56611 - DNA, 20 bp, Artificial Sequence
  Description of Artificial Sequence: Synthetic oligonucleotide
  Target: ATXN1; (-) strand; PAM type: NRG; PAM sequence: AGG
taccttctgttctttctgtc

SEQ ID NO: 56612 - DNA, 20 bp, Artificial Sequence
  Description of Artificial Sequence: Synthetic oligonucleotide
  Target: ATXN1; (-) strand; PAM type: NRG; PAM sequence: CAG
gtaccttctgttctttctgt

SEQ ID NO: 56613 - DNA, 20 bp, Artificial Sequence
  Description of Artificial Sequence: Synthetic oligonucleotide
  Target: ATXN1; (-) strand; PAM type: NRG; PAM sequence: TGG
aggagcccaccccaggacct

SEQ ID NO: 56614 - DNA, 20 bp, Artificial Sequence
  Description of Artificial Sequence: Synthetic oligonucleotide
  Target: ATXN1; (-) strand; PAM type: NRG; PAM sequence: AGG
accacacaggagcccacccc

SEQ ID NO: 56615 - DNA, 20 bp, Artificial Sequence
  Description of Artificial Sequence: Synthetic oligonucleotide
  Target: ATXN1; (-) strand; PAM type: NRG; PAM sequence: CAG
caccacacaggagcccaccc

SEQ ID NO: 56616 - DNA, 20 bp, Artificial Sequence
  Description of Artificial Sequence: Synthetic oligonucleotide
  Target: ATXN1; (-) strand; PAM type: NRG; PAM sequence: GAG
tcctccaacacaccacacag

SEQ ID NO: 56617 - DNA, 20 bp, Artificial Sequence
  Description of Artificial Sequence: Synthetic oligonucleotide
  Target: ATXN1; (-) strand; PAM type: NRG; PAM sequence: AGG
gttcctccaacacaccacac

SEQ ID NO: 56618 - DNA, 20 bp, Artificial Sequence
  Description of Artificial Sequence: Synthetic oligonucleotide
  Target: ATXN1; (-) strand; PAM type: NRG; PAM sequence: CAG
tgttcctccaacacaccaca

SEQ ID NO: 56619 - DNA, 20 bp, Artificial Sequence
  Description of Artificial Sequence: Synthetic oligonucleotide
  Target: ATXN1; (-) strand; PAM type: NRG; PAM sequence: TGG
tgccaggaacaccacctcga

SEQ ID NO: 56620 - DNA, 20 bp, Artificial Sequence
  Description of Artificial Sequence: Synthetic oligonucleotide
  Target: ATXN1; (-) strand; PAM type: NRG; PAM sequence: AGG
caccccctttactcagtgcc

SEQ ID NO: 56621 - DNA, 20 bp, Artificial Sequence
  Description of Artificial Sequence: Synthetic oligonucleotide
  Target: ATXN1; (-) strand; PAM type: NRG; PAM sequence: CAG
ccaccccctttactcagtgc

SEQ ID NO: 56622 - DNA, 20 bp, Artificial Sequence
  Description of Artificial Sequence: Synthetic oligonucleotide
  Target: ATXN1; (-) strand; PAM type: NRG; PAM sequence: CAG
tgctccccaccccctttact

SEQ ID NO: 56623 - DNA, 20 bp, Artificial Sequence
  Description of Artificial Sequence: Synthetic oligonucleotide
  Target: ATXN1; (-) strand; PAM type: NRG; PAM sequence: AAG
tcagactttattgtggctca

SEQ ID NO: 56624 - DNA, 20 bp, Artificial Sequence
  Description of Artificial Sequence: Synthetic oligonucleotide
  Target: ATXN1; (-) strand; PAM type: NRG; PAM sequence: TGG
aaggacctcagactttattg

SEQ ID NO: 56625 - DNA, 20 bp, Artificial Sequence
  Description of Artificial Sequence: Synthetic oligonucleotide
  Target: ATXN1; (-) strand; PAM type: NRG; PAM sequence: CAG
ctcactcagagtaaggacct

SEQ ID NO: 56626 - DNA, 20 bp, Artificial Sequence
  Description of Artificial Sequence: Synthetic oligonucleotide
  Target: ATXN1; (-) strand; PAM type: NRG; PAM sequence: AGG
ctctcagctcactcagagta

SEQ ID NO: 56627 - DNA, 20 bp, Artificial Sequence
  Description of Artificial Sequence: Synthetic oligonucleotide
  Target: ATXN1; (-) strand; PAM type: NRG; PAM sequence: AAG
cctctcagctcactcagagt

SEQ ID NO: 56628 - DNA, 20 bp, Artificial Sequence
  Description of Artificial Sequence: Synthetic oligonucleotide
  Target: ATXN1; (-) strand; PAM type: NRG; PAM sequence: GAG
agtgcctctcagctcactca

SEQ ID NO: 56629 - DNA, 20 bp, Artificial Sequence
  Description of Artificial Sequence: Synthetic oligonucleotide
  Target: ATXN1; (-) strand; PAM type: NRG; PAM sequence: CAG
ccagtgcctctcagctcact

SEQ ID NO: 56630 - DNA, 20 bp, Artificial Sequence
  Description of Artificial Sequence: Synthetic oligonucleotide
  Target: ATXN1; (-) strand; PAM type: NRG; PAM sequence: CAG
caaaaccctccagtgcctct

SEQ ID NO: 56631 - DNA, 20 bp, Artificial Sequence
  Description of Artificial Sequence: Synthetic oligonucleotide
  Target: ATXN1; (-) strand; PAM type: NRG; PAM sequence: CAG
ctcctctgatcaaaaccctc

SEQ ID NO: 56632 - DNA, 20 bp, Artificial Sequence
  Description of Artificial Sequence: Synthetic oligonucleotide
  Target: ATXN1; (-) strand; PAM type: NRG; PAM sequence: CAG
gaactggtgaaaatgtagtc

SEQ ID NO: 56633 - DNA, 20 bp, Artificial Sequence
  Description of Artificial Sequence: Synthetic oligonucleotide
  Target: ATXN1; (-) strand; PAM type: NRG; PAM sequence: TAG
agcatgaactggtgaaaatg

SEQ ID NO: 56634 - DNA, 20 bp, Artificial Sequence
  Description of Artificial Sequence: Synthetic oligonucleotide
  Target: ATXN1; (-) strand; PAM type: NRG; PAM sequence: TGG
atgcaacagccagcatgaac

SEQ ID NO: 56635 - DNA, 20 bp, Artificial Sequence
  Description of Artificial Sequence: Synthetic oligonucleotide
  Target: ATXN1; (-) strand; PAM type: NRG; PAM sequence: CAG
tatctcctccatgcaacagc

SEQ ID NO: 56636 - DNA, 20 bp, Artificial Sequence
  Description of Artificial Sequence: Synthetic oligonucleotide
  Target: ATXN1; (-) strand; PAM type: NRG; PAM sequence: CAG
agaatatctcctccatgcaa

SEQ ID NO: 56637 - DNA, 20 bp, Artificial Sequence
  Description of Artificial Sequence: Synthetic oligonucleotide
  Target: ATXN1; (-) strand; PAM type: NRG; PAM sequence: CAG
gtagtctctctgcttcttct

SEQ ID NO: 56638 - DNA, 20 bp, Artificial Sequence
  Description of Artificial Sequence: Synthetic oligonucleotide
  Target: ATXN1; (-) strand; PAM type: NRG; PAM sequence: TAG
ttcatcagtaacctcctgag

SEQ ID NO: 56639 - DNA, 20 bp, Artificial Sequence
  Description of Artificial Sequence: Synthetic oligonucleotide
  Target: ATXN1; (-) strand; PAM type: NRG; PAM sequence: GAG
gagttcatcagtaacctcct

SEQ ID NO: 56640 - DNA, 20 bp, Artificial Sequence
  Description of Artificial Sequence: Synthetic oligonucleotide
  Target: ATXN1; (-) strand; PAM type: NRG; PAM sequence: CAG
atctcttggctggagttcat

SEQ ID NO: 56641 - DNA, 20 bp, Artificial Sequence
  Description of Artificial Sequence: Synthetic oligonucleotide
  Target: ATXN1; (-) strand; PAM type: NRG; PAM sequence: GAG
gtgccaccatctcttggctg

SEQ ID NO: 56642 - DNA, 20 bp, Artificial Sequence
  Description of Artificial Sequence: Synthetic oligonucleotide
  Target: ATXN1; (-) strand; PAM type: NRG; PAM sequence: TGG
cggtgccaccatctcttggc

SEQ ID NO: 56643 - DNA, 20 bp, Artificial Sequence
  Description of Artificial Sequence: Synthetic oligonucleotide
  Target: ATXN1; (-) strand; PAM type: NRG; PAM sequence: TGG
tccacggtgccaccatctct

SEQ ID NO: 56644 - DNA, 20 bp, Artificial Sequence
  Description of Artificial Sequence: Synthetic oligonucleotide
  Target: ATXN1; (-) strand; PAM type: NRG; PAM sequence: CGG
tacacaattctgctggtcca

SEQ ID NO: 56645 - DNA, 20 bp, Artificial Sequence
  Description of Artificial Sequence: Synthetic oligonucleotide
  Target: ATXN1; (-) strand; PAM type: NRG; PAM sequence: TGG
tttctcctacacaattctgc

SEQ ID NO: 56646 - DNA, 20 bp, Artificial Sequence
  Description of Artificial Sequence: Synthetic oligonucleotide
  Target: ATXN1; (-) strand; PAM type: NRG; PAM sequence: CAG
ccttccagttactcaggcca

SEQ ID NO: 56647 - DNA, 20 bp, Artificial Sequence
  Description of Artificial Sequence: Synthetic oligonucleotide
  Target: ATXN1; (-) strand; PAM type: NRG; PAM sequence: AGG
ccatctccttccagttactc

SEQ ID NO: 56648 - DNA, 20 bp, Artificial Sequence
  Description of Artificial Sequence: Synthetic oligonucleotide
  Target: ATXN1; (-) strand; PAM type: NRG; PAM sequence: CAG
cccatctccttccagttact

SEQ ID NO: 56649 - DNA, 20 bp, Artificial Sequence
  Description of Artificial Sequence: Synthetic oligonucleotide
  Target: ATXN1; (-) strand; PAM type: NRG; PAM sequence: CAG
actgccttcccatctccttc

SEQ ID NO: 56650 - DNA, 20 bp, Artificial Sequence
  Description of Artificial Sequence: Synthetic oligonucleotide
  Target: ATXN1; (-) strand; PAM type: NRG; PAM sequence: GGG
gtctcttaactgccttcagt

SEQ ID NO: 56651 - DNA, 20 bp, Artificial Sequence
  Description of Artificial Sequence: Synthetic oligonucleotide
  Target: ATXN1; (-) strand; PAM type: NRG; PAM sequence: TGG
tgtctcttaactgccttcag

SEQ ID NO: 56652 - DNA, 20 bp, Artificial Sequence
  Description of Artificial Sequence: Synthetic oligonucleotide
  Target: ATXN1; (-) strand; PAM type: NRG; PAM sequence: CAG
cactgtctcttaactgcctt

SEQ ID NO: 56653 - DNA, 20 bp, Artificial Sequence
  Description of Artificial Sequence: Synthetic oligonucleotide
  Target: ATXN1; (-) strand; PAM type: NRG; PAM sequence: AGG
gggccttttctttgaacctc

SEQ ID NO: 56654 - DNA, 20 bp, Artificial Sequence
  Description of Artificial Sequence: Synthetic oligonucleotide
  Target: ATXN1; (-) strand; PAM type: NRG; PAM sequence: CAG
tgggccttttctttgaacct

SEQ ID NO: 56655 - DNA, 20 bp, Artificial Sequence
  Description of Artificial Sequence: Synthetic oligonucleotide
  Target: ATXN1; (-) strand; PAM type: NRG; PAM sequence: GGG
actgacaccttctccagcct

SEQ ID NO: 56656 - DNA, 20 bp, Artificial Sequence
  Description of Artificial Sequence: Synthetic oligonucleotide
  Target: ATXN1; (-) strand; PAM type: NRG; PAM sequence: TGG
aactgacaccttctccagcc

SEQ ID NO: 56657 - DNA, 20 bp, Artificial Sequence
  Description of Artificial Sequence: Synthetic oligonucleotide
  Target: ATXN1; (-) strand; PAM type: NRG; PAM sequence: CAG
ctcaaaactgacaccttctc

SEQ ID NO: 56658 - DNA, 20 bp, Artificial Sequence
  Description of Artificial Sequence: Synthetic oligonucleotide
  Target: ATXN1; (-) strand; PAM type: NRG; PAM sequence: TGG
cagggctcagtcctcaaacc

SEQ ID NO: 56659 - DNA, 20 bp, Artificial Sequence
  Description of Artificial Sequence: Synthetic oligonucleotide
  Target: ATXN1; (-) strand; PAM type: NRG; PAM sequence: CAG
tgtgagagagcctcagggct

SEQ ID NO: 56660 - DNA, 20 bp, Artificial Sequence
  Description of Artificial Sequence: Synthetic oligonucleotide
  Target: ATXN1; (-) strand; PAM type: NRG; PAM sequence: GGG
ccaaatgtgagagagcctca

SEQ ID NO: 56661 - DNA, 20 bp, Artificial Sequence
  Description of Artificial Sequence: Synthetic oligonucleotide
  Target: ATXN1; (-) strand; PAM type: NRG; PAM sequence: AGG
tccaaatgtgagagagcctc

SEQ ID NO: 56662 - DNA, 20 bp, Artificial Sequence
  Description of Artificial Sequence: Synthetic oligonucleotide
  Target: ATXN1; (-) strand; PAM type: NRG; PAM sequence: CAG
ttccaaatgtgagagagcct

SEQ ID NO: 56663 - DNA, 20 bp, Artificial Sequence
  Description of Artificial Sequence: Synthetic oligonucleotide
  Target: ATXN1; (-) strand; PAM type: NRG; PAM sequence: GAG
tctggtttccaaatgtgaga

SEQ ID NO: 56664 - DNA, 20 bp, Artificial Sequence
  Description of Artificial Sequence: Synthetic oligonucleotide
  Target: ATXN1; (-) strand; PAM type: NRG; PAM sequence: GAG
cctctggtttccaaatgtga

SEQ ID NO: 56665 - DNA, 20 bp, Artificial Sequence
  Description of Artificial Sequence: Synthetic oligonucleotide
  Target: ATXN1; (-) strand; PAM type: NRG; PAM sequence: GAG
agcctctggtttccaaatgt

SEQ ID NO: 56666 - DNA, 20 bp, Artificial Sequence
  Description of Artificial Sequence: Synthetic oligonucleotide
  Target: ATXN1; (-) strand; PAM type: NRG; PAM sequence: TGG
tagcggaaagtagcagcctc

SEQ ID NO: 56667 - DNA, 20 bp, Artificial Sequence
  Description of Artificial Sequence: Synthetic oligonucleotide
  Target: ATXN1; (-) strand; PAM type: NRG; PAM sequence: CAG
tggaaagtagcggaaagtag

SEQ ID NO: 56668 - DNA, 20 bp, Artificial Sequence
  Description of Artificial Sequence: Synthetic oligonucleotide
  Target: ATXN1; (-) strand; PAM type: NRG; PAM sequence: TAG
gagtggaaagtagcggaaag

SEQ ID NO: 56669 - DNA, 20 bp, Artificial Sequence
  Description of Artificial Sequence: Synthetic oligonucleotide
  Target: ATXN1; (-) strand; PAM type: NRG; PAM sequence: AAG
tcagagtggaaagtagcgga

SEQ ID NO: 56670 - DNA, 20 bp, Artificial Sequence
  Description of Artificial Sequence: Synthetic oligonucleotide
  Target: ATXN1; (-) strand; PAM type: NRG; PAM sequence: CGG
acaatcagagtggaaagtag

SEQ ID NO: 56671 - DNA, 20 bp, Artificial Sequence
  Description of Artificial Sequence: Synthetic oligonucleotide
  Target: ATXN1; (-) strand; PAM type: NRG; PAM sequence: TAG
ggaacaatcagagtggaaag

SEQ ID NO: 56672 - DNA, 20 bp, Artificial Sequence
  Description of Artificial Sequence: Synthetic oligonucleotide
  Target: ATXN1; (-) strand; PAM type: NRG; PAM sequence: AAG
agtggaacaatcagagtgga

SEQ ID NO: 56673 - DNA, 20 bp, Artificial Sequence
  Description of Artificial Sequence: Synthetic oligonucleotide
  Target: ATXN1; (-) strand; PAM type: NRG; PAM sequence: TGG
cacaagtggaacaatcagag

SEQ ID NO: 56674 - DNA, 20 bp, Artificial Sequence
  Description of Artificial Sequence: Synthetic oligonucleotide
  Target: ATXN1; (-) strand; PAM type: NRG; PAM sequence: GAG
aatcacaagtggaacaatca

SEQ ID NO: 56675 - DNA, 20 bp, Artificial Sequence
  Description of Artificial Sequence: Synthetic oligonucleotide
  Target: ATXN1; (-) strand; PAM type: NRG; PAM sequence: CAG
ctaatcacaagtggaacaat

SEQ ID NO: 56676 - DNA, 20 bp, Artificial Sequence
  Description of Artificial Sequence: Synthetic oligonucleotide
  Target: ATXN1; (-) strand; PAM type: NRG; PAM sequence: TGG
cgatacagcctaatcacaag

SEQ ID NO: 56677 - DNA, 20 bp, Artificial Sequence
  Description of Artificial Sequence: Synthetic oligonucleotide
  Target: ATXN1; (-) strand; PAM type: NRG; PAM sequence: AAG
agccgatacagcctaatcac

SEQ ID NO: 56678 - DNA, 20 bp, Artificial Sequence
  Description of Artificial Sequence: Synthetic oligonucleotide
  Target: ATXN1; (-) strand; PAM type: NRG; PAM sequence: CAG
actcccacccacagccgata

SEQ ID NO: 56679 - DNA, 20 bp, Artificial Sequence
  Description of Artificial Sequence: Synthetic oligonucleotide
  Target: ATXN1; (-) strand; PAM type: NRG; PAM sequence: CAG
ctgatacgcactcccaccca

SEQ ID NO: 56680 - DNA, 20 bp, Artificial Sequence
  Description of Artificial Sequence: Synthetic oligonucleotide
  Target: ATXN1; (-) strand; PAM type: NRG; PAM sequence: TGG
caagtagccttccacggggg

SEQ ID NO: 56681 - DNA, 20 bp, Artificial Sequence
  Description of Artificial Sequence: Synthetic oligonucleotide
  Target: ATXN1; (-) strand; PAM type: NRG; PAM sequence: GGG
catcaagtagccttccacgg

SEQ ID NO: 56682 - DNA, 20 bp, Artificial Sequence
  Description of Artificial Sequence: Synthetic oligonucleotide
  Target: ATXN1; (-) strand; PAM type: NRG; PAM sequence: GGG
gcatcaagtagccttccacg

SEQ ID NO: 56683 - DNA, 20 bp, Artificial Sequence
  Description of Artificial Sequence: Synthetic oligonucleotide
  Target: ATXN1; (-) strand; PAM type: NRG; PAM sequence: GGG
cgcatcaagtagccttccac

SEQ ID NO: 56684 - DNA, 20 bp, Artificial Sequence
  Description of Artificial Sequence: Synthetic oligonucleotide
  Target: ATXN1; (-) strand; PAM type: NRG; PAM sequence: CGG
ccgcatcaagtagccttcca

SEQ ID NO: 56685 - DNA, 20 bp, Artificial Sequence
  Description of Artificial Sequence: Synthetic oligonucleotide
  Target: ATXN1; (-) strand; PAM type: NRG; PAM sequence: TAG
tggaacttatccgcatcaag

SEQ ID NO: 56686 - DNA, 20 bp, Artificial Sequence
  Description of Artificial Sequence: Synthetic oligonucleotide
  Target: ATXN1; (-) strand; PAM type: NRG; PAM sequence: AAG
ggatggaacttatccgcatc

SEQ ID NO: 56687 - DNA, 20 bp, Artificial Sequence
  Description of Artificial Sequence: Synthetic oligonucleotide
  Target: ATXN1; (-) strand; PAM type: NRG; PAM sequence: TGG
cttttgggtttgccagtgga

SEQ ID NO: 56688 - DNA, 20 bp, Artificial Sequence
  Description of Artificial Sequence: Synthetic oligonucleotide
  Target: ATXN1; (-) strand; PAM type: NRG; PAM sequence: TGG
gtagcttttgggtttgccag

SEQ ID NO: 56689 - DNA, 20 bp, Artificial Sequence
  Description of Artificial Sequence: Synthetic oligonucleotide
  Target: ATXN1; (-) strand; PAM type: NRG; PAM sequence: CAG
tgtgtagcttttgggtttgc

SEQ ID NO: 56690 - DNA, 20 bp, Artificial Sequence
  Description of Artificial Sequence: Synthetic oligonucleotide
  Target: ATXN1; (-) strand; PAM type: NRG; PAM sequence: GGG
tgtagacatgtgtagctttt

SEQ ID NO: 56691 - DNA, 20 bp, Artificial Sequence
  Description of Artificial Sequence: Synthetic oligonucleotide
  Target: ATXN1; (-) strand; PAM type: NRG; PAM sequence: TGG
atgtagacatgtgtagcttt

SEQ ID NO: 56692 - DNA, 20 bp, Artificial Sequence
  Description of Artificial Sequence: Synthetic oligonucleotide
  Target: ATXN1; (-) strand; PAM type: NRG; PAM sequence: TAG
ccttcccatgtagacatgtg

SEQ ID NO: 56693 - DNA, 20 bp, Artificial Sequence
  Description of Artificial Sequence: Synthetic oligonucleotide
  Target: ATXN1; (-) strand; PAM type: NRG; PAM sequence: TAG
gccgcacagcccttcccatg

SEQ ID NO: 56694 - DNA, 20 bp, Artificial Sequence
  Description of Artificial Sequence: Synthetic oligonucleotide
  Target: ATXN1; (-) strand; PAM type: NRG; PAM sequence: CAG
tgctgtgcacctgtgccgca

SEQ ID NO: 56695 - DNA, 20 bp, Artificial Sequence
  Description of Artificial Sequence: Synthetic oligonucleotide
  Target: ATXN1; (-) strand; PAM type: NRG; PAM sequence: GAG
aacatcaggggaagagcgct

SEQ ID NO: 56696 - DNA, 20 bp, Artificial Sequence
  Description of Artificial Sequence: Synthetic oligonucleotide
  Target: ATXN1; (-) strand; PAM type: NRG; PAM sequence: GAG
gagcagaaacatcaggggaa

SEQ ID NO: 56697 - DNA, 20 bp, Artificial Sequence
  Description of Artificial Sequence: Synthetic oligonucleotide
  Target: ATXN1; (-) strand; PAM type: NRG; PAM sequence: AAG
aagagcagaaacatcagggg

SEQ ID NO: 56698 - DNA, 20 bp, Artificial Sequence
  Description of Artificial Sequence: Synthetic oligonucleotide
  Target: ATXN1; (-) strand; PAM type: NRG; PAM sequence: GGG
gggaagagcagaaacatcag

SEQ ID NO: 56699 - DNA, 20 bp, Artificial Sequence
  Description of Artificial Sequence: Synthetic oligonucleotide
  Target: ATXN1; (-) strand; PAM type: NRG; PAM sequence: GGG
tgggaagagcagaaacatca

SEQ ID NO: 56700 - DNA, 20 bp, Artificial Sequence
  Description of Artificial Sequence: Synthetic oligonucleotide
  Target: ATXN1; (-) strand; PAM type: NRG; PAM sequence: AGG
atgggaagagcagaaacatc

SEQ ID NO: 56701 - DNA, 20 bp, Artificial Sequence
  Description of Artificial Sequence: Synthetic oligonucleotide
  Target: ATXN1; (-) strand; PAM type: NRG; PAM sequence: CAG
catgggaagagcagaaacat

SEQ ID NO: 56702 - DNA, 20 bp, Artificial Sequence
  Description of Artificial Sequence: Synthetic oligonucleotide
  Target: ATXN1; (-) strand; PAM type: NRG; PAM sequence: CAG
tccttagtgcatgggaagag

SEQ ID NO: 56703 - DNA, 20 bp, Artificial Sequence
  Description of Artificial Sequence: Synthetic oligonucleotide
  Target: ATXN1; (-) strand; PAM type: NRG; PAM sequence: GAG
agctccttagtgcatgggaa

SEQ ID NO: 56704 - DNA, 20 bp, Artificial Sequence
  Description of Artificial Sequence: Synthetic oligonucleotide
  Target: ATXN1; (-) strand; PAM type: NRG; PAM sequence: AAG
tcagctccttagtgcatggg

SEQ ID NO: 56705 - DNA, 20 bp, Artificial Sequence
  Description of Artificial Sequence: Synthetic oligonucleotide
  Target: ATXN1; (-) strand; PAM type: NRG; PAM sequence: GGG
tgctcagctccttagtgcat

SEQ ID NO: 56706 - DNA, 20 bp, Artificial Sequence
  Description of Artificial Sequence: Synthetic oligonucleotide
  Target: ATXN1; (-) strand; PAM type: NRG; PAM sequence: TGG
ttgctcagctccttagtgca

SEQ ID NO: 56707 - DNA, 20 bp, Artificial Sequence
  Description of Artificial Sequence: Synthetic oligonucleotide
  Target: ATXN1; (-) strand; PAM type: NRG; PAM sequence: TAG
ttgctgtttgctcagctcct

SEQ ID NO: 56708 - DNA, 20 bp, Artificial Sequence
  Description of Artificial Sequence: Synthetic oligonucleotide
  Target: ATXN1; (-) strand; PAM type: NRG; PAM sequence: CAG
cttctgacttgctgtttgct

SEQ ID NO: 56709 - DNA, 20 bp, Artificial Sequence
  Description of Artificial Sequence: Synthetic oligonucleotide
  Target: ATXN1; (-) strand; PAM type: NRG; PAM sequence: TGG
cctctggcctctgcttacca

SEQ ID NO: 56710 - DNA, 20 bp, Artificial Sequence
  Description of Artificial Sequence: Synthetic oligonucleotide
  Target: ATXN1; (-) strand; PAM type: NRG; PAM sequence: TGG
ttttaattcccagccacctc

SEQ ID NO: 56711 - DNA, 20 bp, Artificial Sequence
  Description of Artificial Sequence: Synthetic oligonucleotide
  Target: ATXN1; (-) strand; PAM type: NRG; PAM sequence: CAG
taagttgtccttttaattcc

SEQ ID NO: 56712 - DNA, 20 bp, Artificial Sequence
  Description of Artificial Sequence: Synthetic oligonucleotide
  Target: ATXN1; (-) strand; PAM type: NRG; PAM sequence: AAG
tggcagaacagtaaggttat

SEQ ID NO: 56713 - DNA, 20 bp, Artificial Sequence
  Description of Artificial Sequence: Synthetic oligonucleotide
  Target: ATXN1; (-) strand; PAM type: NRG; PAM sequence: AGG
aggaatttggcagaacagta

SEQ ID NO: 56714 - DNA, 20 bp, Artificial Sequence
  Description of Artificial Sequence: Synthetic oligonucleotide
  Target: ATXN1; (-) strand; PAM type: NRG; PAM sequence: AAG
taggaatttggcagaacagt

SEQ ID NO: 56715 - DNA, 20 bp, Artificial Sequence
  Description of Artificial Sequence: Synthetic oligonucleotide
  Target: ATXN1; (-) strand; PAM type: NRG; PAM sequence: CAG
tctgtaggaatttggcagaa

SEQ ID NO: 56716 - DNA, 20 bp, Artificial Sequence
  Description of Artificial Sequence: Synthetic oligonucleotide
  Target: ATXN1; (-) strand; PAM type: NRG; PAM sequence: CAG
tcagttctgtaggaatttgg

SEQ ID NO: 56717 - DNA, 20 bp, Artificial Sequence
  Description of Artificial Sequence: Synthetic oligonucleotide
  Target: ATXN1; (-) strand; PAM type: NRG; PAM sequence: TGG
ttatcagttctgtaggaatt

SEQ ID NO: 56718 - DNA, 20 bp, Artificial Sequence
  Description of Artificial Sequence: Synthetic oligonucleotide
  Target: ATXN1; (-) strand; PAM type: NRG; PAM sequence: AGG
gggagtcttatcagttctgt

SEQ ID NO: 56719 - DNA, 20 bp, Artificial Sequence
  Description of Artificial Sequence: Synthetic oligonucleotide
  Target: ATXN1; (-) strand; PAM type: NRG; PAM sequence: TAG
agggagtcttatcagttctg

SEQ ID NO: 56720 - DNA, 20 bp, Artificial Sequence
  Description of Artificial Sequence: Synthetic oligonucleotide
  Target: ATXN1; (-) strand; PAM type: NRG; PAM sequence: CAG
aagtatccagggagtcttat

SEQ ID NO: 56721 - DNA, 20 bp, Artificial Sequence
  Description of Artificial Sequence: Synthetic oligonucleotide
  Target: ATXN1; (-) strand; PAM type: NRG; PAM sequence: GAG
atacaacaaaagtatccagg

SEQ ID NO: 56722 - DNA, 20 bp, Artificial Sequence
  Description of Artificial Sequence: Synthetic oligonucleotide
  Target: ATXN1; (-) strand; PAM type: NRG; PAM sequence: GGG
taatacaacaaaagtatcca

SEQ ID NO: 56723 - DNA, 20 bp, Artificial Sequence
  Description of Artificial Sequence: Synthetic oligonucleotide
  Target: ATXN1; (-) strand; PAM type: NRG; PAM sequence: AGG
ataatacaacaaaagtatcc

SEQ ID NO: 56724 - DNA, 20 bp, Artificial Sequence
  Description of Artificial Sequence: Synthetic oligonucleotide
  Target: ATXN1; (-) strand; PAM type: NRG; PAM sequence: CAG
aataatacaacaaaagtatc

SEQ ID NO: 56725 - DNA, 20 bp, Artificial Sequence
  Description of Artificial Sequence: Synthetic oligonucleotide
  Target: ATXN1; (-) strand; PAM type: NRG; PAM sequence: AAG
gttagaaaataatacaacaa

SEQ ID NO: 56726 - DNA, 20 bp, Artificial Sequence
  Description of Artificial Sequence: Synthetic oligonucleotide
  Target: ATXN1; (-) strand; PAM type: NRG; PAM sequence: TAG
ggattatctatgttttctgt

SEQ ID NO: 56727 - DNA, 20 bp, Artificial Sequence
  Description of Artificial Sequence: Synthetic oligonucleotide
  Target: ATXN1; (-) strand; PAM type: NRG; PAM sequence: TGG
aggaagagacacaaggagct

SEQ ID NO: 56728 - DNA, 20 bp, Artificial Sequence
  Description of Artificial Sequence: Synthetic oligonucleotide
  Target: ATXN1; (-) strand; PAM type: NRG; PAM sequence: GAG
aaagcaggaagagacacaag

SEQ ID NO: 56729 - DNA, 20 bp, Artificial Sequence
  Description of Artificial Sequence: Synthetic oligonucleotide
  Target: ATXN1; (-) strand; PAM type: NRG; PAM sequence: AGG
ttaaagcaggaagagacaca

SEQ ID NO: 56730 - DNA, 20 bp, Artificial Sequence
  Description of Artificial Sequence: Synthetic oligonucleotide
  Target: ATXN1; (-) strand; PAM type: NRG; PAM sequence: AAG
attaaagcaggaagagacac

SEQ ID NO: 56731 - DNA, 20 bp, Artificial Sequence
  Description of Artificial Sequence: Synthetic oligonucleotide
  Target: ATXN1; (-) strand; PAM type: NRG; PAM sequence: GAG
aattataattaaagcaggaa

SEQ ID NO: 56732 - DNA, 20 bp, Artificial Sequence
  Description of Artificial Sequence: Synthetic oligonucleotide
  Target: ATXN1; (-) strand; PAM type: NRG; PAM sequence: AAG
caaattataattaaagcagg

SEQ ID NO: 56733 - DNA, 20 bp, Artificial Sequence
  Description of Artificial Sequence: Synthetic oligonucleotide
  Target: ATXN1; (-) strand; PAM type: NRG; PAM sequence: AGG
aatcaaattataattaaagc

SEQ ID NO: 56734 - DNA, 20 bp, Artificial Sequence
  Description of Artificial Sequence: Synthetic oligonucleotide
  Target: ATXN1; (-) strand; PAM type: NRG; PAM sequence: CAG
taatcaaattataattaaag

SEQ ID NO: 56735 - DNA, 20 bp, Artificial Sequence
  Description of Artificial Sequence: Synthetic oligonucleotide
  Target: ATXN1; (-) strand; PAM type: NRG; PAM sequence: AAG
agttaatcaaattataatta

SEQ ID NO: 56736 - DNA, 20 bp, Artificial Sequence
  Description of Artificial Sequence: Synthetic oligonucleotide
  Target: ATXN1; (-) strand; PAM type: NRG; PAM sequence: AAG
agggaataccaataatttgt

SEQ ID NO: 56737 - DNA, 20 bp, Artificial Sequence
  Description of Artificial Sequence: Synthetic oligonucleotide
  Target: ATXN1; (-) strand; PAM type: NRG; PAM sequence: GGG
tcaaatgggctggaacaaaa

SEQ ID NO: 56738 - DNA, 20 bp, Artificial Sequence
  Description of Artificial Sequence: Synthetic oligonucleotide
  Target: ATXN1; (-) strand; PAM type: NRG; PAM sequence: AGG
ctcaaatgggctggaacaaa

SEQ ID NO: 56739 - DNA, 20 bp, Artificial Sequence
  Description of Artificial Sequence: Synthetic oligonucleotide
  Target: ATXN1; (-) strand; PAM type: NRG; PAM sequence: AAG
cctcaaatgggctggaacaa

SEQ ID NO: 56740 - DNA, 20 bp, Artificial Sequence
  Description of Artificial Sequence: Synthetic oligonucleotide
  Target: ATXN1; (-) strand; PAM type: NRG; PAM sequence: TGG
aattatatcctcaaatgggc

SEQ ID NO: 56741 - DNA, 20 bp, Artificial Sequence
  Description of Artificial Sequence: Synthetic oligonucleotide
  Target: ATXN1; (-) strand; PAM type: NRG; PAM sequence: GGG
gagaaattatatcctcaaat

SEQ ID NO: 56742 - DNA, 20 bp, Artificial Sequence
  Description of Artificial Sequence: Synthetic oligonucleotide
  Target: ATXN1; (-) strand; PAM type: NRG; PAM sequence: TGG
agagaaattatatcctcaaa

SEQ ID NO: 56743 - DNA, 20 bp, Artificial Sequence
  Description of Artificial Sequence: Synthetic oligonucleotide
  Target: ATXN1; (-) strand; PAM type: NRG; PAM sequence: GAG
tgcatttaggaagagatgaa

SEQ ID NO: 56744 - DNA, 20 bp, Artificial Sequence
  Description of Artificial Sequence: Synthetic oligonucleotide
  Target: ATXN1; (-) strand; PAM type: NRG; PAM sequence: AAG
tatgcatttaggaagagatg

SEQ ID NO: 56745 - DNA, 20 bp, Artificial Sequence
  Description of Artificial Sequence: Synthetic oligonucleotide
  Target: ATXN1; (-) strand; PAM type: NRG; PAM sequence: GAG
ccaacttatgcatttaggaa

SEQ ID NO: 56746 - DNA, 20 bp, Artificial Sequence
  Description of Artificial Sequence: Synthetic oligonucleotide
  Target: ATXN1; (-) strand; PAM type: NRG; PAM sequence: AAG
agccaacttatgcatttagg

SEQ ID NO: 56747 - DNA, 20 bp, Artificial Sequence
  Description of Artificial Sequence: Synthetic oligonucleotide
  Target: ATXN1; (-) strand; PAM type: NRG; PAM sequence: AGG
ctgagccaacttatgcattt

SEQ ID NO: 56748 - DNA, 20 bp, Artificial Sequence
  Description of Artificial Sequence: Synthetic oligonucleotide
  Target: ATXN1; (-) strand; PAM type: NRG; PAM sequence: TAG
gctgagccaacttatgcatt

SEQ ID NO: 56749 - DNA, 20 bp, Artificial Sequence
  Description of Artificial Sequence: Synthetic oligonucleotide
  Target: ATXN1; (-) strand; PAM type: NRG; PAM sequence: GAG
aagtaattatactttatgct

SEQ ID NO: 56750 - DNA, 20 bp, Artificial Sequence
  Description of Artificial Sequence: Synthetic oligonucleotide
  Target: ATXN1; (-) strand; PAM type: NRG; PAM sequence: AAG
acctagcttccatggttatc

SEQ ID NO: 56751 - DNA, 20 bp, Artificial Sequence
  Description of Artificial Sequence: Synthetic oligonucleotide
  Target: ATXN1; (-) strand; PAM type: NRG; PAM sequence: TGG
tctctgctacctagcttcca

SEQ ID NO: 56752 - DNA, 20 bp, Artificial Sequence
  Description of Artificial Sequence: Synthetic oligonucleotide
  Target: ATXN1; (-) strand; PAM type: NRG; PAM sequence: TAG
tccttacactctctgctacc

SEQ ID NO: 56753 - DNA, 20 bp, Artificial Sequence
  Description of Artificial Sequence: Synthetic oligonucleotide
  Target: ATXN1; (-) strand; PAM type: NRG; PAM sequence: AAG
agtgcatttcaaaatacagg

SEQ ID NO: 56754 - DNA, 20 bp, Artificial Sequence
  Description of Artificial Sequence: Synthetic oligonucleotide
  Target: ATXN1; (-) strand; PAM type: NRG; PAM sequence: AGG
gacagtgcatttcaaaatac

SEQ ID NO: 56755 - DNA, 20 bp, Artificial Sequence
  Description of Artificial Sequence: Synthetic oligonucleotide
  Target: ATXN1; (-) strand; PAM type: NRG; PAM sequence: CAG
ggacagtgcatttcaaaata

SEQ ID NO: 56756 - DNA, 20 bp, Artificial Sequence
  Description of Artificial Sequence: Synthetic oligonucleotide
  Target: ATXN1; (-) strand; PAM type: NRG; PAM sequence: CAG
ccccagacaaggtccatgga

SEQ ID NO: 56757 - DNA, 20 bp, Artificial Sequence
  Description of Artificial Sequence: Synthetic oligonucleotide
  Target: ATXN1; (-) strand; PAM type: NRG; PAM sequence: TGG
tcttccccagacaaggtcca

SEQ ID NO: 56758 - DNA, 20 bp, Artificial Sequence
  Description of Artificial Sequence: Synthetic oligonucleotide
  Target: ATXN1; (-) strand; PAM type: NRG; PAM sequence: AGG
ggcaccctcttccccagaca

SEQ ID NO: 56759 - DNA, 20 bp, Artificial Sequence
  Description of Artificial Sequence: Synthetic oligonucleotide
  Target: ATXN1; (-) strand; PAM type: NRG; PAM sequence: AAG
tggcaccctcttccccagac

SEQ ID NO: 56760 - DNA, 20 bp, Artificial Sequence
  Description of Artificial Sequence: Synthetic oligonucleotide
  Target: ATXN1; (-) strand; PAM type: NRG; PAM sequence: CAG
tagtgtggcaccctcttccc

SEQ ID NO: 56761 - DNA, 20 bp, Artificial Sequence
  Description of Artificial Sequence: Synthetic oligonucleotide
  Target: ATXN1; (-) strand; PAM type: NRG; PAM sequence: TGG
agccaaggccagaattagtg

SEQ ID NO: 56762 - DNA, 20 bp, Artificial Sequence
  Description of Artificial Sequence: Synthetic oligonucleotide
  Target: ATXN1; (-) strand; PAM type: NRG; PAM sequence: TAG
atagtagccaaggccagaat

SEQ ID NO: 56763 - DNA, 20 bp, Artificial Sequence
  Description of Artificial Sequence: Synthetic oligonucleotide
  Target: ATXN1; (-) strand; PAM type: NRG; PAM sequence: CAG
acacccatagtagccaaggc

SEQ ID NO: 56764 - DNA, 20 bp, Artificial Sequence
  Description of Artificial Sequence: Synthetic oligonucleotide
  Target: ATXN1; (-) strand; PAM type: NRG; PAM sequence: AGG
ttgaacacccatagtagcca

SEQ ID NO: 56765 - DNA, 20 bp, Artificial Sequence
  Description of Artificial Sequence: Synthetic oligonucleotide
  Target: ATXN1; (-) strand; PAM type: NRG; PAM sequence: AAG
cttgaacacccatagtagcc

SEQ ID NO: 56766 - DNA, 20 bp, Artificial Sequence
  Description of Artificial Sequence: Synthetic oligonucleotide
  Target: ATXN1; (-) strand; PAM type: NRG; PAM sequence: TAG
tgcttcttgaacacccatag

SEQ ID NO: 56767 - DNA, 20 bp, Artificial Sequence
  Description of Artificial Sequence: Synthetic oligonucleotide
  Target: ATXN1; (-) strand; PAM type: NRG; PAM sequence: TAG
tgctgcttcttgaacaccca

SEQ ID NO: 56768 - DNA, 20 bp, Artificial Sequence
  Description of Artificial Sequence: Synthetic oligonucleotide
  Target: ATXN1; (-) strand; PAM type: NRG; PAM sequence: AAG
ccataagaagtcccgaccag

SEQ ID NO: 56769 - DNA, 20 bp, Artificial Sequence
  Description of Artificial Sequence: Synthetic oligonucleotide
  Target: ATXN1; (-) strand; PAM type: NRG; PAM sequence: CAG
ctgccataagaagtcccgac

SEQ ID NO: 56770 - DNA, 20 bp, Artificial Sequence
  Description of Artificial Sequence: Synthetic oligonucleotide
  Target: ATXN1; (-) strand; PAM type: NRG; PAM sequence: AAG
ttggggaccactgccataag

SEQ ID NO: 56771 - DNA, 20 bp, Artificial Sequence
  Description of Artificial Sequence: Synthetic oligonucleotide
  Target: ATXN1; (-) strand; PAM type: NRG; PAM sequence: AAG
agtttggggaccactgccat

SEQ ID NO: 56772 - DNA, 20 bp, Artificial Sequence
  Description of Artificial Sequence: Synthetic oligonucleotide
  Target: ATXN1; (-) strand; PAM type: NRG; PAM sequence: GGG
gaccagtgccaaaaagtttg

SEQ ID NO: 56773 - DNA, 20 bp, Artificial Sequence
  Description of Artificial Sequence: Synthetic oligonucleotide
  Target: ATXN1; (-) strand; PAM type: NRG; PAM sequence: GGG
ggaccagtgccaaaaagttt

SEQ ID NO: 56774 - DNA, 20 bp, Artificial Sequence
  Description of Artificial Sequence: Synthetic oligonucleotide
  Target: ATXN1; (-) strand; PAM type: NRG; PAM sequence: TGG
tggaccagtgccaaaaagtt

SEQ ID NO: 56775 - DNA, 20 bp, Artificial Sequence
  Description of Artificial Sequence: Synthetic oligonucleotide
  Target: ATXN1; (-) strand; PAM type: NRG; PAM sequence: AAG
cctcatggaccagtgccaaa

SEQ ID NO: 56776 - DNA, 20 bp, Artificial Sequence
  Description of Artificial Sequence: Synthetic oligonucleotide
  Target: ATXN1; (-) strand; PAM type: NRG; PAM sequence: CAG
ctacccctagcctcatggac

SEQ ID NO: 56777 - DNA, 20 bp, Artificial Sequence
  Description of Artificial Sequence: Synthetic oligonucleotide
  Target: ATXN1; (-) strand; PAM type: NRG; PAM sequence: TGG
tccccctacccctagcctca

SEQ ID NO: 56778 - DNA, 20 bp, Artificial Sequence
  Description of Artificial Sequence: Synthetic oligonucleotide
  Target: ATXN1; (-) strand; PAM type: NRG; PAM sequence: TAG
atgcctgatccccctacccc

SEQ ID NO: 56779 - DNA, 20 bp, Artificial Sequence
  Description of Artificial Sequence: Synthetic oligonucleotide
  Target: ATXN1; (-) strand; PAM type: NRG; PAM sequence: GAG
ctaggttgtaccttccttat

SEQ ID NO: 56780 - DNA, 20 bp, Artificial Sequence
  Description of Artificial Sequence: Synthetic oligonucleotide
  Target: ATXN1; (-) strand; PAM type: NRG; PAM sequence: AGG
actgcacatgtgagggatct

SEQ ID NO: 56781 - DNA, 20 bp, Artificial Sequence
  Description of Artificial Sequence: Synthetic oligonucleotide
  Target: ATXN1; (-) strand; PAM type: NRG; PAM sequence: TAG
aactgcacatgtgagggatc

SEQ ID NO: 56782 - DNA, 20 bp, Artificial Sequence
  Description of Artificial Sequence: Synthetic oligonucleotide
  Target: ATXN1; (-) strand; PAM type: NRG; PAM sequence: GGG
actgtgaactgcacatgtga

SEQ ID NO: 56783 - DNA, 20 bp, Artificial Sequence
  Description of Artificial Sequence: Synthetic oligonucleotide
  Target: ATXN1; (-) strand; PAM type: NRG; PAM sequence: AGG
tactgtgaactgcacatgtg

SEQ ID NO: 56784 - DNA, 20 bp, Artificial Sequence
  Description of Artificial Sequence: Synthetic oligonucleotide
  Target: ATXN1; (-) strand; PAM type: NRG; PAM sequence: GAG
gtactgtgaactgcacatgt

SEQ ID NO: 56785 - DNA, 20 bp, Artificial Sequence
  Description of Artificial Sequence: Synthetic oligonucleotide
  Target: ATXN1; (-) strand; PAM type: NRG; PAM sequence: AAG
ttagattctttctcatagga

SEQ ID NO: 56786 - DNA, 20 bp, Artificial Sequence
  Description of Artificial Sequence: Synthetic oligonucleotide
  Target: ATXN1; (-) strand; PAM type: NRG; PAM sequence: AGG
agcattagattctttctcat

SEQ ID NO: 56787 - DNA, 20 bp, Artificial Sequence
  Description of Artificial Sequence: Synthetic oligonucleotide
  Target: ATXN1; (-) strand; PAM type: NRG; PAM sequence: TAG
cagcattagattctttctca

SEQ ID NO: 56788 - DNA, 20 bp, Artificial Sequence
  Description of Artificial Sequence: Synthetic oligonucleotide
  Target: ATXN1; (-) strand; PAM type: NRG; PAM sequence: TAG
tgtcagatcagtggcagcat

SEQ ID NO: 56789 - DNA, 20 bp, Artificial Sequence
  Description of Artificial Sequence: Synthetic oligonucleotide
  Target: ATXN1; (-) strand; PAM type: NRG; PAM sequence: CAG
acctcctgtcagatcagtgg

SEQ ID NO: 56790 - DNA, 20 bp, Artificial Sequence
  Description of Artificial Sequence: Synthetic oligonucleotide
  Target: ATXN1; (-) strand; PAM type: NRG; PAM sequence: TGG
tccacctcctgtcagatcag

SEQ ID NO: 56791 - DNA, 20 bp, Artificial Sequence
  Description of Artificial Sequence: Synthetic oligonucleotide
  Target: ATXN1; (-) strand; PAM type: NRG; PAM sequence: CAG
agctccacctcctgtcagat

SEQ ID NO: 56792 - DNA, 20 bp, Artificial Sequence
  Description of Artificial Sequence: Synthetic oligonucleotide
  Target: ATXN1; (-) strand; PAM type: NRG; PAM sequence: CAG
gcctaagctccacctcctgt

SEQ ID NO: 56793 - DNA, 20 bp, Artificial Sequence
  Description of Artificial Sequence: Synthetic oligonucleotide
  Target: ATXN1; (-) strand; PAM type: NRG; PAM sequence: AAG
ttagccagctcagccagcct

SEQ ID NO: 56794 - DNA, 20 bp, Artificial Sequence
  Description of Artificial Sequence: Synthetic oligonucleotide
  Target: ATXN1; (-) strand; PAM type: NRG; PAM sequence: CAG
ccggcattagccagctcagc

SEQ ID NO: 56795 - DNA, 20 bp, Artificial Sequence
  Description of Artificial Sequence: Synthetic oligonucleotide
  Target: ATXN1; (-) strand; PAM type: NRG; PAM sequence: CAG
cgagccggcattagccagct

SEQ ID NO: 56796 - DNA, 20 bp, Artificial Sequence
  Description of Artificial Sequence: Synthetic oligonucleotide
  Target: ATXN1; (-) strand; PAM type: NRG; PAM sequence: CAG
gcaggcgagccggcattagc

SEQ ID NO: 56797 - DNA, 20 bp, Artificial Sequence
  Description of Artificial Sequence: Synthetic oligonucleotide
  Target: ATXN1; (-) strand; PAM type: NRG; PAM sequence: TAG
agaggcaggcgagccggcat

SEQ ID NO: 56798 - DNA, 20 bp, Artificial Sequence
  Description of Artificial Sequence: Synthetic oligonucleotide
  Target: ATXN1; (-) strand; PAM type: NRG; PAM sequence: CGG
taggtgagaggcaggcgagc

SEQ ID NO: 56799 - DNA, 20 bp, Artificial Sequence
  Description of Artificial Sequence: Synthetic oligonucleotide
  Target: ATXN1; (-) strand; PAM type: NRG; PAM sequence: GAG
ccagtaggtgagaggcaggc

SEQ ID NO: 56800 - DNA, 20 bp, Artificial Sequence
  Description of Artificial Sequence: Synthetic oligonucleotide
  Target: ATXN1; (-) strand; PAM type: NRG; PAM sequence: AGG
cacaccagtaggtgagaggc

SEQ ID NO: 56801 - DNA, 20 bp, Artificial Sequence
  Description of Artificial Sequence: Synthetic oligonucleotide
  Target: ATXN1; (-) strand; PAM type: NRG; PAM sequence: CAG
gcacaccagtaggtgagagg

SEQ ID NO: 56802 - DNA, 20 bp, Artificial Sequence
  Description of Artificial Sequence: Synthetic oligonucleotide
  Target: ATXN1; (-) strand; PAM type: NRG; PAM sequence: AGG
gtggcacaccagtaggtgag

SEQ ID NO: 56803 - DNA, 20 bp, Artificial Sequence
  Description of Artificial Sequence: Synthetic oligonucleotide
  Target: ATXN1; (-) strand; PAM type: NRG; PAM sequence: GAG
ggtggcacaccagtaggtga

SEQ ID NO: 56804 - DNA, 20 bp, Artificial Sequence
  Description of Artificial Sequence: Synthetic oligonucleotide
  Target: ATXN1; (-) strand; PAM type: NRG; PAM sequence: GAG
tgggtggcacaccagtaggt

SEQ ID NO: 56805 - DNA, 20 bp, Artificial Sequence
  Description of Artificial Sequence: Synthetic oligonucleotide
  Target: ATXN1; (-) strand; PAM type: NRG; PAM sequence: AGG
gaactgggtggcacaccagt

SEQ ID NO: 56806 - DNA, 20 bp, Artificial Sequence
  Description of Artificial Sequence: Synthetic oligonucleotide
  Target: ATXN1; (-) strand; PAM type: NRG; PAM sequence: TAG
ggaactgggtggcacaccag

SEQ ID NO: 56807 - DNA, 20 bp, Artificial Sequence
  Description of Artificial Sequence: Synthetic oligonucleotide
  Target: ATXN1; (-) strand; PAM type: NRG; PAM sequence: CAG
ttaggaactgggtggcacac

SEQ ID NO: 56808 - DNA, 20 bp, Artificial Sequence
  Description of Artificial Sequence: Synthetic oligonucleotide
  Target: ATXN1; (-) strand; PAM type: NRG; PAM sequence: TGG
gtggcctgttaggaactggg

SEQ ID NO: 56809 - DNA, 20 bp, Artificial Sequence
  Description of Artificial Sequence: Synthetic oligonucleotide
  Target: ATXN1; (-) strand; PAM type: NRG; PAM sequence: GGG
tctgtggcctgttaggaact

SEQ ID NO: 56810 - DNA, 20 bp, Artificial Sequence
  Description of Artificial Sequence: Synthetic oligonucleotide
  Target: ATXN1; (-) strand; PAM type: NRG; PAM sequence: TGG
gtctgtggcctgttaggaac

SEQ ID NO: 56811 - DNA, 20 bp, Artificial Sequence
  Description of Artificial Sequence: Synthetic oligonucleotide
  Target: ATXN1; (-) strand; PAM type: NRG; PAM sequence: AGG
ttatgggtctgtggcctgtt

SEQ ID NO: 56812 - DNA, 20 bp, Artificial Sequence
  Description of Artificial Sequence: Synthetic oligonucleotide
  Target: ATXN1; (-) strand; PAM type: NRG; PAM sequence: TAG
attatgggtctgtggcctgt

SEQ ID NO: 56813 - DNA, 20 bp, Artificial Sequence
  Description of Artificial Sequence: Synthetic oligonucleotide
  Target: ATXN1; (-) strand; PAM type: NRG; PAM sequence: TGG
catggaccattatgggtctg

SEQ ID NO: 56814 - DNA, 20 bp, Artificial Sequence
  Description of Artificial Sequence: Synthetic oligonucleotide
  Target: ATXN1; (-) strand; PAM type: NRG; PAM sequence: GGG
cctgggccatggaccattat

SEQ ID NO: 56815 - DNA, 20 bp, Artificial Sequence
  Description of Artificial Sequence: Synthetic oligonucleotide
  Target: ATXN1; (-) strand; PAM type: NRG; PAM sequence: TGG
ccctgggccatggaccatta

SEQ ID NO: 56816 - DNA, 20 bp, Artificial Sequence
  Description of Artificial Sequence: Synthetic oligonucleotide
  Target: ATXN1; (-) strand; PAM type: NRG; PAM sequence: TGG
ggttcccaacccctgggcca

SEQ ID NO: 56817 - DNA, 20 bp, Artificial Sequence
  Description of Artificial Sequence: Synthetic oligonucleotide
  Target: ATXN1; (-) strand; PAM type: NRG; PAM sequence: GGG
cacaggggttcccaacccct

SEQ ID NO: 56818 - DNA, 20 bp, Artificial Sequence
  Description of Artificial Sequence: Synthetic oligonucleotide
  Target: ATXN1; (-) strand; PAM type: NRG; PAM sequence: TGG
acacaggggttcccaacccc

SEQ ID NO: 56819 - DNA, 20 bp, Artificial Sequence
  Description of Artificial Sequence: Synthetic oligonucleotide
  Target: ATXN1; (-) strand; PAM type: NRG; PAM sequence: GGG
tgtcaggtcctataacacag

SEQ ID NO: 56820 - DNA, 20 bp, Artificial Sequence
  Description of Artificial Sequence: Synthetic oligonucleotide
  Target: ATXN1; (-) strand; PAM type: NRG; PAM sequence: GGG
gtgtcaggtcctataacaca

SEQ ID NO: 56821 - DNA, 20 bp, Artificial Sequence
  Description of Artificial Sequence: Synthetic oligonucleotide
  Target: ATXN1; (-) strand; PAM type: NRG; PAM sequence: AGG
ggtgtcaggtcctataacac

SEQ ID NO: 56822 - DNA, 20 bp, Artificial Sequence
  Description of Artificial Sequence: Synthetic oligonucleotide
  Target: ATXN1; (-) strand; PAM type: NRG; PAM sequence: CAG
gggtgtcaggtcctataaca

SEQ ID NO: 56823 - DNA, 20 bp, Artificial Sequence
  Description of Artificial Sequence: Synthetic oligonucleotide
  Target: ATXN1; (-) strand; PAM type: NRG; PAM sequence: AGG
gatggcagaaattgggtgtc

SEQ ID NO: 56824 - DNA, 20 bp, Artificial Sequence
  Description of Artificial Sequence: Synthetic oligonucleotide
  Target: ATXN1; (-) strand; PAM type: NRG; PAM sequence: CAG
agatggcagaaattgggtgt

SEQ ID NO: 56825 - DNA, 20 bp, Artificial Sequence
  Description of Artificial Sequence: Synthetic oligonucleotide
  Target: ATXN1; (-) strand; PAM type: NRG; PAM sequence: GGG
cttttcagatggcagaaatt

SEQ ID NO: 56826 - DNA, 20 bp, Artificial Sequence
  Description of Artificial Sequence: Synthetic oligonucleotide
  Target: ATXN1; (-) strand; PAM type: NRG; PAM sequence: TGG
gcttttcagatggcagaaat

SEQ ID NO: 56827 - DNA, 20 bp, Artificial Sequence
  Description of Artificial Sequence: Synthetic oligonucleotide
  Target: ATXN1; (-) strand; PAM type: NRG; PAM sequence: CAG
tttctttgcttttcagatgg

SEQ ID NO: 56828 - DNA, 20 bp, Artificial Sequence
  Description of Artificial Sequence: Synthetic oligonucleotide
  Target: ATXN1; (-) strand; PAM type: NRG; PAM sequence: TGG
atctttctttgcttttcaga

SEQ ID NO: 56829 - DNA, 20 bp, Artificial Sequence
  Description of Artificial Sequence: Synthetic oligonucleotide
  Target: ATXN1; (-) strand; PAM type: NRG; PAM sequence: CAG
tgttatctttctttgctttt

SEQ ID NO: 56830 - DNA, 20 bp, Artificial Sequence
  Description of Artificial Sequence: Synthetic oligonucleotide
  Target: ATXN1; (-) strand; PAM type: NRG; PAM sequence: GAG
tttctgctaaaaagtcaaca

SEQ ID NO: 56831 - DNA, 20 bp, Artificial Sequence
  Description of Artificial Sequence: Synthetic oligonucleotide
  Target: ATXN1; (-) strand; PAM type: NRG; PAM sequence: CAG
tatttctgctaaaaagtcaa

SEQ ID NO: 56832 - DNA, 20 bp, Artificial Sequence
  Description of Artificial Sequence: Synthetic oligonucleotide
  Target: ATXN1; (-) strand; PAM type: NRG; PAM sequence: AAG
aaatttttatttctgctaaa

SEQ ID NO: 56833 - DNA, 20 bp, Artificial Sequence
  Description of Artificial Sequence: Synthetic oligonucleotide
  Target: ATXN1; (-) strand; PAM type: NRG; PAM sequence: AAG
aaaatggagaaaaaataaac

SEQ ID NO: 56834 - DNA, 20 bp, Artificial Sequence
  Description of Artificial Sequence: Synthetic oligonucleotide
  Target: ATXN1; (-) strand; PAM type: NRG; PAM sequence: GAG
atattttggattaaaaaatg

SEQ ID NO: 56835 - DNA, 20 bp, Artificial Sequence
  Description of Artificial Sequence: Synthetic oligonucleotide
  Target: ATXN1; (-) strand; PAM type: NRG; PAM sequence: TGG
taatattttggattaaaaaa

SEQ ID NO: 56836 - DNA, 20 bp, Artificial Sequence
  Description of Artificial Sequence: Synthetic oligonucleotide
  Target: ATXN1; (-) strand; PAM type: NRG; PAM sequence: TGG
tattatgtgttgtaatattt

SEQ ID NO: 56837 - DNA, 20 bp, Artificial Sequence
  Description of Artificial Sequence: Synthetic oligonucleotide
  Target: ATXN1; (-) strand; PAM type: NRG; PAM sequence: CAG
tggcactaaatgtattattt

SEQ ID NO: 56838 - DNA, 20 bp, Artificial Sequence
  Description of Artificial Sequence: Synthetic oligonucleotide
  Target: ATXN1; (-) strand; PAM type: NRG; PAM sequence: TGG
aatgaaacctgactcaaagc

SEQ ID NO: 56839 - DNA, 20 bp, Artificial Sequence
  Description of Artificial Sequence: Synthetic oligonucleotide
  Target: ATXN1; (-) strand; PAM type: NRG; PAM sequence: AAG
cagcaatgaaacctgactca

SEQ ID NO: 56840 - DNA, 20 bp, Artificial Sequence
  Description of Artificial Sequence: Synthetic oligonucleotide
  Target: ATXN1; (-) strand; PAM type: NRG; PAM sequence: CAG
cacctttacctttctcttga

SEQ ID NO: 56841 - DNA, 20 bp, Artificial Sequence
  Description of Artificial Sequence: Synthetic oligonucleotide
  Target: ATXN1; (-) strand; PAM type: NRG; PAM sequence: TGG
tttactgtctacaagggaga

SEQ ID NO: 56842 - DNA, 20 bp, Artificial Sequence
  Description of Artificial Sequence: Synthetic oligonucleotide
  Target: ATXN1; (-) strand; PAM type: NRG; PAM sequence: GAG
aaaatttactgtctacaagg

SEQ ID NO: 56843 - DNA, 20 bp, Artificial Sequence
  Description of Artificial Sequence: Synthetic oligonucleotide
  Target: ATXN1; (-) strand; PAM type: NRG; PAM sequence: GGG
ttaaaatttactgtctacaa

SEQ ID NO: 56844 - DNA, 20 bp, Artificial Sequence
  Description of Artificial Sequence: Synthetic oligonucleotide
  Target: ATXN1; (-) strand; PAM type: NRG; PAM sequence: AGG
attaaaatttactgtctaca

SEQ ID NO: 56845 - DNA, 20 bp, Artificial Sequence
  Description of Artificial Sequence: Synthetic oligonucleotide
  Target: ATXN1; (-) strand; PAM type: NRG; PAM sequence: AAG
aattaaaatttactgtctac

SEQ ID NO: 56846 - DNA, 20 bp, Artificial Sequence
  Description of Artificial Sequence: Synthetic oligonucleotide
  Target: ATXN1; (-) strand; PAM type: NRG; PAM sequence: AGG
gacttgtagagatgaggtgt

SEQ ID NO: 56847 - DNA, 20 bp, Artificial Sequence
  Description of Artificial Sequence: Synthetic oligonucleotide
  Target: ATXN1; (-) strand; PAM type: NRG; PAM sequence: TAG
agacttgtagagatgaggtg

SEQ ID NO: 56848 - DNA, 20 bp, Artificial Sequence
  Description of Artificial Sequence: Synthetic oligonucleotide
  Target: ATXN1; (-) strand; PAM type: NRG; PAM sequence: AGG
tcaggagacttgtagagatg

SEQ ID NO: 56849 - DNA, 20 bp, Artificial Sequence
  Description of Artificial Sequence: Synthetic oligonucleotide
  Target: ATXN1; (-) strand; PAM type: NRG; PAM sequence: GAG
ttcaggagacttgtagagat

SEQ ID NO: 56850 - DNA, 20 bp, Artificial Sequence
  Description of Artificial Sequence: Synthetic oligonucleotide
  Target: ATXN1; (-) strand; PAM type: NRG; PAM sequence: GAG
tatgtttcaggagacttgta

SEQ ID NO: 56851 - DNA, 20 bp, Artificial Sequence
  Description of Artificial Sequence: Synthetic oligonucleotide
  Target: ATXN1; (-) strand; PAM type: NRG; PAM sequence: TAG
ggtatgtttcaggagacttg

SEQ ID NO: 56852 - DNA, 20 bp, Artificial Sequence
  Description of Artificial Sequence: Synthetic oligonucleotide
  Target: ATXN1; (-) strand; PAM type: NRG; PAM sequence: GAG
aatatcttggtatgtttcag

SEQ ID NO: 56853 - DNA, 20 bp, Artificial Sequence
  Description of Artificial Sequence: Synthetic oligonucleotide
  Target: ATXN1; (-) strand; PAM type: NRG; PAM sequence: AGG
acaatatcttggtatgtttc

SEQ ID NO: 56854 - DNA, 20 bp, Artificial Sequence
  Description of Artificial Sequence: Synthetic oligonucleotide
  Target: ATXN1; (-) strand; PAM type: NRG; PAM sequence: CAG
gacaatatcttggtatgttt

SEQ ID NO: 56855 - DNA, 20 bp, Artificial Sequence
  Description of Artificial Sequence: Synthetic oligonucleotide
  Target: ATXN1; (-) strand; PAM type: NRG; PAM sequence: TGG
tctacagaaagacaatatct

SEQ ID NO: 56856 - DNA, 20 bp, Artificial Sequence
  Description of Artificial Sequence: Synthetic oligonucleotide
  Target: ATXN1; (-) strand; PAM type: NRG; PAM sequence: AAG
acgtgctctgagtctacaga

SEQ ID NO: 56857 - DNA, 20 bp, Artificial Sequence
  Description of Artificial Sequence: Synthetic oligonucleotide
  Target: ATXN1; (-) strand; PAM type: NRG; PAM sequence: CAG
ttatacgtgctctgagtcta

SEQ ID NO: 56858 - DNA, 20 bp, Artificial Sequence
  Description of Artificial Sequence: Synthetic oligonucleotide
  Target: ATXN1; (-) strand; PAM type: NRG; PAM sequence: GAG
tatctgattatacgtgctct

SEQ ID NO: 56859 - DNA, 20 bp, Artificial Sequence
  Description of Artificial Sequence: Synthetic oligonucleotide
  Target: ATXN1; (-) strand; PAM type: NRG; PAM sequence: CAG
aatataaacagtaagtggac

SEQ ID NO: 56860 - DNA, 20 bp, Artificial Sequence
  Description of Artificial Sequence: Synthetic oligonucleotide
  Target: ATXN1; (-) strand; PAM type: NRG; PAM sequence: TGG
tatacaatataaacagtaag

SEQ ID NO: 56861 - DNA, 20 bp, Artificial Sequence
  Description of Artificial Sequence: Synthetic oligonucleotide
  Target: ATXN1; (-) strand; PAM type: NRG; PAM sequence: AAG
aaatatacaatataaacagt

SEQ ID NO: 56862 - DNA, 20 bp, Artificial Sequence
  Description of Artificial Sequence: Synthetic oligonucleotide
  Target: ATXN1; (-) strand; PAM type: NRG; PAM sequence: CAG
gataaaatatacaatataaa

SEQ ID NO: 56863 - DNA, 20 bp, Artificial Sequence
  Description of Artificial Sequence: Synthetic oligonucleotide
  Target: ATXN1; (-) strand; PAM type: NRG; PAM sequence: TGG
ttataggtataaatcattct

SEQ ID NO: 56864 - DNA, 20 bp, Artificial Sequence
  Description of Artificial Sequence: Synthetic oligonucleotide
  Target: ATXN1; (-) strand; PAM type: NRG; PAM sequence: AGG
atcctcctggctggatttat

SEQ ID NO: 56865 - DNA, 20 bp, Artificial Sequence
  Description of Artificial Sequence: Synthetic oligonucleotide
  Target: ATXN1; (-) strand; PAM type: NRG; PAM sequence: TAG
gatcctcctggctggattta

SEQ ID NO: 56866 - DNA, 20 bp, Artificial Sequence
  Description of Artificial Sequence: Synthetic oligonucleotide
  Target: ATXN1; (-) strand; PAM type: NRG; PAM sequence: TGG
tattctgagatcctcctggc

SEQ ID NO: 56867 - DNA, 20 bp, Artificial Sequence
  Description of Artificial Sequence: Synthetic oligonucleotide
  Target: ATXN1; (-) strand; PAM type: NRG; PAM sequence: TGG
atattattctgagatcctcc

SEQ ID NO: 56868 - DNA, 20 bp, Artificial Sequence
  Description of Artificial Sequence: Synthetic oligonucleotide
  Target: ATXN1; (-) strand; PAM type: NRG; PAM sequence: GAG
tatctcataaatattattct

SEQ ID NO: 56869 - DNA, 20 bp, Artificial Sequence
  Description of Artificial Sequence: Synthetic oligonucleotide
  Target: ATXN1; (-) strand; PAM type: NRG; PAM sequence: CAG
gaagtgttgctattaaattt

SEQ ID NO: 56870 - DNA, 20 bp, Artificial Sequence
  Description of Artificial Sequence: Synthetic oligonucleotide
  Target: ATXN1; (-) strand; PAM type: NRG; PAM sequence: AAG
tgatagtccatctacttaag

SEQ ID NO: 56871 - DNA, 20 bp, Artificial Sequence
  Description of Artificial Sequence: Synthetic oligonucleotide
  Target: ATXN1; (-) strand; PAM type: NRG; PAM sequence: AAG
tcttgatagtccatctactt

SEQ ID NO: 56872 - DNA, 20 bp, Artificial Sequence
  Description of Artificial Sequence: Synthetic oligonucleotide
  Target: ATXN1; (-) strand; PAM type: NRG; PAM sequence: TAG
ttattttaagagtttcttga

SEQ ID NO: 56873 - DNA, 20 bp, Artificial Sequence
  Description of Artificial Sequence: Synthetic oligonucleotide
  Target: ATXN1; (-) strand; PAM type: NRG; PAM sequence: GAG
ttttcattctgttattttaa

SEQ ID NO: 56874 - DNA, 20 bp, Artificial Sequence
  Description of Artificial Sequence: Synthetic oligonucleotide
  Target: ATXN1; (-) strand; PAM type: NRG; PAM sequence: AAG
atttttcattctgttatttt

SEQ ID NO: 56875 - DNA, 20 bp, Artificial Sequence
  Description of Artificial Sequence: Synthetic oligonucleotide
  Target: ATXN1; (-) strand; PAM type: NRG; PAM sequence: GAG
gctgacggggcttatataca

SEQ ID NO: 56876 - DNA, 20 bp, Artificial Sequence
  Description of Artificial Sequence: Synthetic oligonucleotide
  Target: ATXN1; (-) strand; PAM type: NRG; PAM sequence: CAG
tggctgacggggcttatata

SEQ ID NO: 56877 - DNA, 20 bp, Artificial Sequence
  Description of Artificial Sequence: Synthetic oligonucleotide
  Target: ATXN1; (-) strand; PAM type: NRG; PAM sequence: GGG
ctcccgtgtactggctgacg

SEQ ID NO: 56878 - DNA, 20 bp, Artificial Sequence
  Description of Artificial Sequence: Synthetic oligonucleotide
  Target: ATXN1; (-) strand; PAM type: NRG; PAM sequence: GGG
cctcccgtgtactggctgac

SEQ ID NO: 56879 - DNA, 20 bp, Artificial Sequence
  Description of Artificial Sequence: Synthetic oligonucleotide
  Target: ATXN1; (-) strand; PAM type: NRG; PAM sequence: CGG
acctcccgtgtactggctga

SEQ ID NO: 56880 - DNA, 20 bp, Artificial Sequence
  Description of Artificial Sequence: Synthetic oligonucleotide
  Target: ATXN1; (-) strand; PAM type: NRG; PAM sequence: TGG
atcgagtacctcccgtgtac

SEQ ID NO: 56881 - DNA, 20 bp, Artificial Sequence
  Description of Artificial Sequence: Synthetic oligonucleotide
  Target: ATXN1; (-) strand; PAM type: NRG; PAM sequence: GAG
tccttcatttggcattgatc

SEQ ID NO: 56882 - DNA, 20 bp, Artificial Sequence
  Description of Artificial Sequence: Synthetic oligonucleotide
  Target: ATXN1; (-) strand; PAM type: NRG; PAM sequence: TGG
tacgaagtcactccttcatt

SEQ ID NO: 56883 - DNA, 20 bp, Artificial Sequence
  Description of Artificial Sequence: Synthetic oligonucleotide
  Target: ATXN1; (-) strand; PAM type: NRG; PAM sequence: AAG
gcttcttagtccctcttacg

SEQ ID NO: 56884 - DNA, 20 bp, Artificial Sequence
  Description of Artificial Sequence: Synthetic oligonucleotide
  Target: ATXN1; (-) strand; PAM type: NRG; PAM sequence: TAG
tagcaacttgaattgcttct

SEQ ID NO: 56885 - DNA, 20 bp, Artificial Sequence
  Description of Artificial Sequence: Synthetic oligonucleotide
  Target: ATXN1; (-) strand; PAM type: NRG; PAM sequence: TAG
ttacacaagagattccagaa

SEQ ID NO: 56886 - DNA, 20 bp, Artificial Sequence
  Description of Artificial Sequence: Synthetic oligonucleotide
  Target: ATXN1; (-) strand; PAM type: NRG; PAM sequence: CAG
ccatcttacacaagagattc

SEQ ID NO: 56887 - DNA, 20 bp, Artificial Sequence
  Description of Artificial Sequence: Synthetic oligonucleotide
  Target: ATXN1; (-) strand; PAM type: NRG; PAM sequence: GAG
ttgattcccatcttacacaa

SEQ ID NO: 56888 - DNA, 20 bp, Artificial Sequence
  Description of Artificial Sequence: Synthetic oligonucleotide
  Target: ATXN1; (-) strand; PAM type: NRG; PAM sequence: AAG
acttgattcccatcttacac

SEQ ID NO: 56889 - DNA, 20 bp, Artificial Sequence
  Description of Artificial Sequence: Synthetic oligonucleotide
  Target: ATXN1; (-) strand; PAM type: NRG; PAM sequence: TAG
aattctattaatgactctgt

SEQ ID NO: 56890 - DNA, 20 bp, Artificial Sequence
  Description of Artificial Sequence: Synthetic oligonucleotide
  Target: ATXN1; (-) strand; PAM type: NRG; PAM sequence: AAG
tttggagtttcctcttttgg

SEQ ID NO: 56891 - DNA, 20 bp, Artificial Sequence
  Description of Artificial Sequence: Synthetic oligonucleotide
  Target: ATXN1; (-) strand; PAM type: NRG; PAM sequence: TGG
aactttggagtttcctcttt

SEQ ID NO: 56892 - DNA, 20 bp, Artificial Sequence
  Description of Artificial Sequence: Synthetic oligonucleotide
  Target: ATXN1; (-) strand; PAM type: NRG; PAM sequence: GAG
gtaatgaaagggtaactttg

SEQ ID NO: 56893 - DNA, 20 bp, Artificial Sequence
  Description of Artificial Sequence: Synthetic oligonucleotide
  Target: ATXN1; (-) strand; PAM type: NRG; PAM sequence: TGG
cagtaatgaaagggtaactt

SEQ ID NO: 56894 - DNA, 20 bp, Artificial Sequence
  Description of Artificial Sequence: Synthetic oligonucleotide
  Target: ATXN1; (-) strand; PAM type: NRG; PAM sequence: GGG
tgagaaattcagtaatgaaa

SEQ ID NO: 56895 - DNA, 20 bp, Artificial Sequence
  Description of Artificial Sequence: Synthetic oligonucleotide
  Target: ATXN1; (-) strand; PAM type: NRG; PAM sequence: AGG
ctgagaaattcagtaatgaa

SEQ ID NO: 56896 - DNA, 20 bp, Artificial Sequence
  Description of Artificial Sequence: Synthetic oligonucleotide
  Target: ATXN1; (-) strand; PAM type: NRG; PAM sequence: AAG
tctgagaaattcagtaatga

SEQ ID NO: 56897 - DNA, 20 bp, Artificial Sequence
  Description of Artificial Sequence: Synthetic oligonucleotide
  Target: ATXN1; (-) strand; PAM type: NRG; PAM sequence: CAG
cactgagaatctgagaaatt

SEQ ID NO: 56898 - DNA, 20 bp, Artificial Sequence
  Description of Artificial Sequence: Synthetic oligonucleotide
  Target: ATXN1; (-) strand; PAM type: NRG; PAM sequence: GAG
tttagatccactgagaatct

SEQ ID NO: 56899 - DNA, 20 bp, Artificial Sequence
  Description of Artificial Sequence: Synthetic oligonucleotide
  Target: ATXN1; (-) strand; PAM type: NRG; PAM sequence: GAG
agtttaaatttagatccact

SEQ ID NO: 56900 - DNA, 20 bp, Artificial Sequence
  Description of Artificial Sequence: Synthetic oligonucleotide
  Target: ATXN1; (-) strand; PAM type: NRG; PAM sequence: TAG
tttcctgtgcagtttaaatt

SEQ ID NO: 56901 - DNA, 20 bp, Artificial Sequence
  Description of Artificial Sequence: Synthetic oligonucleotide
  Target: ATXN1; (-) strand; PAM type: NRG; PAM sequence: CAG
aaagggccttgtttcctgtg

SEQ ID NO: 56902 - DNA, 20 bp, Artificial Sequence
  Description of Artificial Sequence: Synthetic oligonucleotide
  Target: ATXN1; (-) strand; PAM type: NRG; PAM sequence: GGG
atttagcaccttttgacaaa

SEQ ID NO: 56903 - DNA, 20 bp, Artificial Sequence
  Description of Artificial Sequence: Synthetic oligonucleotide
  Target: ATXN1; (-) strand; PAM type: NRG; PAM sequence: AGG
gatttagcaccttttgacaa

SEQ ID NO: 56904 - DNA, 20 bp, Artificial Sequence
  Description of Artificial Sequence: Synthetic oligonucleotide
  Target: ATXN1; (-) strand; PAM type: NRG; PAM sequence: AAG
agatttagcaccttttgaca

SEQ ID NO: 56905 - DNA, 20 bp, Artificial Sequence
  Description of Artificial Sequence: Synthetic oligonucleotide
  Target: ATXN1; (-) strand; PAM type: NRG; PAM sequence: TAG
cttatagtgtaggttagatt

SEQ ID NO: 56906 - DNA, 20 bp, Artificial Sequence
  Description of Artificial Sequence: Synthetic oligonucleotide
  Target: ATXN1; (-) strand; PAM type: NRG; PAM sequence: TAG
gtgcttcttatagtgtaggt

SEQ ID NO: 56907 - DNA, 20 bp, Artificial Sequence
  Description of Artificial Sequence: Synthetic oligonucleotide
  Target: ATXN1; (-) strand; PAM type: NRG; PAM sequence: AGG
aaacgtgcttcttatagtgt

SEQ ID NO: 56908 - DNA, 20 bp, Artificial Sequence
  Description of Artificial Sequence: Synthetic oligonucleotide
  Target: ATXN1; (-) strand; PAM type: NRG; PAM sequence: TAG
caaacgtgcttcttatagtg

SEQ ID NO: 56909 - DNA, 20 bp, Artificial Sequence
  Description of Artificial Sequence: Synthetic oligonucleotide
  Target: ATXN1; (-) strand; PAM type: NRG; PAM sequence: TAG
atgggcaaacgtgcttctta

SEQ ID NO: 56910 - DNA, 20 bp, Artificial Sequence
  Description of Artificial Sequence: Synthetic oligonucleotide
  Target: ATXN1; (-) strand; PAM type: NRG; PAM sequence: GGG
cataacatggaacacaggat

SEQ ID NO: 56911 - DNA, 20 bp, Artificial Sequence
  Description of Artificial Sequence: Synthetic oligonucleotide
  Target: ATXN1; (-) strand; PAM type: NRG; PAM sequence: TGG
tcataacatggaacacagga

SEQ ID NO: 56912 - DNA, 20 bp, Artificial Sequence
  Description of Artificial Sequence: Synthetic oligonucleotide
  Target: ATXN1; (-) strand; PAM type: NRG; PAM sequence: AGG
cccttcataacatggaacac

SEQ ID NO: 56913 - DNA, 20 bp, Artificial Sequence
  Description of Artificial Sequence: Synthetic oligonucleotide
  Target: ATXN1; (-) strand; PAM type: NRG; PAM sequence: CAG
gcccttcataacatggaaca

SEQ ID NO: 56914 - DNA, 20 bp, Artificial Sequence
  Description of Artificial Sequence: Synthetic oligonucleotide
  Target: ATXN1; (-) strand; PAM type: NRG; PAM sequence: TGG
cttggaggcccttcataaca

SEQ ID NO: 56915 - DNA, 20 bp, Artificial Sequence
  Description of Artificial Sequence: Synthetic oligonucleotide
  Target: ATXN1; (-) strand; PAM type: NRG; PAM sequence: AGG
tgtcctttttaaattcttgg

SEQ ID NO: 56916 - DNA, 20 bp, Artificial Sequence
  Description of Artificial Sequence: Synthetic oligonucleotide
  Target: ATXN1; (-) strand; PAM type: NRG; PAM sequence: GAG
ttgtcctttttaaattcttg

SEQ ID NO: 56917 - DNA, 20 bp, Artificial Sequence
  Description of Artificial Sequence: Synthetic oligonucleotide
  Target: ATXN1; (-) strand; PAM type: NRG; PAM sequence: TGG
ttttgtcctttttaaattct

SEQ ID NO: 56918 - DNA, 20 bp, Artificial Sequence
  Description of Artificial Sequence: Synthetic oligonucleotide
  Target: ATXN1; (-) strand; PAM type: NRG; PAM sequence: AGG
gctagatagtaatactataa

SEQ ID NO: 56919 - DNA, 20 bp, Artificial Sequence
  Description of Artificial Sequence: Synthetic oligonucleotide
  Target: ATXN1; (-) strand; PAM type: NRG; PAM sequence: AAG
agctagatagtaatactata

SEQ ID NO: 56920 - DNA, 20 bp, Artificial Sequence
  Description of Artificial Sequence: Synthetic oligonucleotide
  Target: ATXN1; (-) strand; PAM type: NRG; PAM sequence: TAG
tttggcttttagtagctaga

SEQ ID NO: 56921 - DNA, 20 bp, Artificial Sequence
  Description of Artificial Sequence: Synthetic oligonucleotide
  Target: ATXN1; (-) strand; PAM type: NRG; PAM sequence: TAG
tctttttggcttttagtagc

SEQ ID NO: 56922 - DNA, 20 bp, Artificial Sequence
  Description of Artificial Sequence: Synthetic oligonucleotide
  Target: ATXN1; (-) strand; PAM type: NRG; PAM sequence: TAG
tttttctttttggcttttag

SEQ ID NO: 56923 - DNA, 20 bp, Artificial Sequence
  Description of Artificial Sequence: Synthetic oligonucleotide
  Target: ATXN1; (-) strand; PAM type: NRG; PAM sequence: TAG
acatttttctttttggcttt

SEQ ID NO: 56924 - DNA, 20 bp, Artificial Sequence
  Description of Artificial Sequence: Synthetic oligonucleotide
  Target: ATXN1; (-) strand; PAM type: NRG; PAM sequence: TGG
tgacatcacatttttctttt

SEQ ID NO: 56925 - DNA, 20 bp, Artificial Sequence
  Description of Artificial Sequence: Synthetic oligonucleotide
  Target: ATXN1; (-) strand; PAM type: NRG; PAM sequence: TAG
ttgttataactttacaaatg

SEQ ID NO: 56926 - DNA, 20 bp, Artificial Sequence
  Description of Artificial Sequence: Synthetic oligonucleotide
  Target: ATXN1; (-) strand; PAM type: NRG; PAM sequence: TGG
aagtctctagctctgaaaat

SEQ ID NO: 56927 - DNA, 20 bp, Artificial Sequence
  Description of Artificial Sequence: Synthetic oligonucleotide
  Target: ATXN1; (-) strand; PAM type: NRG; PAM sequence: TAG
cccccgcgaaaagaagtctc

SEQ ID NO: 56928 - DNA, 20 bp, Artificial Sequence
  Description of Artificial Sequence: Synthetic oligonucleotide
  Target: ATXN1; (-) strand; PAM type: NRG; PAM sequence: AAG
ccccccccccccgcgaaaag

SEQ ID NO: 56929 - DNA, 20 bp, Artificial Sequence
  Description of Artificial Sequence: Synthetic oligonucleotide
  Target: ATXN1; (-) strand; PAM type: NRG; PAM sequence: AAG
cccccccccccccccgcgaa

SEQ ID NO: 56930 - DNA, 20 bp, Artificial Sequence
  Description of Artificial Sequence: Synthetic oligonucleotide
  Target: ATXN1; (-) strand; PAM type: NRG; PAM sequence: CGG
ccttattcccgccccgcccc

SEQ ID NO: 56931 - DNA, 20 bp, Artificial Sequence
  Description of Artificial Sequence: Synthetic oligonucleotide
  Target: ATXN1; (-) strand; PAM type: NRG; PAM sequence: CAG
tctggtacacattctgatgt

SEQ ID NO: 56932 - DNA, 20 bp, Artificial Sequence
  Description of Artificial Sequence: Synthetic oligonucleotide
  Target: ATXN1; (-) strand; PAM type: NRG; PAM sequence: TGG
aaaaaacccctgagtcactc

SEQ ID NO: 56933 - DNA, 20 bp, Artificial Sequence
  Description of Artificial Sequence: Synthetic oligonucleotide
  Target: ATXN1; (-) strand; PAM type: NRG; PAM sequence: GAG
gaggctgaaaaaaaacccct

SEQ ID NO: 56934 - DNA, 20 bp, Artificial Sequence
  Description of Artificial Sequence: Synthetic oligonucleotide
  Target: ATXN1; (-) strand; PAM type: NRG; PAM sequence: AGG
ctgagtaaatggtagctctg

SEQ ID NO: 56935 - DNA, 20 bp, Artificial Sequence
  Description of Artificial Sequence: Synthetic oligonucleotide
  Target: ATXN1; (-) strand; PAM type: NRG; PAM sequence: GAG
gctgagtaaatggtagctct

SEQ ID NO: 56936 - DNA, 20 bp, Artificial Sequence
  Description of Artificial Sequence: Synthetic oligonucleotide
  Target: ATXN1; (-) strand; PAM type: NRG; PAM sequence: TAG
gctggacgctgagtaaatgg

SEQ ID NO: 56937 - DNA, 20 bp, Artificial Sequence
  Description of Artificial Sequence: Synthetic oligonucleotide
  Target: ATXN1; (-) strand; PAM type: NRG; PAM sequence: TGG
gacgctggacgctgagtaaa

SEQ ID NO: 56938 - DNA, 20 bp, Artificial Sequence
  Description of Artificial Sequence: Synthetic oligonucleotide
  Target: ATXN1; (-) strand; PAM type: NRG; PAM sequence: GAG
tggttaggacgctggacgct

SEQ ID NO: 56939 - DNA, 20 bp, Artificial Sequence
  Description of Artificial Sequence: Synthetic oligonucleotide
  Target: ATXN1; (-) strand; PAM type: NRG; PAM sequence: TGG
tttaggcttggttaggacgc

SEQ ID NO: 56940 - DNA, 20 bp, Artificial Sequence
  Description of Artificial Sequence: Synthetic oligonucleotide
  Target: ATXN1; (-) strand; PAM type: NRG; PAM sequence: AGG
gatcaagtttaggcttggtt

SEQ ID NO: 56941 - DNA, 20 bp, Artificial Sequence
  Description of Artificial Sequence: Synthetic oligonucleotide
  Target: ATXN1; (-) strand; PAM type: NRG; PAM sequence: TAG
agatcaagtttaggcttggt

SEQ ID NO: 56942 - DNA, 20 bp, Artificial Sequence
  Description of Artificial Sequence: Synthetic oligonucleotide
  Target: ATXN1; (-) strand; PAM type: NRG; PAM sequence: TGG
atttagatcaagtttaggct

SEQ ID NO: 56943 - DNA, 20 bp, Artificial Sequence
  Description of Artificial Sequence: Synthetic oligonucleotide
  Target: ATXN1; (-) strand; PAM type: NRG; PAM sequence: AGG
acacaatttagatcaagttt

SEQ ID NO: 56944 - DNA, 20 bp, Artificial Sequence
  Description of Artificial Sequence: Synthetic oligonucleotide
  Target: ATXN1; (-) strand; PAM type: NRG; PAM sequence: TAG
gacacaatttagatcaagtt

SEQ ID NO: 56945 - DNA, 20 bp, Artificial Sequence
  Description of Artificial Sequence: Synthetic oligonucleotide
  Target: ATXN1; (-) strand; PAM type: NRG; PAM sequence: AAG
caaaagacacaatttagatc

SEQ ID NO: 56946 - DNA, 20 bp, Artificial Sequence
  Description of Artificial Sequence: Synthetic oligonucleotide
  Target: ATXN1; (-) strand; PAM type: NRG; PAM sequence: TAG
attcatcaaaagacacaatt

SEQ ID NO: 56947 - DNA, 20 bp, Artificial Sequence
  Description of Artificial Sequence: Synthetic oligonucleotide
  Target: ATXN1; (-) strand; PAM type: NRG; PAM sequence: AAG
aaccactactaattcatcaa

SEQ ID NO: 56948 - DNA, 20 bp, Artificial Sequence
  Description of Artificial Sequence: Synthetic oligonucleotide
  Target: ATXN1; (-) strand; PAM type: NRG; PAM sequence: CAG
gtatcttttccaaattaaca

SEQ ID NO: 56949 - DNA, 20 bp, Artificial Sequence
  Description of Artificial Sequence: Synthetic oligonucleotide
  Target: ATXN1; (-) strand; PAM type: NRG; PAM sequence: TAG
ttttatttgtttaacatatg

SEQ ID NO: 56950 - DNA, 20 bp, Artificial Sequence
  Description of Artificial Sequence: Synthetic oligonucleotide
  Target: ATXN1; (-) strand; PAM type: NRG; PAM sequence: AAG
agtgctttgaaaaacaaaac

SEQ ID NO: 56951 - DNA, 20 bp, Artificial Sequence
  Description of Artificial Sequence: Synthetic oligonucleotide
  Target: ATXN1; (-) strand; PAM type: NRG; PAM sequence: AAG
ttagggacaagaaaactaca

SEQ ID NO: 56952 - DNA, 20 bp, Artificial Sequence
  Description of Artificial Sequence: Synthetic oligonucleotide
  Target: ATXN1; (-) strand; PAM type: NRG; PAM sequence: AAG
agtaaatactttttagggac

SEQ ID NO: 56953 - DNA, 20 bp, Artificial Sequence
  Description of Artificial Sequence: Synthetic oligonucleotide
  Target: ATXN1; (-) strand; PAM type: NRG; PAM sequence: GGG
tttttagtaaatacttttta

SEQ ID NO: 56954 - DNA, 20 bp, Artificial Sequence
  Description of Artificial Sequence: Synthetic oligonucleotide
  Target: ATXN1; (-) strand; PAM type: NRG; PAM sequence: AGG
atttttagtaaatacttttt

SEQ ID NO: 56955 - DNA, 20 bp, Artificial Sequence
  Description of Artificial Sequence: Synthetic oligonucleotide
  Target: ATXN1; (-) strand; PAM type: NRG; PAM sequence: TAG
gatttttagtaaatactttt

SEQ ID NO: 56956 - DNA, 20 bp, Artificial Sequence
  Description of Artificial Sequence: Synthetic oligonucleotide
  Target: ATXN1; (-) strand; PAM type: NRG; PAM sequence: TAG
tgatttcggtcacagatttt

SEQ ID NO: 56957 - DNA, 20 bp, Artificial Sequence
  Description of Artificial Sequence: Synthetic oligonucleotide
  Target: ATXN1; (-) strand; PAM type: NRG; PAM sequence: CAG
gaaaagtttgatttcggtca

SEQ ID NO: 56958 - DNA, 20 bp, Artificial Sequence
  Description of Artificial Sequence: Synthetic oligonucleotide
  Target: ATXN1; (-) strand; PAM type: NRG; PAM sequence: CGG
caaaatgaaaagtttgattt

SEQ ID NO: 56959 - DNA, 20 bp, Artificial Sequence
  Description of Artificial Sequence: Synthetic oligonucleotide
  Target: ATXN1; (-) strand; PAM type: NRG; PAM sequence: AAG
ctcaaatacttcaaaatgaa

SEQ ID NO: 56960 - DNA, 20 bp, Artificial Sequence
  Description of Artificial Sequence: Synthetic oligonucleotide
  Target: ATXN1; (-) strand; PAM type: NRG; PAM sequence: TGG
tctgctaaatactatgcctc

SEQ ID NO: 56961 - DNA, 20 bp, Artificial Sequence
  Description of Artificial Sequence: Synthetic oligonucleotide
  Target: ATXN1; (-) strand; PAM type: NRG; PAM sequence: AAG
attttttaatagtgcttgag

SEQ ID NO: 56962 - DNA, 20 bp, Artificial Sequence
  Description of Artificial Sequence: Synthetic oligonucleotide
  Target: ATXN1; (-) strand; PAM type: NRG; PAM sequence: GAG
ttaattttttaatagtgctt

SEQ ID NO: 56963 - DNA, 20 bp, Artificial Sequence
  Description of Artificial Sequence: Synthetic oligonucleotide
  Target: ATXN1; (-) strand; PAM type: NRG; PAM sequence: TAG
gccccactttaattttttaa

SEQ ID NO: 56964 - DNA, 20 bp, Artificial Sequence
  Description of Artificial Sequence: Synthetic oligonucleotide
  Target: ATXN1; (-) strand; PAM type: NRG; PAM sequence: TGG
caggcgtgagccactgtgcc

SEQ ID NO: 56965 - DNA, 20 bp, Artificial Sequence
  Description of Artificial Sequence: Synthetic oligonucleotide
  Target: ATXN1; (-) strand; PAM type: NRG; PAM sequence: GAG
agtgctgggattacaggcgt

SEQ ID NO: 56966 - DNA, 20 bp, Artificial Sequence
  Description of Artificial Sequence: Synthetic oligonucleotide
  Target: ATXN1; (-) strand; PAM type: NRG; PAM sequence: AGG
cccaaaagtgctgggattac

SEQ ID NO: 56967 - DNA, 20 bp, Artificial Sequence
  Description of Artificial Sequence: Synthetic oligonucleotide
  Target: ATXN1; (-) strand; PAM type: NRG; PAM sequence: CAG
tcccaaaagtgctgggatta

SEQ ID NO: 56968 - DNA, 20 bp, Artificial Sequence
  Description of Artificial Sequence: Synthetic oligonucleotide
  Target: ATXN1; (-) strand; PAM type: NRG; PAM sequence: GGG
ttcagcctcccaaaagtgct

SEQ ID NO: 56969 - DNA, 20 bp, Artificial Sequence
  Description of Artificial Sequence: Synthetic oligonucleotide
  Target: ATXN1; (-) strand; PAM type: NRG; PAM sequence: TGG
cttcagcctcccaaaagtgc

SEQ ID NO: 56970 - DNA, 20 bp, Artificial Sequence
  Description of Artificial Sequence: Synthetic oligonucleotide
  Target: ATXN1; (-) strand; PAM type: NRG; PAM sequence: AAG
tgcccacttcagcctcccaa

SEQ ID NO: 56971 - DNA, 20 bp, Artificial Sequence
  Description of Artificial Sequence: Synthetic oligonucleotide
  Target: ATXN1; (-) strand; PAM type: NRG; PAM sequence: CAG
ctcagatgatctgcccactt

SEQ ID NO: 56972 - DNA, 20 bp, Artificial Sequence
  Description of Artificial Sequence: Synthetic oligonucleotide
  Target: ATXN1; (-) strand; PAM type: NRG; PAM sequence: CAG
tggtctcgaacttccgacct

SEQ ID NO: 56973 - DNA, 20 bp, Artificial Sequence
  Description of Artificial Sequence: Synthetic oligonucleotide
  Target: ATXN1; (-) strand; PAM type: NRG; PAM sequence: TGG
tttcaccatgttgcccaggc

SEQ ID NO: 56974 - DNA, 20 bp, Artificial Sequence
  Description of Artificial Sequence: Synthetic oligonucleotide
  Target: ATXN1; (-) strand; PAM type: NRG; PAM sequence: AGG
ggggtttcaccatgttgccc

SEQ ID NO: 56975 - DNA, 20 bp, Artificial Sequence
  Description of Artificial Sequence: Synthetic oligonucleotide
  Target: ATXN1; (-) strand; PAM type: NRG; PAM sequence: CAG
tggggtttcaccatgttgcc

SEQ ID NO: 56976 - DNA, 20 bp, Artificial Sequence
  Description of Artificial Sequence: Synthetic oligonucleotide
  Target: ATXN1; (-) strand; PAM type: NRG; PAM sequence: GGG
ttgtatttttggtaaagatg

SEQ ID NO: 56977 - DNA, 20 bp, Artificial Sequence
  Description of Artificial Sequence: Synthetic oligonucleotide
  Target: ATXN1; (-) strand; PAM type: NRG; PAM sequence: GGG
tttgtatttttggtaaagat

SEQ ID NO: 56978 - DNA, 20 bp, Artificial Sequence
  Description of Artificial Sequence: Synthetic oligonucleotide
  Target: ATXN1; (-) strand; PAM type: NRG; PAM sequence: TGG
ttttgtatttttggtaaaga

SEQ ID NO: 56979 - DNA, 20 bp, Artificial Sequence
  Description of Artificial Sequence: Synthetic oligonucleotide
  Target: ATXN1; (-) strand; PAM type: NRG; PAM sequence: AAG
taatttttgtatttttggta

SEQ ID NO: 56980 - DNA, 20 bp, Artificial Sequence
  Description of Artificial Sequence: Synthetic oligonucleotide
  Target: ATXN1; (-) strand; PAM type: NRG; PAM sequence: TGG
ccacctaatttttgtatttt

SEQ ID NO: 56981 - DNA, 20 bp, Artificial Sequence
  Description of Artificial Sequence: Synthetic oligonucleotide
  Target: ATXN1; (-) strand; PAM type: NRG; PAM sequence: AGG
tcccgagtagctgggattac

SEQ ID NO: 56982 - DNA, 20 bp, Artificial Sequence
  Description of Artificial Sequence: Synthetic oligonucleotide
  Target: ATXN1; (-) strand; PAM type: NRG; PAM sequence: CAG
ctcccgagtagctgggatta

SEQ ID NO: 56983 - DNA, 20 bp, Artificial Sequence
  Description of Artificial Sequence: Synthetic oligonucleotide
  Target: ATXN1; (-) strand; PAM type: NRG; PAM sequence: GGG
cctcagcctcccgagtagct

SEQ ID NO: 56984 - DNA, 20 bp, Artificial Sequence
  Description of Artificial Sequence: Synthetic oligonucleotide
  Target: ATXN1; (-) strand; PAM type: NRG; PAM sequence: TGG
gcctcagcctcccgagtagc

SEQ ID NO: 56985 - DNA, 20 bp, Artificial Sequence
  Description of Artificial Sequence: Synthetic oligonucleotide
  Target: ATXN1; (-) strand; PAM type: NRG; PAM sequence: TAG
tcctgcctcagcctcccgag

SEQ ID NO: 56986 - DNA, 20 bp, Artificial Sequence
  Description of Artificial Sequence: Synthetic oligonucleotide
  Target: ATXN1; (-) strand; PAM type: NRG; PAM sequence: GAG
ttctcctgcctcagcctccc

SEQ ID NO: 56987 - DNA, 20 bp, Artificial Sequence
  Description of Artificial Sequence: Synthetic oligonucleotide
  Target: ATXN1; (-) strand; PAM type: NRG; PAM sequence: CAG
ttcaagtgattctcctgcct

SEQ ID NO: 56988 - DNA, 20 bp, Artificial Sequence
  Description of Artificial Sequence: Synthetic oligonucleotide
  Target: ATXN1; (-) strand; PAM type: NRG; PAM sequence: AAG
aacctccgcctcccgggttc

SEQ ID NO: 56989 - DNA, 20 bp, Artificial Sequence
  Description of Artificial Sequence: Synthetic oligonucleotide
  Target: ATXN1; (-) strand; PAM type: NRG; PAM sequence: GGG
cactgcaacctccgcctccc

SEQ ID NO: 56990 - DNA, 20 bp, Artificial Sequence
  Description of Artificial Sequence: Synthetic oligonucleotide
  Target: ATXN1; (-) strand; PAM type: NRG; PAM sequence: CGG
tcactgcaacctccgcctcc

SEQ ID NO: 56991 - DNA, 20 bp, Artificial Sequence
  Description of Artificial Sequence: Synthetic oligonucleotide
  Target: ATXN1; (-) strand; PAM type: NRG; PAM sequence: CAG
ggagtgcaatggcaccgtct

SEQ ID NO: 56992 - DNA, 20 bp, Artificial Sequence
  Description of Artificial Sequence: Synthetic oligonucleotide
  Target: ATXN1; (-) strand; PAM type: NRG; PAM sequence: TGG
tcccccaggctggagtgcaa

SEQ ID NO: 56993 - DNA, 20 bp, Artificial Sequence
  Description of Artificial Sequence: Synthetic oligonucleotide
  Target: ATXN1; (-) strand; PAM type: NRG; PAM sequence: GAG
tgctcttgtcccccaggctg

SEQ ID NO: 56994 - DNA, 20 bp, Artificial Sequence
  Description of Artificial Sequence: Synthetic oligonucleotide
  Target: ATXN1; (-) strand; PAM type: NRG; PAM sequence: TGG
cttgctcttgtcccccaggc

SEQ ID NO: 56995 - DNA, 20 bp, Artificial Sequence
  Description of Artificial Sequence: Synthetic oligonucleotide
  Target: ATXN1; (-) strand; PAM type: NRG; PAM sequence: AGG
aagtcttgctcttgtccccc

SEQ ID NO: 56996 - DNA, 20 bp, Artificial Sequence
  Description of Artificial Sequence: Synthetic oligonucleotide
  Target: ATXN1; (-) strand; PAM type: NRG; PAM sequence: CAG
gaagtcttgctcttgtcccc

SEQ ID NO: 56997 - DNA, 20 bp, Artificial Sequence
  Description of Artificial Sequence: Synthetic oligonucleotide
  Target: ATXN1; (-) strand; PAM type: NRG; PAM sequence: AAG
ttttttttttttttgagacg

SEQ ID NO: 56998 - DNA, 20 bp, Artificial Sequence
  Description of Artificial Sequence: Synthetic oligonucleotide
  Target: ATXN1; (-) strand; PAM type: NRG; PAM sequence: GAG
ttcaattttttttttttttt

SEQ ID NO: 56999 - DNA, 20 bp, Artificial Sequence
  Description of Artificial Sequence: Synthetic oligonucleotide
  Target: ATXN1; (-) strand; PAM type: NRG; PAM sequence: TGG
caggcatgagccaccgcacc

SEQ ID NO: 57000 - DNA, 20 bp, Artificial Sequence
  Description of Artificial Sequence: Synthetic oligonucleotide
  Target: ATXN1; (-) strand; PAM type: NRG; PAM sequence: GAG
agtgctgggattacaggcat

SEQ ID NO: 57001 - DNA, 20 bp, Artificial Sequence
  Description of Artificial Sequence: Synthetic oligonucleotide
  Target: ATXN1; (-) strand; PAM type: NRG; PAM sequence: AGG
tcccaaagtgctgggattac

SEQ ID NO: 57002 - DNA, 20 bp, Artificial Sequence
  Description of Artificial Sequence: Synthetic oligonucleotide
  Target: ATXN1; (-) strand; PAM type: NRG; PAM sequence: CAG
ctcccaaagtgctgggatta

SEQ ID NO: 57003 - DNA, 20 bp, Artificial Sequence
  Description of Artificial Sequence: Synthetic oligonucleotide
  Target: ATXN1; (-) strand; PAM type: NRG; PAM sequence: GGG
tttagacctcccaaagtgct

SEQ ID NO: 57004 - DNA, 20 bp, Artificial Sequence
  Description of Artificial Sequence: Synthetic oligonucleotide
  Target: ATXN1; (-) strand; PAM type: NRG; PAM sequence: TGG
atttagacctcccaaagtgc

SEQ ID NO: 57005 - DNA, 20 bp, Artificial Sequence
  Description of Artificial Sequence: Synthetic oligonucleotide
  Target: ATXN1; (-) strand; PAM type: NRG; PAM sequence: AAG
ccacccatttagacctccca

SEQ ID NO: 57006 - DNA, 20 bp, Artificial Sequence
  Description of Artificial Sequence: Synthetic oligonucleotide
  Target: ATXN1; (-) strand; PAM type: NRG; PAM sequence: TAG
gttcaagcgatccacccatt

SEQ ID NO: 57007 - DNA, 20 bp, Artificial Sequence
  Description of Artificial Sequence: Synthetic oligonucleotide
  Target: ATXN1; (-) strand; PAM type: NRG; PAM sequence: AAG
ggctggagactcctgggttc

SEQ ID NO: 57008 - DNA, 20 bp, Artificial Sequence
  Description of Artificial Sequence: Synthetic oligonucleotide
  Target: ATXN1; (-) strand; PAM type: NRG; PAM sequence: GGG
tgcccaggctggagactcct

SEQ ID NO: 57009 - DNA, 20 bp, Artificial Sequence
  Description of Artificial Sequence: Synthetic oligonucleotide
  Target: ATXN1; (-) strand; PAM type: NRG; PAM sequence: TGG
ttgcccaggctggagactcc

SEQ ID NO: 57010 - DNA, 20 bp, Artificial Sequence
  Description of Artificial Sequence: Synthetic oligonucleotide
  Target: ATXN1; (-) strand; PAM type: NRG; PAM sequence: GAG
ttgccatgttgcccaggctg

SEQ ID NO: 57011 - DNA, 20 bp, Artificial Sequence
  Description of Artificial Sequence: Synthetic oligonucleotide
  Target: ATXN1; (-) strand; PAM type: NRG; PAM sequence: TGG
ttttgccatgttgcccaggc

SEQ ID NO: 57012 - DNA, 20 bp, Artificial Sequence
  Description of Artificial Sequence: Synthetic oligonucleotide
  Target: ATXN1; (-) strand; PAM type: NRG; PAM sequence: AGG
ggggttttgccatgttgccc

SEQ ID NO: 57013 - DNA, 20 bp, Artificial Sequence
  Description of Artificial Sequence: Synthetic oligonucleotide
  Target: ATXN1; (-) strand; PAM type: NRG; PAM sequence: CAG
tggggttttgccatgttgcc

SEQ ID NO: 57014 - DNA, 20 bp, Artificial Sequence
  Description of Artificial Sequence: Synthetic oligonucleotide
  Target: ATXN1; (-) strand; PAM type: NRG; PAM sequence: GGG
ttgtatttttggtagagatg

SEQ ID NO: 57015 - DNA, 20 bp, Artificial Sequence
  Description of Artificial Sequence: Synthetic oligonucleotide
  Target: ATXN1; (-) strand; PAM type: NRG; PAM sequence: GGG
tttgtatttttggtagagat

SEQ ID NO: 57016 - DNA, 20 bp, Artificial Sequence
  Description of Artificial Sequence: Synthetic oligonucleotide
  Target: ATXN1; (-) strand; PAM type: NRG; PAM sequence: TGG
ttttgtatttttggtagaga

SEQ ID NO: 57017 - DNA, 20 bp, Artificial Sequence
  Description of Artificial Sequence: Synthetic oligonucleotide
  Target: ATXN1; (-) strand; PAM type: NRG; PAM sequence: GAG
aattttttgtatttttggta

SEQ ID NO: 57018 - DNA, 20 bp, Artificial Sequence
  Description of Artificial Sequence: Synthetic oligonucleotide
  Target: ATXN1; (-) strand; PAM type: NRG; PAM sequence: TAG
ctaattttttgtatttttgg

SEQ ID NO: 57019 - DNA, 20 bp, Artificial Sequence
  Description of Artificial Sequence: Synthetic oligonucleotide
  Target: ATXN1; (-) strand; PAM type: NRG; PAM sequence: TGG
tggctaattttttgtatttt

SEQ ID NO: 57020 - DNA, 20 bp, Artificial Sequence
  Description of Artificial Sequence: Synthetic oligonucleotide
  Target: ATXN1; (-) strand; PAM type: NRG; PAM sequence: TGG
taagaatgtgccaccacgcc

SEQ ID NO: 57021 - DNA, 20 bp, Artificial Sequence
  Description of Artificial Sequence: Synthetic oligonucleotide
  Target: ATXN1; (-) strand; PAM type: NRG; PAM sequence: AAG
tgggggcatgtctctgtggt

SEQ ID NO: 57022 - DNA, 20 bp, Artificial Sequence
  Description of Artificial Sequence: Synthetic oligonucleotide
  Target: ATXN1; (-) strand; PAM type: NRG; PAM sequence: TGG
gttttgggggcatgtctctg

SEQ ID NO: 57023 - DNA, 20 bp, Artificial Sequence
  Description of Artificial Sequence: Synthetic oligonucleotide
  Target: ATXN1; (-) strand; PAM type: NRG; PAM sequence: GGG
aaagttttcatctgttttgg

SEQ ID NO: 57024 - DNA, 20 bp, Artificial Sequence
  Description of Artificial Sequence: Synthetic oligonucleotide
  Target: ATXN1; (-) strand; PAM type: NRG; PAM sequence: GGG
caaagttttcatctgttttg

SEQ ID NO: 57025 - DNA, 20 bp, Artificial Sequence
  Description of Artificial Sequence: Synthetic oligonucleotide
  Target: ATXN1; (-) strand; PAM type: NRG; PAM sequence: GGG
tcaaagttttcatctgtttt

SEQ ID NO: 57026 - DNA, 20 bp, Artificial Sequence
  Description of Artificial Sequence: Synthetic oligonucleotide
  Target: ATXN1; (-) strand; PAM type: NRG; PAM sequence: TGG
atcaaagttttcatctgttt

SEQ ID NO: 57027 - DNA, 20 bp, Artificial Sequence
  Description of Artificial Sequence: Synthetic oligonucleotide
  Target: ATXN1; (-) strand; PAM type: NRG; PAM sequence: AAG
ttagctcttttgaaatatca

SEQ ID NO: 57028 - DNA, 20 bp, Artificial Sequence
  Description of Artificial Sequence: Synthetic oligonucleotide
  Target: ATXN1; (-) strand; PAM type: NRG; PAM sequence: TAG
cttacttcctcattttcttt

SEQ ID NO: 57029 - DNA, 20 bp, Artificial Sequence
  Description of Artificial Sequence: Synthetic oligonucleotide
  Target: ATXN1; (-) strand; PAM type: NRG; PAM sequence: TAG
ctgaatgtttttattgggat

SEQ ID NO: 57030 - DNA, 20 bp, Artificial Sequence
  Description of Artificial Sequence: Synthetic oligonucleotide
  Target: ATXN1; (-) strand; PAM type: NRG; PAM sequence: GGG
catttctgaatgtttttatt

SEQ ID NO: 57031 - DNA, 20 bp, Artificial Sequence
  Description of Artificial Sequence: Synthetic oligonucleotide
  Target: ATXN1; (-) strand; PAM type: NRG; PAM sequence: TGG
tcatttctgaatgtttttat

SEQ ID NO: 57032 - DNA, 20 bp, Artificial Sequence
  Description of Artificial Sequence: Synthetic oligonucleotide
  Target: ATXN1; (-) strand; PAM type: NRG; PAM sequence: TGG
tttggtcttcatctagaaaa

SEQ ID NO: 57033 - DNA, 20 bp, Artificial Sequence
  Description of Artificial Sequence: Synthetic oligonucleotide
  Target: ATXN1; (-) strand; PAM type: NRG; PAM sequence: TAG
cttcttatttggtcttcatc

SEQ ID NO: 57034 - DNA, 20 bp, Artificial Sequence
  Description of Artificial Sequence: Synthetic oligonucleotide
  Target: ATXN1; (-) strand; PAM type: NRG; PAM sequence: TGG
ctcttgtgttccttcttatt

SEQ ID NO: 57035 - DNA, 20 bp, Artificial Sequence
  Description of Artificial Sequence: Synthetic oligonucleotide
  Target: ATXN1; (-) strand; PAM type: NRG; PAM sequence: AGG
tcccaagtagctgggactaa

SEQ ID NO: 57036 - DNA, 20 bp, Artificial Sequence
  Description of Artificial Sequence: Synthetic oligonucleotide
  Target: ATXN1; (-) strand; PAM type: NRG; PAM sequence: AAG
ctcccaagtagctgggacta

SEQ ID NO: 57037 - DNA, 20 bp, Artificial Sequence
  Description of Artificial Sequence: Synthetic oligonucleotide
  Target: ATXN1; (-) strand; PAM type: NRG; PAM sequence: GGG
ccttagcctcccaagtagct

SEQ ID NO: 57038 - DNA, 20 bp, Artificial Sequence
  Description of Artificial Sequence: Synthetic oligonucleotide
  Target: ATXN1; (-) strand; PAM type: NRG; PAM sequence: TGG
accttagcctcccaagtagc

SEQ ID NO: 57039 - DNA, 20 bp, Artificial Sequence
  Description of Artificial Sequence: Synthetic oligonucleotide
  Target: ATXN1; (-) strand; PAM type: NRG; PAM sequence: TAG
tcccaccttagcctcccaag

SEQ ID NO: 57040 - DNA, 20 bp, Artificial Sequence
  Description of Artificial Sequence: Synthetic oligonucleotide
  Target: ATXN1; (-) strand; PAM type: NRG; PAM sequence: AAG
tcatcccaccttagcctccc

SEQ ID NO: 57041 - DNA, 20 bp, Artificial Sequence
  Description of Artificial Sequence: Synthetic oligonucleotide
  Target: ATXN1; (-) strand; PAM type: NRG; PAM sequence: TAG
ttcaagcaatcatcccacct

SEQ ID NO: 57042 - DNA, 20 bp, Artificial Sequence
  Description of Artificial Sequence: Synthetic oligonucleotide
  Target: ATXN1; (-) strand; PAM type: NRG; PAM sequence: AAG
aacctctggctcctgggttc

SEQ ID NO: 57043 - DNA, 20 bp, Artificial Sequence
  Description of Artificial Sequence: Synthetic oligonucleotide
  Target: ATXN1; (-) strand; PAM type: NRG; PAM sequence: GGG
cactgcaacctctggctcct

SEQ ID NO: 57044 - DNA, 20 bp, Artificial Sequence
  Description of Artificial Sequence: Synthetic oligonucleotide
  Target: ATXN1; (-) strand; PAM type: NRG; PAM sequence: TGG
tcactgcaacctctggctcc

SEQ ID NO: 57045 - DNA, 20 bp, Artificial Sequence
  Description of Artificial Sequence: Synthetic oligonucleotide
  Target: ATXN1; (-) strand; PAM type: NRG; PAM sequence: TGG
ttttggctcactgcaacctc

SEQ ID NO: 57046 - DNA, 20 bp, Artificial Sequence
  Description of Artificial Sequence: Synthetic oligonucleotide
  Target: ATXN1; (-) strand; PAM type: NRG; PAM sequence: TGG
ggagtgcagtggtgctattt

SEQ ID NO: 57047 - DNA, 20 bp, Artificial Sequence
  Description of Artificial Sequence: Synthetic oligonucleotide
  Target: ATXN1; (-) strand; PAM type: NRG; PAM sequence: TGG
tttcccaggttggagtgcag

SEQ ID NO: 57048 - DNA, 20 bp, Artificial Sequence
  Description of Artificial Sequence: Synthetic oligonucleotide
  Target: ATXN1; (-) strand; PAM type: NRG; PAM sequence: CAG
ctgtttcccaggttggagtg

SEQ ID NO: 57049 - DNA, 20 bp, Artificial Sequence
  Description of Artificial Sequence: Synthetic oligonucleotide
  Target: ATXN1; (-) strand; PAM type: NRG; PAM sequence: GAG
tcactctgtttcccaggttg

SEQ ID NO: 57050 - DNA, 20 bp, Artificial Sequence
  Description of Artificial Sequence: Synthetic oligonucleotide
  Target: ATXN1; (-) strand; PAM type: NRG; PAM sequence: TGG
tctcactctgtttcccaggt

SEQ ID NO: 57051 - DNA, 20 bp, Artificial Sequence
  Description of Artificial Sequence: Synthetic oligonucleotide
  Target: ATXN1; (-) strand; PAM type: NRG; PAM sequence: AGG
agggtctcactctgtttccc

SEQ ID NO: 57052 - DNA, 20 bp, Artificial Sequence
  Description of Artificial Sequence: Synthetic oligonucleotide
  Target: ATXN1; (-) strand; PAM type: NRG; PAM sequence: CAG
cagggtctcactctgtttcc

SEQ ID NO: 57053 - DNA, 20 bp, Artificial Sequence
  Description of Artificial Sequence: Synthetic oligonucleotide
  Target: ATXN1; (-) strand; PAM type: NRG; PAM sequence: GGG
tcttttttttttttaagaca

SEQ ID NO: 57054 - DNA, 20 bp, Artificial Sequence
  Description of Artificial Sequence: Synthetic oligonucleotide
  Target: ATXN1; (-) strand; PAM type: NRG; PAM sequence: AGG
ttcttttttttttttaagac

SEQ ID NO: 57055 - DNA, 20 bp, Artificial Sequence
  Description of Artificial Sequence: Synthetic oligonucleotide
  Target: ATXN1; (-) strand; PAM type: NRG; PAM sequence: CAG
tttcttttttttttttaaga

SEQ ID NO: 57056 - DNA, 20 bp, Artificial Sequence
  Description of Artificial Sequence: Synthetic oligonucleotide
  Target: ATXN1; (-) strand; PAM type: NRG; PAM sequence: AAG
ttcttttctttttttttttt

SEQ ID NO: 57057 - DNA, 20 bp, Artificial Sequence
  Description of Artificial Sequence: Synthetic oligonucleotide
  Target: ATXN1; (-) strand; PAM type: NRG; PAM sequence: TGG
aactgtgctacctttgacac

SEQ ID NO: 57058 - DNA, 20 bp, Artificial Sequence
  Description of Artificial Sequence: Synthetic oligonucleotide
  Target: ATXN1; (-) strand; PAM type: NRG; PAM sequence: GGG
tggcagggaggaggagggca

SEQ ID NO: 57059 - DNA, 20 bp, Artificial Sequence
  Description of Artificial Sequence: Synthetic oligonucleotide
  Target: ATXN1; (-) strand; PAM type: NRG; PAM sequence: AGG
ctggcagggaggaggagggc

SEQ ID NO: 57060 - DNA, 20 bp, Artificial Sequence
  Description of Artificial Sequence: Synthetic oligonucleotide
  Target: ATXN1; (-) strand; PAM type: NRG; PAM sequence: CAG
actggcagggaggaggaggg

SEQ ID NO: 57061 - DNA, 20 bp, Artificial Sequence
  Description of Artificial Sequence: Synthetic oligonucleotide
  Target: ATXN1; (-) strand; PAM type: NRG; PAM sequence: GGG
gttactggcagggaggagga

SEQ ID NO: 57062 - DNA, 20 bp, Artificial Sequence
  Description of Artificial Sequence: Synthetic oligonucleotide
  Target: ATXN1; (-) strand; PAM type: NRG; PAM sequence: AGG
tgttactggcagggaggagg

SEQ ID NO: 57063 - DNA, 20 bp, Artificial Sequence
  Description of Artificial Sequence: Synthetic oligonucleotide
  Target: ATXN1; (-) strand; PAM type: NRG; PAM sequence: GAG
ttgttactggcagggaggag

SEQ ID NO: 57064 - DNA, 20 bp, Artificial Sequence
  Description of Artificial Sequence: Synthetic oligonucleotide
  Target: ATXN1; (-) strand; PAM type: NRG; PAM sequence: AGG
tattgttactggcagggagg

SEQ ID NO: 57065 - DNA, 20 bp, Artificial Sequence
  Description of Artificial Sequence: Synthetic oligonucleotide
  Target: ATXN1; (-) strand; PAM type: NRG; PAM sequence: GAG
ctattgttactggcagggag

SEQ ID NO: 57066 - DNA, 20 bp, Artificial Sequence
  Description of Artificial Sequence: Synthetic oligonucleotide
  Target: ATXN1; (-) strand; PAM type: NRG; PAM sequence: AGG
tgctattgttactggcaggg

SEQ ID NO: 57067 - DNA, 20 bp, Artificial Sequence
  Description of Artificial Sequence: Synthetic oligonucleotide
  Target: ATXN1; (-) strand; PAM type: NRG; PAM sequence: GAG
ttgctattgttactggcagg

SEQ ID NO: 57068 - DNA, 20 bp, Artificial Sequence
  Description of Artificial Sequence: Synthetic oligonucleotide
  Target: ATXN1; (-) strand; PAM type: NRG; PAM sequence: GGG
cattgctattgttactggca

SEQ ID NO: 57069 - DNA, 20 bp, Artificial Sequence
  Description of Artificial Sequence: Synthetic oligonucleotide
  Target: ATXN1; (-) strand; PAM type: NRG; PAM sequence: AGG
tcattgctattgttactggc

SEQ ID NO: 57070 - DNA, 20 bp, Artificial Sequence
  Description of Artificial Sequence: Synthetic oligonucleotide
  Target: ATXN1; (-) strand; PAM type: NRG; PAM sequence: CAG
atcattgctattgttactgg

SEQ ID NO: 57071 - DNA, 20 bp, Artificial Sequence
  Description of Artificial Sequence: Synthetic oligonucleotide
  Target: ATXN1; (-) strand; PAM type: NRG; PAM sequence: TGG
gttatcattgctattgttac

SEQ ID NO: 57072 - DNA, 20 bp, Artificial Sequence
  Description of Artificial Sequence: Synthetic oligonucleotide
  Target: ATXN1; (-) strand; PAM type: NRG; PAM sequence: TGG
tgatgtggtccatgggtttt

SEQ ID NO: 57073 - DNA, 20 bp, Artificial Sequence
  Description of Artificial Sequence: Synthetic oligonucleotide
  Target: ATXN1; (-) strand; PAM type: NRG; PAM sequence: GGG
tttgtcttgatgtggtccat

SEQ ID NO: 57074 - DNA, 20 bp, Artificial Sequence
  Description of Artificial Sequence: Synthetic oligonucleotide
  Target: ATXN1; (-) strand; PAM type: NRG; PAM sequence: TGG
ttttgtcttgatgtggtcca

SEQ ID NO: 57075 - DNA, 20 bp, Artificial Sequence
  Description of Artificial Sequence: Synthetic oligonucleotide
  Target: ATXN1; (-) strand; PAM type: NRG; PAM sequence: TGG
aacctcattttgtcttgatg

SEQ ID NO: 57076 - DNA, 20 bp, Artificial Sequence
  Description of Artificial Sequence: Synthetic oligonucleotide
  Target: ATXN1; (-) strand; PAM type: NRG; PAM sequence: CAG
cttcaggtttatggactaca

SEQ ID NO: 57077 - DNA, 20 bp, Artificial Sequence
  Description of Artificial Sequence: Synthetic oligonucleotide
  Target: ATXN1; (-) strand; PAM type: NRG; PAM sequence: TGG
cattcctgtcttcaggttta

SEQ ID NO: 57078 - DNA, 20 bp, Artificial Sequence
  Description of Artificial Sequence: Synthetic oligonucleotide
  Target: ATXN1; (-) strand; PAM type: NRG; PAM sequence: AGG
ccacacccattcctgtcttc

SEQ ID NO: 57079 - DNA, 20 bp, Artificial Sequence
  Description of Artificial Sequence: Synthetic oligonucleotide
  Target: ATXN1; (-) strand; PAM type: NRG; PAM sequence: CAG
gccacacccattcctgtctt

SEQ ID NO: 57080 - DNA, 20 bp, Artificial Sequence
  Description of Artificial Sequence: Synthetic oligonucleotide
  Target: ATXN1; (-) strand; PAM type: NRG; PAM sequence: CGG
ctctgtcactataaatggtt

SEQ ID NO: 57081 - DNA, 20 bp, Artificial Sequence
  Description of Artificial Sequence: Synthetic oligonucleotide
  Target: ATXN1; (-) strand; PAM type: NRG; PAM sequence: TGG
cctggctctgtcactataaa

SEQ ID NO: 57082 - DNA, 20 bp, Artificial Sequence
  Description of Artificial Sequence: Synthetic oligonucleotide
  Target: ATXN1; (-) strand; PAM type: NRG; PAM sequence: TGG
gcacagatattgcttctgcc

SEQ ID NO: 57083 - DNA, 20 bp, Artificial Sequence
  Description of Artificial Sequence: Synthetic oligonucleotide
  Target: ATXN1; (-) strand; PAM type: NRG; PAM sequence: CAG
tcctccaactttctcttgca

SEQ ID NO: 57084 - DNA, 20 bp, Artificial Sequence
  Description of Artificial Sequence: Synthetic oligonucleotide
  Target: ATXN1; (-) strand; PAM type: NRG; PAM sequence: CAG
gcccgttgtgccaaaacctt

SEQ ID NO: 57085 - DNA, 20 bp, Artificial Sequence
  Description of Artificial Sequence: Synthetic oligonucleotide
  Target: ATXN1; (-) strand; PAM type: NRG; PAM sequence: GAG
aaggacctttggaagcttgg

SEQ ID NO: 57086 - DNA, 20 bp, Artificial Sequence
  Description of Artificial Sequence: Synthetic oligonucleotide
  Target: ATXN1; (-) strand; PAM type: NRG; PAM sequence: GGG
gtaaggacctttggaagctt

SEQ ID NO: 57087 - DNA, 20 bp, Artificial Sequence
  Description of Artificial Sequence: Synthetic oligonucleotide
  Target: ATXN1; (-) strand; PAM type: NRG; PAM sequence: TGG
cgtaaggacctttggaagct

SEQ ID NO: 57088 - DNA, 20 bp, Artificial Sequence
  Description of Artificial Sequence: Synthetic oligonucleotide
  Target: ATXN1; (-) strand; PAM type: NRG; PAM sequence: AAG
cgtgccgtaaggacctttgg

SEQ ID NO: 57089 - DNA, 20 bp, Artificial Sequence
  Description of Artificial Sequence: Synthetic oligonucleotide
  Target: ATXN1; (-) strand; PAM type: NRG; PAM sequence: TGG
gaccgtgccgtaaggacctt

SEQ ID NO: 57090 - DNA, 20 bp, Artificial Sequence
  Description of Artificial Sequence: Synthetic oligonucleotide
  Target: ATXN1; (-) strand; PAM type: NRG; PAM sequence: AGG
accctgctgaccgtgccgta

SEQ ID NO: 57091 - DNA, 20 bp, Artificial Sequence
  Description of Artificial Sequence: Synthetic oligonucleotide
  Target: ATXN1; (-) strand; PAM type: NRG; PAM sequence: AAG
caccctgctgaccgtgccgt

SEQ ID NO: 57092 - DNA, 20 bp, Artificial Sequence
  Description of Artificial Sequence: Synthetic oligonucleotide
  Target: ATXN1; (-) strand; PAM type: NRG; PAM sequence: TAG
tgatgctgctgtgctcaaaa

SEQ ID NO: 57093 - DNA, 20 bp, Artificial Sequence
  Description of Artificial Sequence: Synthetic oligonucleotide
  Target: ATXN1; (-) strand; PAM type: NRG; PAM sequence: AGG
ccccatgaattggattctgc

SEQ ID NO: 57094 - DNA, 20 bp, Artificial Sequence
  Description of Artificial Sequence: Synthetic oligonucleotide
  Target: ATXN1; (-) strand; PAM type: NRG; PAM sequence: CAG
accccatgaattggattctg

SEQ ID NO: 57095 - DNA, 20 bp, Artificial Sequence
  Description of Artificial Sequence: Synthetic oligonucleotide
  Target: ATXN1; (-) strand; PAM type: NRG; PAM sequence: TGG
cttgccctcaccccatgaat

SEQ ID NO: 57096 - DNA, 20 bp, Artificial Sequence
  Description of Artificial Sequence: Synthetic oligonucleotide
  Target: ATXN1; (-) strand; PAM type: NRG; PAM sequence: GGG
aagcacctcagaccttccca

SEQ ID NO: 57097 - DNA, 20 bp, Artificial Sequence
  Description of Artificial Sequence: Synthetic oligonucleotide
  Target: ATXN1; (-) strand; PAM type: NRG; PAM sequence: AGG
taagcacctcagaccttccc

SEQ ID NO: 57098 - DNA, 20 bp, Artificial Sequence
  Description of Artificial Sequence: Synthetic oligonucleotide
  Target: ATXN1; (-) strand; PAM type: NRG; PAM sequence: CAG
ctaagcacctcagaccttcc

SEQ ID NO: 57099 - DNA, 20 bp, Artificial Sequence
  Description of Artificial Sequence: Synthetic oligonucleotide
  Target: ATXN1; (-) strand; PAM type: NRG; PAM sequence: CAG
tccgtaacacctaagcacct

SEQ ID NO: 57100 - DNA, 20 bp, Artificial Sequence
  Description of Artificial Sequence: Synthetic oligonucleotide
  Target: ATXN1; (-) strand; PAM type: NRG; PAM sequence: AAG
gccctggctccgtaacacct

SEQ ID NO: 57101 - DNA, 20 bp, Artificial Sequence
  Description of Artificial Sequence: Synthetic oligonucleotide
  Target: ATXN1; (-) strand; PAM type: NRG; PAM sequence: TGG
tgttggtctcaagagtgccc

SEQ ID NO: 57102 - DNA, 20 bp, Artificial Sequence
  Description of Artificial Sequence: Synthetic oligonucleotide
  Target: ATXN1; (-) strand; PAM type: NRG; PAM sequence: GAG
cttagatttgttggtctcaa

SEQ ID NO: 57103 - DNA, 20 bp, Artificial Sequence
  Description of Artificial Sequence: Synthetic oligonucleotide
  Target: ATXN1; (-) strand; PAM type: NRG; PAM sequence: AAG
agcttagatttgttggtctc

SEQ ID NO: 57104 - DNA, 20 bp, Artificial Sequence
  Description of Artificial Sequence: Synthetic oligonucleotide
  Target: ATXN1; (-) strand; PAM type: NRG; PAM sequence: TGG
ggaaggaagcttagatttgt

SEQ ID NO: 57105 - DNA, 20 bp, Artificial Sequence
  Description of Artificial Sequence: Synthetic oligonucleotide
  Target: ATXN1; (-) strand; PAM type: NRG; PAM sequence: TAG
tttggtcgtggaaggaagct

SEQ ID NO: 57106 - DNA, 20 bp, Artificial Sequence
  Description of Artificial Sequence: Synthetic oligonucleotide
  Target: ATXN1; (-) strand; PAM type: NRG; PAM sequence: AAG
ggtgatttggtcgtggaagg

SEQ ID NO: 57107 - DNA, 20 bp, Artificial Sequence
  Description of Artificial Sequence: Synthetic oligonucleotide
  Target: ATXN1; (-) strand; PAM type: NRG; PAM sequence: AGG
caaggtgatttggtcgtgga

SEQ ID NO: 57108 - DNA, 20 bp, Artificial Sequence
  Description of Artificial Sequence: Synthetic oligonucleotide
  Target: ATXN1; (-) strand; PAM type: NRG; PAM sequence: AAG
tcaaggtgatttggtcgtgg

SEQ ID NO: 57109 - DNA, 20 bp, Artificial Sequence
  Description of Artificial Sequence: Synthetic oligonucleotide
  Target: ATXN1; (-) strand; PAM type: NRG; PAM sequence: TGG
ttctcaaggtgatttggtcg

SEQ ID NO: 57110 - DNA, 20 bp, Artificial Sequence
  Description of Artificial Sequence: Synthetic oligonucleotide
  Target: ATXN1; (-) strand; PAM type: NRG; PAM sequence: TGG
agtttcttctcaaggtgatt

SEQ ID NO: 57111 - DNA, 20 bp, Artificial Sequence
  Description of Artificial Sequence: Synthetic oligonucleotide
  Target: ATXN1; (-) strand; PAM type: NRG; PAM sequence: AGG
ctctcaaaagtttcttctca

SEQ ID NO: 57112 - DNA, 20 bp, Artificial Sequence
  Description of Artificial Sequence: Synthetic oligonucleotide
  Target: ATXN1; (-) strand; PAM type: NRG; PAM sequence: AAG
gctctcaaaagtttcttctc

SEQ ID NO: 57113 - DNA, 20 bp, Artificial Sequence
  Description of Artificial Sequence: Synthetic oligonucleotide
  Target: ATXN1; (-) strand; PAM type: NRG; PAM sequence: AAG
gatttagattctgctctcaa

SEQ ID NO: 57114 - DNA, 20 bp, Artificial Sequence
  Description of Artificial Sequence: Synthetic oligonucleotide
  Target: ATXN1; (-) strand; PAM type: NRG; PAM sequence: TAG
tattactgccatgttcgatt

SEQ ID NO: 57115 - DNA, 20 bp, Artificial Sequence
  Description of Artificial Sequence: Synthetic oligonucleotide
  Target: ATXN1; (-) strand; PAM type: NRG; PAM sequence: TGG
tctgccccctcccttcactt

SEQ ID NO: 57116 - DNA, 20 bp, Artificial Sequence
  Description of Artificial Sequence: Synthetic oligonucleotide
  Target: ATXN1; (-) strand; PAM type: NRG; PAM sequence: TGG
cttctctgcctcccttcact

SEQ ID NO: 57117 - DNA, 20 bp, Artificial Sequence
  Description of Artificial Sequence: Synthetic oligonucleotide
  Target: ATXN1; (-) strand; PAM type: NRG; PAM sequence: TAG
aaataaggcctatattttct

SEQ ID NO: 57118 - DNA, 20 bp, Artificial Sequence
  Description of Artificial Sequence: Synthetic oligonucleotide
  Target: ATXN1; (-) strand; PAM type: NRG; PAM sequence: AGG
tgtttccatggaataaaata

SEQ ID NO: 57119 - DNA, 20 bp, Artificial Sequence
  Description of Artificial Sequence: Synthetic oligonucleotide
  Target: ATXN1; (-) strand; PAM type: NRG; PAM sequence: AAG
ttgtttccatggaataaaat

SEQ ID NO: 57120 - DNA, 20 bp, Artificial Sequence
  Description of Artificial Sequence: Synthetic oligonucleotide
  Target: ATXN1; (-) strand; PAM type: NRG; PAM sequence: TGG
tccgtcttctgttgtttcca

SEQ ID NO: 57121 - DNA, 20 bp, Artificial Sequence
  Description of Artificial Sequence: Synthetic oligonucleotide
  Target: ATXN1; (-) strand; PAM type: NRG; PAM sequence: TAG
attttctagtgtctaggcca

SEQ ID NO: 57122 - DNA, 20 bp, Artificial Sequence
  Description of Artificial Sequence: Synthetic oligonucleotide
  Target: ATXN1; (-) strand; PAM type: NRG; PAM sequence: AGG
gaaaatattttctagtgtct

SEQ ID NO: 57123 - DNA, 20 bp, Artificial Sequence
  Description of Artificial Sequence: Synthetic oligonucleotide
  Target: ATXN1; (-) strand; PAM type: NRG; PAM sequence: TAG
agaaaatattttctagtgtc

SEQ ID NO: 57124 - DNA, 20 bp, Artificial Sequence
  Description of Artificial Sequence: Synthetic oligonucleotide
  Target: ATXN1; (-) strand; PAM type: NRG; PAM sequence: TAG
atgggccagaaaatattttc

SEQ ID NO: 57125 - DNA, 20 bp, Artificial Sequence
  Description of Artificial Sequence: Synthetic oligonucleotide
  Target: ATXN1; (-) strand; PAM type: NRG; PAM sequence: CAG
tttagggataagggatgggc

SEQ ID NO: 57126 - DNA, 20 bp, Artificial Sequence
  Description of Artificial Sequence: Synthetic oligonucleotide
  Target: ATXN1; (-) strand; PAM type: NRG; PAM sequence: GGG
tatttttagggataagggat

SEQ ID NO: 57127 - DNA, 20 bp, Artificial Sequence
  Description of Artificial Sequence: Synthetic oligonucleotide
  Target: ATXN1; (-) strand; PAM type: NRG; PAM sequence: TGG
gtatttttagggataaggga

SEQ ID NO: 57128 - DNA, 20 bp, Artificial Sequence
  Description of Artificial Sequence: Synthetic oligonucleotide
  Target: ATXN1; (-) strand; PAM type: NRG; PAM sequence: GGG
tcttgtatttttagggataa

SEQ ID NO: 57129 - DNA, 20 bp, Artificial Sequence
  Description of Artificial Sequence: Synthetic oligonucleotide
  Target: ATXN1; (-) strand; PAM type: NRG; PAM sequence: AGG
ttcttgtatttttagggata

SEQ ID NO: 57130 - DNA, 20 bp, Artificial Sequence
  Description of Artificial Sequence: Synthetic oligonucleotide
  Target: ATXN1; (-) strand; PAM type: NRG; PAM sequence: AAG
tttcttgtatttttagggat

SEQ ID NO: 57131 - DNA, 20 bp, Artificial Sequence
  Description of Artificial Sequence: Synthetic oligonucleotide
  Target: ATXN1; (-) strand; PAM type: NRG; PAM sequence: GGG
tgagttttcttgtattttta

SEQ ID NO: 57132 - DNA, 20 bp, Artificial Sequence
  Description of Artificial Sequence: Synthetic oligonucleotide
  Target: ATXN1; (-) strand; PAM type: NRG; PAM sequence: AGG
atgagttttcttgtattttt

SEQ ID NO: 57133 - DNA, 20 bp, Artificial Sequence
  Description of Artificial Sequence: Synthetic oligonucleotide
  Target: ATXN1; (-) strand; PAM type: NRG; PAM sequence: TAG
aatgagttttcttgtatttt

SEQ ID NO: 57134 - DNA, 20 bp, Artificial Sequence
  Description of Artificial Sequence: Synthetic oligonucleotide
  Target: ATXN1; (-) strand; PAM type: NRG; PAM sequence: GAG
tactcatttttaagtggaat

SEQ ID NO: 57135 - DNA, 20 bp, Artificial Sequence
  Description of Artificial Sequence: Synthetic oligonucleotide
  Target: ATXN1; (-) strand; PAM type: NRG; PAM sequence: TGG
ttttgttactcatttttaag

SEQ ID NO: 57136 - DNA, 20 bp, Artificial Sequence
  Description of Artificial Sequence: Synthetic oligonucleotide
  Target: ATXN1; (-) strand; PAM type: NRG; PAM sequence: AAG
ctattttgttactcattttt

SEQ ID NO: 57137 - DNA, 20 bp, Artificial Sequence
  Description of Artificial Sequence: Synthetic oligonucleotide
  Target: ATXN1; (-) strand; PAM type: NRG; PAM sequence: AAG
tgggggcatgtctctgtggt

SEQ ID NO: 57138 - DNA, 20 bp, Artificial Sequence
  Description of Artificial Sequence: Synthetic oligonucleotide
  Target: ATXN1; (-) strand; PAM type: NRG; PAM sequence: TGG
gttttgggggcatgtctctg

SEQ ID NO: 57139 - DNA, 20 bp, Artificial Sequence
  Description of Artificial Sequence: Synthetic oligonucleotide
  Target: ATXN1; (-) strand; PAM type: NRG; PAM sequence: GGG
aaagttttcatctgttttgg

SEQ ID NO: 57140 - DNA, 20 bp, Artificial Sequence
  Description of Artificial Sequence: Synthetic oligonucleotide
  Target: ATXN1; (-) strand; PAM type: NRG; PAM sequence: GGG
taaagttttcatctgttttg

SEQ ID NO: 57141 - DNA, 20 bp, Artificial Sequence
  Description of Artificial Sequence: Synthetic oligonucleotide
  Target: ATXN1; (-) strand; PAM type: NRG; PAM sequence: GGG
ttaaagttttcatctgtttt

SEQ ID NO: 57142 - DNA, 20 bp, Artificial Sequence
  Description of Artificial Sequence: Synthetic oligonucleotide
  Target: ATXN1; (-) strand; PAM type: NRG; PAM sequence: TGG
attaaagttttcatctgttt

SEQ ID NO: 57143 - DNA, 20 bp, Artificial Sequence
  Description of Artificial Sequence: Synthetic oligonucleotide
  Target: ATXN1; (-) strand; PAM type: NRG; PAM sequence: AAG
ttagctcttttgaaatatta

SEQ ID NO: 57144 - DNA, 20 bp, Artificial Sequence
  Description of Artificial Sequence: Synthetic oligonucleotide
  Target: ATXN1; (-) strand; PAM type: NRG; PAM sequence: TAG
cttactgcctcattttcttt

SEQ ID NO: 57145 - DNA, 20 bp, Artificial Sequence
  Description of Artificial Sequence: Synthetic oligonucleotide
  Target: ATXN1; (-) strand; PAM type: NRG; PAM sequence: TAG
ctgaatgtttttattgggat

SEQ ID NO: 57146 - DNA, 20 bp, Artificial Sequence
  Description of Artificial Sequence: Synthetic oligonucleotide
  Target: ATXN1; (-) strand; PAM type: NRG; PAM sequence: GGG
catttctgaatgtttttatt

SEQ ID NO: 57147 - DNA, 20 bp, Artificial Sequence
  Description of Artificial Sequence: Synthetic oligonucleotide
  Target: ATXN1; (-) strand; PAM type: NRG; PAM sequence: TGG
tcatttctgaatgtttttat

SEQ ID NO: 57148 - DNA, 20 bp, Artificial Sequence
  Description of Artificial Sequence: Synthetic oligonucleotide
  Target: ATXN1; (-) strand; PAM type: NRG; PAM sequence: TGG
tttggtcttcatctagaaaa

SEQ ID NO: 57149 - DNA, 20 bp, Artificial Sequence
  Description of Artificial Sequence: Synthetic oligonucleotide
  Target: ATXN1; (-) strand; PAM type: NRG; PAM sequence: TAG
cttcttatttggtcttcatc

SEQ ID NO: 57150 - DNA, 20 bp, Artificial Sequence
  Description of Artificial Sequence: Synthetic oligonucleotide
  Target: ATXN1; (-) strand; PAM type: NRG; PAM sequence: TGG
ctcttgtgttccttcttatt

SEQ ID NO: 57151 - DNA, 20 bp, Artificial Sequence
  Description of Artificial Sequence: Synthetic oligonucleotide
  Target: ATXN1; (-) strand; PAM type: NRG; PAM sequence: AAG
ctattttttagcactcctca

SEQ ID NO: 57152 - DNA, 20 bp, Artificial Sequence
  Description of Artificial Sequence: Synthetic oligonucleotide
  Target: ATXN1; (-) strand; PAM type: NRG; PAM sequence: TAG
actttctcctttctattttt

SEQ ID NO: 57153 - DNA, 20 bp, Artificial Sequence
  Description of Artificial Sequence: Synthetic oligonucleotide
  Target: ATXN1; (-) strand; PAM type: NRG; PAM sequence: GAG
tttgctcatgttccttttct

SEQ ID NO: 57154 - DNA, 20 bp, Artificial Sequence
  Description of Artificial Sequence: Synthetic oligonucleotide
  Target: ATXN1; (-) strand; PAM type: NRG; PAM sequence: GGG
tcttattacagtgttatgtt

SEQ ID NO: 57155 - DNA, 20 bp, Artificial Sequence
  Description of Artificial Sequence: Synthetic oligonucleotide
  Target: ATXN1; (-) strand; PAM type: NRG; PAM sequence: TGG
ctcttattacagtgttatgt

SEQ ID NO: 57156 - DNA, 20 bp, Artificial Sequence
  Description of Artificial Sequence: Synthetic oligonucleotide
  Target: ATXN1; (-) strand; PAM type: NRG; PAM sequence: CAG
ttcttcaaaggctcttatta

SEQ ID NO: 57157 - DNA, 20 bp, Artificial Sequence
  Description of Artificial Sequence: Synthetic oligonucleotide
  Target: ATXN1; (-) strand; PAM type: NRG; PAM sequence: AGG
ttattgcttttcttcttcaa

SEQ ID NO: 57158 - DNA, 20 bp, Artificial Sequence
  Description of Artificial Sequence: Synthetic oligonucleotide
  Target: ATXN1; (-) strand; PAM type: NRG; PAM sequence: AAG
tttattgcttttcttcttca

SEQ ID NO: 57159 - DNA, 20 bp, Artificial Sequence
  Description of Artificial Sequence: Synthetic oligonucleotide
  Target: ATXN1; (-) strand; PAM type: NRG; PAM sequence: AAG
tgtgcttcagtcacgatttt

SEQ ID NO: 57160 - DNA, 20 bp, Artificial Sequence
  Description of Artificial Sequence: Synthetic oligonucleotide
  Target: ATXN1; (-) strand; PAM type: NRG; PAM sequence: CAG
tacttctagaatttgtgctt

SEQ ID NO: 57161 - DNA, 20 bp, Artificial Sequence
  Description of Artificial Sequence: Synthetic oligonucleotide
  Target: ATXN1; (-) strand; PAM type: NRG; PAM sequence: TAG
ttcaaatctttttctacttc

SEQ ID NO: 57162 - DNA, 20 bp, Artificial Sequence
  Description of Artificial Sequence: Synthetic oligonucleotide
  Target: ATXN1; (-) strand; PAM type: NRG; PAM sequence: TAG
tggagtattctgtcaatata

SEQ ID NO: 57163 - DNA, 20 bp, Artificial Sequence
  Description of Artificial Sequence: Synthetic oligonucleotide
  Target: ATXN1; (-) strand; PAM type: NRG; PAM sequence: GAG
tcagtttttccaggtgcatg

SEQ ID NO: 57164 - DNA, 20 bp, Artificial Sequence
  Description of Artificial Sequence: Synthetic oligonucleotide
  Target: ATXN1; (-) strand; PAM type: NRG; PAM sequence: TGG
ggtcagtttttccaggtgca

SEQ ID NO: 57165 - DNA, 20 bp, Artificial Sequence
  Description of Artificial Sequence: Synthetic oligonucleotide
  Target: ATXN1; (-) strand; PAM type: NRG; PAM sequence: AGG
tttcctaggtcagtttttcc

SEQ ID NO: 57166 - DNA, 20 bp, Artificial Sequence
  Description of Artificial Sequence: Synthetic oligonucleotide
  Target: ATXN1; (-) strand; PAM type: NRG; PAM sequence: CAG
ctttcctaggtcagtttttc

SEQ ID NO: 57167 - DNA, 20 bp, Artificial Sequence
  Description of Artificial Sequence: Synthetic oligonucleotide
  Target: ATXN1; (-) strand; PAM type: NRG; PAM sequence: CAG
ttttgttttctttcctaggt

SEQ ID NO: 57168 - DNA, 20 bp, Artificial Sequence
  Description of Artificial Sequence: Synthetic oligonucleotide
  Target: ATXN1; (-) strand; PAM type: NRG; PAM sequence: AGG
ttttttttgttttctttcct

SEQ ID NO: 57169 - DNA, 20 bp, Artificial Sequence
  Description of Artificial Sequence: Synthetic oligonucleotide
  Target: ATXN1; (-) strand; PAM type: NRG; PAM sequence: TAG
tttttttttgttttctttcc

SEQ ID NO: 57170 - DNA, 20 bp, Artificial Sequence
  Description of Artificial Sequence: Synthetic oligonucleotide
  Target: ATXN1; (-) strand; PAM type: NRG; PAM sequence: AAG
tcattttacctgagtgtcca

SEQ ID NO: 57171 - DNA, 20 bp, Artificial Sequence
  Description of Artificial Sequence: Synthetic oligonucleotide
  Target: ATXN1; (-) strand; PAM type: NRG; PAM sequence: GAG
gtaactcagtcattttacct

SEQ ID NO: 57172 - DNA, 20 bp, Artificial Sequence
  Description of Artificial Sequence: Synthetic oligonucleotide
  Target: ATXN1; (-) strand; PAM type: NRG; PAM sequence: CAG
tctgtcccttataggtaact

SEQ ID NO: 57173 - DNA, 20 bp, Artificial Sequence
  Description of Artificial Sequence: Synthetic oligonucleotide
  Target: ATXN1; (-) strand; PAM type: NRG; PAM sequence: AGG
tctaattttctgtcccttat

SEQ ID NO: 57174 - DNA, 20 bp, Artificial Sequence
  Description of Artificial Sequence: Synthetic oligonucleotide
  Target: ATXN1; (-) strand; PAM type: NRG; PAM sequence: TAG
ctctaattttctgtccctta

SEQ ID NO: 57175 - DNA, 20 bp, Artificial Sequence
  Description of Artificial Sequence: Synthetic oligonucleotide
  Target: ATXN1; (-) strand; PAM type: NRG; PAM sequence: GGG
agcctggctcttgaaaaatc

SEQ ID NO: 57176 - DNA, 20 bp, Artificial Sequence
  Description of Artificial Sequence: Synthetic oligonucleotide
  Target: ATXN1; (-) strand; PAM type: NRG; PAM sequence: CGG
aagcctggctcttgaaaaat

SEQ ID NO: 57177 - DNA, 20 bp, Artificial Sequence
  Description of Artificial Sequence: Synthetic oligonucleotide
  Target: ATXN1; (-) strand; PAM type: NRG; PAM sequence: TGG
ctgacttttagcatgaagcc

SEQ ID NO: 57178 - DNA, 20 bp, Artificial Sequence
  Description of Artificial Sequence: Synthetic oligonucleotide
  Target: ATXN1; (-) strand; PAM type: NRG; PAM sequence: AAG
cgctactgacttttagcatg

SEQ ID NO: 57179 - DNA, 20 bp, Artificial Sequence
  Description of Artificial Sequence: Synthetic oligonucleotide
  Target: ATXN1; (-) strand; PAM type: NRG; PAM sequence: TAG
agtgtcacgctactgacttt

SEQ ID NO: 57180 - DNA, 20 bp, Artificial Sequence
  Description of Artificial Sequence: Synthetic oligonucleotide
  Target: ATXN1; (-) strand; PAM type: NRG; PAM sequence: GAG
ttggcttagttgtctttcct

SEQ ID NO: 57181 - DNA, 20 bp, Artificial Sequence
  Description of Artificial Sequence: Synthetic oligonucleotide
  Target: ATXN1; (-) strand; PAM type: NRG; PAM sequence: TAG
tgggtataagatccttggct

SEQ ID NO: 57182 - DNA, 20 bp, Artificial Sequence
  Description of Artificial Sequence: Synthetic oligonucleotide
  Target: ATXN1; (-) strand; PAM type: NRG; PAM sequence: TGG
ttggctgggtataagatcct

SEQ ID NO: 57183 - DNA, 20 bp, Artificial Sequence
  Description of Artificial Sequence: Synthetic oligonucleotide
  Target: ATXN1; (-) strand; PAM type: NRG; PAM sequence: AAG
agatcattttggctgggtat

SEQ ID NO: 57184 - DNA, 20 bp, Artificial Sequence
  Description of Artificial Sequence: Synthetic oligonucleotide
  Target: ATXN1; (-) strand; PAM type: NRG; PAM sequence: GGG
gctggaagatcattttggct

SEQ ID NO: 57185 - DNA, 20 bp, Artificial Sequence
  Description of Artificial Sequence: Synthetic oligonucleotide
  Target: ATXN1; (-) strand; PAM type: NRG; PAM sequence: TGG
ggctggaagatcattttggc

SEQ ID NO: 57186 - DNA, 20 bp, Artificial Sequence
  Description of Artificial Sequence: Synthetic oligonucleotide
  Target: ATXN1; (-) strand; PAM type: NRG; PAM sequence: TGG
tgttggctggaagatcattt

SEQ ID NO: 57187 - DNA, 20 bp, Artificial Sequence
  Description of Artificial Sequence: Synthetic oligonucleotide
  Target: ATXN1; (-) strand; PAM type: NRG; PAM sequence: AAG
aacagattgttgttggctgg

SEQ ID NO: 57188 - DNA, 20 bp, Artificial Sequence
  Description of Artificial Sequence: Synthetic oligonucleotide
  Target: ATXN1; (-) strand; PAM type: NRG; PAM sequence: TGG
cataacagattgttgttggc

SEQ ID NO: 57189 - DNA, 20 bp, Artificial Sequence
  Description of Artificial Sequence: Synthetic oligonucleotide
  Target: ATXN1; (-) strand; PAM type: NRG; PAM sequence: TGG
tattcataacagattgttgt

SEQ ID NO: 57190 - DNA, 20 bp, Artificial Sequence
  Description of Artificial Sequence: Synthetic oligonucleotide
  Target: ATXN1; (-) strand; PAM type: NRG; PAM sequence: CAG
gggtccttgcatattcataa

SEQ ID NO: 57191 - DNA, 20 bp, Artificial Sequence
  Description of Artificial Sequence: Synthetic oligonucleotide
  Target: ATXN1; (-) strand; PAM type: NRG; PAM sequence: GGG
ttctgcgaacaatattcctt

SEQ ID NO: 57192 - DNA, 20 bp, Artificial Sequence
  Description of Artificial Sequence: Synthetic oligonucleotide
  Target: ATXN1; (-) strand; PAM type: NRG; PAM sequence: TGG
tttctgcgaacaatattcct

SEQ ID NO: 57193 - DNA, 20 bp, Artificial Sequence
  Description of Artificial Sequence: Synthetic oligonucleotide
  Target: ATXN1; (-) strand; PAM type: NRG; PAM sequence: GGG
tctcccttgcagattactaa

SEQ ID NO: 57194 - DNA, 20 bp, Artificial Sequence
  Description of Artificial Sequence: Synthetic oligonucleotide
  Target: ATXN1; (-) strand; PAM type: NRG; PAM sequence: AGG
ttctcccttgcagattacta

SEQ ID NO: 57195 - DNA, 20 bp, Artificial Sequence
  Description of Artificial Sequence: Synthetic oligonucleotide
  Target: ATXN1; (-) strand; PAM type: NRG; PAM sequence: AAG
cttctcccttgcagattact

SEQ ID NO: 57196 - DNA, 20 bp, Artificial Sequence
  Description of Artificial Sequence: Synthetic oligonucleotide
  Target: ATXN1; (-) strand; PAM type: NRG; PAM sequence: CAG
tgcctgactcttctcccttg

SEQ ID NO: 57197 - DNA, 20 bp, Artificial Sequence
  Description of Artificial Sequence: Synthetic oligonucleotide
  Target: ATXN1; (-) strand; PAM type: NRG; PAM sequence: TGG
cagtgcctttccagccagac

SEQ ID NO: 57198 - DNA, 20 bp, Artificial Sequence
  Description of Artificial Sequence: Synthetic oligonucleotide
  Target: ATXN1; (-) strand; PAM type: NRG; PAM sequence: CAG
tgtatcagtgcctttccagc

SEQ ID NO: 57199 - DNA, 20 bp, Artificial Sequence
  Description of Artificial Sequence: Synthetic oligonucleotide
  Target: ATXN1; (-) strand; PAM type: NRG; PAM sequence: CAG
tctttgtatcagtgcctttc

SEQ ID NO: 57200 - DNA, 20 bp, Artificial Sequence
  Description of Artificial Sequence: Synthetic oligonucleotide
  Target: ATXN1; (-) strand; PAM type: NRG; PAM sequence: CAG
tgctcacccagtctttgtat

SEQ ID NO: 57201 - DNA, 20 bp, Artificial Sequence
  Description of Artificial Sequence: Synthetic oligonucleotide
  Target: ATXN1; (-) strand; PAM type: NRG; PAM sequence: CAG
ttatgtgttaaatgctcacc

SEQ ID NO: 57202 - DNA, 20 bp, Artificial Sequence
  Description of Artificial Sequence: Synthetic oligonucleotide
  Target: ATXN1; (-) strand; PAM type: NRG; PAM sequence: CAG
atctttcagtaacagaccta

SEQ ID NO: 57203 - DNA, 20 bp, Artificial Sequence
  Description of Artificial Sequence: Synthetic oligonucleotide
  Target: ATXN1; (-) strand; PAM type: NRG; PAM sequence: CAG
ttgtaatcatctttcagtaa

SEQ ID NO: 57204 - DNA, 20 bp, Artificial Sequence
  Description of Artificial Sequence: Synthetic oligonucleotide
  Target: ATXN1; (-) strand; PAM type: NRG; PAM sequence: CAG
gtttccttgtaatcatcttt

SEQ ID NO: 57205 - DNA, 20 bp, Artificial Sequence
  Description of Artificial Sequence: Synthetic oligonucleotide
  Target: ATXN1; (-) strand; PAM type: NRG; PAM sequence: TGG
acatagtcattatatcgttc

SEQ ID NO: 57206 - DNA, 20 bp, Artificial Sequence
  Description of Artificial Sequence: Synthetic oligonucleotide
  Target: ATXN1; (-) strand; PAM type: NRG; PAM sequence: TAG
atctatattgtcagggcaca

SEQ ID NO: 57207 - DNA, 20 bp, Artificial Sequence
  Description of Artificial Sequence: Synthetic oligonucleotide
  Target: ATXN1; (-) strand; PAM type: NRG; PAM sequence: GGG
ttatactatctatattgtca

SEQ ID NO: 57208 - DNA, 20 bp, Artificial Sequence
  Description of Artificial Sequence: Synthetic oligonucleotide
  Target: ATXN1; (-) strand; PAM type: NRG; PAM sequence: AGG
attatactatctatattgtc

SEQ ID NO: 57209 - DNA, 20 bp, Artificial Sequence
  Description of Artificial Sequence: Synthetic oligonucleotide
  Target: ATXN1; (-) strand; PAM type: NRG; PAM sequence: CAG
cattatactatctatattgt

SEQ ID NO: 57210 - DNA, 20 bp, Artificial Sequence
  Description of Artificial Sequence: Synthetic oligonucleotide
  Target: ATXN1; (-) strand; PAM type: NRG; PAM sequence: GAG
cacttaacatctatgttagt

SEQ ID NO: 57211 - DNA, 20 bp, Artificial Sequence
  Description of Artificial Sequence: Synthetic oligonucleotide
  Target: ATXN1; (-) strand; PAM type: NRG; PAM sequence: TAG
ctcccacttaacatctatgt

SEQ ID NO: 57212 - DNA, 20 bp, Artificial Sequence
  Description of Artificial Sequence: Synthetic oligonucleotide
  Target: ATXN1; (-) strand; PAM type: NRG; PAM sequence: AGG
tctggctataatttgattta

SEQ ID NO: 57213 - DNA, 20 bp, Artificial Sequence
  Description of Artificial Sequence: Synthetic oligonucleotide
  Target: ATXN1; (-) strand; PAM type: NRG; PAM sequence: AAG
ctctggctataatttgattt

SEQ ID NO: 57214 - DNA, 20 bp, Artificial Sequence
  Description of Artificial Sequence: Synthetic oligonucleotide
  Target: ATXN1; (-) strand; PAM type: NRG; PAM sequence: TGG
ttctttcttattttcttctc

SEQ ID NO: 57215 - DNA, 20 bp, Artificial Sequence
  Description of Artificial Sequence: Synthetic oligonucleotide
  Target: ATXN1; (-) strand; PAM type: NRG; PAM sequence: TAG
ctgagtgattttgaaattct

SEQ ID NO: 57216 - DNA, 20 bp, Artificial Sequence
  Description of Artificial Sequence: Synthetic oligonucleotide
  Target: ATXN1; (-) strand; PAM type: NRG; PAM sequence: GAG
gtttattggtttccaactct

SEQ ID NO: 57217 - DNA, 20 bp, Artificial Sequence
  Description of Artificial Sequence: Synthetic oligonucleotide
  Target: ATXN1; (-) strand; PAM type: NRG; PAM sequence: TGG
ttttcttagctgttgtttat

SEQ ID NO: 57218 - DNA, 20 bp, Artificial Sequence
  Description of Artificial Sequence: Synthetic oligonucleotide
  Target: ATXN1; (-) strand; PAM type: NRG; PAM sequence: TAG
cttatcccccaaacttttct

SEQ ID NO: 57219 - DNA, 20 bp, Artificial Sequence
  Description of Artificial Sequence: Synthetic oligonucleotide
  Target: ATXN1; (-) strand; PAM type: NRG; PAM sequence: TGG
tttagaataattccttaata

SEQ ID NO: 57220 - DNA, 20 bp, Artificial Sequence
  Description of Artificial Sequence: Synthetic oligonucleotide
  Target: ATXN1; (-) strand; PAM type: NRG; PAM sequence: TAG
agccttccagtaaaaatgtt

SEQ ID NO: 57221 - DNA, 20 bp, Artificial Sequence
  Description of Artificial Sequence: Synthetic oligonucleotide
  Target: ATXN1; (-) strand; PAM type: NRG; PAM sequence: CAG
agccaccatgcccagccttc

SEQ ID NO: 57222 - DNA, 20 bp, Artificial Sequence
  Description of Artificial Sequence: Synthetic oligonucleotide
  Target: ATXN1; (-) strand; PAM type: NRG; PAM sequence: CAG
caggtgtgagccaccatgcc

SEQ ID NO: 57223 - DNA, 20 bp, Artificial Sequence
  Description of Artificial Sequence: Synthetic oligonucleotide
  Target: ATXN1; (-) strand; PAM type: NRG; PAM sequence: GAG
agtgttgggattacaggtgt

SEQ ID NO: 57224 - DNA, 20 bp, Artificial Sequence
  Description of Artificial Sequence: Synthetic oligonucleotide
  Target: ATXN1; (-) strand; PAM type: NRG; PAM sequence: AGG
tcccaaagtgttgggattac

SEQ ID NO: 57225 - DNA, 20 bp, Artificial Sequence
  Description of Artificial Sequence: Synthetic oligonucleotide
  Target: ATXN1; (-) strand; PAM type: NRG; PAM sequence: CAG
ctcccaaagtgttgggatta

SEQ ID NO: 57226 - DNA, 20 bp, Artificial Sequence
  Description of Artificial Sequence: Synthetic oligonucleotide
  Target: ATXN1; (-) strand; PAM type: NRG; PAM sequence: GGG
ccttggcctcccaaagtgtt

SEQ ID NO: 57227 - DNA, 20 bp, Artificial Sequence
  Description of Artificial Sequence: Synthetic oligonucleotide
  Target: ATXN1; (-) strand; PAM type: NRG; PAM sequence: TGG
gccttggcctcccaaagtgt

SEQ ID NO: 57228 - DNA, 20 bp, Artificial Sequence
  Description of Artificial Sequence: Synthetic oligonucleotide
  Target: ATXN1; (-) strand; PAM type: NRG; PAM sequence: AAG
ccacccgccttggcctccca

SEQ ID NO: 57229 - DNA, 20 bp, Artificial Sequence
  Description of Artificial Sequence: Synthetic oligonucleotide
  Target: ATXN1; (-) strand; PAM type: NRG; PAM sequence: TGG
ctcaagtgatccacccgcct

SEQ ID NO: 57230 - DNA, 20 bp, Artificial Sequence
  Description of Artificial Sequence: Synthetic oligonucleotide
  Target: ATXN1; (-) strand; PAM type: NRG; PAM sequence: AAG
agtctcaagttcctggcctc

SEQ ID NO: 57231 - DNA, 20 bp, Artificial Sequence
  Description of Artificial Sequence: Synthetic oligonucleotide
  Target: ATXN1; (-) strand; PAM type: NRG; PAM sequence: TGG
ccaggctagtctcaagttcc

SEQ ID NO: 57232 - DNA, 20 bp, Artificial Sequence
  Description of Artificial Sequence: Synthetic oligonucleotide
  Target: ATXN1; (-) strand; PAM type: NRG; PAM sequence: AAG
atgttggccaggctagtctc

SEQ ID NO: 57233 - DNA, 20 bp, Artificial Sequence
  Description of Artificial Sequence: Synthetic oligonucleotide
  Target: ATXN1; (-) strand; PAM type: NRG; PAM sequence: TAG
ttttgccatgttggccaggc

SEQ ID NO: 57234 - DNA, 20 bp, Artificial Sequence
  Description of Artificial Sequence: Synthetic oligonucleotide
  Target: ATXN1; (-) strand; PAM type: NRG; PAM sequence: AGG
ggggttttgccatgttggcc

SEQ ID NO: 57235 - DNA, 20 bp, Artificial Sequence
  Description of Artificial Sequence: Synthetic oligonucleotide
  Target: ATXN1; (-) strand; PAM type: NRG; PAM sequence: CAG
cggggttttgccatgttggc

SEQ ID NO: 57236 - DNA, 20 bp, Artificial Sequence
  Description of Artificial Sequence: Synthetic oligonucleotide
  Target: ATXN1; (-) strand; PAM type: NRG; PAM sequence: TGG
gagacggggttttgccatgt

SEQ ID NO: 57237 - DNA, 20 bp, Artificial Sequence
  Description of Artificial Sequence: Synthetic oligonucleotide
  Target: ATXN1; (-) strand; PAM type: NRG; PAM sequence: GGG
ttggatttttggtagagacg

SEQ ID NO: 57238 - DNA, 20 bp, Artificial Sequence
  Description of Artificial Sequence: Synthetic oligonucleotide
  Target: ATXN1; (-) strand; PAM type: NRG; PAM sequence: GGG
tttggatttttggtagagac

SEQ ID NO: 57239 - DNA, 20 bp, Artificial Sequence
  Description of Artificial Sequence: Synthetic oligonucleotide
  Target: ATXN1; (-) strand; PAM type: NRG; PAM sequence: CGG
ttttggatttttggtagaga

SEQ ID NO: 57240 - DNA, 20 bp, Artificial Sequence
  Description of Artificial Sequence: Synthetic oligonucleotide
  Target: ATXN1; (-) strand; PAM type: NRG; PAM sequence: GAG
taatttttggatttttggta

SEQ ID NO: 57241 - DNA, 20 bp, Artificial Sequence
  Description of Artificial Sequence: Synthetic oligonucleotide
  Target: ATXN1; (-) strand; PAM type: NRG; PAM sequence: TAG
ggtaatttttggatttttgg

SEQ ID NO: 57242 - DNA, 20 bp, Artificial Sequence
  Description of Artificial Sequence: Synthetic oligonucleotide
  Target: ATXN1; (-) strand; PAM type: NRG; PAM sequence: TGG
ccaggtaatttttggatttt

SEQ ID NO: 57243 - DNA, 20 bp, Artificial Sequence
  Description of Artificial Sequence: Synthetic oligonucleotide
  Target: ATXN1; (-) strand; PAM type: NRG; PAM sequence: TGG
caccacgaccaggtaatttt

SEQ ID NO: 57244 - DNA, 20 bp, Artificial Sequence
  Description of Artificial Sequence: Synthetic oligonucleotide
  Target: ATXN1; (-) strand; PAM type: NRG; PAM sequence: AGG
aggtgtgcgccaccacgacc

SEQ ID NO: 57245 - DNA, 20 bp, Artificial Sequence
  Description of Artificial Sequence: Synthetic oligonucleotide
  Target: ATXN1; (-) strand; PAM type: NRG; PAM sequence: CAG
caggtgtgcgccaccacgac

SEQ ID NO: 57246 - DNA, 20 bp, Artificial Sequence
  Description of Artificial Sequence: Synthetic oligonucleotide
  Target: ATXN1; (-) strand; PAM type: NRG; PAM sequence: AGG
tcctgagtagatgggattac

SEQ ID NO: 57247 - DNA, 20 bp, Artificial Sequence
  Description of Artificial Sequence: Synthetic oligonucleotide
  Target: ATXN1; (-) strand; PAM type: NRG; PAM sequence: CAG
ctcctgagtagatgggatta

SEQ ID NO: 57248 - DNA, 20 bp, Artificial Sequence
  Description of Artificial Sequence: Synthetic oligonucleotide
  Target: ATXN1; (-) strand; PAM type: NRG; PAM sequence: GGG
cctcagcctcctgagtagat

SEQ ID NO: 57249 - DNA, 20 bp, Artificial Sequence
  Description of Artificial Sequence: Synthetic oligonucleotide
  Target: ATXN1; (-) strand; PAM type: NRG; PAM sequence: TGG
gcctcagcctcctgagtaga

SEQ ID NO: 57250 - DNA, 20 bp, Artificial Sequence
  Description of Artificial Sequence: Synthetic oligonucleotide
  Target: ATXN1; (-) strand; PAM type: NRG; PAM sequence: TAG
tcgtgcctcagcctcctgag

SEQ ID NO: 57251 - DNA, 20 bp, Artificial Sequence
  Description of Artificial Sequence: Synthetic oligonucleotide
  Target: ATXN1; (-) strand; PAM type: NRG; PAM sequence: GAG
ttctcgtgcctcagcctcct

SEQ ID NO: 57252 - DNA, 20 bp, Artificial Sequence
  Description of Artificial Sequence: Synthetic oligonucleotide
  Target: ATXN1; (-) strand; PAM type: NRG; PAM sequence: CAG
tttaagcaattctcgtgcct

SEQ ID NO: 57253 - DNA, 20 bp, Artificial Sequence
  Description of Artificial Sequence: Synthetic oligonucleotide
  Target: ATXN1; (-) strand; PAM type: NRG; PAM sequence: AAG
agcctcaccctcctgggttt

SEQ ID NO: 57254 - DNA, 20 bp, Artificial Sequence
  Description of Artificial Sequence: Synthetic oligonucleotide
  Target: ATXN1; (-) strand; PAM type: NRG; PAM sequence: GGG
cactgcagcctcaccctcct

SEQ ID NO: 57255 - DNA, 20 bp, Artificial Sequence
  Description of Artificial Sequence: Synthetic oligonucleotide
  Target: ATXN1; (-) strand; PAM type: NRG; PAM sequence: TGG
tcactgcagcctcaccctcc

SEQ ID NO: 57256 - DNA, 20 bp, Artificial Sequence
  Description of Artificial Sequence: Synthetic oligonucleotide
  Target: ATXN1; (-) strand; PAM type: NRG; PAM sequence: CAG
ggcaccatcttggctcactg

SEQ ID NO: 57257 - DNA, 20 bp, Artificial Sequence
  Description of Artificial Sequence: Synthetic oligonucleotide
  Target: ATXN1; (-) strand; PAM type: NRG; PAM sequence: TGG
ggagagcagtggcaccatct

SEQ ID NO: 57258 - DNA, 20 bp, Artificial Sequence
  Description of Artificial Sequence: Synthetic oligonucleotide
  Target: ATXN1; (-) strand; PAM type: NRG; PAM sequence: TGG
tcacccgggctggagagcag

SEQ ID NO: 57259 - DNA, 20 bp, Artificial Sequence
  Description of Artificial Sequence: Synthetic oligonucleotide
  Target: ATXN1; (-) strand; PAM type: NRG; PAM sequence: CAG
ctgtcacccgggctggagag

SEQ ID NO: 57260 - DNA, 20 bp, Artificial Sequence
  Description of Artificial Sequence: Synthetic oligonucleotide
  Target: ATXN1; (-) strand; PAM type: NRG; PAM sequence: GAG
gctctgtcacccgggctgga

SEQ ID NO: 57261 - DNA, 20 bp, Artificial Sequence
  Description of Artificial Sequence: Synthetic oligonucleotide
  Target: ATXN1; (-) strand; PAM type: NRG; PAM sequence: GAG
ttgctctgtcacccgggctg

SEQ ID NO: 57262 - DNA, 20 bp, Artificial Sequence
  Description of Artificial Sequence: Synthetic oligonucleotide
  Target: ATXN1; (-) strand; PAM type: NRG; PAM sequence: TGG
ccttgctctgtcacccgggc

SEQ ID NO: 57263 - DNA, 20 bp, Artificial Sequence
  Description of Artificial Sequence: Synthetic oligonucleotide
  Target: ATXN1; (-) strand; PAM type: NRG; PAM sequence: GGG
caagccttgctctgtcaccc

SEQ ID NO: 57264 - DNA, 20 bp, Artificial Sequence
  Description of Artificial Sequence: Synthetic oligonucleotide
  Target: ATXN1; (-) strand; PAM type: NRG; PAM sequence: CGG
ccaagccttgctctgtcacc

SEQ ID NO: 57265 - DNA, 20 bp, Artificial Sequence
  Description of Artificial Sequence: Synthetic oligonucleotide
  Target: ATXN1; (-) strand; PAM type: NRG; PAM sequence: AAG
tttgtttgtttttccagacc

SEQ ID NO: 57266 - DNA, 20 bp, Artificial Sequence
  Description of Artificial Sequence: Synthetic oligonucleotide
  Target: ATXN1; (-) strand; PAM type: NRG; PAM sequence: CAG
tttttgtttgtttgtttttc

SEQ ID NO: 57267 - DNA, 20 bp, Artificial Sequence
  Description of Artificial Sequence: Synthetic oligonucleotide
  Target: ATXN1; (-) strand; PAM type: NRG; PAM sequence: AGG
ccccaagtagctgggactac

SEQ ID NO: 57268 - DNA, 20 bp, Artificial Sequence
  Description of Artificial Sequence: Synthetic oligonucleotide
  Target: ATXN1; (-) strand; PAM type: NRG; PAM sequence: CAG
cccccaagtagctgggacta

SEQ ID NO: 57269 - DNA, 20 bp, Artificial Sequence
  Description of Artificial Sequence: Synthetic oligonucleotide
  Target: ATXN1; (-) strand; PAM type: NRG; PAM sequence: GGG
cctcagccccccaagtagct

SEQ ID NO: 57270 - DNA, 20 bp, Artificial Sequence
  Description of Artificial Sequence: Synthetic oligonucleotide
  Target: ATXN1; (-) strand; PAM type: NRG; PAM sequence: TGG
gcctcagccccccaagtagc

SEQ ID NO: 57271 - DNA, 20 bp, Artificial Sequence
  Description of Artificial Sequence: Synthetic oligonucleotide
  Target: ATXN1; (-) strand; PAM type: NRG; PAM sequence: TAG
ttctgcctcagccccccaag

SEQ ID NO: 57272 - DNA, 20 bp, Artificial Sequence
  Description of Artificial Sequence: Synthetic oligonucleotide
  Target: ATXN1; (-) strand; PAM type: NRG; PAM sequence: AAG
tccttctgcctcagcccccc

SEQ ID NO: 57273 - DNA, 20 bp, Artificial Sequence
  Description of Artificial Sequence: Synthetic oligonucleotide
  Target: ATXN1; (-) strand; PAM type: NRG; PAM sequence: CAG
cttaagcaatccttctgcct

SEQ ID NO: 57274 - DNA, 20 bp, Artificial Sequence
  Description of Artificial Sequence: Synthetic oligonucleotide
  Target: ATXN1; (-) strand; PAM type: NRG; PAM sequence: AAG
agccttgaactcttaggctt

SEQ ID NO: 57275 - DNA, 20 bp, Artificial Sequence
  Description of Artificial Sequence: Synthetic oligonucleotide
  Target: ATXN1; (-) strand; PAM type: NRG; PAM sequence: AGG
cactgcagccttgaactctt

SEQ ID NO: 57276 - DNA, 20 bp, Artificial Sequence
  Description of Artificial Sequence: Synthetic oligonucleotide
  Target: ATXN1; (-) strand; PAM type: NRG; PAM sequence: TAG
tcactgcagccttgaactct

SEQ ID NO: 57277 - DNA, 20 bp, Artificial Sequence
  Description of Artificial Sequence: Synthetic oligonucleotide
  Target: ATXN1; (-) strand; PAM type: NRG; PAM sequence: CAG
ggtacagtcttggctcactg

SEQ ID NO: 57278 - DNA, 20 bp, Artificial Sequence
  Description of Artificial Sequence: Synthetic oligonucleotide
  Target: ATXN1; (-) strand; PAM type: NRG; PAM sequence: TGG
ggagtacagtggtacagtct

SEQ ID NO: 57279 - DNA, 20 bp, Artificial Sequence
  Description of Artificial Sequence: Synthetic oligonucleotide
  Target: ATXN1; (-) strand; PAM type: NRG; PAM sequence: CAG
caggctggagtacagtggta

SEQ ID NO: 57280 - DNA, 20 bp, Artificial Sequence
  Description of Artificial Sequence: Synthetic oligonucleotide
  Target: ATXN1; (-) strand; PAM type: NRG; PAM sequence: TGG
tcacccaggctggagtacag

SEQ ID NO: 57281 - DNA, 20 bp, Artificial Sequence
  Description of Artificial Sequence: Synthetic oligonucleotide
  Target: ATXN1; (-) strand; PAM type: NRG; PAM sequence: CAG
ttgtcacccaggctggagta

SEQ ID NO: 57282 - DNA, 20 bp, Artificial Sequence
  Description of Artificial Sequence: Synthetic oligonucleotide
  Target: ATXN1; (-) strand; PAM type: NRG; PAM sequence: GAG
tcactttgtcacccaggctg

SEQ ID NO: 57283 - DNA, 20 bp, Artificial Sequence
  Description of Artificial Sequence: Synthetic oligonucleotide
  Target: ATXN1; (-) strand; PAM type: NRG; PAM sequence: TGG
tctcactttgtcacccaggc

SEQ ID NO: 57284 - DNA, 20 bp, Artificial Sequence
  Description of Artificial Sequence: Synthetic oligonucleotide
  Target: ATXN1; (-) strand; PAM type: NRG; PAM sequence: AGG
agggtctcactttgtcaccc

SEQ ID NO: 57285 - DNA, 20 bp, Artificial Sequence
  Description of Artificial Sequence: Synthetic oligonucleotide
  Target: ATXN1; (-) strand; PAM type: NRG; PAM sequence: CAG
cagggtctcactttgtcacc

SEQ ID NO: 57286 - DNA, 20 bp, Artificial Sequence
  Description of Artificial Sequence: Synthetic oligonucleotide
  Target: ATXN1; (-) strand; PAM type: NRG; PAM sequence: GGG
tatttatttatttagagaca

SEQ ID NO: 57287 - DNA, 20 bp, Artificial Sequence
  Description of Artificial Sequence: Synthetic oligonucleotide
  Target: ATXN1; (-) strand; PAM type: NRG; PAM sequence: AGG
ttatttatttatttagagac

SEQ ID NO: 57288 - DNA, 20 bp, Artificial Sequence
  Description of Artificial Sequence: Synthetic oligonucleotide
  Target: ATXN1; (-) strand; PAM type: NRG; PAM sequence: CAG
tttatttatttatttagaga

SEQ ID NO: 57289 - DNA, 20 bp, Artificial Sequence
  Description of Artificial Sequence: Synthetic oligonucleotide
  Target: ATXN1; (-) strand; PAM type: NRG; PAM sequence: GAG
tagatttatttatttattta

SEQ ID NO: 57290 - DNA, 20 bp, Artificial Sequence
  Description of Artificial Sequence: Synthetic oligonucleotide
  Target: ATXN1; (-) strand; PAM type: NRG; PAM sequence: TAG
aatagatttatttatttatt

SEQ ID NO: 57291 - DNA, 20 bp, Artificial Sequence
  Description of Artificial Sequence: Synthetic oligonucleotide
  Target: ATXN1; (-) strand; PAM type: NRG; PAM sequence: TAG
tttttttttttttgctccaa

SEQ ID NO: 57292 - DNA, 20 bp, Artificial Sequence
  Description of Artificial Sequence: Synthetic oligonucleotide
  Target: ATXN1; (-) strand; PAM type: NRG; PAM sequence: AGG
agcaatcatactatttaggt

SEQ ID NO: 57293 - DNA, 20 bp, Artificial Sequence
  Description of Artificial Sequence: Synthetic oligonucleotide
  Target: ATXN1; (-) strand; PAM type: NRG; PAM sequence: TAG
aagcaatcatactatttagg

SEQ ID NO: 57294 - DNA, 20 bp, Artificial Sequence
  Description of Artificial Sequence: Synthetic oligonucleotide
  Target: ATXN1; (-) strand; PAM type: NRG; PAM sequence: AGG
tataagcaatcatactattt

SEQ ID NO: 57295 - DNA, 20 bp, Artificial Sequence
  Description of Artificial Sequence: Synthetic oligonucleotide
  Target: ATXN1; (-) strand; PAM type: NRG; PAM sequence: TAG
ttataagcaatcatactatt

SEQ ID NO: 57296 - DNA, 20 bp, Artificial Sequence
  Description of Artificial Sequence: Synthetic oligonucleotide
  Target: ATXN1; (-) strand; PAM type: NRG; PAM sequence: AAG
atatctttcatttttattat

SEQ ID NO: 57297 - DNA, 20 bp, Artificial Sequence
  Description of Artificial Sequence: Synthetic oligonucleotide
  Target: ATXN1; (-) strand; PAM type: NRG; PAM sequence: AGG
ttctcctttttaccattttt

SEQ ID NO: 57298 - DNA, 20 bp, Artificial Sequence
  Description of Artificial Sequence: Synthetic oligonucleotide
  Target: ATXN1; (-) strand; PAM type: NRG; PAM sequence: TAG
tttctcctttttaccatttt

SEQ ID NO: 57299 - DNA, 20 bp, Artificial Sequence
  Description of Artificial Sequence: Synthetic oligonucleotide
  Target: ATXN1; (-) strand; PAM type: NRG; PAM sequence: AAG
aaaacaaggtgaagtcgttg

SEQ ID NO: 57300 - DNA, 20 bp, Artificial Sequence
  Description of Artificial Sequence: Synthetic oligonucleotide
  Target: ATXN1; (-) strand; PAM type: NRG; PAM sequence: AAG
aaaacccacaaaacaaggtg

SEQ ID NO: 57301 - DNA, 20 bp, Artificial Sequence
  Description of Artificial Sequence: Synthetic oligonucleotide
  Target: ATXN1; (-) strand; PAM type: NRG; PAM sequence: AGG
gaaacaaaacccacaaaaca

SEQ ID NO: 57302 - DNA, 20 bp, Artificial Sequence
  Description of Artificial Sequence: Synthetic oligonucleotide
  Target: ATXN1; (-) strand; PAM type: NRG; PAM sequence: AAG
tgaaacaaaacccacaaaac

SEQ ID NO: 57303 - DNA, 20 bp, Artificial Sequence
  Description of Artificial Sequence: Synthetic oligonucleotide
  Target: ATXN1; (-) strand; PAM type: NRG; PAM sequence: AAG
cttcctaagaggcttttgaa

SEQ ID NO: 57304 - DNA, 20 bp, Artificial Sequence
  Description of Artificial Sequence: Synthetic oligonucleotide
  Target: ATXN1; (-) strand; PAM type: NRG; PAM sequence: AGG
ttaatttgagacttcctaag

SEQ ID NO: 57305 - DNA, 20 bp, Artificial Sequence
  Description of Artificial Sequence: Synthetic oligonucleotide
  Target: ATXN1; (-) strand; PAM type: NRG; PAM sequence: GAG
tttaatttgagacttcctaa

SEQ ID NO: 57306 - DNA, 20 bp, Artificial Sequence
  Description of Artificial Sequence: Synthetic oligonucleotide
  Target: ATXN1; (-) strand; PAM type: NRG; PAM sequence: AAG
actttaatttgagacttcct

SEQ ID NO: 57307 - DNA, 20 bp, Artificial Sequence
  Description of Artificial Sequence: Synthetic oligonucleotide
  Target: ATXN1; (-) strand; PAM type: NRG; PAM sequence: GAG
gagttcacttactttaattt

SEQ ID NO: 57308 - DNA, 20 bp, Artificial Sequence
  Description of Artificial Sequence: Synthetic oligonucleotide
  Target: ATXN1; (-) strand; PAM type: NRG; PAM sequence: GAG
caataactggatatacattt

SEQ ID NO: 57309 - DNA, 20 bp, Artificial Sequence
  Description of Artificial Sequence: Synthetic oligonucleotide
  Target: ATXN1; (-) strand; PAM type: NRG; PAM sequence: TGG
tgtgtgtttatgccaataac

SEQ ID NO: 57310 - DNA, 20 bp, Artificial Sequence
  Description of Artificial Sequence: Synthetic oligonucleotide
  Target: ATXN1; (-) strand; PAM type: NRG; PAM sequence: CAG
agggtcatttggaatagtta

SEQ ID NO: 57311 - DNA, 20 bp, Artificial Sequence
  Description of Artificial Sequence: Synthetic oligonucleotide
  Target: ATXN1; (-) strand; PAM type: NRG; PAM sequence: TAG
tatgttagggtcatttggaa

SEQ ID NO: 57312 - DNA, 20 bp, Artificial Sequence
  Description of Artificial Sequence: Synthetic oligonucleotide
  Target: ATXN1; (-) strand; PAM type: NRG; PAM sequence: TGG
tacaatatgttagggtcatt

SEQ ID NO: 57313 - DNA, 20 bp, Artificial Sequence
  Description of Artificial Sequence: Synthetic oligonucleotide
  Target: ATXN1; (-) strand; PAM type: NRG; PAM sequence: GGG
aattacattacaatatgtta

SEQ ID NO: 57314 - DNA, 20 bp, Artificial Sequence
  Description of Artificial Sequence: Synthetic oligonucleotide
  Target: ATXN1; (-) strand; PAM type: NRG; PAM sequence: AGG
caattacattacaatatgtt

SEQ ID NO: 57315 - DNA, 20 bp, Artificial Sequence
  Description of Artificial Sequence: Synthetic oligonucleotide
  Target: ATXN1; (-) strand; PAM type: NRG; PAM sequence: TAG
acaattacattacaatatgt

SEQ ID NO: 57316 - DNA, 20 bp, Artificial Sequence
  Description of Artificial Sequence: Synthetic oligonucleotide
  Target: ATXN1; (-) strand; PAM type: NRG; PAM sequence: TGG
ttagtccactgggctagaga

SEQ ID NO: 57317 - DNA, 20 bp, Artificial Sequence
  Description of Artificial Sequence: Synthetic oligonucleotide
  Target: ATXN1; (-) strand; PAM type: NRG; PAM sequence: GAG
gtttttagtccactgggcta

SEQ ID NO: 57318 - DNA, 20 bp, Artificial Sequence
  Description of Artificial Sequence: Synthetic oligonucleotide
  Target: ATXN1; (-) strand; PAM type: NRG; PAM sequence: TAG
tggtttttagtccactgggc

SEQ ID NO: 57319 - DNA, 20 bp, Artificial Sequence
  Description of Artificial Sequence: Synthetic oligonucleotide
  Target: ATXN1; (-) strand; PAM type: NRG; PAM sequence: GGG
gtattggtttttagtccact

SEQ ID NO: 57320 - DNA, 20 bp, Artificial Sequence
  Description of Artificial Sequence: Synthetic oligonucleotide
  Target: ATXN1; (-) strand; PAM type: NRG; PAM sequence: TGG
tgtattggtttttagtccac

SEQ ID NO: 57321 - DNA, 20 bp, Artificial Sequence
  Description of Artificial Sequence: Synthetic oligonucleotide
  Target: ATXN1; (-) strand; PAM type: NRG; PAM sequence: TAG
tttagttttgtattggtttt

SEQ ID NO: 57322 - DNA, 20 bp, Artificial Sequence
  Description of Artificial Sequence: Synthetic oligonucleotide
  Target: ATXN1; (-) strand; PAM type: NRG; PAM sequence: TGG
ttgattgtttagttttgtat

SEQ ID NO: 57323 - DNA, 20 bp, Artificial Sequence
  Description of Artificial Sequence: Synthetic oligonucleotide
  Target: ATXN1; (-) strand; PAM type: NRG; PAM sequence: TAG
ttttttttattttgattgtt

SEQ ID NO: 57324 - DNA, 20 bp, Artificial Sequence
  Description of Artificial Sequence: Synthetic oligonucleotide
  Target: ATXN1; (-) strand; PAM type: NRG; PAM sequence: AGG
atgcttactgaaaatgttta

SEQ ID NO: 57325 - DNA, 20 bp, Artificial Sequence
  Description of Artificial Sequence: Synthetic oligonucleotide
  Target: ATXN1; (-) strand; PAM type: NRG; PAM sequence: AAG
tatgcttactgaaaatgttt

SEQ ID NO: 57326 - DNA, 20 bp, Artificial Sequence
  Description of Artificial Sequence: Synthetic oligonucleotide
  Target: ATXN1; (-) strand; PAM type: NRG; PAM sequence: CAG
taatttccgaacaaaaatgc

SEQ ID NO: 57327 - DNA, 20 bp, Artificial Sequence
  Description of Artificial Sequence: Synthetic oligonucleotide
  Target: ATXN1; (-) strand; PAM type: NRG; PAM sequence: CAG
ttctctcaaactgaaaatag

SEQ ID NO: 57328 - DNA, 20 bp, Artificial Sequence
  Description of Artificial Sequence: Synthetic oligonucleotide
  Target: ATXN1; (-) strand; PAM type: NRG; PAM sequence: TAG
tctttctctcaaactgaaaa

SEQ ID NO: 57329 - DNA, 20 bp, Artificial Sequence
  Description of Artificial Sequence: Synthetic oligonucleotide
  Target: ATXN1; (-) strand; PAM type: NRG; PAM sequence: CAG
taacttcattcattttacat

SEQ ID NO: 57330 - DNA, 20 bp, Artificial Sequence
  Description of Artificial Sequence: Synthetic oligonucleotide
  Target: ATXN1; (-) strand; PAM type: NRG; PAM sequence: AGG
gtttatactgatgtgccaca

SEQ ID NO: 57331 - DNA, 20 bp, Artificial Sequence
  Description of Artificial Sequence: Synthetic oligonucleotide
  Target: ATXN1; (-) strand; PAM type: NRG; PAM sequence: AAG
agtttatactgatgtgccac

SEQ ID NO: 57332 - DNA, 20 bp, Artificial Sequence
  Description of Artificial Sequence: Synthetic oligonucleotide
  Target: ATXN1; (-) strand; PAM type: NRG; PAM sequence: GAG
tttaaggtaaaatacctcat

SEQ ID NO: 57333 - DNA, 20 bp, Artificial Sequence
  Description of Artificial Sequence: Synthetic oligonucleotide
  Target: ATXN1; (-) strand; PAM type: NRG; PAM sequence: AGG
ccgtgtgtacgtatttttta

SEQ ID NO: 57334 - DNA, 20 bp, Artificial Sequence
  Description of Artificial Sequence: Synthetic oligonucleotide
  Target: ATXN1; (-) strand; PAM type: NRG; PAM sequence: AAG
gccgtgtgtacgtatttttt

SEQ ID NO: 57335 - DNA, 20 bp, Artificial Sequence
  Description of Artificial Sequence: Synthetic oligonucleotide
  Target: ATXN1; (-) strand; PAM type: NRG; PAM sequence: TGG
caggcatgagccatcgtgcc

SEQ ID NO: 57336 - DNA, 20 bp, Artificial Sequence
  Description of Artificial Sequence: Synthetic oligonucleotide
  Target: ATXN1; (-) strand; PAM type: NRG; PAM sequence: GAG
agtgctgggattacaggcat

SEQ ID NO: 57337 - DNA, 20 bp, Artificial Sequence
  Description of Artificial Sequence: Synthetic oligonucleotide
  Target: ATXN1; (-) strand; PAM type: NRG; PAM sequence: AGG
tcccaaagtgctgggattac

SEQ ID NO: 57338 - DNA, 20 bp, Artificial Sequence
  Description of Artificial Sequence: Synthetic oligonucleotide
  Target: ATXN1; (-) strand; PAM type: NRG; PAM sequence: CAG
ctcccaaagtgctgggatta

SEQ ID NO: 57339 - DNA, 20 bp, Artificial Sequence
  Description of Artificial Sequence: Synthetic oligonucleotide
  Target: ATXN1; (-) strand; PAM type: NRG; PAM sequence: GGG
ccttggcctcccaaagtgct

SEQ ID NO: 57340 - DNA, 20 bp, Artificial Sequence
  Description of Artificial Sequence: Synthetic oligonucleotide
  Target: ATXN1; (-) strand; PAM type: NRG; PAM sequence: TGG
tccttggcctcccaaagtgc

SEQ ID NO: 57341 - DNA, 20 bp, Artificial Sequence
  Description of Artificial Sequence: Synthetic oligonucleotide
  Target: ATXN1; (-) strand; PAM type: NRG; PAM sequence: AAG
cggccctccttggcctccca

SEQ ID NO: 57342 - DNA, 20 bp, Artificial Sequence
  Description of Artificial Sequence: Synthetic oligonucleotide
  Target: ATXN1; (-) strand; PAM type: NRG; PAM sequence: TGG
accttgtgatcggccctcct

SEQ ID NO: 57343 - DNA, 20 bp, Artificial Sequence
  Description of Artificial Sequence: Synthetic oligonucleotide
  Target: ATXN1; (-) strand; PAM type: NRG; PAM sequence: CGG
cgatctcctgaccttgtgat

SEQ ID NO: 57344 - DNA, 20 bp, Artificial Sequence
  Description of Artificial Sequence: Synthetic oligonucleotide
  Target: ATXN1; (-) strand; PAM type: NRG; PAM sequence: TGG
tttcactgtgttagccagga

SEQ ID NO: 57345 - DNA, 20 bp, Artificial Sequence
  Description of Artificial Sequence: Synthetic oligonucleotide
  Target: ATXN1; (-) strand; PAM type: NRG; PAM sequence: AGG
ggggtttcactgtgttagcc

SEQ ID NO: 57346 - DNA, 20 bp, Artificial Sequence
  Description of Artificial Sequence: Synthetic oligonucleotide
  Target: ATXN1; (-) strand; PAM type: NRG; PAM sequence: CAG
cggggtttcactgtgttagc

SEQ ID NO: 57347 - DNA, 20 bp, Artificial Sequence
  Description of Artificial Sequence: Synthetic oligonucleotide
  Target: ATXN1; (-) strand; PAM type: NRG; PAM sequence: TAG
gagacggggtttcactgtgt

SEQ ID NO: 57348 - DNA, 20 bp, Artificial Sequence
  Description of Artificial Sequence: Synthetic oligonucleotide
  Target: ATXN1; (-) strand; PAM type: NRG; PAM sequence: GGG
ttctgtttttagtagagacg

SEQ ID NO: 57349 - DNA, 20 bp, Artificial Sequence
  Description of Artificial Sequence: Synthetic oligonucleotide
  Target: ATXN1; (-) strand; PAM type: NRG; PAM sequence: GGG
tttctgtttttagtagagac

SEQ ID NO: 57350 - DNA, 20 bp, Artificial Sequence
  Description of Artificial Sequence: Synthetic oligonucleotide
  Target: ATXN1; (-) strand; PAM type: NRG; PAM sequence: CGG
ttttctgtttttagtagaga

SEQ ID NO: 57351 - DNA, 20 bp, Artificial Sequence
  Description of Artificial Sequence: Synthetic oligonucleotide
  Target: ATXN1; (-) strand; PAM type: NRG; PAM sequence: GAG
aatcttttctgtttttagta

SEQ ID NO: 57352 - DNA, 20 bp, Artificial Sequence
  Description of Artificial Sequence: Synthetic oligonucleotide
  Target: ATXN1; (-) strand; PAM type: NRG; PAM sequence: TAG
ctaatcttttctgtttttag

SEQ ID NO: 57353 - DNA, 20 bp, Artificial Sequence
  Description of Artificial Sequence: Synthetic oligonucleotide
  Target: ATXN1; (-) strand; PAM type: NRG; PAM sequence: TAG
tggctaatcttttctgtttt

SEQ ID NO: 57354 - DNA, 20 bp, Artificial Sequence
  Description of Artificial Sequence: Synthetic oligonucleotide
  Target: ATXN1; (-) strand; PAM type: NRG; PAM sequence: TGG
caggcgcccgccaccacgcc

SEQ ID NO: 57355 - DNA, 20 bp, Artificial Sequence
  Description of Artificial Sequence: Synthetic oligonucleotide
  Target: ATXN1; (-) strand; PAM type: NRG; PAM sequence: AGG
tcccgagtagctgggactac

SEQ ID NO: 57356 - DNA, 20 bp, Artificial Sequence
  Description of Artificial Sequence: Synthetic oligonucleotide
  Target: ATXN1; (-) strand; PAM type: NRG; PAM sequence: CAG
ctcccgagtagctgggacta

SEQ ID NO: 57357 - DNA, 20 bp, Artificial Sequence
  Description of Artificial Sequence: Synthetic oligonucleotide
  Target: ATXN1; (-) strand; PAM type: NRG; PAM sequence: GGG
cctcagcctcccgagtagct

SEQ ID NO: 57358 - DNA, 20 bp, Artificial Sequence
  Description of Artificial Sequence: Synthetic oligonucleotide
  Target: ATXN1; (-) strand; PAM type: NRG; PAM sequence: TGG
gcctcagcctcccgagtagc

SEQ ID NO: 57359 - DNA, 20 bp, Artificial Sequence
  Description of Artificial Sequence: Synthetic oligonucleotide
  Target: ATXN1; (-) strand; PAM type: NRG; PAM sequence: TAG
tcctgcctcagcctcccgag

SEQ ID NO: 57360 - DNA, 20 bp, Artificial Sequence
  Description of Artificial Sequence: Synthetic oligonucleotide
  Target: ATXN1; (-) strand; PAM type: NRG; PAM sequence: GAG
ttctcctgcctcagcctccc

SEQ ID NO: 57361 - DNA, 20 bp, Artificial Sequence
  Description of Artificial Sequence: Synthetic oligonucleotide
  Target: ATXN1; (-) strand; PAM type: NRG; PAM sequence: CAG
ttcacgccattctcctgcct

SEQ ID NO: 57362 - DNA, 20 bp, Artificial Sequence
  Description of Artificial Sequence: Synthetic oligonucleotide
  Target: ATXN1; (-) strand; PAM type: NRG; PAM sequence: AGG
cactgcaagctccacctccc

SEQ ID NO: 57363 - DNA, 20 bp, Artificial Sequence
  Description of Artificial Sequence: Synthetic oligonucleotide
  Target: ATXN1; (-) strand; PAM type: NRG; PAM sequence: CAG
tcactgcaagctccacctcc

SEQ ID NO: 57364 - DNA, 20 bp, Artificial Sequence
  Description of Artificial Sequence: Synthetic oligonucleotide
  Target: ATXN1; (-) strand; PAM type: NRG; PAM sequence: AAG
gcgcaatctcggctcactgc

SEQ ID NO: 57365 - DNA, 20 bp, Artificial Sequence
  Description of Artificial Sequence: Synthetic oligonucleotide
  Target: ATXN1; (-) strand; PAM type: NRG; PAM sequence: CGG
ggaatgcagtggcgcaatct

SEQ ID NO: 57366 - DNA, 20 bp, Artificial Sequence
  Description of Artificial Sequence: Synthetic oligonucleotide
  Target: ATXN1; (-) strand; PAM type: NRG; PAM sequence: TGG
tcgcccaggctggaatgcag

SEQ ID NO: 57367 - DNA, 20 bp, Artificial Sequence
  Description of Artificial Sequence: Synthetic oligonucleotide
  Target: ATXN1; (-) strand; PAM type: NRG; PAM sequence: CAG
ctgtcgcccaggctggaatg

SEQ ID NO: 57368 - DNA, 20 bp, Artificial Sequence
  Description of Artificial Sequence: Synthetic oligonucleotide
  Target: ATXN1; (-) strand; PAM type: NRG; PAM sequence: TGG
cctcgctctgtcgcccaggc

SEQ ID NO: 57369 - DNA, 20 bp, Artificial Sequence
  Description of Artificial Sequence: Synthetic oligonucleotide
  Target: ATXN1; (-) strand; PAM type: NRG; PAM sequence: AGG
ggagcctcgctctgtcgccc

SEQ ID NO: 57370 - DNA, 20 bp, Artificial Sequence
  Description of Artificial Sequence: Synthetic oligonucleotide
  Target: ATXN1; (-) strand; PAM type: NRG; PAM sequence: CAG
cggagcctcgctctgtcgcc

SEQ ID NO: 57371 - DNA, 20 bp, Artificial Sequence
  Description of Artificial Sequence: Synthetic oligonucleotide
  Target: ATXN1; (-) strand; PAM type: NRG; PAM sequence: GAG
ttttttttttttttgagacg

SEQ ID NO: 57372 - DNA, 20 bp, Artificial Sequence
  Description of Artificial Sequence: Synthetic oligonucleotide
  Target: ATXN1; (-) strand; PAM type: NRG; PAM sequence: CGG
ttttttttttttttttgaga

SEQ ID NO: 57373 - DNA, 20 bp, Artificial Sequence
  Description of Artificial Sequence: Synthetic oligonucleotide
  Target: ATXN1; (-) strand; PAM type: NRG; PAM sequence: GAG
tacttttttttttttttttt

SEQ ID NO: 57374 - DNA, 20 bp, Artificial Sequence
  Description of Artificial Sequence: Synthetic oligonucleotide
  Target: ATXN1; (-) strand; PAM type: NRG; PAM sequence: TAG
tgtctctctagatatagata

SEQ ID NO: 57375 - DNA, 20 bp, Artificial Sequence
  Description of Artificial Sequence: Synthetic oligonucleotide
  Target: ATXN1; (-) strand; PAM type: NRG; PAM sequence: TAG
aatctgtgtctctctagata

SEQ ID NO: 57376 - DNA, 20 bp, Artificial Sequence
  Description of Artificial Sequence: Synthetic oligonucleotide
  Target: ATXN1; (-) strand; PAM type: NRG; PAM sequence: TAG
ataggaaatctgtgtctctc

SEQ ID NO: 57377 - DNA, 20 bp, Artificial Sequence
  Description of Artificial Sequence: Synthetic oligonucleotide
  Target: ATXN1; (-) strand; PAM type: NRG; PAM sequence: AGG
cagtggacacagccagtgat

SEQ ID NO: 57378 - DNA, 20 bp, Artificial Sequence
  Description of Artificial Sequence: Synthetic oligonucleotide
  Target: ATXN1; (-) strand; PAM type: NRG; PAM sequence: TAG
ccagtggacacagccagtga

SEQ ID NO: 57379 - DNA, 20 bp, Artificial Sequence
  Description of Artificial Sequence: Synthetic oligonucleotide
  Target: ATXN1; (-) strand; PAM type: NRG; PAM sequence: CAG
tcctttccagtggacacagc

SEQ ID NO: 57380 - DNA, 20 bp, Artificial Sequence
  Description of Artificial Sequence: Synthetic oligonucleotide
  Target: ATXN1; (-) strand; PAM type: NRG; PAM sequence: CAG
tttttcctttccagtggaca

SEQ ID NO: 57381 - DNA, 20 bp, Artificial Sequence
  Description of Artificial Sequence: Synthetic oligonucleotide
  Target: ATXN1; (-) strand; PAM type: NRG; PAM sequence: TGG
atattgtttttcctttccag

SEQ ID NO: 57382 - DNA, 20 bp, Artificial Sequence
  Description of Artificial Sequence: Synthetic oligonucleotide
  Target: ATXN1; (-) strand; PAM type: NRG; PAM sequence: CAG
tgaatattgtttttcctttc

SEQ ID NO: 57383 - DNA, 20 bp, Artificial Sequence
  Description of Artificial Sequence: Synthetic oligonucleotide
  Target: ATXN1; (-) strand; PAM type: NRG; PAM sequence: GGG
ccaggggaactgttctcact

SEQ ID NO: 57384 - DNA, 20 bp, Artificial Sequence
  Description of Artificial Sequence: Synthetic oligonucleotide
  Target: ATXN1; (-) strand; PAM type: NRG; PAM sequence: TGG
cccaggggaactgttctcac

SEQ ID NO: 57385 - DNA, 20 bp, Artificial Sequence
  Description of Artificial Sequence: Synthetic oligonucleotide
  Target: ATXN1; (-) strand; PAM type: NRG; PAM sequence: GGG
gaccaaagactgggccccag

SEQ ID NO: 57386 - DNA, 20 bp, Artificial Sequence
  Description of Artificial Sequence: Synthetic oligonucleotide
  Target: ATXN1; (-) strand; PAM type: NRG; PAM sequence: GGG
agaccaaagactgggcccca

SEQ ID NO: 57387 - DNA, 20 bp, Artificial Sequence
  Description of Artificial Sequence: Synthetic oligonucleotide
  Target: ATXN1; (-) strand; PAM type: NRG; PAM sequence: AGG
gagaccaaagactgggcccc

SEQ ID NO: 57388 - DNA, 20 bp, Artificial Sequence
  Description of Artificial Sequence: Synthetic oligonucleotide
  Target: ATXN1; (-) strand; PAM type: NRG; PAM sequence: CAG
ggagaccaaagactgggccc

SEQ ID NO: 57389 - DNA, 20 bp, Artificial Sequence
  Description of Artificial Sequence: Synthetic oligonucleotide
  Target: ATXN1; (-) strand; PAM type: NRG; PAM sequence: GGG
atatttggagaccaaagact

SEQ ID NO: 57390 - DNA, 20 bp, Artificial Sequence
  Description of Artificial Sequence: Synthetic oligonucleotide
  Target: ATXN1; (-) strand; PAM type: NRG; PAM sequence: TGG
gatatttggagaccaaagac

SEQ ID NO: 57391 - DNA, 20 bp, Artificial Sequence
  Description of Artificial Sequence: Synthetic oligonucleotide
  Target: ATXN1; (-) strand; PAM type: NRG; PAM sequence: AAG
gaaatgatatttggagacca

SEQ ID NO: 57392 - DNA, 20 bp, Artificial Sequence
  Description of Artificial Sequence: Synthetic oligonucleotide
  Target: ATXN1; (-) strand; PAM type: NRG; PAM sequence: GAG
tcagtgagaaatgatatttg

SEQ ID NO: 57393 - DNA, 20 bp, Artificial Sequence
  Description of Artificial Sequence: Synthetic oligonucleotide
  Target: ATXN1; (-) strand; PAM type: NRG; PAM sequence: TGG
tttcagtgagaaatgatatt

SEQ ID NO: 57394 - DNA, 20 bp, Artificial Sequence
  Description of Artificial Sequence: Synthetic oligonucleotide
  Target: ATXN1; (-) strand; PAM type: NRG; PAM sequence: GAG
gagacctggtttctttcagt

SEQ ID NO: 57395 - DNA, 20 bp, Artificial Sequence
  Description of Artificial Sequence: Synthetic oligonucleotide
  Target: ATXN1; (-) strand; PAM type: NRG; PAM sequence: CAG
caaggagacctggtttcttt

SEQ ID NO: 57396 - DNA, 20 bp, Artificial Sequence
  Description of Artificial Sequence: Synthetic oligonucleotide
  Target: ATXN1; (-) strand; PAM type: NRG; PAM sequence: TGG
agcttttttccaaggagacc

SEQ ID NO: 57397 - DNA, 20 bp, Artificial Sequence
  Description of Artificial Sequence: Synthetic oligonucleotide
  Target: ATXN1; (-) strand; PAM type: NRG; PAM sequence: GAG
gggatcagcttttttccaag

SEQ ID NO: 57398 - DNA, 20 bp, Artificial Sequence
  Description of Artificial Sequence: Synthetic oligonucleotide
  Target: ATXN1; (-) strand; PAM type: NRG; PAM sequence: AGG
ctgggatcagcttttttcca

SEQ ID NO: 57399 - DNA, 20 bp, Artificial Sequence
  Description of Artificial Sequence: Synthetic oligonucleotide
  Target: ATXN1; (-) strand; PAM type: NRG; PAM sequence: AAG
tctgggatcagcttttttcc

SEQ ID NO: 57400 - DNA, 20 bp, Artificial Sequence
  Description of Artificial Sequence: Synthetic oligonucleotide
  Target: ATXN1; (-) strand; PAM type: NRG; PAM sequence: CAG
tcttgccttagctctgggat

SEQ ID NO: 57401 - DNA, 20 bp, Artificial Sequence
  Description of Artificial Sequence: Synthetic oligonucleotide
  Target: ATXN1; (-) strand; PAM type: NRG; PAM sequence: GGG
acatttcttgccttagctct

SEQ ID NO: 57402 - DNA, 20 bp, Artificial Sequence
  Description of Artificial Sequence: Synthetic oligonucleotide
  Target: ATXN1; (-) strand; PAM type: NRG; PAM sequence: TGG
tacatttcttgccttagctc

SEQ ID NO: 57403 - DNA, 20 bp, Artificial Sequence
  Description of Artificial Sequence: Synthetic oligonucleotide
  Target: ATXN1; (-) strand; PAM type: NRG; PAM sequence: TAG
atcttgtacatttcttgcct

SEQ ID NO: 57404 - DNA, 20 bp, Artificial Sequence
  Description of Artificial Sequence: Synthetic oligonucleotide
  Target: ATXN1; (-) strand; PAM type: NRG; PAM sequence: AGG
ctagtataacactatgttcc

SEQ ID NO: 57405 - DNA, 20 bp, Artificial Sequence
  Description of Artificial Sequence: Synthetic oligonucleotide
  Target: ATXN1; (-) strand; PAM type: NRG; PAM sequence: CAG
tctagtataacactatgttc

SEQ ID NO: 57406 - DNA, 20 bp, Artificial Sequence
  Description of Artificial Sequence: Synthetic oligonucleotide
  Target: ATXN1; (-) strand; PAM type: NRG; PAM sequence: TAG
ttgatagttttcttgctttc

SEQ ID NO: 57407 - DNA, 20 bp, Artificial Sequence
  Description of Artificial Sequence: Synthetic oligonucleotide
  Target: ATXN1; (-) strand; PAM type: NRG; PAM sequence: TAG
ccaatactggctgtctttga

SEQ ID NO: 57408 - DNA, 20 bp, Artificial Sequence
  Description of Artificial Sequence: Synthetic oligonucleotide
  Target: ATXN1; (-) strand; PAM type: NRG; PAM sequence: TGG
gagtccttttaatccaatac

SEQ ID NO: 57409 - DNA, 20 bp, Artificial Sequence
  Description of Artificial Sequence: Synthetic oligonucleotide
  Target: ATXN1; (-) strand; PAM type: NRG; PAM sequence: GAG
tcctattcagtttggctact

SEQ ID NO: 57410 - DNA, 20 bp, Artificial Sequence
  Description of Artificial Sequence: Synthetic oligonucleotide
  Target: ATXN1; (-) strand; PAM type: NRG; PAM sequence: TGG
cattgggatcctattcagtt

SEQ ID NO: 57411 - DNA, 20 bp, Artificial Sequence
  Description of Artificial Sequence: Synthetic oligonucleotide
  Target: ATXN1; (-) strand; PAM type: NRG; PAM sequence: CAG
ctgagcattgggatcctatt

SEQ ID NO: 57412 - DNA, 20 bp, Artificial Sequence
  Description of Artificial Sequence: Synthetic oligonucleotide
  Target: ATXN1; (-) strand; PAM type: NRG; PAM sequence: GGG
tggtcccctgtctgagcatt

SEQ ID NO: 57413 - DNA, 20 bp, Artificial Sequence
  Description of Artificial Sequence: Synthetic oligonucleotide
  Target: ATXN1; (-) strand; PAM type: NRG; PAM sequence: TGG
atggtcccctgtctgagcat

SEQ ID NO: 57414 - DNA, 20 bp, Artificial Sequence
  Description of Artificial Sequence: Synthetic oligonucleotide
  Target: ATXN1; (-) strand; PAM type: NRG; PAM sequence: GAG
gttcagatggtcccctgtct

SEQ ID NO: 57415 - DNA, 20 bp, Artificial Sequence
  Description of Artificial Sequence: Synthetic oligonucleotide
  Target: ATXN1; (-) strand; PAM type: NRG; PAM sequence: TGG
taccctttttcatgttcaga

SEQ ID NO: 57416 - DNA, 20 bp, Artificial Sequence
  Description of Artificial Sequence: Synthetic oligonucleotide
  Target: ATXN1; (-) strand; PAM type: NRG; PAM sequence: CAG
tgattaccctttttcatgtt

SEQ ID NO: 57417 - DNA, 20 bp, Artificial Sequence
  Description of Artificial Sequence: Synthetic oligonucleotide
  Target: ATXN1; (-) strand; PAM type: NRG; PAM sequence: CAG
tgttgtgtttcagtccatga

SEQ ID NO: 57418 - DNA, 20 bp, Artificial Sequence
  Description of Artificial Sequence: Synthetic oligonucleotide
  Target: ATXN1; (-) strand; PAM type: NRG; PAM sequence: CAG
gcagcatatctgttgtgttt

SEQ ID NO: 57419 - DNA, 20 bp, Artificial Sequence
  Description of Artificial Sequence: Synthetic oligonucleotide
  Target: ATXN1; (-) strand; PAM type: NRG; PAM sequence: CAG
gactgtaaattcatagattg

SEQ ID NO: 57420 - DNA, 20 bp, Artificial Sequence
  Description of Artificial Sequence: Synthetic oligonucleotide
  Target: ATXN1; (-) strand; PAM type: NRG; PAM sequence: TAG
aaagcatgactgtaaattca

SEQ ID NO: 57421 - DNA, 20 bp, Artificial Sequence
  Description of Artificial Sequence: Synthetic oligonucleotide
  Target: ATXN1; (-) strand; PAM type: NRG; PAM sequence: AAG
accaagtcactgtgttttga

SEQ ID NO: 57422 - DNA, 20 bp, Artificial Sequence
  Description of Artificial Sequence: Synthetic oligonucleotide
  Target: ATXN1; (-) strand; PAM type: NRG; PAM sequence: AAG
ctagttcacagtgtcaaacc

SEQ ID NO: 57423 - DNA, 20 bp, Artificial Sequence
  Description of Artificial Sequence: Synthetic oligonucleotide
  Target: ATXN1; (-) strand; PAM type: NRG; PAM sequence: CAG
tgcacgatacagctagttca

SEQ ID NO: 57424 - DNA, 20 bp, Artificial Sequence
  Description of Artificial Sequence: Synthetic oligonucleotide
  Target: ATXN1; (-) strand; PAM type: NRG; PAM sequence: TAG
accaatttgcacgatacagc

SEQ ID NO: 57425 - DNA, 20 bp, Artificial Sequence
  Description of Artificial Sequence: Synthetic oligonucleotide
  Target: ATXN1; (-) strand; PAM type: NRG; PAM sequence: CAG
atttaccaatttgcacgata

SEQ ID NO: 57426 - DNA, 20 bp, Artificial Sequence
  Description of Artificial Sequence: Synthetic oligonucleotide
  Target: ATXN1; (-) strand; PAM type: NRG; PAM sequence: TAG
ggaaaagcaggataatatac

SEQ ID NO: 57427 - DNA, 20 bp, Artificial Sequence
  Description of Artificial Sequence: Synthetic oligonucleotide
  Target: ATXN1; (-) strand; PAM type: NRG; PAM sequence: AGG
tcaggttttgtaggaaaagc

SEQ ID NO: 57428 - DNA, 20 bp, Artificial Sequence
  Description of Artificial Sequence: Synthetic oligonucleotide
  Target: ATXN1; (-) strand; PAM type: NRG; PAM sequence: CAG
ttcaggttttgtaggaaaag

SEQ ID NO: 57429 - DNA, 20 bp, Artificial Sequence
  Description of Artificial Sequence: Synthetic oligonucleotide
  Target: ATXN1; (-) strand; PAM type: NRG; PAM sequence: AAG
tgcttcaggttttgtaggaa

SEQ ID NO: 57430 - DNA, 20 bp, Artificial Sequence
  Description of Artificial Sequence: Synthetic oligonucleotide
  Target: ATXN1; (-) strand; PAM type: NRG; PAM sequence: AGG
cccggtgcttcaggttttgt

SEQ ID NO: 57431 - DNA, 20 bp, Artificial Sequence
  Description of Artificial Sequence: Synthetic oligonucleotide
  Target: ATXN1; (-) strand; PAM type: NRG; PAM sequence: TAG
acccggtgcttcaggttttg

SEQ ID NO: 57432 - DNA, 20 bp, Artificial Sequence
  Description of Artificial Sequence: Synthetic oligonucleotide
  Target: ATXN1; (-) strand; PAM type: NRG; PAM sequence: AGG
atttatctacccggtgcttc

SEQ ID NO: 57433 - DNA, 20 bp, Artificial Sequence
  Description of Artificial Sequence: Synthetic oligonucleotide
  Target: ATXN1; (-) strand; PAM type: NRG; PAM sequence: CAG
aatttatctacccggtgctt

SEQ ID NO: 57434 - DNA, 20 bp, Artificial Sequence
  Description of Artificial Sequence: Synthetic oligonucleotide
  Target: ATXN1; (-) strand; PAM type: NRG; PAM sequence: CGG
gcatctgtaatttatctacc

SEQ ID NO: 57435 - DNA, 20 bp, Artificial Sequence
  Description of Artificial Sequence: Synthetic oligonucleotide
  Target: ATXN1; (-) strand; PAM type: NRG; PAM sequence: GAG
caggaattattgttcatgaa

SEQ ID NO: 57436 - DNA, 20 bp, Artificial Sequence
  Description of Artificial Sequence: Synthetic oligonucleotide
  Target: ATXN1; (-) strand; PAM type: NRG; PAM sequence: AAG
agcaggaattattgttcatg

SEQ ID NO: 57437 - DNA, 20 bp, Artificial Sequence
  Description of Artificial Sequence: Synthetic oligonucleotide
  Target: ATXN1; (-) strand; PAM type: NRG; PAM sequence: AGG
ttatttgttcatttgttagc

SEQ ID NO: 57438 - DNA, 20 bp, Artificial Sequence
  Description of Artificial Sequence: Synthetic oligonucleotide
  Target: ATXN1; (-) strand; PAM type: NRG; PAM sequence: CAG
attatttgttcatttgttag

SEQ ID NO: 57439 - DNA, 20 bp, Artificial Sequence
  Description of Artificial Sequence: Synthetic oligonucleotide
  Target: ATXN1; (-) strand; PAM type: NRG; PAM sequence: TAG
attattatttgttcatttgt

SEQ ID NO: 57440 - DNA, 20 bp, Artificial Sequence
  Description of Artificial Sequence: Synthetic oligonucleotide
  Target: ATXN1; (-) strand; PAM type: NRG; PAM sequence: TAG
tcagggattgcaaatagtgg

SEQ ID NO: 57441 - DNA, 20 bp, Artificial Sequence
  Description of Artificial Sequence: Synthetic oligonucleotide
  Target: ATXN1; (-) strand; PAM type: NRG; PAM sequence: TGG
ttatcagggattgcaaatag

SEQ ID NO: 57442 - DNA, 20 bp, Artificial Sequence
  Description of Artificial Sequence: Synthetic oligonucleotide
  Target: ATXN1; (-) strand; PAM type: NRG; PAM sequence: TAG
aatttatcagggattgcaaa

SEQ ID NO: 57443 - DNA, 20 bp, Artificial Sequence
  Description of Artificial Sequence: Synthetic oligonucleotide
  Target: ATXN1; (-) strand; PAM type: NRG; PAM sequence: GGG
ctgaattcataaatttatca

SEQ ID NO: 57444 - DNA, 20 bp, Artificial Sequence
  Description of Artificial Sequence: Synthetic oligonucleotide
  Target: ATXN1; (-) strand; PAM type: NRG; PAM sequence: AGG
tctgaattcataaatttatc

SEQ ID NO: 57445 - DNA, 20 bp, Artificial Sequence
  Description of Artificial Sequence: Synthetic oligonucleotide
  Target: ATXN1; (-) strand; PAM type: NRG; PAM sequence: CAG
atctgaattcataaatttat

SEQ ID NO: 57446 - DNA, 20 bp, Artificial Sequence
  Description of Artificial Sequence: Synthetic oligonucleotide
  Target: ATXN1; (-) strand; PAM type: NRG; PAM sequence: GAG
gtggcatctctttttgcagt

SEQ ID NO: 57447 - DNA, 20 bp, Artificial Sequence
  Description of Artificial Sequence: Synthetic oligonucleotide
  Target: ATXN1; (-) strand; PAM type: NRG; PAM sequence: CAG
gttggtggcatctctttttg

SEQ ID NO: 57448 - DNA, 20 bp, Artificial Sequence
  Description of Artificial Sequence: Synthetic oligonucleotide
  Target: ATXN1; (-) strand; PAM type: NRG; PAM sequence: TGG
cttcaggaggtaatggttgg

SEQ ID NO: 57449 - DNA, 20 bp, Artificial Sequence
  Description of Artificial Sequence: Synthetic oligonucleotide
  Target: ATXN1; (-) strand; PAM type: NRG; PAM sequence: TGG
ttccttcaggaggtaatggt

SEQ ID NO: 57450 - DNA, 20 bp, Artificial Sequence
  Description of Artificial Sequence: Synthetic oligonucleotide
  Target: ATXN1; (-) strand; PAM type: NRG; PAM sequence: TGG
gtatttccttcaggaggtaa

SEQ ID NO: 57451 - DNA, 20 bp, Artificial Sequence
  Description of Artificial Sequence: Synthetic oligonucleotide
  Target: ATXN1; (-) strand; PAM type: NRG; PAM sequence: AGG
tgttgtgtatttccttcagg

SEQ ID NO: 57452 - DNA, 20 bp, Artificial Sequence
  Description of Artificial Sequence: Synthetic oligonucleotide
  Target: ATXN1; (-) strand; PAM type: NRG; PAM sequence: GAG
gtgttgtgtatttccttcag

SEQ ID NO: 57453 - DNA, 20 bp, Artificial Sequence
  Description of Artificial Sequence: Synthetic oligonucleotide
  Target: ATXN1; (-) strand; PAM type: NRG; PAM sequence: AGG
ttgtgttgtgtatttccttc

SEQ ID NO: 57454 - DNA, 20 bp, Artificial Sequence
  Description of Artificial Sequence: Synthetic oligonucleotide
  Target: ATXN1; (-) strand; PAM type: NRG; PAM sequence: CAG
gttgtgttgtgtatttcctt

SEQ ID NO: 57455 - DNA, 20 bp, Artificial Sequence
  Description of Artificial Sequence: Synthetic oligonucleotide
  Target: ATXN1; (-) strand; PAM type: NRG; PAM sequence: TGG
ttgcctgactgcttcatagt

SEQ ID NO: 57456 - DNA, 20 bp, Artificial Sequence
  Description of Artificial Sequence: Synthetic oligonucleotide
  Target: ATXN1; (-) strand; PAM type: NRG; PAM sequence: TAG
tgctttgcctgactgcttca

SEQ ID NO: 57457 - DNA, 20 bp, Artificial Sequence
  Description of Artificial Sequence: Synthetic oligonucleotide
  Target: ATXN1; (-) strand; PAM type: NRG; PAM sequence: AGG
gaattgctaggaagttctag

SEQ ID NO: 57458 - DNA, 20 bp, Artificial Sequence
  Description of Artificial Sequence: Synthetic oligonucleotide
  Target: ATXN1; (-) strand; PAM type: NRG; PAM sequence: GAG
ggaattgctaggaagttcta

SEQ ID NO: 57459 - DNA, 20 bp, Artificial Sequence
  Description of Artificial Sequence: Synthetic oligonucleotide
  Target: ATXN1; (-) strand; PAM type: NRG; PAM sequence: TAG
tgggaattgctaggaagttc

SEQ ID NO: 57460 - DNA, 20 bp, Artificial Sequence
  Description of Artificial Sequence: Synthetic oligonucleotide
  Target: ATXN1; (-) strand; PAM type: NRG; PAM sequence: AAG
atttcttgggaattgctagg

SEQ ID NO: 57461 - DNA, 20 bp, Artificial Sequence
  Description of Artificial Sequence: Synthetic oligonucleotide
  Target: ATXN1; (-) strand; PAM type: NRG; PAM sequence: AGG
tgaatttcttgggaattgct

SEQ ID NO: 57462 - DNA, 20 bp, Artificial Sequence
  Description of Artificial Sequence: Synthetic oligonucleotide
  Target: ATXN1; (-) strand; PAM type: NRG; PAM sequence: TAG
ctgaatttcttgggaattgc

SEQ ID NO: 57463 - DNA, 20 bp, Artificial Sequence
  Description of Artificial Sequence: Synthetic oligonucleotide
  Target: ATXN1; (-) strand; PAM type: NRG; PAM sequence: GGG
ctctgtctcctgaatttctt

SEQ ID NO: 57464 - DNA, 20 bp, Artificial Sequence
  Description of Artificial Sequence: Synthetic oligonucleotide
  Target: ATXN1; (-) strand; PAM type: NRG; PAM sequence: TGG
cctctgtctcctgaatttct

SEQ ID NO: 57465 - DNA, 20 bp, Artificial Sequence
  Description of Artificial Sequence: Synthetic oligonucleotide
  Target: ATXN1; (-) strand; PAM type: NRG; PAM sequence: AAG
tgcctccatgtggtgttgct

SEQ ID NO: 57466 - DNA, 20 bp, Artificial Sequence
  Description of Artificial Sequence: Synthetic oligonucleotide
  Target: ATXN1; (-) strand; PAM type: NRG; PAM sequence: TGG
tttggatgattgcctccatg

SEQ ID NO: 57467 - DNA, 20 bp, Artificial Sequence
  Description of Artificial Sequence: Synthetic oligonucleotide
  Target: ATXN1; (-) strand; PAM type: NRG; PAM sequence: TGG
atttcccacccgtctgggtt

SEQ ID NO: 57468 - DNA, 20 bp, Artificial Sequence
  Description of Artificial Sequence: Synthetic oligonucleotide
  Target: ATXN1; (-) strand; PAM type: NRG; PAM sequence: GGG
gtagaatttcccacccgtct

SEQ ID NO: 57469 - DNA, 20 bp, Artificial Sequence
  Description of Artificial Sequence: Synthetic oligonucleotide
  Target: ATXN1; (-) strand; PAM type: NRG; PAM sequence: TGG
ggtagaatttcccacccgtc

SEQ ID NO: 57470 - DNA, 20 bp, Artificial Sequence
  Description of Artificial Sequence: Synthetic oligonucleotide
  Target: ATXN1; (-) strand; PAM type: NRG; PAM sequence: TAG
aaaccagaccatttgtctgg

SEQ ID NO: 57471 - DNA, 20 bp, Artificial Sequence
  Description of Artificial Sequence: Synthetic oligonucleotide
  Target: ATXN1; (-) strand; PAM type: NRG; PAM sequence: TGG
gagaaaccagaccatttgtc

SEQ ID NO: 57472 - DNA, 20 bp, Artificial Sequence
  Description of Artificial Sequence: Synthetic oligonucleotide
  Target: ATXN1; (-) strand; PAM type: NRG; PAM sequence: CAG
agttttttctgttgagaaac

SEQ ID NO: 57473 - DNA, 20 bp, Artificial Sequence
  Description of Artificial Sequence: Synthetic oligonucleotide
  Target: ATXN1; (-) strand; PAM type: NRG; PAM sequence: GAG
attttgcagttttttctgtt

SEQ ID NO: 57474 - DNA, 20 bp, Artificial Sequence
  Description of Artificial Sequence: Synthetic oligonucleotide
  Target: ATXN1; (-) strand; PAM type: NRG; PAM sequence: CAG
tatgtcttttttttattttg

SEQ ID NO: 57475 - DNA, 20 bp, Artificial Sequence
  Description of Artificial Sequence: Synthetic oligonucleotide
  Target: ATXN1; (-) strand; PAM type: NRG; PAM sequence: CGG
taaacctcttttacactact

SEQ ID NO: 57476 - DNA, 20 bp, Artificial Sequence
  Description of Artificial Sequence: Synthetic oligonucleotide
  Target: ATXN1; (-) strand; PAM type: NRG; PAM sequence: CGG
gatccaaataaaggtcattt

SEQ ID NO: 57477 - DNA, 20 bp, Artificial Sequence
  Description of Artificial Sequence: Synthetic oligonucleotide
  Target: ATXN1; (-) strand; PAM type: NRG; PAM sequence: AGG
ttgaaccaagatccaaataa

SEQ ID NO: 57478 - DNA, 20 bp, Artificial Sequence
  Description of Artificial Sequence: Synthetic oligonucleotide
  Target: ATXN1; (-) strand; PAM type: NRG; PAM sequence: AAG
tttgaaccaagatccaaata

SEQ ID NO: 57479 - DNA, 20 bp, Artificial Sequence
  Description of Artificial Sequence: Synthetic oligonucleotide
  Target: ATXN1; (-) strand; PAM type: NRG; PAM sequence: AAG
tttaatagtttatttgaacc

SEQ ID NO: 57480 - DNA, 20 bp, Artificial Sequence
  Description of Artificial Sequence: Synthetic oligonucleotide
  Target: ATXN1; (-) strand; PAM type: NRG; PAM sequence: TAG
tatgttgtaggattttttaa

SEQ ID NO: 57481 - DNA, 20 bp, Artificial Sequence
  Description of Artificial Sequence: Synthetic oligonucleotide
  Target: ATXN1; (-) strand; PAM type: NRG; PAM sequence: AGG
taagttttattttatgttgt

SEQ ID NO: 57482 - DNA, 20 bp, Artificial Sequence
  Description of Artificial Sequence: Synthetic oligonucleotide
  Target: ATXN1; (-) strand; PAM type: NRG; PAM sequence: TAG
ataagttttattttatgttg

SEQ ID NO: 57483 - DNA, 20 bp, Artificial Sequence
  Description of Artificial Sequence: Synthetic oligonucleotide
  Target: ATXN1; (-) strand; PAM type: NRG; PAM sequence: AAG
ttcctaattgacttattaat

SEQ ID NO: 57484 - DNA, 20 bp, Artificial Sequence
  Description of Artificial Sequence: Synthetic oligonucleotide
  Target: ATXN1; (-) strand; PAM type: NRG; PAM sequence: CAG
aatatcatcaaatatcccgt

SEQ ID NO: 57485 - DNA, 20 bp, Artificial Sequence
  Description of Artificial Sequence: Synthetic oligonucleotide
  Target: ATXN1; (-) strand; PAM type: NRG; PAM sequence: CAG
cacaccaaaaaatgcattaa

SEQ ID NO: 57486 - DNA, 20 bp, Artificial Sequence
  Description of Artificial Sequence: Synthetic oligonucleotide
  Target: ATXN1; (-) strand; PAM type: NRG; PAM sequence: AGG
tactatttctataaatgatt

SEQ ID NO: 57487 - DNA, 20 bp, Artificial Sequence
  Description of Artificial Sequence: Synthetic oligonucleotide
  Target: ATXN1; (-) strand; PAM type: NRG; PAM sequence: TAG
ttactatttctataaatgat

SEQ ID NO: 57488 - DNA, 20 bp, Artificial Sequence
  Description of Artificial Sequence: Synthetic oligonucleotide
  Target: ATXN1; (-) strand; PAM type: NRG; PAM sequence: CAG
tggaccttgcatcttcataa

SEQ ID NO: 57489 - DNA, 20 bp, Artificial Sequence
  Description of Artificial Sequence: Synthetic oligonucleotide
  Target: ATXN1; (-) strand; PAM type: NRG; PAM sequence: TGG
ttccaaataacagtattccc

SEQ ID NO: 57490 - DNA, 20 bp, Artificial Sequence
  Description of Artificial Sequence: Synthetic oligonucleotide
  Target: ATXN1; (-) strand; PAM type: NRG; PAM sequence: CAG
ttgaagcaaattccaaataa

SEQ ID NO: 57491 - DNA, 20 bp, Artificial Sequence
  Description of Artificial Sequence: Synthetic oligonucleotide
  Target: ATXN1; (-) strand; PAM type: NRG; PAM sequence: AAG
tctgcacctggattattttg

SEQ ID NO: 57492 - DNA, 20 bp, Artificial Sequence
  Description of Artificial Sequence: Synthetic oligonucleotide
  Target: ATXN1; (-) strand; PAM type: NRG; PAM sequence: TGG
ctctactccacctctgcacc

SEQ ID NO: 57493 - DNA, 20 bp, Artificial Sequence
  Description of Artificial Sequence: Synthetic oligonucleotide
  Target: ATXN1; (-) strand; PAM type: NRG; PAM sequence: GAG
caccaccccattcagcagca

SEQ ID NO: 57494 - DNA, 20 bp, Artificial Sequence
  Description of Artificial Sequence: Synthetic oligonucleotide
  Target: ATXN1; (-) strand; PAM type: NRG; PAM sequence: CAG
cccaccaccccattcagcag

SEQ ID NO: 57495 - DNA, 20 bp, Artificial Sequence
  Description of Artificial Sequence: Synthetic oligonucleotide
  Target: ATXN1; (-) strand; PAM type: NRG; PAM sequence: CAG
tgccccaccaccccattcag

SEQ ID NO: 57496 - DNA, 20 bp, Artificial Sequence
  Description of Artificial Sequence: Synthetic oligonucleotide
  Target: ATXN1; (-) strand; PAM type: NRG; PAM sequence: CAG
ttttgccccaccaccccatt

SEQ ID NO: 57497 - DNA, 20 bp, Artificial Sequence
  Description of Artificial Sequence: Synthetic oligonucleotide
  Target: ATXN1; (-) strand; PAM type: NRG; PAM sequence: TGG
cacatttgaaagcagagagg

SEQ ID NO: 57498 - DNA, 20 bp, Artificial Sequence
  Description of Artificial Sequence: Synthetic oligonucleotide
  Target: ATXN1; (-) strand; PAM type: NRG; PAM sequence: AGG
aaacacatttgaaagcagag

SEQ ID NO: 57499 - DNA, 20 bp, Artificial Sequence
  Description of Artificial Sequence: Synthetic oligonucleotide
  Target: ATXN1; (-) strand; PAM type: NRG; PAM sequence: GAG
caaacacatttgaaagcaga

SEQ ID NO: 57500 - DNA, 20 bp, Artificial Sequence
  Description of Artificial Sequence: Synthetic oligonucleotide
  Target: ATXN1; (-) strand; PAM type: NRG; PAM sequence: GAG
atcaaacacatttgaaagca

SEQ ID NO: 57501 - DNA, 20 bp, Artificial Sequence
  Description of Artificial Sequence: Synthetic oligonucleotide
  Target: ATXN1; (-) strand; PAM type: NRG; PAM sequence: CAG
atatcaaacacatttgaaag

SEQ ID NO: 57502 - DNA, 20 bp, Artificial Sequence
  Description of Artificial Sequence: Synthetic oligonucleotide
  Target: ATXN1; (-) strand; PAM type: NRG; PAM sequence: AAG
gaaatatcaaacacatttga

SEQ ID NO: 57503 - DNA, 20 bp, Artificial Sequence
  Description of Artificial Sequence: Synthetic oligonucleotide
  Target: ATXN1; (-) strand; PAM type: NRG; PAM sequence: AAG
atataaaaacttaaaaaaaa

SEQ ID NO: 57504 - DNA, 20 bp, Artificial Sequence
  Description of Artificial Sequence: Synthetic oligonucleotide
  Target: ATXN1; (-) strand; PAM type: NRG; PAM sequence: AAG
cacatgtaccctaaaactta

SEQ ID NO: 57505 - DNA, 20 bp, Artificial Sequence
  Description of Artificial Sequence: Synthetic oligonucleotide
  Target: ATXN1; (-) strand; PAM type: NRG; PAM sequence: TGG
atgggtgcagcacaccagca

SEQ ID NO: 57506 - DNA, 20 bp, Artificial Sequence
  Description of Artificial Sequence: Synthetic oligonucleotide
  Target: ATXN1; (-) strand; PAM type: NRG; PAM sequence: CAG
aggtaatgggtgcagcacac

SEQ ID NO: 57507 - DNA, 20 bp, Artificial Sequence
  Description of Artificial Sequence: Synthetic oligonucleotide
  Target: ATXN1; (-) strand; PAM type: NRG; PAM sequence: CAG
agatgacgaggtaatgggtg

SEQ ID NO: 57508 - DNA, 20 bp, Artificial Sequence
  Description of Artificial Sequence: Synthetic oligonucleotide
  Target: ATXN1; (-) strand; PAM type: NRG; PAM sequence: GGG
atgctagatgacgaggtaat

SEQ ID NO: 57509 - DNA, 20 bp, Artificial Sequence
  Description of Artificial Sequence: Synthetic oligonucleotide
  Target: ATXN1; (-) strand; PAM type: NRG; PAM sequence: TGG
aatgctagatgacgaggtaa

SEQ ID NO: 57510 - DNA, 20 bp, Artificial Sequence
  Description of Artificial Sequence: Synthetic oligonucleotide
  Target: ATXN1; (-) strand; PAM type: NRG; PAM sequence: AGG
acacctaatgctagatgacg

SEQ ID NO: 57511 - DNA, 20 bp, Artificial Sequence
  Description of Artificial Sequence: Synthetic oligonucleotide
  Target: ATXN1; (-) strand; PAM type: NRG; PAM sequence: GAG
tacacctaatgctagatgac

SEQ ID NO: 57512 - DNA, 20 bp, Artificial Sequence
  Description of Artificial Sequence: Synthetic oligonucleotide
  Target: ATXN1; (-) strand; PAM type: NRG; PAM sequence: TAG
ttaggagatacacctaatgc

SEQ ID NO: 57513 - DNA, 20 bp, Artificial Sequence
  Description of Artificial Sequence: Synthetic oligonucleotide
  Target: ATXN1; (-) strand; PAM type: NRG; PAM sequence: GAG
ggggggagggatagcattag

SEQ ID NO: 57514 - DNA, 20 bp, Artificial Sequence
  Description of Artificial Sequence: Synthetic oligonucleotide
  Target: ATXN1; (-) strand; PAM type: NRG; PAM sequence: AGG
gaggggggagggatagcatt

SEQ ID NO: 57515 - DNA, 20 bp, Artificial Sequence
  Description of Artificial Sequence: Synthetic oligonucleotide
  Target: ATXN1; (-) strand; PAM type: NRG; PAM sequence: TAG
ggaggggggagggatagcat

SEQ ID NO: 57516 - DNA, 20 bp, Artificial Sequence
  Description of Artificial Sequence: Synthetic oligonucleotide
  Target: ATXN1; (-) strand; PAM type: NRG; PAM sequence: TAG
gtggggggaggggggaggga

SEQ ID NO: 57517 - DNA, 20 bp, Artificial Sequence
  Description of Artificial Sequence: Synthetic oligonucleotide
  Target: ATXN1; (-) strand; PAM type: NRG; PAM sequence: GGG
tggggtggggggagggggga

SEQ ID NO: 57518 - DNA, 20 bp, Artificial Sequence
  Description of Artificial Sequence: Synthetic oligonucleotide
  Target: ATXN1; (-) strand; PAM type: NRG; PAM sequence: AGG
gtggggtggggggagggggg

SEQ ID NO: 57519 - DNA, 20 bp, Artificial Sequence
  Description of Artificial Sequence: Synthetic oligonucleotide
  Target: ATXN1; (-) strand; PAM type: NRG; PAM sequence: GAG
tgtggggtggggggaggggg

SEQ ID NO: 57520 - DNA, 20 bp, Artificial Sequence
  Description of Artificial Sequence: Synthetic oligonucleotide
  Target: ATXN1; (-) strand; PAM type: NRG; PAM sequence: GGG
gttgtggggtggggggaggg

SEQ ID NO: 57521 - DNA, 20 bp, Artificial Sequence
  Description of Artificial Sequence: Synthetic oligonucleotide
  Target: ATXN1; (-) strand; PAM type: NRG; PAM sequence: GGG
tgttgtggggtggggggagg

SEQ ID NO: 57522 - DNA, 20 bp, Artificial Sequence
  Description of Artificial Sequence: Synthetic oligonucleotide
  Target: ATXN1; (-) strand; PAM type: NRG; PAM sequence: GGG
ctgttgtggggtggggggag

SEQ ID NO: 57523 - DNA, 20 bp, Artificial Sequence
  Description of Artificial Sequence: Synthetic oligonucleotide
  Target: ATXN1; (-) strand; PAM type: NRG; PAM sequence: GGG
actgttgtggggtgggggga

SEQ ID NO: 57524 - DNA, 20 bp, Artificial Sequence
  Description of Artificial Sequence: Synthetic oligonucleotide
  Target: ATXN1; (-) strand; PAM type: NRG; PAM sequence: AGG
gactgttgtggggtgggggg

SEQ ID NO: 57525 - DNA, 20 bp, Artificial Sequence
  Description of Artificial Sequence: Synthetic oligonucleotide
  Target: ATXN1; (-) strand; PAM type: NRG; PAM sequence: GAG
ggactgttgtggggtggggg

SEQ ID NO: 57526 - DNA, 20 bp, Artificial Sequence
  Description of Artificial Sequence: Synthetic oligonucleotide
  Target: ATXN1; (-) strand; PAM type: NRG; PAM sequence: GGG
ggggactgttgtggggtggg

SEQ ID NO: 57527 - DNA, 20 bp, Artificial Sequence
  Description of Artificial Sequence: Synthetic oligonucleotide
  Target: ATXN1; (-) strand; PAM type: NRG; PAM sequence: GGG
tggggactgttgtggggtgg

SEQ ID NO: 57528 - DNA, 20 bp, Artificial Sequence
  Description of Artificial Sequence: Synthetic oligonucleotide
  Target: ATXN1; (-) strand; PAM type: NRG; PAM sequence: GGG
ctggggactgttgtggggtg

SEQ ID NO: 57529 - DNA, 20 bp, Artificial Sequence
  Description of Artificial Sequence: Synthetic oligonucleotide
  Target: ATXN1; (-) strand; PAM type: NRG; PAM sequence: GGG
tctggggactgttgtggggt

SEQ ID NO: 57530 - DNA, 20 bp, Artificial Sequence
  Description of Artificial Sequence: Synthetic oligonucleotide
  Target: ATXN1; (-) strand; PAM type: NRG; PAM sequence: TGG
ctctggggactgttgtgggg

SEQ ID NO: 57531 - DNA, 20 bp, Artificial Sequence
  Description of Artificial Sequence: Synthetic oligonucleotide
  Target: ATXN1; (-) strand; PAM type: NRG; PAM sequence: GGG
acactctggggactgttgtg

SEQ ID NO: 57532 - DNA, 20 bp, Artificial Sequence
  Description of Artificial Sequence: Synthetic oligonucleotide
  Target: ATXN1; (-) strand; PAM type: NRG; PAM sequence: GGG
cacactctggggactgttgt

SEQ ID NO: 57533 - DNA, 20 bp, Artificial Sequence
  Description of Artificial Sequence: Synthetic oligonucleotide
  Target: ATXN1; (-) strand; PAM type: NRG; PAM sequence: TGG
tcacactctggggactgttg

SEQ ID NO: 57534 - DNA, 20 bp, Artificial Sequence
  Description of Artificial Sequence: Synthetic oligonucleotide
  Target: ATXN1; (-) strand; PAM type: NRG; PAM sequence: GGG
aaggggaacatcacactctg

SEQ ID NO: 57535 - DNA, 20 bp, Artificial Sequence
  Description of Artificial Sequence: Synthetic oligonucleotide
  Target: ATXN1; (-) strand; PAM type: NRG; PAM sequence: GGG
gaaggggaacatcacactct

SEQ ID NO: 57536 - DNA, 20 bp, Artificial Sequence
  Description of Artificial Sequence: Synthetic oligonucleotide
  Target: ATXN1; (-) strand; PAM type: NRG; PAM sequence: TGG
ggaaggggaacatcacactc

SEQ ID NO: 57537 - DNA, 20 bp, Artificial Sequence
  Description of Artificial Sequence: Synthetic oligonucleotide
  Target: ATXN1; (-) strand; PAM type: NRG; PAM sequence: GGG
gaacacatggacacaggaag

SEQ ID NO: 57538 - DNA, 20 bp, Artificial Sequence
  Description of Artificial Sequence: Synthetic oligonucleotide
  Target: ATXN1; (-) strand; PAM type: NRG; PAM sequence: GGG
agaacacatggacacaggaa

SEQ ID NO: 57539 - DNA, 20 bp, Artificial Sequence
  Description of Artificial Sequence: Synthetic oligonucleotide
  Target: ATXN1; (-) strand; PAM type: NRG; PAM sequence: AGG
gagaacacatggacacagga

SEQ ID NO: 57540 - DNA, 20 bp, Artificial Sequence
  Description of Artificial Sequence: Synthetic oligonucleotide
  Target: ATXN1; (-) strand; PAM type: NRG; PAM sequence: AAG
tgagaacacatggacacagg

SEQ ID NO: 57541 - DNA, 20 bp, Artificial Sequence
  Description of Artificial Sequence: Synthetic oligonucleotide
  Target: ATXN1; (-) strand; PAM type: NRG; PAM sequence: AGG
caatgagaacacatggacac

SEQ ID NO: 57542 - DNA, 20 bp, Artificial Sequence
  Description of Artificial Sequence: Synthetic oligonucleotide
  Target: ATXN1; (-) strand; PAM type: NRG; PAM sequence: CAG
acaatgagaacacatggaca

SEQ ID NO: 57543 - DNA, 20 bp, Artificial Sequence
  Description of Artificial Sequence: Synthetic oligonucleotide
  Target: ATXN1; (-) strand; PAM type: NRG; PAM sequence: TGG
aattgaacaatgagaacaca

SEQ ID NO: 57544 - DNA, 20 bp, Artificial Sequence
  Description of Artificial Sequence: Synthetic oligonucleotide
  Target: ATXN1; (-) strand; PAM type: NRG; PAM sequence: GAG
atagatgggaattgaacaat

SEQ ID NO: 57545 - DNA, 20 bp, Artificial Sequence
  Description of Artificial Sequence: Synthetic oligonucleotide
  Target: ATXN1; (-) strand; PAM type: NRG; PAM sequence: GGG
gcatgttctcactcatagat

SEQ ID NO: 57546 - DNA, 20 bp, Artificial Sequence
  Description of Artificial Sequence: Synthetic oligonucleotide
  Target: ATXN1; (-) strand; PAM type: NRG; PAM sequence: TGG
cgcatgttctcactcataga

SEQ ID NO: 57547 - DNA, 20 bp, Artificial Sequence
  Description of Artificial Sequence: Synthetic oligonucleotide
  Target: ATXN1; (-) strand; PAM type: NRG; PAM sequence: TAG
acaccgcatgttctcactca

SEQ ID NO: 57548 - DNA, 20 bp, Artificial Sequence
  Description of Artificial Sequence: Synthetic oligonucleotide
  Target: ATXN1; (-) strand; PAM type: NRG; PAM sequence: AGG
attctcagtaaactatcaca

SEQ ID NO: 57549 - DNA, 20 bp, Artificial Sequence
  Description of Artificial Sequence: Synthetic oligonucleotide
  Target: ATXN1; (-) strand; PAM type: NRG; PAM sequence: AAG
cattctcagtaaactatcac

SEQ ID NO: 57550 - DNA, 20 bp, Artificial Sequence
  Description of Artificial Sequence: Synthetic oligonucleotide
  Target: ATXN1; (-) strand; PAM type: NRG; PAM sequence: CAG
aaattggaaatcatcattct

SEQ ID NO: 57551 - DNA, 20 bp, Artificial Sequence
  Description of Artificial Sequence: Synthetic oligonucleotide
  Target: ATXN1; (-) strand; PAM type: NRG; PAM sequence: TGG
tgtagggacatggatgaaat

SEQ ID NO: 57552 - DNA, 20 bp, Artificial Sequence
  Description of Artificial Sequence: Synthetic oligonucleotide
  Target: ATXN1; (-) strand; PAM type: NRG; PAM sequence: TGG
tcacgtcctttgtagggaca

SEQ ID NO: 57553 - DNA, 20 bp, Artificial Sequence
  Description of Artificial Sequence: Synthetic oligonucleotide
  Target: ATXN1; (-) strand; PAM type: NRG; PAM sequence: GGG
atgagttcacgtcctttgta

SEQ ID NO: 57554 - DNA, 20 bp, Artificial Sequence
  Description of Artificial Sequence: Synthetic oligonucleotide
  Target: ATXN1; (-) strand; PAM type: NRG; PAM sequence: AGG
gatgagttcacgtcctttgt

SEQ ID NO: 57555 - DNA, 20 bp, Artificial Sequence
  Description of Artificial Sequence: Synthetic oligonucleotide
  Target: ATXN1; (-) strand; PAM type: NRG; PAM sequence: TAG
tgatgagttcacgtcctttg

SEQ ID NO: 57556 - DNA, 20 bp, Artificial Sequence
  Description of Artificial Sequence: Synthetic oligonucleotide
  Target: ATXN1; (-) strand; PAM type: NRG; PAM sequence: GAG
atgcagccataaaaaatgat

SEQ ID NO: 57557 - DNA, 20 bp, Artificial Sequence
  Description of Artificial Sequence: Synthetic oligonucleotide
  Target: ATXN1; (-) strand; PAM type: NRG; PAM sequence: CAG
atacaccatggaatactatg

SEQ ID NO: 57558 - DNA, 20 bp, Artificial Sequence
  Description of Artificial Sequence: Synthetic oligonucleotide
  Target: ATXN1; (-) strand; PAM type: NRG; PAM sequence: TGG
aatgtggcacatatacacca

SEQ ID NO: 57559 - DNA, 20 bp, Artificial Sequence
  Description of Artificial Sequence: Synthetic oligonucleotide
  Target: ATXN1; (-) strand; PAM type: NRG; PAM sequence: TGG
tagactggattaagaaaatg

SEQ ID NO: 57560 - DNA, 20 bp, Artificial Sequence
  Description of Artificial Sequence: Synthetic oligonucleotide
  Target: ATXN1; (-) strand; PAM type: NRG; PAM sequence: AAG
caacaatgatagactggatt

SEQ ID NO: 57561 - DNA, 20 bp, Artificial Sequence
  Description of Artificial Sequence: Synthetic oligonucleotide
  Target: ATXN1; (-) strand; PAM type: NRG; PAM sequence: TGG
aatgtccaacaatgatagac

SEQ ID NO: 57562 - DNA, 20 bp, Artificial Sequence
  Description of Artificial Sequence: Synthetic oligonucleotide
  Target: ATXN1; (-) strand; PAM type: NRG; PAM sequence: TAG
acccaaatgtccaacaatga

SEQ ID NO: 57563 - DNA, 20 bp, Artificial Sequence
  Description of Artificial Sequence: Synthetic oligonucleotide
  Target: ATXN1; (-) strand; PAM type: NRG; PAM sequence: TGG
tattcacaatagcaaagact

SEQ ID NO: 57564 - DNA, 20 bp, Artificial Sequence
  Description of Artificial Sequence: Synthetic oligonucleotide
  Target: ATXN1; (-) strand; PAM type: NRG; PAM sequence: AAG
cggcactattcacaatagca

SEQ ID NO: 57565 - DNA, 20 bp, Artificial Sequence
  Description of Artificial Sequence: Synthetic oligonucleotide
  Target: ATXN1; (-) strand; PAM type: NRG; PAM sequence: TAG
tatggcggcactattcacaa

SEQ ID NO: 57566 - DNA, 20 bp, Artificial Sequence
  Description of Artificial Sequence: Synthetic oligonucleotide
  Target: ATXN1; (-) strand; PAM type: NRG; PAM sequence: CGG
atgcacatgtatgtttatgg

SEQ ID NO: 57567 - DNA, 20 bp, Artificial Sequence
  Description of Artificial Sequence: Synthetic oligonucleotide
  Target: ATXN1; (-) strand; PAM type: NRG; PAM sequence: TGG
cacatgcacatgtatgttta

SEQ ID NO: 57568 - DNA, 20 bp, Artificial Sequence
  Description of Artificial Sequence: Synthetic oligonucleotide
  Target: ATXN1; (-) strand; PAM type: NRG; PAM sequence: AAG
ctataaatcatgctgcaata

SEQ ID NO: 57569 - DNA, 20 bp, Artificial Sequence
  Description of Artificial Sequence: Synthetic oligonucleotide
  Target: ATXN1; (-) strand; PAM type: NRG; PAM sequence: AGG
attactgggtatatacccaa

SEQ ID NO: 57570 - DNA, 20 bp, Artificial Sequence
  Description of Artificial Sequence: Synthetic oligonucleotide
  Target: ATXN1; (-) strand; PAM type: NRG; PAM sequence: AAG
cattactgggtatataccca

SEQ ID NO: 57571 - DNA, 20 bp, Artificial Sequence
  Description of Artificial Sequence: Synthetic oligonucleotide
  Target: ATXN1; (-) strand; PAM type: NRG; PAM sequence: GGG
gacccagccatcccattact

SEQ ID NO: 57572 - DNA, 20 bp, Artificial Sequence
  Description of Artificial Sequence: Synthetic oligonucleotide
  Target: ATXN1; (-) strand; PAM type: NRG; PAM sequence: TGG
tgacccagccatcccattac

SEQ ID NO: 57573 - DNA, 20 bp, Artificial Sequence
  Description of Artificial Sequence: Synthetic oligonucleotide
  Target: ATXN1; (-) strand; PAM type: NRG; PAM sequence: CAG
actagaaataccatttgacc

SEQ ID NO: 57574 - DNA, 20 bp, Artificial Sequence
  Description of Artificial Sequence: Synthetic oligonucleotide
  Target: ATXN1; (-) strand; PAM type: NRG; PAM sequence: TAG
attcctcagggatctagaac

SEQ ID NO: 57575 - DNA, 20 bp, Artificial Sequence
  Description of Artificial Sequence: Synthetic oligonucleotide
  Target: ATXN1; (-) strand; PAM type: NRG; PAM sequence: TAG
gtggcgattcctcagggatc

SEQ ID NO: 57576 - DNA, 20 bp, Artificial Sequence
  Description of Artificial Sequence: Synthetic oligonucleotide
  Target: ATXN1; (-) strand; PAM type: NRG; PAM sequence: GGG
gtcagtgtggcgattcctca

SEQ ID NO: 57577 - DNA, 20 bp, Artificial Sequence
  Description of Artificial Sequence: Synthetic oligonucleotide
  Target: ATXN1; (-) strand; PAM type: NRG; PAM sequence: AGG
agtcagtgtggcgattcctc

SEQ ID NO: 57578 - DNA, 20 bp, Artificial Sequence
  Description of Artificial Sequence: Synthetic oligonucleotide
  Target: ATXN1; (-) strand; PAM type: NRG; PAM sequence: CAG
aagtcagtgtggcgattcct

SEQ ID NO: 57579 - DNA, 20 bp, Artificial Sequence
  Description of Artificial Sequence: Synthetic oligonucleotide
  Target: ATXN1; (-) strand; PAM type: NRG; PAM sequence: TGG
aaccattgtggaagtcagtg

SEQ ID NO: 57580 - DNA, 20 bp, Artificial Sequence
  Description of Artificial Sequence: Synthetic oligonucleotide
  Target: ATXN1; (-) strand; PAM type: NRG; PAM sequence: CAG
agttcaaccattgtggaagt

SEQ ID NO: 57581 - DNA, 20 bp, Artificial Sequence
  Description of Artificial Sequence: Synthetic oligonucleotide
  Target: ATXN1; (-) strand; PAM type: NRG; PAM sequence: AAG
aactagttcaaccattgtgg

SEQ ID NO: 57582 - DNA, 20 bp, Artificial Sequence
  Description of Artificial Sequence: Synthetic oligonucleotide
  Target: ATXN1; (-) strand; PAM type: NRG; PAM sequence: TGG
gtaaactagttcaaccattg

SEQ ID NO: 57583 - DNA, 20 bp, Artificial Sequence
  Description of Artificial Sequence: Synthetic oligonucleotide
  Target: ATXN1; (-) strand; PAM type: NRG; PAM sequence: TAG
ctgttggtgggactgtaaac

SEQ ID NO: 57584 - DNA, 20 bp, Artificial Sequence
  Description of Artificial Sequence: Synthetic oligonucleotide
  Target: ATXN1; (-) strand; PAM type: NRG; PAM sequence: GGG
aacacttttacactgttggt

SEQ ID NO: 57585 - DNA, 20 bp, Artificial Sequence
  Description of Artificial Sequence: Synthetic oligonucleotide
  Target: ATXN1; (-) strand; PAM type: NRG; PAM sequence: TGG
gaacacttttacactgttgg

SEQ ID NO: 57586 - DNA, 20 bp, Artificial Sequence
  Description of Artificial Sequence: Synthetic oligonucleotide
  Target: ATXN1; (-) strand; PAM type: NRG; PAM sequence: TGG
taggaacacttttacactgt

SEQ ID NO: 57587 - DNA, 20 bp, Artificial Sequence
  Description of Artificial Sequence: Synthetic oligonucleotide
  Target: ATXN1; (-) strand; PAM type: NRG; PAM sequence: AGG
tggagaggatgtggagaaat

SEQ ID NO: 57588 - DNA, 20 bp, Artificial Sequence
  Description of Artificial Sequence: Synthetic oligonucleotide
  Target: ATXN1; (-) strand; PAM type: NRG; PAM sequence: TAG
ctggagaggatgtggagaaa

SEQ ID NO: 57589 - DNA, 20 bp, Artificial Sequence
  Description of Artificial Sequence: Synthetic oligonucleotide
  Target: ATXN1; (-) strand; PAM type: NRG; PAM sequence: GAG
caggtgctggagaggatgtg

SEQ ID NO: 57590 - DNA, 20 bp, Artificial Sequence
  Description of Artificial Sequence: Synthetic oligonucleotide
  Target: ATXN1; (-) strand; PAM type: NRG; PAM sequence: TGG
aacaggtgctggagaggatg

SEQ ID NO: 57591 - DNA, 20 bp, Artificial Sequence
  Description of Artificial Sequence: Synthetic oligonucleotide
  Target: ATXN1; (-) strand; PAM type: NRG; PAM sequence: AGG
ggaaacaacaggtgctggag

SEQ ID NO: 57592 - DNA, 20 bp, Artificial Sequence
  Description of Artificial Sequence: Synthetic oligonucleotide
  Target: ATXN1; (-) strand; PAM type: NRG; PAM sequence: GAG
aggaaacaacaggtgctgga

SEQ ID NO: 57593 - DNA, 20 bp, Artificial Sequence
  Description of Artificial Sequence: Synthetic oligonucleotide
  Target: ATXN1; (-) strand; PAM type: NRG; PAM sequence: GAG
tcaggaaacaacaggtgctg

SEQ ID NO: 57594 - DNA, 20 bp, Artificial Sequence
  Description of Artificial Sequence: Synthetic oligonucleotide
  Target: ATXN1; (-) strand; PAM type: NRG; PAM sequence: TGG
agtcaggaaacaacaggtgc

SEQ ID NO: 57595 - DNA, 20 bp, Artificial Sequence
  Description of Artificial Sequence: Synthetic oligonucleotide
  Target: ATXN1; (-) strand; PAM type: NRG; PAM sequence: AGG
ttaaaaagtcaggaaacaac

SEQ ID NO: 57596 - DNA, 20 bp, Artificial Sequence
  Description of Artificial Sequence: Synthetic oligonucleotide
  Target: ATXN1; (-) strand; PAM type: NRG; PAM sequence: CAG
attaaaaagtcaggaaacaa

SEQ ID NO: 57597 - DNA, 20 bp, Artificial Sequence
  Description of Artificial Sequence: Synthetic oligonucleotide
  Target: ATXN1; (-) strand; PAM type: NRG; PAM sequence: AGG
atggcaatcattaaaaagtc

SEQ ID NO: 57598 - DNA, 20 bp, Artificial Sequence
  Description of Artificial Sequence: Synthetic oligonucleotide
  Target: ATXN1; (-) strand; PAM type: NRG; PAM sequence: CAG
aatggcaatcattaaaaagt

SEQ ID NO: 57599 - DNA, 20 bp, Artificial Sequence
  Description of Artificial Sequence: Synthetic oligonucleotide
  Target: ATXN1; (-) strand; PAM type: NRG; PAM sequence: AAG
ttagaatggcaatcattaaa

SEQ ID NO: 57600 - DNA, 20 bp, Artificial Sequence
  Description of Artificial Sequence: Synthetic oligonucleotide
  Target: ATXN1; (-) strand; PAM type: NRG; PAM sequence: TGG
ccatctcacaccagttagaa

SEQ ID NO: 57601 - DNA, 20 bp, Artificial Sequence
  Description of Artificial Sequence: Synthetic oligonucleotide
  Target: ATXN1; (-) strand; PAM type: NRG; PAM sequence: TAG
agataccatctcacaccagt

SEQ ID NO: 57602 - DNA, 20 bp, Artificial Sequence
  Description of Artificial Sequence: Synthetic oligonucleotide
  Target: ATXN1; (-) strand; PAM type: NRG; PAM sequence: CAG
aatgagataccatctcacac

SEQ ID NO: 57603 - DNA, 20 bp, Artificial Sequence
  Description of Artificial Sequence: Synthetic oligonucleotide
  Target: ATXN1; (-) strand; PAM type: NRG; PAM sequence: GAG
atgcaaatcaaaaccacaat

SEQ ID NO: 57604 - DNA, 20 bp, Artificial Sequence
  Description of Artificial Sequence: Synthetic oligonucleotide
  Target: ATXN1; (-) strand; PAM type: NRG; PAM sequence: GAG
ctcatcatcactggccatca

SEQ ID NO: 57605 - DNA, 20 bp, Artificial Sequence
  Description of Artificial Sequence: Synthetic oligonucleotide
  Target: ATXN1; (-) strand; PAM type: NRG; PAM sequence: CAG
tgctcatcatcactggccat

SEQ ID NO: 57606 - DNA, 20 bp, Artificial Sequence
  Description of Artificial Sequence: Synthetic oligonucleotide
  Target: ATXN1; (-) strand; PAM type: NRG; PAM sequence: TGG
gaaaaaatgctcatcatcac

SEQ ID NO: 57607 - DNA, 20 bp, Artificial Sequence
  Description of Artificial Sequence: Synthetic oligonucleotide
  Target: ATXN1; (-) strand; PAM type: NRG; PAM sequence: AAG
gaagacatttatgcagccaa

SEQ ID NO: 57608 - DNA, 20 bp, Artificial Sequence
  Description of Artificial Sequence: Synthetic oligonucleotide
  Target: ATXN1; (-) strand; PAM type: NRG; PAM sequence: CAG
ctcaaaagaagacatttatg

SEQ ID NO: 57609 - DNA, 20 bp, Artificial Sequence
  Description of Artificial Sequence: Synthetic oligonucleotide
  Target: ATXN1; (-) strand; PAM type: NRG; PAM sequence: AAG
taacagacacttctcaaaag

SEQ ID NO: 57610 - DNA, 20 bp, Artificial Sequence
  Description of Artificial Sequence: Synthetic oligonucleotide
  Target: ATXN1; (-) strand; PAM type: NRG; PAM sequence: AAG
atttaacagacacttctcaa

SEQ ID NO: 57611 - DNA, 20 bp, Artificial Sequence
  Description of Artificial Sequence: Synthetic oligonucleotide
  Target: ATXN1; (-) strand; PAM type: NRG; PAM sequence: CAG
gaaatatcaaacacatttaa

SEQ ID NO: 57612 - DNA, 20 bp, Artificial Sequence
  Description of Artificial Sequence: Synthetic oligonucleotide
  Target: ATXN1; (-) strand; PAM type: NRG; PAM sequence: TAG
ggaactttaactttgtgtta

SEQ ID NO: 57613 - DNA, 20 bp, Artificial Sequence
  Description of Artificial Sequence: Synthetic oligonucleotide
  Target: ATXN1; (-) strand; PAM type: NRG; PAM sequence: AGG
aaacactgccaaattaccaa

SEQ ID NO: 57614 - DNA, 20 bp, Artificial Sequence
  Description of Artificial Sequence: Synthetic oligonucleotide
  Target: ATXN1; (-) strand; PAM type: NRG; PAM sequence: AAG
gaaacactgccaaattacca

SEQ ID NO: 57615 - DNA, 20 bp, Artificial Sequence
  Description of Artificial Sequence: Synthetic oligonucleotide
  Target: ATXN1; (-) strand; PAM type: NRG; PAM sequence: GAG
ggctgtgggaaaccacattt

SEQ ID NO: 57616 - DNA, 20 bp, Artificial Sequence
  Description of Artificial Sequence: Synthetic oligonucleotide
  Target: ATXN1; (-) strand; PAM type: NRG; PAM sequence: GGG
gcaccccaaaggaaggctgt

SEQ ID NO: 57617 - DNA, 20 bp, Artificial Sequence
  Description of Artificial Sequence: Synthetic oligonucleotide
  Target: ATXN1; (-) strand; PAM type: NRG; PAM sequence: TGG
ggcaccccaaaggaaggctg

SEQ ID NO: 57618 - DNA, 20 bp, Artificial Sequence
  Description of Artificial Sequence: Synthetic oligonucleotide
  Target: ATXN1; (-) strand; PAM type: NRG; PAM sequence: AGG
ttaacaggcaccccaaagga

SEQ ID NO: 57619 - DNA, 20 bp, Artificial Sequence
  Description of Artificial Sequence: Synthetic oligonucleotide
  Target: ATXN1; (-) strand; PAM type: NRG; PAM sequence: AAG
tttaacaggcaccccaaagg

SEQ ID NO: 57620 - DNA, 20 bp, Artificial Sequence
  Description of Artificial Sequence: Synthetic oligonucleotide
  Target: ATXN1; (-) strand; PAM type: NRG; PAM sequence: AGG
aattttaacaggcaccccaa

SEQ ID NO: 57621 - DNA, 20 bp, Artificial Sequence
  Description of Artificial Sequence: Synthetic oligonucleotide
  Target: ATXN1; (-) strand; PAM type: NRG; PAM sequence: AAG
gaattttaacaggcacccca

SEQ ID NO: 57622 - DNA, 20 bp, Artificial Sequence
  Description of Artificial Sequence: Synthetic oligonucleotide
  Target: ATXN1; (-) strand; PAM type: NRG; PAM sequence: AGG
tcaggaatgtgaattttaac

SEQ ID NO: 57623 - DNA, 20 bp, Artificial Sequence
  Description of Artificial Sequence: Synthetic oligonucleotide
  Target: ATXN1; (-) strand; PAM type: NRG; PAM sequence: CAG
gtcaggaatgtgaattttaa

SEQ ID NO: 57624 - DNA, 20 bp, Artificial Sequence
  Description of Artificial Sequence: Synthetic oligonucleotide
  Target: ATXN1; (-) strand; PAM type: NRG; PAM sequence: AGG
gccccgagtaagctgatgtc

SEQ ID NO: 57625 - DNA, 20 bp, Artificial Sequence
  Description of Artificial Sequence: Synthetic oligonucleotide
  Target: ATXN1; (-) strand; PAM type: NRG; PAM sequence: CAG
tgccccgagtaagctgatgt

SEQ ID NO: 57626 - DNA, 20 bp, Artificial Sequence
  Description of Artificial Sequence: Synthetic oligonucleotide
  Target: ATXN1; (-) strand; PAM type: NRG; PAM sequence: AAG
ttttgagaagtgccccgagt

SEQ ID NO: 57627 - DNA, 20 bp, Artificial Sequence
  Description of Artificial Sequence: Synthetic oligonucleotide
  Target: ATXN1; (-) strand; PAM type: NRG; PAM sequence: GAG
tcaattttgagaagtgcccc

SEQ ID NO: 57628 - DNA, 20 bp, Artificial Sequence
  Description of Artificial Sequence: Synthetic oligonucleotide
  Target: ATXN1; (-) strand; PAM type: NRG; PAM sequence: AAG
gggcagctttcaattttgag

SEQ ID NO: 57629 - DNA, 20 bp, Artificial Sequence
  Description of Artificial Sequence: Synthetic oligonucleotide
  Target: ATXN1; (-) strand; PAM type: NRG; PAM sequence: GAG
gttgggcagctttcaatttt

SEQ ID NO: 57630 - DNA, 20 bp, Artificial Sequence
  Description of Artificial Sequence: Synthetic oligonucleotide
  Target: ATXN1; (-) strand; PAM type: NRG; PAM sequence: CAG
ttcacaaatctggggttggg

SEQ ID NO: 57631 - DNA, 20 bp, Artificial Sequence
  Description of Artificial Sequence: Synthetic oligonucleotide
  Target: ATXN1; (-) strand; PAM type: NRG; PAM sequence: GGG
tgattcacaaatctggggtt

SEQ ID NO: 57632 - DNA, 20 bp, Artificial Sequence
  Description of Artificial Sequence: Synthetic oligonucleotide
  Target: ATXN1; (-) strand; PAM type: NRG; PAM sequence: TGG
ctgattcacaaatctggggt

SEQ ID NO: 57633 - DNA, 20 bp, Artificial Sequence
  Description of Artificial Sequence: Synthetic oligonucleotide
  Target: ATXN1; (-) strand; PAM type: NRG; PAM sequence: GGG
aattctgattcacaaatctg

SEQ ID NO: 57634 - DNA, 20 bp, Artificial Sequence
  Description of Artificial Sequence: Synthetic oligonucleotide
  Target: ATXN1; (-) strand; PAM type: NRG; PAM sequence: GGG
gaattctgattcacaaatct

SEQ ID NO: 57635 - DNA, 20 bp, Artificial Sequence
  Description of Artificial Sequence: Synthetic oligonucleotide
  Target: ATXN1; (-) strand; PAM type: NRG; PAM sequence: TGG
ggaattctgattcacaaatc

SEQ ID NO: 57636 - DNA, 20 bp, Artificial Sequence
  Description of Artificial Sequence: Synthetic oligonucleotide
  Target: ATXN1; (-) strand; PAM type: NRG; PAM sequence: AGG
gttttctgggcttcactccc

SEQ ID NO: 57637 - DNA, 20 bp, Artificial Sequence
  Description of Artificial Sequence: Synthetic oligonucleotide
  Target: ATXN1; (-) strand; PAM type: NRG; PAM sequence: CAG
agttttctgggcttcactcc

SEQ ID NO: 57638 - DNA, 20 bp, Artificial Sequence
  Description of Artificial Sequence: Synthetic oligonucleotide
  Target: ATXN1; (-) strand; PAM type: NRG; PAM sequence: GGG
tatgtaaaatacagttttct

SEQ ID NO: 57639 - DNA, 20 bp, Artificial Sequence
  Description of Artificial Sequence: Synthetic oligonucleotide
  Target: ATXN1; (-) strand; PAM type: NRG; PAM sequence: TGG
gtatgtaaaatacagttttc

SEQ ID NO: 57640 - DNA, 20 bp, Artificial Sequence
  Description of Artificial Sequence: Synthetic oligonucleotide
  Target: ATXN1; (-) strand; PAM type: NRG; PAM sequence: CAG
tgcatactgtatgtaaaata

SEQ ID NO: 57641 - DNA, 20 bp, Artificial Sequence
  Description of Artificial Sequence: Synthetic oligonucleotide
  Target: ATXN1; (-) strand; PAM type: NRG; PAM sequence: AAG
aagcaaaatggagtgtgcag

SEQ ID NO: 57642 - DNA, 20 bp, Artificial Sequence
  Description of Artificial Sequence: Synthetic oligonucleotide
  Target: ATXN1; (-) strand; PAM type: NRG; PAM sequence: CAG
ctaaagcaaaatggagtgtg

SEQ ID NO: 57643 - DNA, 20 bp, Artificial Sequence
  Description of Artificial Sequence: Synthetic oligonucleotide
  Target: ATXN1; (-) strand; PAM type: NRG; PAM sequence: GAG
caaatgactaaagcaaaatg

SEQ ID NO: 57644 - DNA, 20 bp, Artificial Sequence
  Description of Artificial Sequence: Synthetic oligonucleotide
  Target: ATXN1; (-) strand; PAM type: NRG; PAM sequence: TGG
tgcaaatgactaaagcaaaa

SEQ ID NO: 57645 - DNA, 20 bp, Artificial Sequence
  Description of Artificial Sequence: Synthetic oligonucleotide
  Target: ATXN1; (-) strand; PAM type: NRG; PAM sequence: AAG
ttatttcatgcaaatgacta

SEQ ID NO: 57646 - DNA, 20 bp, Artificial Sequence
  Description of Artificial Sequence: Synthetic oligonucleotide
  Target: ATXN1; (-) strand; PAM type: NRG; PAM sequence: AAG
aactgttaaaccctttgaaa

SEQ ID NO: 57647 - DNA, 20 bp, Artificial Sequence
  Description of Artificial Sequence: Synthetic oligonucleotide
  Target: ATXN1; (-) strand; PAM type: NRG; PAM sequence: TAG
ctttaatagaaaaaaaactt

SEQ ID NO: 57648 - DNA, 20 bp, Artificial Sequence
  Description of Artificial Sequence: Synthetic oligonucleotide
  Target: ATXN1; (-) strand; PAM type: NRG; PAM sequence: TAG
tcactgtaaagttcctttaa

SEQ ID NO: 57649 - DNA, 20 bp, Artificial Sequence
  Description of Artificial Sequence: Synthetic oligonucleotide
  Target: ATXN1; (-) strand; PAM type: NRG; PAM sequence: AAG
gaatattttaggtcactgta

SEQ ID NO: 57650 - DNA, 20 bp, Artificial Sequence
  Description of Artificial Sequence: Synthetic oligonucleotide
  Target: ATXN1; (-) strand; PAM type: NRG; PAM sequence: AGG
caacatgtgaagaatatttt

SEQ ID NO: 57651 - DNA, 20 bp, Artificial Sequence
  Description of Artificial Sequence: Synthetic oligonucleotide
  Target: ATXN1; (-) strand; PAM type: NRG; PAM sequence: TAG
acaacatgtgaagaatattt

SEQ ID NO: 57652 - DNA, 20 bp, Artificial Sequence
  Description of Artificial Sequence: Synthetic oligonucleotide
  Target: ATXN1; (-) strand; PAM type: NRG; PAM sequence: AAG
aaatgaaacaacaacatgtg

SEQ ID NO: 57653 - DNA, 20 bp, Artificial Sequence
  Description of Artificial Sequence: Synthetic oligonucleotide
  Target: ATXN1; (-) strand; PAM type: NRG; PAM sequence: CAG
caccaacaggatatatttta

SEQ ID NO: 57654 - DNA, 20 bp, Artificial Sequence
  Description of Artificial Sequence: Synthetic oligonucleotide
  Target: ATXN1; (-) strand; PAM type: NRG; PAM sequence: AGG
tgttgatagatgacaccaac

SEQ ID NO: 57655 - DNA, 20 bp, Artificial Sequence
  Description of Artificial Sequence: Synthetic oligonucleotide
  Target: ATXN1; (-) strand; PAM type: NRG; PAM sequence: CAG
ttgttgatagatgacaccaa

SEQ ID NO: 57656 - DNA, 20 bp, Artificial Sequence
  Description of Artificial Sequence: Synthetic oligonucleotide
  Target: ATXN1; (-) strand; PAM type: NRG; PAM sequence: TAG
taagactatgtacttgttga

SEQ ID NO: 57657 - DNA, 20 bp, Artificial Sequence
  Description of Artificial Sequence: Synthetic oligonucleotide
  Target: ATXN1; (-) strand; PAM type: NRG; PAM sequence: AAG
tctcccataataaaaatttt

SEQ ID NO: 57658 - DNA, 20 bp, Artificial Sequence
  Description of Artificial Sequence: Synthetic oligonucleotide
  Target: ATXN1; (-) strand; PAM type: NRG; PAM sequence: TGG
tcagcaaactgtagagagta

SEQ ID NO: 57659 - DNA, 20 bp, Artificial Sequence
  Description of Artificial Sequence: Synthetic oligonucleotide
  Target: ATXN1; (-) strand; PAM type: NRG; PAM sequence: GAG
cacgctcagcaaactgtaga

SEQ ID NO: 57660 - DNA, 20 bp, Artificial Sequence
  Description of Artificial Sequence: Synthetic oligonucleotide
  Target: ATXN1; (-) strand; PAM type: NRG; PAM sequence: GAG
cacacgctcagcaaactgta

SEQ ID NO: 57661 - DNA, 20 bp, Artificial Sequence
  Description of Artificial Sequence: Synthetic oligonucleotide
  Target: ATXN1; (-) strand; PAM type: NRG; PAM sequence: TAG
accacacgctcagcaaactg

SEQ ID NO: 57662 - DNA, 20 bp, Artificial Sequence
  Description of Artificial Sequence: Synthetic oligonucleotide
  Target: ATXN1; (-) strand; PAM type: NRG; PAM sequence: CAG
tagtttattaaccacacgct

SEQ ID NO: 57663 - DNA, 20 bp, Artificial Sequence
  Description of Artificial Sequence: Synthetic oligonucleotide
  Target: ATXN1; (-) strand; PAM type: NRG; PAM sequence: TAG
ttactctaggctatttcctc

SEQ ID NO: 57664 - DNA, 20 bp, Artificial Sequence
  Description of Artificial Sequence: Synthetic oligonucleotide
  Target: ATXN1; (-) strand; PAM type: NRG; PAM sequence: AGG
agcttcatccatgttactct

SEQ ID NO: 57665 - DNA, 20 bp, Artificial Sequence
  Description of Artificial Sequence: Synthetic oligonucleotide
  Target: ATXN1; (-) strand; PAM type: NRG; PAM sequence: TAG
tagcttcatccatgttactc

SEQ ID NO: 57666 - DNA, 20 bp, Artificial Sequence
  Description of Artificial Sequence: Synthetic oligonucleotide
  Target: ATXN1; (-) strand; PAM type: NRG; PAM sequence: TAG
atacaaaaggcacatttctg

SEQ ID NO: 57667 - DNA, 20 bp, Artificial Sequence
  Description of Artificial Sequence: Synthetic oligonucleotide
  Target: ATXN1; (-) strand; PAM type: NRG; PAM sequence: AGG
aagcatgtcttccatacaaa

SEQ ID NO: 57668 - DNA, 20 bp, Artificial Sequence
  Description of Artificial Sequence: Synthetic oligonucleotide
  Target: ATXN1; (-) strand; PAM type: NRG; PAM sequence: AAG
caagcatgtcttccatacaa

SEQ ID NO: 57669 - DNA, 20 bp, Artificial Sequence
  Description of Artificial Sequence: Synthetic oligonucleotide
  Target: ATXN1; (-) strand; PAM type: NRG; PAM sequence: AAG
aacttatcttctctgtcacc

SEQ ID NO: 57670 - DNA, 20 bp, Artificial Sequence
  Description of Artificial Sequence: Synthetic oligonucleotide
  Target: ATXN1; (-) strand; PAM type: NRG; PAM sequence: GAG
tatatgctaatgctatagct

SEQ ID NO: 57671 - DNA, 20 bp, Artificial Sequence
  Description of Artificial Sequence: Synthetic oligonucleotide
  Target: ATXN1; (-) strand; PAM type: NRG; PAM sequence: TAG
gggaatatatgctaatgcta

SEQ ID NO: 57672 - DNA, 20 bp, Artificial Sequence
  Description of Artificial Sequence: Synthetic oligonucleotide
  Target: ATXN1; (-) strand; PAM type: NRG; PAM sequence: GGG
taggaatagttgtataatct

SEQ ID NO: 57673 - DNA, 20 bp, Artificial Sequence
  Description of Artificial Sequence: Synthetic oligonucleotide
  Target: ATXN1; (-) strand; PAM type: NRG; PAM sequence: TGG
ctaggaatagttgtataatc

SEQ ID NO: 57674 - DNA, 20 bp, Artificial Sequence
  Description of Artificial Sequence: Synthetic oligonucleotide
  Target: ATXN1; (-) strand; PAM type: NRG; PAM sequence: TAG
agtgcttgtgagtctaggaa

SEQ ID NO: 57675 - DNA, 20 bp, Artificial Sequence
  Description of Artificial Sequence: Synthetic oligonucleotide
  Target: ATXN1; (-) strand; PAM type: NRG; PAM sequence: AGG
aaaatagtgcttgtgagtct

SEQ ID NO: 57676 - DNA, 20 bp, Artificial Sequence
  Description of Artificial Sequence: Synthetic oligonucleotide
  Target: ATXN1; (-) strand; PAM type: NRG; PAM sequence: TAG
gaaaatagtgcttgtgagtc

SEQ ID NO: 57677 - DNA, 20 bp, Artificial Sequence
  Description of Artificial Sequence: Synthetic oligonucleotide
  Target: ATXN1; (-) strand; PAM type: NRG; PAM sequence: GAG
ttttggaaaatagtgcttgt

SEQ ID NO: 57678 - DNA, 20 bp, Artificial Sequence
  Description of Artificial Sequence: Synthetic oligonucleotide
  Target: ATXN1; (-) strand; PAM type: NRG; PAM sequence: TAG
gacacattctttttggaaaa

SEQ ID NO: 57679 - DNA, 20 bp, Artificial Sequence
  Description of Artificial Sequence: Synthetic oligonucleotide
  Target: ATXN1; (-) strand; PAM type: NRG; PAM sequence: TGG
gataagggacacattctttt

SEQ ID NO: 57680 - DNA, 20 bp, Artificial Sequence
  Description of Artificial Sequence: Synthetic oligonucleotide
  Target: ATXN1; (-) strand; PAM type: NRG; PAM sequence: GGG
gttctgtgtgttaaggataa

SEQ ID NO: 57681 - DNA, 20 bp, Artificial Sequence
  Description of Artificial Sequence: Synthetic oligonucleotide
  Target: ATXN1; (-) strand; PAM type: NRG; PAM sequence: AGG
tgttctgtgtgttaaggata

SEQ ID NO: 57682 - DNA, 20 bp, Artificial Sequence
  Description of Artificial Sequence: Synthetic oligonucleotide
  Target: ATXN1; (-) strand; PAM type: NRG; PAM sequence: AAG
atgttctgtgtgttaaggat

SEQ ID NO: 57683 - DNA, 20 bp, Artificial Sequence
  Description of Artificial Sequence: Synthetic oligonucleotide
  Target: ATXN1; (-) strand; PAM type: NRG; PAM sequence: AGG
gaattatgttctgtgtgtta

SEQ ID NO: 57684 - DNA, 20 bp, Artificial Sequence
  Description of Artificial Sequence: Synthetic oligonucleotide
  Target: ATXN1; (-) strand; PAM type: NRG; PAM sequence: AAG
agaattatgttctgtgtgtt

SEQ ID NO: 57685 - DNA, 20 bp, Artificial Sequence
  Description of Artificial Sequence: Synthetic oligonucleotide
  Target: ATXN1; (-) strand; PAM type: NRG; PAM sequence: AAG
tgataagcactatcattaga

SEQ ID NO: 57686 - DNA, 20 bp, Artificial Sequence
  Description of Artificial Sequence: Synthetic oligonucleotide
  Target: ATXN1; (-) strand; PAM type: NRG; PAM sequence: TAG
ctagtgataagcactatcat

SEQ ID NO: 57687 - DNA, 20 bp, Artificial Sequence
  Description of Artificial Sequence: Synthetic oligonucleotide
  Target: ATXN1; (-) strand; PAM type: NRG; PAM sequence: AAG
agcctctggcttctagtgat

SEQ ID NO: 57688 - DNA, 20 bp, Artificial Sequence
  Description of Artificial Sequence: Synthetic oligonucleotide
  Target: ATXN1; (-) strand; PAM type: NRG; PAM sequence: TAG
ttcaacaagcctctggcttc

SEQ ID NO: 57689 - DNA, 20 bp, Artificial Sequence
  Description of Artificial Sequence: Synthetic oligonucleotide
  Target: ATXN1; (-) strand; PAM type: NRG; PAM sequence: TGG
tgagtcattcaacaagcctc

SEQ ID NO: 57690 - DNA, 20 bp, Artificial Sequence
  Description of Artificial Sequence: Synthetic oligonucleotide
  Target: ATXN1; (-) strand; PAM type: NRG; PAM sequence: AAG
gggaaactgagtcattcaac

SEQ ID NO: 57691 - DNA, 20 bp, Artificial Sequence
  Description of Artificial Sequence: Synthetic oligonucleotide
  Target: ATXN1; (-) strand; PAM type: NRG; PAM sequence: GAG
atttactttccagggaaact

SEQ ID NO: 57692 - DNA, 20 bp, Artificial Sequence
  Description of Artificial Sequence: Synthetic oligonucleotide
  Target: ATXN1; (-) strand; PAM type: NRG; PAM sequence: GGG
tacactatatttactttcca

SEQ ID NO: 57693 - DNA, 20 bp, Artificial Sequence
  Description of Artificial Sequence: Synthetic oligonucleotide
  Target: ATXN1; (-) strand; PAM type: NRG; PAM sequence: AGG
gtacactatatttactttcc

SEQ ID NO: 57694 - DNA, 20 bp, Artificial Sequence
  Description of Artificial Sequence: Synthetic oligonucleotide
  Target: ATXN1; (-) strand; PAM type: NRG; PAM sequence: CAG
ggtacactatatttactttc

SEQ ID NO: 57695 - DNA, 20 bp, Artificial Sequence
  Description of Artificial Sequence: Synthetic oligonucleotide
  Target: ATXN1; (-) strand; PAM type: NRG; PAM sequence: CGG
tttctgattgtctgtcatcc

SEQ ID NO: 57696 - DNA, 20 bp, Artificial Sequence
  Description of Artificial Sequence: Synthetic oligonucleotide
  Target: ATXN1; (-) strand; PAM type: NRG; PAM sequence: GAG
tctaacgtgggtgacagaac

SEQ ID NO: 57697 - DNA, 20 bp, Artificial Sequence
  Description of Artificial Sequence: Synthetic oligonucleotide
  Target: ATXN1; (-) strand; PAM type: NRG; PAM sequence: CAG
ctgcactctaacgtgggtga

SEQ ID NO: 57698 - DNA, 20 bp, Artificial Sequence
  Description of Artificial Sequence: Synthetic oligonucleotide
  Target: ATXN1; (-) strand; PAM type: NRG; PAM sequence: GGG
atgccactgcactctaacgt

SEQ ID NO: 57699 - DNA, 20 bp, Artificial Sequence
  Description of Artificial Sequence: Synthetic oligonucleotide
  Target: ATXN1; (-) strand; PAM type: NRG; PAM sequence: TGG
catgccactgcactctaacg

SEQ ID NO: 57700 - DNA, 20 bp, Artificial Sequence
  Description of Artificial Sequence: Synthetic oligonucleotide
  Target: ATXN1; (-) strand; PAM type: NRG; PAM sequence: GAG
ggccaaggttgcagtatgct

SEQ ID NO: 57701 - DNA, 20 bp, Artificial Sequence
  Description of Artificial Sequence: Synthetic oligonucleotide
  Target: ATXN1; (-) strand; PAM type: NRG; PAM sequence: CAG
aacccaagaggccaaggttg

SEQ ID NO: 57702 - DNA, 20 bp, Artificial Sequence
  Description of Artificial Sequence: Synthetic oligonucleotide
  Target: ATXN1; (-) strand; PAM type: NRG; PAM sequence: AGG
agtttgaacccaagaggcca

SEQ ID NO: 57703 - DNA, 20 bp, Artificial Sequence
  Description of Artificial Sequence: Synthetic oligonucleotide
  Target: ATXN1; (-) strand; PAM type: NRG; PAM sequence: AAG
tagtttgaacccaagaggcc

SEQ ID NO: 57704 - DNA, 20 bp, Artificial Sequence
  Description of Artificial Sequence: Synthetic oligonucleotide
  Target: ATXN1; (-) strand; PAM type: NRG; PAM sequence: AGG
gagaatagtttgaacccaag

SEQ ID NO: 57705 - DNA, 20 bp, Artificial Sequence
  Description of Artificial Sequence: Synthetic oligonucleotide
  Target: ATXN1; (-) strand; PAM type: NRG; PAM sequence: GAG
ggagaatagtttgaacccaa

SEQ ID NO: 57706 - DNA, 20 bp, Artificial Sequence
  Description of Artificial Sequence: Synthetic oligonucleotide
  Target: ATXN1; (-) strand; PAM type: NRG; PAM sequence: AAG
caggagaatagtttgaaccc

SEQ ID NO: 57707 - DNA, 20 bp, Artificial Sequence
  Description of Artificial Sequence: Synthetic oligonucleotide
  Target: ATXN1; (-) strand; PAM type: NRG; PAM sequence: TAG
aggaggctgaggcaggagaa

SEQ ID NO: 57708 - DNA, 20 bp, Artificial Sequence
  Description of Artificial Sequence: Synthetic oligonucleotide
  Target: ATXN1; (-) strand; PAM type: NRG; PAM sequence: GAG
tactcaggaggctgaggcag

SEQ ID NO: 57709 - DNA, 20 bp, Artificial Sequence
  Description of Artificial Sequence: Synthetic oligonucleotide
  Target: ATXN1; (-) strand; PAM type: NRG; PAM sequence: AGG
gctactcaggaggctgaggc

SEQ ID NO: 57710 - DNA, 20 bp, Artificial Sequence
  Description of Artificial Sequence: Synthetic oligonucleotide
  Target: ATXN1; (-) strand; PAM type: NRG; PAM sequence: CAG
agctactcaggaggctgagg

SEQ ID NO: 57711 - DNA, 20 bp, Artificial Sequence
  Description of Artificial Sequence: Synthetic oligonucleotide
  Target: ATXN1; (-) strand; PAM type: NRG; PAM sequence: AGG
accagctactcaggaggctg

SEQ ID NO: 57712 - DNA, 20 bp, Artificial Sequence
  Description of Artificial Sequence: Synthetic oligonucleotide
  Target: ATXN1; (-) strand; PAM type: NRG; PAM sequence: GAG
taccagctactcaggaggct

SEQ ID NO: 57713 - DNA, 20 bp, Artificial Sequence
  Description of Artificial Sequence: Synthetic oligonucleotide
  Target: ATXN1; (-) strand; PAM type: NRG; PAM sequence: AGG
tgtaataccagctactcagg

SEQ ID NO: 57714 - DNA, 20 bp, Artificial Sequence
  Description of Artificial Sequence: Synthetic oligonucleotide
  Target: ATXN1; (-) strand; PAM type: NRG; PAM sequence: GAG
ctgtaataccagctactcag

SEQ ID NO: 57715 - DNA, 20 bp, Artificial Sequence
  Description of Artificial Sequence: Synthetic oligonucleotide
  Target: ATXN1; (-) strand; PAM type: NRG; PAM sequence: AGG
acctgtaataccagctactc

SEQ ID NO: 57716 - DNA, 20 bp, Artificial Sequence
  Description of Artificial Sequence: Synthetic oligonucleotide
  Target: ATXN1; (-) strand; PAM type: NRG; PAM sequence: CAG
cacctgtaataccagctact

SEQ ID NO: 57717 - DNA, 20 bp, Artificial Sequence
  Description of Artificial Sequence: Synthetic oligonucleotide
  Target: ATXN1; (-) strand; PAM type: NRG; PAM sequence: CAG
gtggtgggcacctgtaatac

SEQ ID NO: 57718 - DNA, 20 bp, Artificial Sequence
  Description of Artificial Sequence: Synthetic oligonucleotide
  Target: ATXN1; (-) strand; PAM type: NRG; PAM sequence: GGG
aaattagctgggtgggtggt

SEQ ID NO: 57719 - DNA, 20 bp, Artificial Sequence
  Description of Artificial Sequence: Synthetic oligonucleotide
  Target: ATXN1; (-) strand; PAM type: NRG; PAM sequence: TGG
aaaattagctgggtgggtgg

SEQ ID NO: 57720 - DNA, 20 bp, Artificial Sequence
  Description of Artificial Sequence: Synthetic oligonucleotide
  Target: ATXN1; (-) strand; PAM type: NRG; PAM sequence: TGG
acaaaaattagctgggtggg

SEQ ID NO: 57721 - DNA, 20 bp, Artificial Sequence
  Description of Artificial Sequence: Synthetic oligonucleotide
  Target: ATXN1; (-) strand; PAM type: NRG; PAM sequence: GGG
aatacaaaaattagctgggt

SEQ ID NO: 57722 - DNA, 20 bp, Artificial Sequence
  Description of Artificial Sequence: Synthetic oligonucleotide
  Target: ATXN1; (-) strand; PAM type: NRG; PAM sequence: TGG
aaatacaaaaattagctggg

SEQ ID NO: 57723 - DNA, 20 bp, Artificial Sequence
  Description of Artificial Sequence: Synthetic oligonucleotide
  Target: ATXN1; (-) strand; PAM type: NRG; PAM sequence: GGG
taaaaatacaaaaattagct

SEQ ID NO: 57724 - DNA, 20 bp, Artificial Sequence
  Description of Artificial Sequence: Synthetic oligonucleotide
  Target: ATXN1; (-) strand; PAM type: NRG; PAM sequence: TGG
ctaaaaatacaaaaattagc

SEQ ID NO: 57725 - DNA, 20 bp, Artificial Sequence
  Description of Artificial Sequence: Synthetic oligonucleotide
  Target: ATXN1; (-) strand; PAM type: NRG; PAM sequence: TAG
cctactaaaaatacaaaaat

SEQ ID NO: 57726 - DNA, 20 bp, Artificial Sequence
  Description of Artificial Sequence: Synthetic oligonucleotide
  Target: ATXN1; (-) strand; PAM type: NRG; PAM sequence: TGG
tgagacaaacctggccaaca

SEQ ID NO: 57727 - DNA, 20 bp, Artificial Sequence
  Description of Artificial Sequence: Synthetic oligonucleotide
  Target: ATXN1; (-) strand; PAM type: NRG; PAM sequence: TGG
ccaggagtttgagacaaacc

SEQ ID NO: 57728 - DNA, 20 bp, Artificial Sequence
  Description of Artificial Sequence: Synthetic oligonucleotide
  Target: ATXN1; (-) strand; PAM type: NRG; PAM sequence: GAG
tcacttgaggccaggagttt

SEQ ID NO: 57729 - DNA, 20 bp, Artificial Sequence
  Description of Artificial Sequence: Synthetic oligonucleotide
  Target: ATXN1; (-) strand; PAM type: NRG; PAM sequence: GAG
ggtggatcacttgaggccag

SEQ ID NO: 57730 - DNA, 20 bp, Artificial Sequence
  Description of Artificial Sequence: Synthetic oligonucleotide
  Target: ATXN1; (-) strand; PAM type: NRG; PAM sequence: AGG
caggtggatcacttgaggcc

SEQ ID NO: 57731 - DNA, 20 bp, Artificial Sequence
  Description of Artificial Sequence: Synthetic oligonucleotide
  Target: ATXN1; (-) strand; PAM type: NRG; PAM sequence: CAG
gcaggtggatcacttgaggc

SEQ ID NO: 57732 - DNA, 20 bp, Artificial Sequence
  Description of Artificial Sequence: Synthetic oligonucleotide
  Target: ATXN1; (-) strand; PAM type: NRG; PAM sequence: AGG
tgaggcaggtggatcacttg

SEQ ID NO: 57733 - DNA, 20 bp, Artificial Sequence
  Description of Artificial Sequence: Synthetic oligonucleotide
  Target: ATXN1; (-) strand; PAM type: NRG; PAM sequence: GAG
ctgaggcaggtggatcactt

SEQ ID NO: 57734 - DNA, 20 bp, Artificial Sequence
  Description of Artificial Sequence: Synthetic oligonucleotide
  Target: ATXN1; (-) strand; PAM type: NRG; PAM sequence: TGG
ctttgggaggctgaggcagg

SEQ ID NO: 57735 - DNA, 20 bp, Artificial Sequence
  Description of Artificial Sequence: Synthetic oligonucleotide
  Target: ATXN1; (-) strand; PAM type: NRG; PAM sequence: AGG
gcactttgggaggctgaggc

SEQ ID NO: 57736 - DNA, 20 bp, Artificial Sequence
  Description of Artificial Sequence: Synthetic oligonucleotide
  Target: ATXN1; (-) strand; PAM type: NRG; PAM sequence: CAG
agcactttgggaggctgagg

SEQ ID NO: 57737 - DNA, 20 bp, Artificial Sequence
  Description of Artificial Sequence: Synthetic oligonucleotide
  Target: ATXN1; (-) strand; PAM type: NRG; PAM sequence: AGG
cctagcactttgggaggctg

SEQ ID NO: 57738 - DNA, 20 bp, Artificial Sequence
  Description of Artificial Sequence: Synthetic oligonucleotide
  Target: ATXN1; (-) strand; PAM type: NRG; PAM sequence: GAG
tcctagcactttgggaggct

SEQ ID NO: 57739 - DNA, 20 bp, Artificial Sequence
  Description of Artificial Sequence: Synthetic oligonucleotide
  Target: ATXN1; (-) strand; PAM type: NRG; PAM sequence: AGG
tctaatcctagcactttggg

SEQ ID NO: 57740 - DNA, 20 bp, Artificial Sequence
  Description of Artificial Sequence: Synthetic oligonucleotide
  Target: ATXN1; (-) strand; PAM type: NRG; PAM sequence: GAG
ttctaatcctagcactttgg

SEQ ID NO: 57741 - DNA, 20 bp, Artificial Sequence
  Description of Artificial Sequence: Synthetic oligonucleotide
  Target: ATXN1; (-) strand; PAM type: NRG; PAM sequence: GGG
acttctaatcctagcacttt

SEQ ID NO: 57742 - DNA, 20 bp, Artificial Sequence
  Description of Artificial Sequence: Synthetic oligonucleotide
  Target: ATXN1; (-) strand; PAM type: NRG; PAM sequence: TGG
cacttctaatcctagcactt

SEQ ID NO: 57743 - DNA, 20 bp, Artificial Sequence
  Description of Artificial Sequence: Synthetic oligonucleotide
  Target: ATXN1; (-) strand; PAM type: NRG; PAM sequence: TAG
gtggctaacacttctaatcc

SEQ ID NO: 57744 - DNA, 20 bp, Artificial Sequence
  Description of Artificial Sequence: Synthetic oligonucleotide
  Target: ATXN1; (-) strand; PAM type: NRG; PAM sequence: TGG
taaaaataggcagggtgtgg

SEQ ID NO: 57745 - DNA, 20 bp, Artificial Sequence
  Description of Artificial Sequence: Synthetic oligonucleotide
  Target: ATXN1; (-) strand; PAM type: NRG; PAM sequence: TGG
aaataaaaataggcagggtg

SEQ ID NO: 57746 - DNA, 20 bp, Artificial Sequence
  Description of Artificial Sequence: Synthetic oligonucleotide
  Target: ATXN1; (-) strand; PAM type: NRG; PAM sequence: GGG
ataaaaaataaaaataggca

SEQ ID NO: 57747 - DNA, 20 bp, Artificial Sequence
  Description of Artificial Sequence: Synthetic oligonucleotide
  Target: ATXN1; (-) strand; PAM type: NRG; PAM sequence: AGG
gataaaaaataaaaataggc

SEQ ID NO: 57748 - DNA, 20 bp, Artificial Sequence
  Description of Artificial Sequence: Synthetic oligonucleotide
  Target: ATXN1; (-) strand; PAM type: NRG; PAM sequence: CAG
tgataaaaaataaaaatagg

SEQ ID NO: 57749 - DNA, 20 bp, Artificial Sequence
  Description of Artificial Sequence: Synthetic oligonucleotide
  Target: ATXN1; (-) strand; PAM type: NRG; PAM sequence: AGG
ccttgataaaaaataaaaat

SEQ ID NO: 57750 - DNA, 20 bp, Artificial Sequence
  Description of Artificial Sequence: Synthetic oligonucleotide
  Target: ATXN1; (-) strand; PAM type: NRG; PAM sequence: TAG
gccttgataaaaaataaaaa

SEQ ID NO: 57751 - DNA, 20 bp, Artificial Sequence
  Description of Artificial Sequence: Synthetic oligonucleotide
  Target: ATXN1; (-) strand; PAM type: NRG; PAM sequence: TAG
caaaaccagcctgggcaaca

SEQ ID NO: 57752 - DNA, 20 bp, Artificial Sequence
  Description of Artificial Sequence: Synthetic oligonucleotide
  Target: ATXN1; (-) strand; PAM type: NRG; PAM sequence: GGG
cagaagttcaaaaccagcct

SEQ ID NO: 57753 - DNA, 20 bp, Artificial Sequence
  Description of Artificial Sequence: Synthetic oligonucleotide
  Target: ATXN1; (-) strand; PAM type: NRG; PAM sequence: TGG
ccagaagttcaaaaccagcc

SEQ ID NO: 57754 - DNA, 20 bp, Artificial Sequence
  Description of Artificial Sequence: Synthetic oligonucleotide
  Target: ATXN1; (-) strand; PAM type: NRG; PAM sequence: CAG
tgacgccagaagttcaaaac

SEQ ID NO: 57755 - DNA, 20 bp, Artificial Sequence
  Description of Artificial Sequence: Synthetic oligonucleotide
  Target: ATXN1; (-) strand; PAM type: NRG; PAM sequence: AAG
ggaggatcacttgacgccag

SEQ ID NO: 57756 - DNA, 20 bp, Artificial Sequence
  Description of Artificial Sequence: Synthetic oligonucleotide
  Target: ATXN1; (-) strand; PAM type: NRG; PAM sequence: CAG
gtgggaggatcacttgacgc

SEQ ID NO: 57757 - DNA, 20 bp, Artificial Sequence
  Description of Artificial Sequence: Synthetic oligonucleotide
  Target: ATXN1; (-) strand; PAM type: NRG; PAM sequence: AGG
ctttgggaggccgaggtggg

SEQ ID NO: 57758 - DNA, 20 bp, Artificial Sequence
  Description of Artificial Sequence: Synthetic oligonucleotide
  Target: ATXN1; (-) strand; PAM type: NRG; PAM sequence: GAG
actttgggaggccgaggtgg

SEQ ID NO: 57759 - DNA, 20 bp, Artificial Sequence
  Description of Artificial Sequence: Synthetic oligonucleotide
  Target: ATXN1; (-) strand; PAM type: NRG; PAM sequence: GGG
gcactttgggaggccgaggt

SEQ ID NO: 57760 - DNA, 20 bp, Artificial Sequence
  Description of Artificial Sequence: Synthetic oligonucleotide
  Target: ATXN1; (-) strand; PAM type: NRG; PAM sequence: TGG
agcactttgggaggccgagg

SEQ ID NO: 57761 - DNA, 20 bp, Artificial Sequence
  Description of Artificial Sequence: Synthetic oligonucleotide
  Target: ATXN1; (-) strand; PAM type: NRG; PAM sequence: AGG
cccagcactttgggaggccg

SEQ ID NO: 57762 - DNA, 20 bp, Artificial Sequence
  Description of Artificial Sequence: Synthetic oligonucleotide
  Target: ATXN1; (-) strand; PAM type: NRG; PAM sequence: GAG
tcccagcactttgggaggcc

SEQ ID NO: 57763 - DNA, 20 bp, Artificial Sequence
  Description of Artificial Sequence: Synthetic oligonucleotide
  Target: ATXN1; (-) strand; PAM type: NRG; PAM sequence: AGG
tgtaatcccagcactttggg

SEQ ID NO: 57764 - DNA, 20 bp, Artificial Sequence
  Description of Artificial Sequence: Synthetic oligonucleotide
  Target: ATXN1; (-) strand; PAM type: NRG; PAM sequence: GAG
ctgtaatcccagcactttgg

SEQ ID NO: 57765 - DNA, 20 bp, Artificial Sequence
  Description of Artificial Sequence: Synthetic oligonucleotide
  Target: ATXN1; (-) strand; PAM type: NRG; PAM sequence: GGG
acctgtaatcccagcacttt

SEQ ID NO: 57766 - DNA, 20 bp, Artificial Sequence
  Description of Artificial Sequence: Synthetic oligonucleotide
  Target: ATXN1; (-) strand; PAM type: NRG; PAM sequence: TGG
cacctgtaatcccagcactt

SEQ ID NO: 57767 - DNA, 20 bp, Artificial Sequence
  Description of Artificial Sequence: Synthetic oligonucleotide
  Target: ATXN1; (-) strand; PAM type: NRG; PAM sequence: CAG
gtagctcacacctgtaatcc

SEQ ID NO: 57768 - DNA, 20 bp, Artificial Sequence
  Description of Artificial Sequence: Synthetic oligonucleotide
  Target: ATXN1; (-) strand; PAM type: NRG; PAM sequence: TAG
tgctattaggccaggcgcag

SEQ ID NO: 57769 - DNA, 20 bp, Artificial Sequence
  Description of Artificial Sequence: Synthetic oligonucleotide
  Target: ATXN1; (-) strand; PAM type: NRG; PAM sequence: CAG
ctttgctattaggccaggcg

SEQ ID NO: 57770 - DNA, 20 bp, Artificial Sequence
  Description of Artificial Sequence: Synthetic oligonucleotide
  Target: ATXN1; (-) strand; PAM type: NRG; PAM sequence: AGG
agcgcctttgctattaggcc

SEQ ID NO: 57771 - DNA, 20 bp, Artificial Sequence
  Description of Artificial Sequence: Synthetic oligonucleotide
  Target: ATXN1; (-) strand; PAM type: NRG; PAM sequence: CAG
cagcgcctttgctattaggc

SEQ ID NO: 57772 - DNA, 20 bp, Artificial Sequence
  Description of Artificial Sequence: Synthetic oligonucleotide
  Target: ATXN1; (-) strand; PAM type: NRG; PAM sequence: AGG
ttatcagcgcctttgctatt

SEQ ID NO: 57773 - DNA, 20 bp, Artificial Sequence
  Description of Artificial Sequence: Synthetic oligonucleotide
  Target: ATXN1; (-) strand; PAM type: NRG; PAM sequence: TAG
tttatcagcgcctttgctat

SEQ ID NO: 57774 - DNA, 20 bp, Artificial Sequence
  Description of Artificial Sequence: Synthetic oligonucleotide
  Target: ATXN1; (-) strand; PAM type: NRG; PAM sequence: CAG
tgctctcctattttttttat

SEQ ID NO: 57775 - DNA, 20 bp, Artificial Sequence
  Description of Artificial Sequence: Synthetic oligonucleotide
  Target: ATXN1; (-) strand; PAM type: NRG; PAM sequence: TGG
tagtaatgcttactaagtgc

SEQ ID NO: 57776 - DNA, 20 bp, Artificial Sequence
  Description of Artificial Sequence: Synthetic oligonucleotide
  Target: ATXN1; (-) strand; PAM type: NRG; PAM sequence: AAG
gcattttagtaatgcttact

SEQ ID NO: 57777 - DNA, 20 bp, Artificial Sequence
  Description of Artificial Sequence: Synthetic oligonucleotide
  Target: ATXN1; (-) strand; PAM type: NRG; PAM sequence: TAG
taagagtgtaactagcattt

SEQ ID NO: 57778 - DNA, 20 bp, Artificial Sequence
  Description of Artificial Sequence: Synthetic oligonucleotide
  Target: ATXN1; (-) strand; PAM type: NRG; PAM sequence: TAG
aaagcttctaagagtgtaac

SEQ ID NO: 57779 - DNA, 20 bp, Artificial Sequence
  Description of Artificial Sequence: Synthetic oligonucleotide
  Target: ATXN1; (-) strand; PAM type: NRG; PAM sequence: GAG
atcctatataaagcttctaa

SEQ ID NO: 57780 - DNA, 20 bp, Artificial Sequence
  Description of Artificial Sequence: Synthetic oligonucleotide
  Target: ATXN1; (-) strand; PAM type: NRG; PAM sequence: AAG
aaatcctatataaagcttct

SEQ ID NO: 57781 - DNA, 20 bp, Artificial Sequence
  Description of Artificial Sequence: Synthetic oligonucleotide
  Target: ATXN1; (-) strand; PAM type: NRG; PAM sequence: AAG
taaattagaaatcctatata

SEQ ID NO: 57782 - DNA, 20 bp, Artificial Sequence
  Description of Artificial Sequence: Synthetic oligonucleotide
  Target: ATXN1; (-) strand; PAM type: NRG; PAM sequence: TAG
agcttcaataaagattaaat

SEQ ID NO: 57783 - DNA, 20 bp, Artificial Sequence
  Description of Artificial Sequence: Synthetic oligonucleotide
  Target: ATXN1; (-) strand; PAM type: NRG; PAM sequence: AAG
aaaagctacaagcttcaata

SEQ ID NO: 57784 - DNA, 20 bp, Artificial Sequence
  Description of Artificial Sequence: Synthetic oligonucleotide
  Target: ATXN1; (-) strand; PAM type: NRG; PAM sequence: AAG
taaataagtttaaaagctac

SEQ ID NO: 57785 - DNA, 20 bp, Artificial Sequence
  Description of Artificial Sequence: Synthetic oligonucleotide
  Target: ATXN1; (-) strand; PAM type: NRG; PAM sequence: AAG
gggcttttaaataagtttaa

SEQ ID NO: 57786 - DNA, 20 bp, Artificial Sequence
  Description of Artificial Sequence: Synthetic oligonucleotide
  Target: ATXN1; (-) strand; PAM type: NRG; PAM sequence: AAG
aatctttggggcttttaaat

SEQ ID NO: 57787 - DNA, 20 bp, Artificial Sequence
  Description of Artificial Sequence: Synthetic oligonucleotide
  Target: ATXN1; (-) strand; PAM type: NRG; PAM sequence: GGG
gcccgttggtagaatctttg

SEQ ID NO: 57788 - DNA, 20 bp, Artificial Sequence
  Description of Artificial Sequence: Synthetic oligonucleotide
  Target: ATXN1; (-) strand; PAM type: NRG; PAM sequence: GGG
agcccgttggtagaatcttt

SEQ ID NO: 57789 - DNA, 20 bp, Artificial Sequence
  Description of Artificial Sequence: Synthetic oligonucleotide
  Target: ATXN1; (-) strand; PAM type: NRG; PAM sequence: TGG
aagcccgttggtagaatctt

SEQ ID NO: 57790 - DNA, 20 bp, Artificial Sequence
  Description of Artificial Sequence: Synthetic oligonucleotide
  Target: ATXN1; (-) strand; PAM type: NRG; PAM sequence: TAG
gatgctctgaagcccgttgg

SEQ ID NO: 57791 - DNA, 20 bp, Artificial Sequence
  Description of Artificial Sequence: Synthetic oligonucleotide
  Target: ATXN1; (-) strand; PAM type: NRG; PAM sequence: TGG
gcagatgctctgaagcccgt

SEQ ID NO: 57792 - DNA, 20 bp, Artificial Sequence
  Description of Artificial Sequence: Synthetic oligonucleotide
  Target: ATXN1; (-) strand; PAM type: NRG; PAM sequence: AAG
aataaaacgcagatgctctg

SEQ ID NO: 57793 - DNA, 20 bp, Artificial Sequence
  Description of Artificial Sequence: Synthetic oligonucleotide
  Target: ATXN1; (-) strand; PAM type: NRG; PAM sequence: CAG
ttcaatttaaaaataaaacg

SEQ ID NO: 57794 - DNA, 20 bp, Artificial Sequence
  Description of Artificial Sequence: Synthetic oligonucleotide
  Target: ATXN1; (-) strand; PAM type: NRG; PAM sequence: GAG
aactacagttacttaataat

SEQ ID NO: 57795 - DNA, 20 bp, Artificial Sequence
  Description of Artificial Sequence: Synthetic oligonucleotide
  Target: ATXN1; (-) strand; PAM type: NRG; PAM sequence: CAG
ggagagcttttctgaaacta

SEQ ID NO: 57796 - DNA, 20 bp, Artificial Sequence
  Description of Artificial Sequence: Synthetic oligonucleotide
  Target: ATXN1; (-) strand; PAM type: NRG; PAM sequence: GAG
tctactatatggcacatgga

SEQ ID NO: 57797 - DNA, 20 bp, Artificial Sequence
  Description of Artificial Sequence: Synthetic oligonucleotide
  Target: ATXN1; (-) strand; PAM type: NRG; PAM sequence: GAG
attctactatatggcacatg

SEQ ID NO: 57798 - DNA, 20 bp, Artificial Sequence
  Description of Artificial Sequence: Synthetic oligonucleotide
  Target: ATXN1; (-) strand; PAM type: NRG; PAM sequence: TGG
ttattctactatatggcaca

SEQ ID NO: 57799 - DNA, 20 bp, Artificial Sequence
  Description of Artificial Sequence: Synthetic oligonucleotide
  Target: ATXN1; (-) strand; PAM type: NRG; PAM sequence: TGG
ttaagtgttattctactata

SEQ ID NO: 57800 - DNA, 20 bp, Artificial Sequence
  Description of Artificial Sequence: Synthetic oligonucleotide
  Target: ATXN1; (-) strand; PAM type: NRG; PAM sequence: AAG
tagaccctagcccctgaatt

SEQ ID NO: 57801 - DNA, 20 bp, Artificial Sequence
  Description of Artificial Sequence: Synthetic oligonucleotide
  Target: ATXN1; (-) strand; PAM type: NRG; PAM sequence: TAG
tgggtgggaactttagaccc

SEQ ID NO: 57802 - DNA, 20 bp, Artificial Sequence
  Description of Artificial Sequence: Synthetic oligonucleotide
  Target: ATXN1; (-) strand; PAM type: NRG; PAM sequence: TAG
tctgcattgggtgggaactt

SEQ ID NO: 57803 - DNA, 20 bp, Artificial Sequence
  Description of Artificial Sequence: Synthetic oligonucleotide
  Target: ATXN1; (-) strand; PAM type: NRG; PAM sequence: GGG
ccacacactctgcattgggt

SEQ ID NO: 57804 - DNA, 20 bp, Artificial Sequence
  Description of Artificial Sequence: Synthetic oligonucleotide
  Target: ATXN1; (-) strand; PAM type: NRG; PAM sequence: TGG
cccacacactctgcattggg

SEQ ID NO: 57805 - DNA, 20 bp, Artificial Sequence
  Description of Artificial Sequence: Synthetic oligonucleotide
  Target: ATXN1; (-) strand; PAM type: NRG; PAM sequence: GGG
gaacccacacactctgcatt

SEQ ID NO: 57806 - DNA, 20 bp, Artificial Sequence
  Description of Artificial Sequence: Synthetic oligonucleotide
  Target: ATXN1; (-) strand; PAM type: NRG; PAM sequence: TGG
tgaacccacacactctgcat

SEQ ID NO: 57807 - DNA, 20 bp, Artificial Sequence
  Description of Artificial Sequence: Synthetic oligonucleotide
  Target: ATXN1; (-) strand; PAM type: NRG; PAM sequence: AGG
atttgcaccttacaatttca

SEQ ID NO: 57808 - DNA, 20 bp, Artificial Sequence
  Description of Artificial Sequence: Synthetic oligonucleotide
  Target: ATXN1; (-) strand; PAM type: NRG; PAM sequence: AAG
gatttgcaccttacaatttc

SEQ ID NO: 57809 - DNA, 20 bp, Artificial Sequence
  Description of Artificial Sequence: Synthetic oligonucleotide
  Target: ATXN1; (-) strand; PAM type: NRG; PAM sequence: AGG
ggtttgagtggaatggtatt

SEQ ID NO: 57810 - DNA, 20 bp, Artificial Sequence
  Description of Artificial Sequence: Synthetic oligonucleotide
  Target: ATXN1; (-) strand; PAM type: NRG; PAM sequence: TAG
aggtttgagtggaatggtat

SEQ ID NO: 57811 - DNA, 20 bp, Artificial Sequence
  Description of Artificial Sequence: Synthetic oligonucleotide
  Target: ATXN1; (-) strand; PAM type: NRG; PAM sequence: TGG
attgaaaggtttgagtggaa

SEQ ID NO: 57812 - DNA, 20 bp, Artificial Sequence
  Description of Artificial Sequence: Synthetic oligonucleotide
  Target: ATXN1; (-) strand; PAM type: NRG; PAM sequence: TGG
gaagcattgaaaggtttgag

SEQ ID NO: 57813 - DNA, 20 bp, Artificial Sequence
  Description of Artificial Sequence: Synthetic oligonucleotide
  Target: ATXN1; (-) strand; PAM type: NRG; PAM sequence: GAG
taggaagcattgaaaggttt

SEQ ID NO: 57814 - DNA, 20 bp, Artificial Sequence
  Description of Artificial Sequence: Synthetic oligonucleotide
  Target: ATXN1; (-) strand; PAM type: NRG; PAM sequence: AGG
atgtaataggaagcattgaa

SEQ ID NO: 57815 - DNA, 20 bp, Artificial Sequence
  Description of Artificial Sequence: Synthetic oligonucleotide
  Target: ATXN1; (-) strand; PAM type: NRG; PAM sequence: AAG
aatgtaataggaagcattga

SEQ ID NO: 57816 - DNA, 20 bp, Artificial Sequence
  Description of Artificial Sequence: Synthetic oligonucleotide
  Target: ATXN1; (-) strand; PAM type: NRG; PAM sequence: AAG
tttaccataaatgtaatagg

SEQ ID NO: 57817 - DNA, 20 bp, Artificial Sequence
  Description of Artificial Sequence: Synthetic oligonucleotide
  Target: ATXN1; (-) strand; PAM type: NRG; PAM sequence: AGG
gtttttaccataaatgtaat

SEQ ID NO: 57818 - DNA, 20 bp, Artificial Sequence
  Description of Artificial Sequence: Synthetic oligonucleotide
  Target: ATXN1; (-) strand; PAM type: NRG; PAM sequence: TAG
ggtttttaccataaatgtaa

SEQ ID NO: 57819 - DNA, 20 bp, Artificial Sequence
  Description of Artificial Sequence: Synthetic oligonucleotide
  Target: ATXN1; (-) strand; PAM type: NRG; PAM sequence: TGG
cttgacatggaccaggactg

SEQ ID NO: 57820 - DNA, 20 bp, Artificial Sequence
  Description of Artificial Sequence: Synthetic oligonucleotide
  Target: ATXN1; (-) strand; PAM type: NRG; PAM sequence: AGG
tctaagtcttgacatggacc

SEQ ID NO: 57821 - DNA, 20 bp, Artificial Sequence
  Description of Artificial Sequence: Synthetic oligonucleotide
  Target: ATXN1; (-) strand; PAM type: NRG; PAM sequence: CAG
ttctaagtcttgacatggac

SEQ ID NO: 57822 - DNA, 20 bp, Artificial Sequence
  Description of Artificial Sequence: Synthetic oligonucleotide
  Target: ATXN1; (-) strand; PAM type: NRG; PAM sequence: TGG
gggccttctaagtcttgaca

SEQ ID NO: 57823 - DNA, 20 bp, Artificial Sequence
  Description of Artificial Sequence: Synthetic oligonucleotide
  Target: ATXN1; (-) strand; PAM type: NRG; PAM sequence: AAG
cagatcatgtagggccttct

SEQ ID NO: 57824 - DNA, 20 bp, Artificial Sequence
  Description of Artificial Sequence: Synthetic oligonucleotide
  Target: ATXN1; (-) strand; PAM type: NRG; PAM sequence: GGG
agttggggtcagatcatgta

SEQ ID NO: 57825 - DNA, 20 bp, Artificial Sequence
  Description of Artificial Sequence: Synthetic oligonucleotide
  Target: ATXN1; (-) strand; PAM type: NRG; PAM sequence: AGG
tagttggggtcagatcatgt

SEQ ID NO: 57826 - DNA, 20 bp, Artificial Sequence
  Description of Artificial Sequence: Synthetic oligonucleotide
  Target: ATXN1; (-) strand; PAM type: NRG; PAM sequence: TAG
atagttggggtcagatcatg

SEQ ID NO: 57827 - DNA, 20 bp, Artificial Sequence
  Description of Artificial Sequence: Synthetic oligonucleotide
  Target: ATXN1; (-) strand; PAM type: NRG; PAM sequence: CAG
gggtttcacatagttggggt

SEQ ID NO: 57828 - DNA, 20 bp, Artificial Sequence
  Description of Artificial Sequence: Synthetic oligonucleotide
  Target: ATXN1; (-) strand; PAM type: NRG; PAM sequence: GGG
aggagggtttcacatagttg

SEQ ID NO: 57829 - DNA, 20 bp, Artificial Sequence
  Description of Artificial Sequence: Synthetic oligonucleotide
  Target: ATXN1; (-) strand; PAM type: NRG; PAM sequence: GGG
gaggagggtttcacatagtt

SEQ ID NO: 57830 - DNA, 20 bp, Artificial Sequence
  Description of Artificial Sequence: Synthetic oligonucleotide
  Target: ATXN1; (-) strand; PAM type: NRG; PAM sequence: TGG
ggaggagggtttcacatagt

SEQ ID NO: 57831 - DNA, 20 bp, Artificial Sequence
  Description of Artificial Sequence: Synthetic oligonucleotide
  Target: ATXN1; (-) strand; PAM type: NRG; PAM sequence: TAG
aagaggaggagggtttcaca

SEQ ID NO: 57832 - DNA, 20 bp, Artificial Sequence
  Description of Artificial Sequence: Synthetic oligonucleotide
  Target: ATXN1; (-) strand; PAM type: NRG; PAM sequence: GGG
ggcaggaaaaaagaggagga

SEQ ID NO: 57833 - DNA, 20 bp, Artificial Sequence
  Description of Artificial Sequence: Synthetic oligonucleotide
  Target: ATXN1; (-) strand; PAM type: NRG; PAM sequence: AGG
gggcaggaaaaaagaggagg

SEQ ID NO: 57834 - DNA, 20 bp, Artificial Sequence
  Description of Artificial Sequence: Synthetic oligonucleotide
  Target: ATXN1; (-) strand; PAM type: NRG; PAM sequence: GAG
tgggcaggaaaaaagaggag

SEQ ID NO: 57835 - DNA, 20 bp, Artificial Sequence
  Description of Artificial Sequence: Synthetic oligonucleotide
  Target: ATXN1; (-) strand; PAM type: NRG; PAM sequence: AGG
gatgggcaggaaaaaagagg

SEQ ID NO: 57836 - DNA, 20 bp, Artificial Sequence
  Description of Artificial Sequence: Synthetic oligonucleotide
  Target: ATXN1; (-) strand; PAM type: NRG; PAM sequence: GAG
agatgggcaggaaaaaagag

SEQ ID NO: 57837 - DNA, 20 bp, Artificial Sequence
  Description of Artificial Sequence: Synthetic oligonucleotide
  Target: ATXN1; (-) strand; PAM type: NRG; PAM sequence: AGG
ggagatgggcaggaaaaaag

SEQ ID NO: 57838 - DNA, 20 bp, Artificial Sequence
  Description of Artificial Sequence: Synthetic oligonucleotide
  Target: ATXN1; (-) strand; PAM type: NRG; PAM sequence: GAG
aggagatgggcaggaaaaaa

SEQ ID NO: 57839 - DNA, 20 bp, Artificial Sequence
  Description of Artificial Sequence: Synthetic oligonucleotide
  Target: ATXN1; (-) strand; PAM type: NRG; PAM sequence: AAG
ggaggagatgggcaggaaaa

SEQ ID NO: 57840 - DNA, 20 bp, Artificial Sequence
  Description of Artificial Sequence: Synthetic oligonucleotide
  Target: ATXN1; (-) strand; PAM type: NRG; PAM sequence: AGG
aacatagggaggagatgggc

SEQ ID NO: 57841 - DNA, 20 bp, Artificial Sequence
  Description of Artificial Sequence: Synthetic oligonucleotide
  Target: ATXN1; (-) strand; PAM type: NRG; PAM sequence: CAG
gaacatagggaggagatggg

SEQ ID NO: 57842 - DNA, 20 bp, Artificial Sequence
  Description of Artificial Sequence: Synthetic oligonucleotide
  Target: ATXN1; (-) strand; PAM type: NRG; PAM sequence: GGG
gcagaacatagggaggagat

SEQ ID NO: 57843 - DNA, 20 bp, Artificial Sequence
  Description of Artificial Sequence: Synthetic oligonucleotide
  Target: ATXN1; (-) strand; PAM type: NRG; PAM sequence: TGG
agcagaacatagggaggaga

SEQ ID NO: 57844 - DNA, 20 bp, Artificial Sequence
  Description of Artificial Sequence: Synthetic oligonucleotide
  Target: ATXN1; (-) strand; PAM type: NRG; PAM sequence: GAG
ctggagcagaacatagggag

SEQ ID NO: 57845 - DNA, 20 bp, Artificial Sequence
  Description of Artificial Sequence: Synthetic oligonucleotide
  Target: ATXN1; (-) strand; PAM type: NRG; PAM sequence: AGG
tgctggagcagaacataggg

SEQ ID NO: 57846 - DNA, 20 bp, Artificial Sequence
  Description of Artificial Sequence: Synthetic oligonucleotide
  Target: ATXN1; (-) strand; PAM type: NRG; PAM sequence: GAG
atgctggagcagaacatagg

SEQ ID NO: 57847 - DNA, 20 bp, Artificial Sequence
  Description of Artificial Sequence: Synthetic oligonucleotide
  Target: ATXN1; (-) strand; PAM type: NRG; PAM sequence: GGG
ctatgctggagcagaacata

SEQ ID NO: 57848 - DNA, 20 bp, Artificial Sequence
  Description of Artificial Sequence: Synthetic oligonucleotide
  Target: ATXN1; (-) strand; PAM type: NRG; PAM sequence: AGG
actatgctggagcagaacat

SEQ ID NO: 57849 - DNA, 20 bp, Artificial Sequence
  Description of Artificial Sequence: Synthetic oligonucleotide
  Target: ATXN1; (-) strand; PAM type: NRG; PAM sequence: TAG
cactatgctggagcagaaca

SEQ ID NO: 57850 - DNA, 20 bp, Artificial Sequence
  Description of Artificial Sequence: Synthetic oligonucleotide
  Target: ATXN1; (-) strand; PAM type: NRG; PAM sequence: CAG
tggaggccactatgctggag

SEQ ID NO: 57851 - DNA, 20 bp, Artificial Sequence
  Description of Artificial Sequence: Synthetic oligonucleotide
  Target: ATXN1; (-) strand; PAM type: NRG; PAM sequence: GAG
gtgtggaggccactatgctg

SEQ ID NO: 57852 - DNA, 20 bp, Artificial Sequence
  Description of Artificial Sequence: Synthetic oligonucleotide
  Target: ATXN1; (-) strand; PAM type: NRG; PAM sequence: TGG
gagtgtggaggccactatgc

SEQ ID NO: 57853 - DNA, 20 bp, Artificial Sequence
  Description of Artificial Sequence: Synthetic oligonucleotide
  Target: ATXN1; (-) strand; PAM type: NRG; PAM sequence: AGG
ggatgtggaagggagtgtgg

SEQ ID NO: 57854 - DNA, 20 bp, Artificial Sequence
  Description of Artificial Sequence: Synthetic oligonucleotide
  Target: ATXN1; (-) strand; PAM type: NRG; PAM sequence: GAG
tggatgtggaagggagtgtg

SEQ ID NO: 57855 - DNA, 20 bp, Artificial Sequence
  Description of Artificial Sequence: Synthetic oligonucleotide
  Target: ATXN1; (-) strand; PAM type: NRG; PAM sequence: TGG
cctggatgtggaagggagtg

SEQ ID NO: 57856 - DNA, 20 bp, Artificial Sequence
  Description of Artificial Sequence: Synthetic oligonucleotide
  Target: ATXN1; (-) strand; PAM type: NRG; PAM sequence: GAG
ttgtgcctggatgtggaagg

SEQ ID NO: 57857 - DNA, 20 bp, Artificial Sequence
  Description of Artificial Sequence: Synthetic oligonucleotide
  Target: ATXN1; (-) strand; PAM type: NRG; PAM sequence: GGG
gattgtgcctggatgtggaa

SEQ ID NO: 57858 - DNA, 20 bp, Artificial Sequence
  Description of Artificial Sequence: Synthetic oligonucleotide
  Target: ATXN1; (-) strand; PAM type: NRG; PAM sequence: AGG
ggattgtgcctggatgtgga

SEQ ID NO: 57859 - DNA, 20 bp, Artificial Sequence
  Description of Artificial Sequence: Synthetic oligonucleotide
  Target: ATXN1; (-) strand; PAM type: NRG; PAM sequence: AAG
aggattgtgcctggatgtgg

SEQ ID NO: 57860 - DNA, 20 bp, Artificial Sequence
  Description of Artificial Sequence: Synthetic oligonucleotide
  Target: ATXN1; (-) strand; PAM type: NRG; PAM sequence: TGG
accaggattgtgcctggatg

SEQ ID NO: 57861 - DNA, 20 bp, Artificial Sequence
  Description of Artificial Sequence: Synthetic oligonucleotide
  Target: ATXN1; (-) strand; PAM type: NRG; PAM sequence: TGG
ggtaggaccaggattgtgcc

SEQ ID NO: 57862 - DNA, 20 bp, Artificial Sequence
  Description of Artificial Sequence: Synthetic oligonucleotide
  Target: ATXN1; (-) strand; PAM type: NRG; PAM sequence: AGG
ggagcattctaggtaggacc

SEQ ID NO: 57863 - DNA, 20 bp, Artificial Sequence
  Description of Artificial Sequence: Synthetic oligonucleotide
  Target: ATXN1; (-) strand; PAM type: NRG; PAM sequence: CAG
aggagcattctaggtaggac

SEQ ID NO: 57864 - DNA, 20 bp, Artificial Sequence
  Description of Artificial Sequence: Synthetic oligonucleotide
  Target: ATXN1; (-) strand; PAM type: NRG; PAM sequence: AGG
gccagaggagcattctaggt

SEQ ID NO: 57865 - DNA, 20 bp, Artificial Sequence
  Description of Artificial Sequence: Synthetic oligonucleotide
  Target: ATXN1; (-) strand; PAM type: NRG; PAM sequence: TAG
tgccagaggagcattctagg

SEQ ID NO: 57866 - DNA, 20 bp, Artificial Sequence
  Description of Artificial Sequence: Synthetic oligonucleotide
  Target: ATXN1; (-) strand; PAM type: NRG; PAM sequence: AGG
atttgccagaggagcattct

SEQ ID NO: 57867 - DNA, 20 bp, Artificial Sequence
  Description of Artificial Sequence: Synthetic oligonucleotide
  Target: ATXN1; (-) strand; PAM type: NRG; PAM sequence: TAG
catttgccagaggagcattc

SEQ ID NO: 57868 - DNA, 20 bp, Artificial Sequence
  Description of Artificial Sequence: Synthetic oligonucleotide
  Target: ATXN1; (-) strand; PAM type: NRG; PAM sequence: GAG
agagaactcatttgccagag

SEQ ID NO: 57869 - DNA, 20 bp, Artificial Sequence
  Description of Artificial Sequence: Synthetic oligonucleotide
  Target: ATXN1; (-) strand; PAM type: NRG; PAM sequence: AGG
gaagagaactcatttgccag

SEQ ID NO: 57870 - DNA, 20 bp, Artificial Sequence
  Description of Artificial Sequence: Synthetic oligonucleotide
  Target: ATXN1; (-) strand; PAM type: NRG; PAM sequence: GAG
tgaagagaactcatttgcca

SEQ ID NO: 57871 - DNA, 20 bp, Artificial Sequence
  Description of Artificial Sequence: Synthetic oligonucleotide
  Target: ATXN1; (-) strand; PAM type: NRG; PAM sequence: CAG
aatgaagagaactcatttgc

SEQ ID NO: 57872 - DNA, 20 bp, Artificial Sequence
  Description of Artificial Sequence: Synthetic oligonucleotide
  Target: ATXN1; (-) strand; PAM type: NRG; PAM sequence: GAG
acagcagagacctgaatgaa

SEQ ID NO: 57873 - DNA, 20 bp, Artificial Sequence
  Description of Artificial Sequence: Synthetic oligonucleotide
  Target: ATXN1; (-) strand; PAM type: NRG; PAM sequence: AAG
tcacagcagagacctgaatg

SEQ ID NO: 57874 - DNA, 20 bp, Artificial Sequence
  Description of Artificial Sequence: Synthetic oligonucleotide
  Target: ATXN1; (-) strand; PAM type: NRG; PAM sequence: GAG
gggagggacacatcacagca

SEQ ID NO: 57875 - DNA, 20 bp, Artificial Sequence
  Description of Artificial Sequence: Synthetic oligonucleotide
  Target: ATXN1; (-) strand; PAM type: NRG; PAM sequence: CAG
cagggagggacacatcacag

SEQ ID NO: 57876 - DNA, 20 bp, Artificial Sequence
  Description of Artificial Sequence: Synthetic oligonucleotide
  Target: ATXN1; (-) strand; PAM type: NRG; PAM sequence: CAG
gaccagggagggacacatca

SEQ ID NO: 57877 - DNA, 20 bp, Artificial Sequence
  Description of Artificial Sequence: Synthetic oligonucleotide
  Target: ATXN1; (-) strand; PAM type: NRG; PAM sequence: GGG
ttagacaaggcgaccaggga

SEQ ID NO: 57878 - DNA, 20 bp, Artificial Sequence
  Description of Artificial Sequence: Synthetic oligonucleotide
  Target: ATXN1; (-) strand; PAM type: NRG; PAM sequence: AGG
tttagacaaggcgaccaggg

SEQ ID NO: 57879 - DNA, 20 bp, Artificial Sequence
  Description of Artificial Sequence: Synthetic oligonucleotide
  Target: ATXN1; (-) strand; PAM type: NRG; PAM sequence: GAG
ttttagacaaggcgaccagg

SEQ ID NO: 57880 - DNA, 20 bp, Artificial Sequence
  Description of Artificial Sequence: Synthetic oligonucleotide
  Target: ATXN1; (-) strand; PAM type: NRG; PAM sequence: GGG
tcttttagacaaggcgacca

SEQ ID NO: 57881 - DNA, 20 bp, Artificial Sequence
  Description of Artificial Sequence: Synthetic oligonucleotide
  Target: ATXN1; (-) strand; PAM type: NRG; PAM sequence: AGG
ctcttttagacaaggcgacc

SEQ ID NO: 57882 - DNA, 20 bp, Artificial Sequence
  Description of Artificial Sequence: Synthetic oligonucleotide
  Target: ATXN1; (-) strand; PAM type: NRG; PAM sequence: CAG
gctcttttagacaaggcgac

SEQ ID NO: 57883 - DNA, 20 bp, Artificial Sequence
  Description of Artificial Sequence: Synthetic oligonucleotide
  Target: ATXN1; (-) strand; PAM type: NRG; PAM sequence: AGG
ggggcctgctcttttagaca

SEQ ID NO: 57884 - DNA, 20 bp, Artificial Sequence
  Description of Artificial Sequence: Synthetic oligonucleotide
  Target: ATXN1; (-) strand; PAM type: NRG; PAM sequence: AAG
gggggcctgctcttttagac

SEQ ID NO: 57885 - DNA, 20 bp, Artificial Sequence
  Description of Artificial Sequence: Synthetic oligonucleotide
  Target: ATXN1; (-) strand; PAM type: NRG; PAM sequence: TAG
gaagagggggcctgctcttt

SEQ ID NO: 57886 - DNA, 20 bp, Artificial Sequence
  Description of Artificial Sequence: Synthetic oligonucleotide
  Target: ATXN1; (-) strand; PAM type: NRG; PAM sequence: GGG
cagaggggcgagggaagagg

SEQ ID NO: 57887 - DNA, 20 bp, Artificial Sequence
  Description of Artificial Sequence: Synthetic oligonucleotide
  Target: ATXN1; (-) strand; PAM type: NRG; PAM sequence: GGG
tcagaggggcgagggaagag

SEQ ID NO: 57888 - DNA, 20 bp, Artificial Sequence
  Description of Artificial Sequence: Synthetic oligonucleotide
  Target: ATXN1; (-) strand; PAM type: NRG; PAM sequence: GGG
atcagaggggcgagggaaga

SEQ ID NO: 57889 - DNA, 20 bp, Artificial Sequence
  Description of Artificial Sequence: Synthetic oligonucleotide
  Target: ATXN1; (-) strand; PAM type: NRG; PAM sequence: AGG
aatcagaggggcgagggaag

SEQ ID NO: 57890 - DNA, 20 bp, Artificial Sequence
  Description of Artificial Sequence: Synthetic oligonucleotide
  Target: ATXN1; (-) strand; PAM type: NRG; PAM sequence: GAG
gaatcagaggggcgagggaa

SEQ ID NO: 57891 - DNA, 20 bp, Artificial Sequence
  Description of Artificial Sequence: Synthetic oligonucleotide
  Target: ATXN1; (-) strand; PAM type: NRG; PAM sequence: AAG
aagaatcagaggggcgaggg

SEQ ID NO: 57892 - DNA, 20 bp, Artificial Sequence
  Description of Artificial Sequence: Synthetic oligonucleotide
  Target: ATXN1; (-) strand; PAM type: NRG; PAM sequence: GGG
gagaagaatcagaggggcga

SEQ ID NO: 57893 - DNA, 20 bp, Artificial Sequence
  Description of Artificial Sequence: Synthetic oligonucleotide
  Target: ATXN1; (-) strand; PAM type: NRG; PAM sequence: AGG
agagaagaatcagaggggcg

SEQ ID NO: 57894 - DNA, 20 bp, Artificial Sequence
  Description of Artificial Sequence: Synthetic oligonucleotide
  Target: ATXN1; (-) strand; PAM type: NRG; PAM sequence: GAG
aagagaagaatcagaggggc

SEQ ID NO: 57895 - DNA, 20 bp, Artificial Sequence
  Description of Artificial Sequence: Synthetic oligonucleotide
  Target: ATXN1; (-) strand; PAM type: NRG; PAM sequence: GGG
aatgaagagaagaatcagag

SEQ ID NO: 57896 - DNA, 20 bp, Artificial Sequence
  Description of Artificial Sequence: Synthetic oligonucleotide
  Target: ATXN1; (-) strand; PAM type: NRG; PAM sequence: GGG
gaatgaagagaagaatcaga

SEQ ID NO: 57897 - DNA, 20 bp, Artificial Sequence
  Description of Artificial Sequence: Synthetic oligonucleotide
  Target: ATXN1; (-) strand; PAM type: NRG; PAM sequence: AGG
tgaatgaagagaagaatcag

SEQ ID NO: 57898 - DNA, 20 bp, Artificial Sequence
  Description of Artificial Sequence: Synthetic oligonucleotide
  Target: ATXN1; (-) strand; PAM type: NRG; PAM sequence: GAG
atgaatgaagagaagaatca

SEQ ID NO: 57899 - DNA, 20 bp, Artificial Sequence
  Description of Artificial Sequence: Synthetic oligonucleotide
  Target: ATXN1; (-) strand; PAM type: NRG; PAM sequence: CAG
tgatgaatgaagagaagaat

SEQ ID NO: 57900 - DNA, 20 bp, Artificial Sequence
  Description of Artificial Sequence: Synthetic oligonucleotide
  Target: ATXN1; (-) strand; PAM type: NRG; PAM sequence: AAG
cagctgtgatgaatgaagag

SEQ ID NO: 57901 - DNA, 20 bp, Artificial Sequence
  Description of Artificial Sequence: Synthetic oligonucleotide
  Target: ATXN1; (-) strand; PAM type: NRG; PAM sequence: GAG
catcagctgtgatgaatgaa

SEQ ID NO: 57902 - DNA, 20 bp, Artificial Sequence
  Description of Artificial Sequence: Synthetic oligonucleotide
  Target: ATXN1; (-) strand; PAM type: NRG; PAM sequence: AAG
aacatcagctgtgatgaatg

SEQ ID NO: 57903 - DNA, 20 bp, Artificial Sequence
  Description of Artificial Sequence: Synthetic oligonucleotide
  Target: ATXN1; (-) strand; PAM type: NRG; PAM sequence: CAG
aggactttgtggtgtaacat

SEQ ID NO: 57904 - DNA, 20 bp, Artificial Sequence
  Description of Artificial Sequence: Synthetic oligonucleotide
  Target: ATXN1; (-) strand; PAM type: NRG; PAM sequence: TGG
acaaaccaacaaggactttg

SEQ ID NO: 57905 - DNA, 20 bp, Artificial Sequence
  Description of Artificial Sequence: Synthetic oligonucleotide
  Target: ATXN1; (-) strand; PAM type: NRG; PAM sequence: AGG
gcgcaggaaacaaaccaaca

SEQ ID NO: 57906 - DNA, 20 bp, Artificial Sequence
  Description of Artificial Sequence: Synthetic oligonucleotide
  Target: ATXN1; (-) strand; PAM type: NRG; PAM sequence: AAG
agcgcaggaaacaaaccaac

SEQ ID NO: 57907 - DNA, 20 bp, Artificial Sequence
  Description of Artificial Sequence: Synthetic oligonucleotide
  Target: ATXN1; (-) strand; PAM type: NRG; PAM sequence: AGG
aaggagcatcattctagcgc

SEQ ID NO: 57908 - DNA, 20 bp, Artificial Sequence
  Description of Artificial Sequence: Synthetic oligonucleotide
  Target: ATXN1; (-) strand; PAM type: NRG; PAM sequence: CAG
taaggagcatcattctagcg

SEQ ID NO: 57909 - DNA, 20 bp, Artificial Sequence
  Description of Artificial Sequence: Synthetic oligonucleotide
  Target: ATXN1; (-) strand; PAM type: NRG; PAM sequence: TAG
ataaataaggagcatcattc

SEQ ID NO: 57910 - DNA, 20 bp, Artificial Sequence
  Description of Artificial Sequence: Synthetic oligonucleotide
  Target: ATXN1; (-) strand; PAM type: NRG; PAM sequence: GAG
atcagtaatgaataaataag

SEQ ID NO: 57911 - DNA, 20 bp, Artificial Sequence
  Description of Artificial Sequence: Synthetic oligonucleotide
  Target: ATXN1; (-) strand; PAM type: NRG; PAM sequence: AGG
atatcagtaatgaataaata

SEQ ID NO: 57912 - DNA, 20 bp, Artificial Sequence
  Description of Artificial Sequence: Synthetic oligonucleotide
  Target: ATXN1; (-) strand; PAM type: NRG; PAM sequence: AAG
tatatcagtaatgaataaat

SEQ ID NO: 57913 - DNA, 20 bp, Artificial Sequence
  Description of Artificial Sequence: Synthetic oligonucleotide
  Target: ATXN1; (-) strand; PAM type: NRG; PAM sequence: CAG
tatgtacacctgtgatatat

SEQ ID NO: 57914 - DNA, 20 bp, Artificial Sequence
  Description of Artificial Sequence: Synthetic oligonucleotide
  Target: ATXN1; (-) strand; PAM type: NRG; PAM sequence: TAG
gagtaagttttaggattcaa

SEQ ID NO: 57915 - DNA, 20 bp, Artificial Sequence
  Description of Artificial Sequence: Synthetic oligonucleotide
  Target: ATXN1; (-) strand; PAM type: NRG; PAM sequence: AGG
aaatagaaggagtaagtttt

SEQ ID NO: 57916 - DNA, 20 bp, Artificial Sequence
  Description of Artificial Sequence: Synthetic oligonucleotide
  Target: ATXN1; (-) strand; PAM type: NRG; PAM sequence: TAG
taaatagaaggagtaagttt

SEQ ID NO: 57917 - DNA, 20 bp, Artificial Sequence
  Description of Artificial Sequence: Synthetic oligonucleotide
  Target: ATXN1; (-) strand; PAM type: NRG; PAM sequence: AAG
tacagttaaatagaaggagt

SEQ ID NO: 57918 - DNA, 20 bp, Artificial Sequence
  Description of Artificial Sequence: Synthetic oligonucleotide
  Target: ATXN1; (-) strand; PAM type: NRG; PAM sequence: GAG
aaaatacagttaaatagaag

SEQ ID NO: 57919 - DNA, 20 bp, Artificial Sequence
  Description of Artificial Sequence: Synthetic oligonucleotide
  Target: ATXN1; (-) strand; PAM type: NRG; PAM sequence: AGG
caaaaatacagttaaataga

SEQ ID NO: 57920 - DNA, 20 bp, Artificial Sequence
  Description of Artificial Sequence: Synthetic oligonucleotide
  Target: ATXN1; (-) strand; PAM type: NRG; PAM sequence: AAG
acaaaaatacagttaaatag

SEQ ID NO: 57921 - DNA, 20 bp, Artificial Sequence
  Description of Artificial Sequence: Synthetic oligonucleotide
  Target: ATXN1; (-) strand; PAM type: NRG; PAM sequence: TAG
gatacaaaaatacagttaaa

SEQ ID NO: 57922 - DNA, 20 bp, Artificial Sequence
  Description of Artificial Sequence: Synthetic oligonucleotide
  Target: ATXN1; (-) strand; PAM type: NRG; PAM sequence: CAG
taatgggtgatacaaaaata

SEQ ID NO: 57923 - DNA, 20 bp, Artificial Sequence
  Description of Artificial Sequence: Synthetic oligonucleotide
  Target: ATXN1; (-) strand; PAM type: NRG; PAM sequence: GGG
atgaagagaagtcagttaat

SEQ ID NO: 57924 - DNA, 20 bp, Artificial Sequence
  Description of Artificial Sequence: Synthetic oligonucleotide
  Target: ATXN1; (-) strand; PAM type: NRG; PAM sequence: TGG
gatgaagagaagtcagttaa

SEQ ID NO: 57925 - DNA, 20 bp, Artificial Sequence
  Description of Artificial Sequence: Synthetic oligonucleotide
  Target: ATXN1; (-) strand; PAM type: NRG; PAM sequence: CAG
gagcaaggatgaagagaagt

SEQ ID NO: 57926 - DNA, 20 bp, Artificial Sequence
  Description of Artificial Sequence: Synthetic oligonucleotide
  Target: ATXN1; (-) strand; PAM type: NRG; PAM sequence: AAG
gtttgagcaaggatgaagag

SEQ ID NO: 57927 - DNA, 20 bp, Artificial Sequence
  Description of Artificial Sequence: Synthetic oligonucleotide
  Target: ATXN1; (-) strand; PAM type: NRG; PAM sequence: GAG
gcagtttgagcaaggatgaa

SEQ ID NO: 57928 - DNA, 20 bp, Artificial Sequence
  Description of Artificial Sequence: Synthetic oligonucleotide
  Target: ATXN1; (-) strand; PAM type: NRG; PAM sequence: AAG
ctgcagtttgagcaaggatg

SEQ ID NO: 57929 - DNA, 20 bp, Artificial Sequence
  Description of Artificial Sequence: Synthetic oligonucleotide
  Target: ATXN1; (-) strand; PAM type: NRG; PAM sequence: AGG
taggtgctgcagtttgagca

SEQ ID NO: 57930 - DNA, 20 bp, Artificial Sequence
  Description of Artificial Sequence: Synthetic oligonucleotide
  Target: ATXN1; (-) strand; PAM type: NRG; PAM sequence: AAG
ataggtgctgcagtttgagc

SEQ ID NO: 57931 - DNA, 20 bp, Artificial Sequence
  Description of Artificial Sequence: Synthetic oligonucleotide
  Target: ATXN1; (-) strand; PAM type: NRG; PAM sequence: GAG
actcataggtgctgcagttt

SEQ ID NO: 57932 - DNA, 20 bp, Artificial Sequence
  Description of Artificial Sequence: Synthetic oligonucleotide
  Target: ATXN1; (-) strand; PAM type: NRG; PAM sequence: CAG
gctaagactcataggtgctg

SEQ ID NO: 57933 - DNA, 20 bp, Artificial Sequence
  Description of Artificial Sequence: Synthetic oligonucleotide
  Target: ATXN1; (-) strand; PAM type: NRG; PAM sequence: AGG
ttctctgtgctaagactcat

SEQ ID NO: 57934 - DNA, 20 bp, Artificial Sequence
  Description of Artificial Sequence: Synthetic oligonucleotide
  Target: ATXN1; (-) strand; PAM type: NRG; PAM sequence: TAG
cttctctgtgctaagactca

SEQ ID NO: 57935 - DNA, 20 bp, Artificial Sequence
  Description of Artificial Sequence: Synthetic oligonucleotide
  Target: ATXN1; (-) strand; PAM type: NRG; PAM sequence: AAG
cagagtgccttctctgtgct

SEQ ID NO: 57936 - DNA, 20 bp, Artificial Sequence
  Description of Artificial Sequence: Synthetic oligonucleotide
  Target: ATXN1; (-) strand; PAM type: NRG; PAM sequence: GAG
ttattgagccaatacttaca

SEQ ID NO: 57937 - DNA, 20 bp, Artificial Sequence
  Description of Artificial Sequence: Synthetic oligonucleotide
  Target: ATXN1; (-) strand; PAM type: NRG; PAM sequence: CAG
atttattgagccaatactta

SEQ ID NO: 57938 - DNA, 20 bp, Artificial Sequence
  Description of Artificial Sequence: Synthetic oligonucleotide
  Target: ATXN1; (-) strand; PAM type: NRG; PAM sequence: GAG
gtaagacacttttatttatt

SEQ ID NO: 57939 - DNA, 20 bp, Artificial Sequence
  Description of Artificial Sequence: Synthetic oligonucleotide
  Target: ATXN1; (-) strand; PAM type: NRG; PAM sequence: AAG
gtgtccttgttgggcaatgt

SEQ ID NO: 57940 - DNA, 20 bp, Artificial Sequence
  Description of Artificial Sequence: Synthetic oligonucleotide
  Target: ATXN1; (-) strand; PAM type: NRG; PAM sequence: GGG
ctgtatatagtgtccttgtt

SEQ ID NO: 57941 - DNA, 20 bp, Artificial Sequence
  Description of Artificial Sequence: Synthetic oligonucleotide
  Target: ATXN1; (-) strand; PAM type: NRG; PAM sequence: TGG
actgtatatagtgtccttgt

SEQ ID NO: 57942 - DNA, 20 bp, Artificial Sequence
  Description of Artificial Sequence: Synthetic oligonucleotide
  Target: ATXN1; (-) strand; PAM type: NRG; PAM sequence: TAG
gtataaacaaaaactgtata

SEQ ID NO: 57943 - DNA, 20 bp, Artificial Sequence
  Description of Artificial Sequence: Synthetic oligonucleotide
  Target: ATXN1; (-) strand; PAM type: NRG; PAM sequence: TGG
gtgagcattgttgcacaggg

SEQ ID NO: 57944 - DNA, 20 bp, Artificial Sequence
  Description of Artificial Sequence: Synthetic oligonucleotide
  Target: ATXN1; (-) strand; PAM type: NRG; PAM sequence: GGG
tatgtgagcattgttgcaca

SEQ ID NO: 57945 - DNA, 20 bp, Artificial Sequence
  Description of Artificial Sequence: Synthetic oligonucleotide
  Target: ATXN1; (-) strand; PAM type: NRG; PAM sequence: AGG
gtatgtgagcattgttgcac

SEQ ID NO: 57946 - DNA, 20 bp, Artificial Sequence
  Description of Artificial Sequence: Synthetic oligonucleotide
  Target: ATXN1; (-) strand; PAM type: NRG; PAM sequence: CAG
tgtatgtgagcattgttgca

SEQ ID NO: 57947 - DNA, 20 bp, Artificial Sequence
  Description of Artificial Sequence: Synthetic oligonucleotide
  Target: ATXN1; (-) strand; PAM type: NRG; PAM sequence: GAG
tttcaaattccactgtatgt

SEQ ID NO: 57948 - DNA, 20 bp, Artificial Sequence
  Description of Artificial Sequence: Synthetic oligonucleotide
  Target: ATXN1; (-) strand; PAM type: NRG; PAM sequence: TGG
tgggccttagcctagctcag

SEQ ID NO: 57949 - DNA, 20 bp, Artificial Sequence
  Description of Artificial Sequence: Synthetic oligonucleotide
  Target: ATXN1; (-) strand; PAM type: NRG; PAM sequence: CAG
tcttgggccttagcctagct

SEQ ID NO: 57950 - DNA, 20 bp, Artificial Sequence
  Description of Artificial Sequence: Synthetic oligonucleotide
  Target: ATXN1; (-) strand; PAM type: NRG; PAM sequence: TAG
tttcctcttgggccttagcc

SEQ ID NO: 57951 - DNA, 20 bp, Artificial Sequence
  Description of Artificial Sequence: Synthetic oligonucleotide
  Target: ATXN1; (-) strand; PAM type: NRG; PAM sequence: TAG
taggctttcctcttgggcct

SEQ ID NO: 57952 - DNA, 20 bp, Artificial Sequence
  Description of Artificial Sequence: Synthetic oligonucleotide
  Target: ATXN1; (-) strand; PAM type: NRG; PAM sequence: GGG
ctgatgtaggctttcctctt

SEQ ID NO: 57953 - DNA, 20 bp, Artificial Sequence
  Description of Artificial Sequence: Synthetic oligonucleotide
  Target: ATXN1; (-) strand; PAM type: NRG; PAM sequence: TGG
tctgatgtaggctttcctct

SEQ ID NO: 57954 - DNA, 20 bp, Artificial Sequence
  Description of Artificial Sequence: Synthetic oligonucleotide
  Target: ATXN1; (-) strand; PAM type: NRG; PAM sequence: AGG
tccagacacagatctgatgt

SEQ ID NO: 57955 - DNA, 20 bp, Artificial Sequence
  Description of Artificial Sequence: Synthetic oligonucleotide
  Target: ATXN1; (-) strand; PAM type: NRG; PAM sequence: TAG
gtccagacacagatctgatg

SEQ ID NO: 57956 - DNA, 20 bp, Artificial Sequence
  Description of Artificial Sequence: Synthetic oligonucleotide
  Target: ATXN1; (-) strand; PAM type: NRG; PAM sequence: CAG
gtggtgtggacgtccagaca

SEQ ID NO: 57957 - DNA, 20 bp, Artificial Sequence
  Description of Artificial Sequence: Synthetic oligonucleotide
  Target: ATXN1; (-) strand; PAM type: NRG; PAM sequence: CAG
ggtgcagtggtgtggacgtc

SEQ ID NO: 57958 - DNA, 20 bp, Artificial Sequence
  Description of Artificial Sequence: Synthetic oligonucleotide
  Target: ATXN1; (-) strand; PAM type: NRG; PAM sequence: TGG
acatcaaaggtgcagtggtg

SEQ ID NO: 57959 - DNA, 20 bp, Artificial Sequence
  Description of Artificial Sequence: Synthetic oligonucleotide
  Target: ATXN1; (-) strand; PAM type: NRG; PAM sequence: TGG
tagggacatcaaaggtgcag

SEQ ID NO: 57960 - DNA, 20 bp, Artificial Sequence
  Description of Artificial Sequence: Synthetic oligonucleotide
  Target: ATXN1; (-) strand; PAM type: NRG; PAM sequence: CAG
tgctagggacatcaaaggtg

SEQ ID NO: 57961 - DNA, 20 bp, Artificial Sequence
  Description of Artificial Sequence: Synthetic oligonucleotide
  Target: ATXN1; (-) strand; PAM type: NRG; PAM sequence: AGG
atctctgctagggacatcaa

SEQ ID NO: 57962 - DNA, 20 bp, Artificial Sequence
  Description of Artificial Sequence: Synthetic oligonucleotide
  Target: ATXN1; (-) strand; PAM type: NRG; PAM sequence: AAG
gatctctgctagggacatca

SEQ ID NO: 57963 - DNA, 20 bp, Artificial Sequence
  Description of Artificial Sequence: Synthetic oligonucleotide
  Target: ATXN1; (-) strand; PAM type: NRG; PAM sequence: GGG
aaaaagcttgatctctgcta

SEQ ID NO: 57964 - DNA, 20 bp, Artificial Sequence
  Description of Artificial Sequence: Synthetic oligonucleotide
  Target: ATXN1; (-) strand; PAM type: NRG; PAM sequence: AGG
aaaaaagcttgatctctgct

SEQ ID NO: 57965 - DNA, 20 bp, Artificial Sequence
  Description of Artificial Sequence: Synthetic oligonucleotide
  Target: ATXN1; (-) strand; PAM type: NRG; PAM sequence: TAG
caaaaaagcttgatctctgc

SEQ ID NO: 57966 - DNA, 20 bp, Artificial Sequence
  Description of Artificial Sequence: Synthetic oligonucleotide
  Target: ATXN1; (-) strand; PAM type: NRG; PAM sequence: AAG
aacccttcatgcaagcaaaa

SEQ ID NO: 57967 - DNA, 20 bp, Artificial Sequence
  Description of Artificial Sequence: Synthetic oligonucleotide
  Target: ATXN1; (-) strand; PAM type: NRG; PAM sequence: AAG
gttaagaaaacccttcatgc

SEQ ID NO: 57968 - DNA, 20 bp, Artificial Sequence
  Description of Artificial Sequence: Synthetic oligonucleotide
  Target: ATXN1; (-) strand; PAM type: NRG; PAM sequence: AAG
cttactaacaaaatggagtt

SEQ ID NO: 57969 - DNA, 20 bp, Artificial Sequence
  Description of Artificial Sequence: Synthetic oligonucleotide
  Target: ATXN1; (-) strand; PAM type: NRG; PAM sequence: GAG
agagccttactaacaaaatg

SEQ ID NO: 57970 - DNA, 20 bp, Artificial Sequence
  Description of Artificial Sequence: Synthetic oligonucleotide
  Target: ATXN1; (-) strand; PAM type: NRG; PAM sequence: TGG
gtagagccttactaacaaaa

SEQ ID NO: 57971 - DNA, 20 bp, Artificial Sequence
  Description of Artificial Sequence: Synthetic oligonucleotide
  Target: ATXN1; (-) strand; PAM type: NRG; PAM sequence: GAG
tggcaaatcttgaagatgta

SEQ ID NO: 57972 - DNA, 20 bp, Artificial Sequence
  Description of Artificial Sequence: Synthetic oligonucleotide
  Target: ATXN1; (-) strand; PAM type: NRG; PAM sequence: TAG
gttggcaaatcttgaagatg

SEQ ID NO: 57973 - DNA, 20 bp, Artificial Sequence
  Description of Artificial Sequence: Synthetic oligonucleotide
  Target: ATXN1; (-) strand; PAM type: NRG; PAM sequence: AAG
aaatcagttggcaaatcttg

SEQ ID NO: 57974 - DNA, 20 bp, Artificial Sequence
  Description of Artificial Sequence: Synthetic oligonucleotide
  Target: ATXN1; (-) strand; PAM type: NRG; PAM sequence: TGG
acagcaacaaataaatcagt

SEQ ID NO: 57975 - DNA, 20 bp, Artificial Sequence
  Description of Artificial Sequence: Synthetic oligonucleotide
  Target: ATXN1; (-) strand; PAM type: NRG; PAM sequence: CAG
aacaacagcaacaaataaat

SEQ ID NO: 57976 - DNA, 20 bp, Artificial Sequence
  Description of Artificial Sequence: Synthetic oligonucleotide
  Target: ATXN1; (-) strand; PAM type: NRG; PAM sequence: CAG
ccctttaaccctcacaacaa

SEQ ID NO: 57977 - DNA, 20 bp, Artificial Sequence
  Description of Artificial Sequence: Synthetic oligonucleotide
  Target: ATXN1; (-) strand; PAM type: NRG; PAM sequence: AAG
aactaagaatctaacttcag

SEQ ID NO: 57978 - DNA, 20 bp, Artificial Sequence
  Description of Artificial Sequence: Synthetic oligonucleotide
  Target: ATXN1; (-) strand; PAM type: NRG; PAM sequence: CAG
ggtaactaagaatctaactt

SEQ ID NO: 57979 - DNA, 20 bp, Artificial Sequence
  Description of Artificial Sequence: Synthetic oligonucleotide
  Target: ATXN1; (-) strand; PAM type: NRG; PAM sequence: AAG
atttgattaacggggtaact

SEQ ID NO: 57980 - DNA, 20 bp, Artificial Sequence
  Description of Artificial Sequence: Synthetic oligonucleotide
  Target: ATXN1; (-) strand; PAM type: NRG; PAM sequence: GGG
gaagttacatttgattaacg

SEQ ID NO: 57981 - DNA, 20 bp, Artificial Sequence
  Description of Artificial Sequence: Synthetic oligonucleotide
  Target: ATXN1; (-) strand; PAM type: NRG; PAM sequence: GGG
ggaagttacatttgattaac

SEQ ID NO: 57982 - DNA, 20 bp, Artificial Sequence
  Description of Artificial Sequence: Synthetic oligonucleotide
  Target: ATXN1; (-) strand; PAM type: NRG; PAM sequence: CGG
tggaagttacatttgattaa

SEQ ID NO: 57983 - DNA, 20 bp, Artificial Sequence
  Description of Artificial Sequence: Synthetic oligonucleotide
  Target: ATXN1; (-) strand; PAM type: NRG; PAM sequence: AAG
ttgtggcaatgccaggatgg

SEQ ID NO: 57984 - DNA, 20 bp, Artificial Sequence
  Description of Artificial Sequence: Synthetic oligonucleotide
  Target: ATXN1; (-) strand; PAM type: NRG; PAM sequence: TGG
tagttgtggcaatgccagga

SEQ ID NO: 57985 - DNA, 20 bp, Artificial Sequence
  Description of Artificial Sequence: Synthetic oligonucleotide
  Target: ATXN1; (-) strand; PAM type: NRG; PAM sequence: AGG
ttagtagttgtggcaatgcc

SEQ ID NO: 57986 - DNA, 20 bp, Artificial Sequence
  Description of Artificial Sequence: Synthetic oligonucleotide
  Target: ATXN1; (-) strand; PAM type: NRG; PAM sequence: CAG
attagtagttgtggcaatgc

SEQ ID NO: 57987 - DNA, 20 bp, Artificial Sequence
  Description of Artificial Sequence: Synthetic oligonucleotide
  Target: ATXN1; (-) strand; PAM type: NRG; PAM sequence: TGG
gtctggcccattagtagttg

SEQ ID NO: 57988 - DNA, 20 bp, Artificial Sequence
  Description of Artificial Sequence: Synthetic oligonucleotide
  Target: ATXN1; (-) strand; PAM type: NRG; PAM sequence: TAG
agtatggtctggcccattag

SEQ ID NO: 57989 - DNA, 20 bp, Artificial Sequence
  Description of Artificial Sequence: Synthetic oligonucleotide
  Target: ATXN1; (-) strand; PAM type: NRG; PAM sequence: TAG
ggcagtatggtctggcccat

SEQ ID NO: 57990 - DNA, 20 bp, Artificial Sequence
  Description of Artificial Sequence: Synthetic oligonucleotide
  Target: ATXN1; (-) strand; PAM type: NRG; PAM sequence: TGG
acaagcctggcagtatggtc

SEQ ID NO: 57991 - DNA, 20 bp, Artificial Sequence
  Description of Artificial Sequence: Synthetic oligonucleotide
  Target: ATXN1; (-) strand; PAM type: NRG; PAM sequence: TGG
tctacacaagcctggcagta

SEQ ID NO: 57992 - DNA, 20 bp, Artificial Sequence
  Description of Artificial Sequence: Synthetic oligonucleotide
  Target: ATXN1; (-) strand; PAM type: NRG; PAM sequence: CAG
tgagatctacacaagcctgg

SEQ ID NO: 57993 - DNA, 20 bp, Artificial Sequence
  Description of Artificial Sequence: Synthetic oligonucleotide
  Target: ATXN1; (-) strand; PAM type: NRG; PAM sequence: TGG
ttttgagatctacacaagcc

SEQ ID NO: 57994 - DNA, 20 bp, Artificial Sequence
  Description of Artificial Sequence: Synthetic oligonucleotide
  Target: ATXN1; (-) strand; PAM type: NRG; PAM sequence: AAG
ctttattttgagatctacac

SEQ ID NO: 57995 - DNA, 20 bp, Artificial Sequence
  Description of Artificial Sequence: Synthetic oligonucleotide
  Target: ATXN1; (-) strand; PAM type: NRG; PAM sequence: GAG
tgacgggatacctttatttt

SEQ ID NO: 57996 - DNA, 20 bp, Artificial Sequence
  Description of Artificial Sequence: Synthetic oligonucleotide
  Target: ATXN1; (-) strand; PAM type: NRG; PAM sequence: GGG
caggatgtcactgagatgac

SEQ ID NO: 57997 - DNA, 20 bp, Artificial Sequence
  Description of Artificial Sequence: Synthetic oligonucleotide
  Target: ATXN1; (-) strand; PAM type: NRG; PAM sequence: CGG
acaggatgtcactgagatga

SEQ ID NO: 57998 - DNA, 20 bp, Artificial Sequence
  Description of Artificial Sequence: Synthetic oligonucleotide
  Target: ATXN1; (-) strand; PAM type: NRG; PAM sequence: GAG
ctgagaaacaggatgtcact

SEQ ID NO: 57999 - DNA, 20 bp, Artificial Sequence
  Description of Artificial Sequence: Synthetic oligonucleotide
  Target: ATXN1; (-) strand; PAM type: NRG; PAM sequence: AGG
aacctttctacctgagaaac

SEQ ID NO: 58000 - DNA, 20 bp, Artificial Sequence
  Description of Artificial Sequence: Synthetic oligonucleotide
  Target: ATXN1; (-) strand; PAM type: NRG; PAM sequence: CAG
caacctttctacctgagaaa

SEQ ID NO: 58001 - DNA, 20 bp, Artificial Sequence
  Description of Artificial Sequence: Synthetic oligonucleotide
  Target: ATXN1; (-) strand; PAM type: NRG; PAM sequence: GAG
gcgctacaacctttctacct

SEQ ID NO: 58002 - DNA, 20 bp, Artificial Sequence
  Description of Artificial Sequence: Synthetic oligonucleotide
  Target: ATXN1; (-) strand; PAM type: NRG; PAM sequence: TAG
atgtttaaaaaaagcaatgg

SEQ ID NO: 58003 - DNA, 20 bp, Artificial Sequence
  Description of Artificial Sequence: Synthetic oligonucleotide
  Target: ATXN1; (-) strand; PAM type: NRG; PAM sequence: TGG
tatatgtttaaaaaaagcaa

SEQ ID NO: 58004 - DNA, 20 bp, Artificial Sequence
  Description of Artificial Sequence: Synthetic oligonucleotide
  Target: ATXN1; (-) strand; PAM type: NRG; PAM sequence: AAG
taagtttatatgtttaaaaa

SEQ ID NO: 58005 - DNA, 20 bp, Artificial Sequence
  Description of Artificial Sequence: Synthetic oligonucleotide
  Target: ATXN1; (-) strand; PAM type: NRG; PAM sequence: AAG
agtggacgtagggagaactt

SEQ ID NO: 58006 - DNA, 20 bp, Artificial Sequence
  Description of Artificial Sequence: Synthetic oligonucleotide
  Target: ATXN1; (-) strand; PAM type: NRG; PAM sequence: GAG
ttcatgcaagtggacgtagg

SEQ ID NO: 58007 - DNA, 20 bp, Artificial Sequence
  Description of Artificial Sequence: Synthetic oligonucleotide
  Target: ATXN1; (-) strand; PAM type: NRG; PAM sequence: GGG
atttcatgcaagtggacgta

SEQ ID NO: 58008 - DNA, 20 bp, Artificial Sequence
  Description of Artificial Sequence: Synthetic oligonucleotide
  Target: ATXN1; (-) strand; PAM type: NRG; PAM sequence: AGG
aatttcatgcaagtggacgt

SEQ ID NO: 58009 - DNA, 20 bp, Artificial Sequence
  Description of Artificial Sequence: Synthetic oligonucleotide
  Target: ATXN1; (-) strand; PAM type: NRG; PAM sequence: TAG
aaatttcatgcaagtggacg

SEQ ID NO: 58010 - DNA, 20 bp, Artificial Sequence
  Description of Artificial Sequence: Synthetic oligonucleotide
  Target: ATXN1; (-) strand; PAM type: NRG; PAM sequence: TGG
cttgtgaaatttcatgcaag

SEQ ID NO: 58011 - DNA, 20 bp, Artificial Sequence
  Description of Artificial Sequence: Synthetic oligonucleotide
  Target: ATXN1; (-) strand; PAM type: NRG; PAM sequence: AAG
tcacttgtgaaatttcatgc

SEQ ID NO: 58012 - DNA, 20 bp, Artificial Sequence
  Description of Artificial Sequence: Synthetic oligonucleotide
  Target: ATXN1; (-) strand; PAM type: NRG; PAM sequence: GGG
gatacactcatgctgtacta

SEQ ID NO: 58013 - DNA, 20 bp, Artificial Sequence
  Description of Artificial Sequence: Synthetic oligonucleotide
  Target: ATXN1; (-) strand; PAM type: NRG; PAM sequence: AGG
tgatacactcatgctgtact

SEQ ID NO: 58014 - DNA, 20 bp, Artificial Sequence
  Description of Artificial Sequence: Synthetic oligonucleotide
  Target: ATXN1; (-) strand; PAM type: NRG; PAM sequence: TAG
atgatacactcatgctgtac

SEQ ID NO: 58015 - DNA, 20 bp, Artificial Sequence
  Description of Artificial Sequence: Synthetic oligonucleotide
  Target: ATXN1; (-) strand; PAM type: NRG; PAM sequence: TGG
cagggtgttttgtctggtct

SEQ ID NO: 58016 - DNA, 20 bp, Artificial Sequence
  Description of Artificial Sequence: Synthetic oligonucleotide
  Target: ATXN1; (-) strand; PAM type: NRG; PAM sequence: TGG
agaactcagggtgttttgtc

SEQ ID NO: 58017 - DNA, 20 bp, Artificial Sequence
  Description of Artificial Sequence: Synthetic oligonucleotide
  Target: ATXN1; (-) strand; PAM type: NRG; PAM sequence: GGG
tcactgaggacaagaactca

SEQ ID NO: 58018 - DNA, 20 bp, Artificial Sequence
  Description of Artificial Sequence: Synthetic oligonucleotide
  Target: ATXN1; (-) strand; PAM type: NRG; PAM sequence: AGG
ttcactgaggacaagaactc

SEQ ID NO: 58019 - DNA, 20 bp, Artificial Sequence
  Description of Artificial Sequence: Synthetic oligonucleotide
  Target: ATXN1; (-) strand; PAM type: NRG; PAM sequence: CAG
attcactgaggacaagaact

SEQ ID NO: 58020 - DNA, 20 bp, Artificial Sequence
  Description of Artificial Sequence: Synthetic oligonucleotide
  Target: ATXN1; (-) strand; PAM type: NRG; PAM sequence: AAG
taccaaaattcactgaggac

SEQ ID NO: 58021 - DNA, 20 bp, Artificial Sequence
  Description of Artificial Sequence: Synthetic oligonucleotide
  Target: ATXN1; (-) strand; PAM type: NRG; PAM sequence: AGG
ttacataccaaaattcactg

SEQ ID NO: 58022 - DNA, 20 bp, Artificial Sequence
  Description of Artificial Sequence: Synthetic oligonucleotide
  Target: ATXN1; (-) strand; PAM type: NRG; PAM sequence: GAG
attacataccaaaattcact

SEQ ID NO: 58023 - DNA, 20 bp, Artificial Sequence
  Description of Artificial Sequence: Synthetic oligonucleotide
  Target: ATXN1; (-) strand; PAM type: NRG; PAM sequence: CAG
cataagcatggtatgtctga

SEQ ID NO: 58024 - DNA, 20 bp, Artificial Sequence
  Description of Artificial Sequence: Synthetic oligonucleotide
  Target: ATXN1; (-) strand; PAM type: NRG; PAM sequence: TGG
gacattggctaccataagca

SEQ ID NO: 58025 - DNA, 20 bp, Artificial Sequence
  Description of Artificial Sequence: Synthetic oligonucleotide
  Target: ATXN1; (-) strand; PAM type: NRG; PAM sequence: AAG
tctctgacattggctaccat

SEQ ID NO: 58026 - DNA, 20 bp, Artificial Sequence
  Description of Artificial Sequence: Synthetic oligonucleotide
  Target: ATXN1; (-) strand; PAM type: NRG; PAM sequence: TGG
ttagatttaatctctgacat

SEQ ID NO: 58027 - DNA, 20 bp, Artificial Sequence
  Description of Artificial Sequence: Synthetic oligonucleotide
  Target: ATXN1; (-) strand; PAM type: NRG; PAM sequence: TAG
gtgggtccaatcttgaactt

SEQ ID NO: 58028 - DNA, 20 bp, Artificial Sequence
  Description of Artificial Sequence: Synthetic oligonucleotide
  Target: ATXN1; (-) strand; PAM type: NRG; PAM sequence: GGG
ttgtctttgctttgcatggt

SEQ ID NO: 58029 - DNA, 20 bp, Artificial Sequence
  Description of Artificial Sequence: Synthetic oligonucleotide
  Target: ATXN1; (-) strand; PAM type: NRG; PAM sequence: TGG
attgtctttgctttgcatgg

SEQ ID NO: 58030 - DNA, 20 bp, Artificial Sequence
  Description of Artificial Sequence: Synthetic oligonucleotide
  Target: ATXN1; (-) strand; PAM type: NRG; PAM sequence: TGG
gaaattgtctttgctttgca

SEQ ID NO: 58031 - DNA, 20 bp, Artificial Sequence
  Description of Artificial Sequence: Synthetic oligonucleotide
  Target: ATXN1; (-) strand; PAM type: NRG; PAM sequence: AAG
tctctttcaattttagaagg

SEQ ID NO: 58032 - DNA, 20 bp, Artificial Sequence
  Description of Artificial Sequence: Synthetic oligonucleotide
  Target: ATXN1; (-) strand; PAM type: NRG; PAM sequence: AGG
tcatctctttcaattttaga

SEQ ID NO: 58033 - DNA, 20 bp, Artificial Sequence
  Description of Artificial Sequence: Synthetic oligonucleotide
  Target: ATXN1; (-) strand; PAM type: NRG; PAM sequence: AAG
ctcatctctttcaattttag

SEQ ID NO: 58034 - DNA, 20 bp, Artificial Sequence
  Description of Artificial Sequence: Synthetic oligonucleotide
  Target: ATXN1; (-) strand; PAM type: NRG; PAM sequence: TAG
gggctcatctctttcaattt

SEQ ID NO: 58035 - DNA, 20 bp, Artificial Sequence
  Description of Artificial Sequence: Synthetic oligonucleotide
  Target: ATXN1; (-) strand; PAM type: NRG; PAM sequence: GGG
aaactcataagcctgaggga

SEQ ID NO: 58036 - DNA, 20 bp, Artificial Sequence
  Description of Artificial Sequence: Synthetic oligonucleotide
  Target: ATXN1; (-) strand; PAM type: NRG; PAM sequence: AGG
gaaactcataagcctgaggg

SEQ ID NO: 58037 - DNA, 20 bp, Artificial Sequence
  Description of Artificial Sequence: Synthetic oligonucleotide
  Target: ATXN1; (-) strand; PAM type: NRG; PAM sequence: GAG
agaaactcataagcctgagg

SEQ ID NO: 58038 - DNA, 20 bp, Artificial Sequence
  Description of Artificial Sequence: Synthetic oligonucleotide
  Target: ATXN1; (-) strand; PAM type: NRG; PAM sequence: GGG
gaagaaactcataagcctga

SEQ ID NO: 58039 - DNA, 20 bp, Artificial Sequence
  Description of Artificial Sequence: Synthetic oligonucleotide
  Target: ATXN1; (-) strand; PAM type: NRG; PAM sequence: AGG
agaagaaactcataagcctg

SEQ ID NO: 58040 - DNA, 20 bp, Artificial Sequence
  Description of Artificial Sequence: Synthetic oligonucleotide
  Target: ATXN1; (-) strand; PAM type: NRG; PAM sequence: GAG
aagaagaaactcataagcct

SEQ ID NO: 58041 - DNA, 20 bp, Artificial Sequence
  Description of Artificial Sequence: Synthetic oligonucleotide
  Target: ATXN1; (-) strand; PAM type: NRG; PAM sequence: AAG
aagaagaagaagaaactcat

SEQ ID NO: 58042 - DNA, 20 bp, Artificial Sequence
  Description of Artificial Sequence: Synthetic oligonucleotide
  Target: ATXN1; (-) strand; PAM type: NRG; PAM sequence: AAG
acttaaaaaacaagaagaag

SEQ ID NO: 58043 - DNA, 20 bp, Artificial Sequence
  Description of Artificial Sequence: Synthetic oligonucleotide
  Target: ATXN1; (-) strand; PAM type: NRG; PAM sequence: AAG
tgtacttaaaaaacaagaag

SEQ ID NO: 58044 - DNA, 20 bp, Artificial Sequence
  Description of Artificial Sequence: Synthetic oligonucleotide
  Target: ATXN1; (-) strand; PAM type: NRG; PAM sequence: AAG
tgatgtacttaaaaaacaag

SEQ ID NO: 58045 - DNA, 20 bp, Artificial Sequence
  Description of Artificial Sequence: Synthetic oligonucleotide
  Target: ATXN1; (-) strand; PAM type: NRG; PAM sequence: AAG
cattgatgtacttaaaaaac

SEQ ID NO: 58046 - DNA, 20 bp, Artificial Sequence
  Description of Artificial Sequence: Synthetic oligonucleotide
  Target: ATXN1; (-) strand; PAM type: NRG; PAM sequence: GAG
ttttaaattataacattaat

SEQ ID NO: 58047 - DNA, 20 bp, Artificial Sequence
  Description of Artificial Sequence: Synthetic oligonucleotide
  Target: ATXN1; (-) strand; PAM type: NRG; PAM sequence: GAG
cctaaatcttccattagagg

SEQ ID NO: 58048 - DNA, 20 bp, Artificial Sequence
  Description of Artificial Sequence: Synthetic oligonucleotide
  Target: ATXN1; (-) strand; PAM type: NRG; PAM sequence: GGG
agcctaaatcttccattaga

SEQ ID NO: 58049 - DNA, 20 bp, Artificial Sequence
  Description of Artificial Sequence: Synthetic oligonucleotide
  Target: ATXN1; (-) strand; PAM type: NRG; PAM sequence: AGG
tagcctaaatcttccattag

SEQ ID NO: 58050 - DNA, 20 bp, Artificial Sequence
  Description of Artificial Sequence: Synthetic oligonucleotide
  Target: ATXN1; (-) strand; PAM type: NRG; PAM sequence: GAG
ctagcctaaatcttccatta

SEQ ID NO: 58051 - DNA, 20 bp, Artificial Sequence
  Description of Artificial Sequence: Synthetic oligonucleotide
  Target: ATXN1; (-) strand; PAM type: NRG; PAM sequence: TAG
ctctagcctaaatcttccat

SEQ ID NO: 58052 - DNA, 20 bp, Artificial Sequence
  Description of Artificial Sequence: Synthetic oligonucleotide
  Target: ATXN1; (-) strand; PAM type: NRG; PAM sequence: TAG
ggaccaatgatagcttcctc

SEQ ID NO: 58053 - DNA, 20 bp, Artificial Sequence
  Description of Artificial Sequence: Synthetic oligonucleotide
  Target: ATXN1; (-) strand; PAM type: NRG; PAM sequence: TAG
gcgatttggaggaccaatga

SEQ ID NO: 58054 - DNA, 20 bp, Artificial Sequence
  Description of Artificial Sequence: Synthetic oligonucleotide
  Target: ATXN1; (-) strand; PAM type: NRG; PAM sequence: AGG
ttggtaagcctgcgatttgg

SEQ ID NO: 58055 - DNA, 20 bp, Artificial Sequence
  Description of Artificial Sequence: Synthetic oligonucleotide
  Target: ATXN1; (-) strand; PAM type: NRG; PAM sequence: GAG
attggtaagcctgcgatttg

SEQ ID NO: 58056 - DNA, 20 bp, Artificial Sequence
  Description of Artificial Sequence: Synthetic oligonucleotide
  Target: ATXN1; (-) strand; PAM type: NRG; PAM sequence: TGG
taattggtaagcctgcgatt

SEQ ID NO: 58057 - DNA, 20 bp, Artificial Sequence
  Description of Artificial Sequence: Synthetic oligonucleotide
  Target: ATXN1; (-) strand; PAM type: NRG; PAM sequence: AAG
atttacattttttaattggt

SEQ ID NO: 58058 - DNA, 20 bp, Artificial Sequence
  Description of Artificial Sequence: Synthetic oligonucleotide
  Target: ATXN1; (-) strand; PAM type: NRG; PAM sequence: TGG
aaccatttacattttttaat

SEQ ID NO: 58059 - DNA, 20 bp, Artificial Sequence
  Description of Artificial Sequence: Synthetic oligonucleotide
  Target: ATXN1; (-) strand; PAM type: NRG; PAM sequence: AAG
aaaagaaatggcttctttca

SEQ ID NO: 58060 - DNA, 20 bp, Artificial Sequence
  Description of Artificial Sequence: Synthetic oligonucleotide
  Target: ATXN1; (-) strand; PAM type: NRG; PAM sequence: TGG
aacaaaaggaagaaaagaaa

SEQ ID NO: 58061 - DNA, 20 bp, Artificial Sequence
  Description of Artificial Sequence: Synthetic oligonucleotide
  Target: ATXN1; (-) strand; PAM type: NRG; PAM sequence: AAG
acttaaaacaaaaggaagaa

SEQ ID NO: 58062 - DNA, 20 bp, Artificial Sequence
  Description of Artificial Sequence: Synthetic oligonucleotide
  Target: ATXN1; (-) strand; PAM type: NRG; PAM sequence: AAG
tgttcacttaaaacaaaagg

SEQ ID NO: 58063 - DNA, 20 bp, Artificial Sequence
  Description of Artificial Sequence: Synthetic oligonucleotide
  Target: ATXN1; (-) strand; PAM type: NRG; PAM sequence: AGG
acgtgttcacttaaaacaaa

SEQ ID NO: 58064 - DNA, 20 bp, Artificial Sequence
  Description of Artificial Sequence: Synthetic oligonucleotide
  Target: ATXN1; (-) strand; PAM type: NRG; PAM sequence: AAG
aacgtgttcacttaaaacaa

SEQ ID NO: 58065 - DNA, 20 bp, Artificial Sequence
  Description of Artificial Sequence: Synthetic oligonucleotide
  Target: ATXN1; (-) strand; PAM type: NRG; PAM sequence: AGG
aacagttaccttgcaagctc

SEQ ID NO: 58066 - DNA, 20 bp, Artificial Sequence
  Description of Artificial Sequence: Synthetic oligonucleotide
  Target: ATXN1; (-) strand; PAM type: NRG; PAM sequence: CAG
aaacagttaccttgcaagct

SEQ ID NO: 58067 - DNA, 20 bp, Artificial Sequence
  Description of Artificial Sequence: Synthetic oligonucleotide
  Target: ATXN1; (-) strand; PAM type: NRG; PAM sequence: AAG
tttttaaacagttaccttgc

SEQ ID NO: 58068 - DNA, 20 bp, Artificial Sequence
  Description of Artificial Sequence: Synthetic oligonucleotide
  Target: ATXN1; (-) strand; PAM type: NRG; PAM sequence: CAG
agttgttttatttttttaaa

SEQ ID NO: 58069 - DNA, 20 bp, Artificial Sequence
  Description of Artificial Sequence: Synthetic oligonucleotide
  Target: ATXN1; (-) strand; PAM type: NRG; PAM sequence: GAG
aaggagttgcaaataataat

SEQ ID NO: 58070 - DNA, 20 bp, Artificial Sequence
  Description of Artificial Sequence: Synthetic oligonucleotide
  Target: ATXN1; (-) strand; PAM type: NRG; PAM sequence: GAG
ccctgattccctaaaataag

SEQ ID NO: 58071 - DNA, 20 bp, Artificial Sequence
  Description of Artificial Sequence: Synthetic oligonucleotide
  Target: ATXN1; (-) strand; PAM type: NRG; PAM sequence: AGG
aaccctgattccctaaaata

SEQ ID NO: 58072 - DNA, 20 bp, Artificial Sequence
  Description of Artificial Sequence: Synthetic oligonucleotide
  Target: ATXN1; (-) strand; PAM type: NRG; PAM sequence: AAG
aaaccctgattccctaaaat

SEQ ID NO: 58073 - DNA, 20 bp, Artificial Sequence
  Description of Artificial Sequence: Synthetic oligonucleotide
  Target: ATXN1; (-) strand; PAM type: NRG; PAM sequence: GAG
ttatgttgttgtgcagtatt

SEQ ID NO: 58074 - DNA, 20 bp, Artificial Sequence
  Description of Artificial Sequence: Synthetic oligonucleotide
  Target: ATXN1; (-) strand; PAM type: NRG; PAM sequence: CAG
atattttttatgttgttgtg

SEQ ID NO: 58075 - DNA, 20 bp, Artificial Sequence
  Description of Artificial Sequence: Synthetic oligonucleotide
  Target: ATXN1; (-) strand; PAM type: NRG; PAM sequence: AGG
atttattgccttttgttgtt

SEQ ID NO: 58076 - DNA, 20 bp, Artificial Sequence
  Description of Artificial Sequence: Synthetic oligonucleotide
  Target: ATXN1; (-) strand; PAM type: NRG; PAM sequence: TAG
aatttattgccttttgttgt

SEQ ID NO: 58077 - DNA, 20 bp, Artificial Sequence
  Description of Artificial Sequence: Synthetic oligonucleotide
  Target: ATXN1; (-) strand; PAM type: NRG; PAM sequence: CAG
gctgcaatcttctttaactt

SEQ ID NO: 58078 - DNA, 20 bp, Artificial Sequence
  Description of Artificial Sequence: Synthetic oligonucleotide
  Target: ATXN1; (-) strand; PAM type: NRG; PAM sequence: CAG
gaaagcagtgttagagatga

SEQ ID NO: 58079 - DNA, 20 bp, Artificial Sequence
  Description of Artificial Sequence: Synthetic oligonucleotide
  Target: ATXN1; (-) strand; PAM type: NRG; PAM sequence: GAG
gaaatttgaaagcagtgtta

SEQ ID NO: 58080 - DNA, 20 bp, Artificial Sequence
  Description of Artificial Sequence: Synthetic oligonucleotide
  Target: ATXN1; (-) strand; PAM type: NRG; PAM sequence: TAG
cagaaatttgaaagcagtgt

SEQ ID NO: 58081 - DNA, 20 bp, Artificial Sequence
  Description of Artificial Sequence: Synthetic oligonucleotide
  Target: ATXN1; (-) strand; PAM type: NRG; PAM sequence: CAG
tgaacacagaaatttgaaag

SEQ ID NO: 58082 - DNA, 20 bp, Artificial Sequence
  Description of Artificial Sequence: Synthetic oligonucleotide
  Target: ATXN1; (-) strand; PAM type: NRG; PAM sequence: AAG
tgatgaacacagaaatttga

SEQ ID NO: 58083 - DNA, 20 bp, Artificial Sequence
  Description of Artificial Sequence: Synthetic oligonucleotide
  Target: ATXN1; (-) strand; PAM type: NRG; PAM sequence: CAG
atgaagctttgtgatgaaca

SEQ ID NO: 58084 - DNA, 20 bp, Artificial Sequence
  Description of Artificial Sequence: Synthetic oligonucleotide
  Target: ATXN1; (-) strand; PAM type: NRG; PAM sequence: AAG
atcaagaagaaagaacaatg

SEQ ID NO: 58085 - DNA, 20 bp, Artificial Sequence
  Description of Artificial Sequence: Synthetic oligonucleotide
  Target: ATXN1; (-) strand; PAM type: NRG; PAM sequence: AAG
gacttataaaatcaagaaga

SEQ ID NO: 58086 - DNA, 20 bp, Artificial Sequence
  Description of Artificial Sequence: Synthetic oligonucleotide
  Target: ATXN1; (-) strand; PAM type: NRG; PAM sequence: AAG
tgctgacttataaaatcaag

SEQ ID NO: 58087 - DNA, 20 bp, Artificial Sequence
  Description of Artificial Sequence: Synthetic oligonucleotide
  Target: ATXN1; (-) strand; PAM type: NRG; PAM sequence: AAG
taatgctgacttataaaatc

SEQ ID NO: 58088 - DNA, 20 bp, Artificial Sequence
  Description of Artificial Sequence: Synthetic oligonucleotide
  Target: ATXN1; (-) strand; PAM type: NRG; PAM sequence: CAG
gcataatgtatgttagattt

SEQ ID NO: 58089 - DNA, 20 bp, Artificial Sequence
  Description of Artificial Sequence: Synthetic oligonucleotide
  Target: ATXN1; (-) strand; PAM type: NRG; PAM sequence: TAG
tttgttagcataatgtatgt

SEQ ID NO: 58090 - DNA, 20 bp, Artificial Sequence
  Description of Artificial Sequence: Synthetic oligonucleotide
  Target: ATXN1; (-) strand; PAM type: NRG; PAM sequence: TAG
cgaataaaggaaaattttgt

SEQ ID NO: 58091 - DNA, 20 bp, Artificial Sequence
  Description of Artificial Sequence: Synthetic oligonucleotide
  Target: ATXN1; (-) strand; PAM type: NRG; PAM sequence: AGG
tcaacatatgaaacgaataa

SEQ ID NO: 58092 - DNA, 20 bp, Artificial Sequence
  Description of Artificial Sequence: Synthetic oligonucleotide
  Target: ATXN1; (-) strand; PAM type: NRG; PAM sequence: AAG
ctcaacatatgaaacgaata

SEQ ID NO: 58093 - DNA, 20 bp, Artificial Sequence
  Description of Artificial Sequence: Synthetic oligonucleotide
  Target: ATXN1; (-) strand; PAM type: NRG; PAM sequence: TAG
tggaggtttacaaatatttt

SEQ ID NO: 58094 - DNA, 20 bp, Artificial Sequence
  Description of Artificial Sequence: Synthetic oligonucleotide
  Target: ATXN1; (-) strand; PAM type: NRG; PAM sequence: AGG
cattcattgcctttacttgg

SEQ ID NO: 58095 - DNA, 20 bp, Artificial Sequence
  Description of Artificial Sequence: Synthetic oligonucleotide
  Target: ATXN1; (-) strand; PAM type: NRG; PAM sequence: GAG
tcattcattgcctttacttg

SEQ ID NO: 58096 - DNA, 20 bp, Artificial Sequence
  Description of Artificial Sequence: Synthetic oligonucleotide
  Target: ATXN1; (-) strand; PAM type: NRG; PAM sequence: TGG
tatcattcattgcctttact

SEQ ID NO: 58097 - DNA, 20 bp, Artificial Sequence
  Description of Artificial Sequence: Synthetic oligonucleotide
  Target: ATXN1; (-) strand; PAM type: NRG; PAM sequence: AGG
ctatggcagtgatcacccac

SEQ ID NO: 58098 - DNA, 20 bp, Artificial Sequence
  Description of Artificial Sequence: Synthetic oligonucleotide
  Target: ATXN1; (-) strand; PAM type: NRG; PAM sequence: CAG
gctatggcagtgatcaccca

SEQ ID NO: 58099 - DNA, 20 bp, Artificial Sequence
  Description of Artificial Sequence: Synthetic oligonucleotide
  Target: ATXN1; (-) strand; PAM type: NRG; PAM sequence: CAG
taggcattatatagctatgg

SEQ ID NO: 58100 - DNA, 20 bp, Artificial Sequence
  Description of Artificial Sequence: Synthetic oligonucleotide
  Target: ATXN1; (-) strand; PAM type: NRG; PAM sequence: TGG
atttaggcattatatagcta

SEQ ID NO: 58101 - DNA, 20 bp, Artificial Sequence
  Description of Artificial Sequence: Synthetic oligonucleotide
  Target: ATXN1; (-) strand; PAM type: NRG; PAM sequence: TAG
tcctgtatttaggcattata

SEQ ID NO: 58102 - DNA, 20 bp, Artificial Sequence
  Description of Artificial Sequence: Synthetic oligonucleotide
  Target: ATXN1; (-) strand; PAM type: NRG; PAM sequence: AGG
tgcttctctttcctgtattt

SEQ ID NO: 58103 - DNA, 20 bp, Artificial Sequence
  Description of Artificial Sequence: Synthetic oligonucleotide
  Target: ATXN1; (-) strand; PAM type: NRG; PAM sequence: TAG
ttgcttctctttcctgtatt

SEQ ID NO: 58104 - DNA, 20 bp, Artificial Sequence
  Description of Artificial Sequence: Synthetic oligonucleotide
  Target: ATXN1; (-) strand; PAM type: NRG; PAM sequence: CGG
agcatagttcccacaaggac

SEQ ID NO: 58105 - DNA, 20 bp, Artificial Sequence
  Description of Artificial Sequence: Synthetic oligonucleotide
  Target: ATXN1; (-) strand; PAM type: NRG; PAM sequence: AGG
aggggagcatagttcccaca

SEQ ID NO: 58106 - DNA, 20 bp, Artificial Sequence
  Description of Artificial Sequence: Synthetic oligonucleotide
  Target: ATXN1; (-) strand; PAM type: NRG; PAM sequence: AAG
taggggagcatagttcccac

SEQ ID NO: 58107 - DNA, 20 bp, Artificial Sequence
  Description of Artificial Sequence: Synthetic oligonucleotide
  Target: ATXN1; (-) strand; PAM type: NRG; PAM sequence: TAG
tgcaatcatataggggagca

SEQ ID NO: 58108 - DNA, 20 bp, Artificial Sequence
  Description of Artificial Sequence: Synthetic oligonucleotide
  Target: ATXN1; (-) strand; PAM type: NRG; PAM sequence: GAG
gtgtttgcaatcatataggg

SEQ ID NO: 58109 - DNA, 20 bp, Artificial Sequence
  Description of Artificial Sequence: Synthetic oligonucleotide
  Target: ATXN1; (-) strand; PAM type: NRG; PAM sequence: GGG
gagtgtttgcaatcatatag

SEQ ID NO: 58110 - DNA, 20 bp, Artificial Sequence
  Description of Artificial Sequence: Synthetic oligonucleotide
  Target: ATXN1; (-) strand; PAM type: NRG; PAM sequence: GGG
tgagtgtttgcaatcatata

SEQ ID NO: 58111 - DNA, 20 bp, Artificial Sequence
  Description of Artificial Sequence: Synthetic oligonucleotide
  Target: ATXN1; (-) strand; PAM type: NRG; PAM sequence: AGG
ctgagtgtttgcaatcatat

SEQ ID NO: 58112 - DNA, 20 bp, Artificial Sequence
  Description of Artificial Sequence: Synthetic oligonucleotide
  Target: ATXN1; (-) strand; PAM type: NRG; PAM sequence: TAG
tctgagtgtttgcaatcata

SEQ ID NO: 58113 - DNA, 20 bp, Artificial Sequence
  Description of Artificial Sequence: Synthetic oligonucleotide
  Target: ATXN1; (-) strand; PAM type: NRG; PAM sequence: GAG
ttcatatattacttatatct

SEQ ID NO: 58114 - DNA, 20 bp, Artificial Sequence
  Description of Artificial Sequence: Synthetic oligonucleotide
  Target: ATXN1; (-) strand; PAM type: NRG; PAM sequence: AAG
aaagaagaggaagattaagt

SEQ ID NO: 58115 - DNA, 20 bp, Artificial Sequence
  Description of Artificial Sequence: Synthetic oligonucleotide
  Target: ATXN1; (-) strand; PAM type: NRG; PAM sequence: AAG
tgaaaaagaagaggaagatt

SEQ ID NO: 58116 - DNA, 20 bp, Artificial Sequence
  Description of Artificial Sequence: Synthetic oligonucleotide
  Target: ATXN1; (-) strand; PAM type: NRG; PAM sequence: AAG
aacatgtgaaaaagaagagg

SEQ ID NO: 58117 - DNA, 20 bp, Artificial Sequence
  Description of Artificial Sequence: Synthetic oligonucleotide
  Target: ATXN1; (-) strand; PAM type: NRG; PAM sequence: AGG
ccaaacatgtgaaaaagaag

SEQ ID NO: 58118 - DNA, 20 bp, Artificial Sequence
  Description of Artificial Sequence: Synthetic oligonucleotide
  Target: ATXN1; (-) strand; PAM type: NRG; PAM sequence: GAG
cccaaacatgtgaaaaagaa

SEQ ID NO: 58119 - DNA, 20 bp, Artificial Sequence
  Description of Artificial Sequence: Synthetic oligonucleotide
  Target: ATXN1; (-) strand; PAM type: NRG; PAM sequence: AAG
ctcccaaacatgtgaaaaag

SEQ ID NO: 58120 - DNA, 20 bp, Artificial Sequence
  Description of Artificial Sequence: Synthetic oligonucleotide
  Target: ATXN1; (-) strand; PAM type: NRG; PAM sequence: AAG
ttgctcccaaacatgtgaaa

SEQ ID NO: 58121 - DNA, 20 bp, Artificial Sequence
  Description of Artificial Sequence: Synthetic oligonucleotide
  Target: ATXN1; (-) strand; PAM type: NRG; PAM sequence: AGG
gttgcatcagtgattgttcc

SEQ ID NO: 58122 - DNA, 20 bp, Artificial Sequence
  Description of Artificial Sequence: Synthetic oligonucleotide
  Target: ATXN1; (-) strand; PAM type: NRG; PAM sequence: CAG
tgttgcatcagtgattgttc

SEQ ID NO: 58123 - DNA, 20 bp, Artificial Sequence
  Description of Artificial Sequence: Synthetic oligonucleotide
  Target: ATXN1; (-) strand; PAM type: NRG; PAM sequence: CAG
tgtgtaaacacatgttgcat

SEQ ID NO: 58124 - DNA, 20 bp, Artificial Sequence
  Description of Artificial Sequence: Synthetic oligonucleotide
  Target: ATXN1; (-) strand; PAM type: NRG; PAM sequence: AAG
ctcctgtccttccattctct

SEQ ID NO: 58125 - DNA, 20 bp, Artificial Sequence
  Description of Artificial Sequence: Synthetic oligonucleotide
  Target: ATXN1; (-) strand; PAM type: NRG; PAM sequence: CAG
cactggcagatggaactatt

SEQ ID NO: 58126 - DNA, 20 bp, Artificial Sequence
  Description of Artificial Sequence: Synthetic oligonucleotide
  Target: ATXN1; (-) strand; PAM type: NRG; PAM sequence: TGG
gctacattatcactggcaga

SEQ ID NO: 58127 - DNA, 20 bp, Artificial Sequence
  Description of Artificial Sequence: Synthetic oligonucleotide
  Target: ATXN1; (-) strand; PAM type: NRG; PAM sequence: CAG
gggagctacattatcactgg

SEQ ID NO: 58128 - DNA, 20 bp, Artificial Sequence
  Description of Artificial Sequence: Synthetic oligonucleotide
  Target: ATXN1; (-) strand; PAM type: NRG; PAM sequence: TGG
gatgggagctacattatcac

SEQ ID NO: 58129 - DNA, 20 bp, Artificial Sequence
  Description of Artificial Sequence: Synthetic oligonucleotide
  Target: ATXN1; (-) strand; PAM type: NRG; PAM sequence: GAG
ctagatgggaagggtgatgg

SEQ ID NO: 58130 - DNA, 20 bp, Artificial Sequence
  Description of Artificial Sequence: Synthetic oligonucleotide
  Target: ATXN1; (-) strand; PAM type: NRG; PAM sequence: GGG
cactagatgggaagggtgat

SEQ ID NO: 58131 - DNA, 20 bp, Artificial Sequence
  Description of Artificial Sequence: Synthetic oligonucleotide
  Target: ATXN1; (-) strand; PAM type: NRG; PAM sequence: TGG
gcactagatgggaagggtga

SEQ ID NO: 58132 - DNA, 20 bp, Artificial Sequence
  Description of Artificial Sequence: Synthetic oligonucleotide
  Target: ATXN1; (-) strand; PAM type: NRG; PAM sequence: GGG
cagagagcactagatgggaa

SEQ ID NO: 58133 - DNA, 20 bp, Artificial Sequence
  Description of Artificial Sequence: Synthetic oligonucleotide
  Target: ATXN1; (-) strand; PAM type: NRG; PAM sequence: AGG
tcagagagcactagatggga

SEQ ID NO: 58134 - DNA, 20 bp, Artificial Sequence
  Description of Artificial Sequence: Synthetic oligonucleotide
  Target: ATXN1; (-) strand; PAM type: NRG; PAM sequence: AAG
atcagagagcactagatggg

SEQ ID NO: 58135 - DNA, 20 bp, Artificial Sequence
  Description of Artificial Sequence: Synthetic oligonucleotide
  Target: ATXN1; (-) strand; PAM type: NRG; PAM sequence: GGG
tgaatcagagagcactagat

SEQ ID NO: 58136 - DNA, 20 bp, Artificial Sequence
  Description of Artificial Sequence: Synthetic oligonucleotide
  Target: ATXN1; (-) strand; PAM type: NRG; PAM sequence: TGG
ttgaatcagagagcactaga

SEQ ID NO: 58137 - DNA, 20 bp, Artificial Sequence
  Description of Artificial Sequence: Synthetic oligonucleotide
  Target: ATXN1; (-) strand; PAM type: NRG; PAM sequence: TAG
tcccttgaatcagagagcac

SEQ ID NO: 58138 - DNA, 20 bp, Artificial Sequence
  Description of Artificial Sequence: Synthetic oligonucleotide
  Target: ATXN1; (-) strand; PAM type: NRG; PAM sequence: GAG
attccttcccttgaatcaga

SEQ ID NO: 58139 - DNA, 20 bp, Artificial Sequence
  Description of Artificial Sequence: Synthetic oligonucleotide
  Target: ATXN1; (-) strand; PAM type: NRG; PAM sequence: GAG
acattccttcccttgaatca

SEQ ID NO: 58140 - DNA, 20 bp, Artificial Sequence
  Description of Artificial Sequence: Synthetic oligonucleotide
  Target: ATXN1; (-) strand; PAM type: NRG; PAM sequence: CAG
gcacattccttcccttgaat

SEQ ID NO: 58141 - DNA, 20 bp, Artificial Sequence
  Description of Artificial Sequence: Synthetic oligonucleotide
  Target: ATXN1; (-) strand; PAM type: NRG; PAM sequence: AAG
agcccctgccctctcttcca

SEQ ID NO: 58142 - DNA, 20 bp, Artificial Sequence
  Description of Artificial Sequence: Synthetic oligonucleotide
  Target: ATXN1; (-) strand; PAM type: NRG; PAM sequence: AAG
cctacgtctctctgagtaat

SEQ ID NO: 58143 - DNA, 20 bp, Artificial Sequence
  Description of Artificial Sequence: Synthetic oligonucleotide
  Target: ATXN1; (-) strand; PAM type: NRG; PAM sequence: GAG
ctttgaacctacgtctctct

SEQ ID NO: 58144 - DNA, 20 bp, Artificial Sequence
  Description of Artificial Sequence: Synthetic oligonucleotide
  Target: ATXN1; (-) strand; PAM type: NRG; PAM sequence: TGG
tctgctaataataaacgtgc

SEQ ID NO: 58145 - DNA, 20 bp, Artificial Sequence
  Description of Artificial Sequence: Synthetic oligonucleotide
  Target: ATXN1; (-) strand; PAM type: NRG; PAM sequence: GAG
aatgggagtgagtcagttca

SEQ ID NO: 58146 - DNA, 20 bp, Artificial Sequence
  Description of Artificial Sequence: Synthetic oligonucleotide
  Target: ATXN1; (-) strand; PAM type: NRG; PAM sequence: CAG
ggaatgggagtgagtcagtt

SEQ ID NO: 58147 - DNA, 20 bp, Artificial Sequence
  Description of Artificial Sequence: Synthetic oligonucleotide
  Target: ATXN1; (-) strand; PAM type: NRG; PAM sequence: CAG
tcgatggaatgggagtgagt

SEQ ID NO: 58148 - DNA, 20 bp, Artificial Sequence
  Description of Artificial Sequence: Synthetic oligonucleotide
  Target: ATXN1; (-) strand; PAM type: NRG; PAM sequence: GAG
aggctcgatggaatgggagt

SEQ ID NO: 58149 - DNA, 20 bp, Artificial Sequence
  Description of Artificial Sequence: Synthetic oligonucleotide
  Target: ATXN1; (-) strand; PAM type: NRG; PAM sequence: GAG
aaagaggctcgatggaatgg

SEQ ID NO: 58150 - DNA, 20 bp, Artificial Sequence
  Description of Artificial Sequence: Synthetic oligonucleotide
  Target: ATXN1; (-) strand; PAM type: NRG; PAM sequence: GGG
taaaagaggctcgatggaat

SEQ ID NO: 58151 - DNA, 20 bp, Artificial Sequence
  Description of Artificial Sequence: Synthetic oligonucleotide
  Target: ATXN1; (-) strand; PAM type: NRG; PAM sequence: TGG
ataaaagaggctcgatggaa

SEQ ID NO: 58152 - DNA, 20 bp, Artificial Sequence
  Description of Artificial Sequence: Synthetic oligonucleotide
  Target: ATXN1; (-) strand; PAM type: NRG; PAM sequence: TGG
tgcagataaaagaggctcga

SEQ ID NO: 58153 - DNA, 20 bp, Artificial Sequence
  Description of Artificial Sequence: Synthetic oligonucleotide
  Target: ATXN1; (-) strand; PAM type: NRG; PAM sequence: AGG
ctccatgttgcagataaaag

SEQ ID NO: 58154 - DNA, 20 bp, Artificial Sequence
  Description of Artificial Sequence: Synthetic oligonucleotide
  Target: ATXN1; (-) strand; PAM type: NRG; PAM sequence: GAG
tctccatgttgcagataaaa

SEQ ID NO: 58155 - DNA, 20 bp, Artificial Sequence
  Description of Artificial Sequence: Synthetic oligonucleotide
  Target: ATXN1; (-) strand; PAM type: NRG; PAM sequence: AAG
catctccatgttgcagataa

SEQ ID NO: 58156 - DNA, 20 bp, Artificial Sequence
  Description of Artificial Sequence: Synthetic oligonucleotide
  Target: ATXN1; (-) strand; PAM type: NRG; PAM sequence: CAG
ctcatagcatctccatgttg

SEQ ID NO: 58157 - DNA, 20 bp, Artificial Sequence
  Description of Artificial Sequence: Synthetic oligonucleotide
  Target: ATXN1; (-) strand; PAM type: NRG; PAM sequence: TAG
aaggaatcttcagaaactca

SEQ ID NO: 58158 - DNA, 20 bp, Artificial Sequence
  Description of Artificial Sequence: Synthetic oligonucleotide
  Target: ATXN1; (-) strand; PAM type: NRG; PAM sequence: CAG
atgagatattaaggaatctt

SEQ ID NO: 58159 - DNA, 20 bp, Artificial Sequence
  Description of Artificial Sequence: Synthetic oligonucleotide
  Target: ATXN1; (-) strand; PAM type: NRG; PAM sequence: AGG
gttatttttatgagatatta

SEQ ID NO: 58160 - DNA, 20 bp, Artificial Sequence
  Description of Artificial Sequence: Synthetic oligonucleotide
  Target: ATXN1; (-) strand; PAM type: NRG; PAM sequence: AAG
tgttatttttatgagatatt

SEQ ID NO: 58161 - DNA, 20 bp, Artificial Sequence
  Description of Artificial Sequence: Synthetic oligonucleotide
  Target: ATXN1; (-) strand; PAM type: NRG; PAM sequence: GAG
tggttttatgttatttttat

SEQ ID NO: 58162 - DNA, 20 bp, Artificial Sequence
  Description of Artificial Sequence: Synthetic oligonucleotide
  Target: ATXN1; (-) strand; PAM type: NRG; PAM sequence: TGG
ttgaatacttcatatggagg

SEQ ID NO: 58163 - DNA, 20 bp, Artificial Sequence
  Description of Artificial Sequence: Synthetic oligonucleotide
  Target: ATXN1; (-) strand; PAM type: NRG; PAM sequence: AGG
tcattgaatacttcatatgg

SEQ ID NO: 58164 - DNA, 20 bp, Artificial Sequence
  Description of Artificial Sequence: Synthetic oligonucleotide
  Target: ATXN1; (-) strand; PAM type: NRG; PAM sequence: GAG
ttcattgaatacttcatatg

SEQ ID NO: 58165 - DNA, 20 bp, Artificial Sequence
  Description of Artificial Sequence: Synthetic oligonucleotide
  Target: ATXN1; (-) strand; PAM type: NRG; PAM sequence: TGG
tattcattgaatacttcata

SEQ ID NO: 58166 - DNA, 20 bp, Artificial Sequence
  Description of Artificial Sequence: Synthetic oligonucleotide
  Target: ATXN1; (-) strand; PAM type: NRG; PAM sequence: AAG
caaggtccccagaagggagg

SEQ ID NO: 58167 - DNA, 20 bp, Artificial Sequence
  Description of Artificial Sequence: Synthetic oligonucleotide
  Target: ATXN1; (-) strand; PAM type: NRG; PAM sequence: AGG
ctacaaggtccccagaaggg

SEQ ID NO: 58168 - DNA, 20 bp, Artificial Sequence
  Description of Artificial Sequence: Synthetic oligonucleotide
  Target: ATXN1; (-) strand; PAM type: NRG; PAM sequence: GAG
tctacaaggtccccagaagg

SEQ ID NO: 58169 - DNA, 20 bp, Artificial Sequence
  Description of Artificial Sequence: Synthetic oligonucleotide
  Target: ATXN1; (-) strand; PAM type: NRG; PAM sequence: GGG
tttctacaaggtccccagaa

SEQ ID NO: 58170 - DNA, 20 bp, Artificial Sequence
  Description of Artificial Sequence: Synthetic oligonucleotide
  Target: ATXN1; (-) strand; PAM type: NRG; PAM sequence: AGG
atttctacaaggtccccaga

SEQ ID NO: 58171 - DNA, 20 bp, Artificial Sequence
  Description of Artificial Sequence: Synthetic oligonucleotide
  Target: ATXN1; (-) strand; PAM type: NRG; PAM sequence: AAG
catttctacaaggtccccag

SEQ ID NO: 58172 - DNA, 20 bp, Artificial Sequence
  Description of Artificial Sequence: Synthetic oligonucleotide
  Target: ATXN1; (-) strand; PAM type: NRG; PAM sequence: CAG
cagcatttctacaaggtccc

SEQ ID NO: 58173 - DNA, 20 bp, Artificial Sequence
  Description of Artificial Sequence: Synthetic oligonucleotide
  Target: ATXN1; (-) strand; PAM type: NRG; PAM sequence: AGG
gcctcatcagcatttctaca

SEQ ID NO: 58174 - DNA, 20 bp, Artificial Sequence
  Description of Artificial Sequence: Synthetic oligonucleotide
  Target: ATXN1; (-) strand; PAM type: NRG; PAM sequence: AAG
agcctcatcagcatttctac

SEQ ID NO: 58175 - DNA, 20 bp, Artificial Sequence
  Description of Artificial Sequence: Synthetic oligonucleotide
  Target: ATXN1; (-) strand; PAM type: NRG; PAM sequence: CAG
ggtcgctggagcagcctcat

SEQ ID NO: 58176 - DNA, 20 bp, Artificial Sequence
  Description of Artificial Sequence: Synthetic oligonucleotide
  Target: ATXN1; (-) strand; PAM type: NRG; PAM sequence: CAG
attgattttggtcgctggag

SEQ ID NO: 58177 - DNA, 20 bp, Artificial Sequence
  Description of Artificial Sequence: Synthetic oligonucleotide
  Target: ATXN1; (-) strand; PAM type: NRG; PAM sequence: GAG
gacattgattttggtcgctg

SEQ ID NO: 58178 - DNA, 20 bp, Artificial Sequence
  Description of Artificial Sequence: Synthetic oligonucleotide
  Target: ATXN1; (-) strand; PAM type: NRG; PAM sequence: TGG
tggacattgattttggtcgc

SEQ ID NO: 58179 - DNA, 20 bp, Artificial Sequence
  Description of Artificial Sequence: Synthetic oligonucleotide
  Target: ATXN1; (-) strand; PAM type: NRG; PAM sequence: TGG
ccaagattggacattgattt

SEQ ID NO: 58180 - DNA, 20 bp, Artificial Sequence
  Description of Artificial Sequence: Synthetic oligonucleotide
  Target: ATXN1; (-) strand; PAM type: NRG; PAM sequence: TGG
agaaggtcctttcccaagat

SEQ ID NO: 58181 - DNA, 20 bp, Artificial Sequence
  Description of Artificial Sequence: Synthetic oligonucleotide
  Target: ATXN1; (-) strand; PAM type: NRG; PAM sequence: AAG
cacctagaaggtcctttccc

SEQ ID NO: 58182 - DNA, 20 bp, Artificial Sequence
  Description of Artificial Sequence: Synthetic oligonucleotide
  Target: ATXN1; (-) strand; PAM type: NRG; PAM sequence: AGG
gttgacatccttcacctaga

SEQ ID NO: 58183 - DNA, 20 bp, Artificial Sequence
  Description of Artificial Sequence: Synthetic oligonucleotide
  Target: ATXN1; (-) strand; PAM type: NRG; PAM sequence: AAG
ggttgacatccttcacctag

SEQ ID NO: 58184 - DNA, 20 bp, Artificial Sequence
  Description of Artificial Sequence: Synthetic oligonucleotide
  Target: ATXN1; (-) strand; PAM type: NRG; PAM sequence: TAG
tggggttgacatccttcacc

SEQ ID NO: 58185 - DNA, 20 bp, Artificial Sequence
  Description of Artificial Sequence: Synthetic oligonucleotide
  Target: ATXN1; (-) strand; PAM type: NRG; PAM sequence: GGG
ctccatgatgtttaggaatg

SEQ ID NO: 58186 - DNA, 20 bp, Artificial Sequence
  Description of Artificial Sequence: Synthetic oligonucleotide
  Target: ATXN1; (-) strand; PAM type: NRG; PAM sequence: GGG
tctccatgatgtttaggaat

SEQ ID NO: 58187 - DNA, 20 bp, Artificial Sequence
  Description of Artificial Sequence: Synthetic oligonucleotide
  Target: ATXN1; (-) strand; PAM type: NRG; PAM sequence: TGG
ctctccatgatgtttaggaa

SEQ ID NO: 58188 - DNA, 20 bp, Artificial Sequence
  Description of Artificial Sequence: Synthetic oligonucleotide
  Target: ATXN1; (-) strand; PAM type: NRG; PAM sequence: AGG
aggacctctccatgatgttt

SEQ ID NO: 58189 - DNA, 20 bp, Artificial Sequence
  Description of Artificial Sequence: Synthetic oligonucleotide
  Target: ATXN1; (-) strand; PAM type: NRG; PAM sequence: TAG
gaggacctctccatgatgtt

SEQ ID NO: 58190 - DNA, 20 bp, Artificial Sequence
  Description of Artificial Sequence: Synthetic oligonucleotide
  Target: ATXN1; (-) strand; PAM type: NRG; PAM sequence: AGG
tggacacctgtatttctgag

SEQ ID NO: 58191 - DNA, 20 bp, Artificial Sequence
  Description of Artificial Sequence: Synthetic oligonucleotide
  Target: ATXN1; (-) strand; PAM type: NRG; PAM sequence: GAG
atggacacctgtatttctga

SEQ ID NO: 58192 - DNA, 20 bp, Artificial Sequence
  Description of Artificial Sequence: Synthetic oligonucleotide
  Target: ATXN1; (-) strand; PAM type: NRG; PAM sequence: GAG
ggatggacacctgtatttct

SEQ ID NO: 58193 - DNA, 20 bp, Artificial Sequence
  Description of Artificial Sequence: Synthetic oligonucleotide
  Target: ATXN1; (-) strand; PAM type: NRG; PAM sequence: TGG
gaaagaggttaggatgggga

SEQ ID NO: 58194 - DNA, 20 bp, Artificial Sequence
  Description of Artificial Sequence: Synthetic oligonucleotide
  Target: ATXN1; (-) strand; PAM type: NRG; PAM sequence: GGG
ggctgaaagaggttaggatg

SEQ ID NO: 58195 - DNA, 20 bp, Artificial Sequence
  Description of Artificial Sequence: Synthetic oligonucleotide
  Target: ATXN1; (-) strand; PAM type: NRG; PAM sequence: GGG
aggctgaaagaggttaggat

SEQ ID NO: 58196 - DNA, 20 bp, Artificial Sequence
  Description of Artificial Sequence: Synthetic oligonucleotide
  Target: ATXN1; (-) strand; PAM type: NRG; PAM sequence: TGG
gaggctgaaagaggttagga

SEQ ID NO: 58197 - DNA, 20 bp, Artificial Sequence
  Description of Artificial Sequence: Synthetic oligonucleotide
  Target: ATXN1; (-) strand; PAM type: NRG; PAM sequence: AGG
aagtgaggctgaaagaggtt

SEQ ID NO: 58198 - DNA, 20 bp, Artificial Sequence
  Description of Artificial Sequence: Synthetic oligonucleotide
  Target: ATXN1; (-) strand; PAM type: NRG; PAM sequence: TAG
aaagtgaggctgaaagaggt

SEQ ID NO: 58199 - DNA, 20 bp, Artificial Sequence
  Description of Artificial Sequence: Synthetic oligonucleotide
  Target: ATXN1; (-) strand; PAM type: NRG; PAM sequence: AGG
cactaaagtgaggctgaaag

SEQ ID NO: 58200 - DNA, 20 bp, Artificial Sequence
  Description of Artificial Sequence: Synthetic oligonucleotide
  Target: ATXN1; (-) strand; PAM type: NRG; PAM sequence: GAG
ccactaaagtgaggctgaaa

SEQ ID NO: 58201 - DNA, 20 bp, Artificial Sequence
  Description of Artificial Sequence: Synthetic oligonucleotide
  Target: ATXN1; (-) strand; PAM type: NRG; PAM sequence: AAG
aaccactaaagtgaggctga

SEQ ID NO: 58202 - DNA, 20 bp, Artificial Sequence
  Description of Artificial Sequence: Synthetic oligonucleotide
  Target: ATXN1; (-) strand; PAM type: NRG; PAM sequence: AGG
cacagataaccactaaagtg

SEQ ID NO: 58203 - DNA, 20 bp, Artificial Sequence
  Description of Artificial Sequence: Synthetic oligonucleotide
  Target: ATXN1; (-) strand; PAM type: NRG; PAM sequence: GAG
tcacagataaccactaaagt

SEQ ID NO: 58204 - DNA, 20 bp, Artificial Sequence
  Description of Artificial Sequence: Synthetic oligonucleotide
  Target: ATXN1; (-) strand; PAM type: NRG; PAM sequence: AAG
gcgttcacagataaccacta

SEQ ID NO: 58205 - DNA, 20 bp, Artificial Sequence
  Description of Artificial Sequence: Synthetic oligonucleotide
  Target: ATXN1; (-) strand; PAM type: NRG; PAM sequence: CAG
tcatggatcaggtgcgttca

SEQ ID NO: 58206 - DNA, 20 bp, Artificial Sequence
  Description of Artificial Sequence: Synthetic oligonucleotide
  Target: ATXN1; (-) strand; PAM type: NRG; PAM sequence: AGG
ccttttaatcctcatggatc

SEQ ID NO: 58207 - DNA, 20 bp, Artificial Sequence
  Description of Artificial Sequence: Synthetic oligonucleotide
  Target: ATXN1; (-) strand; PAM type: NRG; PAM sequence: CAG
tccttttaatcctcatggat

SEQ ID NO: 58208 - DNA, 20 bp, Artificial Sequence
  Description of Artificial Sequence: Synthetic oligonucleotide
  Target: ATXN1; (-) strand; PAM type: NRG; PAM sequence: TGG
tgttgtccttttaatcctca

SEQ ID NO: 58209 - DNA, 20 bp, Artificial Sequence
  Description of Artificial Sequence: Synthetic oligonucleotide
  Target: ATXN1; (-) strand; PAM type: NRG; PAM sequence: GGG
catagcgttggcccttgggg

SEQ ID NO: 58210 - DNA, 20 bp, Artificial Sequence
  Description of Artificial Sequence: Synthetic oligonucleotide
  Target: ATXN1; (-) strand; PAM type: NRG; PAM sequence: GGG
tcatagcgttggcccttggg

SEQ ID NO: 58211 - DNA, 20 bp, Artificial Sequence
  Description of Artificial Sequence: Synthetic oligonucleotide
  Target: ATXN1; (-) strand; PAM type: NRG; PAM sequence: GGG
ttcatagcgttggcccttgg

SEQ ID NO: 58212 - DNA, 20 bp, Artificial Sequence
  Description of Artificial Sequence: Synthetic oligonucleotide
  Target: ATXN1; (-) strand; PAM type: NRG; PAM sequence: GGG
cttcatagcgttggcccttg

SEQ ID NO: 58213 - DNA, 20 bp, Artificial Sequence
  Description of Artificial Sequence: Synthetic oligonucleotide
  Target: ATXN1; (-) strand; PAM type: NRG; PAM sequence: GGG
tcttcatagcgttggccctt

SEQ ID NO: 58214 - DNA, 20 bp, Artificial Sequence
  Description of Artificial Sequence: Synthetic oligonucleotide
  Target: ATXN1; (-) strand; PAM type: NRG; PAM sequence: TGG
ctcttcatagcgttggccct

SEQ ID NO: 58215 - DNA, 20 bp, Artificial Sequence
  Description of Artificial Sequence: Synthetic oligonucleotide
  Target: ATXN1; (-) strand; PAM type: NRG; PAM sequence: TGG
catgtggctcttcatagcgt

SEQ ID NO: 58216 - DNA, 20 bp, Artificial Sequence
  Description of Artificial Sequence: Synthetic oligonucleotide
  Target: ATXN1; (-) strand; PAM type: NRG; PAM sequence: TAG
aatggccatgtggctcttca

SEQ ID NO: 58217 - DNA, 20 bp, Artificial Sequence
  Description of Artificial Sequence: Synthetic oligonucleotide
  Target: ATXN1; (-) strand; PAM type: NRG; PAM sequence: TGG
attctcaaggaatggccatg

SEQ ID NO: 58218 - DNA, 20 bp, Artificial Sequence
  Description of Artificial Sequence: Synthetic oligonucleotide
  Target: ATXN1; (-) strand; PAM type: NRG; PAM sequence: TGG
gattagtaattctcaaggaa

SEQ ID NO: 58219 - DNA, 20 bp, Artificial Sequence
  Description of Artificial Sequence: Synthetic oligonucleotide
  Target: ATXN1; (-) strand; PAM type: NRG; PAM sequence: AGG
ttcatgattagtaattctca

SEQ ID NO: 58220 - DNA, 20 bp, Artificial Sequence
  Description of Artificial Sequence: Synthetic oligonucleotide
  Target: ATXN1; (-) strand; PAM type: NRG; PAM sequence: AAG
attcatgattagtaattctc

SEQ ID NO: 58221 - DNA, 20 bp, Artificial Sequence
  Description of Artificial Sequence: Synthetic oligonucleotide
  Target: ATXN1; (-) strand; PAM type: NRG; PAM sequence: TAG
agaaccgaatgattcatgat

SEQ ID NO: 58222 - DNA, 20 bp, Artificial Sequence
  Description of Artificial Sequence: Synthetic oligonucleotide
  Target: ATXN1; (-) strand; PAM type: NRG; PAM sequence: GAG
taagccaaaggagcatcctg

SEQ ID NO: 58223 - DNA, 20 bp, Artificial Sequence
  Description of Artificial Sequence: Synthetic oligonucleotide
  Target: ATXN1; (-) strand; PAM type: NRG; PAM sequence: TGG
tttaagccaaaggagcatcc

SEQ ID NO: 58224 - DNA, 20 bp, Artificial Sequence
  Description of Artificial Sequence: Synthetic oligonucleotide
  Target: ATXN1; (-) strand; PAM type: NRG; PAM sequence: GAG
gacttcggtttaagccaaag

SEQ ID NO: 58225 - DNA, 20 bp, Artificial Sequence
  Description of Artificial Sequence: Synthetic oligonucleotide
  Target: ATXN1; (-) strand; PAM type: NRG; PAM sequence: AGG
ttgacttcggtttaagccaa

SEQ ID NO: 58226 - DNA, 20 bp, Artificial Sequence
  Description of Artificial Sequence: Synthetic oligonucleotide
  Target: ATXN1; (-) strand; PAM type: NRG; PAM sequence: AAG
attgacttcggtttaagcca

SEQ ID NO: 58227 - DNA, 20 bp, Artificial Sequence
  Description of Artificial Sequence: Synthetic oligonucleotide
  Target: ATXN1; (-) strand; PAM type: NRG; PAM sequence: AAG
gaaaagattgacttcggttt

SEQ ID NO: 58228 - DNA, 20 bp, Artificial Sequence
  Description of Artificial Sequence: Synthetic oligonucleotide
  Target: ATXN1; (-) strand; PAM type: NRG; PAM sequence: CGG
tgcttagaaaagattgactt

SEQ ID NO: 58229 - DNA, 20 bp, Artificial Sequence
  Description of Artificial Sequence: Synthetic oligonucleotide
  Target: ATXN1; (-) strand; PAM type: NRG; PAM sequence: AAG
tccccatttaatgcttagaa

SEQ ID NO: 58230 - DNA, 20 bp, Artificial Sequence
  Description of Artificial Sequence: Synthetic oligonucleotide
  Target: ATXN1; (-) strand; PAM type: NRG; PAM sequence: TAG
agatgtccccatttaatgct

SEQ ID NO: 58231 - DNA, 20 bp, Artificial Sequence
  Description of Artificial Sequence: Synthetic oligonucleotide
  Target: ATXN1; (-) strand; PAM type: NRG; PAM sequence: AAG
ttgcttttaaatgggaagag

SEQ ID NO: 58232 - DNA, 20 bp, Artificial Sequence
  Description of Artificial Sequence: Synthetic oligonucleotide
  Target: ATXN1; (-) strand; PAM type: NRG; PAM sequence: GAG
tgcttgcttttaaatgggaa

SEQ ID NO: 58233 - DNA, 20 bp, Artificial Sequence
  Description of Artificial Sequence: Synthetic oligonucleotide
  Target: ATXN1; (-) strand; PAM type: NRG; PAM sequence: AAG
actgcttgcttttaaatggg

SEQ ID NO: 58234 - DNA, 20 bp, Artificial Sequence
  Description of Artificial Sequence: Synthetic oligonucleotide
  Target: ATXN1; (-) strand; PAM type: NRG; PAM sequence: GGG
gcaactgcttgcttttaaat

SEQ ID NO: 58235 - DNA, 20 bp, Artificial Sequence
  Description of Artificial Sequence: Synthetic oligonucleotide
  Target: ATXN1; (-) strand; PAM type: NRG; PAM sequence: TGG
ggcaactgcttgcttttaaa

SEQ ID NO: 58236 - DNA, 20 bp, Artificial Sequence
  Description of Artificial Sequence: Synthetic oligonucleotide
  Target: ATXN1; (-) strand; PAM type: NRG; PAM sequence: TGG
tataatttgtacagctgaag

SEQ ID NO: 58237 - DNA, 20 bp, Artificial Sequence
  Description of Artificial Sequence: Synthetic oligonucleotide
  Target: ATXN1; (-) strand; PAM type: NRG; PAM sequence: AAG
ctatataatttgtacagctg

SEQ ID NO: 58238 - DNA, 20 bp, Artificial Sequence
  Description of Artificial Sequence: Synthetic oligonucleotide
  Target: ATXN1; (-) strand; PAM type: NRG; PAM sequence: CAG
tcaatcctatataatttgta

SEQ ID NO: 58239 - DNA, 20 bp, Artificial Sequence
  Description of Artificial Sequence: Synthetic oligonucleotide
  Target: ATXN1; (-) strand; PAM type: NRG; PAM sequence: CAG
cgtgagcaactgtgcccaac

SEQ ID NO: 58240 - DNA, 20 bp, Artificial Sequence
  Description of Artificial Sequence: Synthetic oligonucleotide
  Target: ATXN1; (-) strand; PAM type: NRG; PAM sequence: GAG
agttctgggattacaggcgt

SEQ ID NO: 58241 - DNA, 20 bp, Artificial Sequence
  Description of Artificial Sequence: Synthetic oligonucleotide
  Target: ATXN1; (-) strand; PAM type: NRG; PAM sequence: AGG
tcccaaagttctgggattac

SEQ ID NO: 58242 - DNA, 20 bp, Artificial Sequence
  Description of Artificial Sequence: Synthetic oligonucleotide
  Target: ATXN1; (-) strand; PAM type: NRG; PAM sequence: CAG
atcccaaagttctgggatta

SEQ ID NO: 58243 - DNA, 20 bp, Artificial Sequence
  Description of Artificial Sequence: Synthetic oligonucleotide
  Target: ATXN1; (-) strand; PAM type: NRG; PAM sequence: GGG
cctgggcatcccaaagttct

SEQ ID NO: 58244 - DNA, 20 bp, Artificial Sequence
  Description of Artificial Sequence: Synthetic oligonucleotide
  Target: ATXN1; (-) strand; PAM type: NRG; PAM sequence: TGG
acctgggcatcccaaagttc

SEQ ID NO: 58245 - DNA, 20 bp, Artificial Sequence
  Description of Artificial Sequence: Synthetic oligonucleotide
  Target: ATXN1; (-) strand; PAM type: NRG; PAM sequence: AAG
ccacccacctgggcatccca

SEQ ID NO: 58246 - DNA, 20 bp, Artificial Sequence
  Description of Artificial Sequence: Synthetic oligonucleotide
  Target: ATXN1; (-) strand; PAM type: NRG; PAM sequence: GGG
ctttggtgatccacccacct

SEQ ID NO: 58247 - DNA, 20 bp, Artificial Sequence
  Description of Artificial Sequence: Synthetic oligonucleotide
  Target: ATXN1; (-) strand; PAM type: NRG; PAM sequence: TGG
cctttggtgatccacccacc

SEQ ID NO: 58248 - DNA, 20 bp, Artificial Sequence
  Description of Artificial Sequence: Synthetic oligonucleotide
  Target: ATXN1; (-) strand; PAM type: NRG; PAM sequence: TGG
tgtctcgaattcctgacctt

SEQ ID NO: 58249 - DNA, 20 bp, Artificial Sequence
  Description of Artificial Sequence: Synthetic oligonucleotide
  Target: ATXN1; (-) strand; PAM type: NRG; PAM sequence: AGG
agtgtttcactgtgttggcc

SEQ ID NO: 58250 - DNA, 20 bp, Artificial Sequence
  Description of Artificial Sequence: Synthetic oligonucleotide
  Target: ATXN1; (-) strand; PAM type: NRG; PAM sequence: CAG
cagtgtttcactgtgttggc

SEQ ID NO: 58251 - DNA, 20 bp, Artificial Sequence
  Description of Artificial Sequence: Synthetic oligonucleotide
  Target: ATXN1; (-) strand; PAM type: NRG; PAM sequence: TGG
gagacagtgtttcactgtgt

SEQ ID NO: 58252 - DNA, 20 bp, Artificial Sequence
  Description of Artificial Sequence: Synthetic oligonucleotide
  Target: ATXN1; (-) strand; PAM type: NRG; PAM sequence: CAG
ttttgtatttttagtagaga

SEQ ID NO: 58253 - DNA, 20 bp, Artificial Sequence
  Description of Artificial Sequence: Synthetic oligonucleotide
  Target: ATXN1; (-) strand; PAM type: NRG; PAM sequence: GAG
taatttttgtatttttagta

SEQ ID NO: 58254 - DNA, 20 bp, Artificial Sequence
  Description of Artificial Sequence: Synthetic oligonucleotide
  Target: ATXN1; (-) strand; PAM type: NRG; PAM sequence: TAG
actaatttttgtatttttag

SEQ ID NO: 58255 - DNA, 20 bp, Artificial Sequence
  Description of Artificial Sequence: Synthetic oligonucleotide
  Target: ATXN1; (-) strand; PAM type: NRG; PAM sequence: TAG
gagactaatttttgtatttt

SEQ ID NO: 58256 - DNA, 20 bp, Artificial Sequence
  Description of Artificial Sequence: Synthetic oligonucleotide
  Target: ATXN1; (-) strand; PAM type: NRG; PAM sequence: GAG
taatttttgtattttcagta

SEQ ID NO: 58257 - DNA, 20 bp, Artificial Sequence
  Description of Artificial Sequence: Synthetic oligonucleotide
  Target: ATXN1; (-) strand; PAM type: NRG; PAM sequence: TAG
actaatttttgtattttcag

SEQ ID NO: 58258 - DNA, 20 bp, Artificial Sequence
  Description of Artificial Sequence: Synthetic oligonucleotide
  Target: ATXN1; (-) strand; PAM type: NRG; PAM sequence: CAG
ctaactaatttttgtatttt

SEQ ID NO: 58259 - DNA, 20 bp, Artificial Sequence
  Description of Artificial Sequence: Synthetic oligonucleotide
  Target: ATXN1; (-) strand; PAM type: NRG; PAM sequence: TAG
ttctgcctcagcctcctgag

SEQ ID NO: 58260 - DNA, 20 bp, Artificial Sequence
  Description of Artificial Sequence: Synthetic oligonucleotide
  Target: ATXN1; (-) strand; PAM type: NRG; PAM sequence: GAG
ttcttctgcctcagcctcct

SEQ ID NO: 58261 - DNA, 20 bp, Artificial Sequence
  Description of Artificial Sequence: Synthetic oligonucleotide
  Target: ATXN1; (-) strand; PAM type: NRG; PAM sequence: CAG
ttcaagtgattcttctgcct

SEQ ID NO: 58262 - DNA, 20 bp, Artificial Sequence
  Description of Artificial Sequence: Synthetic oligonucleotide
  Target: ATXN1; (-) strand; PAM type: NRG; PAM sequence: AAG
aaactctggccctcgggttc

SEQ ID NO: 58263 - DNA, 20 bp, Artificial Sequence
  Description of Artificial Sequence: Synthetic oligonucleotide
  Target: ATXN1; (-) strand; PAM type: NRG; PAM sequence: GGG
cactgcaaactctggccctc

SEQ ID NO: 58264 - DNA, 20 bp, Artificial Sequence
  Description of Artificial Sequence: Synthetic oligonucleotide
  Target: ATXN1; (-) strand; PAM type: NRG; PAM sequence: CGG
tcactgcaaactctggccct

SEQ ID NO: 58265 - DNA, 20 bp, Artificial Sequence
  Description of Artificial Sequence: Synthetic oligonucleotide
  Target: ATXN1; (-) strand; PAM type: NRG; PAM sequence: TGG
tcttggctcactgcaaactc

SEQ ID NO: 58266 - DNA, 20 bp, Artificial Sequence
  Description of Artificial Sequence: Synthetic oligonucleotide
  Target: ATXN1; (-) strand; PAM type: NRG; PAM sequence: TGG
ggagtgcagtggtgtgatct

SEQ ID NO: 58267 - DNA, 20 bp, Artificial Sequence
  Description of Artificial Sequence: Synthetic oligonucleotide
  Target: ATXN1; (-) strand; PAM type: NRG; PAM sequence: TGG
tcgcccaggctggagtgcag

SEQ ID NO: 58268 - DNA, 20 bp, Artificial Sequence
  Description of Artificial Sequence: Synthetic oligonucleotide
  Target: ATXN1; (-) strand; PAM type: NRG; PAM sequence: CAG
ctgtcgcccaggctggagtg

SEQ ID NO: 58269 - DNA, 20 bp, Artificial Sequence
  Description of Artificial Sequence: Synthetic oligonucleotide
  Target: ATXN1; (-) strand; PAM type: NRG; PAM sequence: GAG
tcgctctgtcgcccaggctg

SEQ ID NO: 58270 - DNA, 20 bp, Artificial Sequence
  Description of Artificial Sequence: Synthetic oligonucleotide
  Target: ATXN1; (-) strand; PAM type: NRG; PAM sequence: TGG
tctcgctctgtcgcccaggc

SEQ ID NO: 58271 - DNA, 20 bp, Artificial Sequence
  Description of Artificial Sequence: Synthetic oligonucleotide
  Target: ATXN1; (-) strand; PAM type: NRG; PAM sequence: AGG
ggagtctcgctctgtcgccc

SEQ ID NO: 58272 - DNA, 20 bp, Artificial Sequence
  Description of Artificial Sequence: Synthetic oligonucleotide
  Target: ATXN1; (-) strand; PAM type: NRG; PAM sequence: CAG
cggagtctcgctctgtcgcc

SEQ ID NO: 58273 - DNA, 20 bp, Artificial Sequence
  Description of Artificial Sequence: Synthetic oligonucleotide
  Target: ATXN1; (-) strand; PAM type: NRG; PAM sequence: GAG
tggcctttttttttgagacg

SEQ ID NO: 58274 - DNA, 20 bp, Artificial Sequence
  Description of Artificial Sequence: Synthetic oligonucleotide
  Target: ATXN1; (-) strand; PAM type: NRG; PAM sequence: CGG
cctggcctttttttttgaga

SEQ ID NO: 58275 - DNA, 20 bp, Artificial Sequence
  Description of Artificial Sequence: Synthetic oligonucleotide
  Target: ATXN1; (-) strand; PAM type: NRG; PAM sequence: GAG
tgcacctggccttttttttt

SEQ ID NO: 58276 - DNA, 20 bp, Artificial Sequence
  Description of Artificial Sequence: Synthetic oligonucleotide
  Target: ATXN1; (-) strand; PAM type: NRG; PAM sequence: TGG
caggcatgaggcactgcacc

SEQ ID NO: 58277 - DNA, 20 bp, Artificial Sequence
  Description of Artificial Sequence: Synthetic oligonucleotide
  Target: ATXN1; (-) strand; PAM type: NRG; PAM sequence: AGG
gtgctgggattacaggcatg

SEQ ID NO: 58278 - DNA, 20 bp, Artificial Sequence
  Description of Artificial Sequence: Synthetic oligonucleotide
  Target: ATXN1; (-) strand; PAM type: NRG; PAM sequence: GAG
agtgctgggattacaggcat

SEQ ID NO: 58279 - DNA, 20 bp, Artificial Sequence
  Description of Artificial Sequence: Synthetic oligonucleotide
  Target: ATXN1; (-) strand; PAM type: NRG; PAM sequence: AGG
tcccaaagtgctgggattac

SEQ ID NO: 58280 - DNA, 20 bp, Artificial Sequence
  Description of Artificial Sequence: Synthetic oligonucleotide
  Target: ATXN1; (-) strand; PAM type: NRG; PAM sequence: CAG
ctcccaaagtgctgggatta

SEQ ID NO: 58281 - DNA, 20 bp, Artificial Sequence
  Description of Artificial Sequence: Synthetic oligonucleotide
  Target: ATXN1; (-) strand; PAM type: NRG; PAM sequence: GGG
ccttggcctcccaaagtgct

SEQ ID NO: 58282 - DNA, 20 bp, Artificial Sequence
  Description of Artificial Sequence: Synthetic oligonucleotide
  Target: ATXN1; (-) strand; PAM type: NRG; PAM sequence: TGG
gccttggcctcccaaagtgc

SEQ ID NO: 58283 - DNA, 20 bp, Artificial Sequence
  Description of Artificial Sequence: Synthetic oligonucleotide
  Target: ATXN1; (-) strand; PAM type: NRG; PAM sequence: AAG
ctgccggccttggcctccca

SEQ ID NO: 58284 - DNA, 20 bp, Artificial Sequence
  Description of Artificial Sequence: Synthetic oligonucleotide
  Target: ATXN1; (-) strand; PAM type: NRG; PAM sequence: TGG
ctcaggtgatctgccggcct

SEQ ID NO: 58285 - DNA, 20 bp, Artificial Sequence
  Description of Artificial Sequence: Synthetic oligonucleotide
  Target: ATXN1; (-) strand; PAM type: NRG; PAM sequence: CGG
cccgacctcaggtgatctgc

SEQ ID NO: 58286 - DNA, 20 bp, Artificial Sequence
  Description of Artificial Sequence: Synthetic oligonucleotide
  Target: ATXN1; (-) strand; PAM type: NRG; PAM sequence: AGG
ggtctccaactcccgacctc

SEQ ID NO: 58287 - DNA, 20 bp, Artificial Sequence
  Description of Artificial Sequence: Synthetic oligonucleotide
  Target: ATXN1; (-) strand; PAM type: NRG; PAM sequence: CAG
tggtctccaactcccgacct

SEQ ID NO: 58288 - DNA, 20 bp, Artificial Sequence
  Description of Artificial Sequence: Synthetic oligonucleotide
  Target: ATXN1; (-) strand; PAM type: NRG; PAM sequence: TGG
ttcctccatgttggtcgggc

SEQ ID NO: 58289 - DNA, 20 bp, Artificial Sequence
  Description of Artificial Sequence: Synthetic oligonucleotide
  Target: ATXN1; (-) strand; PAM type: NRG; PAM sequence: GGG
gaggttcctccatgttggtc

SEQ ID NO: 58290 - DNA, 20 bp, Artificial Sequence
  Description of Artificial Sequence: Synthetic oligonucleotide
  Target: ATXN1; (-) strand; PAM type: NRG; PAM sequence: CGG
tgaggttcctccatgttggt

SEQ ID NO: 58291 - DNA, 20 bp, Artificial Sequence
  Description of Artificial Sequence: Synthetic oligonucleotide
  Target: ATXN1; (-) strand; PAM type: NRG; PAM sequence: TGG
gagatgaggttcctccatgt

SEQ ID NO: 58292 - DNA, 20 bp, Artificial Sequence
  Description of Artificial Sequence: Synthetic oligonucleotide
  Target: ATXN1; (-) strand; PAM type: NRG; PAM sequence: AGG
ttacatttttagcagagatg

SEQ ID NO: 58293 - DNA, 20 bp, Artificial Sequence
  Description of Artificial Sequence: Synthetic oligonucleotide
  Target: ATXN1; (-) strand; PAM type: NRG; PAM sequence: GAG
tttacatttttagcagagat

SEQ ID NO: 58294 - DNA, 20 bp, Artificial Sequence
  Description of Artificial Sequence: Synthetic oligonucleotide
  Target: ATXN1; (-) strand; PAM type: NRG; PAM sequence: GAG
ctaattttacatttttagca

SEQ ID NO: 58295 - DNA, 20 bp, Artificial Sequence
  Description of Artificial Sequence: Synthetic oligonucleotide
  Target: ATXN1; (-) strand; PAM type: NRG; PAM sequence: CAG
ggctaattttacatttttag

SEQ ID NO: 58296 - DNA, 20 bp, Artificial Sequence
  Description of Artificial Sequence: Synthetic oligonucleotide
  Target: ATXN1; (-) strand; PAM type: NRG; PAM sequence: TAG
cccggctaattttacatttt

SEQ ID NO: 58297 - DNA, 20 bp, Artificial Sequence
  Description of Artificial Sequence: Synthetic oligonucleotide
  Target: ATXN1; (-) strand; PAM type: NRG; PAM sequence: CGG
caggcatgtgccaccacgcc

SEQ ID NO: 58298 - DNA, 20 bp, Artificial Sequence
  Description of Artificial Sequence: Synthetic oligonucleotide
  Target: ATXN1; (-) strand; PAM type: NRG; PAM sequence: AGG
ttctgagtagctgggattac

SEQ ID NO: 58299 - DNA, 20 bp, Artificial Sequence
  Description of Artificial Sequence: Synthetic oligonucleotide
  Target: ATXN1; (-) strand; PAM type: NRG; PAM sequence: CAG
cttctgagtagctgggatta

SEQ ID NO: 58300 - DNA, 20 bp, Artificial Sequence
  Description of Artificial Sequence: Synthetic oligonucleotide
  Target: ATXN1; (-) strand; PAM type: NRG; PAM sequence: GGG
cctcagccttctgagtagct

SEQ ID NO: 58301 - DNA, 20 bp, Artificial Sequence
  Description of Artificial Sequence: Synthetic oligonucleotide
  Target: ATXN1; (-) strand; PAM type: NRG; PAM sequence: TGG
gcctcagccttctgagtagc

SEQ ID NO: 58302 - DNA, 20 bp, Artificial Sequence
  Description of Artificial Sequence: Synthetic oligonucleotide
  Target: ATXN1; (-) strand; PAM type: NRG; PAM sequence: TAG
tcctgcctcagccttctgag

SEQ ID NO: 58303 - DNA, 20 bp, Artificial Sequence
  Description of Artificial Sequence: Synthetic oligonucleotide
  Target: ATXN1; (-) strand; PAM type: NRG; PAM sequence: GAG
ttctcctgcctcagccttct

SEQ ID NO: 58304 - DNA, 20 bp, Artificial Sequence
  Description of Artificial Sequence: Synthetic oligonucleotide
  Target: ATXN1; (-) strand; PAM type: NRG; PAM sequence: CAG
ttcaagtggttctcctgcct

SEQ ID NO: 58305 - DNA, 20 bp, Artificial Sequence
  Description of Artificial Sequence: Synthetic oligonucleotide
  Target: ATXN1; (-) strand; PAM type: NRG; PAM sequence: TGG
ctccgcctcctgggttcaag

SEQ ID NO: 58306 - DNA, 20 bp, Artificial Sequence
  Description of Artificial Sequence: Synthetic oligonucleotide
  Target: ATXN1; (-) strand; PAM type: NRG; PAM sequence: AAG
aacctccgcctcctgggttc

SEQ ID NO: 58307 - DNA, 20 bp, Artificial Sequence
  Description of Artificial Sequence: Synthetic oligonucleotide
  Target: ATXN1; (-) strand; PAM type: NRG; PAM sequence: GGG
cactgcaacctccgcctcct

SEQ ID NO: 58308 - DNA, 20 bp, Artificial Sequence
  Description of Artificial Sequence: Synthetic oligonucleotide
  Target: ATXN1; (-) strand; PAM type: NRG; PAM sequence: TGG
tcactgcaacctccgcctcc

SEQ ID NO: 58309 - DNA, 20 bp, Artificial Sequence
  Description of Artificial Sequence: Synthetic oligonucleotide
  Target: ATXN1; (-) strand; PAM type: NRG; PAM sequence: TGG
ggagagcaatggcacgatct

SEQ ID NO: 58310 - DNA, 20 bp, Artificial Sequence
  Description of Artificial Sequence: Synthetic oligonucleotide
  Target: ATXN1; (-) strand; PAM type: NRG; PAM sequence: TGG
ttgcccacgctggagagcaa

SEQ ID NO: 58311 - DNA, 20 bp, Artificial Sequence
  Description of Artificial Sequence: Synthetic oligonucleotide
  Target: ATXN1; (-) strand; PAM type: NRG; PAM sequence: GAG
ctcttgttgcccacgctgga

SEQ ID NO: 58312 - DNA, 20 bp, Artificial Sequence
  Description of Artificial Sequence: Synthetic oligonucleotide
  Target: ATXN1; (-) strand; PAM type: NRG; PAM sequence: GAG
tgctcttgttgcccacgctg

SEQ ID NO: 58313 - DNA, 20 bp, Artificial Sequence
  Description of Artificial Sequence: Synthetic oligonucleotide
  Target: ATXN1; (-) strand; PAM type: NRG; PAM sequence: TGG
tttgctcttgttgcccacgc

SEQ ID NO: 58314 - DNA, 20 bp, Artificial Sequence
  Description of Artificial Sequence: Synthetic oligonucleotide
  Target: ATXN1; (-) strand; PAM type: NRG; PAM sequence: GAG
ctttttttttttttgagacg

SEQ ID NO: 58315 - DNA, 20 bp, Artificial Sequence
  Description of Artificial Sequence: Synthetic oligonucleotide
  Target: ATXN1; (-) strand; PAM type: NRG; PAM sequence: CGG
ttctttttttttttttgaga

SEQ ID NO: 58316 - DNA, 20 bp, Artificial Sequence
  Description of Artificial Sequence: Synthetic oligonucleotide
  Target: ATXN1; (-) strand; PAM type: NRG; PAM sequence: GAG
ttctttcttttttttttttt

SEQ ID NO: 58317 - DNA, 20 bp, Artificial Sequence
  Description of Artificial Sequence: Synthetic oligonucleotide
  Target: ATXN1; (-) strand; PAM type: NRG; PAM sequence: GAG
gctttgagaatgggggaaaa

SEQ ID NO: 58318 - DNA, 20 bp, Artificial Sequence
  Description of Artificial Sequence: Synthetic oligonucleotide
  Target: ATXN1; (-) strand; PAM type: NRG; PAM sequence: AAG
ttgctttgagaatgggggaa

SEQ ID NO: 58319 - DNA, 20 bp, Artificial Sequence
  Description of Artificial Sequence: Synthetic oligonucleotide
  Target: ATXN1; (-) strand; PAM type: NRG; PAM sequence: GGG
tctgtttgctttgagaatgg

SEQ ID NO: 58320 - DNA, 20 bp, Artificial Sequence
  Description of Artificial Sequence: Synthetic oligonucleotide
  Target: ATXN1; (-) strand; PAM type: NRG; PAM sequence: GGG
ttctgtttgctttgagaatg

SEQ ID NO: 58321 - DNA, 20 bp, Artificial Sequence
  Description of Artificial Sequence: Synthetic oligonucleotide
  Target: ATXN1; (-) strand; PAM type: NRG; PAM sequence: GGG
tttctgtttgctttgagaat

SEQ ID NO: 58322 - DNA, 20 bp, Artificial Sequence
  Description of Artificial Sequence: Synthetic oligonucleotide
  Target: ATXN1; (-) strand; PAM type: NRG; PAM sequence: TGG
gtttctgtttgctttgagaa

SEQ ID NO: 58323 - DNA, 20 bp, Artificial Sequence
  Description of Artificial Sequence: Synthetic oligonucleotide
  Target: ATXN1; (-) strand; PAM type: NRG; PAM sequence: GAG
aatttgtttctgtttgcttt

SEQ ID NO: 58324 - DNA, 20 bp, Artificial Sequence
  Description of Artificial Sequence: Synthetic oligonucleotide
  Target: ATXN1; (-) strand; PAM type: NRG; PAM sequence: TAG
tgaagatagaaacaggagga

SEQ ID NO: 58325 - DNA, 20 bp, Artificial Sequence
  Description of Artificial Sequence: Synthetic oligonucleotide
  Target: ATXN1; (-) strand; PAM type: NRG; PAM sequence: AGG
agactgaagatagaaacagg

SEQ ID NO: 58326 - DNA, 20 bp, Artificial Sequence
  Description of Artificial Sequence: Synthetic oligonucleotide
  Target: ATXN1; (-) strand; PAM type: NRG; PAM sequence: GAG
aagactgaagatagaaacag

SEQ ID NO: 58327 - DNA, 20 bp, Artificial Sequence
  Description of Artificial Sequence: Synthetic oligonucleotide
  Target: ATXN1; (-) strand; PAM type: NRG; PAM sequence: AGG
gcaagactgaagatagaaac

SEQ ID NO: 58328 - DNA, 20 bp, Artificial Sequence
  Description of Artificial Sequence: Synthetic oligonucleotide
  Target: ATXN1; (-) strand; PAM type: NRG; PAM sequence: CAG
agcaagactgaagatagaaa

SEQ ID NO: 58329 - DNA, 20 bp, Artificial Sequence
  Description of Artificial Sequence: Synthetic oligonucleotide
  Target: ATXN1; (-) strand; PAM type: NRG; PAM sequence: TAG
aaagacagcaagactgaaga

SEQ ID NO: 58330 - DNA, 20 bp, Artificial Sequence
  Description of Artificial Sequence: Synthetic oligonucleotide
  Target: ATXN1; (-) strand; PAM type: NRG; PAM sequence: AAG
agacaaagacagcaagactg

SEQ ID NO: 58331 - DNA, 20 bp, Artificial Sequence
  Description of Artificial Sequence: Synthetic oligonucleotide
  Target: ATXN1; (-) strand; PAM type: NRG; PAM sequence: AAG
cttagaaagacaaagacagc

SEQ ID NO: 58332 - DNA, 20 bp, Artificial Sequence
  Description of Artificial Sequence: Synthetic oligonucleotide
  Target: ATXN1; (-) strand; PAM type: NRG; PAM sequence: CAG
gcatcttagaaagacaaaga

SEQ ID NO: 58333 - DNA, 20 bp, Artificial Sequence
  Description of Artificial Sequence: Synthetic oligonucleotide
  Target: ATXN1; (-) strand; PAM type: NRG; PAM sequence: AAG
tctggcatcttagaaagaca

SEQ ID NO: 58334 - DNA, 20 bp, Artificial Sequence
  Description of Artificial Sequence: Synthetic oligonucleotide
  Target: ATXN1; (-) strand; PAM type: NRG; PAM sequence: AAG
aacttctctggcatcttaga

SEQ ID NO: 58335 - DNA, 20 bp, Artificial Sequence
  Description of Artificial Sequence: Synthetic oligonucleotide
  Target: ATXN1; (-) strand; PAM type: NRG; PAM sequence: TAG
aggaaacttctctggcatct

SEQ ID NO: 58336 - DNA, 20 bp, Artificial Sequence
  Description of Artificial Sequence: Synthetic oligonucleotide
  Target: ATXN1; (-) strand; PAM type: NRG; PAM sequence: TGG
atatgcagaggaaacttctc

SEQ ID NO: 58337 - DNA, 20 bp, Artificial Sequence
  Description of Artificial Sequence: Synthetic oligonucleotide
  Target: ATXN1; (-) strand; PAM type: NRG; PAM sequence: AGG
agaatattttctatatgcag

SEQ ID NO: 58338 - DNA, 20 bp, Artificial Sequence
  Description of Artificial Sequence: Synthetic oligonucleotide
  Target: ATXN1; (-) strand; PAM type: NRG; PAM sequence: GAG
cagaatattttctatatgca

SEQ ID NO: 58339 - DNA, 20 bp, Artificial Sequence
  Description of Artificial Sequence: Synthetic oligonucleotide
  Target: ATXN1; (-) strand; PAM type: NRG; PAM sequence: CAG
cccagaatattttctatatg

SEQ ID NO: 58340 - DNA, 20 bp, Artificial Sequence
  Description of Artificial Sequence: Synthetic oligonucleotide
  Target: ATXN1; (-) strand; PAM type: NRG; PAM sequence: CAG
ggcacaagacagacaaatcc

SEQ ID NO: 58341 - DNA, 20 bp, Artificial Sequence
  Description of Artificial Sequence: Synthetic oligonucleotide
  Target: ATXN1; (-) strand; PAM type: NRG; PAM sequence: CAG
tccctagtgagggcacaaga

SEQ ID NO: 58342 - DNA, 20 bp, Artificial Sequence
  Description of Artificial Sequence: Synthetic oligonucleotide
  Target: ATXN1; (-) strand; PAM type: NRG; PAM sequence: AAG
gacttccctagtgagggcac

SEQ ID NO: 58343 - DNA, 20 bp, Artificial Sequence
  Description of Artificial Sequence: Synthetic oligonucleotide
  Target: ATXN1; (-) strand; PAM type: NRG; PAM sequence: GGG
taaggggacttccctagtga

SEQ ID NO: 58344 - DNA, 20 bp, Artificial Sequence
  Description of Artificial Sequence: Synthetic oligonucleotide
  Target: ATXN1; (-) strand; PAM type: NRG; PAM sequence: AGG
ctaaggggacttccctagtg

SEQ ID NO: 58345 - DNA, 20 bp, Artificial Sequence
  Description of Artificial Sequence: Synthetic oligonucleotide
  Target: ATXN1; (-) strand; PAM type: NRG; PAM sequence: GAG
cctaaggggacttccctagt

SEQ ID NO: 58346 - DNA, 20 bp, Artificial Sequence
  Description of Artificial Sequence: Synthetic oligonucleotide
  Target: ATXN1; (-) strand; PAM type: NRG; PAM sequence: TAG
gacgcctaaggggacttccc

SEQ ID NO: 58347 - DNA, 20 bp, Artificial Sequence
  Description of Artificial Sequence: Synthetic oligonucleotide
  Target: ATXN1; (-) strand; PAM type: NRG; PAM sequence: GGG
ctgacattcggacgcctaag

SEQ ID NO: 58348 - DNA, 20 bp, Artificial Sequence
  Description of Artificial Sequence: Synthetic oligonucleotide
  Target: ATXN1; (-) strand; PAM type: NRG; PAM sequence: GGG
cctgacattcggacgcctaa

SEQ ID NO: 58349 - DNA, 20 bp, Artificial Sequence
  Description of Artificial Sequence: Synthetic oligonucleotide
  Target: ATXN1; (-) strand; PAM type: NRG; PAM sequence: AGG
gcctgacattcggacgccta

SEQ ID NO: 58350 - DNA, 20 bp, Artificial Sequence
  Description of Artificial Sequence: Synthetic oligonucleotide
  Target: ATXN1; (-) strand; PAM type: NRG; PAM sequence: AAG
ggcctgacattcggacgcct

SEQ ID NO: 58351 - DNA, 20 bp, Artificial Sequence
  Description of Artificial Sequence: Synthetic oligonucleotide
  Target: ATXN1; (-) strand; PAM type: NRG; PAM sequence: CGG
tctaagaacggcctgacatt

SEQ ID NO: 58352 - DNA, 20 bp, Artificial Sequence
  Description of Artificial Sequence: Synthetic oligonucleotide
  Target: ATXN1; (-) strand; PAM type: NRG; PAM sequence: CGG
gcaaaaaggcaatctaagaa

SEQ ID NO: 58353 - DNA, 20 bp, Artificial Sequence
  Description of Artificial Sequence: Synthetic oligonucleotide
  Target: ATXN1; (-) strand; PAM type: NRG; PAM sequence: AAG
tataggcaaaaaggcaatct

SEQ ID NO: 58354 - DNA, 20 bp, Artificial Sequence
  Description of Artificial Sequence: Synthetic oligonucleotide
  Target: ATXN1; (-) strand; PAM type: NRG; PAM sequence: AGG
ctcgtgtgttataggcaaaa

SEQ ID NO: 58355 - DNA, 20 bp, Artificial Sequence
  Description of Artificial Sequence: Synthetic oligonucleotide
  Target: ATXN1; (-) strand; PAM type: NRG; PAM sequence: AAG
cctcgtgtgttataggcaaa

SEQ ID NO: 58356 - DNA, 20 bp, Artificial Sequence
  Description of Artificial Sequence: Synthetic oligonucleotide
  Target: ATXN1; (-) strand; PAM type: NRG; PAM sequence: AGG
attacaacctcgtgtgttat

SEQ ID NO: 58357 - DNA, 20 bp, Artificial Sequence
  Description of Artificial Sequence: Synthetic oligonucleotide
  Target: ATXN1; (-) strand; PAM type: NRG; PAM sequence: TAG
cattacaacctcgtgtgtta

SEQ ID NO: 58358 - DNA, 20 bp, Artificial Sequence
  Description of Artificial Sequence: Synthetic oligonucleotide
  Target: ATXN1; (-) strand; PAM type: NRG; PAM sequence: GAG
taggcatctgtcttgttcat

SEQ ID NO: 58359 - DNA, 20 bp, Artificial Sequence
  Description of Artificial Sequence: Synthetic oligonucleotide
  Target: ATXN1; (-) strand; PAM type: NRG; PAM sequence: AGG
agaattctacttgctatagt

SEQ ID NO: 58360 - DNA, 20 bp, Artificial Sequence
  Description of Artificial Sequence: Synthetic oligonucleotide
  Target: ATXN1; (-) strand; PAM type: NRG; PAM sequence: TAG
cagaattctacttgctatag

SEQ ID NO: 58361 - DNA, 20 bp, Artificial Sequence
  Description of Artificial Sequence: Synthetic oligonucleotide
  Target: ATXN1; (-) strand; PAM type: NRG; PAM sequence: TAG
ttgcagaattctacttgcta

SEQ ID NO: 58362 - DNA, 20 bp, Artificial Sequence
  Description of Artificial Sequence: Synthetic oligonucleotide
  Target: ATXN1; (-) strand; PAM type: NRG; PAM sequence: CAG
atgtcattgaatgtcgtttg

SEQ ID NO: 58363 - DNA, 20 bp, Artificial Sequence
  Description of Artificial Sequence: Synthetic oligonucleotide
  Target: ATXN1; (-) strand; PAM type: NRG; PAM sequence: TGG
agttgcaggtcttctctctg

SEQ ID NO: 58364 - DNA, 20 bp, Artificial Sequence
  Description of Artificial Sequence: Synthetic oligonucleotide
  Target: ATXN1; (-) strand; PAM type: NRG; PAM sequence: AGG
tttcttttctaccgagttgc

SEQ ID NO: 58365 - DNA, 20 bp, Artificial Sequence
  Description of Artificial Sequence: Synthetic oligonucleotide
  Target: ATXN1; (-) strand; PAM type: NRG; PAM sequence: CAG
gtttcttttctaccgagttg

SEQ ID NO: 58366 - DNA, 20 bp, Artificial Sequence
  Description of Artificial Sequence: Synthetic oligonucleotide
  Target: ATXN1; (-) strand; PAM type: NRG; PAM sequence: GAG
catcgtgtttcttttctacc

SEQ ID NO: 58367 - DNA, 20 bp, Artificial Sequence
  Description of Artificial Sequence: Synthetic oligonucleotide
  Target: ATXN1; (-) strand; PAM type: NRG; PAM sequence: CAG
aaagctcacagtctggtgct

SEQ ID NO: 58368 - DNA, 20 bp, Artificial Sequence
  Description of Artificial Sequence: Synthetic oligonucleotide
  Target: ATXN1; (-) strand; PAM type: NRG; PAM sequence: TGG
ccctcaaaaagctcacagtc

SEQ ID NO: 58369 - DNA, 20 bp, Artificial Sequence
  Description of Artificial Sequence: Synthetic oligonucleotide
  Target: ATXN1; (-) strand; PAM type: NRG; PAM sequence: CAG
ctttaccctcaaaaagctca

SEQ ID NO: 58370 - DNA, 20 bp, Artificial Sequence
  Description of Artificial Sequence: Synthetic oligonucleotide
  Target: ATXN1; (-) strand; PAM type: NRG; PAM sequence: AAG
acataatctttaccctcaaa

SEQ ID NO: 58371 - DNA, 20 bp, Artificial Sequence
  Description of Artificial Sequence: Synthetic oligonucleotide
  Target: ATXN1; (-) strand; PAM type: NRG; PAM sequence: GAG
agcaatacaccctgaactcg

SEQ ID NO: 58372 - DNA, 20 bp, Artificial Sequence
  Description of Artificial Sequence: Synthetic oligonucleotide
  Target: ATXN1; (-) strand; PAM type: NRG; PAM sequence: CGG
ccagcaatacaccctgaact

SEQ ID NO: 58373 - DNA, 20 bp, Artificial Sequence
  Description of Artificial Sequence: Synthetic oligonucleotide
  Target: ATXN1; (-) strand; PAM type: NRG; PAM sequence: CAG
cctaaatatttattgaatgc

SEQ ID NO: 58374 - DNA, 20 bp, Artificial Sequence
  Description of Artificial Sequence: Synthetic oligonucleotide
  Target: ATXN1; (-) strand; PAM type: NRG; PAM sequence: TAG
tttctcatatcattcattac

SEQ ID NO: 58375 - DNA, 20 bp, Artificial Sequence
  Description of Artificial Sequence: Synthetic oligonucleotide
  Target: ATXN1; (-) strand; PAM type: NRG; PAM sequence: AGG
gctatcaacaaaatctggaa

SEQ ID NO: 58376 - DNA, 20 bp, Artificial Sequence
  Description of Artificial Sequence: Synthetic oligonucleotide
  Target: ATXN1; (-) strand; PAM type: NRG; PAM sequence: AAG
tgctatcaacaaaatctgga

SEQ ID NO: 58377 - DNA, 20 bp, Artificial Sequence
  Description of Artificial Sequence: Synthetic oligonucleotide
  Target: ATXN1; (-) strand; PAM type: NRG; PAM sequence: TGG
cttatgctatcaacaaaatc

SEQ ID NO: 58378 - DNA, 20 bp, Artificial Sequence
  Description of Artificial Sequence: Synthetic oligonucleotide
  Target: ATXN1; (-) strand; PAM type: NRG; PAM sequence: CAG
tcctaaatgttttccttttc

SEQ ID NO: 58379 - DNA, 20 bp, Artificial Sequence
  Description of Artificial Sequence: Synthetic oligonucleotide
  Target: ATXN1; (-) strand; PAM type: NRG; PAM sequence: TGG
gacacacaatcactcagaga

SEQ ID NO: 58380 - DNA, 20 bp, Artificial Sequence
  Description of Artificial Sequence: Synthetic oligonucleotide
  Target: ATXN1; (-) strand; PAM type: NRG; PAM sequence: GAG
gactgacacacaatcactca

SEQ ID NO: 58381 - DNA, 20 bp, Artificial Sequence
  Description of Artificial Sequence: Synthetic oligonucleotide
  Target: ATXN1; (-) strand; PAM type: NRG; PAM sequence: CAG
aagactgacacacaatcact

SEQ ID NO: 58382 - DNA, 20 bp, Artificial Sequence
  Description of Artificial Sequence: Synthetic oligonucleotide
  Target: ATXN1; (-) strand; PAM type: NRG; PAM sequence: AAG
aaaattcagtttttcctctg

SEQ ID NO: 58383 - DNA, 20 bp, Artificial Sequence
  Description of Artificial Sequence: Synthetic oligonucleotide
  Target: ATXN1; (-) strand; PAM type: NRG; PAM sequence: CAG
ggctttttaaaagaaaaatt

SEQ ID NO: 58384 - DNA, 20 bp, Artificial Sequence
  Description of Artificial Sequence: Synthetic oligonucleotide
  Target: ATXN1; (-) strand; PAM type: NRG; PAM sequence: AAG
ctgtcccactggctttttaa

SEQ ID NO: 58385 - DNA, 20 bp, Artificial Sequence
  Description of Artificial Sequence: Synthetic oligonucleotide
  Target: ATXN1; (-) strand; PAM type: NRG; PAM sequence: TGG
ttcagaaatgactgtcccac

SEQ ID NO: 58386 - DNA, 20 bp, Artificial Sequence
  Description of Artificial Sequence: Synthetic oligonucleotide
  Target: ATXN1; (-) strand; PAM type: NRG; PAM sequence: CAG
ttgattcacaaatgagtttt

SEQ ID NO: 58387 - DNA, 20 bp, Artificial Sequence
  Description of Artificial Sequence: Synthetic oligonucleotide
  Target: ATXN1; (-) strand; PAM type: NRG; PAM sequence: GAG
tctggttttgattcacaaat

SEQ ID NO: 58388 - DNA, 20 bp, Artificial Sequence
  Description of Artificial Sequence: Synthetic oligonucleotide
  Target: ATXN1; (-) strand; PAM type: NRG; PAM sequence: TGG
ctcagtcacttggtctactc

SEQ ID NO: 58389 - DNA, 20 bp, Artificial Sequence
  Description of Artificial Sequence: Synthetic oligonucleotide
  Target: ATXN1; (-) strand; PAM type: NRG; PAM sequence: TGG
cattggaatgctcagtcact

SEQ ID NO: 58390 - DNA, 20 bp, Artificial Sequence
  Description of Artificial Sequence: Synthetic oligonucleotide
  Target: ATXN1; (-) strand; PAM type: NRG; PAM sequence: CAG
taccctttcattggaatgct

SEQ ID NO: 58391 - DNA, 20 bp, Artificial Sequence
  Description of Artificial Sequence: Synthetic oligonucleotide
  Target: ATXN1; (-) strand; PAM type: NRG; PAM sequence: TGG
tgctttttttaccctttcat

SEQ ID NO: 58392 - DNA, 20 bp, Artificial Sequence
  Description of Artificial Sequence: Synthetic oligonucleotide
  Target: ATXN1; (-) strand; PAM type: NRG; PAM sequence: CAG
agtgagagtgggaaaaaaat

SEQ ID NO: 58393 - DNA, 20 bp, Artificial Sequence
  Description of Artificial Sequence: Synthetic oligonucleotide
  Target: ATXN1; (-) strand; PAM type: NRG; PAM sequence: GGG
aatctcacaccagtgagagt

SEQ ID NO: 58394 - DNA, 20 bp, Artificial Sequence
  Description of Artificial Sequence: Synthetic oligonucleotide
  Target: ATXN1; (-) strand; PAM type: NRG; PAM sequence: TGG
aaatctcacaccagtgagag

SEQ ID NO: 58395 - DNA, 20 bp, Artificial Sequence
  Description of Artificial Sequence: Synthetic oligonucleotide
  Target: ATXN1; (-) strand; PAM type: NRG; PAM sequence: GAG
ttaaaatctcacaccagtga

SEQ ID NO: 58396 - DNA, 20 bp, Artificial Sequence
  Description of Artificial Sequence: Synthetic oligonucleotide
  Target: ATXN1; (-) strand; PAM type: NRG; PAM sequence: GAG
ctttaaaatctcacaccagt

SEQ ID NO: 58397 - DNA, 20 bp, Artificial Sequence
  Description of Artificial Sequence: Synthetic oligonucleotide
  Target: ATXN1; (-) strand; PAM type: NRG; PAM sequence: CAG
atgtctttaaaatctcacac

SEQ ID NO: 58398 - DNA, 20 bp, Artificial Sequence
  Description of Artificial Sequence: Synthetic oligonucleotide
  Target: ATXN1; (-) strand; PAM type: NRG; PAM sequence: AGG
acgccatccttttgacagga

SEQ ID NO: 58399 - DNA, 20 bp, Artificial Sequence
  Description of Artificial Sequence: Synthetic oligonucleotide
  Target: ATXN1; (-) strand; PAM type: NRG; PAM sequence: AAG
gacgccatccttttgacagg

SEQ ID NO: 58400 - DNA, 20 bp, Artificial Sequence
  Description of Artificial Sequence: Synthetic oligonucleotide
  Target: ATXN1; (-) strand; PAM type: NRG; PAM sequence: AGG
tttgacgccatccttttgac

SEQ ID NO: 58401 - DNA, 20 bp, Artificial Sequence
  Description of Artificial Sequence: Synthetic oligonucleotide
  Target: ATXN1; (-) strand; PAM type: NRG; PAM sequence: CAG
atttgacgccatccttttga

SEQ ID NO: 58402 - DNA, 20 bp, Artificial Sequence
  Description of Artificial Sequence: Synthetic oligonucleotide
  Target: ATXN1; (-) strand; PAM type: NRG; PAM sequence: AGG
caagagggatatgaagaggc

SEQ ID NO: 58403 - DNA, 20 bp, Artificial Sequence
  Description of Artificial Sequence: Synthetic oligonucleotide
  Target: ATXN1; (-) strand; PAM type: NRG; PAM sequence: CAG
acaagagggatatgaagagg

SEQ ID NO: 58404 - DNA, 20 bp, Artificial Sequence
  Description of Artificial Sequence: Synthetic oligonucleotide
  Target: ATXN1; (-) strand; PAM type: NRG; PAM sequence: AGG
agaacaagagggatatgaag

SEQ ID NO: 58405 - DNA, 20 bp, Artificial Sequence
  Description of Artificial Sequence: Synthetic oligonucleotide
  Target: ATXN1; (-) strand; PAM type: NRG; PAM sequence: GAG
aagaacaagagggatatgaa

SEQ ID NO: 58406 - DNA, 20 bp, Artificial Sequence
  Description of Artificial Sequence: Synthetic oligonucleotide
  Target: ATXN1; (-) strand; PAM type: NRG; PAM sequence: AAG
ataagaacaagagggatatg

SEQ ID NO: 58407 - DNA, 20 bp, Artificial Sequence
  Description of Artificial Sequence: Synthetic oligonucleotide
  Target: ATXN1; (-) strand; PAM type: NRG; PAM sequence: GGG
gatgtactataagaacaaga

SEQ ID NO: 58408 - DNA, 20 bp, Artificial Sequence
  Description of Artificial Sequence: Synthetic oligonucleotide
  Target: ATXN1; (-) strand; PAM type: NRG; PAM sequence: AGG
agatgtactataagaacaag

SEQ ID NO: 58409 - DNA, 20 bp, Artificial Sequence
  Description of Artificial Sequence: Synthetic oligonucleotide
  Target: ATXN1; (-) strand; PAM type: NRG; PAM sequence: GAG
tagatgtactataagaacaa

SEQ ID NO: 58410 - DNA, 20 bp, Artificial Sequence
  Description of Artificial Sequence: Synthetic oligonucleotide
  Target: ATXN1; (-) strand; PAM type: NRG; PAM sequence: AAG
aatagatgtactataagaac

SEQ ID NO: 58411 - DNA, 20 bp, Artificial Sequence
  Description of Artificial Sequence: Synthetic oligonucleotide
  Target: ATXN1; (-) strand; PAM type: NRG; PAM sequence: AAG
gacaagaatagatgtactat

SEQ ID NO: 58412 - DNA, 20 bp, Artificial Sequence
  Description of Artificial Sequence: Synthetic oligonucleotide
  Target: ATXN1; (-) strand; PAM type: NRG; PAM sequence: TAG
gtggtggaatgagacaagaa

SEQ ID NO: 58413 - DNA, 20 bp, Artificial Sequence
  Description of Artificial Sequence: Synthetic oligonucleotide
  Target: ATXN1; (-) strand; PAM type: NRG; PAM sequence: AAG
ttgttgtggtggaatgagac

SEQ ID NO: 58414 - DNA, 20 bp, Artificial Sequence
  Description of Artificial Sequence: Synthetic oligonucleotide
  Target: ATXN1; (-) strand; PAM type: NRG; PAM sequence: GAG
aaaacttgttgtggtggaat

SEQ ID NO: 58415 - DNA, 20 bp, Artificial Sequence
  Description of Artificial Sequence: Synthetic oligonucleotide
  Target: ATXN1; (-) strand; PAM type: NRG; PAM sequence: TGG
tattataaaacttgttgtgg

SEQ ID NO: 58416 - DNA, 20 bp, Artificial Sequence
  Description of Artificial Sequence: Synthetic oligonucleotide
  Target: ATXN1; (-) strand; PAM type: NRG; PAM sequence: TGG
tgctattataaaacttgttg

SEQ ID NO: 58417 - DNA, 20 bp, Artificial Sequence
  Description of Artificial Sequence: Synthetic oligonucleotide
  Target: ATXN1; (-) strand; PAM type: NRG; PAM sequence: AAG
gtaacattttcaaaagataa

SEQ ID NO: 58418 - DNA, 20 bp, Artificial Sequence
  Description of Artificial Sequence: Synthetic oligonucleotide
  Target: ATXN1; (-) strand; PAM type: NRG; PAM sequence: AAG
attgtctgtaacattttcaa

SEQ ID NO: 58419 - DNA, 20 bp, Artificial Sequence
  Description of Artificial Sequence: Synthetic oligonucleotide
  Target: ATXN1; (-) strand; PAM type: NRG; PAM sequence: GAG
gaacttttaaatcagtaata

SEQ ID NO: 58420 - DNA, 20 bp, Artificial Sequence
  Description of Artificial Sequence: Synthetic oligonucleotide
  Target: ATXN1; (-) strand; PAM type: NRG; PAM sequence: TAG
ttgaacttttaaatcagtaa

SEQ ID NO: 58421 - DNA, 20 bp, Artificial Sequence
  Description of Artificial Sequence: Synthetic oligonucleotide
  Target: ATXN1; (-) strand; PAM type: NRG; PAM sequence: CAG
taaatcttgaacttttaaat

SEQ ID NO: 58422 - DNA, 20 bp, Artificial Sequence
  Description of Artificial Sequence: Synthetic oligonucleotide
  Target: ATXN1; (-) strand; PAM type: NRG; PAM sequence: CAG
ggtttacgctaaactttcat

SEQ ID NO: 58423 - DNA, 20 bp, Artificial Sequence
  Description of Artificial Sequence: Synthetic oligonucleotide
  Target: ATXN1; (-) strand; PAM type: NRG; PAM sequence: AGG
aaaatctagtcagctaaagt

SEQ ID NO: 58424 - DNA, 20 bp, Artificial Sequence
  Description of Artificial Sequence: Synthetic oligonucleotide
  Target: ATXN1; (-) strand; PAM type: NRG; PAM sequence: TAG
aaaaatctagtcagctaaag

SEQ ID NO: 58425 - DNA, 20 bp, Artificial Sequence
  Description of Artificial Sequence: Synthetic oligonucleotide
  Target: ATXN1; (-) strand; PAM type: NRG; PAM sequence: AAG
ttaaaaaatctagtcagcta

SEQ ID NO: 58426 - DNA, 20 bp, Artificial Sequence
  Description of Artificial Sequence: Synthetic oligonucleotide
  Target: ATXN1; (-) strand; PAM type: NRG; PAM sequence: CAG
aaccttttaaaaaatctagt

SEQ ID NO: 58427 - DNA, 20 bp, Artificial Sequence
  Description of Artificial Sequence: Synthetic oligonucleotide
  Target: ATXN1; (-) strand; PAM type: NRG; PAM sequence: TAG
cctaaaccttttaaaaaatc

SEQ ID NO: 58428 - DNA, 20 bp, Artificial Sequence
  Description of Artificial Sequence: Synthetic oligonucleotide
  Target: ATXN1; (-) strand; PAM type: NRG; PAM sequence: AGG
agtttaataatgcttaaagg

SEQ ID NO: 58429 - DNA, 20 bp, Artificial Sequence
  Description of Artificial Sequence: Synthetic oligonucleotide
  Target: ATXN1; (-) strand; PAM type: NRG; PAM sequence: GAG
aagtttaataatgcttaaag

SEQ ID NO: 58430 - DNA, 20 bp, Artificial Sequence
  Description of Artificial Sequence: Synthetic oligonucleotide
  Target: ATXN1; (-) strand; PAM type: NRG; PAM sequence: AGG
gtaagtttaataatgcttaa

SEQ ID NO: 58431 - DNA, 20 bp, Artificial Sequence
  Description of Artificial Sequence: Synthetic oligonucleotide
  Target: ATXN1; (-) strand; PAM type: NRG; PAM sequence: AAG
agtaagtttaataatgctta

SEQ ID NO: 58432 - DNA, 20 bp, Artificial Sequence
  Description of Artificial Sequence: Synthetic oligonucleotide
  Target: ATXN1; (-) strand; PAM type: NRG; PAM sequence: AAG
gcaaatgatggtgataaagt

SEQ ID NO: 58433 - DNA, 20 bp, Artificial Sequence
  Description of Artificial Sequence: Synthetic oligonucleotide
  Target: ATXN1; (-) strand; PAM type: NRG; PAM sequence: AAG
ggatgcaaatgatggtgata

SEQ ID NO: 58434 - DNA, 20 bp, Artificial Sequence
  Description of Artificial Sequence: Synthetic oligonucleotide
  Target: ATXN1; (-) strand; PAM type: NRG; PAM sequence: TGG
tgttgtctggatgcaaatga

SEQ ID NO: 58435 - DNA, 20 bp, Artificial Sequence
  Description of Artificial Sequence: Synthetic oligonucleotide
  Target: ATXN1; (-) strand; PAM type: NRG; PAM sequence: TGG
ctttcgactagcatgttgtc

SEQ ID NO: 58436 - DNA, 20 bp, Artificial Sequence
  Description of Artificial Sequence: Synthetic oligonucleotide
  Target: ATXN1; (-) strand; PAM type: NRG; PAM sequence: TAG
aagactaaatcactttcgac

SEQ ID NO: 58437 - DNA, 20 bp, Artificial Sequence
  Description of Artificial Sequence: Synthetic oligonucleotide
  Target: ATXN1; (-) strand; PAM type: NRG; PAM sequence: AAG
ttttataaagaattacttta

SEQ ID NO: 58438 - DNA, 20 bp, Artificial Sequence
  Description of Artificial Sequence: Synthetic oligonucleotide
  Target: ATXN1; (-) strand; PAM type: NRG; PAM sequence: AAG
aaatctaataaaattttata

SEQ ID NO: 58439 - DNA, 20 bp, Artificial Sequence
  Description of Artificial Sequence: Synthetic oligonucleotide
  Target: ATXN1; (-) strand; PAM type: NRG; PAM sequence: CAG
ccaaaaacagaccttgaacc

SEQ ID NO: 58440 - DNA, 20 bp, Artificial Sequence
  Description of Artificial Sequence: Synthetic oligonucleotide
  Target: ATXN1; (-) strand; PAM type: NRG; PAM sequence: CAG
caagtgaaacacaccaaaaa

SEQ ID NO: 58441 - DNA, 20 bp, Artificial Sequence
  Description of Artificial Sequence: Synthetic oligonucleotide
  Target: ATXN1; (-) strand; PAM type: NRG; PAM sequence: AAG
atgattatgtaagattacac

SEQ ID NO: 58442 - DNA, 20 bp, Artificial Sequence
  Description of Artificial Sequence: Synthetic oligonucleotide
  Target: ATXN1; (-) strand; PAM type: NRG; PAM sequence: AAG
gaaaagtaacatgattatgt

SEQ ID NO: 58443 - DNA, 20 bp, Artificial Sequence
  Description of Artificial Sequence: Synthetic oligonucleotide
  Target: ATXN1; (-) strand; PAM type: NRG; PAM sequence: AAG
gatgagactgatgctgagaa

SEQ ID NO: 58444 - DNA, 20 bp, Artificial Sequence
  Description of Artificial Sequence: Synthetic oligonucleotide
  Target: ATXN1; (-) strand; PAM type: NRG; PAM sequence: GAG
tcaatgatgagactgatgct

SEQ ID NO: 58445 - DNA, 20 bp, Artificial Sequence
  Description of Artificial Sequence: Synthetic oligonucleotide
  Target: ATXN1; (-) strand; PAM type: NRG; PAM sequence: GAG
gtaccccctctatcaatgat

SEQ ID NO: 58446 - DNA, 20 bp, Artificial Sequence
  Description of Artificial Sequence: Synthetic oligonucleotide
  Target: ATXN1; (-) strand; PAM type: NRG; PAM sequence: GAG
tcggcatcccaaagtgctga

SEQ ID NO: 58447 - DNA, 20 bp, Artificial Sequence
  Description of Artificial Sequence: Synthetic oligonucleotide
  Target: ATXN1; (-) strand; PAM type: NRG; PAM sequence: GAG
cctcggcatcccaaagtgct

SEQ ID NO: 58448 - DNA, 20 bp, Artificial Sequence
  Description of Artificial Sequence: Synthetic oligonucleotide
  Target: ATXN1; (-) strand; PAM type: NRG; PAM sequence: AAG
ccacccgcctcggcatccca

SEQ ID NO: 58449 - DNA, 20 bp, Artificial Sequence
  Description of Artificial Sequence: Synthetic oligonucleotide
  Target: ATXN1; (-) strand; PAM type: NRG; PAM sequence: CGG
accttgtgatccacccgcct

SEQ ID NO: 58450 - DNA, 20 bp, Artificial Sequence
  Description of Artificial Sequence: Synthetic oligonucleotide
  Target: ATXN1; (-) strand; PAM type: NRG; PAM sequence: TGG
tttcaccgtgttagccagga

SEQ ID NO: 58451 - DNA, 20 bp, Artificial Sequence
  Description of Artificial Sequence: Synthetic oligonucleotide
  Target: ATXN1; (-) strand; PAM type: NRG; PAM sequence: AGG
ggggtttcaccgtgttagcc

SEQ ID NO: 58452 - DNA, 20 bp, Artificial Sequence
  Description of Artificial Sequence: Synthetic oligonucleotide
  Target: ATXN1; (-) strand; PAM type: NRG; PAM sequence: CAG
cggggtttcaccgtgttagc

SEQ ID NO: 58453 - DNA, 20 bp, Artificial Sequence
  Description of Artificial Sequence: Synthetic oligonucleotide
  Target: ATXN1; (-) strand; PAM type: NRG; PAM sequence: TAG
gagacggggtttcaccgtgt

SEQ ID NO: 58454 - DNA, 20 bp, Artificial Sequence
  Description of Artificial Sequence: Synthetic oligonucleotide
  Target: ATXN1; (-) strand; PAM type: NRG; PAM sequence: GGG
ttgtatttttagtagagacg

SEQ ID NO: 58455 - DNA, 20 bp, Artificial Sequence
  Description of Artificial Sequence: Synthetic oligonucleotide
  Target: ATXN1; (-) strand; PAM type: NRG; PAM sequence: GGG
tttgtatttttagtagagac

SEQ ID NO: 58456 - DNA, 20 bp, Artificial Sequence
  Description of Artificial Sequence: Synthetic oligonucleotide
  Target: ATXN1; (-) strand; PAM type: NRG; PAM sequence: CGG
ttttgtatttttagtagaga

SEQ ID NO: 58457 - DNA, 20 bp, Artificial Sequence
  Description of Artificial Sequence: Synthetic oligonucleotide
  Target: ATXN1; (-) strand; PAM type: NRG; PAM sequence: GAG
atttttttgtatttttagta

SEQ ID NO: 58458 - DNA, 20 bp, Artificial Sequence
  Description of Artificial Sequence: Synthetic oligonucleotide
  Target: ATXN1; (-) strand; PAM type: NRG; PAM sequence: TAG
taatttttttgtatttttag

SEQ ID NO: 58459 - DNA, 20 bp, Artificial Sequence
  Description of Artificial Sequence: Synthetic oligonucleotide
  Target: ATXN1; (-) strand; PAM type: NRG; PAM sequence: TAG
agctaatttttttgtatttt

SEQ ID NO: 58460 - DNA, 20 bp, Artificial Sequence
  Description of Artificial Sequence: Synthetic oligonucleotide
  Target: ATXN1; (-) strand; PAM type: NRG; PAM sequence: CAG
caggcacctgccactacgcc

SEQ ID NO: 58461 - DNA, 20 bp, Artificial Sequence
  Description of Artificial Sequence: Synthetic oligonucleotide
  Target: ATXN1; (-) strand; PAM type: NRG; PAM sequence: AGG
tcctgagtagctgggactac

SEQ ID NO: 58462 - DNA, 20 bp, Artificial Sequence
  Description of Artificial Sequence: Synthetic oligonucleotide
  Target: ATXN1; (-) strand; PAM type: NRG; PAM sequence: CAG
ctcctgagtagctgggacta

SEQ ID NO: 58463 - DNA, 20 bp, Artificial Sequence
  Description of Artificial Sequence: Synthetic oligonucleotide
  Target: ATXN1; (-) strand; PAM type: NRG; PAM sequence: GGG
cctcagcctcctgagtagct

SEQ ID NO: 58464 - DNA, 20 bp, Artificial Sequence
  Description of Artificial Sequence: Synthetic oligonucleotide
  Target: ATXN1; (-) strand; PAM type: NRG; PAM sequence: TGG
gcctcagcctcctgagtagc

SEQ ID NO: 58465 - DNA, 20 bp, Artificial Sequence
  Description of Artificial Sequence: Synthetic oligonucleotide
  Target: ATXN1; (-) strand; PAM type: NRG; PAM sequence: TAG
tcctgcctcagcctcctgag

SEQ ID NO: 58466 - DNA, 20 bp, Artificial Sequence
  Description of Artificial Sequence: Synthetic oligonucleotide
  Target: ATXN1; (-) strand; PAM type: NRG; PAM sequence: GAG
ttctcctgcctcagcctcct

SEQ ID NO: 58467 - DNA, 20 bp, Artificial Sequence
  Description of Artificial Sequence: Synthetic oligonucleotide
  Target: ATXN1; (-) strand; PAM type: NRG; PAM sequence: CAG
ttcaagcgattctcctgcct

SEQ ID NO: 58468 - DNA, 20 bp, Artificial Sequence
  Description of Artificial Sequence: Synthetic oligonucleotide
  Target: ATXN1; (-) strand; PAM type: NRG; PAM sequence: AAG
aacctctgcctcccgggttc

SEQ ID NO: 58469 - DNA, 20 bp, Artificial Sequence
  Description of Artificial Sequence: Synthetic oligonucleotide
  Target: ATXN1; (-) strand; PAM type: NRG; PAM sequence: GGG
cacttcaacctctgcctccc

SEQ ID NO: 58470 - DNA, 20 bp, Artificial Sequence
  Description of Artificial Sequence: Synthetic oligonucleotide
  Target: ATXN1; (-) strand; PAM type: NRG; PAM sequence: CGG
tcacttcaacctctgcctcc

SEQ ID NO: 58471 - DNA, 20 bp, Artificial Sequence
  Description of Artificial Sequence: Synthetic oligonucleotide
  Target: ATXN1; (-) strand; PAM type: NRG; PAM sequence: TGG
ggagtgcagtggcgcaatct

SEQ ID NO: 58472 - DNA, 20 bp, Artificial Sequence
  Description of Artificial Sequence: Synthetic oligonucleotide
  Target: ATXN1; (-) strand; PAM type: NRG; PAM sequence: TGG
tcgcccaggctggagtgcag

SEQ ID NO: 58473 - DNA, 20 bp, Artificial Sequence
  Description of Artificial Sequence: Synthetic oligonucleotide
  Target: ATXN1; (-) strand; PAM type: NRG; PAM sequence: CAG
ctgtcgcccaggctggagtg

SEQ ID NO: 58474 - DNA, 20 bp, Artificial Sequence
  Description of Artificial Sequence: Synthetic oligonucleotide
  Target: ATXN1; (-) strand; PAM type: NRG; PAM sequence: GAG
tcactctgtcgcccaggctg

SEQ ID NO: 58475 - DNA, 20 bp, Artificial Sequence
  Description of Artificial Sequence: Synthetic oligonucleotide
  Target: ATXN1; (-) strand; PAM type: NRG; PAM sequence: TGG
tctcactctgtcgcccaggc

SEQ ID NO: 58476 - DNA, 20 bp, Artificial Sequence
  Description of Artificial Sequence: Synthetic oligonucleotide
  Target: ATXN1; (-) strand; PAM type: NRG; PAM sequence: AGG
ggagtctcactctgtcgccc

SEQ ID NO: 58477 - DNA, 20 bp, Artificial Sequence
  Description of Artificial Sequence: Synthetic oligonucleotide
  Target: ATXN1; (-) strand; PAM type: NRG; PAM sequence: CAG
cggagtctcactctgtcgcc

SEQ ID NO: 58478 - DNA, 20 bp, Artificial Sequence
  Description of Artificial Sequence: Synthetic oligonucleotide
  Target: ATXN1; (-) strand; PAM type: NRG; PAM sequence: GAG
tttattttatttttgagacg

SEQ ID NO: 58479 - DNA, 20 bp, Artificial Sequence
  Description of Artificial Sequence: Synthetic oligonucleotide
  Target: ATXN1; (-) strand; PAM type: NRG; PAM sequence: CGG
attttattttatttttgaga

SEQ ID NO: 58480 - DNA, 20 bp, Artificial Sequence
  Description of Artificial Sequence: Synthetic oligonucleotide
  Target: ATXN1; (-) strand; PAM type: NRG; PAM sequence: GAG
ctttattttattttattttt

SEQ ID NO: 58481 - DNA, 20 bp, Artificial Sequence
  Description of Artificial Sequence: Synthetic oligonucleotide
  Target: ATXN1; (-) strand; PAM type: NRG; PAM sequence: TGG
gagcaattcttagacaatta

SEQ ID NO: 58482 - DNA, 20 bp, Artificial Sequence
  Description of Artificial Sequence: Synthetic oligonucleotide
  Target: ATXN1; (-) strand; PAM type: NRG; PAM sequence: TAG
gtaatcctcagagcaattct

SEQ ID NO: 58483 - DNA, 20 bp, Artificial Sequence
  Description of Artificial Sequence: Synthetic oligonucleotide
  Target: ATXN1; (-) strand; PAM type: NRG; PAM sequence: GAG
ttacactgatgtaatcctca

SEQ ID NO: 58484 - DNA, 20 bp, Artificial Sequence
  Description of Artificial Sequence: Synthetic oligonucleotide
  Target: ATXN1; (-) strand; PAM type: NRG; PAM sequence: CAG
ccttacactgatgtaatcct

SEQ ID NO: 58485 - DNA, 20 bp, Artificial Sequence
  Description of Artificial Sequence: Synthetic oligonucleotide
  Target: ATXN1; (-) strand; PAM type: NRG; PAM sequence: AAG
tttttgcatacatttcagta

SEQ ID NO: 58486 - DNA, 20 bp, Artificial Sequence
  Description of Artificial Sequence: Synthetic oligonucleotide
  Target: ATXN1; (-) strand; PAM type: NRG; PAM sequence: CAG
gatattttttgcatacattt

SEQ ID NO: 58487 - DNA, 20 bp, Artificial Sequence
  Description of Artificial Sequence: Synthetic oligonucleotide
  Target: ATXN1; (-) strand; PAM type: NRG; PAM sequence: AAG
gatgatgataatgataatga

SEQ ID NO: 58488 - DNA, 20 bp, Artificial Sequence
  Description of Artificial Sequence: Synthetic oligonucleotide
  Target: ATXN1; (-) strand; PAM type: NRG; PAM sequence: AAG
agtttttaaagtatcaggtg

SEQ ID NO: 58489 - DNA, 20 bp, Artificial Sequence
  Description of Artificial Sequence: Synthetic oligonucleotide
  Target: ATXN1; (-) strand; PAM type: NRG; PAM sequence: AGG
tttgaagtttttaaagtatc

SEQ ID NO: 58490 - DNA, 20 bp, Artificial Sequence
  Description of Artificial Sequence: Synthetic oligonucleotide
  Target: ATXN1; (-) strand; PAM type: NRG; PAM sequence: CAG
atttgaagtttttaaagtat

SEQ ID NO: 58491 - DNA, 20 bp, Artificial Sequence
  Description of Artificial Sequence: Synthetic oligonucleotide
  Target: ATXN1; (-) strand; PAM type: NRG; PAM sequence: AAG
tctttcatttgaagttttta

SEQ ID NO: 58492 - DNA, 20 bp, Artificial Sequence
  Description of Artificial Sequence: Synthetic oligonucleotide
  Target: ATXN1; (-) strand; PAM type: NRG; PAM sequence: AAG
ttcttaccctctttcatttg

SEQ ID NO: 58493 - DNA, 20 bp, Artificial Sequence
  Description of Artificial Sequence: Synthetic oligonucleotide
  Target: ATXN1; (-) strand; PAM type: NRG; PAM sequence: GGG
tacagagtaggggatccagt

SEQ ID NO: 58494 - DNA, 20 bp, Artificial Sequence
  Description of Artificial Sequence: Synthetic oligonucleotide
  Target: ATXN1; (-) strand; PAM type: NRG; PAM sequence: TGG
gtacagagtaggggatccag

SEQ ID NO: 58495 - DNA, 20 bp, Artificial Sequence
  Description of Artificial Sequence: Synthetic oligonucleotide
  Target: ATXN1; (-) strand; PAM type: NRG; PAM sequence: CAG
caggtacagagtaggggatc

SEQ ID NO: 58496 - DNA, 20 bp, Artificial Sequence
  Description of Artificial Sequence: Synthetic oligonucleotide
  Target: ATXN1; (-) strand; PAM type: NRG; PAM sequence: GGG
caatgccaggtacagagtag

SEQ ID NO: 58497 - DNA, 20 bp, Artificial Sequence
  Description of Artificial Sequence: Synthetic oligonucleotide
  Target: ATXN1; (-) strand; PAM type: NRG; PAM sequence: GGG
acaatgccaggtacagagta

SEQ ID NO: 58498 - DNA, 20 bp, Artificial Sequence
  Description of Artificial Sequence: Synthetic oligonucleotide
  Target: ATXN1; (-) strand; PAM type: NRG; PAM sequence: AGG
cacaatgccaggtacagagt

SEQ ID NO: 58499 - DNA, 20 bp, Artificial Sequence
  Description of Artificial Sequence: Synthetic oligonucleotide
  Target: ATXN1; (-) strand; PAM type: NRG; PAM sequence: TAG
gcacaatgccaggtacagag

SEQ ID NO: 58500 - DNA, 20 bp, Artificial Sequence
  Description of Artificial Sequence: Synthetic oligonucleotide
  Target: ATXN1; (-) strand; PAM type: NRG; PAM sequence: GAG
gtagcacaatgccaggtaca

SEQ ID NO: 58501 - DNA, 20 bp, Artificial Sequence
  Description of Artificial Sequence: Synthetic oligonucleotide
  Target: ATXN1; (-) strand; PAM type: NRG; PAM sequence: CAG
ctgtagcacaatgccaggta

SEQ ID NO: 58502 - DNA, 20 bp, Artificial Sequence
  Description of Artificial Sequence: Synthetic oligonucleotide
  Target: ATXN1; (-) strand; PAM type: NRG; PAM sequence: AGG
acaacctgtagcacaatgcc

SEQ ID NO: 58503 - DNA, 20 bp, Artificial Sequence
  Description of Artificial Sequence: Synthetic oligonucleotide
  Target: ATXN1; (-) strand; PAM type: NRG; PAM sequence: CAG
cacaacctgtagcacaatgc

SEQ ID NO: 58504 - DNA, 20 bp, Artificial Sequence
  Description of Artificial Sequence: Synthetic oligonucleotide
  Target: ATXN1; (-) strand; PAM type: NRG; PAM sequence: TAG
agtgacatatgcacaacctg

SEQ ID NO: 58505 - DNA, 20 bp, Artificial Sequence
  Description of Artificial Sequence: Synthetic oligonucleotide
  Target: ATXN1; (-) strand; PAM type: NRG; PAM sequence: AAG
gggctgttgttgtaacctaa

SEQ ID NO: 58506 - DNA, 20 bp, Artificial Sequence
  Description of Artificial Sequence: Synthetic oligonucleotide
  Target: ATXN1; (-) strand; PAM type: NRG; PAM sequence: GGG
aaatttatgtgtagacagtt

SEQ ID NO: 58507 - DNA, 20 bp, Artificial Sequence
  Description of Artificial Sequence: Synthetic oligonucleotide
  Target: ATXN1; (-) strand; PAM type: NRG; PAM sequence: TGG
taaatttatgtgtagacagt

SEQ ID NO: 58508 - DNA, 20 bp, Artificial Sequence
  Description of Artificial Sequence: Synthetic oligonucleotide
  Target: ATXN1; (-) strand; PAM type: NRG; PAM sequence: CAG
gatataaatttatgtgtaga

SEQ ID NO: 58509 - DNA, 20 bp, Artificial Sequence
  Description of Artificial Sequence: Synthetic oligonucleotide
  Target: ATXN1; (-) strand; PAM type: NRG; PAM sequence: TAG
agcagatataaatttatgtg

SEQ ID NO: 58510 - DNA, 20 bp, Artificial Sequence
  Description of Artificial Sequence: Synthetic oligonucleotide
  Target: ATXN1; (-) strand; PAM type: NRG; PAM sequence: CAG
tatagtttattcctatacag

SEQ ID NO: 58511 - DNA, 20 bp, Artificial Sequence
  Description of Artificial Sequence: Synthetic oligonucleotide
  Target: ATXN1; (-) strand; PAM type: NRG; PAM sequence: CAG
aaatatagtttattcctata

SEQ ID NO: 58512 - DNA, 20 bp, Artificial Sequence
  Description of Artificial Sequence: Synthetic oligonucleotide
  Target: ATXN1; (-) strand; PAM type: NRG; PAM sequence: TAG
attttccagaattagaaata

SEQ ID NO: 58513 - DNA, 20 bp, Artificial Sequence
  Description of Artificial Sequence: Synthetic oligonucleotide
  Target: ATXN1; (-) strand; PAM type: NRG; PAM sequence: TAG
tgcacctcattttccagaat

SEQ ID NO: 58514 - DNA, 20 bp, Artificial Sequence
  Description of Artificial Sequence: Synthetic oligonucleotide
  Target: ATXN1; (-) strand; PAM type: NRG; PAM sequence: CAG
cctctctgcacctcattttc

SEQ ID NO: 58515 - DNA, 20 bp, Artificial Sequence
  Description of Artificial Sequence: Synthetic oligonucleotide
  Target: ATXN1; (-) strand; PAM type: NRG; PAM sequence: AAG
attgaagcatacttgaattc

SEQ ID NO: 58516 - DNA, 20 bp, Artificial Sequence
  Description of Artificial Sequence: Synthetic oligonucleotide
  Target: ATXN1; (-) strand; PAM type: NRG; PAM sequence: AAG
cagcttcgatttaattattg

SEQ ID NO: 58517 - DNA, 20 bp, Artificial Sequence
  Description of Artificial Sequence: Synthetic oligonucleotide
  Target: ATXN1; (-) strand; PAM type: NRG; PAM sequence: CAG
caagtgtgagccatctcgcc

SEQ ID NO: 58518 - DNA, 20 bp, Artificial Sequence
  Description of Artificial Sequence: Synthetic oligonucleotide
  Target: ATXN1; (-) strand; PAM type: NRG; PAM sequence: GAG
agtgctgggattacaagtgt

SEQ ID NO: 58519 - DNA, 20 bp, Artificial Sequence
  Description of Artificial Sequence: Synthetic oligonucleotide
  Target: ATXN1; (-) strand; PAM type: NRG; PAM sequence: AAG
tcccaaagtgctgggattac

SEQ ID NO: 58520 - DNA, 20 bp, Artificial Sequence
  Description of Artificial Sequence: Synthetic oligonucleotide
  Target: ATXN1; (-) strand; PAM type: NRG; PAM sequence: GGG
actcagcctcccaaagtgct

SEQ ID NO: 58521 - DNA, 20 bp, Artificial Sequence
  Description of Artificial Sequence: Synthetic oligonucleotide
  Target: ATXN1; (-) strand; PAM type: NRG; PAM sequence: TGG
gactcagcctcccaaagtgc

SEQ ID NO: 58522 - DNA, 20 bp, Artificial Sequence
  Description of Artificial Sequence: Synthetic oligonucleotide
  Target: ATXN1; (-) strand; PAM type: NRG; PAM sequence: AAG
ccgcctgactcagcctccca

SEQ ID NO: 58523 - DNA, 20 bp, Artificial Sequence
  Description of Artificial Sequence: Synthetic oligonucleotide
  Target: ATXN1; (-) strand; PAM type: NRG; PAM sequence: CAG
ctcaagtgatccgcctgact

SEQ ID NO: 58524 - DNA, 20 bp, Artificial Sequence
  Description of Artificial Sequence: Synthetic oligonucleotide
  Target: ATXN1; (-) strand; PAM type: NRG; PAM sequence: AAG
ggtcttgaactcctgacctc

SEQ ID NO: 58525 - DNA, 20 bp, Artificial Sequence
  Description of Artificial Sequence: Synthetic oligonucleotide
  Target: ATXN1; (-) strand; PAM type: NRG; PAM sequence: TGG
ttttgccatgttggccaggc

SEQ ID NO: 58526 - DNA, 20 bp, Artificial Sequence
  Description of Artificial Sequence: Synthetic oligonucleotide
  Target: ATXN1; (-) strand; PAM type: NRG; PAM sequence: AGG
ggggttttgccatgttggcc

SEQ ID NO: 58527 - DNA, 20 bp, Artificial Sequence
  Description of Artificial Sequence: Synthetic oligonucleotide
  Target: ATXN1; (-) strand; PAM type: NRG; PAM sequence: CAG
cggggttttgccatgttggc

SEQ ID NO: 58528 - DNA, 20 bp, Artificial Sequence
  Description of Artificial Sequence: Synthetic oligonucleotide
  Target: ATXN1; (-) strand; PAM type: NRG; PAM sequence: TGG
gagacggggttttgccatgt

SEQ ID NO: 58529 - DNA, 20 bp, Artificial Sequence
  Description of Artificial Sequence: Synthetic oligonucleotide
  Target: ATXN1; (-) strand; PAM type: NRG; PAM sequence: GGG
ttgtagttttagtagagacg

SEQ ID NO: 58530 - DNA, 20 bp, Artificial Sequence
  Description of Artificial Sequence: Synthetic oligonucleotide
  Target: ATXN1; (-) strand; PAM type: NRG; PAM sequence: GGG
tttgtagttttagtagagac

SEQ ID NO: 58531 - DNA, 20 bp, Artificial Sequence
  Description of Artificial Sequence: Synthetic oligonucleotide
  Target: ATXN1; (-) strand; PAM type: NRG; PAM sequence: CGG
ttttgtagttttagtagaga

SEQ ID NO: 58532 - DNA, 20 bp, Artificial Sequence
  Description of Artificial Sequence: Synthetic oligonucleotide
  Target: ATXN1; (-) strand; PAM type: NRG; PAM sequence: GAG
ccttttttgtagttttagta

SEQ ID NO: 58533 - DNA, 20 bp, Artificial Sequence
  Description of Artificial Sequence: Synthetic oligonucleotide
  Target: ATXN1; (-) strand; PAM type: NRG; PAM sequence: TAG
aaccttttttgtagttttag

SEQ ID NO: 58534 - DNA, 20 bp, Artificial Sequence
  Description of Artificial Sequence: Synthetic oligonucleotide
  Target: ATXN1; (-) strand; PAM type: NRG; PAM sequence: TAG
gctaaccttttttgtagttt

SEQ ID NO: 58535 - DNA, 20 bp, Artificial Sequence
  Description of Artificial Sequence: Synthetic oligonucleotide
  Target: ATXN1; (-) strand; PAM type: NRG; PAM sequence: TAG
tgcctggctaaccttttttg

SEQ ID NO: 58536 - DNA, 20 bp, Artificial Sequence
  Description of Artificial Sequence: Synthetic oligonucleotide
  Target: ATXN1; (-) strand; PAM type: NRG; PAM sequence: TGG
caggcacgtgccaccatgcc

SEQ ID NO: 58537 - DNA, 20 bp, Artificial Sequence
  Description of Artificial Sequence: Synthetic oligonucleotide
  Target: ATXN1; (-) strand; PAM type: NRG; PAM sequence: AGG
gtctgagtagctggaattac

SEQ ID NO: 58538 - DNA, 20 bp, Artificial Sequence
  Description of Artificial Sequence: Synthetic oligonucleotide
  Target: ATXN1; (-) strand; PAM type: NRG; PAM sequence: CAG
tgtctgagtagctggaatta

SEQ ID NO: 58539 - DNA, 20 bp, Artificial Sequence
  Description of Artificial Sequence: Synthetic oligonucleotide
  Target: ATXN1; (-) strand; PAM type: NRG; PAM sequence: TGG
caagcgattgtctgagtagc

SEQ ID NO: 58540 - DNA, 20 bp, Artificial Sequence
  Description of Artificial Sequence: Synthetic oligonucleotide
  Target: ATXN1; (-) strand; PAM type: NRG; PAM sequence: TAG
ggttcaagcgattgtctgag

SEQ ID NO: 58541 - DNA, 20 bp, Artificial Sequence
  Description of Artificial Sequence: Synthetic oligonucleotide
  Target: ATXN1; (-) strand; PAM type: NRG; PAM sequence: GAG
ctgggttcaagcgattgtct

SEQ ID NO: 58542 - DNA, 20 bp, Artificial Sequence
  Description of Artificial Sequence: Synthetic oligonucleotide
  Target: ATXN1; (-) strand; PAM type: NRG; PAM sequence: AAG
aacctccacttcctgggttc

SEQ ID NO: 58543 - DNA, 20 bp, Artificial Sequence
  Description of Artificial Sequence: Synthetic oligonucleotide
  Target: ATXN1; (-) strand; PAM type: NRG; PAM sequence: GGG
cactgcaacctccacttcct

SEQ ID NO: 58544 - DNA, 20 bp, Artificial Sequence
  Description of Artificial Sequence: Synthetic oligonucleotide
  Target: ATXN1; (-) strand; PAM type: NRG; PAM sequence: TGG
tcactgcaacctccacttcc

SEQ ID NO: 58545 - DNA, 20 bp, Artificial Sequence
  Description of Artificial Sequence: Synthetic oligonucleotide
  Target: ATXN1; (-) strand; PAM type: NRG; PAM sequence: CAG
aggctggagtccagccatct

SEQ ID NO: 58546 - DNA, 20 bp, Artificial Sequence
  Description of Artificial Sequence: Synthetic oligonucleotide
  Target: ATXN1; (-) strand; PAM type: NRG; PAM sequence: CAG
ttattgcccaggctggagtc

SEQ ID NO: 58547 - DNA, 20 bp, Artificial Sequence
  Description of Artificial Sequence: Synthetic oligonucleotide
  Target: ATXN1; (-) strand; PAM type: NRG; PAM sequence: GAG
cgctcttattgcccaggctg

SEQ ID NO: 58548 - DNA, 20 bp, Artificial Sequence
  Description of Artificial Sequence: Synthetic oligonucleotide
  Target: ATXN1; (-) strand; PAM type: NRG; PAM sequence: TGG
ctcgctcttattgcccaggc

SEQ ID NO: 58549 - DNA, 20 bp, Artificial Sequence
  Description of Artificial Sequence: Synthetic oligonucleotide
  Target: ATXN1; (-) strand; PAM type: NRG; PAM sequence: AGG
gagtctcgctcttattgccc

SEQ ID NO: 58550 - DNA, 20 bp, Artificial Sequence
  Description of Artificial Sequence: Synthetic oligonucleotide
  Target: ATXN1; (-) strand; PAM type: NRG; PAM sequence: CAG
agagtctcgctcttattgcc

SEQ ID NO: 58551 - DNA, 20 bp, Artificial Sequence
  Description of Artificial Sequence: Synthetic oligonucleotide
  Target: ATXN1; (-) strand; PAM type: NRG; PAM sequence: GAG
ttttttttttttttgagaca

SEQ ID NO: 58552 - DNA, 20 bp, Artificial Sequence
  Description of Artificial Sequence: Synthetic oligonucleotide
  Target: ATXN1; (-) strand; PAM type: NRG; PAM sequence: CAG
ttttttttttttttttgaga

SEQ ID NO: 58553 - DNA, 20 bp, Artificial Sequence
  Description of Artificial Sequence: Synthetic oligonucleotide
  Target: ATXN1; (-) strand; PAM type: NRG; PAM sequence: GAG
tttttttttttttttttttt

SEQ ID NO: 58554 - DNA, 20 bp, Artificial Sequence
  Description of Artificial Sequence: Synthetic oligonucleotide
  Target: ATXN1; (-) strand; PAM type: NRG; PAM sequence: CAG
cttggcacactgtaagcact

SEQ ID NO: 58555 - DNA, 20 bp, Artificial Sequence
  Description of Artificial Sequence: Synthetic oligonucleotide
  Target: ATXN1; (-) strand; PAM type: NRG; PAM sequence: AAG
atcagtacttggcacactgt

SEQ ID NO: 58556 - DNA, 20 bp, Artificial Sequence
  Description of Artificial Sequence: Synthetic oligonucleotide
  Target: ATXN1; (-) strand; PAM type: NRG; PAM sequence: TGG
cctgtacctaaatcagtact

SEQ ID NO: 58557 - DNA, 20 bp, Artificial Sequence
  Description of Artificial Sequence: Synthetic oligonucleotide
  Target: ATXN1; (-) strand; PAM type: NRG; PAM sequence: CAG
ctctatccctgtacctaaat

SEQ ID NO: 58558 - DNA, 20 bp, Artificial Sequence
  Description of Artificial Sequence: Synthetic oligonucleotide
  Target: ATXN1; (-) strand; PAM type: NRG; PAM sequence: CAG
tggcagggattttgtctgct

SEQ ID NO: 58559 - DNA, 20 bp, Artificial Sequence
  Description of Artificial Sequence: Synthetic oligonucleotide
  Target: ATXN1; (-) strand; PAM type: NRG; PAM sequence: GGG
tggtcagctctctgatggca

SEQ ID NO: 58560 - DNA, 20 bp, Artificial Sequence
  Description of Artificial Sequence: Synthetic oligonucleotide
  Target: ATXN1; (-) strand; PAM type: NRG; PAM sequence: AGG
ctggtcagctctctgatggc

SEQ ID NO: 58561 - DNA, 20 bp, Artificial Sequence
  Description of Artificial Sequence: Synthetic oligonucleotide
  Target: ATXN1; (-) strand; PAM type: NRG; PAM sequence: CAG
cctggtcagctctctgatgg

SEQ ID NO: 58562 - DNA, 20 bp, Artificial Sequence
  Description of Artificial Sequence: Synthetic oligonucleotide
  Target: ATXN1; (-) strand; PAM type: NRG; PAM sequence: TGG
gttcctggtcagctctctga

SEQ ID NO: 58563 - DNA, 20 bp, Artificial Sequence
  Description of Artificial Sequence: Synthetic oligonucleotide
  Target: ATXN1; (-) strand; PAM type: NRG; PAM sequence: CAG
agaagaattcagttcctggt

SEQ ID NO: 58564 - DNA, 20 bp, Artificial Sequence
  Description of Artificial Sequence: Synthetic oligonucleotide
  Target: ATXN1; (-) strand; PAM type: NRG; PAM sequence: TGG
attcagaagaattcagttcc

SEQ ID NO: 58565 - DNA, 20 bp, Artificial Sequence
  Description of Artificial Sequence: Synthetic oligonucleotide
  Target: ATXN1; (-) strand; PAM type: NRG; PAM sequence: CAG
attttgaattcagaagaatt

SEQ ID NO: 58566 - DNA, 20 bp, Artificial Sequence
  Description of Artificial Sequence: Synthetic oligonucleotide
  Target: ATXN1; (-) strand; PAM type: NRG; PAM sequence: AAG
aacaatgattttgaattcag

SEQ ID NO: 58567 - DNA, 20 bp, Artificial Sequence
  Description of Artificial Sequence: Synthetic oligonucleotide
  Target: ATXN1; (-) strand; PAM type: NRG; PAM sequence: CAG
gaaaacaatgattttgaatt

SEQ ID NO: 58568 - DNA, 20 bp, Artificial Sequence
  Description of Artificial Sequence: Synthetic oligonucleotide
  Target: ATXN1; (-) strand; PAM type: NRG; PAM sequence: GGG
cactggcacaatatggagtg

SEQ ID NO: 58569 - DNA, 20 bp, Artificial Sequence
  Description of Artificial Sequence: Synthetic oligonucleotide
  Target: ATXN1; (-) strand; PAM type: NRG; PAM sequence: GGG
gcactggcacaatatggagt

SEQ ID NO: 58570 - DNA, 20 bp, Artificial Sequence
  Description of Artificial Sequence: Synthetic oligonucleotide
  Target: ATXN1; (-) strand; PAM type: NRG; PAM sequence: TGG
agcactggcacaatatggag

SEQ ID NO: 58571 - DNA, 20 bp, Artificial Sequence
  Description of Artificial Sequence: Synthetic oligonucleotide
  Target: ATXN1; (-) strand; PAM type: NRG; PAM sequence: GAG
ccaagcactggcacaatatg

SEQ ID NO: 58572 - DNA, 20 bp, Artificial Sequence
  Description of Artificial Sequence: Synthetic oligonucleotide
  Target: ATXN1; (-) strand; PAM type: NRG; PAM sequence: TGG
ccccaagcactggcacaata

SEQ ID NO: 58573 - DNA, 20 bp, Artificial Sequence
  Description of Artificial Sequence: Synthetic oligonucleotide
  Target: ATXN1; (-) strand; PAM type: NRG; PAM sequence: TGG
caagtgcaagccccaagcac

SEQ ID NO: 58574 - DNA, 20 bp, Artificial Sequence
  Description of Artificial Sequence: Synthetic oligonucleotide
  Target: ATXN1; (-) strand; PAM type: NRG; PAM sequence: AAG
agagagcaagtgcaagcccc

SEQ ID NO: 58575 - DNA, 20 bp, Artificial Sequence
  Description of Artificial Sequence: Synthetic oligonucleotide
  Target: ATXN1; (-) strand; PAM type: NRG; PAM sequence: AAG
cctttagagagagcaagtgc

SEQ ID NO: 58576 - DNA, 20 bp, Artificial Sequence
  Description of Artificial Sequence: Synthetic oligonucleotide
  Target: ATXN1; (-) strand; PAM type: NRG; PAM sequence: AAG
gtagttcctttagagagagc

SEQ ID NO: 58577 - DNA, 20 bp, Artificial Sequence
  Description of Artificial Sequence: Synthetic oligonucleotide
  Target: ATXN1; (-) strand; PAM type: NRG; PAM sequence: GAG
acaagtagttcctttagaga

SEQ ID NO: 58578 - DNA, 20 bp, Artificial Sequence
  Description of Artificial Sequence: Synthetic oligonucleotide
  Target: ATXN1; (-) strand; PAM type: NRG; PAM sequence: GAG
atacaagtagttcctttaga

SEQ ID NO: 58579 - DNA, 20 bp, Artificial Sequence
  Description of Artificial Sequence: Synthetic oligonucleotide
  Target: ATXN1; (-) strand; PAM type: NRG; PAM sequence: GAG
ctatacaagtagttccttta

SEQ ID NO: 58580 - DNA, 20 bp, Artificial Sequence
  Description of Artificial Sequence: Synthetic oligonucleotide
  Target: ATXN1; (-) strand; PAM type: NRG; PAM sequence: TAG
ttctatacaagtagttcctt

SEQ ID NO: 58581 - DNA, 20 bp, Artificial Sequence
  Description of Artificial Sequence: Synthetic oligonucleotide
  Target: ATXN1; (-) strand; PAM type: NRG; PAM sequence: TAG
gatgttattttctatacaag

SEQ ID NO: 58582 - DNA, 20 bp, Artificial Sequence
  Description of Artificial Sequence: Synthetic oligonucleotide
  Target: ATXN1; (-) strand; PAM type: NRG; PAM sequence: AAG
ccagatgttattttctatac

SEQ ID NO: 58583 - DNA, 20 bp, Artificial Sequence
  Description of Artificial Sequence: Synthetic oligonucleotide
  Target: ATXN1; (-) strand; PAM type: NRG; PAM sequence: CAG
tatgcaattatgctgctgcc

SEQ ID NO: 58584 - DNA, 20 bp, Artificial Sequence
  Description of Artificial Sequence: Synthetic oligonucleotide
  Target: ATXN1; (-) strand; PAM type: NRG; PAM sequence: GGG
tacagagcccctagcagggg

SEQ ID NO: 58585 - DNA, 20 bp, Artificial Sequence
  Description of Artificial Sequence: Synthetic oligonucleotide
  Target: ATXN1; (-) strand; PAM type: NRG; PAM sequence: GGG
ctacagagcccctagcaggg

SEQ ID NO: 58586 - DNA, 20 bp, Artificial Sequence
  Description of Artificial Sequence: Synthetic oligonucleotide
  Target: ATXN1; (-) strand; PAM type: NRG; PAM sequence: GGG
gctacagagcccctagcagg

SEQ ID NO: 58587 - DNA, 20 bp, Artificial Sequence
  Description of Artificial Sequence: Synthetic oligonucleotide
  Target: ATXN1; (-) strand; PAM type: NRG; PAM sequence: GGG
ggctacagagcccctagcag

SEQ ID NO: 58588 - DNA, 20 bp, Artificial Sequence
  Description of Artificial Sequence: Synthetic oligonucleotide
  Target: ATXN1; (-) strand; PAM type: NRG; PAM sequence: GGG
aggctacagagcccctagca

SEQ ID NO: 58589 - DNA, 20 bp, Artificial Sequence
  Description of Artificial Sequence: Synthetic oligonucleotide
  Target: ATXN1; (-) strand; PAM type: NRG; PAM sequence: AGG
gaggctacagagcccctagc

SEQ ID NO: 58590 - DNA, 20 bp, Artificial Sequence
  Description of Artificial Sequence: Synthetic oligonucleotide
  Target: ATXN1; (-) strand; PAM type: NRG; PAM sequence: CAG
tgaggctacagagcccctag

SEQ ID NO: 58591 - DNA, 20 bp, Artificial Sequence
  Description of Artificial Sequence: Synthetic oligonucleotide
  Target: ATXN1; (-) strand; PAM type: NRG; PAM sequence: TAG
ccctgaggctacagagcccc

SEQ ID NO: 58592 - DNA, 20 bp, Artificial Sequence
  Description of Artificial Sequence: Synthetic oligonucleotide
  Target: ATXN1; (-) strand; PAM type: NRG; PAM sequence: GAG
ccttgacccctgaggctaca

SEQ ID NO: 58593 - DNA, 20 bp, Artificial Sequence
  Description of Artificial Sequence: Synthetic oligonucleotide
  Target: ATXN1; (-) strand; PAM type: NRG; PAM sequence: CAG
agccttgacccctgaggcta

SEQ ID NO: 58594 - DNA, 20 bp, Artificial Sequence
  Description of Artificial Sequence: Synthetic oligonucleotide
  Target: ATXN1; (-) strand; PAM type: NRG; PAM sequence: AGG
tcaggcagccttgacccctg

SEQ ID NO: 58595 - DNA, 20 bp, Artificial Sequence
  Description of Artificial Sequence: Synthetic oligonucleotide
  Target: ATXN1; (-) strand; PAM type: NRG; PAM sequence: GAG
ctcaggcagccttgacccct

SEQ ID NO: 58596 - DNA, 20 bp, Artificial Sequence
  Description of Artificial Sequence: Synthetic oligonucleotide
  Target: ATXN1; (-) strand; PAM type: NRG; PAM sequence: CAG
ggattgcctcagccctcagg

SEQ ID NO: 58597 - DNA, 20 bp, Artificial Sequence
  Description of Artificial Sequence: Synthetic oligonucleotide
  Target: ATXN1; (-) strand; PAM type: NRG; PAM sequence: AGG
tatggattgcctcagccctc

SEQ ID NO: 58598 - DNA, 20 bp, Artificial Sequence
  Description of Artificial Sequence: Synthetic oligonucleotide
  Target: ATXN1; (-) strand; PAM type: NRG; PAM sequence: CAG
gtatggattgcctcagccct

SEQ ID NO: 58599 - DNA, 20 bp, Artificial Sequence
  Description of Artificial Sequence: Synthetic oligonucleotide
  Target: ATXN1; (-) strand; PAM type: NRG; PAM sequence: CAG
tatccaagtatggattgcct

SEQ ID NO: 58600 - DNA, 20 bp, Artificial Sequence
  Description of Artificial Sequence: Synthetic oligonucleotide
  Target: ATXN1; (-) strand; PAM type: NRG; PAM sequence: TGG
gctacaggtatatccaagta

SEQ ID NO: 58601 - DNA, 20 bp, Artificial Sequence
  Description of Artificial Sequence: Synthetic oligonucleotide
  Target: ATXN1; (-) strand; PAM type: NRG; PAM sequence: AAG
aatgggctacaggtatatcc

SEQ ID NO: 58602 - DNA, 20 bp, Artificial Sequence
  Description of Artificial Sequence: Synthetic oligonucleotide
  Target: ATXN1; (-) strand; PAM type: NRG; PAM sequence: AGG
gtttgttacaaatgggctac

SEQ ID NO: 58603 - DNA, 20 bp, Artificial Sequence
  Description of Artificial Sequence: Synthetic oligonucleotide
  Target: ATXN1; (-) strand; PAM type: NRG; PAM sequence: CAG
agtttgttacaaatgggcta

SEQ ID NO: 58604 - DNA, 20 bp, Artificial Sequence
  Description of Artificial Sequence: Synthetic oligonucleotide
  Target: ATXN1; (-) strand; PAM type: NRG; PAM sequence: GGG
caagccagtttgttacaaat

SEQ ID NO: 58605 - DNA, 20 bp, Artificial Sequence
  Description of Artificial Sequence: Synthetic oligonucleotide
  Target: ATXN1; (-) strand; PAM type: NRG; PAM sequence: TGG
tcaagccagtttgttacaaa

SEQ ID NO: 58606 - DNA, 20 bp, Artificial Sequence
  Description of Artificial Sequence: Synthetic oligonucleotide
  Target: ATXN1; (-) strand; PAM type: NRG; PAM sequence: CAG
gataatgcagcttctcaagc

SEQ ID NO: 58607 - DNA, 20 bp, Artificial Sequence
  Description of Artificial Sequence: Synthetic oligonucleotide
  Target: ATXN1; (-) strand; PAM type: NRG; PAM sequence: AAG
tgtagataatgcagcttctc

SEQ ID NO: 58608 - DNA, 20 bp, Artificial Sequence
  Description of Artificial Sequence: Synthetic oligonucleotide
  Target: ATXN1; (-) strand; PAM type: NRG; PAM sequence: CAG
tggctacactgtagataatg

SEQ ID NO: 58609 - DNA, 20 bp, Artificial Sequence
  Description of Artificial Sequence: Synthetic oligonucleotide
  Target: ATXN1; (-) strand; PAM type: NRG; PAM sequence: TAG
ctgaatcattggctacactg

SEQ ID NO: 58610 - DNA, 20 bp, Artificial Sequence
  Description of Artificial Sequence: Synthetic oligonucleotide
  Target: ATXN1; (-) strand; PAM type: NRG; PAM sequence: TGG
tagggatattcctgaatcat

SEQ ID NO: 58611 - DNA, 20 bp, Artificial Sequence
  Description of Artificial Sequence: Synthetic oligonucleotide
  Target: ATXN1; (-) strand; PAM type: NRG; PAM sequence: GGG
gaggaaatcagtacaaatta

SEQ ID NO: 58612 - DNA, 20 bp, Artificial Sequence
  Description of Artificial Sequence: Synthetic oligonucleotide
  Target: ATXN1; (-) strand; PAM type: NRG; PAM sequence: AGG
ggaggaaatcagtacaaatt

SEQ ID NO: 58613 - DNA, 20 bp, Artificial Sequence
  Description of Artificial Sequence: Synthetic oligonucleotide
  Target: ATXN1; (-) strand; PAM type: NRG; PAM sequence: TAG
gggaggaaatcagtacaaat

SEQ ID NO: 58614 - DNA, 20 bp, Artificial Sequence
  Description of Artificial Sequence: Synthetic oligonucleotide
  Target: ATXN1; (-) strand; PAM type: NRG; PAM sequence: CAG
taattaacatgggaggaaat

SEQ ID NO: 58615 - DNA, 20 bp, Artificial Sequence
  Description of Artificial Sequence: Synthetic oligonucleotide
  Target: ATXN1; (-) strand; PAM type: NRG; PAM sequence: AGG
gcaataataattaacatggg

SEQ ID NO: 58616 - DNA, 20 bp, Artificial Sequence
  Description of Artificial Sequence: Synthetic oligonucleotide
  Target: ATXN1; (-) strand; PAM type: NRG; PAM sequence: GAG
agcaataataattaacatgg

SEQ ID NO: 58617 - DNA, 20 bp, Artificial Sequence
  Description of Artificial Sequence: Synthetic oligonucleotide
  Target: ATXN1; (-) strand; PAM type: NRG; PAM sequence: GGG
gtagcaataataattaacat

SEQ ID NO: 58618 - DNA, 20 bp, Artificial Sequence
  Description of Artificial Sequence: Synthetic oligonucleotide
  Target: ATXN1; (-) strand; PAM type: NRG; PAM sequence: TGG
tgtagcaataataattaaca

SEQ ID NO: 58619 - DNA, 20 bp, Artificial Sequence
  Description of Artificial Sequence: Synthetic oligonucleotide
  Target: ATXN1; (-) strand; PAM type: NRG; PAM sequence: TAG
atacaattacatgtactgtg

SEQ ID NO: 58620 - DNA, 20 bp, Artificial Sequence
  Description of Artificial Sequence: Synthetic oligonucleotide
  Target: ATXN1; (-) strand; PAM type: NRG; PAM sequence: CAG
agagagtggaaagtctgttc

SEQ ID NO: 58621 - DNA, 20 bp, Artificial Sequence
  Description of Artificial Sequence: Synthetic oligonucleotide
  Target: ATXN1; (-) strand; PAM type: NRG; PAM sequence: AAG
tatggcagtaagagagtgga

SEQ ID NO: 58622 - DNA, 20 bp, Artificial Sequence
  Description of Artificial Sequence: Synthetic oligonucleotide
  Target: ATXN1; (-) strand; PAM type: NRG; PAM sequence: TGG
agtctatggcagtaagagag

SEQ ID NO: 58623 - DNA, 20 bp, Artificial Sequence
  Description of Artificial Sequence: Synthetic oligonucleotide
  Target: ATXN1; (-) strand; PAM type: NRG; PAM sequence: GAG
ctaagtctatggcagtaaga

SEQ ID NO: 58624 - DNA, 20 bp, Artificial Sequence
  Description of Artificial Sequence: Synthetic oligonucleotide
  Target: ATXN1; (-) strand; PAM type: NRG; PAM sequence: GAG
cactaagtctatggcagtaa

SEQ ID NO: 58625 - DNA, 20 bp, Artificial Sequence
  Description of Artificial Sequence: Synthetic oligonucleotide
  Target: ATXN1; (-) strand; PAM type: NRG; PAM sequence: AAG
agcactaagtctatggcagt

SEQ ID NO: 58626 - DNA, 20 bp, Artificial Sequence
  Description of Artificial Sequence: Synthetic oligonucleotide
  Target: ATXN1; (-) strand; PAM type: NRG; PAM sequence: CAG
caaaagcactaagtctatgg

SEQ ID NO: 58627 - DNA, 20 bp, Artificial Sequence
  Description of Artificial Sequence: Synthetic oligonucleotide
  Target: ATXN1; (-) strand; PAM type: NRG; PAM sequence: TGG
tgccaaaagcactaagtcta

SEQ ID NO: 58628 - DNA, 20 bp, Artificial Sequence
  Description of Artificial Sequence: Synthetic oligonucleotide
  Target: ATXN1; (-) strand; PAM type: NRG; PAM sequence: AAG
gctgacctgccaaaagcact

SEQ ID NO: 58629 - DNA, 20 bp, Artificial Sequence
  Description of Artificial Sequence: Synthetic oligonucleotide
  Target: ATXN1; (-) strand; PAM type: NRG; PAM sequence: AAG
tcatcttgctgacctgccaa

SEQ ID NO: 58630 - DNA, 20 bp, Artificial Sequence
  Description of Artificial Sequence: Synthetic oligonucleotide
  Target: ATXN1; (-) strand; PAM type: NRG; PAM sequence: AGG
gttttgtctgctgactacaa

SEQ ID NO: 58631 - DNA, 20 bp, Artificial Sequence
  Description of Artificial Sequence: Synthetic oligonucleotide
  Target: ATXN1; (-) strand; PAM type: NRG; PAM sequence: AAG
agttttgtctgctgactaca

SEQ ID NO: 58632 - DNA, 20 bp, Artificial Sequence
  Description of Artificial Sequence: Synthetic oligonucleotide
  Target: ATXN1; (-) strand; PAM type: NRG; PAM sequence: TAG
aaatgtttctgatggctgtt

SEQ ID NO: 58633 - DNA, 20 bp, Artificial Sequence
  Description of Artificial Sequence: Synthetic oligonucleotide
  Target: ATXN1; (-) strand; PAM type: NRG; PAM sequence: TGG
tattttaaaaatgtttctga

SEQ ID NO: 58634 - DNA, 20 bp, Artificial Sequence
  Description of Artificial Sequence: Synthetic oligonucleotide
  Target: ATXN1; (-) strand; PAM type: NRG; PAM sequence: TAG
tgtctactataataatttaa

SEQ ID NO: 58635 - DNA, 20 bp, Artificial Sequence
  Description of Artificial Sequence: Synthetic oligonucleotide
  Target: ATXN1; (-) strand; PAM type: NRG; PAM sequence: TGG
gttcttttgcattaatttct

SEQ ID NO: 58636 - DNA, 20 bp, Artificial Sequence
  Description of Artificial Sequence: Synthetic oligonucleotide
  Target: ATXN1; (-) strand; PAM type: NRG; PAM sequence: TGG
gataagattaagaaatctct

SEQ ID NO: 58637 - DNA, 20 bp, Artificial Sequence
  Description of Artificial Sequence: Synthetic oligonucleotide
  Target: ATXN1; (-) strand; PAM type: NRG; PAM sequence: AAG
tctgaactggtgataagatt

SEQ ID NO: 58638 - DNA, 20 bp, Artificial Sequence
  Description of Artificial Sequence: Synthetic oligonucleotide
  Target: ATXN1; (-) strand; PAM type: NRG; PAM sequence: AAG
tctgaatctgaactggtgat

SEQ ID NO: 58639 - DNA, 20 bp, Artificial Sequence
  Description of Artificial Sequence: Synthetic oligonucleotide
  Target: ATXN1; (-) strand; PAM type: NRG; PAM sequence: TGG
ttctttttctgaatctgaac

SEQ ID NO: 58640 - DNA, 20 bp, Artificial Sequence
  Description of Artificial Sequence: Synthetic oligonucleotide
  Target: ATXN1; (-) strand; PAM type: NRG; PAM sequence: TAG
agctcccagatcacagcttt

SEQ ID NO: 58641 - DNA, 20 bp, Artificial Sequence
  Description of Artificial Sequence: Synthetic oligonucleotide
  Target: ATXN1; (-) strand; PAM type: NRG; PAM sequence: CAG
atatccaagctcccagatca

SEQ ID NO: 58642 - DNA, 20 bp, Artificial Sequence
  Description of Artificial Sequence: Synthetic oligonucleotide
  Target: ATXN1; (-) strand; PAM type: NRG; PAM sequence: CAG
tgctataatatccaagctcc

SEQ ID NO: 58643 - DNA, 20 bp, Artificial Sequence
  Description of Artificial Sequence: Synthetic oligonucleotide
  Target: ATXN1; (-) strand; PAM type: NRG; PAM sequence: AAG
gcttaattgctataatatcc

SEQ ID NO: 58644 - DNA, 20 bp, Artificial Sequence
  Description of Artificial Sequence: Synthetic oligonucleotide
  Target: ATXN1; (-) strand; PAM type: NRG; PAM sequence: AAG
atctacctctttttatatcc

SEQ ID NO: 58645 - DNA, 20 bp, Artificial Sequence
  Description of Artificial Sequence: Synthetic oligonucleotide
  Target: ATXN1; (-) strand; PAM type: NRG; PAM sequence: GAG
tgctgagtccccctgaaggt

SEQ ID NO: 58646 - DNA, 20 bp, Artificial Sequence
  Description of Artificial Sequence: Synthetic oligonucleotide
  Target: ATXN1; (-) strand; PAM type: NRG; PAM sequence: AGG
tcactgctgagtccccctga

SEQ ID NO: 58647 - DNA, 20 bp, Artificial Sequence
  Description of Artificial Sequence: Synthetic oligonucleotide
  Target: ATXN1; (-) strand; PAM type: NRG; PAM sequence: AAG
gtcactgctgagtccccctg

SEQ ID NO: 58648 - DNA, 20 bp, Artificial Sequence
  Description of Artificial Sequence: Synthetic oligonucleotide
  Target: ATXN1; (-) strand; PAM type: NRG; PAM sequence: GAG
taacagtggtggtcactgct

SEQ ID NO: 58649 - DNA, 20 bp, Artificial Sequence
  Description of Artificial Sequence: Synthetic oligonucleotide
  Target: ATXN1; (-) strand; PAM type: NRG; PAM sequence: TGG
ctttccatacataacagtgg

SEQ ID NO: 58650 - DNA, 20 bp, Artificial Sequence
  Description of Artificial Sequence: Synthetic oligonucleotide
  Target: ATXN1; (-) strand; PAM type: NRG; PAM sequence: TGG
ctcctttccatacataacag

SEQ ID NO: 58651 - DNA, 20 bp, Artificial Sequence
  Description of Artificial Sequence: Synthetic oligonucleotide
  Target: ATXN1; (-) strand; PAM type: NRG; PAM sequence: CAG
ttactcctttccatacataa

SEQ ID NO: 58652 - DNA, 20 bp, Artificial Sequence
  Description of Artificial Sequence: Synthetic oligonucleotide
  Target: ATXN1; (-) strand; PAM type: NRG; PAM sequence: AAG
gccacatgtttcctgacctc

SEQ ID NO: 58653 - DNA, 20 bp, Artificial Sequence
  Description of Artificial Sequence: Synthetic oligonucleotide
  Target: ATXN1; (-) strand; PAM type: NRG; PAM sequence: CAG
cttcagatcctcagtaaata

SEQ ID NO: 58654 - DNA, 20 bp, Artificial Sequence
  Description of Artificial Sequence: Synthetic oligonucleotide
  Target: ATXN1; (-) strand; PAM type: NRG; PAM sequence: CAG
tttgccacacttcagatcct

SEQ ID NO: 58655 - DNA, 20 bp, Artificial Sequence
  Description of Artificial Sequence: Synthetic oligonucleotide
  Target: ATXN1; (-) strand; PAM type: NRG; PAM sequence: CAG
ctagagcatttgccacactt

SEQ ID NO: 58656 - DNA, 20 bp, Artificial Sequence
  Description of Artificial Sequence: Synthetic oligonucleotide
  Target: ATXN1; (-) strand; PAM type: NRG; PAM sequence: GAG
ttccttccttctgtctccta

SEQ ID NO: 58657 - DNA, 20 bp, Artificial Sequence
  Description of Artificial Sequence: Synthetic oligonucleotide
  Target: ATXN1; (-) strand; PAM type: NRG; PAM sequence: TAG
ccttccttccttctgtctcc

SEQ ID NO: 58658 - DNA, 20 bp, Artificial Sequence
  Description of Artificial Sequence: Synthetic oligonucleotide
  Target: ATXN1; (-) strand; PAM type: NRG; PAM sequence: GAG
tagattgggtgttacttgta

SEQ ID NO: 58659 - DNA, 20 bp, Artificial Sequence
  Description of Artificial Sequence: Synthetic oligonucleotide
  Target: ATXN1; (-) strand; PAM type: NRG; PAM sequence: TAG
gttagattgggtgttacttg

SEQ ID NO: 58660 - DNA, 20 bp, Artificial Sequence
  Description of Artificial Sequence: Synthetic oligonucleotide
  Target: ATXN1; (-) strand; PAM type: NRG; PAM sequence: GGG
tcttactacctggttagatt

SEQ ID NO: 58661 - DNA, 20 bp, Artificial Sequence
  Description of Artificial Sequence: Synthetic oligonucleotide
  Target: ATXN1; (-) strand; PAM type: NRG; PAM sequence: TGG
gtcttactacctggttagat

SEQ ID NO: 58662 - DNA, 20 bp, Artificial Sequence
  Description of Artificial Sequence: Synthetic oligonucleotide
  Target: ATXN1; (-) strand; PAM type: NRG; PAM sequence: TAG
gatgagtcttactacctggt

SEQ ID NO: 58663 - DNA, 20 bp, Artificial Sequence
  Description of Artificial Sequence: Synthetic oligonucleotide
  Target: ATXN1; (-) strand; PAM type: NRG; PAM sequence: TGG
tcaagatgagtcttactacc

SEQ ID NO: 58664 - DNA, 20 bp, Artificial Sequence
  Description of Artificial Sequence: Synthetic oligonucleotide
  Target: ATXN1; (-) strand; PAM type: NRG; PAM sequence: GAG
cttcttttttacatcaagat

SEQ ID NO: 58665 - DNA, 20 bp, Artificial Sequence
  Description of Artificial Sequence: Synthetic oligonucleotide
  Target: ATXN1; (-) strand; PAM type: NRG; PAM sequence: AAG
ggttacttcttttttacatc

SEQ ID NO: 58666 - DNA, 20 bp, Artificial Sequence
  Description of Artificial Sequence: Synthetic oligonucleotide
  Target: ATXN1; (-) strand; PAM type: NRG; PAM sequence: TGG
ttttctacagctctgttgtg

SEQ ID NO: 58667 - DNA, 20 bp, Artificial Sequence
  Description of Artificial Sequence: Synthetic oligonucleotide
  Target: ATXN1; (-) strand; PAM type: NRG; PAM sequence: CAG
tctaatagtgaagttttcta

SEQ ID NO: 58668 - DNA, 20 bp, Artificial Sequence
  Description of Artificial Sequence: Synthetic oligonucleotide
  Target: ATXN1; (-) strand; PAM type: NRG; PAM sequence: AAG
ttgtttgttttctaatagtg

SEQ ID NO: 58669 - DNA, 20 bp, Artificial Sequence
  Description of Artificial Sequence: Synthetic oligonucleotide
  Target: ATXN1; (-) strand; PAM type: NRG; PAM sequence: TAG
ctgggttgtttgttttctaa

SEQ ID NO: 58670 - DNA, 20 bp, Artificial Sequence
  Description of Artificial Sequence: Synthetic oligonucleotide
  Target: ATXN1; (-) strand; PAM type: NRG; PAM sequence: GGG
ttttgtccattttaaaaact

SEQ ID NO: 58671 - DNA, 20 bp, Artificial Sequence
  Description of Artificial Sequence: Synthetic oligonucleotide
  Target: ATXN1; (-) strand; PAM type: NRG; PAM sequence: TGG
cttttgtccattttaaaaac

SEQ ID NO: 58672 - DNA, 20 bp, Artificial Sequence
  Description of Artificial Sequence: Synthetic oligonucleotide
  Target: ATXN1; (-) strand; PAM type: NRG; PAM sequence: AGG
atttggtaaggtgtctggtc

SEQ ID NO: 58673 - DNA, 20 bp, Artificial Sequence
  Description of Artificial Sequence: Synthetic oligonucleotide
  Target: ATXN1; (-) strand; PAM type: NRG; PAM sequence: CAG
aatttggtaaggtgtctggt

SEQ ID NO: 58674 - DNA, 20 bp, Artificial Sequence
  Description of Artificial Sequence: Synthetic oligonucleotide
  Target: ATXN1; (-) strand; PAM type: NRG; PAM sequence: TGG
gtctaatttggtaaggtgtc

SEQ ID NO: 58675 - DNA, 20 bp, Artificial Sequence
  Description of Artificial Sequence: Synthetic oligonucleotide
  Target: ATXN1; (-) strand; PAM type: NRG; PAM sequence: AGG
tctctatgtctaatttggta

SEQ ID NO: 58676 - DNA, 20 bp, Artificial Sequence
  Description of Artificial Sequence: Synthetic oligonucleotide
  Target: ATXN1; (-) strand; PAM type: NRG; PAM sequence: AAG
atctctatgtctaatttggt

SEQ ID NO: 58677 - DNA, 20 bp, Artificial Sequence
  Description of Artificial Sequence: Synthetic oligonucleotide
  Target: ATXN1; (-) strand; PAM type: NRG; PAM sequence: TGG
tgccatctctatgtctaatt

SEQ ID NO: 58678 - DNA, 20 bp, Artificial Sequence
  Description of Artificial Sequence: Synthetic oligonucleotide
  Target: ATXN1; (-) strand; PAM type: NRG; PAM sequence: GAG
ccctagtgattcataatgtg

SEQ ID NO: 58679 - DNA, 20 bp, Artificial Sequence
  Description of Artificial Sequence: Synthetic oligonucleotide
  Target: ATXN1; (-) strand; PAM type: NRG; PAM sequence: TGG
ttccctagtgattcataatg

SEQ ID NO: 58680 - DNA, 20 bp, Artificial Sequence
  Description of Artificial Sequence: Synthetic oligonucleotide
  Target: ATXN1; (-) strand; PAM type: NRG; PAM sequence: TAG
tgttttaattcacagttccc

SEQ ID NO: 58681 - DNA, 20 bp, Artificial Sequence
  Description of Artificial Sequence: Synthetic oligonucleotide
  Target: ATXN1; (-) strand; PAM type: NRG; PAM sequence: CAG
cttgtgtttgttttaattca

SEQ ID NO: 58682 - DNA, 20 bp, Artificial Sequence
  Description of Artificial Sequence: Synthetic oligonucleotide
  Target: ATXN1; (-) strand; PAM type: NRG; PAM sequence: TGG
attttggccattttcatagg

SEQ ID NO: 58683 - DNA, 20 bp, Artificial Sequence
  Description of Artificial Sequence: Synthetic oligonucleotide
  Target: ATXN1; (-) strand; PAM type: NRG; PAM sequence: AGG
tggattttggccattttcat

SEQ ID NO: 58684 - DNA, 20 bp, Artificial Sequence
  Description of Artificial Sequence: Synthetic oligonucleotide
  Target: ATXN1; (-) strand; PAM type: NRG; PAM sequence: TAG
ttggattttggccattttca

SEQ ID NO: 58685 - DNA, 20 bp, Artificial Sequence
  Description of Artificial Sequence: Synthetic oligonucleotide
  Target: ATXN1; (-) strand; PAM type: NRG; PAM sequence: TGG
gttggcagtgtgttggattt

SEQ ID NO: 58686 - DNA, 20 bp, Artificial Sequence
  Description of Artificial Sequence: Synthetic oligonucleotide
  Target: ATXN1; (-) strand; PAM type: NRG; PAM sequence: TGG
atctgctgttggcagtgtgt

SEQ ID NO: 58687 - DNA, 20 bp, Artificial Sequence
  Description of Artificial Sequence: Synthetic oligonucleotide
  Target: ATXN1; (-) strand; PAM type: NRG; PAM sequence: CAG
ttgccagcatctgctgttgg

SEQ ID NO: 58688 - DNA, 20 bp, Artificial Sequence
  Description of Artificial Sequence: Synthetic oligonucleotide
  Target: ATXN1; (-) strand; PAM type: NRG; PAM sequence: TGG
tccttgccagcatctgctgt

SEQ ID NO: 58689 - DNA, 20 bp, Artificial Sequence
  Description of Artificial Sequence: Synthetic oligonucleotide
  Target: ATXN1; (-) strand; PAM type: NRG; PAM sequence: CAG
ctatggctctgcatccttgc

SEQ ID NO: 58690 - DNA, 20 bp, Artificial Sequence
  Description of Artificial Sequence: Synthetic oligonucleotide
  Target: ATXN1; (-) strand; PAM type: NRG; PAM sequence: TGG
caatgacttgagagttccta

SEQ ID NO: 58691 - DNA, 20 bp, Artificial Sequence
  Description of Artificial Sequence: Synthetic oligonucleotide
  Target: ATXN1; (-) strand; PAM type: NRG; PAM sequence: GAG
tcccacccgcaatgacttga

SEQ ID NO: 58692 - DNA, 20 bp, Artificial Sequence
  Description of Artificial Sequence: Synthetic oligonucleotide
  Target: ATXN1; (-) strand; PAM type: NRG; PAM sequence: GAG
attcccacccgcaatgactt

SEQ ID NO: 58693 - DNA, 20 bp, Artificial Sequence
  Description of Artificial Sequence: Synthetic oligonucleotide
  Target: ATXN1; (-) strand; PAM type: NRG; PAM sequence: TAG
tgccaaactgttttcccaag

SEQ ID NO: 58694 - DNA, 20 bp, Artificial Sequence
  Description of Artificial Sequence: Synthetic oligonucleotide
  Target: ATXN1; (-) strand; PAM type: NRG; PAM sequence: AAG
aactgccaaactgttttccc

SEQ ID NO: 58695 - DNA, 20 bp, Artificial Sequence
  Description of Artificial Sequence: Synthetic oligonucleotide
  Target: ATXN1; (-) strand; PAM type: NRG; PAM sequence: AGG
aagagtatgtttagctttgt

SEQ ID NO: 58696 - DNA, 20 bp, Artificial Sequence
  Description of Artificial Sequence: Synthetic oligonucleotide
  Target: ATXN1; (-) strand; PAM type: NRG; PAM sequence: TAG
taagagtatgtttagctttg

SEQ ID NO: 58697 - DNA, 20 bp, Artificial Sequence
  Description of Artificial Sequence: Synthetic oligonucleotide
  Target: ATXN1; (-) strand; PAM type: NRG; PAM sequence: TAG
ttgcatgttaagagtatgtt

SEQ ID NO: 58698 - DNA, 20 bp, Artificial Sequence
  Description of Artificial Sequence: Synthetic oligonucleotide
  Target: ATXN1; (-) strand; PAM type: NRG; PAM sequence: GAG
cttgccacattgcatgttaa

SEQ ID NO: 58699 - DNA, 20 bp, Artificial Sequence
  Description of Artificial Sequence: Synthetic oligonucleotide
  Target: ATXN1; (-) strand; PAM type: NRG; PAM sequence: AAG
tgcttgccacattgcatgtt

SEQ ID NO: 58700 - DNA, 20 bp, Artificial Sequence
  Description of Artificial Sequence: Synthetic oligonucleotide
  Target: ATXN1; (-) strand; PAM type: NRG; PAM sequence: GAG
ttatttgtgtagataccaag

SEQ ID NO: 58701 - DNA, 20 bp, Artificial Sequence
  Description of Artificial Sequence: Synthetic oligonucleotide
  Target: ATXN1; (-) strand; PAM type: NRG; PAM sequence: AGG
gtttatttgtgtagatacca

SEQ ID NO: 58702 - DNA, 20 bp, Artificial Sequence
  Description of Artificial Sequence: Synthetic oligonucleotide
  Target: ATXN1; (-) strand; PAM type: NRG; PAM sequence: AAG
agtttatttgtgtagatacc

SEQ ID NO: 58703 - DNA, 20 bp, Artificial Sequence
  Description of Artificial Sequence: Synthetic oligonucleotide
  Target: ATXN1; (-) strand; PAM type: NRG; PAM sequence: TAG
aagtttttagtttatttgtg

SEQ ID NO: 58704 - DNA, 20 bp, Artificial Sequence
  Description of Artificial Sequence: Synthetic oligonucleotide
  Target: ATXN1; (-) strand; PAM type: NRG; PAM sequence: TAG
tttgtgtggacttaagtttt

SEQ ID NO: 58705 - DNA, 20 bp, Artificial Sequence
  Description of Artificial Sequence: Synthetic oligonucleotide
  Target: ATXN1; (-) strand; PAM type: NRG; PAM sequence: AAG
gcaggtttttgtgtggactt

SEQ ID NO: 58706 - DNA, 20 bp, Artificial Sequence
  Description of Artificial Sequence: Synthetic oligonucleotide
  Target: ATXN1; (-) strand; PAM type: NRG; PAM sequence: TGG
tttgagtgcaggtttttgtg

SEQ ID NO: 58707 - DNA, 20 bp, Artificial Sequence
  Description of Artificial Sequence: Synthetic oligonucleotide
  Target: ATXN1; (-) strand; PAM type: NRG; PAM sequence: AGG
tgctataaacatttgagtgc

SEQ ID NO: 58708 - DNA, 20 bp, Artificial Sequence
  Description of Artificial Sequence: Synthetic oligonucleotide
  Target: ATXN1; (-) strand; PAM type: NRG; PAM sequence: CAG
ctgctataaacatttgagtg

SEQ ID NO: 58709 - DNA, 20 bp, Artificial Sequence
  Description of Artificial Sequence: Synthetic oligonucleotide
  Target: ATXN1; (-) strand; PAM type: NRG; PAM sequence: GAG
tgaagctgctataaacattt

SEQ ID NO: 58710 - DNA, 20 bp, Artificial Sequence
  Description of Artificial Sequence: Synthetic oligonucleotide
  Target: ATXN1; (-) strand; PAM type: NRG; PAM sequence: AAG
cccattcacgattatgaatg

SEQ ID NO: 58711 - DNA, 20 bp, Artificial Sequence
  Description of Artificial Sequence: Synthetic oligonucleotide
  Target: ATXN1; (-) strand; PAM type: NRG; PAM sequence: CAG
tctattgtatggatgtacca

SEQ ID NO: 58712 - DNA, 20 bp, Artificial Sequence
  Description of Artificial Sequence: Synthetic oligonucleotide
  Target: ATXN1; (-) strand; PAM type: NRG; PAM sequence: TGG
ctgaataatattctattgta

SEQ ID NO: 58713 - DNA, 20 bp, Artificial Sequence
  Description of Artificial Sequence: Synthetic oligonucleotide
  Target: ATXN1; (-) strand; PAM type: NRG; PAM sequence: TAG
cctgaaagcttatttgtttt

SEQ ID NO: 58714 - DNA, 20 bp, Artificial Sequence
  Description of Artificial Sequence: Synthetic oligonucleotide
  Target: ATXN1; (-) strand; PAM type: NRG; PAM sequence: AAG
ctctcatttttatggcctga

SEQ ID NO: 58715 - DNA, 20 bp, Artificial Sequence
  Description of Artificial Sequence: Synthetic oligonucleotide
  Target: ATXN1; (-) strand; PAM type: NRG; PAM sequence: TGG
ggcttcacctctcattttta

SEQ ID NO: 58716 - DNA, 20 bp, Artificial Sequence
  Description of Artificial Sequence: Synthetic oligonucleotide
  Target: ATXN1; (-) strand; PAM type: NRG; PAM sequence: TGG
ctcaacccaggaagtccagc

SEQ ID NO: 58717 - DNA, 20 bp, Artificial Sequence
  Description of Artificial Sequence: Synthetic oligonucleotide
  Target: ATXN1; (-) strand; PAM type: NRG; PAM sequence: CAG
cccactcaacccaggaagtc

SEQ ID NO: 58718 - DNA, 20 bp, Artificial Sequence
  Description of Artificial Sequence: Synthetic oligonucleotide
  Target: ATXN1; (-) strand; PAM type: NRG; PAM sequence: AAG
aagtccccactcaacccagg

SEQ ID NO: 58719 - DNA, 20 bp, Artificial Sequence
  Description of Artificial Sequence: Synthetic oligonucleotide
  Target: ATXN1; (-) strand; PAM type: NRG; PAM sequence: AGG
cccaagtccccactcaaccc

SEQ ID NO: 58720 - DNA, 20 bp, Artificial Sequence
  Description of Artificial Sequence: Synthetic oligonucleotide
  Target: ATXN1; (-) strand; PAM type: NRG; PAM sequence: CAG
ccccaagtccccactcaacc

SEQ ID NO: 58721 - DNA, 20 bp, Artificial Sequence
  Description of Artificial Sequence: Synthetic oligonucleotide
  Target: ATXN1; (-) strand; PAM type: NRG; PAM sequence: AAG
gtaggacgggaaatttcccc

SEQ ID NO: 58722 - DNA, 20 bp, Artificial Sequence
  Description of Artificial Sequence: Synthetic oligonucleotide
  Target: ATXN1; (-) strand; PAM type: NRG; PAM sequence: GGG
ttacaatccttttgtaggac

SEQ ID NO: 58723 - DNA, 20 bp, Artificial Sequence
  Description of Artificial Sequence: Synthetic oligonucleotide
  Target: ATXN1; (-) strand; PAM type: NRG; PAM sequence: CGG
tttacaatccttttgtagga

SEQ ID NO: 58724 - DNA, 20 bp, Artificial Sequence
  Description of Artificial Sequence: Synthetic oligonucleotide
  Target: ATXN1; (-) strand; PAM type: NRG; PAM sequence: AGG
gtgttttacaatccttttgt

SEQ ID NO: 58725 - DNA, 20 bp, Artificial Sequence
  Description of Artificial Sequence: Synthetic oligonucleotide
  Target: ATXN1; (-) strand; PAM type: NRG; PAM sequence: TAG
tgtgttttacaatccttttg

SEQ ID NO: 58726 - DNA, 20 bp, Artificial Sequence
  Description of Artificial Sequence: Synthetic oligonucleotide
  Target: ATXN1; (-) strand; PAM type: NRG; PAM sequence: TGG
aagacaggaaagttcctgat

SEQ ID NO: 58727 - DNA, 20 bp, Artificial Sequence
  Description of Artificial Sequence: Synthetic oligonucleotide
  Target: ATXN1; (-) strand; PAM type: NRG; PAM sequence: AAG
aaacctcttataagacagga

SEQ ID NO: 58728 - DNA, 20 bp, Artificial Sequence
  Description of Artificial Sequence: Synthetic oligonucleotide
  Target: ATXN1; (-) strand; PAM type: NRG; PAM sequence: AGG
ttacaaacctcttataagac

SEQ ID NO: 58729 - DNA, 20 bp, Artificial Sequence
  Description of Artificial Sequence: Synthetic oligonucleotide
  Target: ATXN1; (-) strand; PAM type: NRG; PAM sequence: CAG
tttacaaacctcttataaga

SEQ ID NO: 58730 - DNA, 20 bp, Artificial Sequence
  Description of Artificial Sequence: Synthetic oligonucleotide
  Target: ATXN1; (-) strand; PAM type: NRG; PAM sequence: AAG
gcgctttacaaacctcttat

SEQ ID NO: 58731 - DNA, 20 bp, Artificial Sequence
  Description of Artificial Sequence: Synthetic oligonucleotide
  Target: ATXN1; (-) strand; PAM type: NRG; PAM sequence: TGG
gcattttaccaagtgctgat

SEQ ID NO: 58732 - DNA, 20 bp, Artificial Sequence
  Description of Artificial Sequence: Synthetic oligonucleotide
  Target: ATXN1; (-) strand; PAM type: NRG; PAM sequence: AAG
gttgattggtgcattttacc

SEQ ID NO: 58733 - DNA, 20 bp, Artificial Sequence
  Description of Artificial Sequence: Synthetic oligonucleotide
  Target: ATXN1; (-) strand; PAM type: NRG; PAM sequence: TGG
gcattttacagagcgttgat

SEQ ID NO: 58734 - DNA, 20 bp, Artificial Sequence
  Description of Artificial Sequence: Synthetic oligonucleotide
  Target: ATXN1; (-) strand; PAM type: NRG; PAM sequence: GAG
gttgattggtgcattttaca

SEQ ID NO: 58735 - DNA, 20 bp, Artificial Sequence
  Description of Artificial Sequence: Synthetic oligonucleotide
  Target: ATXN1; (-) strand; PAM type: NRG; PAM sequence: CAG
gcgttgattggtgcatttta

SEQ ID NO: 58736 - DNA, 20 bp, Artificial Sequence
  Description of Artificial Sequence: Synthetic oligonucleotide
  Target: ATXN1; (-) strand; PAM type: NRG; PAM sequence: TGG
gcattttacagagcgttgat

SEQ ID NO: 58737 - DNA, 20 bp, Artificial Sequence
  Description of Artificial Sequence: Synthetic oligonucleotide
  Target: ATXN1; (-) strand; PAM type: NRG; PAM sequence: GAG
gctgattggtgcattttaca

SEQ ID NO: 58738 - DNA, 20 bp, Artificial Sequence
  Description of Artificial Sequence: Synthetic oligonucleotide
  Target: ATXN1; (-) strand; PAM type: NRG; PAM sequence: CAG
ctgctgattggtgcatttta

SEQ ID NO: 58739 - DNA, 20 bp, Artificial Sequence
  Description of Artificial Sequence: Synthetic oligonucleotide
  Target: ATXN1; (-) strand; PAM type: NRG; PAM sequence: TGG
acttttatactcctgctgat

SEQ ID NO: 58740 - DNA, 20 bp, Artificial Sequence
  Description of Artificial Sequence: Synthetic oligonucleotide
  Target: ATXN1; (-) strand; PAM type: NRG; PAM sequence: TGG
ttttcaatcctccctgcgat

SEQ ID NO: 58741 - DNA, 20 bp, Artificial Sequence
  Description of Artificial Sequence: Synthetic oligonucleotide
  Target: ATXN1; (-) strand; PAM type: NRG; PAM sequence: GAG
attctgtttctgtcctatca

SEQ ID NO: 58742 - DNA, 20 bp, Artificial Sequence
  Description of Artificial Sequence: Synthetic oligonucleotide
  Target: ATXN1; (-) strand; PAM type: NRG; PAM sequence: CAG
atattctgtttctgtcctat

SEQ ID NO: 58743 - DNA, 20 bp, Artificial Sequence
  Description of Artificial Sequence: Synthetic oligonucleotide
  Target: ATXN1; (-) strand; PAM type: NRG; PAM sequence: TGG
gttgccactgctggctgggg

SEQ ID NO: 58744 - DNA, 20 bp, Artificial Sequence
  Description of Artificial Sequence: Synthetic oligonucleotide
  Target: ATXN1; (-) strand; PAM type: NRG; PAM sequence: GGG
tgggttgccactgctggctg

SEQ ID NO: 58745 - DNA, 20 bp, Artificial Sequence
  Description of Artificial Sequence: Synthetic oligonucleotide
  Target: ATXN1; (-) strand; PAM type: NRG; PAM sequence: GGG
atgggttgccactgctggct

SEQ ID NO: 58746 - DNA, 20 bp, Artificial Sequence
  Description of Artificial Sequence: Synthetic oligonucleotide
  Target: ATXN1; (-) strand; PAM type: NRG; PAM sequence: TGG
aatgggttgccactgctggc

SEQ ID NO: 58747 - DNA, 20 bp, Artificial Sequence
  Description of Artificial Sequence: Synthetic oligonucleotide
  Target: ATXN1; (-) strand; PAM type: NRG; PAM sequence: TGG
cccaaatgggttgccactgc

SEQ ID NO: 58748 - DNA, 20 bp, Artificial Sequence
  Description of Artificial Sequence: Synthetic oligonucleotide
  Target: ATXN1; (-) strand; PAM type: NRG; PAM sequence: GGG
gcgtggaaggggacccaaat

SEQ ID NO: 58749 - DNA, 20 bp, Artificial Sequence
  Description of Artificial Sequence: Synthetic oligonucleotide
  Target: ATXN1; (-) strand; PAM type: NRG; PAM sequence: TGG
agcgtggaaggggacccaaa

SEQ ID NO: 58750 - DNA, 20 bp, Artificial Sequence
  Description of Artificial Sequence: Synthetic oligonucleotide
  Target: ATXN1; (-) strand; PAM type: NRG; PAM sequence: GGG
aagcttccccagcgtggaag

SEQ ID NO: 58751 - DNA, 20 bp, Artificial Sequence
  Description of Artificial Sequence: Synthetic oligonucleotide
  Target: ATXN1; (-) strand; PAM type: NRG; PAM sequence: GGG
aaagcttccccagcgtggaa

SEQ ID NO: 58752 - DNA, 20 bp, Artificial Sequence
  Description of Artificial Sequence: Synthetic oligonucleotide
  Target: ATXN1; (-) strand; PAM type: NRG; PAM sequence: AGG
caaagcttccccagcgtgga

SEQ ID NO: 58753 - DNA, 20 bp, Artificial Sequence
  Description of Artificial Sequence: Synthetic oligonucleotide
  Target: ATXN1; (-) strand; PAM type: NRG; PAM sequence: AAG
acaaagcttccccagcgtgg

SEQ ID NO: 58754 - DNA, 20 bp, Artificial Sequence
  Description of Artificial Sequence: Synthetic oligonucleotide
  Target: ATXN1; (-) strand; PAM type: NRG; PAM sequence: TGG
aggacaaagcttccccagcg

SEQ ID NO: 58755 - DNA, 20 bp, Artificial Sequence
  Description of Artificial Sequence: Synthetic oligonucleotide
  Target: ATXN1; (-) strand; PAM type: NRG; PAM sequence: CAG
gcgacaggacaaagcttccc

SEQ ID NO: 58756 - DNA, 20 bp, Artificial Sequence
  Description of Artificial Sequence: Synthetic oligonucleotide
  Target: ATXN1; (-) strand; PAM type: NRG; PAM sequence: AAG
ctgtgaagagcgacaggaca

SEQ ID NO: 58757 - DNA, 20 bp, Artificial Sequence
  Description of Artificial Sequence: Synthetic oligonucleotide
  Target: ATXN1; (-) strand; PAM type: NRG; PAM sequence: AGG
ggttaactgtgaagagcgac

SEQ ID NO: 58758 - DNA, 20 bp, Artificial Sequence
  Description of Artificial Sequence: Synthetic oligonucleotide
  Target: ATXN1; (-) strand; PAM type: NRG; PAM sequence: CAG
aggttaactgtgaagagcga

SEQ ID NO: 58759 - DNA, 20 bp, Artificial Sequence
  Description of Artificial Sequence: Synthetic oligonucleotide
  Target: ATXN1; (-) strand; PAM type: NRG; PAM sequence: GAG
gtagcaaggttaactgtgaa

SEQ ID NO: 58760 - DNA, 20 bp, Artificial Sequence
  Description of Artificial Sequence: Synthetic oligonucleotide
  Target: ATXN1; (-) strand; PAM type: NRG; PAM sequence: AAG
cagtagcaaggttaactgtg

SEQ ID NO: 58761 - DNA, 20 bp, Artificial Sequence
  Description of Artificial Sequence: Synthetic oligonucleotide
  Target: ATXN1; (-) strand; PAM type: NRG; PAM sequence: AGG
ccaaagagtgagcagtagca

SEQ ID NO: 58762 - DNA, 20 bp, Artificial Sequence
  Description of Artificial Sequence: Synthetic oligonucleotide
  Target: ATXN1; (-) strand; PAM type: NRG; PAM sequence: AAG
cccaaagagtgagcagtagc

SEQ ID NO: 58763 - DNA, 20 bp, Artificial Sequence
  Description of Artificial Sequence: Synthetic oligonucleotide
  Target: ATXN1; (-) strand; PAM type: NRG; PAM sequence: TAG
cagacccaaagagtgagcag

SEQ ID NO: 58764 - DNA, 20 bp, Artificial Sequence
  Description of Artificial Sequence: Synthetic oligonucleotide
  Target: ATXN1; (-) strand; PAM type: NRG; PAM sequence: CAG
gcacagacccaaagagtgag

SEQ ID NO: 58765 - DNA, 20 bp, Artificial Sequence
  Description of Artificial Sequence: Synthetic oligonucleotide
  Target: ATXN1; (-) strand; PAM type: NRG; PAM sequence: GAG
atggcacagacccaaagagt

SEQ ID NO: 58766 - DNA, 20 bp, Artificial Sequence
  Description of Artificial Sequence: Synthetic oligonucleotide
  Target: ATXN1; (-) strand; PAM type: NRG; PAM sequence: GAG
aaagatggcacagacccaaa

SEQ ID NO: 58767 - DNA, 20 bp, Artificial Sequence
  Description of Artificial Sequence: Synthetic oligonucleotide
  Target: ATXN1; (-) strand; PAM type: NRG; PAM sequence: AAG
ttaaagatggcacagaccca

SEQ ID NO: 58768 - DNA, 20 bp, Artificial Sequence
  Description of Artificial Sequence: Synthetic oligonucleotide
  Target: ATXN1; (-) strand; PAM type: NRG; PAM sequence: CAG
tacagctcttaaagatggca

SEQ ID NO: 58769 - DNA, 20 bp, Artificial Sequence
  Description of Artificial Sequence: Synthetic oligonucleotide
  Target: ATXN1; (-) strand; PAM type: NRG; PAM sequence: TGG
agtgttacagctcttaaaga

SEQ ID NO: 58770 - DNA, 20 bp, Artificial Sequence
  Description of Artificial Sequence: Synthetic oligonucleotide
  Target: ATXN1; (-) strand; PAM type: NRG; PAM sequence: AAG
ggtgagtgttacagctctta

SEQ ID NO: 58771 - DNA, 20 bp, Artificial Sequence
  Description of Artificial Sequence: Synthetic oligonucleotide
  Target: ATXN1; (-) strand; PAM type: NRG; PAM sequence: CAG
gaccttcacggtgagtgtta

SEQ ID NO: 58772 - DNA, 20 bp, Artificial Sequence
  Description of Artificial Sequence: Synthetic oligonucleotide
  Target: ATXN1; (-) strand; PAM type: NRG; PAM sequence: GAG
gaggcacggaccttcacggt

SEQ ID NO: 58773 - DNA, 20 bp, Artificial Sequence
  Description of Artificial Sequence: Synthetic oligonucleotide
  Target: ATXN1; (-) strand; PAM type: NRG; PAM sequence: CGG
aatggaggcacggaccttca

SEQ ID NO: 58774 - DNA, 20 bp, Artificial Sequence
  Description of Artificial Sequence: Synthetic oligonucleotide
  Target: ATXN1; (-) strand; PAM type: NRG; PAM sequence: CGG
tgacttcaagaatggaggca

SEQ ID NO: 58775 - DNA, 20 bp, Artificial Sequence
  Description of Artificial Sequence: Synthetic oligonucleotide
  Target: ATXN1; (-) strand; PAM type: NRG; PAM sequence: AGG
ctcgctgacttcaagaatgg

SEQ ID NO: 58776 - DNA, 20 bp, Artificial Sequence
  Description of Artificial Sequence: Synthetic oligonucleotide
  Target: ATXN1; (-) strand; PAM type: NRG; PAM sequence: GAG
tctcgctgacttcaagaatg

SEQ ID NO: 58777 - DNA, 20 bp, Artificial Sequence
  Description of Artificial Sequence: Synthetic oligonucleotide
  Target: ATXN1; (-) strand; PAM type: NRG; PAM sequence: TGG
ggtctcgctgacttcaagaa

SEQ ID NO: 58778 - DNA, 20 bp, Artificial Sequence
  Description of Artificial Sequence: Synthetic oligonucleotide
  Target: ATXN1; (-) strand; PAM type: NRG; PAM sequence: AAG
ttcatggtctcgctgacttc

SEQ ID NO: 58779 - DNA, 20 bp, Artificial Sequence
  Description of Artificial Sequence: Synthetic oligonucleotide
  Target: ATXN1; (-) strand; PAM type: NRG; PAM sequence: TGG
ggttccagccggtggattca

SEQ ID NO: 58780 - DNA, 20 bp, Artificial Sequence
  Description of Artificial Sequence: Synthetic oligonucleotide
  Target: ATXN1; (-) strand; PAM type: NRG; PAM sequence: TGG
ccagagttggttccagccgg

SEQ ID NO: 58781 - DNA, 20 bp, Artificial Sequence
  Description of Artificial Sequence: Synthetic oligonucleotide
  Target: ATXN1; (-) strand; PAM type: NRG; PAM sequence: CGG
tgtccagagttggttccagc

SEQ ID NO: 58782 - DNA, 20 bp, Artificial Sequence
  Description of Artificial Sequence: Synthetic oligonucleotide
  Target: ATXN1; (-) strand; PAM type: NRG; PAM sequence: CAG
gatgtgtccagagttggttc

SEQ ID NO: 58783 - DNA, 20 bp, Artificial Sequence
  Description of Artificial Sequence: Synthetic oligonucleotide
  Target: ATXN1; (-) strand; PAM type: NRG; PAM sequence: TGG
ccccaagatgtgtccagagt

SEQ ID NO: 58784 - DNA, 20 bp, Artificial Sequence
  Description of Artificial Sequence: Synthetic oligonucleotide
  Target: ATXN1; (-) strand; PAM type: NRG; PAM sequence: GAG
gatcccccaagatgtgtcca

SEQ ID NO: 58785 - DNA, 20 bp, Artificial Sequence
  Description of Artificial Sequence: Synthetic oligonucleotide
  Target: ATXN1; (-) strand; PAM type: NRG; PAM sequence: CAG
aggatcccccaagatgtgtc

SEQ ID NO: 58786 - DNA, 20 bp, Artificial Sequence
  Description of Artificial Sequence: Synthetic oligonucleotide
  Target: ATXN1; (-) strand; PAM type: NRG; PAM sequence: AAG
aatatctgggaggatccccc

SEQ ID NO: 58787 - DNA, 20 bp, Artificial Sequence
  Description of Artificial Sequence: Synthetic oligonucleotide
  Target: ATXN1; (-) strand; PAM type: NRG; PAM sequence: AGG
accacgttgcaatatctggg

SEQ ID NO: 58788 - DNA, 20 bp, Artificial Sequence
  Description of Artificial Sequence: Synthetic oligonucleotide
  Target: ATXN1; (-) strand; PAM type: NRG; PAM sequence: GAG
caccacgttgcaatatctgg

SEQ ID NO: 58789 - DNA, 20 bp, Artificial Sequence
  Description of Artificial Sequence: Synthetic oligonucleotide
  Target: ATXN1; (-) strand; PAM type: NRG; PAM sequence: GGG
ctcaccacgttgcaatatct

SEQ ID NO: 58790 - DNA, 20 bp, Artificial Sequence
  Description of Artificial Sequence: Synthetic oligonucleotide
  Target: ATXN1; (-) strand; PAM type: NRG; PAM sequence: TGG
actcaccacgttgcaatatc

SEQ ID NO: 58791 - DNA, 20 bp, Artificial Sequence
  Description of Artificial Sequence: Synthetic oligonucleotide
  Target: ATXN1; (-) strand; PAM type: NRG; PAM sequence: TGG
agcaagcaaaaggggtctga

SEQ ID NO: 58792 - DNA, 20 bp, Artificial Sequence
  Description of Artificial Sequence: Synthetic oligonucleotide
  Target: ATXN1; (-) strand; PAM type: NRG; PAM sequence: GGG
gacagaatagcaagcaaaag

SEQ ID NO: 58793 - DNA, 20 bp, Artificial Sequence
  Description of Artificial Sequence: Synthetic oligonucleotide
  Target: ATXN1; (-) strand; PAM type: NRG; PAM sequence: GGG
ggacagaatagcaagcaaaa

SEQ ID NO: 58794 - DNA, 20 bp, Artificial Sequence
  Description of Artificial Sequence: Synthetic oligonucleotide
  Target: ATXN1; (-) strand; PAM type: NRG; PAM sequence: AGG
aggacagaatagcaagcaaa

SEQ ID NO: 58795 - DNA, 20 bp, Artificial Sequence
  Description of Artificial Sequence: Synthetic oligonucleotide
  Target: ATXN1; (-) strand; PAM type: NRG; PAM sequence: AAG
taggacagaatagcaagcaa

SEQ ID NO: 58796 - DNA, 20 bp, Artificial Sequence
  Description of Artificial Sequence: Synthetic oligonucleotide
  Target: ATXN1; (-) strand; PAM type: NRG; PAM sequence: AAG
gaaaaataggacagaatagc

SEQ ID NO: 58797 - DNA, 20 bp, Artificial Sequence
  Description of Artificial Sequence: Synthetic oligonucleotide
  Target: ATXN1; (-) strand; PAM type: NRG; PAM sequence: TAG
taaggaaaaataggacagaa

SEQ ID NO: 58798 - DNA, 20 bp, Artificial Sequence
  Description of Artificial Sequence: Synthetic oligonucleotide
  Target: ATXN1; (-) strand; PAM type: NRG; PAM sequence: CAG
aattctaaggaaaaatagga

SEQ ID NO: 58799 - DNA, 20 bp, Artificial Sequence
  Description of Artificial Sequence: Synthetic oligonucleotide
  Target: ATXN1; (-) strand; PAM type: NRG; PAM sequence: AGG
cctgaattctaaggaaaaat

SEQ ID NO: 58800 - DNA, 20 bp, Artificial Sequence
  Description of Artificial Sequence: Synthetic oligonucleotide
  Target: ATXN1; (-) strand; PAM type: NRG; PAM sequence: TAG
ccctgaattctaaggaaaaa

SEQ ID NO: 58801 - DNA, 20 bp, Artificial Sequence
  Description of Artificial Sequence: Synthetic oligonucleotide
  Target: ATXN1; (-) strand; PAM type: NRG; PAM sequence: AGG
gttttagcccctgaattcta

SEQ ID NO: 58802 - DNA, 20 bp, Artificial Sequence
  Description of Artificial Sequence: Synthetic oligonucleotide
  Target: ATXN1; (-) strand; PAM type: NRG; PAM sequence: AAG
agttttagcccctgaattct

SEQ ID NO: 58803 - DNA, 20 bp, Artificial Sequence
  Description of Artificial Sequence: Synthetic oligonucleotide
  Target: ATXN1; (-) strand; PAM type: NRG; PAM sequence: TAG
ggctgacaggtgcctagttt

SEQ ID NO: 58804 - DNA, 20 bp, Artificial Sequence
  Description of Artificial Sequence: Synthetic oligonucleotide
  Target: ATXN1; (-) strand; PAM type: NRG; PAM sequence: TAG
ttaactggctgacaggtgcc

SEQ ID NO: 58805 - DNA, 20 bp, Artificial Sequence
  Description of Artificial Sequence: Synthetic oligonucleotide
  Target: ATXN1; (-) strand; PAM type: NRG; PAM sequence: AGG
gttgcttttaactggctgac

SEQ ID NO: 58806 - DNA, 20 bp, Artificial Sequence
  Description of Artificial Sequence: Synthetic oligonucleotide
  Target: ATXN1; (-) strand; PAM type: NRG; PAM sequence: CAG
agttgcttttaactggctga

SEQ ID NO: 58807 - DNA, 20 bp, Artificial Sequence
  Description of Artificial Sequence: Synthetic oligonucleotide
  Target: ATXN1; (-) strand; PAM type: NRG; PAM sequence: TGG
ccatgctagttgcttttaac

SEQ ID NO: 58808 - DNA, 20 bp, Artificial Sequence
  Description of Artificial Sequence: Synthetic oligonucleotide
  Target: ATXN1; (-) strand; PAM type: NRG; PAM sequence: TAG
ccttagtcctgtggccatgc

SEQ ID NO: 58809 - DNA, 20 bp, Artificial Sequence
  Description of Artificial Sequence: Synthetic oligonucleotide
  Target: ATXN1; (-) strand; PAM type: NRG; PAM sequence: TGG
catccatgtccttagtcctg

SEQ ID NO: 58810 - DNA, 20 bp, Artificial Sequence
  Description of Artificial Sequence: Synthetic oligonucleotide
  Target: ATXN1; (-) strand; PAM type: NRG; PAM sequence: TAG
gagcctgacatccatgtcct

SEQ ID NO: 58811 - DNA, 20 bp, Artificial Sequence
  Description of Artificial Sequence: Synthetic oligonucleotide
  Target: ATXN1; (-) strand; PAM type: NRG; PAM sequence: GAG
ttagtgagccctttcccaga

SEQ ID NO: 58812 - DNA, 20 bp, Artificial Sequence
  Description of Artificial Sequence: Synthetic oligonucleotide
  Target: ATXN1; (-) strand; PAM type: NRG; PAM sequence: GAG
tgttagtgagccctttccca

SEQ ID NO: 58813 - DNA, 20 bp, Artificial Sequence
  Description of Artificial Sequence: Synthetic oligonucleotide
  Target: ATXN1; (-) strand; PAM type: NRG; PAM sequence: CAG
gttgttagtgagccctttcc

SEQ ID NO: 58814 - DNA, 20 bp, Artificial Sequence
  Description of Artificial Sequence: Synthetic oligonucleotide
  Target: ATXN1; (-) strand; PAM type: NRG; PAM sequence: GAG
aacagtcgggggttgttagt

SEQ ID NO: 58815 - DNA, 20 bp, Artificial Sequence
  Description of Artificial Sequence: Synthetic oligonucleotide
  Target: ATXN1; (-) strand; PAM type: NRG; PAM sequence: TAG
tccaaacagtcgggggttgt

SEQ ID NO: 58816 - DNA, 20 bp, Artificial Sequence
  Description of Artificial Sequence: Synthetic oligonucleotide
  Target: ATXN1; (-) strand; PAM type: NRG; PAM sequence: GGG
tcctgactccaaacagtcgg

SEQ ID NO: 58817 - DNA, 20 bp, Artificial Sequence
  Description of Artificial Sequence: Synthetic oligonucleotide
  Target: ATXN1; (-) strand; PAM type: NRG; PAM sequence: GGG
ctcctgactccaaacagtcg

SEQ ID NO: 58818 - DNA, 20 bp, Artificial Sequence
  Description of Artificial Sequence: Synthetic oligonucleotide
  Target: ATXN1; (-) strand; PAM type: NRG; PAM sequence: GGG
gctcctgactccaaacagtc

SEQ ID NO: 58819 - DNA, 20 bp, Artificial Sequence
  Description of Artificial Sequence: Synthetic oligonucleotide
  Target: ATXN1; (-) strand; PAM type: NRG; PAM sequence: CGG
tgctcctgactccaaacagt

SEQ ID NO: 58820 - DNA, 20 bp, Artificial Sequence
  Description of Artificial Sequence: Synthetic oligonucleotide
  Target: ATXN1; (-) strand; PAM type: NRG; PAM sequence: CAG
ccaatgctcctgactccaaa

SEQ ID NO: 58821 - DNA, 20 bp, Artificial Sequence
  Description of Artificial Sequence: Synthetic oligonucleotide
  Target: ATXN1; (-) strand; PAM type: NRG; PAM sequence: AGG
gaaaagcagaagctggttcc

SEQ ID NO: 58822 - DNA, 20 bp, Artificial Sequence
  Description of Artificial Sequence: Synthetic oligonucleotide
  Target: ATXN1; (-) strand; PAM type: NRG; PAM sequence: CAG
ggaaaagcagaagctggttc

SEQ ID NO: 58823 - DNA, 20 bp, Artificial Sequence
  Description of Artificial Sequence: Synthetic oligonucleotide
  Target: ATXN1; (-) strand; PAM type: NRG; PAM sequence: TGG
agtgcaggaaaagcagaagc

SEQ ID NO: 58824 - DNA, 20 bp, Artificial Sequence
  Description of Artificial Sequence: Synthetic oligonucleotide
  Target: ATXN1; (-) strand; PAM type: NRG; PAM sequence: AAG
cggaagtgcaggaaaagcag

SEQ ID NO: 58825 - DNA, 20 bp, Artificial Sequence
  Description of Artificial Sequence: Synthetic oligonucleotide
  Target: ATXN1; (-) strand; PAM type: NRG; PAM sequence: CAG
gcccggaagtgcaggaaaag

SEQ ID NO: 58826 - DNA, 20 bp, Artificial Sequence
  Description of Artificial Sequence: Synthetic oligonucleotide
  Target: ATXN1; (-) strand; PAM type: NRG; PAM sequence: AAG
ttagcccggaagtgcaggaa

SEQ ID NO: 58827 - DNA, 20 bp, Artificial Sequence
  Description of Artificial Sequence: Synthetic oligonucleotide
  Target: ATXN1; (-) strand; PAM type: NRG; PAM sequence: AGG
taggcttagcccggaagtgc

SEQ ID NO: 58828 - DNA, 20 bp, Artificial Sequence
  Description of Artificial Sequence: Synthetic oligonucleotide
  Target: ATXN1; (-) strand; PAM type: NRG; PAM sequence: CAG
ctaggcttagcccggaagtg

SEQ ID NO: 58829 - DNA, 20 bp, Artificial Sequence
  Description of Artificial Sequence: Synthetic oligonucleotide
  Target: ATXN1; (-) strand; PAM type: NRG; PAM sequence: AAG
cgaccctaggcttagcccgg

SEQ ID NO: 58830 - DNA, 20 bp, Artificial Sequence
  Description of Artificial Sequence: Synthetic oligonucleotide
  Target: ATXN1; (-) strand; PAM type: NRG; PAM sequence: CGG
tgtcgaccctaggcttagcc

SEQ ID NO: 58831 - DNA, 20 bp, Artificial Sequence
  Description of Artificial Sequence: Synthetic oligonucleotide
  Target: ATXN1; (-) strand; PAM type: NRG; PAM sequence: TAG
ctctctgtcgaccctaggct

SEQ ID NO: 58832 - DNA, 20 bp, Artificial Sequence
  Description of Artificial Sequence: Synthetic oligonucleotide
  Target: ATXN1; (-) strand; PAM type: NRG; PAM sequence: AGG
ctttcctctctgtcgaccct

SEQ ID NO: 58833 - DNA, 20 bp, Artificial Sequence
  Description of Artificial Sequence: Synthetic oligonucleotide
  Target: ATXN1; (-) strand; PAM type: NRG; PAM sequence: TAG
gctttcctctctgtcgaccc

SEQ ID NO: 58834 - DNA, 20 bp, Artificial Sequence
  Description of Artificial Sequence: Synthetic oligonucleotide
  Target: ATXN1; (-) strand; PAM type: NRG; PAM sequence: TGG
gttgagaccccggagctgaa

SEQ ID NO: 58835 - DNA, 20 bp, Artificial Sequence
  Description of Artificial Sequence: Synthetic oligonucleotide
  Target: ATXN1; (-) strand; PAM type: NRG; PAM sequence: GAG
aactttttgttgagaccccg

SEQ ID NO: 58836 - DNA, 20 bp, Artificial Sequence
  Description of Artificial Sequence: Synthetic oligonucleotide
  Target: ATXN1; (-) strand; PAM type: NRG; PAM sequence: CGG
ccaactttttgttgagaccc

SEQ ID NO: 58837 - DNA, 20 bp, Artificial Sequence
  Description of Artificial Sequence: Synthetic oligonucleotide
  Target: ATXN1; (-) strand; PAM type: NRG; PAM sequence: GAG
gggccaaccaactttttgtt

SEQ ID NO: 58838 - DNA, 20 bp, Artificial Sequence
  Description of Artificial Sequence: Synthetic oligonucleotide
  Target: ATXN1; (-) strand; PAM type: NRG; PAM sequence: GGG
gagttctgctcatggctgca

SEQ ID NO: 58839 - DNA, 20 bp, Artificial Sequence
  Description of Artificial Sequence: Synthetic oligonucleotide
  Target: ATXN1; (-) strand; PAM type: NRG; PAM sequence: AGG
agagttctgctcatggctgc

SEQ ID NO: 58840 - DNA, 20 bp, Artificial Sequence
  Description of Artificial Sequence: Synthetic oligonucleotide
  Target: ATXN1; (-) strand; PAM type: NRG; PAM sequence: CAG
gagagttctgctcatggctg

SEQ ID NO: 58841 - DNA, 20 bp, Artificial Sequence
  Description of Artificial Sequence: Synthetic oligonucleotide
  Target: ATXN1; (-) strand; PAM type: NRG; PAM sequence: TGG
aactttgagagttctgctca

SEQ ID NO: 58842 - DNA, 20 bp, Artificial Sequence
  Description of Artificial Sequence: Synthetic oligonucleotide
  Target: ATXN1; (-) strand; PAM type: NRG; PAM sequence: GAG
tttgggctatgtaactttga

SEQ ID NO: 58843 - DNA, 20 bp, Artificial Sequence
  Description of Artificial Sequence: Synthetic oligonucleotide
  Target: ATXN1; (-) strand; PAM type: NRG; PAM sequence: GAG
tgtttgggctatgtaacttt

SEQ ID NO: 58844 - DNA, 20 bp, Artificial Sequence
  Description of Artificial Sequence: Synthetic oligonucleotide
  Target: ATXN1; (-) strand; PAM type: NRG; PAM sequence: GGG
tagatgggtgagtcttgttt

SEQ ID NO: 58845 - DNA, 20 bp, Artificial Sequence
  Description of Artificial Sequence: Synthetic oligonucleotide
  Target: ATXN1; (-) strand; PAM type: NRG; PAM sequence: TGG
atagatgggtgagtcttgtt

SEQ ID NO: 58846 - DNA, 20 bp, Artificial Sequence
  Description of Artificial Sequence: Synthetic oligonucleotide
  Target: ATXN1; (-) strand; PAM type: NRG; PAM sequence: GAG
gatagataggatagatgggt

SEQ ID NO: 58847 - DNA, 20 bp, Artificial Sequence
  Description of Artificial Sequence: Synthetic oligonucleotide
  Target: ATXN1; (-) strand; PAM type: NRG; PAM sequence: GGG
tcaggatagataggatagat

SEQ ID NO: 58848 - DNA, 20 bp, Artificial Sequence
  Description of Artificial Sequence: Synthetic oligonucleotide
  Target: ATXN1; (-) strand; PAM type: NRG; PAM sequence: TGG
gtcaggatagataggataga

SEQ ID NO: 58849 - DNA, 20 bp, Artificial Sequence
  Description of Artificial Sequence: Synthetic oligonucleotide
  Target: ATXN1; (-) strand; PAM type: NRG; PAM sequence: TAG
aagggtcaggatagatagga

SEQ ID NO: 58850 - DNA, 20 bp, Artificial Sequence
  Description of Artificial Sequence: Synthetic oligonucleotide
  Target: ATXN1; (-) strand; PAM type: NRG; PAM sequence: AGG
aggcaagggtcaggatagat

SEQ ID NO: 58851 - DNA, 20 bp, Artificial Sequence
  Description of Artificial Sequence: Synthetic oligonucleotide
  Target: ATXN1; (-) strand; PAM type: NRG; PAM sequence: TAG
gaggcaagggtcaggataga

SEQ ID NO: 58852 - DNA, 20 bp, Artificial Sequence
  Description of Artificial Sequence: Synthetic oligonucleotide
  Target: ATXN1; (-) strand; PAM type: NRG; PAM sequence: TAG
ccaggaggcaagggtcagga

SEQ ID NO: 58853 - DNA, 20 bp, Artificial Sequence
  Description of Artificial Sequence: Synthetic oligonucleotide
  Target: ATXN1; (-) strand; PAM type: NRG; PAM sequence: AGG
ggacccaggaggcaagggtc

SEQ ID NO: 58854 - DNA, 20 bp, Artificial Sequence
  Description of Artificial Sequence: Synthetic oligonucleotide
  Target: ATXN1; (-) strand; PAM type: NRG; PAM sequence: CAG
aggacccaggaggcaagggt

SEQ ID NO: 58855 - DNA, 20 bp, Artificial Sequence
  Description of Artificial Sequence: Synthetic oligonucleotide
  Target: ATXN1; (-) strand; PAM type: NRG; PAM sequence: GGG
tgttaggacccaggaggcaa

SEQ ID NO: 58856 - DNA, 20 bp, Artificial Sequence
  Description of Artificial Sequence: Synthetic oligonucleotide
  Target: ATXN1; (-) strand; PAM type: NRG; PAM sequence: AGG
gtgttaggacccaggaggca

SEQ ID NO: 58857 - DNA, 20 bp, Artificial Sequence
  Description of Artificial Sequence: Synthetic oligonucleotide
  Target: ATXN1; (-) strand; PAM type: NRG; PAM sequence: AAG
ggtgttaggacccaggaggc

SEQ ID NO: 58858 - DNA, 20 bp, Artificial Sequence
  Description of Artificial Sequence: Synthetic oligonucleotide
  Target: ATXN1; (-) strand; PAM type: NRG; PAM sequence: AGG
gacaggtgttaggacccagg

SEQ ID NO: 58859 - DNA, 20 bp, Artificial Sequence
  Description of Artificial Sequence: Synthetic oligonucleotide
  Target: ATXN1; (-) strand; PAM type: NRG; PAM sequence: GAG
tgacaggtgttaggacccag

SEQ ID NO: 58860 - DNA, 20 bp, Artificial Sequence
  Description of Artificial Sequence: Synthetic oligonucleotide
  Target: ATXN1; (-) strand; PAM type: NRG; PAM sequence: AGG
tctgacaggtgttaggaccc

SEQ ID NO: 58861 - DNA, 20 bp, Artificial Sequence
  Description of Artificial Sequence: Synthetic oligonucleotide
  Target: ATXN1; (-) strand; PAM type: NRG; PAM sequence: CAG
gtctgacaggtgttaggacc

SEQ ID NO: 58862 - DNA, 20 bp, Artificial Sequence
  Description of Artificial Sequence: Synthetic oligonucleotide
  Target: ATXN1; (-) strand; PAM type: NRG; PAM sequence: AGG
aagtttgtctgacaggtgtt

SEQ ID NO: 58863 - DNA, 20 bp, Artificial Sequence
  Description of Artificial Sequence: Synthetic oligonucleotide
  Target: ATXN1; (-) strand; PAM type: NRG; PAM sequence: TAG
aaagtttgtctgacaggtgt

SEQ ID NO: 58864 - DNA, 20 bp, Artificial Sequence
  Description of Artificial Sequence: Synthetic oligonucleotide
  Target: ATXN1; (-) strand; PAM type: NRG; PAM sequence: AGG
cgggagaaagtttgtctgac

SEQ ID NO: 58865 - DNA, 20 bp, Artificial Sequence
  Description of Artificial Sequence: Synthetic oligonucleotide
  Target: ATXN1; (-) strand; PAM type: NRG; PAM sequence: CAG
gcgggagaaagtttgtctga

SEQ ID NO: 58866 - DNA, 20 bp, Artificial Sequence
  Description of Artificial Sequence: Synthetic oligonucleotide
  Target: ATXN1; (-) strand; PAM type: NRG; PAM sequence: AAG
tggagaagagaggcgggaga

SEQ ID NO: 58867 - DNA, 20 bp, Artificial Sequence
  Description of Artificial Sequence: Synthetic oligonucleotide
  Target: ATXN1; (-) strand; PAM type: NRG; PAM sequence: GAG
accttggagaagagaggcgg

SEQ ID NO: 58868 - DNA, 20 bp, Artificial Sequence
  Description of Artificial Sequence: Synthetic oligonucleotide
  Target: ATXN1; (-) strand; PAM type: NRG; PAM sequence: GGG
taaccttggagaagagaggc

SEQ ID NO: 58869 - DNA, 20 bp, Artificial Sequence
  Description of Artificial Sequence: Synthetic oligonucleotide
  Target: ATXN1; (-) strand; PAM type: NRG; PAM sequence: CGG
ctaaccttggagaagagagg

SEQ ID NO: 58870 - DNA, 20 bp, Artificial Sequence
  Description of Artificial Sequence: Synthetic oligonucleotide
  Target: ATXN1; (-) strand; PAM type: NRG; PAM sequence: AGG
agactaaccttggagaagag

SEQ ID NO: 58871 - DNA, 20 bp, Artificial Sequence
  Description of Artificial Sequence: Synthetic oligonucleotide
  Target: ATXN1; (-) strand; PAM type: NRG; PAM sequence: GAG
aagactaaccttggagaaga

SEQ ID NO: 58872 - DNA, 20 bp, Artificial Sequence
  Description of Artificial Sequence: Synthetic oligonucleotide
  Target: ATXN1; (-) strand; PAM type: NRG; PAM sequence: GAG
gcaagactaaccttggagaa

SEQ ID NO: 58873 - DNA, 20 bp, Artificial Sequence
  Description of Artificial Sequence: Synthetic oligonucleotide
  Target: ATXN1; (-) strand; PAM type: NRG; PAM sequence: AAG
aagcaagactaaccttggag

SEQ ID NO: 58874 - DNA, 20 bp, Artificial Sequence
  Description of Artificial Sequence: Synthetic oligonucleotide
  Target: ATXN1; (-) strand; PAM type: NRG; PAM sequence: GAG
tagaagcaagactaaccttg

SEQ ID NO: 58875 - DNA, 20 bp, Artificial Sequence
  Description of Artificial Sequence: Synthetic oligonucleotide
  Target: ATXN1; (-) strand; PAM type: NRG; PAM sequence: TGG
tttagaagcaagactaacct

SEQ ID NO: 58876 - DNA, 20 bp, Artificial Sequence
  Description of Artificial Sequence: Synthetic oligonucleotide
  Target: ATXN1; (-) strand; PAM type: NRG; PAM sequence: AAG
agggagtggtttttagaagc

SEQ ID NO: 58877 - DNA, 20 bp, Artificial Sequence
  Description of Artificial Sequence: Synthetic oligonucleotide
  Target: ATXN1; (-) strand; PAM type: NRG; PAM sequence: AAG
ggacagggagtggtttttag

SEQ ID NO: 58878 - DNA, 20 bp, Artificial Sequence
  Description of Artificial Sequence: Synthetic oligonucleotide
  Target: ATXN1; (-) strand; PAM type: NRG; PAM sequence: TAG
cagggacagggagtggtttt

SEQ ID NO: 58879 - DNA, 20 bp, Artificial Sequence
  Description of Artificial Sequence: Synthetic oligonucleotide
  Target: ATXN1; (-) strand; PAM type: NRG; PAM sequence: TGG
agagcaccagggacagggag

SEQ ID NO: 58880 - DNA, 20 bp, Artificial Sequence
  Description of Artificial Sequence: Synthetic oligonucleotide
  Target: ATXN1; (-) strand; PAM type: NRG; PAM sequence: GAG
ggaagagcaccagggacagg

SEQ ID NO: 58881 - DNA, 20 bp, Artificial Sequence
  Description of Artificial Sequence: Synthetic oligonucleotide
  Target: ATXN1; (-) strand; PAM type: NRG; PAM sequence: GGG
ctggaagagcaccagggaca

SEQ ID NO: 58882 - DNA, 20 bp, Artificial Sequence
  Description of Artificial Sequence: Synthetic oligonucleotide
  Target: ATXN1; (-) strand; PAM type: NRG; PAM sequence: AGG
actggaagagcaccagggac

SEQ ID NO: 58883 - DNA, 20 bp, Artificial Sequence
  Description of Artificial Sequence: Synthetic oligonucleotide
  Target: ATXN1; (-) strand; PAM type: NRG; PAM sequence: CAG
aactggaagagcaccaggga

SEQ ID NO: 58884 - DNA, 20 bp, Artificial Sequence
  Description of Artificial Sequence: Synthetic oligonucleotide
  Target: ATXN1; (-) strand; PAM type: NRG; PAM sequence: GGG
gagaaactggaagagcacca

SEQ ID NO: 58885 - DNA, 20 bp, Artificial Sequence
  Description of Artificial Sequence: Synthetic oligonucleotide
  Target: ATXN1; (-) strand; PAM type: NRG; PAM sequence: AGG
ggagaaactggaagagcacc

SEQ ID NO: 58886 - DNA, 20 bp, Artificial Sequence
  Description of Artificial Sequence: Synthetic oligonucleotide
  Target: ATXN1; (-) strand; PAM type: NRG; PAM sequence: CAG
aggagaaactggaagagcac

SEQ ID NO: 58887 - DNA, 20 bp, Artificial Sequence
  Description of Artificial Sequence: Synthetic oligonucleotide
  Target: ATXN1; (-) strand; PAM type: NRG; PAM sequence: GAG
ccttataggagaaactggaa

SEQ ID NO: 58888 - DNA, 20 bp, Artificial Sequence
  Description of Artificial Sequence: Synthetic oligonucleotide
  Target: ATXN1; (-) strand; PAM type: NRG; PAM sequence: AAG
atccttataggagaaactgg

SEQ ID NO: 58889 - DNA, 20 bp, Artificial Sequence
  Description of Artificial Sequence: Synthetic oligonucleotide
  Target: ATXN1; (-) strand; PAM type: NRG; PAM sequence: TGG
atcatccttataggagaaac

SEQ ID NO: 58890 - DNA, 20 bp, Artificial Sequence
  Description of Artificial Sequence: Synthetic oligonucleotide
  Target: ATXN1; (-) strand; PAM type: NRG; PAM sequence: GAG
attagaaatcatccttatag

SEQ ID NO: 58891 - DNA, 20 bp, Artificial Sequence
  Description of Artificial Sequence: Synthetic oligonucleotide
  Target: ATXN1; (-) strand; PAM type: NRG; PAM sequence: AGG
atattagaaatcatccttat

SEQ ID NO: 58892 - DNA, 20 bp, Artificial Sequence
  Description of Artificial Sequence: Synthetic oligonucleotide
  Target: ATXN1; (-) strand; PAM type: NRG; PAM sequence: TAG
tatattagaaatcatcctta

SEQ ID NO: 58893 - DNA, 20 bp, Artificial Sequence
  Description of Artificial Sequence: Synthetic oligonucleotide
  Target: ATXN1; (-) strand; PAM type: NRG; PAM sequence: TAG
cagagtcctgaaatttatat

SEQ ID NO: 58894 - DNA, 20 bp, Artificial Sequence
  Description of Artificial Sequence: Synthetic oligonucleotide
  Target: ATXN1; (-) strand; PAM type: NRG; PAM sequence: GAG
ggtgcctaaagaagggagca

SEQ ID NO: 58895 - DNA, 20 bp, Artificial Sequence
  Description of Artificial Sequence: Synthetic oligonucleotide
  Target: ATXN1; (-) strand; PAM type: NRG; PAM sequence: CAG
tgggtgcctaaagaagggag

SEQ ID NO: 58896 - DNA, 20 bp, Artificial Sequence
  Description of Artificial Sequence: Synthetic oligonucleotide
  Target: ATXN1; (-) strand; PAM type: NRG; PAM sequence: GAG
gcctgggtgcctaaagaagg

SEQ ID NO: 58897 - DNA, 20 bp, Artificial Sequence
  Description of Artificial Sequence: Synthetic oligonucleotide
  Target: ATXN1; (-) strand; PAM type: NRG; PAM sequence: GGG
gagcctgggtgcctaaagaa

SEQ ID NO: 58898 - DNA, 20 bp, Artificial Sequence
  Description of Artificial Sequence: Synthetic oligonucleotide
  Target: ATXN1; (-) strand; PAM type: NRG; PAM sequence: AGG
tgagcctgggtgcctaaaga

SEQ ID NO: 58899 - DNA, 20 bp, Artificial Sequence
  Description of Artificial Sequence: Synthetic oligonucleotide
  Target: ATXN1; (-) strand; PAM type: NRG; PAM sequence: AAG
gtgagcctgggtgcctaaag

SEQ ID NO: 58900 - DNA, 20 bp, Artificial Sequence
  Description of Artificial Sequence: Synthetic oligonucleotide
  Target: ATXN1; (-) strand; PAM type: NRG; PAM sequence: AAG
ttggtgagcctgggtgccta

SEQ ID NO: 58901 - DNA, 20 bp, Artificial Sequence
  Description of Artificial Sequence: Synthetic oligonucleotide
  Target: ATXN1; (-) strand; PAM type: NRG; PAM sequence: GGG
tctttctgattggtgagcct

SEQ ID NO: 58902 - DNA, 20 bp, Artificial Sequence
  Description of Artificial Sequence: Synthetic oligonucleotide
  Target: ATXN1; (-) strand; PAM type: NRG; PAM sequence: TGG
gtctttctgattggtgagcc

SEQ ID NO: 58903 - DNA, 20 bp, Artificial Sequence
  Description of Artificial Sequence: Synthetic oligonucleotide
  Target: ATXN1; (-) strand; PAM type: NRG; PAM sequence: GAG
attatgtctttctgattggt

SEQ ID NO: 58904 - DNA, 20 bp, Artificial Sequence
  Description of Artificial Sequence: Synthetic oligonucleotide
  Target: ATXN1; (-) strand; PAM type: NRG; PAM sequence: TGG
aaaaattatgtctttctgat

SEQ ID NO: 58905 - DNA, 20 bp, Artificial Sequence
  Description of Artificial Sequence: Synthetic oligonucleotide
  Target: ATXN1; (-) strand; PAM type: NRG; PAM sequence: TGG
agtcccccacaacagggctt

SEQ ID NO: 58906 - DNA, 20 bp, Artificial Sequence
  Description of Artificial Sequence: Synthetic oligonucleotide
  Target: ATXN1; (-) strand; PAM type: NRG; PAM sequence: GGG
ccagatagtcccccacaaca

SEQ ID NO: 58907 - DNA, 20 bp, Artificial Sequence
  Description of Artificial Sequence: Synthetic oligonucleotide
  Target: ATXN1; (-) strand; PAM type: NRG; PAM sequence: AGG
tccagatagtcccccacaac

SEQ ID NO: 58908 - DNA, 20 bp, Artificial Sequence
  Description of Artificial Sequence: Synthetic oligonucleotide
  Target: ATXN1; (-) strand; PAM type: NRG; PAM sequence: CAG
ttccagatagtcccccacaa

SEQ ID NO: 58909 - DNA, 20 bp, Artificial Sequence
  Description of Artificial Sequence: Synthetic oligonucleotide
  Target: ATXN1; (-) strand; PAM type: NRG; PAM sequence: TAG
agggatcctaaaattccaga

SEQ ID NO: 58910 - DNA, 20 bp, Artificial Sequence
  Description of Artificial Sequence: Synthetic oligonucleotide
  Target: ATXN1; (-) strand; PAM type: NRG; PAM sequence: CAG
gaggagggatcctaaaattc

SEQ ID NO: 58911 - DNA, 20 bp, Artificial Sequence
  Description of Artificial Sequence: Synthetic oligonucleotide
  Target: ATXN1; (-) strand; PAM type: NRG; PAM sequence: GGG
taggtctgctagtctgagga

SEQ ID NO: 58912 - DNA, 20 bp, Artificial Sequence
  Description of Artificial Sequence: Synthetic oligonucleotide
  Target: ATXN1; (-) strand; PAM type: NRG; PAM sequence: AGG
ttaggtctgctagtctgagg

SEQ ID NO: 58913 - DNA, 20 bp, Artificial Sequence
  Description of Artificial Sequence: Synthetic oligonucleotide
  Target: ATXN1; (-) strand; PAM type: NRG; PAM sequence: GAG
gttaggtctgctagtctgag

SEQ ID NO: 58914 - DNA, 20 bp, Artificial Sequence
  Description of Artificial Sequence: Synthetic oligonucleotide
  Target: ATXN1; (-) strand; PAM type: NRG; PAM sequence: AGG
ttgttaggtctgctagtctg

SEQ ID NO: 58915 - DNA, 20 bp, Artificial Sequence
  Description of Artificial Sequence: Synthetic oligonucleotide
  Target: ATXN1; (-) strand; PAM type: NRG; PAM sequence: GAG
tttgttaggtctgctagtct

SEQ ID NO: 58916 - DNA, 20 bp, Artificial Sequence
  Description of Artificial Sequence: Synthetic oligonucleotide
  Target: ATXN1; (-) strand; PAM type: NRG; PAM sequence: TAG
atagcctttgttaggtctgc

SEQ ID NO: 58917 - DNA, 20 bp, Artificial Sequence
  Description of Artificial Sequence: Synthetic oligonucleotide
  Target: ATXN1; (-) strand; PAM type: NRG; PAM sequence: AGG
ctttgggaatagcctttgtt

SEQ ID NO: 58918 - DNA, 20 bp, Artificial Sequence
  Description of Artificial Sequence: Synthetic oligonucleotide
  Target: ATXN1; (-) strand; PAM type: NRG; PAM sequence: TAG
gctttgggaatagcctttgt

SEQ ID NO: 58919 - DNA, 20 bp, Artificial Sequence
  Description of Artificial Sequence: Synthetic oligonucleotide
  Target: ATXN1; (-) strand; PAM type: NRG; PAM sequence: TAG
tcctatcctagctttgggaa

SEQ ID NO: 58920 - DNA, 20 bp, Artificial Sequence
  Description of Artificial Sequence: Synthetic oligonucleotide
  Target: ATXN1; (-) strand; PAM type: NRG; PAM sequence: GGG
tctcctcctatcctagcttt

SEQ ID NO: 58921 - DNA, 20 bp, Artificial Sequence
  Description of Artificial Sequence: Synthetic oligonucleotide
  Target: ATXN1; (-) strand; PAM type: NRG; PAM sequence: TGG
gtctcctcctatcctagctt

SEQ ID NO: 58922 - DNA, 20 bp, Artificial Sequence
  Description of Artificial Sequence: Synthetic oligonucleotide
  Target: ATXN1; (-) strand; PAM type: NRG; PAM sequence: TAG
ttctgagtctcctcctatcc

SEQ ID NO: 58923 - DNA, 20 bp, Artificial Sequence
  Description of Artificial Sequence: Synthetic oligonucleotide
  Target: ATXN1; (-) strand; PAM type: NRG; PAM sequence: GAG
ataggaaggatataatttct

SEQ ID NO: 58924 - DNA, 20 bp, Artificial Sequence
  Description of Artificial Sequence: Synthetic oligonucleotide
  Target: ATXN1; (-) strand; PAM type: NRG; PAM sequence: AGG
cacttatcatatgaatagga

SEQ ID NO: 58925 - DNA, 20 bp, Artificial Sequence
  Description of Artificial Sequence: Synthetic oligonucleotide
  Target: ATXN1; (-) strand; PAM type: NRG; PAM sequence: AAG
tcacttatcatatgaatagg

SEQ ID NO: 58926 - DNA, 20 bp, Artificial Sequence
  Description of Artificial Sequence: Synthetic oligonucleotide
  Target: ATXN1; (-) strand; PAM type: NRG; PAM sequence: AGG
tcctcacttatcatatgaat

SEQ ID NO: 58927 - DNA, 20 bp, Artificial Sequence
  Description of Artificial Sequence: Synthetic oligonucleotide
  Target: ATXN1; (-) strand; PAM type: NRG; PAM sequence: TAG
gtcctcacttatcatatgaa

SEQ ID NO: 58928 - DNA, 20 bp, Artificial Sequence
  Description of Artificial Sequence: Synthetic oligonucleotide
  Target: ATXN1; (-) strand; PAM type: NRG; PAM sequence: GAG
agggatctccagggttggaa

SEQ ID NO: 58929 - DNA, 20 bp, Artificial Sequence
  Description of Artificial Sequence: Synthetic oligonucleotide
  Target: ATXN1; (-) strand; PAM type: NRG; PAM sequence: AAG
gaagggatctccagggttgg

SEQ ID NO: 58930 - DNA, 20 bp, Artificial Sequence
  Description of Artificial Sequence: Synthetic oligonucleotide
  Target: ATXN1; (-) strand; PAM type: NRG; PAM sequence: TGG
aaggaagggatctccagggt

SEQ ID NO: 58931 - DNA, 20 bp, Artificial Sequence
  Description of Artificial Sequence: Synthetic oligonucleotide
  Target: ATXN1; (-) strand; PAM type: NRG; PAM sequence: GGG
agggaaggaagggatctcca

SEQ ID NO: 58932 - DNA, 20 bp, Artificial Sequence
  Description of Artificial Sequence: Synthetic oligonucleotide
  Target: ATXN1; (-) strand; PAM type: NRG; PAM sequence: AGG
gagggaaggaagggatctcc

SEQ ID NO: 58933 - DNA, 20 bp, Artificial Sequence
  Description of Artificial Sequence: Synthetic oligonucleotide
  Target: ATXN1; (-) strand; PAM type: NRG; PAM sequence: CAG
tgagggaaggaagggatctc

SEQ ID NO: 58934 - DNA, 20 bp, Artificial Sequence
  Description of Artificial Sequence: Synthetic oligonucleotide
  Target: ATXN1; (-) strand; PAM type: NRG; PAM sequence: GGG
ccataccctgagggaaggaa

SEQ ID NO: 58935 - DNA, 20 bp, Artificial Sequence
  Description of Artificial Sequence: Synthetic oligonucleotide
  Target: ATXN1; (-) strand; PAM type: NRG; PAM sequence: AGG
gccataccctgagggaagga

SEQ ID NO: 58936 - DNA, 20 bp, Artificial Sequence
  Description of Artificial Sequence: Synthetic oligonucleotide
  Target: ATXN1; (-) strand; PAM type: NRG; PAM sequence: AAG
ggccataccctgagggaagg

SEQ ID NO: 58937 - DNA, 20 bp, Artificial Sequence
  Description of Artificial Sequence: Synthetic oligonucleotide
  Target: ATXN1; (-) strand; PAM type: NRG; PAM sequence: AGG
gagggccataccctgaggga

SEQ ID NO: 58938 - DNA, 20 bp, Artificial Sequence
  Description of Artificial Sequence: Synthetic oligonucleotide
  Target: ATXN1; (-) strand; PAM type: NRG; PAM sequence: AAG
ggagggccataccctgaggg

SEQ ID NO: 58939 - DNA, 20 bp, Artificial Sequence
  Description of Artificial Sequence: Synthetic oligonucleotide
  Target: ATXN1; (-) strand; PAM type: NRG; PAM sequence: GGG
agtggagggccataccctga

SEQ ID NO: 58940 - DNA, 20 bp, Artificial Sequence
  Description of Artificial Sequence: Synthetic oligonucleotide
  Target: ATXN1; (-) strand; PAM type: NRG; PAM sequence: AGG
gagtggagggccataccctg

SEQ ID NO: 58941 - DNA, 20 bp, Artificial Sequence
  Description of Artificial Sequence: Synthetic oligonucleotide
  Target: ATXN1; (-) strand; PAM type: NRG; PAM sequence: GAG
ggagtggagggccataccct

SEQ ID NO: 58942 - DNA, 20 bp, Artificial Sequence
  Description of Artificial Sequence: Synthetic oligonucleotide
  Target: ATXN1; (-) strand; PAM type: NRG; PAM sequence: GGG
atgcctcaaaatggagtgga

SEQ ID NO: 58943 - DNA, 20 bp, Artificial Sequence
  Description of Artificial Sequence: Synthetic oligonucleotide
  Target: ATXN1; (-) strand; PAM type: NRG; PAM sequence: AGG
tatgcctcaaaatggagtgg

SEQ ID NO: 58944 - DNA, 20 bp, Artificial Sequence
  Description of Artificial Sequence: Synthetic oligonucleotide
  Target: ATXN1; (-) strand; PAM type: NRG; PAM sequence: GAG
atatgcctcaaaatggagtg

SEQ ID NO: 58945 - DNA, 20 bp, Artificial Sequence
  Description of Artificial Sequence: Synthetic oligonucleotide
  Target: ATXN1; (-) strand; PAM type: NRG; PAM sequence: TGG
taatatgcctcaaaatggag

SEQ ID NO: 58946 - DNA, 20 bp, Artificial Sequence
  Description of Artificial Sequence: Synthetic oligonucleotide
  Target: ATXN1; (-) strand; PAM type: NRG; PAM sequence: GAG
agataatatgcctcaaaatg

SEQ ID NO: 58947 - DNA, 20 bp, Artificial Sequence
  Description of Artificial Sequence: Synthetic oligonucleotide
  Target: ATXN1; (-) strand; PAM type: NRG; PAM sequence: TGG
aaagataatatgcctcaaaa

SEQ ID NO: 58948 - DNA, 20 bp, Artificial Sequence
  Description of Artificial Sequence: Synthetic oligonucleotide
  Target: ATXN1; (-) strand; PAM type: NRG; PAM sequence: AAG
gaccttacccttgtactata

SEQ ID NO: 58949 - DNA, 20 bp, Artificial Sequence
  Description of Artificial Sequence: Synthetic oligonucleotide
  Target: ATXN1; (-) strand; PAM type: NRG; PAM sequence: AGG
tgttttctcctgttgttatt

SEQ ID NO: 58950 - DNA, 20 bp, Artificial Sequence
  Description of Artificial Sequence: Synthetic oligonucleotide
  Target: ATXN1; (-) strand; PAM type: NRG; PAM sequence: TAG
gtgttttctcctgttgttat

SEQ ID NO: 58951 - DNA, 20 bp, Artificial Sequence
  Description of Artificial Sequence: Synthetic oligonucleotide
  Target: ATXN1; (-) strand; PAM type: NRG; PAM sequence: AAG
tgaaaacctgttagagtcct

SEQ ID NO: 58952 - DNA, 20 bp, Artificial Sequence
  Description of Artificial Sequence: Synthetic oligonucleotide
  Target: ATXN1; (-) strand; PAM type: NRG; PAM sequence: GAG
gcattcttgaaaacctgtta

SEQ ID NO: 58953 - DNA, 20 bp, Artificial Sequence
  Description of Artificial Sequence: Synthetic oligonucleotide
  Target: ATXN1; (-) strand; PAM type: NRG; PAM sequence: TAG
atgcattcttgaaaacctgt

SEQ ID NO: 58954 - DNA, 20 bp, Artificial Sequence
  Description of Artificial Sequence: Synthetic oligonucleotide
  Target: ATXN1; (-) strand; PAM type: NRG; PAM sequence: TGG
ctgagaaaagtcagatttag

SEQ ID NO: 58955 - DNA, 20 bp, Artificial Sequence
  Description of Artificial Sequence: Synthetic oligonucleotide
  Target: ATXN1; (-) strand; PAM type: NRG; PAM sequence: TAG
ggactgagaaaagtcagatt

SEQ ID NO: 58956 - DNA, 20 bp, Artificial Sequence
  Description of Artificial Sequence: Synthetic oligonucleotide
  Target: ATXN1; (-) strand; PAM type: NRG; PAM sequence: CAG
caaagaggactgagaaaagt

SEQ ID NO: 58957 - DNA, 20 bp, Artificial Sequence
  Description of Artificial Sequence: Synthetic oligonucleotide
  Target: ATXN1; (-) strand; PAM type: NRG; PAM sequence: AAG
accacaaagaggactgagaa

SEQ ID NO: 58958 - DNA, 20 bp, Artificial Sequence
  Description of Artificial Sequence: Synthetic oligonucleotide
  Target: ATXN1; (-) strand; PAM type: NRG; PAM sequence: GAG
tttagaccacaaagaggact

SEQ ID NO: 58959 - DNA, 20 bp, Artificial Sequence
  Description of Artificial Sequence: Synthetic oligonucleotide
  Target: ATXN1; (-) strand; PAM type: NRG; PAM sequence: AGG
ttcgtctttagaccacaaag

SEQ ID NO: 58960 - DNA, 20 bp, Artificial Sequence
  Description of Artificial Sequence: Synthetic oligonucleotide
  Target: ATXN1; (-) strand; PAM type: NRG; PAM sequence: GAG
tttcgtctttagaccacaaa

SEQ ID NO: 58961 - DNA, 20 bp, Artificial Sequence
  Description of Artificial Sequence: Synthetic oligonucleotide
  Target: ATXN1; (-) strand; PAM type: NRG; PAM sequence: AAG
cctttcgtctttagaccaca

SEQ ID NO: 58962 - DNA, 20 bp, Artificial Sequence
  Description of Artificial Sequence: Synthetic oligonucleotide
  Target: ATXN1; (-) strand; PAM type: NRG; PAM sequence: TAG
gcacccttgcctttcgtctt

SEQ ID NO: 58963 - DNA, 20 bp, Artificial Sequence
  Description of Artificial Sequence: Synthetic oligonucleotide
  Target: ATXN1; (-) strand; PAM type: NRG; PAM sequence: TGG
gatttagtggcccttaccaa

SEQ ID NO: 58964 - DNA, 20 bp, Artificial Sequence
  Description of Artificial Sequence: Synthetic oligonucleotide
  Target: ATXN1; (-) strand; PAM type: NRG; PAM sequence: TGG
ctgaggaaggtcagatttag

SEQ ID NO: 58965 - DNA, 20 bp, Artificial Sequence
  Description of Artificial Sequence: Synthetic oligonucleotide
  Target: ATXN1; (-) strand; PAM type: NRG; PAM sequence: TAG
ggactgaggaaggtcagatt

SEQ ID NO: 58966 - DNA, 20 bp, Artificial Sequence
  Description of Artificial Sequence: Synthetic oligonucleotide
  Target: ATXN1; (-) strand; PAM type: NRG; PAM sequence: CAG
caaaaaggactgaggaaggt

SEQ ID NO: 58967 - DNA, 20 bp, Artificial Sequence
  Description of Artificial Sequence: Synthetic oligonucleotide
  Target: ATXN1; (-) strand; PAM type: NRG; PAM sequence: AGG
accacaaaaaggactgagga

SEQ ID NO: 58968 - DNA, 20 bp, Artificial Sequence
  Description of Artificial Sequence: Synthetic oligonucleotide
  Target: ATXN1; (-) strand; PAM type: NRG; PAM sequence: AAG
gaccacaaaaaggactgagg

SEQ ID NO: 58969 - DNA, 20 bp, Artificial Sequence
  Description of Artificial Sequence: Synthetic oligonucleotide
  Target: ATXN1; (-) strand; PAM type: NRG; PAM sequence: AGG
ctagaccacaaaaaggactg

SEQ ID NO: 58970 - DNA, 20 bp, Artificial Sequence
  Description of Artificial Sequence: Synthetic oligonucleotide
  Target: ATXN1; (-) strand; PAM type: NRG; PAM sequence: GAG
cctagaccacaaaaaggact

SEQ ID NO: 58971 - DNA, 20 bp, Artificial Sequence
  Description of Artificial Sequence: Synthetic oligonucleotide
  Target: ATXN1; (-) strand; PAM type: NRG; PAM sequence: AGG
tttcctcctagaccacaaaa

SEQ ID NO: 58972 - DNA, 20 bp, Artificial Sequence
  Description of Artificial Sequence: Synthetic oligonucleotide
  Target: ATXN1; (-) strand; PAM type: NRG; PAM sequence: AAG
ttttcctcctagaccacaaa

SEQ ID NO: 58973 - DNA, 20 bp, Artificial Sequence
  Description of Artificial Sequence: Synthetic oligonucleotide
  Target: ATXN1; (-) strand; PAM type: NRG; PAM sequence: TAG
ggaaacactagttttcctcc

SEQ ID NO: 58974 - DNA, 20 bp, Artificial Sequence
  Description of Artificial Sequence: Synthetic oligonucleotide
  Target: ATXN1; (-) strand; PAM type: NRG; PAM sequence: TAG
caaagcagcagcggaaacac

SEQ ID NO: 58975 - DNA, 20 bp, Artificial Sequence
  Description of Artificial Sequence: Synthetic oligonucleotide
  Target: ATXN1; (-) strand; PAM type: NRG; PAM sequence: CGG
tgtgctcaccaaagcagcag

SEQ ID NO: 58976 - DNA, 20 bp, Artificial Sequence
  Description of Artificial Sequence: Synthetic oligonucleotide
  Target: ATXN1; (-) strand; PAM type: NRG; PAM sequence: CAG
agctgtgctcaccaaagcag

SEQ ID NO: 58977 - DNA, 20 bp, Artificial Sequence
  Description of Artificial Sequence: Synthetic oligonucleotide
  Target: ATXN1; (-) strand; PAM type: NRG; PAM sequence: CAG
aatagctgtgctcaccaaag

SEQ ID NO: 58978 - DNA, 20 bp, Artificial Sequence
  Description of Artificial Sequence: Synthetic oligonucleotide
  Target: ATXN1; (-) strand; PAM type: NRG; PAM sequence: AAG
cggaatagctgtgctcacca

SEQ ID NO: 58979 - DNA, 20 bp, Artificial Sequence
  Description of Artificial Sequence: Synthetic oligonucleotide
  Target: ATXN1; (-) strand; PAM type: NRG; PAM sequence: TAG
ctggatcctgctgttcggaa

SEQ ID NO: 58980 - DNA, 20 bp, Artificial Sequence
  Description of Artificial Sequence: Synthetic oligonucleotide
  Target: ATXN1; (-) strand; PAM type: NRG; PAM sequence: CGG
agtccctggatcctgctgtt

SEQ ID NO: 58981 - DNA, 20 bp, Artificial Sequence
  Description of Artificial Sequence: Synthetic oligonucleotide
  Target: ATXN1; (-) strand; PAM type: NRG; PAM sequence: TGG
caagaacccacaacagtccc

SEQ ID NO: 58982 - DNA, 20 bp, Artificial Sequence
  Description of Artificial Sequence: Synthetic oligonucleotide
  Target: ATXN1; (-) strand; PAM type: NRG; PAM sequence: CAG
ccctgcccaagaacccacaa

SEQ ID NO: 58983 - DNA, 20 bp, Artificial Sequence
  Description of Artificial Sequence: Synthetic oligonucleotide
  Target: ATXN1; (-) strand; PAM type: NRG; PAM sequence: AAG
tttttctcttctccctgccc

SEQ ID NO: 58984 - DNA, 20 bp, Artificial Sequence
  Description of Artificial Sequence: Synthetic oligonucleotide
  Target: ATXN1; (-) strand; PAM type: NRG; PAM sequence: CAG
ctgaaagaaaaaaccgcctg

SEQ ID NO: 58985 - DNA, 20 bp, Artificial Sequence
  Description of Artificial Sequence: Synthetic oligonucleotide
  Target: ATXN1; (-) strand; PAM type: NRG; PAM sequence: AAG
cctgggtgtttcccatctga

SEQ ID NO: 58986 - DNA, 20 bp, Artificial Sequence
  Description of Artificial Sequence: Synthetic oligonucleotide
  Target: ATXN1; (-) strand; PAM type: NRG; PAM sequence: GGG
gggtgagcttgttgatgcct

SEQ ID NO: 58987 - DNA, 20 bp, Artificial Sequence
  Description of Artificial Sequence: Synthetic oligonucleotide
  Target: ATXN1; (-) strand; PAM type: NRG; PAM sequence: TGG
agggtgagcttgttgatgcc

SEQ ID NO: 58988 - DNA, 20 bp, Artificial Sequence
  Description of Artificial Sequence: Synthetic oligonucleotide
  Target: ATXN1; (-) strand; PAM type: NRG; PAM sequence: GAG
ttaggatgcgtttcaagggt

SEQ ID NO: 58989 - DNA, 20 bp, Artificial Sequence
  Description of Artificial Sequence: Synthetic oligonucleotide
  Target: ATXN1; (-) strand; PAM type: NRG; PAM sequence: GGG
tggcttaggatgcgtttcaa

SEQ ID NO: 58990 - DNA, 20 bp, Artificial Sequence
  Description of Artificial Sequence: Synthetic oligonucleotide
  Target: ATXN1; (-) strand; PAM type: NRG; PAM sequence: AGG
atggcttaggatgcgtttca

SEQ ID NO: 58991 - DNA, 20 bp, Artificial Sequence
  Description of Artificial Sequence: Synthetic oligonucleotide
  Target: ATXN1; (-) strand; PAM type: NRG; PAM sequence: AAG
aatggcttaggatgcgtttc

SEQ ID NO: 58992 - DNA, 20 bp, Artificial Sequence
  Description of Artificial Sequence: Synthetic oligonucleotide
  Target: ATXN1; (-) strand; PAM type: NRG; PAM sequence: AGG
caaattggtcccaatggctt

SEQ ID NO: 58993 - DNA, 20 bp, Artificial Sequence
  Description of Artificial Sequence: Synthetic oligonucleotide
  Target: ATXN1; (-) strand; PAM type: NRG; PAM sequence: TAG
acaaattggtcccaatggct

SEQ ID NO: 58994 - DNA, 20 bp, Artificial Sequence
  Description of Artificial Sequence: Synthetic oligonucleotide
  Target: ATXN1; (-) strand; PAM type: NRG; PAM sequence: TGG
gcgggacaaattggtcccaa

SEQ ID NO: 58995 - DNA, 20 bp, Artificial Sequence
  Description of Artificial Sequence: Synthetic oligonucleotide
  Target: ATXN1; (-) strand; PAM type: NRG; PAM sequence: TGG
tcagggtttgcgggacaaat

SEQ ID NO: 58996 - DNA, 20 bp, Artificial Sequence
  Description of Artificial Sequence: Synthetic oligonucleotide
  Target: ATXN1; (-) strand; PAM type: NRG; PAM sequence: GGG
gcttctttttcagggtttgc

SEQ ID NO: 58997 - DNA, 20 bp, Artificial Sequence
  Description of Artificial Sequence: Synthetic oligonucleotide
  Target: ATXN1; (-) strand; PAM type: NRG; PAM sequence: CGG
cgcttctttttcagggtttg

SEQ ID NO: 58998 - DNA, 20 bp, Artificial Sequence
  Description of Artificial Sequence: Synthetic oligonucleotide
  Target: ATXN1; (-) strand; PAM type: NRG; PAM sequence: GGG
aataagccgcttctttttca

SEQ ID NO: 58999 - DNA, 20 bp, Artificial Sequence
  Description of Artificial Sequence: Synthetic oligonucleotide
  Target: ATXN1; (-) strand; PAM type: NRG; PAM sequence: AGG
aaataagccgcttctttttc

SEQ ID NO: 59000 - DNA, 20 bp, Artificial Sequence
  Description of Artificial Sequence: Synthetic oligonucleotide
  Target: ATXN1; (-) strand; PAM type: NRG; PAM sequence: CAG
aaaataagccgcttcttttt

SEQ ID NO: 59001 - DNA, 20 bp, Artificial Sequence
  Description of Artificial Sequence: Synthetic oligonucleotide
  Target: ATXN1; (-) strand; PAM type: NRG; PAM sequence: AAG
gaccgtagtgcagaaaaaat

SEQ ID NO: 59002 - DNA, 20 bp, Artificial Sequence
  Description of Artificial Sequence: Synthetic oligonucleotide
  Target: ATXN1; (-) strand; PAM type: NRG; PAM sequence: CAG
attaaggccagaccgtagtg

SEQ ID NO: 59003 - DNA, 20 bp, Artificial Sequence
  Description of Artificial Sequence: Synthetic oligonucleotide
  Target: ATXN1; (-) strand; PAM type: NRG; PAM sequence: TAG
ataatattaaggccagaccg

SEQ ID NO: 59004 - DNA, 20 bp, Artificial Sequence
  Description of Artificial Sequence: Synthetic oligonucleotide
  Target: ATXN1; (-) strand; PAM type: NRG; PAM sequence: CAG
tagagagataatattaaggc

SEQ ID NO: 59005 - DNA, 20 bp, Artificial Sequence
  Description of Artificial Sequence: Synthetic oligonucleotide
  Target: ATXN1; (-) strand; PAM type: NRG; PAM sequence: AGG
ctattagagagataatatta

SEQ ID NO: 59006 - DNA, 20 bp, Artificial Sequence
  Description of Artificial Sequence: Synthetic oligonucleotide
  Target: ATXN1; (-) strand; PAM type: NRG; PAM sequence: AAG
cctattagagagataatatt

SEQ ID NO: 59007 - DNA, 20 bp, Artificial Sequence
  Description of Artificial Sequence: Synthetic oligonucleotide
  Target: ATXN1; (-) strand; PAM type: NRG; PAM sequence: GAG
gaccatttttccctattaga

SEQ ID NO: 59008 - DNA, 20 bp, Artificial Sequence
  Description of Artificial Sequence: Synthetic oligonucleotide
  Target: ATXN1; (-) strand; PAM type: NRG; PAM sequence: GAG
gtgaccatttttccctatta

SEQ ID NO: 59009 - DNA, 20 bp, Artificial Sequence
  Description of Artificial Sequence: Synthetic oligonucleotide
  Target: ATXN1; (-) strand; PAM type: NRG; PAM sequence: TAG
aggtgaccatttttccctat

SEQ ID NO: 59010 - DNA, 20 bp, Artificial Sequence
  Description of Artificial Sequence: Synthetic oligonucleotide
  Target: ATXN1; (-) strand; PAM type: NRG; PAM sequence: AGG
ttgtaatttatacttccctc

SEQ ID NO: 59011 - DNA, 20 bp, Artificial Sequence
  Description of Artificial Sequence: Synthetic oligonucleotide
  Target: ATXN1; (-) strand; PAM type: NRG; PAM sequence: CAG
gttgtaatttatacttccct

SEQ ID NO: 59012 - DNA, 20 bp, Artificial Sequence
  Description of Artificial Sequence: Synthetic oligonucleotide
  Target: ATXN1; (-) strand; PAM type: NRG; PAM sequence: TAG
gaaaaggtcaacctgcagaa

SEQ ID NO: 59013 - DNA, 20 bp, Artificial Sequence
  Description of Artificial Sequence: Synthetic oligonucleotide
  Target: ATXN1; (-) strand; PAM type: NRG; PAM sequence: CAG
ttacagaaaaggtcaacctg

SEQ ID NO: 59014 - DNA, 20 bp, Artificial Sequence
  Description of Artificial Sequence: Synthetic oligonucleotide
  Target: ATXN1; (-) strand; PAM type: NRG; PAM sequence: AGG
tcccttccctcttacagaaa

SEQ ID NO: 59015 - DNA, 20 bp, Artificial Sequence
  Description of Artificial Sequence: Synthetic oligonucleotide
  Target: ATXN1; (-) strand; PAM type: NRG; PAM sequence: AAG
ttcccttccctcttacagaa

SEQ ID NO: 59016 - DNA, 20 bp, Artificial Sequence
  Description of Artificial Sequence: Synthetic oligonucleotide
  Target: ATXN1; (-) strand; PAM type: NRG; PAM sequence: CAG
tccatttcccttccctctta

SEQ ID NO: 59017 - DNA, 20 bp, Artificial Sequence
  Description of Artificial Sequence: Synthetic oligonucleotide
  Target: ATXN1; (-) strand; PAM type: NRG; PAM sequence: AGG
aaaaagaaagcttggacata

SEQ ID NO: 59018 - DNA, 20 bp, Artificial Sequence
  Description of Artificial Sequence: Synthetic oligonucleotide
  Target: ATXN1; (-) strand; PAM type: NRG; PAM sequence: AAG
taaaaagaaagcttggacat

SEQ ID NO: 59019 - DNA, 20 bp, Artificial Sequence
  Description of Artificial Sequence: Synthetic oligonucleotide
  Target: ATXN1; (-) strand; PAM type: NRG; PAM sequence: TGG
ccttcagtaaaaagaaagct

SEQ ID NO: 59020 - DNA, 20 bp, Artificial Sequence
  Description of Artificial Sequence: Synthetic oligonucleotide
  Target: ATXN1; (-) strand; PAM type: NRG; PAM sequence: AAG
attatccttcagtaaaaaga

SEQ ID NO: 59021 - DNA, 20 bp, Artificial Sequence
  Description of Artificial Sequence: Synthetic oligonucleotide
  Target: ATXN1; (-) strand; PAM type: NRG; PAM sequence: AAG
gtggattatccttcagtaaa

SEQ ID NO: 59022 - DNA, 20 bp, Artificial Sequence
  Description of Artificial Sequence: Synthetic oligonucleotide
  Target: ATXN1; (-) strand; PAM type: NRG; PAM sequence: CAG
catagttgtggattatcctt

SEQ ID NO: 59023 - DNA, 20 bp, Artificial Sequence
  Description of Artificial Sequence: Synthetic oligonucleotide
  Target: ATXN1; (-) strand; PAM type: NRG; PAM sequence: TGG
tcgccagctttgcatagttg

SEQ ID NO: 59024 - DNA, 20 bp, Artificial Sequence
  Description of Artificial Sequence: Synthetic oligonucleotide
  Target: ATXN1; (-) strand; PAM type: NRG; PAM sequence: TAG
tgtaaatcgccagctttgca

SEQ ID NO: 59025 - DNA, 20 bp, Artificial Sequence
  Description of Artificial Sequence: Synthetic oligonucleotide
  Target: ATXN1; (-) strand; PAM type: NRG; PAM sequence: CAG
tcctgtggaatgtaaatcgc

SEQ ID NO: 59026 - DNA, 20 bp, Artificial Sequence
  Description of Artificial Sequence: Synthetic oligonucleotide
  Target: ATXN1; (-) strand; PAM type: NRG; PAM sequence: TGG
taatctgagaggtcctcctg

SEQ ID NO: 59027 - DNA, 20 bp, Artificial Sequence
  Description of Artificial Sequence: Synthetic oligonucleotide
  Target: ATXN1; (-) strand; PAM type: NRG; PAM sequence: AGG
ggatatggaggtaatctgag

SEQ ID NO: 59028 - DNA, 20 bp, Artificial Sequence
  Description of Artificial Sequence: Synthetic oligonucleotide
  Target: ATXN1; (-) strand; PAM type: NRG; PAM sequence: GAG
aggatatggaggtaatctga

SEQ ID NO: 59029 - DNA, 20 bp, Artificial Sequence
  Description of Artificial Sequence: Synthetic oligonucleotide
  Target: ATXN1; (-) strand; PAM type: NRG; PAM sequence: GAG
ctaggatatggaggtaatct

SEQ ID NO: 59030 - DNA, 20 bp, Artificial Sequence
  Description of Artificial Sequence: Synthetic oligonucleotide
  Target: ATXN1; (-) strand; PAM type: NRG; PAM sequence: AGG
gtagggaggctaggatatgg

SEQ ID NO: 59031 - DNA, 20 bp, Artificial Sequence
  Description of Artificial Sequence: Synthetic oligonucleotide
  Target: ATXN1; (-) strand; PAM type: NRG; PAM sequence: GAG
tgtagggaggctaggatatg

SEQ ID NO: 59032 - DNA, 20 bp, Artificial Sequence
  Description of Artificial Sequence: Synthetic oligonucleotide
  Target: ATXN1; (-) strand; PAM type: NRG; PAM sequence: TGG
gctgtagggaggctaggata

SEQ ID NO: 59033 - DNA, 20 bp, Artificial Sequence
  Description of Artificial Sequence: Synthetic oligonucleotide
  Target: ATXN1; (-) strand; PAM type: NRG; PAM sequence: AGG
aggggagctgtagggaggct

SEQ ID NO: 59034 - DNA, 20 bp, Artificial Sequence
  Description of Artificial Sequence: Synthetic oligonucleotide
  Target: ATXN1; (-) strand; PAM type: NRG; PAM sequence: TAG
aaggggagctgtagggaggc

SEQ ID NO: 59035 - DNA, 20 bp, Artificial Sequence
  Description of Artificial Sequence: Synthetic oligonucleotide
  Target: ATXN1; (-) strand; PAM type: NRG; PAM sequence: AGG
taggaaggggagctgtaggg

SEQ ID NO: 59036 - DNA, 20 bp, Artificial Sequence
  Description of Artificial Sequence: Synthetic oligonucleotide
  Target: ATXN1; (-) strand; PAM type: NRG; PAM sequence: GAG
ataggaaggggagctgtagg

SEQ ID NO: 59037 - DNA, 20 bp, Artificial Sequence
  Description of Artificial Sequence: Synthetic oligonucleotide
  Target: ATXN1; (-) strand; PAM type: NRG; PAM sequence: GGG
taataggaaggggagctgta

SEQ ID NO: 59038 - DNA, 20 bp, Artificial Sequence
  Description of Artificial Sequence: Synthetic oligonucleotide
  Target: ATXN1; (-) strand; PAM type: NRG; PAM sequence: AGG
ttaataggaaggggagctgt

SEQ ID NO: 59039 - DNA, 20 bp, Artificial Sequence
  Description of Artificial Sequence: Synthetic oligonucleotide
  Target: ATXN1; (-) strand; PAM type: NRG; PAM sequence: TAG
attaataggaaggggagctg

SEQ ID NO: 59040 - DNA, 20 bp, Artificial Sequence
  Description of Artificial Sequence: Synthetic oligonucleotide
  Target: ATXN1; (-) strand; PAM type: NRG; PAM sequence: GAG
ctcatcattaataggaaggg

SEQ ID NO: 59041 - DNA, 20 bp, Artificial Sequence
  Description of Artificial Sequence: Synthetic oligonucleotide
  Target: ATXN1; (-) strand; PAM type: NRG; PAM sequence: GGG
ggctcatcattaataggaag

SEQ ID NO: 59042 - DNA, 20 bp, Artificial Sequence
  Description of Artificial Sequence: Synthetic oligonucleotide
  Target: ATXN1; (-) strand; PAM type: NRG; PAM sequence: GGG
aggctcatcattaataggaa

SEQ ID NO: 59043 - DNA, 20 bp, Artificial Sequence
  Description of Artificial Sequence: Synthetic oligonucleotide
  Target: ATXN1; (-) strand; PAM type: NRG; PAM sequence: AGG
gaggctcatcattaatagga

SEQ ID NO: 59044 - DNA, 20 bp, Artificial Sequence
  Description of Artificial Sequence: Synthetic oligonucleotide
  Target: ATXN1; (-) strand; PAM type: NRG; PAM sequence: AAG
ggaggctcatcattaatagg

SEQ ID NO: 59045 - DNA, 20 bp, Artificial Sequence
  Description of Artificial Sequence: Synthetic oligonucleotide
  Target: ATXN1; (-) strand; PAM type: NRG; PAM sequence: AGG
agaggaggctcatcattaat

SEQ ID NO: 59046 - DNA, 20 bp, Artificial Sequence
  Description of Artificial Sequence: Synthetic oligonucleotide
  Target: ATXN1; (-) strand; PAM type: NRG; PAM sequence: TAG
tagaggaggctcatcattaa

SEQ ID NO: 59047 - DNA, 20 bp, Artificial Sequence
  Description of Artificial Sequence: Synthetic oligonucleotide
  Target: ATXN1; (-) strand; PAM type: NRG; PAM sequence: AGG
tggatggaggagattagagg

SEQ ID NO: 59048 - DNA, 20 bp, Artificial Sequence
  Description of Artificial Sequence: Synthetic oligonucleotide
  Target: ATXN1; (-) strand; PAM type: NRG; PAM sequence: GAG
ctggatggaggagattagag

SEQ ID NO: 59049 - DNA, 20 bp, Artificial Sequence
  Description of Artificial Sequence: Synthetic oligonucleotide
  Target: ATXN1; (-) strand; PAM type: NRG; PAM sequence: AGG
ttctggatggaggagattag

SEQ ID NO: 59050 - DNA, 20 bp, Artificial Sequence
  Description of Artificial Sequence: Synthetic oligonucleotide
  Target: ATXN1; (-) strand; PAM type: NRG; PAM sequence: GAG
cttctggatggaggagatta

SEQ ID NO: 59051 - DNA, 20 bp, Artificial Sequence
  Description of Artificial Sequence: Synthetic oligonucleotide
  Target: ATXN1; (-) strand; PAM type: NRG; PAM sequence: TAG
tccttctggatggaggagat

SEQ ID NO: 59052 - DNA, 20 bp, Artificial Sequence
  Description of Artificial Sequence: Synthetic oligonucleotide
  Target: ATXN1; (-) strand; PAM type: NRG; PAM sequence: GAG
ttgtttccttctggatggag

SEQ ID NO: 59053 - DNA, 20 bp, Artificial Sequence
  Description of Artificial Sequence: Synthetic oligonucleotide
  Target: ATXN1; (-) strand; PAM type: NRG; PAM sequence: AGG
gcttgtttccttctggatgg

SEQ ID NO: 59054 - DNA, 20 bp, Artificial Sequence
  Description of Artificial Sequence: Synthetic oligonucleotide
  Target: ATXN1; (-) strand; PAM type: NRG; PAM sequence: GAG
tgcttgtttccttctggatg

SEQ ID NO: 59055 - DNA, 20 bp, Artificial Sequence
  Description of Artificial Sequence: Synthetic oligonucleotide
  Target: ATXN1; (-) strand; PAM type: NRG; PAM sequence: TGG
tttgcttgtttccttctgga

SEQ ID NO: 59056 - DNA, 20 bp, Artificial Sequence
  Description of Artificial Sequence: Synthetic oligonucleotide
  Target: ATXN1; (-) strand; PAM type: NRG; PAM sequence: TGG
tttctttgcttgtttccttc

SEQ ID NO: 59057 - DNA, 20 bp, Artificial Sequence
  Description of Artificial Sequence: Synthetic oligonucleotide
  Target: ATXN1; (-) strand; PAM type: NRG; PAM sequence: TGG
tgaggggtttggtggtcctt

SEQ ID NO: 59058 - DNA, 20 bp, Artificial Sequence
  Description of Artificial Sequence: Synthetic oligonucleotide
  Target: ATXN1; (-) strand; PAM type: NRG; PAM sequence: TGG
tgatagcctgaggggtttgg

SEQ ID NO: 59059 - DNA, 20 bp, Artificial Sequence
  Description of Artificial Sequence: Synthetic oligonucleotide
  Target: ATXN1; (-) strand; PAM type: NRG; PAM sequence: TGG
aactgatagcctgaggggtt

SEQ ID NO: 59060 - DNA, 20 bp, Artificial Sequence
  Description of Artificial Sequence: Synthetic oligonucleotide
  Target: ATXN1; (-) strand; PAM type: NRG; PAM sequence: GGG
gacataactgatagcctgag

SEQ ID NO: 59061 - DNA, 20 bp, Artificial Sequence
  Description of Artificial Sequence: Synthetic oligonucleotide
  Target: ATXN1; (-) strand; PAM type: NRG; PAM sequence: GGG
agacataactgatagcctga

SEQ ID NO: 59062 - DNA, 20 bp, Artificial Sequence
  Description of Artificial Sequence: Synthetic oligonucleotide
  Target: ATXN1; (-) strand; PAM type: NRG; PAM sequence: AGG
gagacataactgatagcctg

SEQ ID NO: 59063 - DNA, 20 bp, Artificial Sequence
  Description of Artificial Sequence: Synthetic oligonucleotide
  Target: ATXN1; (-) strand; PAM type: NRG; PAM sequence: GAG
ggagacataactgatagcct

SEQ ID NO: 59064 - DNA, 20 bp, Artificial Sequence
  Description of Artificial Sequence: Synthetic oligonucleotide
  Target: ATXN1; (-) strand; PAM type: NRG; PAM sequence: TAG
cttaaaggagacataactga

SEQ ID NO: 59065 - DNA, 20 bp, Artificial Sequence
  Description of Artificial Sequence: Synthetic oligonucleotide
  Target: ATXN1; (-) strand; PAM type: NRG; PAM sequence: GAG
cctccccctacagcttaaag

SEQ ID NO: 59066 - DNA, 20 bp, Artificial Sequence
  Description of Artificial Sequence: Synthetic oligonucleotide
  Target: ATXN1; (-) strand; PAM type: NRG; PAM sequence: AGG
cccctccccctacagcttaa

SEQ ID NO: 59067 - DNA, 20 bp, Artificial Sequence
  Description of Artificial Sequence: Synthetic oligonucleotide
  Target: ATXN1; (-) strand; PAM type: NRG; PAM sequence: AAG
tcccctccccctacagctta

SEQ ID NO: 59068 - DNA, 20 bp, Artificial Sequence
  Description of Artificial Sequence: Synthetic oligonucleotide
  Target: ATXN1; (-) strand; PAM type: NRG; PAM sequence: CAG
gccaaattcccctcccccta

SEQ ID NO: 59069 - DNA, 20 bp, Artificial Sequence
  Description of Artificial Sequence: Synthetic oligonucleotide
  Target: ATXN1; (-) strand; PAM type: NRG; PAM sequence: GGG
gagagagaaggtcccatgtt

SEQ ID NO: 59070 - DNA, 20 bp, Artificial Sequence
  Description of Artificial Sequence: Synthetic oligonucleotide
  Target: ATXN1; (-) strand; PAM type: NRG; PAM sequence: TGG
agagagagaaggtcccatgt

SEQ ID NO: 59071 - DNA, 20 bp, Artificial Sequence
  Description of Artificial Sequence: Synthetic oligonucleotide
  Target: ATXN1; (-) strand; PAM type: NRG; PAM sequence: AGG
ctttaattcagagagagaga

SEQ ID NO: 59072 - DNA, 20 bp, Artificial Sequence
  Description of Artificial Sequence: Synthetic oligonucleotide
  Target: ATXN1; (-) strand; PAM type: NRG; PAM sequence: AAG
gctttaattcagagagagag

SEQ ID NO: 59073 - DNA, 20 bp, Artificial Sequence
  Description of Artificial Sequence: Synthetic oligonucleotide
  Target: ATXN1; (-) strand; PAM type: NRG; PAM sequence: GAG
tctgctttaattcagagaga

SEQ ID NO: 59074 - DNA, 20 bp, Artificial Sequence
  Description of Artificial Sequence: Synthetic oligonucleotide
  Target: ATXN1; (-) strand; PAM type: NRG; PAM sequence: GAG
gatctgctttaattcagaga

SEQ ID NO: 59075 - DNA, 20 bp, Artificial Sequence
  Description of Artificial Sequence: Synthetic oligonucleotide
  Target: ATXN1; (-) strand; PAM type: NRG; PAM sequence: GAG
ttgatctgctttaattcaga

SEQ ID NO: 59076 - DNA, 20 bp, Artificial Sequence
  Description of Artificial Sequence: Synthetic oligonucleotide
  Target: ATXN1; (-) strand; PAM type: NRG; PAM sequence: GAG
ccttgatctgctttaattca

SEQ ID NO: 59077 - DNA, 20 bp, Artificial Sequence
  Description of Artificial Sequence: Synthetic oligonucleotide
  Target: ATXN1; (-) strand; PAM type: NRG; PAM sequence: CAG
taccttgatctgctttaatt

SEQ ID NO: 59078 - DNA, 20 bp, Artificial Sequence
  Description of Artificial Sequence: Synthetic oligonucleotide
  Target: ATXN1; (-) strand; PAM type: NRG; PAM sequence: AGG
gatcatctgaaaactttccc

SEQ ID NO: 59079 - DNA, 20 bp, Artificial Sequence
  Description of Artificial Sequence: Synthetic oligonucleotide
  Target: ATXN1; (-) strand; PAM type: NRG; PAM sequence: CAG
ggatcatctgaaaactttcc

SEQ ID NO: 59080 - DNA, 20 bp, Artificial Sequence
  Description of Artificial Sequence: Synthetic oligonucleotide
  Target: ATXN1; (-) strand; PAM type: NRG; PAM sequence: AGG
aggacatctatatacctacc

SEQ ID NO: 59081 - DNA, 20 bp, Artificial Sequence
  Description of Artificial Sequence: Synthetic oligonucleotide
  Target: ATXN1; (-) strand; PAM type: NRG; PAM sequence: CAG
taggacatctatatacctac

SEQ ID NO: 59082 - DNA, 20 bp, Artificial Sequence
  Description of Artificial Sequence: Synthetic oligonucleotide
  Target: ATXN1; (-) strand; PAM type: NRG; PAM sequence: AGG
aggtttgccctggaccctgt

SEQ ID NO: 59083 - DNA, 20 bp, Artificial Sequence
  Description of Artificial Sequence: Synthetic oligonucleotide
  Target: ATXN1; (-) strand; PAM type: NRG; PAM sequence: TAG
aaggtttgccctggaccctg

SEQ ID NO: 59084 - DNA, 20 bp, Artificial Sequence
  Description of Artificial Sequence: Synthetic oligonucleotide
  Target: ATXN1; (-) strand; PAM type: NRG; PAM sequence: TGG
gtgaggtcgaaggtttgccc

SEQ ID NO: 59085 - DNA, 20 bp, Artificial Sequence
  Description of Artificial Sequence: Synthetic oligonucleotide
  Target: ATXN1; (-) strand; PAM type: NRG; PAM sequence: AGG
atctctccaagtgaggtcga

SEQ ID NO: 59086 - DNA, 20 bp, Artificial Sequence
  Description of Artificial Sequence: Synthetic oligonucleotide
  Target: ATXN1; (-) strand; PAM type: NRG; PAM sequence: AAG
catctctccaagtgaggtcg

SEQ ID NO: 59087 - DNA, 20 bp, Artificial Sequence
  Description of Artificial Sequence: Synthetic oligonucleotide
  Target: ATXN1; (-) strand; PAM type: NRG; PAM sequence: AGG
gcatgacatctctccaagtg

SEQ ID NO: 59088 - DNA, 20 bp, Artificial Sequence
  Description of Artificial Sequence: Synthetic oligonucleotide
  Target: ATXN1; (-) strand; PAM type: NRG; PAM sequence: GAG
agcatgacatctctccaagt

SEQ ID NO: 59089 - DNA, 20 bp, Artificial Sequence
  Description of Artificial Sequence: Synthetic oligonucleotide
  Target: ATXN1; (-) strand; PAM type: NRG; PAM sequence: AAG
caatagcatgacatctctcc

SEQ ID NO: 59090 - DNA, 20 bp, Artificial Sequence
  Description of Artificial Sequence: Synthetic oligonucleotide
  Target: ATXN1; (-) strand; PAM type: NRG; PAM sequence: TAG
gccagggtttgatctaacaa

SEQ ID NO: 59091 - DNA, 20 bp, Artificial Sequence
  Description of Artificial Sequence: Synthetic oligonucleotide
  Target: ATXN1; (-) strand; PAM type: NRG; PAM sequence: GGG
attcttttcattaaaggcca

SEQ ID NO: 59092 - DNA, 20 bp, Artificial Sequence
  Description of Artificial Sequence: Synthetic oligonucleotide
  Target: ATXN1; (-) strand; PAM type: NRG; PAM sequence: AGG
cattcttttcattaaaggcc

SEQ ID NO: 59093 - DNA, 20 bp, Artificial Sequence
  Description of Artificial Sequence: Synthetic oligonucleotide
  Target: ATXN1; (-) strand; PAM type: NRG; PAM sequence: CAG
gcattcttttcattaaaggc

SEQ ID NO: 59094 - DNA, 20 bp, Artificial Sequence
  Description of Artificial Sequence: Synthetic oligonucleotide
  Target: ATXN1; (-) strand; PAM type: NRG; PAM sequence: AGG
agctgcattcttttcattaa

SEQ ID NO: 59095 - DNA, 20 bp, Artificial Sequence
  Description of Artificial Sequence: Synthetic oligonucleotide
  Target: ATXN1; (-) strand; PAM type: NRG; PAM sequence: AAG
aagctgcattcttttcatta

SEQ ID NO: 59096 - DNA, 20 bp, Artificial Sequence
  Description of Artificial Sequence: Synthetic oligonucleotide
  Target: ATXN1; (-) strand; PAM type: NRG; PAM sequence: AAG
aaattctcgggctgcagcta

SEQ ID NO: 59097 - DNA, 20 bp, Artificial Sequence
  Description of Artificial Sequence: Synthetic oligonucleotide
  Target: ATXN1; (-) strand; PAM type: NRG; PAM sequence: CAG
atctccaaattctcgggctg

SEQ ID NO: 59098 - DNA, 20 bp, Artificial Sequence
  Description of Artificial Sequence: Synthetic oligonucleotide
  Target: ATXN1; (-) strand; PAM type: NRG; PAM sequence: GGG
ccaggtatctccaaattctc

SEQ ID NO: 59099 - DNA, 20 bp, Artificial Sequence
  Description of Artificial Sequence: Synthetic oligonucleotide
  Target: ATXN1; (-) strand; PAM type: NRG; PAM sequence: CGG
accaggtatctccaaattct

SEQ ID NO: 59100 - DNA, 20 bp, Artificial Sequence
  Description of Artificial Sequence: Synthetic oligonucleotide
  Target: ATXN1; (-) strand; PAM type: NRG; PAM sequence: AGG
atttacttgactaagatacc

SEQ ID NO: 59101 - DNA, 20 bp, Artificial Sequence
  Description of Artificial Sequence: Synthetic oligonucleotide
  Target: ATXN1; (-) strand; PAM type: NRG; PAM sequence: CAG
catttacttgactaagatac

SEQ ID NO: 59102 - DNA, 20 bp, Artificial Sequence
  Description of Artificial Sequence: Synthetic oligonucleotide
  Target: ATXN1; (-) strand; PAM type: NRG; PAM sequence: AAG
attttgtcatttacttgact

SEQ ID NO: 59103 - DNA, 20 bp, Artificial Sequence
  Description of Artificial Sequence: Synthetic oligonucleotide
  Target: ATXN1; (-) strand; PAM type: NRG; PAM sequence: CGG
agggaatttgtccctttctt

SEQ ID NO: 59104 - DNA, 20 bp, Artificial Sequence
  Description of Artificial Sequence: Synthetic oligonucleotide
  Target: ATXN1; (-) strand; PAM type: NRG; PAM sequence: GGG
ggatggcttgctgcccatta

SEQ ID NO: 59105 - DNA, 20 bp, Artificial Sequence
  Description of Artificial Sequence: Synthetic oligonucleotide
  Target: ATXN1; (-) strand; PAM type: NRG; PAM sequence: AGG
gggatggcttgctgcccatt

SEQ ID NO: 59106 - DNA, 20 bp, Artificial Sequence
  Description of Artificial Sequence: Synthetic oligonucleotide
  Target: ATXN1; (-) strand; PAM type: NRG; PAM sequence: TAG
ggggatggcttgctgcccat

SEQ ID NO: 59107 - DNA, 20 bp, Artificial Sequence
  Description of Artificial Sequence: Synthetic oligonucleotide
  Target: ATXN1; (-) strand; PAM type: NRG; PAM sequence: TGG
gtggggatccataatgggga

SEQ ID NO: 59108 - DNA, 20 bp, Artificial Sequence
  Description of Artificial Sequence: Synthetic oligonucleotide
  Target: ATXN1; (-) strand; PAM type: NRG; PAM sequence: GGG
cccagtggggatccataatg

SEQ ID NO: 59109 - DNA, 20 bp, Artificial Sequence
  Description of Artificial Sequence: Synthetic oligonucleotide
  Target: ATXN1; (-) strand; PAM type: NRG; PAM sequence: GGG
tcccagtggggatccataat

SEQ ID NO: 59110 - DNA, 20 bp, Artificial Sequence
  Description of Artificial Sequence: Synthetic oligonucleotide
  Target: ATXN1; (-) strand; PAM type: NRG; PAM sequence: TGG
gtcccagtggggatccataa

SEQ ID NO: 59111 - DNA, 20 bp, Artificial Sequence
  Description of Artificial Sequence: Synthetic oligonucleotide
  Target: ATXN1; (-) strand; PAM type: NRG; PAM sequence: GGG
tctgagtctaggtcccagtg

SEQ ID NO: 59112 - DNA, 20 bp, Artificial Sequence
  Description of Artificial Sequence: Synthetic oligonucleotide
  Target: ATXN1; (-) strand; PAM type: NRG; PAM sequence: GGG
atctgagtctaggtcccagt

SEQ ID NO: 59113 - DNA, 20 bp, Artificial Sequence
  Description of Artificial Sequence: Synthetic oligonucleotide
  Target: ATXN1; (-) strand; PAM type: NRG; PAM sequence: TGG
gatctgagtctaggtcccag

SEQ ID NO: 59114 - DNA, 20 bp, Artificial Sequence
  Description of Artificial Sequence: Synthetic oligonucleotide
  Target: ATXN1; (-) strand; PAM type: NRG; PAM sequence: CAG
catgatctgagtctaggtcc

SEQ ID NO: 59115 - DNA, 20 bp, Artificial Sequence
  Description of Artificial Sequence: Synthetic oligonucleotide
  Target: ATXN1; (-) strand; PAM type: NRG; PAM sequence: AGG
agttcccatgatctgagtct

SEQ ID NO: 59116 - DNA, 20 bp, Artificial Sequence
  Description of Artificial Sequence: Synthetic oligonucleotide
  Target: ATXN1; (-) strand; PAM type: NRG; PAM sequence: TAG
cagttcccatgatctgagtc

SEQ ID NO: 59117 - DNA, 20 bp, Artificial Sequence
  Description of Artificial Sequence: Synthetic oligonucleotide
  Target: ATXN1; (-) strand; PAM type: NRG; PAM sequence: GAG
gactccagttcccatgatct

SEQ ID NO: 59118 - DNA, 20 bp, Artificial Sequence
  Description of Artificial Sequence: Synthetic oligonucleotide
  Target: ATXN1; (-) strand; PAM type: NRG; PAM sequence: CAG
tcaacagatgtttgcgactc

SEQ ID NO: 59119 - DNA, 20 bp, Artificial Sequence
  Description of Artificial Sequence: Synthetic oligonucleotide
  Target: ATXN1; (-) strand; PAM type: NRG; PAM sequence: CAG
ccttctggaatacaggtcaa

SEQ ID NO: 59120 - DNA, 20 bp, Artificial Sequence
  Description of Artificial Sequence: Synthetic oligonucleotide
  Target: ATXN1; (-) strand; PAM type: NRG; PAM sequence: AGG
ccttagtccttctggaatac

SEQ ID NO: 59121 - DNA, 20 bp, Artificial Sequence
  Description of Artificial Sequence: Synthetic oligonucleotide
  Target: ATXN1; (-) strand; PAM type: NRG; PAM sequence: CAG
tccttagtccttctggaata

SEQ ID NO: 59122 - DNA, 20 bp, Artificial Sequence
  Description of Artificial Sequence: Synthetic oligonucleotide
  Target: ATXN1; (-) strand; PAM type: NRG; PAM sequence: TGG
ctaattctccttagtccttc

SEQ ID NO: 59123 - DNA, 20 bp, Artificial Sequence
  Description of Artificial Sequence: Synthetic oligonucleotide
  Target: ATXN1; (-) strand; PAM type: NRG; PAM sequence: TAG
ggctttttcctaattctcct

SEQ ID NO: 59124 - DNA, 20 bp, Artificial Sequence
  Description of Artificial Sequence: Synthetic oligonucleotide
  Target: ATXN1; (-) strand; PAM type: NRG; PAM sequence: GGG
gacatcattgaataattcat

SEQ ID NO: 59125 - DNA, 20 bp, Artificial Sequence
  Description of Artificial Sequence: Synthetic oligonucleotide
  Target: ATXN1; (-) strand; PAM type: NRG; PAM sequence: TGG
ggacatcattgaataattca

SEQ ID NO: 59126 - DNA, 20 bp, Artificial Sequence
  Description of Artificial Sequence: Synthetic oligonucleotide
  Target: ATXN1; (-) strand; PAM type: NRG; PAM sequence: TGG
ttcctttccctgagttatgg

SEQ ID NO: 59127 - DNA, 20 bp, Artificial Sequence
  Description of Artificial Sequence: Synthetic oligonucleotide
  Target: ATXN1; (-) strand; PAM type: NRG; PAM sequence: TGG
ttcttcctttccctgagtta

SEQ ID NO: 59128 - DNA, 20 bp, Artificial Sequence
  Description of Artificial Sequence: Synthetic oligonucleotide
  Target: ATXN1; (-) strand; PAM type: NRG; PAM sequence: GAG
aggattttcttcctttccct

SEQ ID NO: 59129 - DNA, 20 bp, Artificial Sequence
  Description of Artificial Sequence: Synthetic oligonucleotide
  Target: ATXN1; (-) strand; PAM type: NRG; PAM sequence: AGG
agctgcttgaggaaggcagt

SEQ ID NO: 59130 - DNA, 20 bp, Artificial Sequence
  Description of Artificial Sequence: Synthetic oligonucleotide
  Target: ATXN1; (-) strand; PAM type: NRG; PAM sequence: TAG
tagctgcttgaggaaggcag

SEQ ID NO: 59131 - DNA, 20 bp, Artificial Sequence
  Description of Artificial Sequence: Synthetic oligonucleotide
  Target: ATXN1; (-) strand; PAM type: NRG; PAM sequence: CAG
ccatagctgcttgaggaagg

SEQ ID NO: 59132 - DNA, 20 bp, Artificial Sequence
  Description of Artificial Sequence: Synthetic oligonucleotide
  Target: ATXN1; (-) strand; PAM type: NRG; PAM sequence: AGG
ctcccatagctgcttgagga

SEQ ID NO: 59133 - DNA, 20 bp, Artificial Sequence
  Description of Artificial Sequence: Synthetic oligonucleotide
  Target: ATXN1; (-) strand; PAM type: NRG; PAM sequence: AAG
cctcccatagctgcttgagg

SEQ ID NO: 59134 - DNA, 20 bp, Artificial Sequence
  Description of Artificial Sequence: Synthetic oligonucleotide
  Target: ATXN1; (-) strand; PAM type: NRG; PAM sequence: AGG
aggcctcccatagctgcttg

SEQ ID NO: 59135 - DNA, 20 bp, Artificial Sequence
  Description of Artificial Sequence: Synthetic oligonucleotide
  Target: ATXN1; (-) strand; PAM type: NRG; PAM sequence: GAG
aaggcctcccatagctgctt

SEQ ID NO: 59136 - DNA, 20 bp, Artificial Sequence
  Description of Artificial Sequence: Synthetic oligonucleotide
  Target: ATXN1; (-) strand; PAM type: NRG; PAM sequence: TAG
tattttcttaaggcctccca

SEQ ID NO: 59137 - DNA, 20 bp, Artificial Sequence
  Description of Artificial Sequence: Synthetic oligonucleotide
  Target: ATXN1; (-) strand; PAM type: NRG; PAM sequence: AGG
caggggagtatattttctta

SEQ ID NO: 59138 - DNA, 20 bp, Artificial Sequence
  Description of Artificial Sequence: Synthetic oligonucleotide
  Target: ATXN1; (-) strand; PAM type: NRG; PAM sequence: AAG
acaggggagtatattttctt

SEQ ID NO: 59139 - DNA, 20 bp, Artificial Sequence
  Description of Artificial Sequence: Synthetic oligonucleotide
  Target: ATXN1; (-) strand; PAM type: NRG; PAM sequence: GAG
gagggagttgggtgacaggg

SEQ ID NO: 59140 - DNA, 20 bp, Artificial Sequence
  Description of Artificial Sequence: Synthetic oligonucleotide
  Target: ATXN1; (-) strand; PAM type: NRG; PAM sequence: GGG
tcgagggagttgggtgacag

SEQ ID NO: 59141 - DNA, 20 bp, Artificial Sequence
  Description of Artificial Sequence: Synthetic oligonucleotide
  Target: ATXN1; (-) strand; PAM type: NRG; PAM sequence: GGG
ctcgagggagttgggtgaca

SEQ ID NO: 59142 - DNA, 20 bp, Artificial Sequence
  Description of Artificial Sequence: Synthetic oligonucleotide
  Target: ATXN1; (-) strand; PAM type: NRG; PAM sequence: AGG
cctcgagggagttgggtgac

SEQ ID NO: 59143 - DNA, 20 bp, Artificial Sequence
  Description of Artificial Sequence: Synthetic oligonucleotide
  Target: ATXN1; (-) strand; PAM type: NRG; PAM sequence: CAG
ccctcgagggagttgggtga

SEQ ID NO: 59144 - DNA, 20 bp, Artificial Sequence
  Description of Artificial Sequence: Synthetic oligonucleotide
  Target: ATXN1; (-) strand; PAM type: NRG; PAM sequence: GGG
aattgaccctcgagggagtt

SEQ ID NO: 59145 - DNA, 20 bp, Artificial Sequence
  Description of Artificial Sequence: Synthetic oligonucleotide
  Target: ATXN1; (-) strand; PAM type: NRG; PAM sequence: TGG
caattgaccctcgagggagt

SEQ ID NO: 59146 - DNA, 20 bp, Artificial Sequence
  Description of Artificial Sequence: Synthetic oligonucleotide
  Target: ATXN1; (-) strand; PAM type: NRG; PAM sequence: GAG
ggatcaattgaccctcgagg

SEQ ID NO: 59147 - DNA, 20 bp, Artificial Sequence
  Description of Artificial Sequence: Synthetic oligonucleotide
  Target: ATXN1; (-) strand; PAM type: NRG; PAM sequence: GGG
taggatcaattgaccctcga

SEQ ID NO: 59148 - DNA, 20 bp, Artificial Sequence
  Description of Artificial Sequence: Synthetic oligonucleotide
  Target: ATXN1; (-) strand; PAM type: NRG; PAM sequence: AGG
ttaggatcaattgaccctcg

SEQ ID NO: 59149 - DNA, 20 bp, Artificial Sequence
  Description of Artificial Sequence: Synthetic oligonucleotide
  Target: ATXN1; (-) strand; PAM type: NRG; PAM sequence: GAG
tttaggatcaattgaccctc

SEQ ID NO: 59150 - DNA, 20 bp, Artificial Sequence
  Description of Artificial Sequence: Synthetic oligonucleotide
  Target: ATXN1; (-) strand; PAM type: NRG; PAM sequence: AGG
ttgggtaataaacatctttt

SEQ ID NO: 59151 - DNA, 20 bp, Artificial Sequence
  Description of Artificial Sequence: Synthetic oligonucleotide
  Target: ATXN1; (-) strand; PAM type: NRG; PAM sequence: TAG
attgggtaataaacatcttt

SEQ ID NO: 59152 - DNA, 20 bp, Artificial Sequence
  Description of Artificial Sequence: Synthetic oligonucleotide
  Target: ATXN1; (-) strand; PAM type: NRG; PAM sequence: GGG
tcctgatatctcagctgatt

SEQ ID NO: 59153 - DNA, 20 bp, Artificial Sequence
  Description of Artificial Sequence: Synthetic oligonucleotide
  Target: ATXN1; (-) strand; PAM type: NRG; PAM sequence: TGG
ctcctgatatctcagctgat

SEQ ID NO: 59154 - DNA, 20 bp, Artificial Sequence
  Description of Artificial Sequence: Synthetic oligonucleotide
  Target: ATXN1; (-) strand; PAM type: NRG; PAM sequence: CAG
ggagctttctcctgatatct

SEQ ID NO: 59155 - DNA, 20 bp, Artificial Sequence
  Description of Artificial Sequence: Synthetic oligonucleotide
  Target: ATXN1; (-) strand; PAM type: NRG; PAM sequence: GAG
gggccaagggctcgcttttg

SEQ ID NO: 59156 - DNA, 20 bp, Artificial Sequence
  Description of Artificial Sequence: Synthetic oligonucleotide
  Target: ATXN1; (-) strand; PAM type: NRG; PAM sequence: TGG
cagggccaagggctcgcttt

SEQ ID NO: 59157 - DNA, 20 bp, Artificial Sequence
  Description of Artificial Sequence: Synthetic oligonucleotide
  Target: ATXN1; (-) strand; PAM type: NRG; PAM sequence: GGG
cagattttgttcagggccaa

SEQ ID NO: 59158 - DNA, 20 bp, Artificial Sequence
  Description of Artificial Sequence: Synthetic oligonucleotide
  Target: ATXN1; (-) strand; PAM type: NRG; PAM sequence: AGG
ccagattttgttcagggcca

SEQ ID NO: 59159 - DNA, 20 bp, Artificial Sequence
  Description of Artificial Sequence: Synthetic oligonucleotide
  Target: ATXN1; (-) strand; PAM type: NRG; PAM sequence: AAG
tccagattttgttcagggcc

SEQ ID NO: 59160 - DNA, 20 bp, Artificial Sequence
  Description of Artificial Sequence: Synthetic oligonucleotide
  Target: ATXN1; (-) strand; PAM type: NRG; PAM sequence: GGG
atgcctccagattttgttca

SEQ ID NO: 59161 - DNA, 20 bp, Artificial Sequence
  Description of Artificial Sequence: Synthetic oligonucleotide
  Target: ATXN1; (-) strand; PAM type: NRG; PAM sequence: AGG
aatgcctccagattttgttc

SEQ ID NO: 59162 - DNA, 20 bp, Artificial Sequence
  Description of Artificial Sequence: Synthetic oligonucleotide
  Target: ATXN1; (-) strand; PAM type: NRG; PAM sequence: CAG
taatgcctccagattttgtt

SEQ ID NO: 59163 - DNA, 20 bp, Artificial Sequence
  Description of Artificial Sequence: Synthetic oligonucleotide
  Target: ATXN1; (-) strand; PAM type: NRG; PAM sequence: CAG
gccaggtttaataatgcctc

SEQ ID NO: 59164 - DNA, 20 bp, Artificial Sequence
  Description of Artificial Sequence: Synthetic oligonucleotide
  Target: ATXN1; (-) strand; PAM type: NRG; PAM sequence: AGG
tagagaacaccgcggttgcc

SEQ ID NO: 59165 - DNA, 20 bp, Artificial Sequence
  Description of Artificial Sequence: Synthetic oligonucleotide
  Target: ATXN1; (-) strand; PAM type: NRG; PAM sequence: CAG
ttagagaacaccgcggttgc

SEQ ID NO: 59166 - DNA, 20 bp, Artificial Sequence
  Description of Artificial Sequence: Synthetic oligonucleotide
  Target: ATXN1; (-) strand; PAM type: NRG; PAM sequence: CGG
gttcctattagagaacaccg

SEQ ID NO: 59167 - DNA, 20 bp, Artificial Sequence
  Description of Artificial Sequence: Synthetic oligonucleotide
  Target: ATXN1; (-) strand; PAM type: NRG; PAM sequence: GAG
gttcctcttggttcctatta

SEQ ID NO: 59168 - DNA, 20 bp, Artificial Sequence
  Description of Artificial Sequence: Synthetic oligonucleotide
  Target: ATXN1; (-) strand; PAM type: NRG; PAM sequence: TAG
ctgttcctcttggttcctat

SEQ ID NO: 59169 - DNA, 20 bp, Artificial Sequence
  Description of Artificial Sequence: Synthetic oligonucleotide
  Target: ATXN1; (-) strand; PAM type: NRG; PAM sequence: TGG
ccttttctgcctgttcctct

SEQ ID NO: 59170 - DNA, 20 bp, Artificial Sequence
  Description of Artificial Sequence: Synthetic oligonucleotide
  Target: ATXN1; (-) strand; PAM type: NRG; PAM sequence: CGG
gagggccatgactgaggctg

SEQ ID NO: 59171 - DNA, 20 bp, Artificial Sequence
  Description of Artificial Sequence: Synthetic oligonucleotide
  Target: ATXN1; (-) strand; PAM type: NRG; PAM sequence: AGG
ttgtctgagggccatgactg

SEQ ID NO: 59172 - DNA, 20 bp, Artificial Sequence
  Description of Artificial Sequence: Synthetic oligonucleotide
  Target: ATXN1; (-) strand; PAM type: NRG; PAM sequence: GAG
tttgtctgagggccatgact

SEQ ID NO: 59173 - DNA, 20 bp, Artificial Sequence
  Description of Artificial Sequence: Synthetic oligonucleotide
  Target: ATXN1; (-) strand; PAM type: NRG; PAM sequence: GGG
accaaggtttgtttgtctga

SEQ ID NO: 59174 - DNA, 20 bp, Artificial Sequence
  Description of Artificial Sequence: Synthetic oligonucleotide
  Target: ATXN1; (-) strand; PAM type: NRG; PAM sequence: AGG
caccaaggtttgtttgtctg

SEQ ID NO: 59175 - DNA, 20 bp, Artificial Sequence
  Description of Artificial Sequence: Synthetic oligonucleotide
  Target: ATXN1; (-) strand; PAM type: NRG; PAM sequence: GAG
ccaccaaggtttgtttgtct

SEQ ID NO: 59176 - DNA, 20 bp, Artificial Sequence
  Description of Artificial Sequence: Synthetic oligonucleotide
  Target: ATXN1; (-) strand; PAM type: NRG; PAM sequence: AGG
ctgtcctctctgaaccacca

SEQ ID NO: 59177 - DNA, 20 bp, Artificial Sequence
  Description of Artificial Sequence: Synthetic oligonucleotide
  Target: ATXN1; (-) strand; PAM type: NRG; PAM sequence: AAG
tctgtcctctctgaaccacc

SEQ ID NO: 59178 - DNA, 20 bp, Artificial Sequence
  Description of Artificial Sequence: Synthetic oligonucleotide
  Target: ATXN1; (-) strand; PAM type: NRG; PAM sequence: TGG
aacaagccctactgggtgat

SEQ ID NO: 59179 - DNA, 20 bp, Artificial Sequence
  Description of Artificial Sequence: Synthetic oligonucleotide
  Target: ATXN1; (-) strand; PAM type: NRG; PAM sequence: GGG
cactgataacaagccctact

SEQ ID NO: 59180 - DNA, 20 bp, Artificial Sequence
  Description of Artificial Sequence: Synthetic oligonucleotide
  Target: ATXN1; (-) strand; PAM type: NRG; PAM sequence: TGG
acactgataacaagccctac

SEQ ID NO: 59181 - DNA, 20 bp, Artificial Sequence
  Description of Artificial Sequence: Synthetic oligonucleotide
  Target: ATXN1; (-) strand; PAM type: NRG; PAM sequence: AAG
ttgcaaaccacactgataac

SEQ ID NO: 59182 - DNA, 20 bp, Artificial Sequence
  Description of Artificial Sequence: Synthetic oligonucleotide
  Target: ATXN1; (-) strand; PAM type: NRG; PAM sequence: AGG
ttgttggacagtctttttta

SEQ ID NO: 59183 - DNA, 20 bp, Artificial Sequence
  Description of Artificial Sequence: Synthetic oligonucleotide
  Target: ATXN1; (-) strand; PAM type: NRG; PAM sequence: AAG
cttgttggacagtctttttt

SEQ ID NO: 59184 - DNA, 20 bp, Artificial Sequence
  Description of Artificial Sequence: Synthetic oligonucleotide
  Target: ATXN1; (-) strand; PAM type: NRG; PAM sequence: CAG
gtagcttgtttcttgttgga

SEQ ID NO: 59185 - DNA, 20 bp, Artificial Sequence
  Description of Artificial Sequence: Synthetic oligonucleotide
  Target: ATXN1; (-) strand; PAM type: NRG; PAM sequence: TGG
gggagtagcttgtttcttgt

SEQ ID NO: 59186 - DNA, 20 bp, Artificial Sequence
  Description of Artificial Sequence: Synthetic oligonucleotide
  Target: ATXN1; (-) strand; PAM type: NRG; PAM sequence: TAG
agtggacatgggtgagggag

SEQ ID NO: 59187 - DNA, 20 bp, Artificial Sequence
  Description of Artificial Sequence: Synthetic oligonucleotide
  Target: ATXN1; (-) strand; PAM type: NRG; PAM sequence: GAG
catagtggacatgggtgagg

SEQ ID NO: 59188 - DNA, 20 bp, Artificial Sequence
  Description of Artificial Sequence: Synthetic oligonucleotide
  Target: ATXN1; (-) strand; PAM type: NRG; PAM sequence: GGG
ggcatagtggacatgggtga

SEQ ID NO: 59189 - DNA, 20 bp, Artificial Sequence
  Description of Artificial Sequence: Synthetic oligonucleotide
  Target: ATXN1; (-) strand; PAM type: NRG; PAM sequence: AGG
tggcatagtggacatgggtg

SEQ ID NO: 59190 - DNA, 20 bp, Artificial Sequence
  Description of Artificial Sequence: Synthetic oligonucleotide
  Target: ATXN1; (-) strand; PAM type: NRG; PAM sequence: GAG
ttggcatagtggacatgggt

SEQ ID NO: 59191 - DNA, 20 bp, Artificial Sequence
  Description of Artificial Sequence: Synthetic oligonucleotide
  Target: ATXN1; (-) strand; PAM type: NRG; PAM sequence: GGG
tgccttggcatagtggacat

SEQ ID NO: 59192 - DNA, 20 bp, Artificial Sequence
  Description of Artificial Sequence: Synthetic oligonucleotide
  Target: ATXN1; (-) strand; PAM type: NRG; PAM sequence: TGG
ttgccttggcatagtggaca

SEQ ID NO: 59193 - DNA, 20 bp, Artificial Sequence
  Description of Artificial Sequence: Synthetic oligonucleotide
  Target: ATXN1; (-) strand; PAM type: NRG; PAM sequence: TGG
tagtgattgccttggcatag

SEQ ID NO: 59194 - DNA, 20 bp, Artificial Sequence
  Description of Artificial Sequence: Synthetic oligonucleotide
  Target: ATXN1; (-) strand; PAM type: NRG; PAM sequence: TAG
gtctagtgattgccttggca

SEQ ID NO: 59195 - DNA, 20 bp, Artificial Sequence
  Description of Artificial Sequence: Synthetic oligonucleotide
  Target: ATXN1; (-) strand; PAM type: NRG; PAM sequence: TGG
accccgtctagtgattgcct

SEQ ID NO: 59196 - DNA, 20 bp, Artificial Sequence
  Description of Artificial Sequence: Synthetic oligonucleotide
  Target: ATXN1; (-) strand; PAM type: NRG; PAM sequence: TAG
ctctggggcagtaccccgtc

SEQ ID NO: 59197 - DNA, 20 bp, Artificial Sequence
  Description of Artificial Sequence: Synthetic oligonucleotide
  Target: ATXN1; (-) strand; PAM type: NRG; PAM sequence: CAG
agaacctttgtcctctgggg

SEQ ID NO: 59198 - DNA, 20 bp, Artificial Sequence
  Description of Artificial Sequence: Synthetic oligonucleotide
  Target: ATXN1; (-) strand; PAM type: NRG; PAM sequence: GGG
cggagaacctttgtcctctg

SEQ ID NO: 59199 - DNA, 20 bp, Artificial Sequence
  Description of Artificial Sequence: Synthetic oligonucleotide
  Target: ATXN1; (-) strand; PAM type: NRG; PAM sequence: GGG
ccggagaacctttgtcctct

SEQ ID NO: 59200 - DNA, 20 bp, Artificial Sequence
  Description of Artificial Sequence: Synthetic oligonucleotide
  Target: ATXN1; (-) strand; PAM type: NRG; PAM sequence: TGG
cccggagaacctttgtcctc

SEQ ID NO: 59201 - DNA, 20 bp, Artificial Sequence
  Description of Artificial Sequence: Synthetic oligonucleotide
  Target: ATXN1; (-) strand; PAM type: NRG; PAM sequence: GAG
ggttgggggcttctggcccg

SEQ ID NO: 59202 - DNA, 20 bp, Artificial Sequence
  Description of Artificial Sequence: Synthetic oligonucleotide
  Target: ATXN1; (-) strand; PAM type: NRG; PAM sequence: CGG
ctggttgggggcttctggcc

SEQ ID NO: 59203 - DNA, 20 bp, Artificial Sequence
  Description of Artificial Sequence: Synthetic oligonucleotide
  Target: ATXN1; (-) strand; PAM type: NRG; PAM sequence: TGG
atcatctggttgggggcttc

SEQ ID NO: 59204 - DNA, 20 bp, Artificial Sequence
  Description of Artificial Sequence: Synthetic oligonucleotide
  Target: ATXN1; (-) strand; PAM type: NRG; PAM sequence: GGG
ttgttggatcatctggttgg

SEQ ID NO: 59205 - DNA, 20 bp, Artificial Sequence
  Description of Artificial Sequence: Synthetic oligonucleotide
  Target: ATXN1; (-) strand; PAM type: NRG; PAM sequence: GGG
gttgttggatcatctggttg

SEQ ID NO: 59206 - DNA, 20 bp, Artificial Sequence
  Description of Artificial Sequence: Synthetic oligonucleotide
  Target: ATXN1; (-) strand; PAM type: NRG; PAM sequence: GGG
tgttgttggatcatctggtt

SEQ ID NO: 59207 - DNA, 20 bp, Artificial Sequence
  Description of Artificial Sequence: Synthetic oligonucleotide
  Target: ATXN1; (-) strand; PAM type: NRG; PAM sequence: TGG
ctgttgttggatcatctggt

SEQ ID NO: 59208 - DNA, 20 bp, Artificial Sequence
  Description of Artificial Sequence: Synthetic oligonucleotide
  Target: ATXN1; (-) strand; PAM type: NRG; PAM sequence: TGG
agtcctgttgttggatcatc

SEQ ID NO: 59209 - DNA, 20 bp, Artificial Sequence
  Description of Artificial Sequence: Synthetic oligonucleotide
  Target: ATXN1; (-) strand; PAM type: NRG; PAM sequence: TGG
ggcaccctcagtcctgttgt

SEQ ID NO: 59210 - DNA, 20 bp, Artificial Sequence
  Description of Artificial Sequence: Synthetic oligonucleotide
  Target: ATXN1; (-) strand; PAM type: NRG; PAM sequence: CAG
gtgcttgcaccaggcaccct

SEQ ID NO: 59211 - DNA, 20 bp, Artificial Sequence
  Description of Artificial Sequence: Synthetic oligonucleotide
  Target: ATXN1; (-) strand; PAM type: NRG; PAM sequence: AGG
catgagctggtgcttgcacc

SEQ ID NO: 59212 - DNA, 20 bp, Artificial Sequence
  Description of Artificial Sequence: Synthetic oligonucleotide
  Target: ATXN1; (-) strand; PAM type: NRG; PAM sequence: CAG
acatgagctggtgcttgcac

SEQ ID NO: 59213 - DNA, 20 bp, Artificial Sequence
  Description of Artificial Sequence: Synthetic oligonucleotide
  Target: ATXN1; (-) strand; PAM type: NRG; PAM sequence: TGG
gtgagggtgatgacatgagc

SEQ ID NO: 59214 - DNA, 20 bp, Artificial Sequence
  Description of Artificial Sequence: Synthetic oligonucleotide
  Target: ATXN1; (-) strand; PAM type: NRG; PAM sequence: GAG
ctcagtgagggtgatgacat

SEQ ID NO: 59215 - DNA, 20 bp, Artificial Sequence
  Description of Artificial Sequence: Synthetic oligonucleotide
  Target: ATXN1; (-) strand; PAM type: NRG; PAM sequence: GGG
acttgcccagggctcagtga

SEQ ID NO: 59216 - DNA, 20 bp, Artificial Sequence
  Description of Artificial Sequence: Synthetic oligonucleotide
  Target: ATXN1; (-) strand; PAM type: NRG; PAM sequence: AGG
aacttgcccagggctcagtg

SEQ ID NO: 59217 - DNA, 20 bp, Artificial Sequence
  Description of Artificial Sequence: Synthetic oligonucleotide
  Target: ATXN1; (-) strand; PAM type: NRG; PAM sequence: GAG
aaacttgcccagggctcagt

SEQ ID NO: 59218 - DNA, 20 bp, Artificial Sequence
  Description of Artificial Sequence: Synthetic oligonucleotide
  Target: ATXN1; (-) strand; PAM type: NRG; PAM sequence: CAG
ggctaaacttgcccagggct

SEQ ID NO: 59219 - DNA, 20 bp, Artificial Sequence
  Description of Artificial Sequence: Synthetic oligonucleotide
  Target: ATXN1; (-) strand; PAM type: NRG; PAM sequence: GGG
tcaatggctaaacttgccca

SEQ ID NO: 59220 - DNA, 20 bp, Artificial Sequence
  Description of Artificial Sequence: Synthetic oligonucleotide
  Target: ATXN1; (-) strand; PAM type: NRG; PAM sequence: AGG
ctcaatggctaaacttgccc

SEQ ID NO: 59221 - DNA, 20 bp, Artificial Sequence
  Description of Artificial Sequence: Synthetic oligonucleotide
  Target: ATXN1; (-) strand; PAM type: NRG; PAM sequence: CAG
cctcaatggctaaacttgcc

SEQ ID NO: 59222 - DNA, 20 bp, Artificial Sequence
  Description of Artificial Sequence: Synthetic oligonucleotide
  Target: ATXN1; (-) strand; PAM type: NRG; PAM sequence: TGG
gtcaatttcctggccctcaa

SEQ ID NO: 59223 - DNA, 20 bp, Artificial Sequence
  Description of Artificial Sequence: Synthetic oligonucleotide
  Target: ATXN1; (-) strand; PAM type: NRG; PAM sequence: TGG
ccaggaggaagtcaatttcc

SEQ ID NO: 59224 - DNA, 20 bp, Artificial Sequence
  Description of Artificial Sequence: Synthetic oligonucleotide
  Target: ATXN1; (-) strand; PAM type: NRG; PAM sequence: AAG
ccatgccagtgtccaggagg

SEQ ID NO: 59225 - DNA, 20 bp, Artificial Sequence
  Description of Artificial Sequence: Synthetic oligonucleotide
  Target: ATXN1; (-) strand; PAM type: NRG; PAM sequence: AGG
aggccatgccagtgtccagg

SEQ ID NO: 59226 - DNA, 20 bp, Artificial Sequence
  Description of Artificial Sequence: Synthetic oligonucleotide
  Target: ATXN1; (-) strand; PAM type: NRG; PAM sequence: GAG
aaggccatgccagtgtccag

SEQ ID NO: 59227 - DNA, 20 bp, Artificial Sequence
  Description of Artificial Sequence: Synthetic oligonucleotide
  Target: ATXN1; (-) strand; PAM type: NRG; PAM sequence: AGG
agaaggccatgccagtgtcc

SEQ ID NO: 59228 - DNA, 20 bp, Artificial Sequence
  Description of Artificial Sequence: Synthetic oligonucleotide
  Target: ATXN1; (-) strand; PAM type: NRG; PAM sequence: CAG
gagaaggccatgccagtgtc

SEQ ID NO: 59229 - DNA, 20 bp, Artificial Sequence
  Description of Artificial Sequence: Synthetic oligonucleotide
  Target: ATXN1; (-) strand; PAM type: NRG; PAM sequence: CAG
taacactgagaaggccatgc

SEQ ID NO: 59230 - DNA, 20 bp, Artificial Sequence
  Description of Artificial Sequence: Synthetic oligonucleotide
  Target: ATXN1; (-) strand; PAM type: NRG; PAM sequence: AGG
gcaggagattaacactgaga

SEQ ID NO: 59231 - DNA, 20 bp, Artificial Sequence
  Description of Artificial Sequence: Synthetic oligonucleotide
  Target: ATXN1; (-) strand; PAM type: NRG; PAM sequence: AAG
ggcaggagattaacactgag

SEQ ID NO: 59232 - DNA, 20 bp, Artificial Sequence
  Description of Artificial Sequence: Synthetic oligonucleotide
  Target: ATXN1; (-) strand; PAM type: NRG; PAM sequence: GAG
tggggcaggagattaacact

SEQ ID NO: 59233 - DNA, 20 bp, Artificial Sequence
  Description of Artificial Sequence: Synthetic oligonucleotide
  Target: ATXN1; (-) strand; PAM type: NRG; PAM sequence: GAG
aggacagctgtctggggcag

SEQ ID NO: 59234 - DNA, 20 bp, Artificial Sequence
  Description of Artificial Sequence: Synthetic oligonucleotide
  Target: ATXN1; (-) strand; PAM type: NRG; PAM sequence: AGG
tgaggacagctgtctggggc

SEQ ID NO: 59235 - DNA, 20 bp, Artificial Sequence
  Description of Artificial Sequence: Synthetic oligonucleotide
  Target: ATXN1; (-) strand; PAM type: NRG; PAM sequence: CAG
ttgaggacagctgtctgggg

SEQ ID NO: 59236 - DNA, 20 bp, Artificial Sequence
  Description of Artificial Sequence: Synthetic oligonucleotide
  Target: ATXN1; (-) strand; PAM type: NRG; PAM sequence: GGG
atcttgaggacagctgtctg

SEQ ID NO: 59237 - DNA, 20 bp, Artificial Sequence
  Description of Artificial Sequence: Synthetic oligonucleotide
  Target: ATXN1; (-) strand; PAM type: NRG; PAM sequence: GGG
gatcttgaggacagctgtct

SEQ ID NO: 59238 - DNA, 20 bp, Artificial Sequence
  Description of Artificial Sequence: Synthetic oligonucleotide
  Target: ATXN1; (-) strand; PAM type: NRG; PAM sequence: TGG
ggatcttgaggacagctgtc

SEQ ID NO: 59239 - DNA, 20 bp, Artificial Sequence
  Description of Artificial Sequence: Synthetic oligonucleotide
  Target: ATXN1; (-) strand; PAM type: NRG; PAM sequence: CAG
atggtaatggatcttgagga

SEQ ID NO: 59240 - DNA, 20 bp, Artificial Sequence
  Description of Artificial Sequence: Synthetic oligonucleotide
  Target: ATXN1; (-) strand; PAM type: NRG; PAM sequence: AGG
ttggatggtaatggatcttg

SEQ ID NO: 59241 - DNA, 20 bp, Artificial Sequence
  Description of Artificial Sequence: Synthetic oligonucleotide
  Target: ATXN1; (-) strand; PAM type: NRG; PAM sequence: GAG
cttggatggtaatggatctt

SEQ ID NO: 59242 - DNA, 20 bp, Artificial Sequence
  Description of Artificial Sequence: Synthetic oligonucleotide
  Target: ATXN1; (-) strand; PAM type: NRG; PAM sequence: TGG
caggattccttggatggtaa

SEQ ID NO: 59243 - DNA, 20 bp, Artificial Sequence
  Description of Artificial Sequence: Synthetic oligonucleotide
  Target: ATXN1; (-) strand; PAM type: NRG; PAM sequence: TGG
ctgtcccaggattccttgga

SEQ ID NO: 59244 - DNA, 20 bp, Artificial Sequence
  Description of Artificial Sequence: Synthetic oligonucleotide
  Target: ATXN1; (-) strand; PAM type: NRG; PAM sequence: TGG
caggctgtcccaggattcct

SEQ ID NO: 59245 - DNA, 20 bp, Artificial Sequence
  Description of Artificial Sequence: Synthetic oligonucleotide
  Target: ATXN1; (-) strand; PAM type: NRG; PAM sequence: AGG
acctggttacaggctgtccc

SEQ ID NO: 59246 - DNA, 20 bp, Artificial Sequence
  Description of Artificial Sequence: Synthetic oligonucleotide
  Target: ATXN1; (-) strand; PAM type: NRG; PAM sequence: CAG
tacctggttacaggctgtcc

SEQ ID NO: 59247 - DNA, 20 bp, Artificial Sequence
  Description of Artificial Sequence: Synthetic oligonucleotide
  Target: ATXN1; (-) strand; PAM type: NRG; PAM sequence: AGG
tgggagaaatacctggttac

SEQ ID NO: 59248 - DNA, 20 bp, Artificial Sequence
  Description of Artificial Sequence: Synthetic oligonucleotide
  Target: ATXN1; (-) strand; PAM type: NRG; PAM sequence: CAG
gtgggagaaatacctggtta

SEQ ID NO: 59249 - DNA, 20 bp, Artificial Sequence
  Description of Artificial Sequence: Synthetic oligonucleotide
  Target: ATXN1; (-) strand; PAM type: NRG; PAM sequence: TGG
gaggaggtgggagaaatacc

SEQ ID NO: 59250 - DNA, 20 bp, Artificial Sequence
  Description of Artificial Sequence: Synthetic oligonucleotide
  Target: ATXN1; (-) strand; PAM type: NRG; PAM sequence: GAG
aattacaactgaggaggtgg

SEQ ID NO: 59251 - DNA, 20 bp, Artificial Sequence
  Description of Artificial Sequence: Synthetic oligonucleotide
  Target: ATXN1; (-) strand; PAM type: NRG; PAM sequence: GGG
ccaattacaactgaggaggt

SEQ ID NO: 59252 - DNA, 20 bp, Artificial Sequence
  Description of Artificial Sequence: Synthetic oligonucleotide
  Target: ATXN1; (-) strand; PAM type: NRG; PAM sequence: TGG
cccaattacaactgaggagg

SEQ ID NO: 59253 - DNA, 20 bp, Artificial Sequence
  Description of Artificial Sequence: Synthetic oligonucleotide
  Target: ATXN1; (-) strand; PAM type: NRG; PAM sequence: AGG
tctcccaattacaactgagg

SEQ ID NO: 59254 - DNA, 20 bp, Artificial Sequence
  Description of Artificial Sequence: Synthetic oligonucleotide
  Target: ATXN1; (-) strand; PAM type: NRG; PAM sequence: GAG
gtctcccaattacaactgag

SEQ ID NO: 59255 - DNA, 20 bp, Artificial Sequence
  Description of Artificial Sequence: Synthetic oligonucleotide
  Target: ATXN1; (-) strand; PAM type: NRG; PAM sequence: AGG
aagtctcccaattacaactg

SEQ ID NO: 59256 - DNA, 20 bp, Artificial Sequence
  Description of Artificial Sequence: Synthetic oligonucleotide
  Target: ATXN1; (-) strand; PAM type: NRG; PAM sequence: GAG
aaagtctcccaattacaact

SEQ ID NO: 59257 - DNA, 20 bp, Artificial Sequence
  Description of Artificial Sequence: Synthetic oligonucleotide
  Target: ATXN1; (-) strand; PAM type: NRG; PAM sequence: AAG
aaaagcatgtgaaaagagca

SEQ ID NO: 59258 - DNA, 20 bp, Artificial Sequence
  Description of Artificial Sequence: Synthetic oligonucleotide
  Target: ATXN1; (-) strand; PAM type: NRG; PAM sequence: GAG
ataagaaaagcatgtgaaaa

SEQ ID NO: 59259 - DNA, 20 bp, Artificial Sequence
  Description of Artificial Sequence: Synthetic oligonucleotide
  Target: ATXN1; (-) strand; PAM type: NRG; PAM sequence: AAG
gcataagaaaagcatgtgaa

SEQ ID NO: 59260 - DNA, 20 bp, Artificial Sequence
  Description of Artificial Sequence: Synthetic oligonucleotide
  Target: ATXN1; (-) strand; PAM type: NRG; PAM sequence: AAG
ggggctttcaggcataagaa

SEQ ID NO: 59261 - DNA, 20 bp, Artificial Sequence
  Description of Artificial Sequence: Synthetic oligonucleotide
  Target: ATXN1; (-) strand; PAM type: NRG; PAM sequence: AAG
ggtgtggggctttcaggcat

SEQ ID NO: 59262 - DNA, 20 bp, Artificial Sequence
  Description of Artificial Sequence: Synthetic oligonucleotide
  Target: ATXN1; (-) strand; PAM type: NRG; PAM sequence: AGG
aataagggtgtggggctttc

SEQ ID NO: 59263 - DNA, 20 bp, Artificial Sequence
  Description of Artificial Sequence: Synthetic oligonucleotide
  Target: ATXN1; (-) strand; PAM type: NRG; PAM sequence: CAG
taataagggtgtggggcttt

SEQ ID NO: 59264 - DNA, 20 bp, Artificial Sequence
  Description of Artificial Sequence: Synthetic oligonucleotide
  Target: ATXN1; (-) strand; PAM type: NRG; PAM sequence: GGG
ccctccctaataagggtgtg

SEQ ID NO: 59265 - DNA, 20 bp, Artificial Sequence
  Description of Artificial Sequence: Synthetic oligonucleotide
  Target: ATXN1; (-) strand; PAM type: NRG; PAM sequence: GGG
tccctccctaataagggtgt

SEQ ID NO: 59266 - DNA, 20 bp, Artificial Sequence
  Description of Artificial Sequence: Synthetic oligonucleotide
  Target: ATXN1; (-) strand; PAM type: NRG; PAM sequence: TGG
gtccctccctaataagggtg

SEQ ID NO: 59267 - DNA, 20 bp, Artificial Sequence
  Description of Artificial Sequence: Synthetic oligonucleotide
  Target: ATXN1; (-) strand; PAM type: NRG; PAM sequence: GGG
aatatgtccctccctaataa

SEQ ID NO: 59268 - DNA, 20 bp, Artificial Sequence
  Description of Artificial Sequence: Synthetic oligonucleotide
  Target: ATXN1; (-) strand; PAM type: NRG; PAM sequence: AGG
taatatgtccctccctaata

SEQ ID NO: 59269 - DNA, 20 bp, Artificial Sequence
  Description of Artificial Sequence: Synthetic oligonucleotide
  Target: ATXN1; (-) strand; PAM type: NRG; PAM sequence: AAG
ctaatatgtccctccctaat

SEQ ID NO: 59270 - DNA, 20 bp, Artificial Sequence
  Description of Artificial Sequence: Synthetic oligonucleotide
  Target: ATXN1; (-) strand; PAM type: NRG; PAM sequence: TGG
atagttaatggctccagctt

SEQ ID NO: 59271 - DNA, 20 bp, Artificial Sequence
  Description of Artificial Sequence: Synthetic oligonucleotide
  Target: ATXN1; (-) strand; PAM type: NRG; PAM sequence: CAG
attcatatagttaatggctc

SEQ ID NO: 59272 - DNA, 20 bp, Artificial Sequence
  Description of Artificial Sequence: Synthetic oligonucleotide
  Target: ATXN1; (-) strand; PAM type: NRG; PAM sequence: TGG
ccccatattcatatagttaa

SEQ ID NO: 59273 - DNA, 20 bp, Artificial Sequence
  Description of Artificial Sequence: Synthetic oligonucleotide
  Target: ATXN1; (-) strand; PAM type: NRG; PAM sequence: TAG
acttgttccccatattcata

SEQ ID NO: 59274 - DNA, 20 bp, Artificial Sequence
  Description of Artificial Sequence: Synthetic oligonucleotide
  Target: ATXN1; (-) strand; PAM type: NRG; PAM sequence: GGG
tcaagtaggggacaacaaat

SEQ ID NO: 59275 - DNA, 20 bp, Artificial Sequence
  Description of Artificial Sequence: Synthetic oligonucleotide
  Target: ATXN1; (-) strand; PAM type: NRG; PAM sequence: TGG
ctcaagtaggggacaacaaa

SEQ ID NO: 59276 - DNA, 20 bp, Artificial Sequence
  Description of Artificial Sequence: Synthetic oligonucleotide
  Target: ATXN1; (-) strand; PAM type: NRG; PAM sequence: GGG
ttgattccctcctcaagtag

SEQ ID NO: 59277 - DNA, 20 bp, Artificial Sequence
  Description of Artificial Sequence: Synthetic oligonucleotide
  Target: ATXN1; (-) strand; PAM type: NRG; PAM sequence: GGG
gttgattccctcctcaagta

SEQ ID NO: 59278 - DNA, 20 bp, Artificial Sequence
  Description of Artificial Sequence: Synthetic oligonucleotide
  Target: ATXN1; (-) strand; PAM type: NRG; PAM sequence: AGG
ggttgattccctcctcaagt

SEQ ID NO: 59279 - DNA, 20 bp, Artificial Sequence
  Description of Artificial Sequence: Synthetic oligonucleotide
  Target: ATXN1; (-) strand; PAM type: NRG; PAM sequence: TAG
gggttgattccctcctcaag

SEQ ID NO: 59280 - DNA, 20 bp, Artificial Sequence
  Description of Artificial Sequence: Synthetic oligonucleotide
  Target: ATXN1; (-) strand; PAM type: NRG; PAM sequence: AAG
tcagggttgattccctcctc

SEQ ID NO: 59281 - DNA, 20 bp, Artificial Sequence
  Description of Artificial Sequence: Synthetic oligonucleotide
  Target: ATXN1; (-) strand; PAM type: NRG; PAM sequence: GGG
cttccaatgcccagacttca

SEQ ID NO: 59282 - DNA, 20 bp, Artificial Sequence
  Description of Artificial Sequence: Synthetic oligonucleotide
  Target: ATXN1; (-) strand; PAM type: NRG; PAM sequence: AGG
ccttccaatgcccagacttc

SEQ ID NO: 59283 - DNA, 20 bp, Artificial Sequence
  Description of Artificial Sequence: Synthetic oligonucleotide
  Target: ATXN1; (-) strand; PAM type: NRG; PAM sequence: CAG
tccttccaatgcccagactt

SEQ ID NO: 59284 - DNA, 20 bp, Artificial Sequence
  Description of Artificial Sequence: Synthetic oligonucleotide
  Target: ATXN1; (-) strand; PAM type: NRG; PAM sequence: CAG
cgaattgtccttccaatgcc

SEQ ID NO: 59285 - DNA, 20 bp, Artificial Sequence
  Description of Artificial Sequence: Synthetic oligonucleotide
  Target: ATXN1; (-) strand; PAM type: NRG; PAM sequence: GGG
tagcctgatttggactgggt

SEQ ID NO: 59286 - DNA, 20 bp, Artificial Sequence
  Description of Artificial Sequence: Synthetic oligonucleotide
  Target: ATXN1; (-) strand; PAM type: NRG; PAM sequence: TGG
atagcctgatttggactggg

SEQ ID NO: 59287 - DNA, 20 bp, Artificial Sequence
  Description of Artificial Sequence: Synthetic oligonucleotide
  Target: ATXN1; (-) strand; PAM type: NRG; PAM sequence: GGG
cttatagcctgatttggact

SEQ ID NO: 59288 - DNA, 20 bp, Artificial Sequence
  Description of Artificial Sequence: Synthetic oligonucleotide
  Target: ATXN1; (-) strand; PAM type: NRG; PAM sequence: TGG
tcttatagcctgatttggac

SEQ ID NO: 59289 - DNA, 20 bp, Artificial Sequence
  Description of Artificial Sequence: Synthetic oligonucleotide
  Target: ATXN1; (-) strand; PAM type: NRG; PAM sequence: TGG
tggggtcttatagcctgatt

SEQ ID NO: 59290 - DNA, 20 bp, Artificial Sequence
  Description of Artificial Sequence: Synthetic oligonucleotide
  Target: ATXN1; (-) strand; PAM type: NRG; PAM sequence: TAG
ggaaaagtggtggggtctta

SEQ ID NO: 59291 - DNA, 20 bp, Artificial Sequence
  Description of Artificial Sequence: Synthetic oligonucleotide
  Target: ATXN1; (-) strand; PAM type: NRG; PAM sequence: GGG
tttgataaggaaaagtggtg

SEQ ID NO: 59292 - DNA, 20 bp, Artificial Sequence
  Description of Artificial Sequence: Synthetic oligonucleotide
  Target: ATXN1; (-) strand; PAM type: NRG; PAM sequence: GGG
ctttgataaggaaaagtggt

SEQ ID NO: 59293 - DNA, 20 bp, Artificial Sequence
  Description of Artificial Sequence: Synthetic oligonucleotide
  Target: ATXN1; (-) strand; PAM type: NRG; PAM sequence: TGG
cctttgataaggaaaagtgg

SEQ ID NO: 59294 - DNA, 20 bp, Artificial Sequence
  Description of Artificial Sequence: Synthetic oligonucleotide
  Target: ATXN1; (-) strand; PAM type: NRG; PAM sequence: TGG
ttgcctttgataaggaaaag

SEQ ID NO: 59295 - DNA, 20 bp, Artificial Sequence
  Description of Artificial Sequence: Synthetic oligonucleotide
  Target: ATXN1; (-) strand; PAM type: NRG; PAM sequence: AAG
atattgcctttgataaggaa

SEQ ID NO: 59296 - DNA, 20 bp, Artificial Sequence
  Description of Artificial Sequence: Synthetic oligonucleotide
  Target: ATXN1; (-) strand; PAM type: NRG; PAM sequence: AGG
aagagatattgcctttgata

SEQ ID NO: 59297 - DNA, 20 bp, Artificial Sequence
  Description of Artificial Sequence: Synthetic oligonucleotide
  Target: ATXN1; (-) strand; PAM type: NRG; PAM sequence: AAG
taagagatattgcctttgat

SEQ ID NO: 59298 - DNA, 20 bp, Artificial Sequence
  Description of Artificial Sequence: Synthetic oligonucleotide
  Target: ATXN1; (-) strand; PAM type: NRG; PAM sequence: GAG
ttatgagcttcaggccttaa

SEQ ID NO: 59299 - DNA, 20 bp, Artificial Sequence
  Description of Artificial Sequence: Synthetic oligonucleotide
  Target: ATXN1; (-) strand; PAM type: NRG; PAM sequence: AAG
ctttatgagcttcaggcctt

SEQ ID NO: 59300 - DNA, 20 bp, Artificial Sequence
  Description of Artificial Sequence: Synthetic oligonucleotide
  Target: ATXN1; (-) strand; PAM type: NRG; PAM sequence: AGG
tgtaatcctttatgagcttc

SEQ ID NO: 59301 - DNA, 20 bp, Artificial Sequence
  Description of Artificial Sequence: Synthetic oligonucleotide
  Target: ATXN1; (-) strand; PAM type: NRG; PAM sequence: CAG
ctgtaatcctttatgagctt

SEQ ID NO: 59302 - DNA, 20 bp, Artificial Sequence
  Description of Artificial Sequence: Synthetic oligonucleotide
  Target: ATXN1; (-) strand; PAM type: NRG; PAM sequence: GAG
aatatcctgtaatcctttat

SEQ ID NO: 59303 - DNA, 20 bp, Artificial Sequence
  Description of Artificial Sequence: Synthetic oligonucleotide
  Target: ATXN1; (-) strand; PAM type: NRG; PAM sequence: AAG
ggctactgcattttcttact

SEQ ID NO: 59304 - DNA, 20 bp, Artificial Sequence
  Description of Artificial Sequence: Synthetic oligonucleotide
  Target: ATXN1; (-) strand; PAM type: NRG; PAM sequence: GGG
ctagaattggggtgttgcag

SEQ ID NO: 59305 - DNA, 20 bp, Artificial Sequence
  Description of Artificial Sequence: Synthetic oligonucleotide
  Target: ATXN1; (-) strand; PAM type: NRG; PAM sequence: GGG
cctagaattggggtgttgca

SEQ ID NO: 59306 - DNA, 20 bp, Artificial Sequence
  Description of Artificial Sequence: Synthetic oligonucleotide
  Target: ATXN1; (-) strand; PAM type: NRG; PAM sequence: AGG
tcctagaattggggtgttgc

SEQ ID NO: 59307 - DNA, 20 bp, Artificial Sequence
  Description of Artificial Sequence: Synthetic oligonucleotide
  Target: ATXN1; (-) strand; PAM type: NRG; PAM sequence: CAG
ctcctagaattggggtgttg

SEQ ID NO: 59308 - DNA, 20 bp, Artificial Sequence
  Description of Artificial Sequence: Synthetic oligonucleotide
  Target: ATXN1; (-) strand; PAM type: NRG; PAM sequence: GGG
tttttgtactcctagaattg

SEQ ID NO: 59309 - DNA, 20 bp, Artificial Sequence
  Description of Artificial Sequence: Synthetic oligonucleotide
  Target: ATXN1; (-) strand; PAM type: NRG; PAM sequence: GGG
gtttttgtactcctagaatt

SEQ ID NO: 59310 - DNA, 20 bp, Artificial Sequence
  Description of Artificial Sequence: Synthetic oligonucleotide
  Target: ATXN1; (-) strand; PAM type: NRG; PAM sequence: TGG
agtttttgtactcctagaat

SEQ ID NO: 59311 - DNA, 20 bp, Artificial Sequence
  Description of Artificial Sequence: Synthetic oligonucleotide
  Target: ATXN1; (-) strand; PAM type: NRG; PAM sequence: TAG
cgattcagtttttgtactcc

SEQ ID NO: 59312 - DNA, 20 bp, Artificial Sequence
  Description of Artificial Sequence: Synthetic oligonucleotide
  Target: ATXN1; (-) strand; PAM type: NRG; PAM sequence: CAG
actagtctccactgacgatt

SEQ ID NO: 59313 - DNA, 20 bp, Artificial Sequence
  Description of Artificial Sequence: Synthetic oligonucleotide
  Target: ATXN1; (-) strand; PAM type: NRG; PAM sequence: TAG
atgagtctaggatcttgcac

SEQ ID NO: 59314 - DNA, 20 bp, Artificial Sequence
  Description of Artificial Sequence: Synthetic oligonucleotide
  Target: ATXN1; (-) strand; PAM type: NRG; PAM sequence: AGG
acttcctcactgatgagtct

SEQ ID NO: 59315 - DNA, 20 bp, Artificial Sequence
  Description of Artificial Sequence: Synthetic oligonucleotide
  Target: ATXN1; (-) strand; PAM type: NRG; PAM sequence: TAG
tacttcctcactgatgagtc

SEQ ID NO: 59316 - DNA, 20 bp, Artificial Sequence
  Description of Artificial Sequence: Synthetic oligonucleotide
  Target: ATXN1; (-) strand; PAM type: NRG; PAM sequence: GAG
ggaattacttcctcactgat

SEQ ID NO: 59317 - DNA, 20 bp, Artificial Sequence
  Description of Artificial Sequence: Synthetic oligonucleotide
  Target: ATXN1; (-) strand; PAM type: NRG; PAM sequence: AGG
ttgggtacaaccggatatag

SEQ ID NO: 59318 - DNA, 20 bp, Artificial Sequence
  Description of Artificial Sequence: Synthetic oligonucleotide
  Target: ATXN1; (-) strand; PAM type: NRG; PAM sequence: GAG
gttgggtacaaccggatata

SEQ ID NO: 59319 - DNA, 20 bp, Artificial Sequence
  Description of Artificial Sequence: Synthetic oligonucleotide
  Target: ATXN1; (-) strand; PAM type: NRG; PAM sequence: TAG
gggttgggtacaaccggata

SEQ ID NO: 59320 - DNA, 20 bp, Artificial Sequence
  Description of Artificial Sequence: Synthetic oligonucleotide
  Target: ATXN1; (-) strand; PAM type: NRG; PAM sequence: CGG
gtataggggttgggtacaac

SEQ ID NO: 59321 - DNA, 20 bp, Artificial Sequence
  Description of Artificial Sequence: Synthetic oligonucleotide
  Target: ATXN1; (-) strand; PAM type: NRG; PAM sequence: GGG
gagagcagggtataggggtt

SEQ ID NO: 59322 - DNA, 20 bp, Artificial Sequence
  Description of Artificial Sequence: Synthetic oligonucleotide
  Target: ATXN1; (-) strand; PAM type: NRG; PAM sequence: TGG
agagagcagggtataggggt

SEQ ID NO: 59323 - DNA, 20 bp, Artificial Sequence
  Description of Artificial Sequence: Synthetic oligonucleotide
  Target: ATXN1; (-) strand; PAM type: NRG; PAM sequence: GGG
tttgagagagcagggtatag

SEQ ID NO: 59324 - DNA, 20 bp, Artificial Sequence
  Description of Artificial Sequence: Synthetic oligonucleotide
  Target: ATXN1; (-) strand; PAM type: NRG; PAM sequence: GGG
atttgagagagcagggtata

SEQ ID NO: 59325 - DNA, 20 bp, Artificial Sequence
  Description of Artificial Sequence: Synthetic oligonucleotide
  Target: ATXN1; (-) strand; PAM type: NRG; PAM sequence: AGG
tatttgagagagcagggtat

SEQ ID NO: 59326 - DNA, 20 bp, Artificial Sequence
  Description of Artificial Sequence: Synthetic oligonucleotide
  Target: ATXN1; (-) strand; PAM type: NRG; PAM sequence: TAG
gtatttgagagagcagggta

SEQ ID NO: 59327 - DNA, 20 bp, Artificial Sequence
  Description of Artificial Sequence: Synthetic oligonucleotide
  Target: ATXN1; (-) strand; PAM type: NRG; PAM sequence: GGG
ctttggtatttgagagagca

SEQ ID NO: 59328 - DNA, 20 bp, Artificial Sequence
  Description of Artificial Sequence: Synthetic oligonucleotide
  Target: ATXN1; (-) strand; PAM type: NRG; PAM sequence: AGG
cctttggtatttgagagagc

SEQ ID NO: 59329 - DNA, 20 bp, Artificial Sequence
  Description of Artificial Sequence: Synthetic oligonucleotide
  Target: ATXN1; (-) strand; PAM type: NRG; PAM sequence: CAG
tcctttggtatttgagagag

SEQ ID NO: 59330 - DNA, 20 bp, Artificial Sequence
  Description of Artificial Sequence: Synthetic oligonucleotide
  Target: ATXN1; (-) strand; PAM type: NRG; PAM sequence: GAG
gcttcctttggtatttgaga

SEQ ID NO: 59331 - DNA, 20 bp, Artificial Sequence
  Description of Artificial Sequence: Synthetic oligonucleotide
  Target: ATXN1; (-) strand; PAM type: NRG; PAM sequence: GAG
ctgcttcctttggtatttga

SEQ ID NO: 59332 - DNA, 20 bp, Artificial Sequence
  Description of Artificial Sequence: Synthetic oligonucleotide
  Target: ATXN1; (-) strand; PAM type: NRG; PAM sequence: GAG
ttctgcttcctttggtattt

SEQ ID NO: 59333 - DNA, 20 bp, Artificial Sequence
  Description of Artificial Sequence: Synthetic oligonucleotide
  Target: ATXN1; (-) strand; PAM type: NRG; PAM sequence: TGG
tgaaaccattctgcttcctt

SEQ ID NO: 59334 - DNA, 20 bp, Artificial Sequence
  Description of Artificial Sequence: Synthetic oligonucleotide
  Target: ATXN1; (-) strand; PAM type: NRG; PAM sequence: CAG
agcatccttgaggtccagaa

SEQ ID NO: 59335 - DNA, 20 bp, Artificial Sequence
  Description of Artificial Sequence: Synthetic oligonucleotide
  Target: ATXN1; (-) strand; PAM type: NRG; PAM sequence: CAG
aaggcagcatccttgaggtc

SEQ ID NO: 59336 - DNA, 20 bp, Artificial Sequence
  Description of Artificial Sequence: Synthetic oligonucleotide
  Target: ATXN1; (-) strand; PAM type: NRG; PAM sequence: AGG
cgcagaaggcagcatccttg

SEQ ID NO: 59337 - DNA, 20 bp, Artificial Sequence
  Description of Artificial Sequence: Synthetic oligonucleotide
  Target: ATXN1; (-) strand; PAM type: NRG; PAM sequence: GAG
acgcagaaggcagcatcctt

SEQ ID NO: 59338 - DNA, 20 bp, Artificial Sequence
  Description of Artificial Sequence: Synthetic oligonucleotide
  Target: ATXN1; (-) strand; PAM type: NRG; PAM sequence: CAG
gtgcagaggaacgcagaagg

SEQ ID NO: 59339 - DNA, 20 bp, Artificial Sequence
  Description of Artificial Sequence: Synthetic oligonucleotide
  Target: ATXN1; (-) strand; PAM type: NRG; PAM sequence: AGG
caagtgcagaggaacgcaga

SEQ ID NO: 59340 - DNA, 20 bp, Artificial Sequence
  Description of Artificial Sequence: Synthetic oligonucleotide
  Target: ATXN1; (-) strand; PAM type: NRG; PAM sequence: AAG
ccaagtgcagaggaacgcag

SEQ ID NO: 59341 - DNA, 20 bp, Artificial Sequence
  Description of Artificial Sequence: Synthetic oligonucleotide
  Target: ATXN1; (-) strand; PAM type: NRG; PAM sequence: CAG
agtccaagtgcagaggaacg

SEQ ID NO: 59342 - DNA, 20 bp, Artificial Sequence
  Description of Artificial Sequence: Synthetic oligonucleotide
  Target: ATXN1; (-) strand; PAM type: NRG; PAM sequence: AGG
aactgggagtccaagtgcag

SEQ ID NO: 59343 - DNA, 20 bp, Artificial Sequence
  Description of Artificial Sequence: Synthetic oligonucleotide
  Target: ATXN1; (-) strand; PAM type: NRG; PAM sequence: GAG
aaactgggagtccaagtgca

SEQ ID NO: 59344 - DNA, 20 bp, Artificial Sequence
  Description of Artificial Sequence: Synthetic oligonucleotide
  Target: ATXN1; (-) strand; PAM type: NRG; PAM sequence: CAG
agaaactgggagtccaagtg

SEQ ID NO: 59345 - DNA, 20 bp, Artificial Sequence
  Description of Artificial Sequence: Synthetic oligonucleotide
  Target: ATXN1; (-) strand; PAM type: NRG; PAM sequence: AAG
caaagagaaactgggagtcc

SEQ ID NO: 59346 - DNA, 20 bp, Artificial Sequence
  Description of Artificial Sequence: Synthetic oligonucleotide
  Target: ATXN1; (-) strand; PAM type: NRG; PAM sequence: GAG
caaaggcaaagagaaactgg

SEQ ID NO: 59347 - DNA, 20 bp, Artificial Sequence
  Description of Artificial Sequence: Synthetic oligonucleotide
  Target: ATXN1; (-) strand; PAM type: NRG; PAM sequence: GGG
ctcaaaggcaaagagaaact

SEQ ID NO: 59348 - DNA, 20 bp, Artificial Sequence
  Description of Artificial Sequence: Synthetic oligonucleotide
  Target: ATXN1; (-) strand; PAM type: NRG; PAM sequence: TGG
cctcaaaggcaaagagaaac

SEQ ID NO: 59349 - DNA, 20 bp, Artificial Sequence
  Description of Artificial Sequence: Synthetic oligonucleotide
  Target: ATXN1; (-) strand; PAM type: NRG; PAM sequence: GAG
gtgggatcctcaaaggcaaa

SEQ ID NO: 59350 - DNA, 20 bp, Artificial Sequence
  Description of Artificial Sequence: Synthetic oligonucleotide
  Target: ATXN1; (-) strand; PAM type: NRG; PAM sequence: AAG
ctgtgggatcctcaaaggca

SEQ ID NO: 59351 - DNA, 20 bp, Artificial Sequence
  Description of Artificial Sequence: Synthetic oligonucleotide
  Target: ATXN1; (-) strand; PAM type: NRG; PAM sequence: AGG
gtggtctgtgggatcctcaa

SEQ ID NO: 59352 - DNA, 20 bp, Artificial Sequence
  Description of Artificial Sequence: Synthetic oligonucleotide
  Target: ATXN1; (-) strand; PAM type: NRG; PAM sequence: AAG
tgtggtctgtgggatcctca

SEQ ID NO: 59353 - DNA, 20 bp, Artificial Sequence
  Description of Artificial Sequence: Synthetic oligonucleotide
  Target: ATXN1; (-) strand; PAM type: NRG; PAM sequence: GGG
agttgggttttgtggtctgt

SEQ ID NO: 59354 - DNA, 20 bp, Artificial Sequence
  Description of Artificial Sequence: Synthetic oligonucleotide
  Target: ATXN1; (-) strand; PAM type: NRG; PAM sequence: TGG
aagttgggttttgtggtctg

SEQ ID NO: 59355 - DNA, 20 bp, Artificial Sequence
  Description of Artificial Sequence: Synthetic oligonucleotide
  Target: ATXN1; (-) strand; PAM type: NRG; PAM sequence: TGG
tccatgtaagttgggttttg

SEQ ID NO: 59356 - DNA, 20 bp, Artificial Sequence
  Description of Artificial Sequence: Synthetic oligonucleotide
  Target: ATXN1; (-) strand; PAM type: NRG; PAM sequence: GGG
caagaccgtccatgtaagtt

SEQ ID NO: 59357 - DNA, 20 bp, Artificial Sequence
  Description of Artificial Sequence: Synthetic oligonucleotide
  Target: ATXN1; (-) strand; PAM type: NRG; PAM sequence: TGG
gcaagaccgtccatgtaagt

SEQ ID NO: 59358 - DNA, 20 bp, Artificial Sequence
  Description of Artificial Sequence: Synthetic oligonucleotide
  Target: ATXN1; (-) strand; PAM type: NRG; PAM sequence: AAG
tgaggcaagaccgtccatgt

SEQ ID NO: 59359 - DNA, 20 bp, Artificial Sequence
  Description of Artificial Sequence: Synthetic oligonucleotide
  Target: ATXN1; (-) strand; PAM type: NRG; PAM sequence: AAG
tatccctaaacccttgaggc

SEQ ID NO: 59360 - DNA, 20 bp, Artificial Sequence
  Description of Artificial Sequence: Synthetic oligonucleotide
  Target: ATXN1; (-) strand; PAM type: NRG; PAM sequence: AGG
gggctatccctaaacccttg

SEQ ID NO: 59361 - DNA, 20 bp, Artificial Sequence
  Description of Artificial Sequence: Synthetic oligonucleotide
  Target: ATXN1; (-) strand; PAM type: NRG; PAM sequence: GAG
agggctatccctaaaccctt

SEQ ID NO: 59362 - DNA, 20 bp, Artificial Sequence
  Description of Artificial Sequence: Synthetic oligonucleotide
  Target: ATXN1; (-) strand; PAM type: NRG; PAM sequence: GGG
gtgcctgaccaaacagatga

SEQ ID NO: 59363 - DNA, 20 bp, Artificial Sequence
  Description of Artificial Sequence: Synthetic oligonucleotide
  Target: ATXN1; (-) strand; PAM type: NRG; PAM sequence: AGG
agtgcctgaccaaacagatg

SEQ ID NO: 59364 - DNA, 20 bp, Artificial Sequence
  Description of Artificial Sequence: Synthetic oligonucleotide
  Target: ATXN1; (-) strand; PAM type: NRG; PAM sequence: GAG
cagtgcctgaccaaacagat

SEQ ID NO: 59365 - DNA, 20 bp, Artificial Sequence
  Description of Artificial Sequence: Synthetic oligonucleotide
  Target: ATXN1; (-) strand; PAM type: NRG; PAM sequence: CAG
tgggacagtgcctgaccaaa

SEQ ID NO: 59366 - DNA, 20 bp, Artificial Sequence
  Description of Artificial Sequence: Synthetic oligonucleotide
  Target: ATXN1; (-) strand; PAM type: NRG; PAM sequence: CAG
aagtggcctagatcttggga

SEQ ID NO: 59367 - DNA, 20 bp, Artificial Sequence
  Description of Artificial Sequence: Synthetic oligonucleotide
  Target: ATXN1; (-) strand; PAM type: NRG; PAM sequence: GGG
tgagaagtggcctagatctt

SEQ ID NO: 59368 - DNA, 20 bp, Artificial Sequence
  Description of Artificial Sequence: Synthetic oligonucleotide
  Target: ATXN1; (-) strand; PAM type: NRG; PAM sequence: TGG
ttgagaagtggcctagatct

SEQ ID NO: 59369 - DNA, 20 bp, Artificial Sequence
  Description of Artificial Sequence: Synthetic oligonucleotide
  Target: ATXN1; (-) strand; PAM type: NRG; PAM sequence: TAG
cctggacttgagaagtggcc

SEQ ID NO: 59370 - DNA, 20 bp, Artificial Sequence
  Description of Artificial Sequence: Synthetic oligonucleotide
  Target: ATXN1; (-) strand; PAM type: NRG; PAM sequence: TGG
gcatgcctggacttgagaag

SEQ ID NO: 59371 - DNA, 20 bp, Artificial Sequence
  Description of Artificial Sequence: Synthetic oligonucleotide
  Target: ATXN1; (-) strand; PAM type: NRG; PAM sequence: AAG
ccagcatgcctggacttgag

SEQ ID NO: 59372 - DNA, 20 bp, Artificial Sequence
  Description of Artificial Sequence: Synthetic oligonucleotide
  Target: ATXN1; (-) strand; PAM type: NRG; PAM sequence: GAG
ggaccagcatgcctggactt

SEQ ID NO: 59373 - DNA, 20 bp, Artificial Sequence
  Description of Artificial Sequence: Synthetic oligonucleotide
  Target: ATXN1; (-) strand; PAM type: NRG; PAM sequence: TGG
tactgaaggaccagcatgcc

SEQ ID NO: 59374 - DNA, 20 bp, Artificial Sequence
  Description of Artificial Sequence: Synthetic oligonucleotide
  Target: ATXN1; (-) strand; PAM type: NRG; PAM sequence: CAG
tcatccacatactgaaggac

SEQ ID NO: 59375 - DNA, 20 bp, Artificial Sequence
  Description of Artificial Sequence: Synthetic oligonucleotide
  Target: ATXN1; (-) strand; PAM type: NRG; PAM sequence: AGG
gtaaatcatccacatactga

SEQ ID NO: 59376 - DNA, 20 bp, Artificial Sequence
  Description of Artificial Sequence: Synthetic oligonucleotide
  Target: ATXN1; (-) strand; PAM type: NRG; PAM sequence: AAG
agtaaatcatccacatactg

SEQ ID NO: 59377 - DNA, 20 bp, Artificial Sequence
  Description of Artificial Sequence: Synthetic oligonucleotide
  Target: ATXN1; (-) strand; PAM type: NRG; PAM sequence: AAG
gcttccgaactggtagccaa

SEQ ID NO: 59378 - DNA, 20 bp, Artificial Sequence
  Description of Artificial Sequence: Synthetic oligonucleotide
  Target: ATXN1; (-) strand; PAM type: NRG; PAM sequence: TAG
gcatgaagcttccgaactgg

SEQ ID NO: 59379 - DNA, 20 bp, Artificial Sequence
  Description of Artificial Sequence: Synthetic oligonucleotide
  Target: ATXN1; (-) strand; PAM type: NRG; PAM sequence: TGG
ctggcatgaagcttccgaac

SEQ ID NO: 59380 - DNA, 20 bp, Artificial Sequence
  Description of Artificial Sequence: Synthetic oligonucleotide
  Target: ATXN1; (-) strand; PAM type: NRG; PAM sequence: AAG
tagagtagcctgctggcatg

SEQ ID NO: 59381 - DNA, 20 bp, Artificial Sequence
  Description of Artificial Sequence: Synthetic oligonucleotide
  Target: ATXN1; (-) strand; PAM type: NRG; PAM sequence: TGG
agagatctagagtagcctgc

SEQ ID NO: 59382 - DNA, 20 bp, Artificial Sequence
  Description of Artificial Sequence: Synthetic oligonucleotide
  Target: ATXN1; (-) strand; PAM type: NRG; PAM sequence: TAG
aaagttcaagagatctagag

SEQ ID NO: 59383 - DNA, 20 bp, Artificial Sequence
  Description of Artificial Sequence: Synthetic oligonucleotide
  Target: ATXN1; (-) strand; PAM type: NRG; PAM sequence: GAG
tagaaagttcaagagatcta

SEQ ID NO: 59384 - DNA, 20 bp, Artificial Sequence
  Description of Artificial Sequence: Synthetic oligonucleotide
  Target: ATXN1; (-) strand; PAM type: NRG; PAM sequence: TAG
gctagaaagttcaagagatc

SEQ ID NO: 59385 - DNA, 20 bp, Artificial Sequence
  Description of Artificial Sequence: Synthetic oligonucleotide
  Target: ATXN1; (-) strand; PAM type: NRG; PAM sequence: GAG
tgattagctagaaagttcaa

SEQ ID NO: 59386 - DNA, 20 bp, Artificial Sequence
  Description of Artificial Sequence: Synthetic oligonucleotide
  Target: ATXN1; (-) strand; PAM type: NRG; PAM sequence: AAG
cttgattagctagaaagttc

SEQ ID NO: 59387 - DNA, 20 bp, Artificial Sequence
  Description of Artificial Sequence: Synthetic oligonucleotide
  Target: ATXN1; (-) strand; PAM type: NRG; PAM sequence: AAG
tgtacccttgattagctaga

SEQ ID NO: 59388 - DNA, 20 bp, Artificial Sequence
  Description of Artificial Sequence: Synthetic oligonucleotide
  Target: ATXN1; (-) strand; PAM type: NRG; PAM sequence: TAG
gccttgtacccttgattagc

SEQ ID NO: 59389 - DNA, 20 bp, Artificial Sequence
  Description of Artificial Sequence: Synthetic oligonucleotide
  Target: ATXN1; (-) strand; PAM type: NRG; PAM sequence: TAG
agatgccttgtacccttgat

SEQ ID NO: 59390 - DNA, 20 bp, Artificial Sequence
  Description of Artificial Sequence: Synthetic oligonucleotide
  Target: ATXN1; (-) strand; PAM type: NRG; PAM sequence: TAG
gcagagctgggccttcgatt

SEQ ID NO: 59391 - DNA, 20 bp, Artificial Sequence
  Description of Artificial Sequence: Synthetic oligonucleotide
  Target: ATXN1; (-) strand; PAM type: NRG; PAM sequence: GGG
gacttgttgtaggcagagct

SEQ ID NO: 59392 - DNA, 20 bp, Artificial Sequence
  Description of Artificial Sequence: Synthetic oligonucleotide
  Target: ATXN1; (-) strand; PAM type: NRG; PAM sequence: TGG
tgacttgttgtaggcagagc

SEQ ID NO: 59393 - DNA, 20 bp, Artificial Sequence
  Description of Artificial Sequence: Synthetic oligonucleotide
  Target: ATXN1; (-) strand; PAM type: NRG; PAM sequence: GAG
tatttgacttgttgtaggca

SEQ ID NO: 59394 - DNA, 20 bp, Artificial Sequence
  Description of Artificial Sequence: Synthetic oligonucleotide
  Target: ATXN1; (-) strand; PAM type: NRG; PAM sequence: CAG
gatatttgacttgttgtagg

SEQ ID NO: 59395 - DNA, 20 bp, Artificial Sequence
  Description of Artificial Sequence: Synthetic oligonucleotide
  Target: ATXN1; (-) strand; PAM type: NRG; PAM sequence: AGG
ttagatatttgacttgttgt

SEQ ID NO: 59396 - DNA, 20 bp, Artificial Sequence
  Description of Artificial Sequence: Synthetic oligonucleotide
  Target: ATXN1; (-) strand; PAM type: NRG; PAM sequence: TAG
cttagatatttgacttgttg

SEQ ID NO: 59397 - DNA, 20 bp, Artificial Sequence
  Description of Artificial Sequence: Synthetic oligonucleotide
  Target: ATXN1; (-) strand; PAM type: NRG; PAM sequence: TAG
cctctggctaggattaggct

SEQ ID NO: 59398 - DNA, 20 bp, Artificial Sequence
  Description of Artificial Sequence: Synthetic oligonucleotide
  Target: ATXN1; (-) strand; PAM type: NRG; PAM sequence: AGG
tggttcctctggctaggatt

SEQ ID NO: 59399 - DNA, 20 bp, Artificial Sequence
  Description of Artificial Sequence: Synthetic oligonucleotide
  Target: ATXN1; (-) strand; PAM type: NRG; PAM sequence: TAG
ctggttcctctggctaggat

SEQ ID NO: 59400 - DNA, 20 bp, Artificial Sequence
  Description of Artificial Sequence: Synthetic oligonucleotide
  Target: ATXN1; (-) strand; PAM type: NRG; PAM sequence: AGG
gggccctggttcctctggct

SEQ ID NO: 59401 - DNA, 20 bp, Artificial Sequence
  Description of Artificial Sequence: Synthetic oligonucleotide
  Target: ATXN1; (-) strand; PAM type: NRG; PAM sequence: TAG
agggccctggttcctctggc

SEQ ID NO: 59402 - DNA, 20 bp, Artificial Sequence
  Description of Artificial Sequence: Synthetic oligonucleotide
  Target: ATXN1; (-) strand; PAM type: NRG; PAM sequence: TGG
gctgagggccctggttcctc

SEQ ID NO: 59403 - DNA, 20 bp, Artificial Sequence
  Description of Artificial Sequence: Synthetic oligonucleotide
  Target: ATXN1; (-) strand; PAM type: NRG; PAM sequence: TGG
ttgttctttgctgagggccc

SEQ ID NO: 59404 - DNA, 20 bp, Artificial Sequence
  Description of Artificial Sequence: Synthetic oligonucleotide
  Target: ATXN1; (-) strand; PAM type: NRG; PAM sequence: GGG
ctgtatttgttctttgctga

SEQ ID NO: 59405 - DNA, 20 bp, Artificial Sequence
  Description of Artificial Sequence: Synthetic oligonucleotide
  Target: ATXN1; (-) strand; PAM type: NRG; PAM sequence: AGG
gctgtatttgttctttgctg

SEQ ID NO: 59406 - DNA, 20 bp, Artificial Sequence
  Description of Artificial Sequence: Synthetic oligonucleotide
  Target: ATXN1; (-) strand; PAM type: NRG; PAM sequence: GAG
ggctgtatttgttctttgct

SEQ ID NO: 59407 - DNA, 20 bp, Artificial Sequence
  Description of Artificial Sequence: Synthetic oligonucleotide
  Target: ATXN1; (-) strand; PAM type: NRG; PAM sequence: AGG
gggcaaggacaagccagtat

SEQ ID NO: 59408 - DNA, 20 bp, Artificial Sequence
  Description of Artificial Sequence: Synthetic oligonucleotide
  Target: ATXN1; (-) strand; PAM type: NRG; PAM sequence: TAG
agggcaaggacaagccagta

SEQ ID NO: 59409 - DNA, 20 bp, Artificial Sequence
  Description of Artificial Sequence: Synthetic oligonucleotide
  Target: ATXN1; (-) strand; PAM type: NRG; PAM sequence: CAG
gtgttagggcaaggacaagc

SEQ ID NO: 59410 - DNA, 20 bp, Artificial Sequence
  Description of Artificial Sequence: Synthetic oligonucleotide
  Target: ATXN1; (-) strand; PAM type: NRG; PAM sequence: AAG
taatgtgttagggcaaggac

SEQ ID NO: 59411 - DNA, 20 bp, Artificial Sequence
  Description of Artificial Sequence: Synthetic oligonucleotide
  Target: ATXN1; (-) strand; PAM type: NRG; PAM sequence: AGG
tgttttaatgtgttagggca

SEQ ID NO: 59412 - DNA, 20 bp, Artificial Sequence
  Description of Artificial Sequence: Synthetic oligonucleotide
  Target: ATXN1; (-) strand; PAM type: NRG; PAM sequence: AAG
ctgttttaatgtgttagggc

SEQ ID NO: 59413 - DNA, 20 bp, Artificial Sequence
  Description of Artificial Sequence: Synthetic oligonucleotide
  Target: ATXN1; (-) strand; PAM type: NRG; PAM sequence: GGG
acaactgttttaatgtgtta

SEQ ID NO: 59414 - DNA, 20 bp, Artificial Sequence
  Description of Artificial Sequence: Synthetic oligonucleotide
  Target: ATXN1; (-) strand; PAM type: NRG; PAM sequence: AGG
cacaactgttttaatgtgtt

SEQ ID NO: 59415 - DNA, 20 bp, Artificial Sequence
  Description of Artificial Sequence: Synthetic oligonucleotide
  Target: ATXN1; (-) strand; PAM type: NRG; PAM sequence: TAG
ccacaactgttttaatgtgt

SEQ ID NO: 59416 - DNA, 20 bp, Artificial Sequence
  Description of Artificial Sequence: Synthetic oligonucleotide
  Target: ATXN1; (-) strand; PAM type: NRG; PAM sequence: AGG
ggtaaaagccagtgatccca

SEQ ID NO: 59417 - DNA, 20 bp, Artificial Sequence
  Description of Artificial Sequence: Synthetic oligonucleotide
  Target: ATXN1; (-) strand; PAM type: NRG; PAM sequence: AAG
cggtaaaagccagtgatccc

SEQ ID NO: 59418 - DNA, 20 bp, Artificial Sequence
  Description of Artificial Sequence: Synthetic oligonucleotide
  Target: ATXN1; (-) strand; PAM type: NRG; PAM sequence: CAG
gatccatagtcggtaaaagc

SEQ ID NO: 59419 - DNA, 20 bp, Artificial Sequence
  Description of Artificial Sequence: Synthetic oligonucleotide
  Target: ATXN1; (-) strand; PAM type: NRG; PAM sequence: AAG
cggggatccatagtcggtaa

SEQ ID NO: 59420 - DNA, 20 bp, Artificial Sequence
  Description of Artificial Sequence: Synthetic oligonucleotide
  Target: ATXN1; (-) strand; PAM type: NRG; PAM sequence: CGG
tgtatccggggatccatagt

SEQ ID NO: 59421 - DNA, 20 bp, Artificial Sequence
  Description of Artificial Sequence: Synthetic oligonucleotide
  Target: ATXN1; (-) strand; PAM type: NRG; PAM sequence: TAG
tcgctgtatccggggatcca

SEQ ID NO: 59422 - DNA, 20 bp, Artificial Sequence
  Description of Artificial Sequence: Synthetic oligonucleotide
  Target: ATXN1; (-) strand; PAM type: NRG; PAM sequence: GGG
tggccatctcgctgtatccg

SEQ ID NO: 59423 - DNA, 20 bp, Artificial Sequence
  Description of Artificial Sequence: Synthetic oligonucleotide
  Target: ATXN1; (-) strand; PAM type: NRG; PAM sequence: GGG
ctggccatctcgctgtatcc

SEQ ID NO: 59424 - DNA, 20 bp, Artificial Sequence
  Description of Artificial Sequence: Synthetic oligonucleotide
  Target: ATXN1; (-) strand; PAM type: NRG; PAM sequence: CGG
cctggccatctcgctgtatc

SEQ ID NO: 59425 - DNA, 20 bp, Artificial Sequence
  Description of Artificial Sequence: Synthetic oligonucleotide
  Target: ATXN1; (-) strand; PAM type: NRG; PAM sequence: TGG
gattagagtatagagtggcc

SEQ ID NO: 59426 - DNA, 20 bp, Artificial Sequence
  Description of Artificial Sequence: Synthetic oligonucleotide
  Target: ATXN1; (-) strand; PAM type: NRG; PAM sequence: TGG
tccttgattagagtatagag

SEQ ID NO: 59427 - DNA, 20 bp, Artificial Sequence
  Description of Artificial Sequence: Synthetic oligonucleotide
  Target: ATXN1; (-) strand; PAM type: NRG; PAM sequence: GAG
gtctccttgattagagtata

SEQ ID NO: 59428 - DNA, 20 bp, Artificial Sequence
  Description of Artificial Sequence: Synthetic oligonucleotide
  Target: ATXN1; (-) strand; PAM type: NRG; PAM sequence: TAG
cggtctccttgattagagta

SEQ ID NO: 59429 - DNA, 20 bp, Artificial Sequence
  Description of Artificial Sequence: Synthetic oligonucleotide
  Target: ATXN1; (-) strand; PAM type: NRG; PAM sequence: GAG
cctctcggtctccttgatta

SEQ ID NO: 59430 - DNA, 20 bp, Artificial Sequence
  Description of Artificial Sequence: Synthetic oligonucleotide
  Target: ATXN1; (-) strand; PAM type: NRG; PAM sequence: TAG
gccctctcggtctccttgat

SEQ ID NO: 59431 - DNA, 20 bp, Artificial Sequence
  Description of Artificial Sequence: Synthetic oligonucleotide
  Target: ATXN1; (-) strand; PAM type: NRG; PAM sequence: CGG
tagatgaatatttgccctct

SEQ ID NO: 59432 - DNA, 20 bp, Artificial Sequence
  Description of Artificial Sequence: Synthetic oligonucleotide
  Target: ATXN1; (-) strand; PAM type: NRG; PAM sequence: TAG
gcctctggttcccattctac

SEQ ID NO: 59433 - DNA, 20 bp, Artificial Sequence
  Description of Artificial Sequence: Synthetic oligonucleotide
  Target: ATXN1; (-) strand; PAM type: NRG; PAM sequence: TGG
ttgaaggctgtttctgcctc

SEQ ID NO: 59434 - DNA, 20 bp, Artificial Sequence
  Description of Artificial Sequence: Synthetic oligonucleotide
  Target: ATXN1; (-) strand; PAM type: NRG; PAM sequence: AGG
ggcctgctttaaggttttga

SEQ ID NO: 59435 - DNA, 20 bp, Artificial Sequence
  Description of Artificial Sequence: Synthetic oligonucleotide
  Target: ATXN1; (-) strand; PAM type: NRG; PAM sequence: AAG
gggcctgctttaaggttttg

SEQ ID NO: 59436 - DNA, 20 bp, Artificial Sequence
  Description of Artificial Sequence: Synthetic oligonucleotide
  Target: ATXN1; (-) strand; PAM type: NRG; PAM sequence: AGG
ttgtactagggcctgcttta

SEQ ID NO: 59437 - DNA, 20 bp, Artificial Sequence
  Description of Artificial Sequence: Synthetic oligonucleotide
  Target: ATXN1; (-) strand; PAM type: NRG; PAM sequence: AAG
tttgtactagggcctgcttt

SEQ ID NO: 59438 - DNA, 20 bp, Artificial Sequence
  Description of Artificial Sequence: Synthetic oligonucleotide
  Target: ATXN1; (-) strand; PAM type: NRG; PAM sequence: GGG
taagtcttgagtttgtacta

SEQ ID NO: 59439 - DNA, 20 bp, Artificial Sequence
  Description of Artificial Sequence: Synthetic oligonucleotide
  Target: ATXN1; (-) strand; PAM type: NRG; PAM sequence: AGG
ttaagtcttgagtttgtact

SEQ ID NO: 59440 - DNA, 20 bp, Artificial Sequence
  Description of Artificial Sequence: Synthetic oligonucleotide
  Target: ATXN1; (-) strand; PAM type: NRG; PAM sequence: TAG
cttaagtcttgagtttgtac

SEQ ID NO: 59441 - DNA, 20 bp, Artificial Sequence
  Description of Artificial Sequence: Synthetic oligonucleotide
  Target: ATXN1; (-) strand; PAM type: NRG; PAM sequence: GAG
ctggggaaggcttaagtctt

SEQ ID NO: 59442 - DNA, 20 bp, Artificial Sequence
  Description of Artificial Sequence: Synthetic oligonucleotide
  Target: ATXN1; (-) strand; PAM type: NRG; PAM sequence: AAG
ttttgtcctggggaaggctt

SEQ ID NO: 59443 - DNA, 20 bp, Artificial Sequence
  Description of Artificial Sequence: Synthetic oligonucleotide
  Target: ATXN1; (-) strand; PAM type: NRG; PAM sequence: AGG
gagaagttttgtcctgggga

SEQ ID NO: 59444 - DNA, 20 bp, Artificial Sequence
  Description of Artificial Sequence: Synthetic oligonucleotide
  Target: ATXN1; (-) strand; PAM type: NRG; PAM sequence: AAG
agagaagttttgtcctgggg

SEQ ID NO: 59445 - DNA, 20 bp, Artificial Sequence
  Description of Artificial Sequence: Synthetic oligonucleotide
  Target: ATXN1; (-) strand; PAM type: NRG; PAM sequence: GGG
taaagagaagttttgtcctg

SEQ ID NO: 59446 - DNA, 20 bp, Artificial Sequence
  Description of Artificial Sequence: Synthetic oligonucleotide
  Target: ATXN1; (-) strand; PAM type: NRG; PAM sequence: GGG
ataaagagaagttttgtcct

SEQ ID NO: 59447 - DNA, 20 bp, Artificial Sequence
  Description of Artificial Sequence: Synthetic oligonucleotide
  Target: ATXN1; (-) strand; PAM type: NRG; PAM sequence: TGG
tataaagagaagttttgtcc

SEQ ID NO: 59448 - DNA, 20 bp, Artificial Sequence
  Description of Artificial Sequence: Synthetic oligonucleotide
  Target: ATXN1; (-) strand; PAM type: NRG; PAM sequence: AAG
tctctgtgaggtataaagag

SEQ ID NO: 59449 - DNA, 20 bp, Artificial Sequence
  Description of Artificial Sequence: Synthetic oligonucleotide
  Target: ATXN1; (-) strand; PAM type: NRG; PAM sequence: GAG
ctctctctgtgaggtataaa

SEQ ID NO: 59450 - DNA, 20 bp, Artificial Sequence
  Description of Artificial Sequence: Synthetic oligonucleotide
  Target: ATXN1; (-) strand; PAM type: NRG; PAM sequence: AAG
cgctctctctgtgaggtata

SEQ ID NO: 59451 - DNA, 20 bp, Artificial Sequence
  Description of Artificial Sequence: Synthetic oligonucleotide
  Target: ATXN1; (-) strand; PAM type: NRG; PAM sequence: AGG
ctattcccgctctctctgtg

SEQ ID NO: 59452 - DNA, 20 bp, Artificial Sequence
  Description of Artificial Sequence: Synthetic oligonucleotide
  Target: ATXN1; (-) strand; PAM type: NRG; PAM sequence: GAG
gctattcccgctctctctgt

SEQ ID NO: 59453 - DNA, 20 bp, Artificial Sequence
  Description of Artificial Sequence: Synthetic oligonucleotide
  Target: ATXN1; (-) strand; PAM type: NRG; PAM sequence: GAG
agtctgagtaaggactccaa

SEQ ID NO: 59454 - DNA, 20 bp, Artificial Sequence
  Description of Artificial Sequence: Synthetic oligonucleotide
  Target: ATXN1; (-) strand; PAM type: NRG; PAM sequence: AAG
caagtctgagtaaggactcc

SEQ ID NO: 59455 - DNA, 20 bp, Artificial Sequence
  Description of Artificial Sequence: Synthetic oligonucleotide
  Target: ATXN1; (-) strand; PAM type: NRG; PAM sequence: AGG
ttgtcctacaagtctgagta

SEQ ID NO: 59456 - DNA, 20 bp, Artificial Sequence
  Description of Artificial Sequence: Synthetic oligonucleotide
  Target: ATXN1; (-) strand; PAM type: NRG; PAM sequence: AAG
gttgtcctacaagtctgagt

SEQ ID NO: 59457 - DNA, 20 bp, Artificial Sequence
  Description of Artificial Sequence: Synthetic oligonucleotide
  Target: ATXN1; (-) strand; PAM type: NRG; PAM sequence: GAG
tggggttgtcctacaagtct

SEQ ID NO: 59458 - DNA, 20 bp, Artificial Sequence
  Description of Artificial Sequence: Synthetic oligonucleotide
  Target: ATXN1; (-) strand; PAM type: NRG; PAM sequence: AAG
tggttgtggggttgtcctac

SEQ ID NO: 59459 - DNA, 20 bp, Artificial Sequence
  Description of Artificial Sequence: Synthetic oligonucleotide
  Target: ATXN1; (-) strand; PAM type: NRG; PAM sequence: GGG
ttccttccttactggttgtg

SEQ ID NO: 59460 - DNA, 20 bp, Artificial Sequence
  Description of Artificial Sequence: Synthetic oligonucleotide
  Target: ATXN1; (-) strand; PAM type: NRG; PAM sequence: GGG
gttccttccttactggttgt

SEQ ID NO: 59461 - DNA, 20 bp, Artificial Sequence
  Description of Artificial Sequence: Synthetic oligonucleotide
  Target: ATXN1; (-) strand; PAM type: NRG; PAM sequence: TGG
ggttccttccttactggttg

SEQ ID NO: 59462 - DNA, 20 bp, Artificial Sequence
  Description of Artificial Sequence: Synthetic oligonucleotide
  Target: ATXN1; (-) strand; PAM type: NRG; PAM sequence: TGG
ttgtggggttccttccttac

SEQ ID NO: 59463 - DNA, 20 bp, Artificial Sequence
  Description of Artificial Sequence: Synthetic oligonucleotide
  Target: ATXN1; (-) strand; PAM type: NRG; PAM sequence: GGG
atttccttacttaggttgtg

SEQ ID NO: 59464 - DNA, 20 bp, Artificial Sequence
  Description of Artificial Sequence: Synthetic oligonucleotide
  Target: ATXN1; (-) strand; PAM type: NRG; PAM sequence: GGG
aatttccttacttaggttgt

SEQ ID NO: 59465 - DNA, 20 bp, Artificial Sequence
  Description of Artificial Sequence: Synthetic oligonucleotide
  Target: ATXN1; (-) strand; PAM type: NRG; PAM sequence: TGG
caatttccttacttaggttg

SEQ ID NO: 59466 - DNA, 20 bp, Artificial Sequence
  Description of Artificial Sequence: Synthetic oligonucleotide
  Target: ATXN1; (-) strand; PAM type: NRG; PAM sequence: AGG
ctacatcaatttccttactt

SEQ ID NO: 59467 - DNA, 20 bp, Artificial Sequence
  Description of Artificial Sequence: Synthetic oligonucleotide
  Target: ATXN1; (-) strand; PAM type: NRG; PAM sequence: TAG
actacatcaatttccttact

SEQ ID NO: 59468 - DNA, 20 bp, Artificial Sequence
  Description of Artificial Sequence: Synthetic oligonucleotide
  Target: ATXN1; (-) strand; PAM type: NRG; PAM sequence: CAG
ctacccgtaaacagtgaggc

SEQ ID NO: 59469 - DNA, 20 bp, Artificial Sequence
  Description of Artificial Sequence: Synthetic oligonucleotide
  Target: ATXN1; (-) strand; PAM type: NRG; PAM sequence: AGG
acaactacccgtaaacagtg

SEQ ID NO: 59470 - DNA, 20 bp, Artificial Sequence
  Description of Artificial Sequence: Synthetic oligonucleotide
  Target: ATXN1; (-) strand; PAM type: NRG; PAM sequence: GAG
cacaactacccgtaaacagt

SEQ ID NO: 59471 - DNA, 20 bp, Artificial Sequence
  Description of Artificial Sequence: Synthetic oligonucleotide
  Target: ATXN1; (-) strand; PAM type: NRG; PAM sequence: CAG
ctgccacaactacccgtaaa

SEQ ID NO: 59472 - DNA, 20 bp, Artificial Sequence
  Description of Artificial Sequence: Synthetic oligonucleotide
  Target: ATXN1; (-) strand; PAM type: NRG; PAM sequence: TAG
gatagcctctgacactaaga

SEQ ID NO: 59473 - DNA, 20 bp, Artificial Sequence
  Description of Artificial Sequence: Synthetic oligonucleotide
  Target: ATXN1; (-) strand; PAM type: NRG; PAM sequence: AAG
ttttgatagcctctgacact

SEQ ID NO: 59474 - DNA, 20 bp, Artificial Sequence
  Description of Artificial Sequence: Synthetic oligonucleotide
  Target: ATXN1; (-) strand; PAM type: NRG; PAM sequence: TAG
ctttccttgtattattttga

SEQ ID NO: 59475 - DNA, 20 bp, Artificial Sequence
  Description of Artificial Sequence: Synthetic oligonucleotide
  Target: ATXN1; (-) strand; PAM type: NRG; PAM sequence: GAG
tcatgagtagtctagatggt

SEQ ID NO: 59476 - DNA, 20 bp, Artificial Sequence
  Description of Artificial Sequence: Synthetic oligonucleotide
  Target: ATXN1; (-) strand; PAM type: NRG; PAM sequence: TGG
tacatcatgagtagtctaga

SEQ ID NO: 59477 - DNA, 20 bp, Artificial Sequence
  Description of Artificial Sequence: Synthetic oligonucleotide
  Target: ATXN1; (-) strand; PAM type: NRG; PAM sequence: TAG
catttacatcatgagtagtc

SEQ ID NO: 59478 - DNA, 20 bp, Artificial Sequence
  Description of Artificial Sequence: Synthetic oligonucleotide
  Target: ATXN1; (-) strand; PAM type: NRG; PAM sequence: TAG
tatgccatttacatcatgag

SEQ ID NO: 59479 - DNA, 20 bp, Artificial Sequence
  Description of Artificial Sequence: Synthetic oligonucleotide
  Target: ATXN1; (-) strand; PAM type: NRG; PAM sequence: GAG
tggtatgccatttacatcat

SEQ ID NO: 59480 - DNA, 20 bp, Artificial Sequence
  Description of Artificial Sequence: Synthetic oligonucleotide
  Target: ATXN1; (-) strand; PAM type: NRG; PAM sequence: TGG
cataaatttcctttggcacc

SEQ ID NO: 59481 - DNA, 20 bp, Artificial Sequence
  Description of Artificial Sequence: Synthetic oligonucleotide
  Target: ATXN1; (-) strand; PAM type: NRG; PAM sequence: TGG
tgatagccataaatttcctt

SEQ ID NO: 59482 - DNA, 20 bp, Artificial Sequence
  Description of Artificial Sequence: Synthetic oligonucleotide
  Target: ATXN1; (-) strand; PAM type: NRG; PAM sequence: TAG
ctgagtaggtggttttctga

SEQ ID NO: 59483 - DNA, 20 bp, Artificial Sequence
  Description of Artificial Sequence: Synthetic oligonucleotide
  Target: ATXN1; (-) strand; PAM type: NRG; PAM sequence: TGG
gcgcctggtacctgagtagg

SEQ ID NO: 59484 - DNA, 20 bp, Artificial Sequence
  Description of Artificial Sequence: Synthetic oligonucleotide
  Target: ATXN1; (-) strand; PAM type: NRG; PAM sequence: AGG
gtagcgcctggtacctgagt

SEQ ID NO: 59485 - DNA, 20 bp, Artificial Sequence
  Description of Artificial Sequence: Synthetic oligonucleotide
  Target: ATXN1; (-) strand; PAM type: NRG; PAM sequence: TAG
agtagcgcctggtacctgag

SEQ ID NO: 59486 - DNA, 20 bp, Artificial Sequence
  Description of Artificial Sequence: Synthetic oligonucleotide
  Target: ATXN1; (-) strand; PAM type: NRG; PAM sequence: GAG
atgagtagcgcctggtacct

SEQ ID NO: 59487 - DNA, 20 bp, Artificial Sequence
  Description of Artificial Sequence: Synthetic oligonucleotide
  Target: ATXN1; (-) strand; PAM type: NRG; PAM sequence: TGG
gtccctgaatgagtagcgcc

SEQ ID NO: 59488 - DNA, 20 bp, Artificial Sequence
  Description of Artificial Sequence: Synthetic oligonucleotide
  Target: ATXN1; (-) strand; PAM type: NRG; PAM sequence: TAG
agcaccagtccctgaatgag

SEQ ID NO: 59489 - DNA, 20 bp, Artificial Sequence
  Description of Artificial Sequence: Synthetic oligonucleotide
  Target: ATXN1; (-) strand; PAM type: NRG; PAM sequence: GAG
tcaagcaccagtccctgaat

SEQ ID NO: 59490 - DNA, 20 bp, Artificial Sequence
  Description of Artificial Sequence: Synthetic oligonucleotide
  Target: ATXN1; (-) strand; PAM type: NRG; PAM sequence: CAG
cacgtgtgtatttcaagcac

SEQ ID NO: 59491 - DNA, 20 bp, Artificial Sequence
  Description of Artificial Sequence: Synthetic oligonucleotide
  Target: ATXN1; (-) strand; PAM type: NRG; PAM sequence: AAG
gctgcacacgtgtgtatttc

SEQ ID NO: 59492 - DNA, 20 bp, Artificial Sequence
  Description of Artificial Sequence: Synthetic oligonucleotide
  Target: ATXN1; (-) strand; PAM type: NRG; PAM sequence: GGG
gagaaaagtagcagggttga

SEQ ID NO: 59493 - DNA, 20 bp, Artificial Sequence
  Description of Artificial Sequence: Synthetic oligonucleotide
  Target: ATXN1; (-) strand; PAM type: NRG; PAM sequence: AGG
ggagaaaagtagcagggttg

SEQ ID NO: 59494 - DNA, 20 bp, Artificial Sequence
  Description of Artificial Sequence: Synthetic oligonucleotide
  Target: ATXN1; (-) strand; PAM type: NRG; PAM sequence: GAG
gggagaaaagtagcagggtt

SEQ ID NO: 59495 - DNA, 20 bp, Artificial Sequence
  Description of Artificial Sequence: Synthetic oligonucleotide
  Target: ATXN1; (-) strand; PAM type: NRG; PAM sequence: GGG
cctctgggagaaaagtagca

SEQ ID NO: 59496 - DNA, 20 bp, Artificial Sequence
  Description of Artificial Sequence: Synthetic oligonucleotide
  Target: ATXN1; (-) strand; PAM type: NRG; PAM sequence: AGG
tcctctgggagaaaagtagc

SEQ ID NO: 59497 - DNA, 20 bp, Artificial Sequence
  Description of Artificial Sequence: Synthetic oligonucleotide
  Target: ATXN1; (-) strand; PAM type: NRG; PAM sequence: CAG
atcctctgggagaaaagtag

SEQ ID NO: 59498 - DNA, 20 bp, Artificial Sequence
  Description of Artificial Sequence: Synthetic oligonucleotide
  Target: ATXN1; (-) strand; PAM type: NRG; PAM sequence: TAG
tccatcctctgggagaaaag

SEQ ID NO: 59499 - DNA, 20 bp, Artificial Sequence
  Description of Artificial Sequence: Synthetic oligonucleotide
  Target: ATXN1; (-) strand; PAM type: NRG; PAM sequence: AAG
ttctccatcctctgggagaa

SEQ ID NO: 59500 - DNA, 20 bp, Artificial Sequence
  Description of Artificial Sequence: Synthetic oligonucleotide
  Target: ATXN1; (-) strand; PAM type: NRG; PAM sequence: GAG
attggttctccatcctctgg

SEQ ID NO: 59501 - DNA, 20 bp, Artificial Sequence
  Description of Artificial Sequence: Synthetic oligonucleotide
  Target: ATXN1; (-) strand; PAM type: NRG; PAM sequence: GGG
cgattggttctccatcctct

SEQ ID NO: 59502 - DNA, 20 bp, Artificial Sequence
  Description of Artificial Sequence: Synthetic oligonucleotide
  Target: ATXN1; (-) strand; PAM type: NRG; PAM sequence: TGG
tcgattggttctccatcctc

SEQ ID NO: 59503 - DNA, 20 bp, Artificial Sequence
  Description of Artificial Sequence: Synthetic oligonucleotide
  Target: ATXN1; (-) strand; PAM type: NRG; PAM sequence: TGG
tgttggcagtcatactcgat

SEQ ID NO: 59504 - DNA, 20 bp, Artificial Sequence
  Description of Artificial Sequence: Synthetic oligonucleotide
  Target: ATXN1; (-) strand; PAM type: NRG; PAM sequence: CAG
tctgggctacaatttgttgg

SEQ ID NO: 59505 - DNA, 20 bp, Artificial Sequence
  Description of Artificial Sequence: Synthetic oligonucleotide
  Target: ATXN1; (-) strand; PAM type: NRG; PAM sequence: TGG
aagtctgggctacaatttgt

SEQ ID NO: 59506 - DNA, 20 bp, Artificial Sequence
  Description of Artificial Sequence: Synthetic oligonucleotide
  Target: ATXN1; (-) strand; PAM type: NRG; PAM sequence: GGG
ctgttgggaagcataagtct

SEQ ID NO: 59507 - DNA, 20 bp, Artificial Sequence
  Description of Artificial Sequence: Synthetic oligonucleotide
  Target: ATXN1; (-) strand; PAM type: NRG; PAM sequence: TGG
cctgttgggaagcataagtc

SEQ ID NO: 59508 - DNA, 20 bp, Artificial Sequence
  Description of Artificial Sequence: Synthetic oligonucleotide
  Target: ATXN1; (-) strand; PAM type: NRG; PAM sequence: AAG
gagatcctgttgggaagcat

SEQ ID NO: 59509 - DNA, 20 bp, Artificial Sequence
  Description of Artificial Sequence: Synthetic oligonucleotide
  Target: ATXN1; (-) strand; PAM type: NRG; PAM sequence: AAG
ttctaagagatcctgttggg

SEQ ID NO: 59510 - DNA, 20 bp, Artificial Sequence
  Description of Artificial Sequence: Synthetic oligonucleotide
  Target: ATXN1; (-) strand; PAM type: NRG; PAM sequence: GGG
tacttctaagagatcctgtt

SEQ ID NO: 59511 - DNA, 20 bp, Artificial Sequence
  Description of Artificial Sequence: Synthetic oligonucleotide
  Target: ATXN1; (-) strand; PAM type: NRG; PAM sequence: TGG
gtacttctaagagatcctgt

SEQ ID NO: 59512 - DNA, 20 bp, Artificial Sequence
  Description of Artificial Sequence: Synthetic oligonucleotide
  Target: ATXN1; (-) strand; PAM type: NRG; PAM sequence: GAG
ttagctaagggtacttctaa

SEQ ID NO: 59513 - DNA, 20 bp, Artificial Sequence
  Description of Artificial Sequence: Synthetic oligonucleotide
  Target: ATXN1; (-) strand; PAM type: NRG; PAM sequence: AAG
gattagctaagggtacttct

SEQ ID NO: 59514 - DNA, 20 bp, Artificial Sequence
  Description of Artificial Sequence: Synthetic oligonucleotide
  Target: ATXN1; (-) strand; PAM type: NRG; PAM sequence: GGG
ttaaggtcaggattagctaa

SEQ ID NO: 59515 - DNA, 20 bp, Artificial Sequence
  Description of Artificial Sequence: Synthetic oligonucleotide
  Target: ATXN1; (-) strand; PAM type: NRG; PAM sequence: AGG
gttaaggtcaggattagcta

SEQ ID NO: 59516 - DNA, 20 bp, Artificial Sequence
  Description of Artificial Sequence: Synthetic oligonucleotide
  Target: ATXN1; (-) strand; PAM type: NRG; PAM sequence: AAG
ggttaaggtcaggattagct

SEQ ID NO: 59517 - DNA, 20 bp, Artificial Sequence
  Description of Artificial Sequence: Synthetic oligonucleotide
  Target: ATXN1; (-) strand; PAM type: NRG; PAM sequence: TAG
atataggttaaggtcaggat

SEQ ID NO: 59518 - DNA, 20 bp, Artificial Sequence
  Description of Artificial Sequence: Synthetic oligonucleotide
  Target: ATXN1; (-) strand; PAM type: NRG; PAM sequence: AGG
tcggtatataggttaaggtc

SEQ ID NO: 59519 - DNA, 20 bp, Artificial Sequence
  Description of Artificial Sequence: Synthetic oligonucleotide
  Target: ATXN1; (-) strand; PAM type: NRG; PAM sequence: CAG
atcggtatataggttaaggt

SEQ ID NO: 59520 - DNA, 20 bp, Artificial Sequence
  Description of Artificial Sequence: Synthetic oligonucleotide
  Target: ATXN1; (-) strand; PAM type: NRG; PAM sequence: AGG
ttccatcggtatataggtta

SEQ ID NO: 59521 - DNA, 20 bp, Artificial Sequence
  Description of Artificial Sequence: Synthetic oligonucleotide
  Target: ATXN1; (-) strand; PAM type: NRG; PAM sequence: AAG
cttccatcggtatataggtt

SEQ ID NO: 59522 - DNA, 20 bp, Artificial Sequence
  Description of Artificial Sequence: Synthetic oligonucleotide
  Target: ATXN1; (-) strand; PAM type: NRG; PAM sequence: AGG
atgaacttccatcggtatat

SEQ ID NO: 59523 - DNA, 20 bp, Artificial Sequence
  Description of Artificial Sequence: Synthetic oligonucleotide
  Target: ATXN1; (-) strand; PAM type: NRG; PAM sequence: TAG
aatgaacttccatcggtata

SEQ ID NO: 59524 - DNA, 20 bp, Artificial Sequence
  Description of Artificial Sequence: Synthetic oligonucleotide
  Target: ATXN1; (-) strand; PAM type: NRG; PAM sequence: CGG
ctccacaaatgaacttccat

SEQ ID NO: 59525 - DNA, 20 bp, Artificial Sequence
  Description of Artificial Sequence: Synthetic oligonucleotide
  Target: ATXN1; (-) strand; PAM type: NRG; PAM sequence: TGG
tactgttacatcactaacta

SEQ ID NO: 59526 - DNA, 20 bp, Artificial Sequence
  Description of Artificial Sequence: Synthetic oligonucleotide
  Target: ATXN1; (-) strand; PAM type: NRG; PAM sequence: AAG
gggggaagagacttactttc

SEQ ID NO: 59527 - DNA, 20 bp, Artificial Sequence
  Description of Artificial Sequence: Synthetic oligonucleotide
  Target: ATXN1; (-) strand; PAM type: NRG; PAM sequence: GAG
gcgctggtccgtggggggaa

SEQ ID NO: 59528 - DNA, 20 bp, Artificial Sequence
  Description of Artificial Sequence: Synthetic oligonucleotide
  Target: ATXN1; (-) strand; PAM type: NRG; PAM sequence: AAG
aggcgctggtccgtgggggg

SEQ ID NO: 59529 - DNA, 20 bp, Artificial Sequence
  Description of Artificial Sequence: Synthetic oligonucleotide
  Target: ATXN1; (-) strand; PAM type: NRG; PAM sequence: GGG
actaggcgctggtccgtggg

SEQ ID NO: 59530 - DNA, 20 bp, Artificial Sequence
  Description of Artificial Sequence: Synthetic oligonucleotide
  Target: ATXN1; (-) strand; PAM type: NRG; PAM sequence: GGG
aactaggcgctggtccgtgg

SEQ ID NO: 59531 - DNA, 20 bp, Artificial Sequence
  Description of Artificial Sequence: Synthetic oligonucleotide
  Target: ATXN1; (-) strand; PAM type: NRG; PAM sequence: GGG
taactaggcgctggtccgtg

SEQ ID NO: 59532 - DNA, 20 bp, Artificial Sequence
  Description of Artificial Sequence: Synthetic oligonucleotide
  Target: ATXN1; (-) strand; PAM type: NRG; PAM sequence: GGG
ctaactaggcgctggtccgt

SEQ ID NO: 59533 - DNA, 20 bp, Artificial Sequence
  Description of Artificial Sequence: Synthetic oligonucleotide
  Target: ATXN1; (-) strand; PAM type: NRG; PAM sequence: TGG
gctaactaggcgctggtccg

SEQ ID NO: 59534 - DNA, 20 bp, Artificial Sequence
  Description of Artificial Sequence: Synthetic oligonucleotide
  Target: ATXN1; (-) strand; PAM type: NRG; PAM sequence: TGG
aagttctgctaactaggcgc

SEQ ID NO: 59535 - DNA, 20 bp, Artificial Sequence
  Description of Artificial Sequence: Synthetic oligonucleotide
  Target: ATXN1; (-) strand; PAM type: NRG; PAM sequence: AGG
ttgggtaagttctgctaact

SEQ ID NO: 59536 - DNA, 20 bp, Artificial Sequence
  Description of Artificial Sequence: Synthetic oligonucleotide
  Target: ATXN1; (-) strand; PAM type: NRG; PAM sequence: TAG
cttgggtaagttctgctaac

SEQ ID NO: 59537 - DNA, 20 bp, Artificial Sequence
  Description of Artificial Sequence: Synthetic oligonucleotide
  Target: ATXN1; (-) strand; PAM type: NRG; PAM sequence: AAG
cccggttctaaggcttgggt

SEQ ID NO: 59538 - DNA, 20 bp, Artificial Sequence
  Description of Artificial Sequence: Synthetic oligonucleotide
  Target: ATXN1; (-) strand; PAM type: NRG; PAM sequence: GGG
ctttcccggttctaaggctt

SEQ ID NO: 59539 - DNA, 20 bp, Artificial Sequence
  Description of Artificial Sequence: Synthetic oligonucleotide
  Target: ATXN1; (-) strand; PAM type: NRG; PAM sequence: TGG
cctttcccggttctaaggct

SEQ ID NO: 59540 - DNA, 20 bp, Artificial Sequence
  Description of Artificial Sequence: Synthetic oligonucleotide
  Target: ATXN1; (-) strand; PAM type: NRG; PAM sequence: AGG
tttttcctttcccggttcta

SEQ ID NO: 59541 - DNA, 20 bp, Artificial Sequence
  Description of Artificial Sequence: Synthetic oligonucleotide
  Target: ATXN1; (-) strand; PAM type: NRG; PAM sequence: AAG
ttttttcctttcccggttct

SEQ ID NO: 59542 - DNA, 20 bp, Artificial Sequence
  Description of Artificial Sequence: Synthetic oligonucleotide
  Target: ATXN1; (-) strand; PAM type: NRG; PAM sequence: CGG
tttattcttttttcctttcc

SEQ ID NO: 59543 - DNA, 20 bp, Artificial Sequence
  Description of Artificial Sequence: Synthetic oligonucleotide
  Target: ATXN1; (-) strand; PAM type: NRG; PAM sequence: AAG
atgggcatgtaggattagat

SEQ ID NO: 59544 - DNA, 20 bp, Artificial Sequence
  Description of Artificial Sequence: Synthetic oligonucleotide
  Target: ATXN1; (-) strand; PAM type: NRG; PAM sequence: TAG
gcagcatgggcatgtaggat

SEQ ID NO: 59545 - DNA, 20 bp, Artificial Sequence
  Description of Artificial Sequence: Synthetic oligonucleotide
  Target: ATXN1; (-) strand; PAM type: NRG; PAM sequence: AGG
atattgcagcatgggcatgt

SEQ ID NO: 59546 - DNA, 20 bp, Artificial Sequence
  Description of Artificial Sequence: Synthetic oligonucleotide
  Target: ATXN1; (-) strand; PAM type: NRG; PAM sequence: TAG
catattgcagcatgggcatg

SEQ ID NO: 59547 - DNA, 20 bp, Artificial Sequence
  Description of Artificial Sequence: Synthetic oligonucleotide
  Target: ATXN1; (-) strand; PAM type: NRG; PAM sequence: GGG
ttctttccatattgcagcat

SEQ ID NO: 59548 - DNA, 20 bp, Artificial Sequence
  Description of Artificial Sequence: Synthetic oligonucleotide
  Target: ATXN1; (-) strand; PAM type: NRG; PAM sequence: TGG
tttctttccatattgcagca

SEQ ID NO: 59549 - DNA, 20 bp, Artificial Sequence
  Description of Artificial Sequence: Synthetic oligonucleotide
  Target: ATXN1; (-) strand; PAM type: NRG; PAM sequence: CAG
ctccctttctttccatattg

SEQ ID NO: 59550 - DNA, 20 bp, Artificial Sequence
  Description of Artificial Sequence: Synthetic oligonucleotide
  Target: ATXN1; (-) strand; PAM type: NRG; PAM sequence: AGG
tgggggttcccccagaggtt

SEQ ID NO: 59551 - DNA, 20 bp, Artificial Sequence
  Description of Artificial Sequence: Synthetic oligonucleotide
  Target: ATXN1; (-) strand; PAM type: NRG; PAM sequence: TAG
atgggggttcccccagaggt

SEQ ID NO: 59552 - DNA, 20 bp, Artificial Sequence
  Description of Artificial Sequence: Synthetic oligonucleotide
  Target: ATXN1; (-) strand; PAM type: NRG; PAM sequence: AGG
tttaatgggggttcccccag

SEQ ID NO: 59553 - DNA, 20 bp, Artificial Sequence
  Description of Artificial Sequence: Synthetic oligonucleotide
  Target: ATXN1; (-) strand; PAM type: NRG; PAM sequence: GAG
atttaatgggggttccccca

SEQ ID NO: 59554 - DNA, 20 bp, Artificial Sequence
  Description of Artificial Sequence: Synthetic oligonucleotide
  Target: ATXN1; (-) strand; PAM type: NRG; PAM sequence: CAG
gtatttaatgggggttcccc

SEQ ID NO: 59555 - DNA, 20 bp, Artificial Sequence
  Description of Artificial Sequence: Synthetic oligonucleotide
  Target: ATXN1; (-) strand; PAM type: NRG; PAM sequence: GGG
ttccttgtggtatttaatgg

SEQ ID NO: 59556 - DNA, 20 bp, Artificial Sequence
  Description of Artificial Sequence: Synthetic oligonucleotide
  Target: ATXN1; (-) strand; PAM type: NRG; PAM sequence: GGG
tttccttgtggtatttaatg

SEQ ID NO: 59557 - DNA, 20 bp, Artificial Sequence
  Description of Artificial Sequence: Synthetic oligonucleotide
  Target: ATXN1; (-) strand; PAM type: NRG; PAM sequence: GGG
atttccttgtggtatttaat

SEQ ID NO: 59558 - DNA, 20 bp, Artificial Sequence
  Description of Artificial Sequence: Synthetic oligonucleotide
  Target: ATXN1; (-) strand; PAM type: NRG; PAM sequence: TGG
aatttccttgtggtatttaa

SEQ ID NO: 59559 - DNA, 20 bp, Artificial Sequence
  Description of Artificial Sequence: Synthetic oligonucleotide
  Target: ATXN1; (-) strand; PAM type: NRG; PAM sequence: TGG
ataactccataatttccttg

SEQ ID NO: 59560 - DNA, 20 bp, Artificial Sequence
  Description of Artificial Sequence: Synthetic oligonucleotide
  Target: ATXN1; (-) strand; PAM type: NRG; PAM sequence: GGG
tgtaacactgccacctcctt

SEQ ID NO: 59561 - DNA, 20 bp, Artificial Sequence
  Description of Artificial Sequence: Synthetic oligonucleotide
  Target: ATXN1; (-) strand; PAM type: NRG; PAM sequence: TGG
gtgtaacactgccacctcct

SEQ ID NO: 59562 - DNA, 20 bp, Artificial Sequence
  Description of Artificial Sequence: Synthetic oligonucleotide
  Target: ATXN1; (-) strand; PAM type: NRG; PAM sequence: CAG
cacctttttgatggcttcag

SEQ ID NO: 59563 - DNA, 20 bp, Artificial Sequence
  Description of Artificial Sequence: Synthetic oligonucleotide
  Target: ATXN1; (-) strand; PAM type: NRG; PAM sequence: CAG
cttcacctttttgatggctt

SEQ ID NO: 59564 - DNA, 20 bp, Artificial Sequence
  Description of Artificial Sequence: Synthetic oligonucleotide
  Target: ATXN1; (-) strand; PAM type: NRG; PAM sequence: TGG
tttctccttcacctttttga

SEQ ID NO: 59565 - DNA, 20 bp, Artificial Sequence
  Description of Artificial Sequence: Synthetic oligonucleotide
  Target: ATXN1; (-) strand; PAM type: NRG; PAM sequence: TGG
tggcctcagcatctgcccag

SEQ ID NO: 59566 - DNA, 20 bp, Artificial Sequence
  Description of Artificial Sequence: Synthetic oligonucleotide
  Target: ATXN1; (-) strand; PAM type: NRG; PAM sequence: CAG
ttttggcctcagcatctgcc

SEQ ID NO: 59567 - DNA, 20 bp, Artificial Sequence
  Description of Artificial Sequence: Synthetic oligonucleotide
  Target: ATXN1; (-) strand; PAM type: NRG; PAM sequence: CAG
cctggcagcaattttggcct

SEQ ID NO: 59568 - DNA, 20 bp, Artificial Sequence
  Description of Artificial Sequence: Synthetic oligonucleotide
  Target: ATXN1; (-) strand; PAM type: NRG; PAM sequence: TGG
gttctgcctggcagcaattt

SEQ ID NO: 59569 - DNA, 20 bp, Artificial Sequence
  Description of Artificial Sequence: Synthetic oligonucleotide
  Target: ATXN1; (-) strand; PAM type: NRG; PAM sequence: CAG
taatgggaggttctgcctgg

SEQ ID NO: 59570 - DNA, 20 bp, Artificial Sequence
  Description of Artificial Sequence: Synthetic oligonucleotide
  Target: ATXN1; (-) strand; PAM type: NRG; PAM sequence: TGG
ttctaatgggaggttctgcc

SEQ ID NO: 59571 - DNA, 20 bp, Artificial Sequence
  Description of Artificial Sequence: Synthetic oligonucleotide
  Target: ATXN1; (-) strand; PAM type: NRG; PAM sequence: AGG
ccataggtatttctaatggg

SEQ ID NO: 59572 - DNA, 20 bp, Artificial Sequence
  Description of Artificial Sequence: Synthetic oligonucleotide
  Target: ATXN1; (-) strand; PAM type: NRG; PAM sequence: GAG
tccataggtatttctaatgg

SEQ ID NO: 59573 - DNA, 20 bp, Artificial Sequence
  Description of Artificial Sequence: Synthetic oligonucleotide
  Target: ATXN1; (-) strand; PAM type: NRG; PAM sequence: GGG
cttccataggtatttctaat

SEQ ID NO: 59574 - DNA, 20 bp, Artificial Sequence
  Description of Artificial Sequence: Synthetic oligonucleotide
  Target: ATXN1; (-) strand; PAM type: NRG; PAM sequence: TGG
ccttccataggtatttctaa

SEQ ID NO: 59575 - DNA, 20 bp, Artificial Sequence
  Description of Artificial Sequence: Synthetic oligonucleotide
  Target: ATXN1; (-) strand; PAM type: NRG; PAM sequence: AGG
cataccatgggtccttccat

SEQ ID NO: 59576 - DNA, 20 bp, Artificial Sequence
  Description of Artificial Sequence: Synthetic oligonucleotide
  Target: ATXN1; (-) strand; PAM type: NRG; PAM sequence: TAG
ccataccatgggtccttcca

SEQ ID NO: 59577 - DNA, 20 bp, Artificial Sequence
  Description of Artificial Sequence: Synthetic oligonucleotide
  Target: ATXN1; (-) strand; PAM type: NRG; PAM sequence: GGG
agggggttgttccataccat

SEQ ID NO: 59578 - DNA, 20 bp, Artificial Sequence
  Description of Artificial Sequence: Synthetic oligonucleotide
  Target: ATXN1; (-) strand; PAM type: NRG; PAM sequence: TGG
gagggggttgttccatacca

SEQ ID NO: 59579 - DNA, 20 bp, Artificial Sequence
  Description of Artificial Sequence: Synthetic oligonucleotide
  Target: ATXN1; (-) strand; PAM type: NRG; PAM sequence: GGG
ggggcttaatctcttggagg

SEQ ID NO: 59580 - DNA, 20 bp, Artificial Sequence
  Description of Artificial Sequence: Synthetic oligonucleotide
  Target: ATXN1; (-) strand; PAM type: NRG; PAM sequence: GGG
tggggcttaatctcttggag

SEQ ID NO: 59581 - DNA, 20 bp, Artificial Sequence
  Description of Artificial Sequence: Synthetic oligonucleotide
  Target: ATXN1; (-) strand; PAM type: NRG; PAM sequence: GGG
ctggggcttaatctcttgga

SEQ ID NO: 59582 - DNA, 20 bp, Artificial Sequence
  Description of Artificial Sequence: Synthetic oligonucleotide
  Target: ATXN1; (-) strand; PAM type: NRG; PAM sequence: AGG
actggggcttaatctcttgg

SEQ ID NO: 59583 - DNA, 20 bp, Artificial Sequence
  Description of Artificial Sequence: Synthetic oligonucleotide
  Target: ATXN1; (-) strand; PAM type: NRG; PAM sequence: GAG
tactggggcttaatctcttg

SEQ ID NO: 59584 - DNA, 20 bp, Artificial Sequence
  Description of Artificial Sequence: Synthetic oligonucleotide
  Target: ATXN1; (-) strand; PAM type: NRG; PAM sequence: TGG
agtactggggcttaatctct

SEQ ID NO: 59585 - DNA, 20 bp, Artificial Sequence
  Description of Artificial Sequence: Synthetic oligonucleotide
  Target: ATXN1; (-) strand; PAM type: NRG; PAM sequence: GGG
gtttcgatcagggagtactg

SEQ ID NO: 59586 - DNA, 20 bp, Artificial Sequence
  Description of Artificial Sequence: Synthetic oligonucleotide
  Target: ATXN1; (-) strand; PAM type: NRG; PAM sequence: GGG
tgtttcgatcagggagtact

SEQ ID NO: 59587 - DNA, 20 bp, Artificial Sequence
  Description of Artificial Sequence: Synthetic oligonucleotide
  Target: ATXN1; (-) strand; PAM type: NRG; PAM sequence: TGG
ctgtttcgatcagggagtac

SEQ ID NO: 59588 - DNA, 20 bp, Artificial Sequence
  Description of Artificial Sequence: Synthetic oligonucleotide
  Target: ATXN1; (-) strand; PAM type: NRG; PAM sequence: GAG
cccattctgtttcgatcagg

SEQ ID NO: 59589 - DNA, 20 bp, Artificial Sequence
  Description of Artificial Sequence: Synthetic oligonucleotide
  Target: ATXN1; (-) strand; PAM type: NRG; PAM sequence: GGG
tccccattctgtttcgatca

SEQ ID NO: 59590 - DNA, 20 bp, Artificial Sequence
  Description of Artificial Sequence: Synthetic oligonucleotide
  Target: ATXN1; (-) strand; PAM type: NRG; PAM sequence: AGG
gtccccattctgtttcgatc

SEQ ID NO: 59591 - DNA, 20 bp, Artificial Sequence
  Description of Artificial Sequence: Synthetic oligonucleotide
  Target: ATXN1; (-) strand; PAM type: NRG; PAM sequence: CAG
agtccccattctgtttcgat

SEQ ID NO: 59592 - DNA, 20 bp, Artificial Sequence
  Description of Artificial Sequence: Synthetic oligonucleotide
  Target: ATXN1; (-) strand; PAM type: NRG; PAM sequence: AAG
agaaaactatgcccccgtga

SEQ ID NO: 59593 - DNA, 20 bp, Artificial Sequence
  Description of Artificial Sequence: Synthetic oligonucleotide
  Target: ATXN1; (-) strand; PAM type: NRG; PAM sequence: GAG
gccgttaaccaccccaaggg

SEQ ID NO: 59594 - DNA, 20 bp, Artificial Sequence
  Description of Artificial Sequence: Synthetic oligonucleotide
  Target: ATXN1; (-) strand; PAM type: NRG; PAM sequence: GGG
ctgccgttaaccaccccaag

SEQ ID NO: 59595 - DNA, 20 bp, Artificial Sequence
  Description of Artificial Sequence: Synthetic oligonucleotide
  Target: ATXN1; (-) strand; PAM type: NRG; PAM sequence: GGG
tctgccgttaaccaccccaa

SEQ ID NO: 59596 - DNA, 20 bp, Artificial Sequence
  Description of Artificial Sequence: Synthetic oligonucleotide
  Target: ATXN1; (-) strand; PAM type: NRG; PAM sequence: AGG
ttctgccgttaaccacccca

SEQ ID NO: 59597 - DNA, 20 bp, Artificial Sequence
  Description of Artificial Sequence: Synthetic oligonucleotide
  Target: ATXN1; (-) strand; PAM type: NRG; PAM sequence: AAG
cttctgccgttaaccacccc

SEQ ID NO: 59598 - DNA, 20 bp, Artificial Sequence
  Description of Artificial Sequence: Synthetic oligonucleotide
  Target: ATXN1; (-) strand; PAM type: NRG; PAM sequence: GAG
cactggctggcttcggatat

SEQ ID NO: 59599 - DNA, 20 bp, Artificial Sequence
  Description of Artificial Sequence: Synthetic oligonucleotide
  Target: ATXN1; (-) strand; PAM type: NRG; PAM sequence: CGG
tattttccactggctggctt

SEQ ID NO: 59600 - DNA, 20 bp, Artificial Sequence
  Description of Artificial Sequence: Synthetic oligonucleotide
  Target: ATXN1; (-) strand; PAM type: NRG; PAM sequence: TGG
cttaagtattttccactggc

SEQ ID NO: 59601 - DNA, 20 bp, Artificial Sequence
  Description of Artificial Sequence: Synthetic oligonucleotide
  Target: ATXN1; (-) strand; PAM type: NRG; PAM sequence: TGG
gggtcttaagtattttccac

SEQ ID NO: 59602 - DNA, 20 bp, Artificial Sequence
  Description of Artificial Sequence: Synthetic oligonucleotide
  Target: ATXN1; (-) strand; PAM type: NRG; PAM sequence: AAG
aaagtttggcagggggtctt

SEQ ID NO: 59603 - DNA, 20 bp, Artificial Sequence
  Description of Artificial Sequence: Synthetic oligonucleotide
  Target: ATXN1; (-) strand; PAM type: NRG; PAM sequence: GGG
catgtgaaaagtttggcagg

SEQ ID NO: 59604 - DNA, 20 bp, Artificial Sequence
  Description of Artificial Sequence: Synthetic oligonucleotide
  Target: ATXN1; (-) strand; PAM type: NRG; PAM sequence: GGG
ccatgtgaaaagtttggcag

SEQ ID NO: 59605 - DNA, 20 bp, Artificial Sequence
  Description of Artificial Sequence: Synthetic oligonucleotide
  Target: ATXN1; (-) strand; PAM type: NRG; PAM sequence: GGG
cccatgtgaaaagtttggca

SEQ ID NO: 59606 - DNA, 20 bp, Artificial Sequence
  Description of Artificial Sequence: Synthetic oligonucleotide
  Target: ATXN1; (-) strand; PAM type: NRG; PAM sequence: AGG
acccatgtgaaaagtttggc

SEQ ID NO: 59607 - DNA, 20 bp, Artificial Sequence
  Description of Artificial Sequence: Synthetic oligonucleotide
  Target: ATXN1; (-) strand; PAM type: NRG; PAM sequence: CAG
aacccatgtgaaaagtttgg

SEQ ID NO: 59608 - DNA, 20 bp, Artificial Sequence
  Description of Artificial Sequence: Synthetic oligonucleotide
  Target: ATXN1; (-) strand; PAM type: NRG; PAM sequence: TGG
tcaaacccatgtgaaaagtt

SEQ ID NO: 59609 - DNA, 20 bp, Artificial Sequence
  Description of Artificial Sequence: Synthetic oligonucleotide
  Target: ATXN1; (-) strand; PAM type: NRG; PAM sequence: AAG
tgttctcaaacccatgtgaa

SEQ ID NO: 59610 - DNA, 20 bp, Artificial Sequence
  Description of Artificial Sequence: Synthetic oligonucleotide
  Target: ATXN1; (-) strand; PAM type: NRG; PAM sequence: GAG
tagggatttggccatttgat

SEQ ID NO: 59611 - DNA, 20 bp, Artificial Sequence
  Description of Artificial Sequence: Synthetic oligonucleotide
  Target: ATXN1; (-) strand; PAM type: NRG; PAM sequence: TGG
tggccccataaatagggatt

SEQ ID NO: 59612 - DNA, 20 bp, Artificial Sequence
  Description of Artificial Sequence: Synthetic oligonucleotide
  Target: ATXN1; (-) strand; PAM type: NRG; PAM sequence: GGG
gagatatggccccataaata

SEQ ID NO: 59613 - DNA, 20 bp, Artificial Sequence
  Description of Artificial Sequence: Synthetic oligonucleotide
  Target: ATXN1; (-) strand; PAM type: NRG; PAM sequence: AGG
ggagatatggccccataaat

SEQ ID NO: 59614 - DNA, 20 bp, Artificial Sequence
  Description of Artificial Sequence: Synthetic oligonucleotide
  Target: ATXN1; (-) strand; PAM type: NRG; PAM sequence: TAG
aggagatatggccccataaa

SEQ ID NO: 59615 - DNA, 20 bp, Artificial Sequence
  Description of Artificial Sequence: Synthetic oligonucleotide
  Target: ATXN1; (-) strand; PAM type: NRG; PAM sequence: TGG
tggatggtctggaggagata

SEQ ID NO: 59616 - DNA, 20 bp, Artificial Sequence
  Description of Artificial Sequence: Synthetic oligonucleotide
  Target: ATXN1; (-) strand; PAM type: NRG; PAM sequence: GAG
acttgttggatggtctggag

SEQ ID NO: 59617 - DNA, 20 bp, Artificial Sequence
  Description of Artificial Sequence: Synthetic oligonucleotide
  Target: ATXN1; (-) strand; PAM type: NRG; PAM sequence: AGG
ctacttgttggatggtctgg

SEQ ID NO: 59618 - DNA, 20 bp, Artificial Sequence
  Description of Artificial Sequence: Synthetic oligonucleotide
  Target: ATXN1; (-) strand; PAM type: NRG; PAM sequence: GAG
actacttgttggatggtctg

SEQ ID NO: 59619 - DNA, 20 bp, Artificial Sequence
  Description of Artificial Sequence: Synthetic oligonucleotide
  Target: ATXN1; (-) strand; PAM type: NRG; PAM sequence: TGG
tgactacttgttggatggtc

SEQ ID NO: 59620 - DNA, 20 bp, Artificial Sequence
  Description of Artificial Sequence: Synthetic oligonucleotide
  Target: ATXN1; (-) strand; PAM type: NRG; PAM sequence: TGG
ggctttgactacttgttgga

SEQ ID NO: 59621 - DNA, 20 bp, Artificial Sequence
  Description of Artificial Sequence: Synthetic oligonucleotide
  Target: ATXN1; (-) strand; PAM type: NRG; PAM sequence: TGG
cacaggctttgactacttgt

SEQ ID NO: 59622 - DNA, 20 bp, Artificial Sequence
  Description of Artificial Sequence: Synthetic oligonucleotide
  Target: ATXN1; (-) strand; PAM type: NRG; PAM sequence: AGG
tttcctttggcacacctcac

SEQ ID NO: 59623 - DNA, 20 bp, Artificial Sequence
  Description of Artificial Sequence: Synthetic oligonucleotide
  Target: ATXN1; (-) strand; PAM type: NRG; PAM sequence: CAG
ttttcctttggcacacctca

SEQ ID NO: 59624 - DNA, 20 bp, Artificial Sequence
  Description of Artificial Sequence: Synthetic oligonucleotide
  Target: ATXN1; (-) strand; PAM type: NRG; PAM sequence: TGG
ggaccaagagatttttcctt

SEQ ID NO: 59625 - DNA, 20 bp, Artificial Sequence
  Description of Artificial Sequence: Synthetic oligonucleotide
  Target: ATXN1; (-) strand; PAM type: NRG; PAM sequence: GAG
ggggccttacgatggaccaa

SEQ ID NO: 59626 - DNA, 20 bp, Artificial Sequence
  Description of Artificial Sequence: Synthetic oligonucleotide
  Target: ATXN1; (-) strand; PAM type: NRG; PAM sequence: AAG
aaggggccttacgatggacc

SEQ ID NO: 59627 - DNA, 20 bp, Artificial Sequence
  Description of Artificial Sequence: Synthetic oligonucleotide
  Target: ATXN1; (-) strand; PAM type: NRG; PAM sequence: TGG
ccccaaaaggggccttacga

SEQ ID NO: 59628 - DNA, 20 bp, Artificial Sequence
  Description of Artificial Sequence: Synthetic oligonucleotide
  Target: ATXN1; (-) strand; PAM type: NRG; PAM sequence: GGG
tattctttgttccccaaaag

SEQ ID NO: 59629 - DNA, 20 bp, Artificial Sequence
  Description of Artificial Sequence: Synthetic oligonucleotide
  Target: ATXN1; (-) strand; PAM type: NRG; PAM sequence: GGG
ctattctttgttccccaaaa

SEQ ID NO: 59630 - DNA, 20 bp, Artificial Sequence
  Description of Artificial Sequence: Synthetic oligonucleotide
  Target: ATXN1; (-) strand; PAM type: NRG; PAM sequence: AGG
cctattctttgttccccaaa

SEQ ID NO: 59631 - DNA, 20 bp, Artificial Sequence
  Description of Artificial Sequence: Synthetic oligonucleotide
  Target: ATXN1; (-) strand; PAM type: NRG; PAM sequence: AAG
acctattctttgttccccaa

SEQ ID NO: 59632 - DNA, 20 bp, Artificial Sequence
  Description of Artificial Sequence: Synthetic oligonucleotide
  Target: ATXN1; (-) strand; PAM type: NRG; PAM sequence: TAG
actgccagtcctctccagga

SEQ ID NO: 59633 - DNA, 20 bp, Artificial Sequence
  Description of Artificial Sequence: Synthetic oligonucleotide
  Target: ATXN1; (-) strand; PAM type: NRG; PAM sequence: AGG
tctaactgccagtcctctcc

SEQ ID NO: 59634 - DNA, 20 bp, Artificial Sequence
  Description of Artificial Sequence: Synthetic oligonucleotide
  Target: ATXN1; (-) strand; PAM type: NRG; PAM sequence: CAG
gtctaactgccagtcctctc

SEQ ID NO: 59635 - DNA, 20 bp, Artificial Sequence
  Description of Artificial Sequence: Synthetic oligonucleotide
  Target: ATXN1; (-) strand; PAM type: NRG; PAM sequence: CAG
tatgggtgaagtctaactgc

SEQ ID NO: 59636 - DNA, 20 bp, Artificial Sequence
  Description of Artificial Sequence: Synthetic oligonucleotide
  Target: ATXN1; (-) strand; PAM type: NRG; PAM sequence: AAG
ttgacttaggcatatgggtg

SEQ ID NO: 59637 - DNA, 20 bp, Artificial Sequence
  Description of Artificial Sequence: Synthetic oligonucleotide
  Target: ATXN1; (-) strand; PAM type: NRG; PAM sequence: GGG
tccccttgacttaggcatat

SEQ ID NO: 59638 - DNA, 20 bp, Artificial Sequence
  Description of Artificial Sequence: Synthetic oligonucleotide
  Target: ATXN1; (-) strand; PAM type: NRG; PAM sequence: TGG
atccccttgacttaggcata

SEQ ID NO: 59639 - DNA, 20 bp, Artificial Sequence
  Description of Artificial Sequence: Synthetic oligonucleotide
  Target: ATXN1; (-) strand; PAM type: NRG; PAM sequence: AGG
tattgaaatccccttgactt

SEQ ID NO: 59640 - DNA, 20 bp, Artificial Sequence
  Description of Artificial Sequence: Synthetic oligonucleotide
  Target: ATXN1; (-) strand; PAM type: NRG; PAM sequence: TAG
gtattgaaatccccttgact

SEQ ID NO: 59641 - DNA, 20 bp, Artificial Sequence
  Description of Artificial Sequence: Synthetic oligonucleotide
  Target: ATXN1; (-) strand; PAM type: NRG; PAM sequence: AAG
gttggtcaacacagaccaac

SEQ ID NO: 59642 - DNA, 20 bp, Artificial Sequence
  Description of Artificial Sequence: Synthetic oligonucleotide
  Target: ATXN1; (-) strand; PAM type: NRG; PAM sequence: CAG
tccaatttggttggtcaaca

SEQ ID NO: 59643 - DNA, 20 bp, Artificial Sequence
  Description of Artificial Sequence: Synthetic oligonucleotide
  Target: ATXN1; (-) strand; PAM type: NRG; PAM sequence: TGG
aggcttctatccaatttggt

SEQ ID NO: 59644 - DNA, 20 bp, Artificial Sequence
  Description of Artificial Sequence: Synthetic oligonucleotide
  Target: ATXN1; (-) strand; PAM type: NRG; PAM sequence: TGG
gggaaggcttctatccaatt

SEQ ID NO: 59645 - DNA, 20 bp, Artificial Sequence
  Description of Artificial Sequence: Synthetic oligonucleotide
  Target: ATXN1; (-) strand; PAM type: NRG; PAM sequence: AGG
cttctccgtcttgcagggga

SEQ ID NO: 59646 - DNA, 20 bp, Artificial Sequence
  Description of Artificial Sequence: Synthetic oligonucleotide
  Target: ATXN1; (-) strand; PAM type: NRG; PAM sequence: AAG
ccttctccgtcttgcagggg

SEQ ID NO: 59647 - DNA, 20 bp, Artificial Sequence
  Description of Artificial Sequence: Synthetic oligonucleotide
  Target: ATXN1; (-) strand; PAM type: NRG; PAM sequence: GGG
gagccttctccgtcttgcag

SEQ ID NO: 59648 - DNA, 20 bp, Artificial Sequence
  Description of Artificial Sequence: Synthetic oligonucleotide
  Target: ATXN1; (-) strand; PAM type: NRG; PAM sequence: GGG
tgagccttctccgtcttgca

SEQ ID NO: 59649 - DNA, 20 bp, Artificial Sequence
  Description of Artificial Sequence: Synthetic oligonucleotide
  Target: ATXN1; (-) strand; PAM type: NRG; PAM sequence: AGG
ctgagccttctccgtcttgc

SEQ ID NO: 59650 - DNA, 20 bp, Artificial Sequence
  Description of Artificial Sequence: Synthetic oligonucleotide
  Target: ATXN1; (-) strand; PAM type: NRG; PAM sequence: CAG
cctgagccttctccgtcttg

SEQ ID NO: 59651 - DNA, 20 bp, Artificial Sequence
  Description of Artificial Sequence: Synthetic oligonucleotide
  Target: ATXN1; (-) strand; PAM type: NRG; PAM sequence: GAG
tagtactttaaccacttcct

SEQ ID NO: 59652 - DNA, 20 bp, Artificial Sequence
  Description of Artificial Sequence: Synthetic oligonucleotide
  Target: ATXN1; (-) strand; PAM type: NRG; PAM sequence: TAG
ctgggaattatttcatgagt

SEQ ID NO: 59653 - DNA, 20 bp, Artificial Sequence
  Description of Artificial Sequence: Synthetic oligonucleotide
  Target: ATXN1; (-) strand; PAM type: NRG; PAM sequence: GAG
aaatctgggaattatttcat

SEQ ID NO: 59654 - DNA, 20 bp, Artificial Sequence
  Description of Artificial Sequence: Synthetic oligonucleotide
  Target: ATXN1; (-) strand; PAM type: NRG; PAM sequence: GGG
ctttggggaagcccaaatct

SEQ ID NO: 59655 - DNA, 20 bp, Artificial Sequence
  Description of Artificial Sequence: Synthetic oligonucleotide
  Target: ATXN1; (-) strand; PAM type: NRG; PAM sequence: TGG
gctttggggaagcccaaatc

SEQ ID NO: 59656 - DNA, 20 bp, Artificial Sequence
  Description of Artificial Sequence: Synthetic oligonucleotide
  Target: ATXN1; (-) strand; PAM type: NRG; PAM sequence: AAG
tcgttttgtaagctttgggg

SEQ ID NO: 59657 - DNA, 20 bp, Artificial Sequence
  Description of Artificial Sequence: Synthetic oligonucleotide
  Target: ATXN1; (-) strand; PAM type: NRG; PAM sequence: GGG
ttgtcgttttgtaagctttg

SEQ ID NO: 59658 - DNA, 20 bp, Artificial Sequence
  Description of Artificial Sequence: Synthetic oligonucleotide
  Target: ATXN1; (-) strand; PAM type: NRG; PAM sequence: GGG
attgtcgttttgtaagcttt

SEQ ID NO: 59659 - DNA, 20 bp, Artificial Sequence
  Description of Artificial Sequence: Synthetic oligonucleotide
  Target: ATXN1; (-) strand; PAM type: NRG; PAM sequence: TGG
cattgtcgttttgtaagctt

SEQ ID NO: 59660 - DNA, 20 bp, Artificial Sequence
  Description of Artificial Sequence: Synthetic oligonucleotide
  Target: ATXN1; (-) strand; PAM type: NRG; PAM sequence: AAG
ccggaccattgtcgttttgt

SEQ ID NO: 59661 - DNA, 20 bp, Artificial Sequence
  Description of Artificial Sequence: Synthetic oligonucleotide
  Target: ATXN1; (-) strand; PAM type: NRG; PAM sequence: CGG
gttaccgtggctttaagagc

SEQ ID NO: 59662 - DNA, 20 bp, Artificial Sequence
  Description of Artificial Sequence: Synthetic oligonucleotide
  Target: ATXN1; (-) strand; PAM type: NRG; PAM sequence: GAG
ctgagttaccgtggctttaa

SEQ ID NO: 59663 - DNA, 20 bp, Artificial Sequence
  Description of Artificial Sequence: Synthetic oligonucleotide
  Target: ATXN1; (-) strand; PAM type: NRG; PAM sequence: AAG
ccctgagttaccgtggcttt

SEQ ID NO: 59664 - DNA, 20 bp, Artificial Sequence
  Description of Artificial Sequence: Synthetic oligonucleotide
  Target: ATXN1; (-) strand; PAM type: NRG; PAM sequence: TGG
ggaaattccctgagttaccg

SEQ ID NO: 59665 - DNA, 20 bp, Artificial Sequence
  Description of Artificial Sequence: Synthetic oligonucleotide
  Target: ATXN1; (-) strand; PAM type: NRG; PAM sequence: GAG
tagtgccctggaaattccct

SEQ ID NO: 59666 - DNA, 20 bp, Artificial Sequence
  Description of Artificial Sequence: Synthetic oligonucleotide
  Target: ATXN1; (-) strand; PAM type: NRG; PAM sequence: TGG
atattgtatccctagtgccc

SEQ ID NO: 59667 - DNA, 20 bp, Artificial Sequence
  Description of Artificial Sequence: Synthetic oligonucleotide
  Target: ATXN1; (-) strand; PAM type: NRG; PAM sequence: TAG
tgaaagtgatattgtatccc

SEQ ID NO: 59668 - DNA, 20 bp, Artificial Sequence
  Description of Artificial Sequence: Synthetic oligonucleotide
  Target: ATXN1; (-) strand; PAM type: NRG; PAM sequence: AAG
gtggcctccaggcacagtga

SEQ ID NO: 59669 - DNA, 20 bp, Artificial Sequence
  Description of Artificial Sequence: Synthetic oligonucleotide
  Target: ATXN1; (-) strand; PAM type: NRG; PAM sequence: CAG
aggattgtggcctccaggca

SEQ ID NO: 59670 - DNA, 20 bp, Artificial Sequence
  Description of Artificial Sequence: Synthetic oligonucleotide
  Target: ATXN1; (-) strand; PAM type: NRG; PAM sequence: AGG
ccctgaggattgtggcctcc

SEQ ID NO: 59671 - DNA, 20 bp, Artificial Sequence
  Description of Artificial Sequence: Synthetic oligonucleotide
  Target: ATXN1; (-) strand; PAM type: NRG; PAM sequence: CAG
tccctgaggattgtggcctc

SEQ ID NO: 59672 - DNA, 20 bp, Artificial Sequence
  Description of Artificial Sequence: Synthetic oligonucleotide
  Target: ATXN1; (-) strand; PAM type: NRG; PAM sequence: TGG
tcagccttccctgaggattg

SEQ ID NO: 59673 - DNA, 20 bp, Artificial Sequence
  Description of Artificial Sequence: Synthetic oligonucleotide
  Target: ATXN1; (-) strand; PAM type: NRG; PAM sequence: AGG
tgccttctcagccttccctg

SEQ ID NO: 59674 - DNA, 20 bp, Artificial Sequence
  Description of Artificial Sequence: Synthetic oligonucleotide
  Target: ATXN1; (-) strand; PAM type: NRG; PAM sequence: GAG
ttgccttctcagccttccct

SEQ ID NO: 59675 - DNA, 20 bp, Artificial Sequence
  Description of Artificial Sequence: Synthetic oligonucleotide
  Target: ATXN1; (-) strand; PAM type: NRG; PAM sequence: CAG
gagtgtttcgtttgccttct

SEQ ID NO: 59676 - DNA, 20 bp, Artificial Sequence
  Description of Artificial Sequence: Synthetic oligonucleotide
  Target: ATXN1; (-) strand; PAM type: NRG; PAM sequence: GAG
cgtttccttaagtgcctctt

SEQ ID NO: 59677 - DNA, 20 bp, Artificial Sequence
  Description of Artificial Sequence: Synthetic oligonucleotide
  Target: ATXN1; (-) strand; PAM type: NRG; PAM sequence: AAG
tttcttgtgttcgtttcctt

SEQ ID NO: 59678 - DNA, 20 bp, Artificial Sequence
  Description of Artificial Sequence: Synthetic oligonucleotide
  Target: ATXN1; (-) strand; PAM type: NRG; PAM sequence: GAG
gagagtaggccatgggagat

SEQ ID NO: 59679 - DNA, 20 bp, Artificial Sequence
  Description of Artificial Sequence: Synthetic oligonucleotide
  Target: ATXN1; (-) strand; PAM type: NRG; PAM sequence: GAG
ggcaagagagtaggccatgg

SEQ ID NO: 59680 - DNA, 20 bp, Artificial Sequence
  Description of Artificial Sequence: Synthetic oligonucleotide
  Target: ATXN1; (-) strand; PAM type: NRG; PAM sequence: GGG
tgggcaagagagtaggccat

SEQ ID NO: 59681 - DNA, 20 bp, Artificial Sequence
  Description of Artificial Sequence: Synthetic oligonucleotide
  Target: ATXN1; (-) strand; PAM type: NRG; PAM sequence: TGG
atgggcaagagagtaggcca

SEQ ID NO: 59682 - DNA, 20 bp, Artificial Sequence
  Description of Artificial Sequence: Synthetic oligonucleotide
  Target: ATXN1; (-) strand; PAM type: NRG; PAM sequence: AGG
aaggccatgggcaagagagt

SEQ ID NO: 59683 - DNA, 20 bp, Artificial Sequence
  Description of Artificial Sequence: Synthetic oligonucleotide
  Target: ATXN1; (-) strand; PAM type: NRG; PAM sequence: TAG
caaggccatgggcaagagag

SEQ ID NO: 59684 - DNA, 20 bp, Artificial Sequence
  Description of Artificial Sequence: Synthetic oligonucleotide
  Target: ATXN1; (-) strand; PAM type: NRG; PAM sequence: GAG
caacaaggccatgggcaaga

SEQ ID NO: 59685 - DNA, 20 bp, Artificial Sequence
  Description of Artificial Sequence: Synthetic oligonucleotide
  Target: ATXN1; (-) strand; PAM type: NRG; PAM sequence: GAG
ctcaacaaggccatgggcaa

SEQ ID NO: 59686 - DNA, 20 bp, Artificial Sequence
  Description of Artificial Sequence: Synthetic oligonucleotide
  Target: ATXN1; (-) strand; PAM type: NRG; PAM sequence: AAG
ttctcaacaaggccatgggc

SEQ ID NO: 59687 - DNA, 20 bp, Artificial Sequence
  Description of Artificial Sequence: Synthetic oligonucleotide
  Target: ATXN1; (-) strand; PAM type: NRG; PAM sequence: GGG
tggattctcaacaaggccat

SEQ ID NO: 59688 - DNA, 20 bp, Artificial Sequence
  Description of Artificial Sequence: Synthetic oligonucleotide
  Target: ATXN1; (-) strand; PAM type: NRG; PAM sequence: TGG
ttggattctcaacaaggcca

SEQ ID NO: 59689 - DNA, 20 bp, Artificial Sequence
  Description of Artificial Sequence: Synthetic oligonucleotide
  Target: ATXN1; (-) strand; PAM type: NRG; PAM sequence: AGG
agaattttggattctcaaca

SEQ ID NO: 59690 - DNA, 20 bp, Artificial Sequence
  Description of Artificial Sequence: Synthetic oligonucleotide
  Target: ATXN1; (-) strand; PAM type: NRG; PAM sequence: AAG
gagaattttggattctcaac

SEQ ID NO: 59691 - DNA, 20 bp, Artificial Sequence
  Description of Artificial Sequence: Synthetic oligonucleotide
  Target: ATXN1; (-) strand; PAM type: NRG; PAM sequence: TGG
ccattttgtgaggagaattt

SEQ ID NO: 59692 - DNA, 20 bp, Artificial Sequence
  Description of Artificial Sequence: Synthetic oligonucleotide
  Target: ATXN1; (-) strand; PAM type: NRG; PAM sequence: GAG
actgagccccattttgtgag

SEQ ID NO: 59693 - DNA, 20 bp, Artificial Sequence
  Description of Artificial Sequence: Synthetic oligonucleotide
  Target: ATXN1; (-) strand; PAM type: NRG; PAM sequence: AGG
ggactgagccccattttgtg

SEQ ID NO: 59694 - DNA, 20 bp, Artificial Sequence
  Description of Artificial Sequence: Synthetic oligonucleotide
  Target: ATXN1; (-) strand; PAM type: NRG; PAM sequence: GAG
tggactgagccccattttgt

SEQ ID NO: 59695 - DNA, 20 bp, Artificial Sequence
  Description of Artificial Sequence: Synthetic oligonucleotide
  Target: ATXN1; (-) strand; PAM type: NRG; PAM sequence: GAG
tacagcacttcatatggact

SEQ ID NO: 59696 - DNA, 20 bp, Artificial Sequence
  Description of Artificial Sequence: Synthetic oligonucleotide
  Target: ATXN1; (-) strand; PAM type: NRG; PAM sequence: TGG
catccatacagcacttcata

SEQ ID NO: 59697 - DNA, 20 bp, Artificial Sequence
  Description of Artificial Sequence: Synthetic oligonucleotide
  Target: ATXN1; (-) strand; PAM type: NRG; PAM sequence: CAG
gtgagaaaaggtcatccata

SEQ ID NO: 59698 - DNA, 20 bp, Artificial Sequence
  Description of Artificial Sequence: Synthetic oligonucleotide
  Target: ATXN1; (-) strand; PAM type: NRG; PAM sequence: AGG
aggaggtcatttgtgagaaa

SEQ ID NO: 59699 - DNA, 20 bp, Artificial Sequence
  Description of Artificial Sequence: Synthetic oligonucleotide
  Target: ATXN1; (-) strand; PAM type: NRG; PAM sequence: AAG
taggaggtcatttgtgagaa

SEQ ID NO: 59700 - DNA, 20 bp, Artificial Sequence
  Description of Artificial Sequence: Synthetic oligonucleotide
  Target: ATXN1; (-) strand; PAM type: NRG; PAM sequence: GAG
tcaagtaggaggtcatttgt

SEQ ID NO: 59701 - DNA, 20 bp, Artificial Sequence
  Description of Artificial Sequence: Synthetic oligonucleotide
  Target: ATXN1; (-) strand; PAM type: NRG; PAM sequence: AGG
ccgtttcctgatcaagtagg

SEQ ID NO: 59702 - DNA, 20 bp, Artificial Sequence
  Description of Artificial Sequence: Synthetic oligonucleotide
  Target: ATXN1; (-) strand; PAM type: NRG; PAM sequence: GAG
gccgtttcctgatcaagtag

SEQ ID NO: 59703 - DNA, 20 bp, Artificial Sequence
  Description of Artificial Sequence: Synthetic oligonucleotide
  Target: ATXN1; (-) strand; PAM type: NRG; PAM sequence: AGG
tggccgtttcctgatcaagt

SEQ ID NO: 59704 - DNA, 20 bp, Artificial Sequence
  Description of Artificial Sequence: Synthetic oligonucleotide
  Target: ATXN1; (-) strand; PAM type: NRG; PAM sequence: TAG
ttggccgtttcctgatcaag

SEQ ID NO: 59705 - DNA, 20 bp, Artificial Sequence
  Description of Artificial Sequence: Synthetic oligonucleotide
  Target: ATXN1; (-) strand; PAM type: NRG; PAM sequence: AAG
aacttggccgtttcctgatc

SEQ ID NO: 59706 - DNA, 20 bp, Artificial Sequence
  Description of Artificial Sequence: Synthetic oligonucleotide
  Target: ATXN1; (-) strand; PAM type: NRG; PAM sequence: TGG
agttatatctttgaccaact

SEQ ID NO: 59707 - DNA, 20 bp, Artificial Sequence
  Description of Artificial Sequence: Synthetic oligonucleotide
  Target: ATXN1; (-) strand; PAM type: NRG; PAM sequence: AAG
ttgttggtattttgccaaag

SEQ ID NO: 59708 - DNA, 20 bp, Artificial Sequence
  Description of Artificial Sequence: Synthetic oligonucleotide
  Target: ATXN1; (-) strand; PAM type: NRG; PAM sequence: AAG
gttttgttggtattttgcca

SEQ ID NO: 59709 - DNA, 20 bp, Artificial Sequence
  Description of Artificial Sequence: Synthetic oligonucleotide
  Target: ATXN1; (-) strand; PAM type: NRG; PAM sequence: TGG
gtaggtttttaacgttttgt

SEQ ID NO: 59710 - DNA, 20 bp, Artificial Sequence
  Description of Artificial Sequence: Synthetic oligonucleotide
  Target: ATXN1; (-) strand; PAM type: NRG; PAM sequence: AGG
ctctgtgacatcctttgggt

SEQ ID NO: 59711 - DNA, 20 bp, Artificial Sequence
  Description of Artificial Sequence: Synthetic oligonucleotide
  Target: ATXN1; (-) strand; PAM type: NRG; PAM sequence: TAG
tctctgtgacatcctttggg

SEQ ID NO: 59712 - DNA, 20 bp, Artificial Sequence
  Description of Artificial Sequence: Synthetic oligonucleotide
  Target: ATXN1; (-) strand; PAM type: NRG; PAM sequence: GGG
ttgtctctgtgacatccttt

SEQ ID NO: 59713 - DNA, 20 bp, Artificial Sequence
  Description of Artificial Sequence: Synthetic oligonucleotide
  Target: ATXN1; (-) strand; PAM type: NRG; PAM sequence: TGG
cttgtctctgtgacatcctt

SEQ ID NO: 59714 - DNA, 20 bp, Artificial Sequence
  Description of Artificial Sequence: Synthetic oligonucleotide
  Target: ATXN1; (-) strand; PAM type: NRG; PAM sequence: TGG
ccaacagtaaatctcctggt

SEQ ID NO: 59715 - DNA, 20 bp, Artificial Sequence
  Description of Artificial Sequence: Synthetic oligonucleotide
  Target: ATXN1; (-) strand; PAM type: NRG; PAM sequence: TGG
ttgaccaacagtaaatctcc

SEQ ID NO: 59716 - DNA, 20 bp, Artificial Sequence
  Description of Artificial Sequence: Synthetic oligonucleotide
  Target: ATXN1; (-) strand; PAM type: NRG; PAM sequence: CAG
gaggggagggacttgaccaa

SEQ ID NO: 59717 - DNA, 20 bp, Artificial Sequence
  Description of Artificial Sequence: Synthetic oligonucleotide
  Target: ATXN1; (-) strand; PAM type: NRG; PAM sequence: GGG
agatgaggaggaagagggga

SEQ ID NO: 59718 - DNA, 20 bp, Artificial Sequence
  Description of Artificial Sequence: Synthetic oligonucleotide
  Target: ATXN1; (-) strand; PAM type: NRG; PAM sequence: AGG
tagatgaggaggaagagggg

SEQ ID NO: 59719 - DNA, 20 bp, Artificial Sequence
  Description of Artificial Sequence: Synthetic oligonucleotide
  Target: ATXN1; (-) strand; PAM type: NRG; PAM sequence: GAG
atagatgaggaggaagaggg

SEQ ID NO: 59720 - DNA, 20 bp, Artificial Sequence
  Description of Artificial Sequence: Synthetic oligonucleotide
  Target: ATXN1; (-) strand; PAM type: NRG; PAM sequence: GGG
ccatagatgaggaggaagag

SEQ ID NO: 59721 - DNA, 20 bp, Artificial Sequence
  Description of Artificial Sequence: Synthetic oligonucleotide
  Target: ATXN1; (-) strand; PAM type: NRG; PAM sequence: GGG
tccatagatgaggaggaaga

SEQ ID NO: 59722 - DNA, 20 bp, Artificial Sequence
  Description of Artificial Sequence: Synthetic oligonucleotide
  Target: ATXN1; (-) strand; PAM type: NRG; PAM sequence: AGG
atccatagatgaggaggaag

SEQ ID NO: 59723 - DNA, 20 bp, Artificial Sequence
  Description of Artificial Sequence: Synthetic oligonucleotide
  Target: ATXN1; (-) strand; PAM type: NRG; PAM sequence: GAG
aatccatagatgaggaggaa

SEQ ID NO: 59724 - DNA, 20 bp, Artificial Sequence
  Description of Artificial Sequence: Synthetic oligonucleotide
  Target: ATXN1; (-) strand; PAM type: NRG; PAM sequence: AAG
ggaatccatagatgaggagg

SEQ ID NO: 59725 - DNA, 20 bp, Artificial Sequence
  Description of Artificial Sequence: Synthetic oligonucleotide
  Target: ATXN1; (-) strand; PAM type: NRG; PAM sequence: AGG
caaggaatccatagatgagg

SEQ ID NO: 59726 - DNA, 20 bp, Artificial Sequence
  Description of Artificial Sequence: Synthetic oligonucleotide
  Target: ATXN1; (-) strand; PAM type: NRG; PAM sequence: GAG
acaaggaatccatagatgag

SEQ ID NO: 59727 - DNA, 20 bp, Artificial Sequence
  Description of Artificial Sequence: Synthetic oligonucleotide
  Target: ATXN1; (-) strand; PAM type: NRG; PAM sequence: AGG
ccacaaggaatccatagatg

SEQ ID NO: 59728 - DNA, 20 bp, Artificial Sequence
  Description of Artificial Sequence: Synthetic oligonucleotide
  Target: ATXN1; (-) strand; PAM type: NRG; PAM sequence: GAG
cccacaaggaatccatagat

SEQ ID NO: 59729 - DNA, 20 bp, Artificial Sequence
  Description of Artificial Sequence: Synthetic oligonucleotide
  Target: ATXN1; (-) strand; PAM type: NRG; PAM sequence: TAG
tccttcccacaaggaatcca

SEQ ID NO: 59730 - DNA, 20 bp, Artificial Sequence
  Description of Artificial Sequence: Synthetic oligonucleotide
  Target: ATXN1; (-) strand; PAM type: NRG; PAM sequence: AGG
tgagtatggtccttcccaca

SEQ ID NO: 59731 - DNA, 20 bp, Artificial Sequence
  Description of Artificial Sequence: Synthetic oligonucleotide
  Target: ATXN1; (-) strand; PAM type: NRG; PAM sequence: AAG
ctgagtatggtccttcccac

SEQ ID NO: 59732 - DNA, 20 bp, Artificial Sequence
  Description of Artificial Sequence: Synthetic oligonucleotide
  Target: ATXN1; (-) strand; PAM type: NRG; PAM sequence: TGG
gtagagaggattactgagta

SEQ ID NO: 59733 - DNA, 20 bp, Artificial Sequence
  Description of Artificial Sequence: Synthetic oligonucleotide
  Target: ATXN1; (-) strand; PAM type: NRG; PAM sequence: GAG
tgggggtagagaggattact

SEQ ID NO: 59734 - DNA, 20 bp, Artificial Sequence
  Description of Artificial Sequence: Synthetic oligonucleotide
  Target: ATXN1; (-) strand; PAM type: NRG; PAM sequence: AGG
taactgcagtgggggtagag

SEQ ID NO: 59735 - DNA, 20 bp, Artificial Sequence
  Description of Artificial Sequence: Synthetic oligonucleotide
  Target: ATXN1; (-) strand; PAM type: NRG; PAM sequence: GAG
ttaactgcagtgggggtaga

SEQ ID NO: 59736 - DNA, 20 bp, Artificial Sequence
  Description of Artificial Sequence: Synthetic oligonucleotide
  Target: ATXN1; (-) strand; PAM type: NRG; PAM sequence: GAG
ccttaactgcagtgggggta

SEQ ID NO: 59737 - DNA, 20 bp, Artificial Sequence
  Description of Artificial Sequence: Synthetic oligonucleotide
  Target: ATXN1; (-) strand; PAM type: NRG; PAM sequence: TAG
caccttaactgcagtggggg

SEQ ID NO: 59738 - DNA, 20 bp, Artificial Sequence
  Description of Artificial Sequence: Synthetic oligonucleotide
  Target: ATXN1; (-) strand; PAM type: NRG; PAM sequence: GGG
tgccaccttaactgcagtgg

SEQ ID NO: 59739 - DNA, 20 bp, Artificial Sequence
  Description of Artificial Sequence: Synthetic oligonucleotide
  Target: ATXN1; (-) strand; PAM type: NRG; PAM sequence: GGG
ctgccaccttaactgcagtg

SEQ ID NO: 59740 - DNA, 20 bp, Artificial Sequence
  Description of Artificial Sequence: Synthetic oligonucleotide
  Target: ATXN1; (-) strand; PAM type: NRG; PAM sequence: GGG
cctgccaccttaactgcagt

SEQ ID NO: 59741 - DNA, 20 bp, Artificial Sequence
  Description of Artificial Sequence: Synthetic oligonucleotide
  Target: ATXN1; (-) strand; PAM type: NRG; PAM sequence: TGG
tcctgccaccttaactgcag

SEQ ID NO: 59742 - DNA, 20 bp, Artificial Sequence
  Description of Artificial Sequence: Synthetic oligonucleotide
  Target: ATXN1; (-) strand; PAM type: NRG; PAM sequence: CAG
cactcctgccaccttaactg

SEQ ID NO: 59743 - DNA, 20 bp, Artificial Sequence
  Description of Artificial Sequence: Synthetic oligonucleotide
  Target: ATXN1; (-) strand; PAM type: NRG; PAM sequence: AAG
aactcgcatgtagtgaatcc

SEQ ID NO: 59744 - DNA, 20 bp, Artificial Sequence
  Description of Artificial Sequence: Synthetic oligonucleotide
  Target: ATXN1; (-) strand; PAM type: NRG; PAM sequence: TAG
tccaaagtttaactcgcatg

SEQ ID NO: 59745 - DNA, 20 bp, Artificial Sequence
  Description of Artificial Sequence: Synthetic oligonucleotide
  Target: ATXN1; (-) strand; PAM type: NRG; PAM sequence: AAG
ggttcttcagggggtgtcca

SEQ ID NO: 59746 - DNA, 20 bp, Artificial Sequence
  Description of Artificial Sequence: Synthetic oligonucleotide
  Target: ATXN1; (-) strand; PAM type: NRG; PAM sequence: GGG
ggtcctacaggttcttcagg

SEQ ID NO: 59747 - DNA, 20 bp, Artificial Sequence
  Description of Artificial Sequence: Synthetic oligonucleotide
  Target: ATXN1; (-) strand; PAM type: NRG; PAM sequence: GGG
tggtcctacaggttcttcag

SEQ ID NO: 59748 - DNA, 20 bp, Artificial Sequence
  Description of Artificial Sequence: Synthetic oligonucleotide
  Target: ATXN1; (-) strand; PAM type: NRG; PAM sequence: GGG
atggtcctacaggttcttca

SEQ ID NO: 59749 - DNA, 20 bp, Artificial Sequence
  Description of Artificial Sequence: Synthetic oligonucleotide
  Target: ATXN1; (-) strand; PAM type: NRG; PAM sequence: AGG
gatggtcctacaggttcttc

SEQ ID NO: 59750 - DNA, 20 bp, Artificial Sequence
  Description of Artificial Sequence: Synthetic oligonucleotide
  Target: ATXN1; (-) strand; PAM type: NRG; PAM sequence: CAG
tgatggtcctacaggttctt

SEQ ID NO: 59751 - DNA, 20 bp, Artificial Sequence
  Description of Artificial Sequence: Synthetic oligonucleotide
  Target: ATXN1; (-) strand; PAM type: NRG; PAM sequence: AGG
tcctgagctgatggtcctac

SEQ ID NO: 59752 - DNA, 20 bp, Artificial Sequence
  Description of Artificial Sequence: Synthetic oligonucleotide
  Target: ATXN1; (-) strand; PAM type: NRG; PAM sequence: CAG
ctcctgagctgatggtccta

SEQ ID NO: 59753 - DNA, 20 bp, Artificial Sequence
  Description of Artificial Sequence: Synthetic oligonucleotide
  Target: ATXN1; (-) strand; PAM type: NRG; PAM sequence: TGG
tcttgggactcctgagctga

SEQ ID NO: 59754 - DNA, 20 bp, Artificial Sequence
  Description of Artificial Sequence: Synthetic oligonucleotide
  Target: ATXN1; (-) strand; PAM type: NRG; PAM sequence: GAG
tggctgatcttgggactcct

SEQ ID NO: 59755 - DNA, 20 bp, Artificial Sequence
  Description of Artificial Sequence: Synthetic oligonucleotide
  Target: ATXN1; (-) strand; PAM type: NRG; PAM sequence: GGG
aggctggtctggctgatctt

SEQ ID NO: 59756 - DNA, 20 bp, Artificial Sequence
  Description of Artificial Sequence: Synthetic oligonucleotide
  Target: ATXN1; (-) strand; PAM type: NRG; PAM sequence: TGG
gaggctggtctggctgatct

SEQ ID NO: 59757 - DNA, 20 bp, Artificial Sequence
  Description of Artificial Sequence: Synthetic oligonucleotide
  Target: ATXN1; (-) strand; PAM type: NRG; PAM sequence: TGG
caggtttatcgaggctggtc

SEQ ID NO: 59758 - DNA, 20 bp, Artificial Sequence
  Description of Artificial Sequence: Synthetic oligonucleotide
  Target: ATXN1; (-) strand; PAM type: NRG; PAM sequence: TGG
gttcacaggtttatcgaggc

SEQ ID NO: 59759 - DNA, 20 bp, Artificial Sequence
  Description of Artificial Sequence: Synthetic oligonucleotide
  Target: ATXN1; (-) strand; PAM type: NRG; PAM sequence: AGG
aatggttcacaggtttatcg

SEQ ID NO: 59760 - DNA, 20 bp, Artificial Sequence
  Description of Artificial Sequence: Synthetic oligonucleotide
  Target: ATXN1; (-) strand; PAM type: NRG; PAM sequence: GAG
caatggttcacaggtttatc

SEQ ID NO: 59761 - DNA, 20 bp, Artificial Sequence
  Description of Artificial Sequence: Synthetic oligonucleotide
  Target: ATXN1; (-) strand; PAM type: NRG; PAM sequence: AGG
caaatcttccaatggttcac

SEQ ID NO: 59762 - DNA, 20 bp, Artificial Sequence
  Description of Artificial Sequence: Synthetic oligonucleotide
  Target: ATXN1; (-) strand; PAM type: NRG; PAM sequence: CAG
acaaatcttccaatggttca

SEQ ID NO: 59763 - DNA, 20 bp, Artificial Sequence
  Description of Artificial Sequence: Synthetic oligonucleotide
  Target: ATXN1; (-) strand; PAM type: NRG; PAM sequence: TGG
aggagacacaaatcttccaa

SEQ ID NO: 59764 - DNA, 20 bp, Artificial Sequence
  Description of Artificial Sequence: Synthetic oligonucleotide
  Target: ATXN1; (-) strand; PAM type: NRG; PAM sequence: GAG
gatgtttccttctgaaatag

SEQ ID NO: 59765 - DNA, 20 bp, Artificial Sequence
  Description of Artificial Sequence: Synthetic oligonucleotide
  Target: ATXN1; (-) strand; PAM type: NRG; PAM sequence: AGG
gggatgtttccttctgaaat

SEQ ID NO: 59766 - DNA, 20 bp, Artificial Sequence
  Description of Artificial Sequence: Synthetic oligonucleotide
  Target: ATXN1; (-) strand; PAM type: NRG; PAM sequence: TAG
tgggatgtttccttctgaaa

SEQ ID NO: 59767 - DNA, 20 bp, Artificial Sequence
  Description of Artificial Sequence: Synthetic oligonucleotide
  Target: ATXN1; (-) strand; PAM type: NRG; PAM sequence: GGG
tataggggcctttttagtct

SEQ ID NO: 59768 - DNA, 20 bp, Artificial Sequence
  Description of Artificial Sequence: Synthetic oligonucleotide
  Target: ATXN1; (-) strand; PAM type: NRG; PAM sequence: TGG
ctataggggcctttttagtc

SEQ ID NO: 59769 - DNA, 20 bp, Artificial Sequence
  Description of Artificial Sequence: Synthetic oligonucleotide
  Target: ATXN1; (-) strand; PAM type: NRG; PAM sequence: TAG
atcagctataggggcctttt

SEQ ID NO: 59770 - DNA, 20 bp, Artificial Sequence
  Description of Artificial Sequence: Synthetic oligonucleotide
  Target: ATXN1; (-) strand; PAM type: NRG; PAM sequence: GGG
ttccttaggatcagctatag

SEQ ID NO: 59771 - DNA, 20 bp, Artificial Sequence
  Description of Artificial Sequence: Synthetic oligonucleotide
  Target: ATXN1; (-) strand; PAM type: NRG; PAM sequence: GGG
tttccttaggatcagctata

SEQ ID NO: 59772 - DNA, 20 bp, Artificial Sequence
  Description of Artificial Sequence: Synthetic oligonucleotide
  Target: ATXN1; (-) strand; PAM type: NRG; PAM sequence: AGG
ttttccttaggatcagctat

SEQ ID NO: 59773 - DNA, 20 bp, Artificial Sequence
  Description of Artificial Sequence: Synthetic oligonucleotide
  Target: ATXN1; (-) strand; PAM type: NRG; PAM sequence: TAG
tttttccttaggatcagcta

SEQ ID NO: 59774 - DNA, 20 bp, Artificial Sequence
  Description of Artificial Sequence: Synthetic oligonucleotide
  Target: ATXN1; (-) strand; PAM type: NRG; PAM sequence: CAG
aaagagtttttccttaggat

SEQ ID NO: 59775 - DNA, 20 bp, Artificial Sequence
  Description of Artificial Sequence: Synthetic oligonucleotide
  Target: ATXN1; (-) strand; PAM type: NRG; PAM sequence: AGG
ataggaaagagtttttcctt

SEQ ID NO: 59776 - DNA, 20 bp, Artificial Sequence
  Description of Artificial Sequence: Synthetic oligonucleotide
  Target: ATXN1; (-) strand; PAM type: NRG; PAM sequence: TAG
aataggaaagagtttttcct

SEQ ID NO: 59777 - DNA, 20 bp, Artificial Sequence
  Description of Artificial Sequence: Synthetic oligonucleotide
  Target: ATXN1; (-) strand; PAM type: NRG; PAM sequence: GAG
tatcctttttaaataggaaa

SEQ ID NO: 59778 - DNA, 20 bp, Artificial Sequence
  Description of Artificial Sequence: Synthetic oligonucleotide
  Target: ATXN1; (-) strand; PAM type: NRG; PAM sequence: AAG
cttatcctttttaaatagga

SEQ ID NO: 59779 - DNA, 20 bp, Artificial Sequence
  Description of Artificial Sequence: Synthetic oligonucleotide
  Target: ATXN1; (-) strand; PAM type: NRG; PAM sequence: AGG
ttcacttatcctttttaaat

SEQ ID NO: 59780 - DNA, 20 bp, Artificial Sequence
  Description of Artificial Sequence: Synthetic oligonucleotide
  Target: ATXN1; (-) strand; PAM type: NRG; PAM sequence: TAG
tttcacttatcctttttaaa

SEQ ID NO: 59781 - DNA, 20 bp, Artificial Sequence
  Description of Artificial Sequence: Synthetic oligonucleotide
  Target: ATXN1; (-) strand; PAM type: NRG; PAM sequence: AGG
agtggtgttaaagattatgt

SEQ ID NO: 59782 - DNA, 20 bp, Artificial Sequence
  Description of Artificial Sequence: Synthetic oligonucleotide
  Target: ATXN1; (-) strand; PAM type: NRG; PAM sequence: TAG
gagtggtgttaaagattatg

SEQ ID NO: 59783 - DNA, 20 bp, Artificial Sequence
  Description of Artificial Sequence: Synthetic oligonucleotide
  Target: ATXN1; (-) strand; PAM type: NRG; PAM sequence: AAG
aggggcaaggagtggtgtta

SEQ ID NO: 59784 - DNA, 20 bp, Artificial Sequence
  Description of Artificial Sequence: Synthetic oligonucleotide
  Target: ATXN1; (-) strand; PAM type: NRG; PAM sequence: TGG
tccattaaaggggcaaggag

SEQ ID NO: 59785 - DNA, 20 bp, Artificial Sequence
  Description of Artificial Sequence: Synthetic oligonucleotide
  Target: ATXN1; (-) strand; PAM type: NRG; PAM sequence: GAG
gattccattaaaggggcaag

SEQ ID NO: 59786 - DNA, 20 bp, Artificial Sequence
  Description of Artificial Sequence: Synthetic oligonucleotide
  Target: ATXN1; (-) strand; PAM type: NRG; PAM sequence: AGG
aggattccattaaaggggca

SEQ ID NO: 59787 - DNA, 20 bp, Artificial Sequence
  Description of Artificial Sequence: Synthetic oligonucleotide
  Target: ATXN1; (-) strand; PAM type: NRG; PAM sequence: AAG
aaggattccattaaaggggc

SEQ ID NO: 59788 - DNA, 20 bp, Artificial Sequence
  Description of Artificial Sequence: Synthetic oligonucleotide
  Target: ATXN1; (-) strand; PAM type: NRG; PAM sequence: GGG
gtaaaaggattccattaaag

SEQ ID NO: 59789 - DNA, 20 bp, Artificial Sequence
  Description of Artificial Sequence: Synthetic oligonucleotide
  Target: ATXN1; (-) strand; PAM type: NRG; PAM sequence: GGG
tgtaaaaggattccattaaa

SEQ ID NO: 59790 - DNA, 20 bp, Artificial Sequence
  Description of Artificial Sequence: Synthetic oligonucleotide
  Target: ATXN1; (-) strand; PAM type: NRG; PAM sequence: AGG
ctgtaaaaggattccattaa

SEQ ID NO: 59791 - DNA, 20 bp, Artificial Sequence
  Description of Artificial Sequence: Synthetic oligonucleotide
  Target: ATXN1; (-) strand; PAM type: NRG; PAM sequence: AAG
actgtaaaaggattccatta

SEQ ID NO: 59792 - DNA, 20 bp, Artificial Sequence
  Description of Artificial Sequence: Synthetic oligonucleotide
  Target: ATXN1; (-) strand; PAM type: NRG; PAM sequence: AGG
taatgtgatgaaactgtaaa

SEQ ID NO: 59793 - DNA, 20 bp, Artificial Sequence
  Description of Artificial Sequence: Synthetic oligonucleotide
  Target: ATXN1; (-) strand; PAM type: NRG; PAM sequence: AAG
ataatgtgatgaaactgtaa

SEQ ID NO: 59794 - DNA, 20 bp, Artificial Sequence
  Description of Artificial Sequence: Synthetic oligonucleotide
  Target: ATXN1; (-) strand; PAM type: NRG; PAM sequence: TAG
cctgctgcaaagagaatggt

SEQ ID NO: 59795 - DNA, 20 bp, Artificial Sequence
  Description of Artificial Sequence: Synthetic oligonucleotide
  Target: ATXN1; (-) strand; PAM type: NRG; PAM sequence: TGG
tagtcctgctgcaaagagaa

SEQ ID NO: 59796 - DNA, 20 bp, Artificial Sequence
  Description of Artificial Sequence: Synthetic oligonucleotide
  Target: ATXN1; (-) strand; PAM type: NRG; PAM sequence: GAG
gtatatagtcctgctgcaaa

SEQ ID NO: 59797 - DNA, 20 bp, Artificial Sequence
  Description of Artificial Sequence: Synthetic oligonucleotide
  Target: ATXN1; (-) strand; PAM type: NRG; PAM sequence: AAG
cagtatatagtcctgctgca

SEQ ID NO: 59798 - DNA, 20 bp, Artificial Sequence
  Description of Artificial Sequence: Synthetic oligonucleotide
  Target: ATXN1; (-) strand; PAM type: NRG; PAM sequence: TAG
ccggcaggagctacagtata

SEQ ID NO: 59799 - DNA, 20 bp, Artificial Sequence
  Description of Artificial Sequence: Synthetic oligonucleotide
  Target: ATXN1; (-) strand; PAM type: NRG; PAM sequence: CAG
ttttgtcccggcaggagcta

SEQ ID NO: 59800 - DNA, 20 bp, Artificial Sequence
  Description of Artificial Sequence: Synthetic oligonucleotide
  Target: ATXN1; (-) strand; PAM type: NRG; PAM sequence: GAG
taggatttttgtcccggcag

SEQ ID NO: 59801 - DNA, 20 bp, Artificial Sequence
  Description of Artificial Sequence: Synthetic oligonucleotide
  Target: ATXN1; (-) strand; PAM type: NRG; PAM sequence: AGG
attaggatttttgtcccggc

SEQ ID NO: 59802 - DNA, 20 bp, Artificial Sequence
  Description of Artificial Sequence: Synthetic oligonucleotide
  Target: ATXN1; (-) strand; PAM type: NRG; PAM sequence: CAG
gattaggatttttgtcccgg

SEQ ID NO: 59803 - DNA, 20 bp, Artificial Sequence
  Description of Artificial Sequence: Synthetic oligonucleotide
  Target: ATXN1; (-) strand; PAM type: NRG; PAM sequence: CGG
tgtgattaggatttttgtcc

SEQ ID NO: 59804 - DNA, 20 bp, Artificial Sequence
  Description of Artificial Sequence: Synthetic oligonucleotide
  Target: ATXN1; (-) strand; PAM type: NRG; PAM sequence: AGG
taaaaaaggttgatgtgatt

SEQ ID NO: 59805 - DNA, 20 bp, Artificial Sequence
  Description of Artificial Sequence: Synthetic oligonucleotide
  Target: ATXN1; (-) strand; PAM type: NRG; PAM sequence: TAG
gtaaaaaaggttgatgtgat

SEQ ID NO: 59806 - DNA, 20 bp, Artificial Sequence
  Description of Artificial Sequence: Synthetic oligonucleotide
  Target: ATXN1; (-) strand; PAM type: NRG; PAM sequence: AGG
agctggattgcatgtaaaaa

SEQ ID NO: 59807 - DNA, 20 bp, Artificial Sequence
  Description of Artificial Sequence: Synthetic oligonucleotide
  Target: ATXN1; (-) strand; PAM type: NRG; PAM sequence: AAG
aagctggattgcatgtaaaa

SEQ ID NO: 59808 - DNA, 20 bp, Artificial Sequence
  Description of Artificial Sequence: Synthetic oligonucleotide
  Target: ATXN1; (-) strand; PAM type: NRG; PAM sequence: TGG
aaatgtaagagcgtaaaagc

SEQ ID NO: 59809 - DNA, 20 bp, Artificial Sequence
  Description of Artificial Sequence: Synthetic oligonucleotide
  Target: ATXN1; (-) strand; PAM type: NRG; PAM sequence: AAG
ttggaaatgtaagagcgtaa

SEQ ID NO: 59810 - DNA, 20 bp, Artificial Sequence
  Description of Artificial Sequence: Synthetic oligonucleotide
  Target: ATXN1; (-) strand; PAM type: NRG; PAM sequence: GAG
aggtgaggttggaaatgtaa

SEQ ID NO: 59811 - DNA, 20 bp, Artificial Sequence
  Description of Artificial Sequence: Synthetic oligonucleotide
  Target: ATXN1; (-) strand; PAM type: NRG; PAM sequence: AAG
ataggtgaggttggaaatgt

SEQ ID NO: 59812 - DNA, 20 bp, Artificial Sequence
  Description of Artificial Sequence: Synthetic oligonucleotide
  Target: ATXN1; (-) strand; PAM type: NRG; PAM sequence: TGG
gctcatgtaataggtgaggt

SEQ ID NO: 59813 - DNA, 20 bp, Artificial Sequence
  Description of Artificial Sequence: Synthetic oligonucleotide
  Target: ATXN1; (-) strand; PAM type: NRG; PAM sequence: AGG
cattgctcatgtaataggtg

SEQ ID NO: 59814 - DNA, 20 bp, Artificial Sequence
  Description of Artificial Sequence: Synthetic oligonucleotide
  Target: ATXN1; (-) strand; PAM type: NRG; PAM sequence: GAG
tcattgctcatgtaataggt

SEQ ID NO: 59815 - DNA, 20 bp, Artificial Sequence
  Description of Artificial Sequence: Synthetic oligonucleotide
  Target: ATXN1; (-) strand; PAM type: NRG; PAM sequence: AGG
cttttcattgctcatgtaat

SEQ ID NO: 59816 - DNA, 20 bp, Artificial Sequence
  Description of Artificial Sequence: Synthetic oligonucleotide
  Target: ATXN1; (-) strand; PAM type: NRG; PAM sequence: TAG
gcttttcattgctcatgtaa

SEQ ID NO: 59817 - DNA, 20 bp, Artificial Sequence
  Description of Artificial Sequence: Synthetic oligonucleotide
  Target: ATXN1; (-) strand; PAM type: NRG; PAM sequence: GGG
agatggtattcacggttaca

SEQ ID NO: 59818 - DNA, 20 bp, Artificial Sequence
  Description of Artificial Sequence: Synthetic oligonucleotide
  Target: ATXN1; (-) strand; PAM type: NRG; PAM sequence: AGG
aagatggtattcacggttac

SEQ ID NO: 59819 - DNA, 20 bp, Artificial Sequence
  Description of Artificial Sequence: Synthetic oligonucleotide
  Target: ATXN1; (-) strand; PAM type: NRG; PAM sequence: CAG
taagatggtattcacggtta

SEQ ID NO: 59820 - DNA, 20 bp, Artificial Sequence
  Description of Artificial Sequence: Synthetic oligonucleotide
  Target: ATXN1; (-) strand; PAM type: NRG; PAM sequence: CGG
gaaagttaagatggtattca

SEQ ID NO: 59821 - DNA, 20 bp, Artificial Sequence
  Description of Artificial Sequence: Synthetic oligonucleotide
  Target: ATXN1; (-) strand; PAM type: NRG; PAM sequence: TGG
cggggcttggaaagttaaga

SEQ ID NO: 59822 - DNA, 20 bp, Artificial Sequence
  Description of Artificial Sequence: Synthetic oligonucleotide
  Target: ATXN1; (-) strand; PAM type: NRG; PAM sequence: AAG
ataacggggcttggaaagtt

SEQ ID NO: 59823 - DNA, 20 bp, Artificial Sequence
  Description of Artificial Sequence: Synthetic oligonucleotide
  Target: ATXN1; (-) strand; PAM type: NRG; PAM sequence: AAG
gatgcataacggggcttgga

SEQ ID NO: 59824 - DNA, 20 bp, Artificial Sequence
  Description of Artificial Sequence: Synthetic oligonucleotide
  Target: ATXN1; (-) strand; PAM type: NRG; PAM sequence: TGG
gttggatgcataacggggct

SEQ ID NO: 59825 - DNA, 20 bp, Artificial Sequence
  Description of Artificial Sequence: Synthetic oligonucleotide
  Target: ATXN1; (-) strand; PAM type: NRG; PAM sequence: GGG
gttgcgttggatgcataacg

SEQ ID NO: 59826 - DNA, 20 bp, Artificial Sequence
  Description of Artificial Sequence: Synthetic oligonucleotide
  Target: ATXN1; (-) strand; PAM type: NRG; PAM sequence: GGG
ggttgcgttggatgcataac

SEQ ID NO: 59827 - DNA, 20 bp, Artificial Sequence
  Description of Artificial Sequence: Synthetic oligonucleotide
  Target: ATXN1; (-) strand; PAM type: NRG; PAM sequence: CGG
aggttgcgttggatgcataa

SEQ ID NO: 59828 - DNA, 20 bp, Artificial Sequence
  Description of Artificial Sequence: Synthetic oligonucleotide
  Target: ATXN1; (-) strand; PAM type: NRG; PAM sequence: TGG
ggcctgataacaggttgcgt

SEQ ID NO: 59829 - DNA, 20 bp, Artificial Sequence
  Description of Artificial Sequence: Synthetic oligonucleotide
  Target: ATXN1; (-) strand; PAM type: NRG; PAM sequence: AGG
ccaggggcaggcctgataac

SEQ ID NO: 59830 - DNA, 20 bp, Artificial Sequence
  Description of Artificial Sequence: Synthetic oligonucleotide
  Target: ATXN1; (-) strand; PAM type: NRG; PAM sequence: CAG
cccaggggcaggcctgataa

SEQ ID NO: 59831 - DNA, 20 bp, Artificial Sequence
  Description of Artificial Sequence: Synthetic oligonucleotide
  Target: ATXN1; (-) strand; PAM type: NRG; PAM sequence: AGG
atagtaggtgccccaggggc

SEQ ID NO: 59832 - DNA, 20 bp, Artificial Sequence
  Description of Artificial Sequence: Synthetic oligonucleotide
  Target: ATXN1; (-) strand; PAM type: NRG; PAM sequence: CAG
gatagtaggtgccccagggg

SEQ ID NO: 59833 - DNA, 20 bp, Artificial Sequence
  Description of Artificial Sequence: Synthetic oligonucleotide
  Target: ATXN1; (-) strand; PAM type: NRG; PAM sequence: GGG
tgggatagtaggtgccccag

SEQ ID NO: 59834 - DNA, 20 bp, Artificial Sequence
  Description of Artificial Sequence: Synthetic oligonucleotide
  Target: ATXN1; (-) strand; PAM type: NRG; PAM sequence: GGG
atgggatagtaggtgcccca

SEQ ID NO: 59835 - DNA, 20 bp, Artificial Sequence
  Description of Artificial Sequence: Synthetic oligonucleotide
  Target: ATXN1; (-) strand; PAM type: NRG; PAM sequence: AGG
gatgggatagtaggtgcccc

SEQ ID NO: 59836 - DNA, 20 bp, Artificial Sequence
  Description of Artificial Sequence: Synthetic oligonucleotide
  Target: ATXN1; (-) strand; PAM type: NRG; PAM sequence: CAG
tgatgggatagtaggtgccc

SEQ ID NO: 59837 - DNA, 20 bp, Artificial Sequence
  Description of Artificial Sequence: Synthetic oligonucleotide
  Target: ATXN1; (-) strand; PAM type: NRG; PAM sequence: AGG
aattacactgatgggatagt

SEQ ID NO: 59838 - DNA, 20 bp, Artificial Sequence
  Description of Artificial Sequence: Synthetic oligonucleotide
  Target: ATXN1; (-) strand; PAM type: NRG; PAM sequence: TAG
taattacactgatgggatag

SEQ ID NO: 59839 - DNA, 20 bp, Artificial Sequence
  Description of Artificial Sequence: Synthetic oligonucleotide
  Target: ATXN1; (-) strand; PAM type: NRG; PAM sequence: TAG
gtgtaattacactgatggga

SEQ ID NO: 59840 - DNA, 20 bp, Artificial Sequence
  Description of Artificial Sequence: Synthetic oligonucleotide
  Target: ATXN1; (-) strand; PAM type: NRG; PAM sequence: GGG
gagagtgtaattacactgat

SEQ ID NO: 59841 - DNA, 20 bp, Artificial Sequence
  Description of Artificial Sequence: Synthetic oligonucleotide
  Target: ATXN1; (-) strand; PAM type: NRG; PAM sequence: TGG
ggagagtgtaattacactga

SEQ ID NO: 59842 - DNA, 20 bp, Artificial Sequence
  Description of Artificial Sequence: Synthetic oligonucleotide
  Target: ATXN1; (-) strand; PAM type: NRG; PAM sequence: GAG
atttggggcttgaagttgga

SEQ ID NO: 59843 - DNA, 20 bp, Artificial Sequence
  Description of Artificial Sequence: Synthetic oligonucleotide
  Target: ATXN1; (-) strand; PAM type: NRG; PAM sequence: GAG
tcatttggggcttgaagttg

SEQ ID NO: 59844 - DNA, 20 bp, Artificial Sequence
  Description of Artificial Sequence: Synthetic oligonucleotide
  Target: ATXN1; (-) strand; PAM type: NRG; PAM sequence: TGG
gatcatttggggcttgaagt

SEQ ID NO: 59845 - DNA, 20 bp, Artificial Sequence
  Description of Artificial Sequence: Synthetic oligonucleotide
  Target: ATXN1; (-) strand; PAM type: NRG; PAM sequence: AAG
ctatgatcatttggggcttg

SEQ ID NO: 59846 - DNA, 20 bp, Artificial Sequence
  Description of Artificial Sequence: Synthetic oligonucleotide
  Target: ATXN1; (-) strand; PAM type: NRG; PAM sequence: GGG
gaagttactatgatcatttg

SEQ ID NO: 59847 - DNA, 20 bp, Artificial Sequence
  Description of Artificial Sequence: Synthetic oligonucleotide
  Target: ATXN1; (-) strand; PAM type: NRG; PAM sequence: GGG
ggaagttactatgatcattt

SEQ ID NO: 59848 - DNA, 20 bp, Artificial Sequence
  Description of Artificial Sequence: Synthetic oligonucleotide
  Target: ATXN1; (-) strand; PAM type: NRG; PAM sequence: TGG
tggaagttactatgatcatt

SEQ ID NO: 59849 - DNA, 20 bp, Artificial Sequence
  Description of Artificial Sequence: Synthetic oligonucleotide
  Target: ATXN1; (-) strand; PAM type: NRG; PAM sequence: AAG
gagcggtttgggtgccttgg

SEQ ID NO: 59850 - DNA, 20 bp, Artificial Sequence
  Description of Artificial Sequence: Synthetic oligonucleotide
  Target: ATXN1; (-) strand; PAM type: NRG; PAM sequence: TGG
atagagcggtttgggtgcct

SEQ ID NO: 59851 - DNA, 20 bp, Artificial Sequence
  Description of Artificial Sequence: Synthetic oligonucleotide
  Target: ATXN1; (-) strand; PAM type: NRG; PAM sequence: GGG
ccatctgaatagagcggttt

SEQ ID NO: 59852 - DNA, 20 bp, Artificial Sequence
  Description of Artificial Sequence: Synthetic oligonucleotide
  Target: ATXN1; (-) strand; PAM type: NRG; PAM sequence: TGG
gccatctgaatagagcggtt

SEQ ID NO: 59853 - DNA, 20 bp, Artificial Sequence
  Description of Artificial Sequence: Synthetic oligonucleotide
  Target: ATXN1; (-) strand; PAM type: NRG; PAM sequence: CGG
gacaagccatctgaatagag

SEQ ID NO: 59854 - DNA, 20 bp, Artificial Sequence
  Description of Artificial Sequence: Synthetic oligonucleotide
  Target: ATXN1; (-) strand; PAM type: NRG; PAM sequence: GAG
gcggacaagccatctgaata

SEQ ID NO: 59855 - DNA, 20 bp, Artificial Sequence
  Description of Artificial Sequence: Synthetic oligonucleotide
  Target: ATXN1; (-) strand; PAM type: NRG; PAM sequence: TAG
aagcggacaagccatctgaa

SEQ ID NO: 59856 - DNA, 20 bp, Artificial Sequence
  Description of Artificial Sequence: Synthetic oligonucleotide
  Target: ATXN1; (-) strand; PAM type: NRG; PAM sequence: AAG
gggggccctgagaagcggac

SEQ ID NO: 59857 - DNA, 20 bp, Artificial Sequence
  Description of Artificial Sequence: Synthetic oligonucleotide
  Target: ATXN1; (-) strand; PAM type: NRG; PAM sequence: CGG
tttttgggggccctgagaag

SEQ ID NO: 59858 - DNA, 20 bp, Artificial Sequence
  Description of Artificial Sequence: Synthetic oligonucleotide
  Target: ATXN1; (-) strand; PAM type: NRG; PAM sequence: AAG
tgatttttgggggccctgag

SEQ ID NO: 59859 - DNA, 20 bp, Artificial Sequence
  Description of Artificial Sequence: Synthetic oligonucleotide
  Target: ATXN1; (-) strand; PAM type: NRG; PAM sequence: GAG
tgatgatttttgggggccct

SEQ ID NO: 59860 - DNA, 20 bp, Artificial Sequence
  Description of Artificial Sequence: Synthetic oligonucleotide
  Target: ATXN1; (-) strand; PAM type: NRG; PAM sequence: GGG
gaggaggtgatgatttttgg

SEQ ID NO: 59861 - DNA, 20 bp, Artificial Sequence
  Description of Artificial Sequence: Synthetic oligonucleotide
  Target: ATXN1; (-) strand; PAM type: NRG; PAM sequence: GGG
ggaggaggtgatgatttttg

SEQ ID NO: 59862 - DNA, 20 bp, Artificial Sequence
  Description of Artificial Sequence: Synthetic oligonucleotide
  Target: ATXN1; (-) strand; PAM type: NRG; PAM sequence: GGG
gggaggaggtgatgattttt

SEQ ID NO: 59863 - DNA, 20 bp, Artificial Sequence
  Description of Artificial Sequence: Synthetic oligonucleotide
  Target: ATXN1; (-) strand; PAM type: NRG; PAM sequence: TGG
agggaggaggtgatgatttt

SEQ ID NO: 59864 - DNA, 20 bp, Artificial Sequence
  Description of Artificial Sequence: Synthetic oligonucleotide
  Target: ATXN1; (-) strand; PAM type: NRG; PAM sequence: AGG
ctgtttgttaagcagggagg

SEQ ID NO: 59865 - DNA, 20 bp, Artificial Sequence
  Description of Artificial Sequence: Synthetic oligonucleotide
  Target: ATXN1; (-) strand; PAM type: NRG; PAM sequence: GAG
actgtttgttaagcagggag

SEQ ID NO: 59866 - DNA, 20 bp, Artificial Sequence
  Description of Artificial Sequence: Synthetic oligonucleotide
  Target: ATXN1; (-) strand; PAM type: NRG; PAM sequence: AGG
ggactgtttgttaagcaggg

SEQ ID NO: 59867 - DNA, 20 bp, Artificial Sequence
  Description of Artificial Sequence: Synthetic oligonucleotide
  Target: ATXN1; (-) strand; PAM type: NRG; PAM sequence: GAG
tggactgtttgttaagcagg

SEQ ID NO: 59868 - DNA, 20 bp, Artificial Sequence
  Description of Artificial Sequence: Synthetic oligonucleotide
  Target: ATXN1; (-) strand; PAM type: NRG; PAM sequence: GGG
cctggactgtttgttaagca

SEQ ID NO: 59869 - DNA, 20 bp, Artificial Sequence
  Description of Artificial Sequence: Synthetic oligonucleotide
  Target: ATXN1; (-) strand; PAM type: NRG; PAM sequence: AGG
acctggactgtttgttaagc

SEQ ID NO: 59870 - DNA, 20 bp, Artificial Sequence
  Description of Artificial Sequence: Synthetic oligonucleotide
  Target: ATXN1; (-) strand; PAM type: NRG; PAM sequence: CAG
aacctggactgtttgttaag

SEQ ID NO: 59871 - DNA, 20 bp, Artificial Sequence
  Description of Artificial Sequence: Synthetic oligonucleotide
  Target: ATXN1; (-) strand; PAM type: NRG; PAM sequence: AAG
caaaacctggactgtttgtt

SEQ ID NO: 59872 - DNA, 20 bp, Artificial Sequence
  Description of Artificial Sequence: Synthetic oligonucleotide
  Target: ATXN1; (-) strand; PAM type: NRG; PAM sequence: TGG
atgtttgccattacaaaacc

SEQ ID NO: 59873 - DNA, 20 bp, Artificial Sequence
  Description of Artificial Sequence: Synthetic oligonucleotide
  Target: ATXN1; (-) strand; PAM type: NRG; PAM sequence: GAG
ggggtgaatagtcatacagg

SEQ ID NO: 59874 - DNA, 20 bp, Artificial Sequence
  Description of Artificial Sequence: Synthetic oligonucleotide
  Target: ATXN1; (-) strand; PAM type: NRG; PAM sequence: GGG
caggggtgaatagtcataca

SEQ ID NO: 59875 - DNA, 20 bp, Artificial Sequence
  Description of Artificial Sequence: Synthetic oligonucleotide
  Target: ATXN1; (-) strand; PAM type: NRG; PAM sequence: AGG
ccaggggtgaatagtcatac

SEQ ID NO: 59876 - DNA, 20 bp, Artificial Sequence
  Description of Artificial Sequence: Synthetic oligonucleotide
  Target: ATXN1; (-) strand; PAM type: NRG; PAM sequence: CAG
tccaggggtgaatagtcata

SEQ ID NO: 59877 - DNA, 20 bp, Artificial Sequence
  Description of Artificial Sequence: Synthetic oligonucleotide
  Target: ATXN1; (-) strand; PAM type: NRG; PAM sequence: TAG
gcagggggtccaggggtgaa

SEQ ID NO: 59878 - DNA, 20 bp, Artificial Sequence
  Description of Artificial Sequence: Synthetic oligonucleotide
  Target: ATXN1; (-) strand; PAM type: NRG; PAM sequence: GGG
tgctgctgcagggggtccag

SEQ ID NO: 59879 - DNA, 20 bp, Artificial Sequence
  Description of Artificial Sequence: Synthetic oligonucleotide
  Target: ATXN1; (-) strand; PAM type: NRG; PAM sequence: GGG
gtgctgctgcagggggtcca

SEQ ID NO: 59880 - DNA, 20 bp, Artificial Sequence
  Description of Artificial Sequence: Synthetic oligonucleotide
  Target: ATXN1; (-) strand; PAM type: NRG; PAM sequence: AGG
ggtgctgctgcagggggtcc

SEQ ID NO: 59881 - DNA, 20 bp, Artificial Sequence
  Description of Artificial Sequence: Synthetic oligonucleotide
  Target: ATXN1; (-) strand; PAM type: NRG; PAM sequence: CAG
gggtgctgctgcagggggtc

SEQ ID NO: 59882 - DNA, 20 bp, Artificial Sequence
  Description of Artificial Sequence: Synthetic oligonucleotide
  Target: ATXN1; (-) strand; PAM type: NRG; PAM sequence: GGG
ggtgggggtgctgctgcagg

SEQ ID NO: 59883 - DNA, 20 bp, Artificial Sequence
  Description of Artificial Sequence: Synthetic oligonucleotide
  Target: ATXN1; (-) strand; PAM type: NRG; PAM sequence: GGG
tggtgggggtgctgctgcag

SEQ ID NO: 59884 - DNA, 20 bp, Artificial Sequence
  Description of Artificial Sequence: Synthetic oligonucleotide
  Target: ATXN1; (-) strand; PAM type: NRG; PAM sequence: GGG
gtggtgggggtgctgctgca

SEQ ID NO: 59885 - DNA, 20 bp, Artificial Sequence
  Description of Artificial Sequence: Synthetic oligonucleotide
  Target: ATXN1; (-) strand; PAM type: NRG; PAM sequence: AGG
agtggtgggggtgctgctgc

SEQ ID NO: 59886 - DNA, 20 bp, Artificial Sequence
  Description of Artificial Sequence: Synthetic oligonucleotide
  Target: ATXN1; (-) strand; PAM type: NRG; PAM sequence: CAG
tagtggtgggggtgctgctg

SEQ ID NO: 59887 - DNA, 20 bp, Artificial Sequence
  Description of Artificial Sequence: Synthetic oligonucleotide
  Target: ATXN1; (-) strand; PAM type: NRG; PAM sequence: GGG
aaggtattccttagtggtgg

SEQ ID NO: 59888 - DNA, 20 bp, Artificial Sequence
  Description of Artificial Sequence: Synthetic oligonucleotide
  Target: ATXN1; (-) strand; PAM type: NRG; PAM sequence: GGG
gaaggtattccttagtggtg

SEQ ID NO: 59889 - DNA, 20 bp, Artificial Sequence
  Description of Artificial Sequence: Synthetic oligonucleotide
  Target: ATXN1; (-) strand; PAM type: NRG; PAM sequence: GGG
agaaggtattccttagtggt

SEQ ID NO: 59890 - DNA, 20 bp, Artificial Sequence
  Description of Artificial Sequence: Synthetic oligonucleotide
  Target: ATXN1; (-) strand; PAM type: NRG; PAM sequence: TGG
gagaaggtattccttagtgg

SEQ ID NO: 59891 - DNA, 20 bp, Artificial Sequence
  Description of Artificial Sequence: Synthetic oligonucleotide
  Target: ATXN1; (-) strand; PAM type: NRG; PAM sequence: TGG
gatgagaaggtattccttag

SEQ ID NO: 59892 - DNA, 20 bp, Artificial Sequence
  Description of Artificial Sequence: Synthetic oligonucleotide
  Target: ATXN1; (-) strand; PAM type: NRG; PAM sequence: TAG
gaggatgagaaggtattcct

SEQ ID NO: 59893 - DNA, 20 bp, Artificial Sequence
  Description of Artificial Sequence: Synthetic oligonucleotide
  Target: ATXN1; (-) strand; PAM type: NRG; PAM sequence: AGG
gattgaaagagaggatgaga

SEQ ID NO: 59894 - DNA, 20 bp, Artificial Sequence
  Description of Artificial Sequence: Synthetic oligonucleotide
  Target: ATXN1; (-) strand; PAM type: NRG; PAM sequence: AAG
tgattgaaagagaggatgag

SEQ ID NO: 59895 - DNA, 20 bp, Artificial Sequence
  Description of Artificial Sequence: Synthetic oligonucleotide
  Target: ATXN1; (-) strand; PAM type: NRG; PAM sequence: GAG
gagtgattgaaagagaggat

SEQ ID NO: 59896 - DNA, 20 bp, Artificial Sequence
  Description of Artificial Sequence: Synthetic oligonucleotide
  Target: ATXN1; (-) strand; PAM type: NRG; PAM sequence: AGG
caagagagtgattgaaagag

SEQ ID NO: 59897 - DNA, 20 bp, Artificial Sequence
  Description of Artificial Sequence: Synthetic oligonucleotide
  Target: ATXN1; (-) strand; PAM type: NRG; PAM sequence: GAG
tcaagagagtgattgaaaga

SEQ ID NO: 59898 - DNA, 20 bp, Artificial Sequence
  Description of Artificial Sequence: Synthetic oligonucleotide
  Target: ATXN1; (-) strand; PAM type: NRG; PAM sequence: GAG
attcaagagagtgattgaaa

SEQ ID NO: 59899 - DNA, 20 bp, Artificial Sequence
  Description of Artificial Sequence: Synthetic oligonucleotide
  Target: ATXN1; (-) strand; PAM type: NRG; PAM sequence: AAG
ccattcaagagagtgattga

SEQ ID NO: 59900 - DNA, 20 bp, Artificial Sequence
  Description of Artificial Sequence: Synthetic oligonucleotide
  Target: ATXN1; (-) strand; PAM type: NRG; PAM sequence: GAG
ctactaggaaccattcaaga

SEQ ID NO: 59901 - DNA, 20 bp, Artificial Sequence
  Description of Artificial Sequence: Synthetic oligonucleotide
  Target: ATXN1; (-) strand; PAM type: NRG; PAM sequence: GAG
atctactaggaaccattcaa

SEQ ID NO: 59902 - DNA, 20 bp, Artificial Sequence
  Description of Artificial Sequence: Synthetic oligonucleotide
  Target: ATXN1; (-) strand; PAM type: NRG; PAM sequence: AAG
gtatctactaggaaccattc

SEQ ID NO: 59903 - DNA, 20 bp, Artificial Sequence
  Description of Artificial Sequence: Synthetic oligonucleotide
  Target: ATXN1; (-) strand; PAM type: NRG; PAM sequence: AGG
aaaactgttttgtatctact

SEQ ID NO: 59904 - DNA, 20 bp, Artificial Sequence
  Description of Artificial Sequence: Synthetic oligonucleotide
  Target: ATXN1; (-) strand; PAM type: NRG; PAM sequence: TAG
aaaaactgttttgtatctac

SEQ ID NO: 59905 - DNA, 20 bp, Artificial Sequence
  Description of Artificial Sequence: Synthetic oligonucleotide
  Target: ATXN1; (-) strand; PAM type: NRG; PAM sequence: GAG
tgtgctctattttcccattg

SEQ ID NO: 59906 - DNA, 20 bp, Artificial Sequence
  Description of Artificial Sequence: Synthetic oligonucleotide
  Target: ATXN1; (-) strand; PAM type: NRG; PAM sequence: TGG
cctgtgctctattttcccat

SEQ ID NO: 59907 - DNA, 20 bp, Artificial Sequence
  Description of Artificial Sequence: Synthetic oligonucleotide
  Target: ATXN1; (-) strand; PAM type: NRG; PAM sequence: GAG
aggggtgttgggagcaaact

SEQ ID NO: 59908 - DNA, 20 bp, Artificial Sequence
  Description of Artificial Sequence: Synthetic oligonucleotide
  Target: ATXN1; (-) strand; PAM type: NRG; PAM sequence: GAG
tggctggaaaggggtgttgg

SEQ ID NO: 59909 - DNA, 20 bp, Artificial Sequence
  Description of Artificial Sequence: Synthetic oligonucleotide
  Target: ATXN1; (-) strand; PAM type: NRG; PAM sequence: GGG
agtggctggaaaggggtgtt

SEQ ID NO: 59910 - DNA, 20 bp, Artificial Sequence
  Description of Artificial Sequence: Synthetic oligonucleotide
  Target: ATXN1; (-) strand; PAM type: NRG; PAM sequence: TGG
gagtggctggaaaggggtgt

SEQ ID NO: 59911 - DNA, 20 bp, Artificial Sequence
  Description of Artificial Sequence: Synthetic oligonucleotide
  Target: ATXN1; (-) strand; PAM type: NRG; PAM sequence: GGG
tctggtgagtggctggaaag

SEQ ID NO: 59912 - DNA, 20 bp, Artificial Sequence
  Description of Artificial Sequence: Synthetic oligonucleotide
  Target: ATXN1; (-) strand; PAM type: NRG; PAM sequence: GGG
gtctggtgagtggctggaaa

SEQ ID NO: 59913 - DNA, 20 bp, Artificial Sequence
  Description of Artificial Sequence: Synthetic oligonucleotide
  Target: ATXN1; (-) strand; PAM type: NRG; PAM sequence: AGG
agtctggtgagtggctggaa

SEQ ID NO: 59914 - DNA, 20 bp, Artificial Sequence
  Description of Artificial Sequence: Synthetic oligonucleotide
  Target: ATXN1; (-) strand; PAM type: NRG; PAM sequence: AAG
tagtctggtgagtggctgga

SEQ ID NO: 59915 - DNA, 20 bp, Artificial Sequence
  Description of Artificial Sequence: Synthetic oligonucleotide
  Target: ATXN1; (-) strand; PAM type: NRG; PAM sequence: TGG
aaggtagtctggtgagtggc

SEQ ID NO: 59916 - DNA, 20 bp, Artificial Sequence
  Description of Artificial Sequence: Synthetic oligonucleotide
  Target: ATXN1; (-) strand; PAM type: NRG; PAM sequence: TGG
tgccaaggtagtctggtgag

SEQ ID NO: 59917 - DNA, 20 bp, Artificial Sequence
  Description of Artificial Sequence: Synthetic oligonucleotide
  Target: ATXN1; (-) strand; PAM type: NRG; PAM sequence: GAG
acttgccaaggtagtctggt

SEQ ID NO: 59918 - DNA, 20 bp, Artificial Sequence
  Description of Artificial Sequence: Synthetic oligonucleotide
  Target: ATXN1; (-) strand; PAM type: NRG; PAM sequence: TGG
gagtacttgccaaggtagtc

SEQ ID NO: 59919 - DNA, 20 bp, Artificial Sequence
  Description of Artificial Sequence: Synthetic oligonucleotide
  Target: ATXN1; (-) strand; PAM type: NRG; PAM sequence: TAG
tcctagagtacttgccaagg

SEQ ID NO: 59920 - DNA, 20 bp, Artificial Sequence
  Description of Artificial Sequence: Synthetic oligonucleotide
  Target: ATXN1; (-) strand; PAM type: NRG; PAM sequence: AGG
tactcctagagtacttgcca

SEQ ID NO: 59921 - DNA, 20 bp, Artificial Sequence
  Description of Artificial Sequence: Synthetic oligonucleotide
  Target: ATXN1; (-) strand; PAM type: NRG; PAM sequence: AAG
atactcctagagtacttgcc

SEQ ID NO: 59922 - DNA, 20 bp, Artificial Sequence
  Description of Artificial Sequence: Synthetic oligonucleotide
  Target: ATXN1; (-) strand; PAM type: NRG; PAM sequence: GAG
ttcattttcccatactccta

SEQ ID NO: 59923 - DNA, 20 bp, Artificial Sequence
  Description of Artificial Sequence: Synthetic oligonucleotide
  Target: ATXN1; (-) strand; PAM type: NRG; PAM sequence: TAG
ttttcattttcccatactcc

SEQ ID NO: 59924 - DNA, 20 bp, Artificial Sequence
  Description of Artificial Sequence: Synthetic oligonucleotide
  Target: ATXN1; (-) strand; PAM type: NRG; PAM sequence: GAG
tgtatgttaaaaaggtgtgt

SEQ ID NO: 59925 - DNA, 20 bp, Artificial Sequence
  Description of Artificial Sequence: Synthetic oligonucleotide
  Target: ATXN1; (-) strand; PAM type: NRG; PAM sequence: AGG
actggttgtgtatgttaaaa

SEQ ID NO: 59926 - DNA, 20 bp, Artificial Sequence
  Description of Artificial Sequence: Synthetic oligonucleotide
  Target: ATXN1; (-) strand; PAM type: NRG; PAM sequence: AAG
aactggttgtgtatgttaaa

SEQ ID NO: 59927 - DNA, 20 bp, Artificial Sequence
  Description of Artificial Sequence: Synthetic oligonucleotide
  Target: ATXN1; (-) strand; PAM type: NRG; PAM sequence: TGG
cttggctgggtagacagaac

SEQ ID NO: 59928 - DNA, 20 bp, Artificial Sequence
  Description of Artificial Sequence: Synthetic oligonucleotide
  Target: ATXN1; (-) strand; PAM type: NRG; PAM sequence: CAG
atatgccttggctgggtaga

SEQ ID NO: 59929 - DNA, 20 bp, Artificial Sequence
  Description of Artificial Sequence: Synthetic oligonucleotide
  Target: ATXN1; (-) strand; PAM type: NRG; PAM sequence: TAG
aagaatatgccttggctggg

SEQ ID NO: 59930 - DNA, 20 bp, Artificial Sequence
  Description of Artificial Sequence: Synthetic oligonucleotide
  Target: ATXN1; (-) strand; PAM type: NRG; PAM sequence: GGG
cataagaatatgccttggct

SEQ ID NO: 59931 - DNA, 20 bp, Artificial Sequence
  Description of Artificial Sequence: Synthetic oligonucleotide
  Target: ATXN1; (-) strand; PAM type: NRG; PAM sequence: TGG
acataagaatatgccttggc

SEQ ID NO: 59932 - DNA, 20 bp, Artificial Sequence
  Description of Artificial Sequence: Synthetic oligonucleotide
  Target: ATXN1; (-) strand; PAM type: NRG; PAM sequence: TGG
ttccacataagaatatgcct

SEQ ID NO: 59933 - DNA, 20 bp, Artificial Sequence
  Description of Artificial Sequence: Synthetic oligonucleotide
  Target: ATXN1; (-) strand; PAM type: NRG; PAM sequence: AAG
tgtaagttgaagttccacat

SEQ ID NO: 59934 - DNA, 20 bp, Artificial Sequence
  Description of Artificial Sequence: Synthetic oligonucleotide
  Target: ATXN1; (-) strand; PAM type: NRG; PAM sequence: AAG
ggggaggcagatgtaagttg

SEQ ID NO: 59935 - DNA, 20 bp, Artificial Sequence
  Description of Artificial Sequence: Synthetic oligonucleotide
  Target: ATXN1; (-) strand; PAM type: NRG; PAM sequence: AAG
gttagtggggaggcagatgt

SEQ ID NO: 59936 - DNA, 20 bp, Artificial Sequence
  Description of Artificial Sequence: Synthetic oligonucleotide
  Target: ATXN1; (-) strand; PAM type: NRG; PAM sequence: CAG
ctgtccagttagtggggagg

SEQ ID NO: 59937 - DNA, 20 bp, Artificial Sequence
  Description of Artificial Sequence: Synthetic oligonucleotide
  Target: ATXN1; (-) strand; PAM type: NRG; PAM sequence: AGG
tgcctgtccagttagtgggg

SEQ ID NO: 59938 - DNA, 20 bp, Artificial Sequence
  Description of Artificial Sequence: Synthetic oligonucleotide
  Target: ATXN1; (-) strand; PAM type: NRG; PAM sequence: GAG
gtgcctgtccagttagtggg

SEQ ID NO: 59939 - DNA, 20 bp, Artificial Sequence
  Description of Artificial Sequence: Synthetic oligonucleotide
  Target: ATXN1; (-) strand; PAM type: NRG; PAM sequence: GGG
aggtgcctgtccagttagtg

SEQ ID NO: 59940 - DNA, 20 bp, Artificial Sequence
  Description of Artificial Sequence: Synthetic oligonucleotide
  Target: ATXN1; (-) strand; PAM type: NRG; PAM sequence: GGG
caggtgcctgtccagttagt

SEQ ID NO: 59941 - DNA, 20 bp, Artificial Sequence
  Description of Artificial Sequence: Synthetic oligonucleotide
  Target: ATXN1; (-) strand; PAM type: NRG; PAM sequence: TGG
acaggtgcctgtccagttag

SEQ ID NO: 59942 - DNA, 20 bp, Artificial Sequence
  Description of Artificial Sequence: Synthetic oligonucleotide
  Target: ATXN1; (-) strand; PAM type: NRG; PAM sequence: TAG
ggtacaggtgcctgtccagt

SEQ ID NO: 59943 - DNA, 20 bp, Artificial Sequence
  Description of Artificial Sequence: Synthetic oligonucleotide
  Target: ATXN1; (-) strand; PAM type: NRG; PAM sequence: CAG
ctaaggtacaggtgcctgtc

SEQ ID NO: 59944 - DNA, 20 bp, Artificial Sequence
  Description of Artificial Sequence: Synthetic oligonucleotide
  Target: ATXN1; (-) strand; PAM type: NRG; PAM sequence: AGG
acttaggaagactaaggtac

SEQ ID NO: 59945 - DNA, 20 bp, Artificial Sequence
  Description of Artificial Sequence: Synthetic oligonucleotide
  Target: ATXN1; (-) strand; PAM type: NRG; PAM sequence: CAG
gacttaggaagactaaggta

SEQ ID NO: 59946 - DNA, 20 bp, Artificial Sequence
  Description of Artificial Sequence: Synthetic oligonucleotide
  Target: ATXN1; (-) strand; PAM type: NRG; PAM sequence: AGG
gttgggacttaggaagacta

SEQ ID NO: 59947 - DNA, 20 bp, Artificial Sequence
  Description of Artificial Sequence: Synthetic oligonucleotide
  Target: ATXN1; (-) strand; PAM type: NRG; PAM sequence: AAG
tgttgggacttaggaagact

SEQ ID NO: 59948 - DNA, 20 bp, Artificial Sequence
  Description of Artificial Sequence: Synthetic oligonucleotide
  Target: ATXN1; (-) strand; PAM type: NRG; PAM sequence: AAG
tgttaatgttgggacttagg

SEQ ID NO: 59949 - DNA, 20 bp, Artificial Sequence
  Description of Artificial Sequence: Synthetic oligonucleotide
  Target: ATXN1; (-) strand; PAM type: NRG; PAM sequence: AGG
taatgttaatgttgggactt

SEQ ID NO: 59950 - DNA, 20 bp, Artificial Sequence
  Description of Artificial Sequence: Synthetic oligonucleotide
  Target: ATXN1; (-) strand; PAM type: NRG; PAM sequence: TAG
gtaatgttaatgttgggact

SEQ ID NO: 59951 - DNA, 20 bp, Artificial Sequence
  Description of Artificial Sequence: Synthetic oligonucleotide
  Target: ATXN1; (-) strand; PAM type: NRG; PAM sequence: GGG
cctgcggtaatgttaatgtt

SEQ ID NO: 59952 - DNA, 20 bp, Artificial Sequence
  Description of Artificial Sequence: Synthetic oligonucleotide
  Target: ATXN1; (-) strand; PAM type: NRG; PAM sequence: TGG
tcctgcggtaatgttaatgt

SEQ ID NO: 59953 - DNA, 20 bp, Artificial Sequence
  Description of Artificial Sequence: Synthetic oligonucleotide
  Target: ATXN1; (-) strand; PAM type: NRG; PAM sequence: CGG
tgatagggtctgatttcctg

SEQ ID NO: 59954 - DNA, 20 bp, Artificial Sequence
  Description of Artificial Sequence: Synthetic oligonucleotide
  Target: ATXN1; (-) strand; PAM type: NRG; PAM sequence: GGG
agctttgaggggcactgata

SEQ ID NO: 59955 - DNA, 20 bp, Artificial Sequence
  Description of Artificial Sequence: Synthetic oligonucleotide
  Target: ATXN1; (-) strand; PAM type: NRG; PAM sequence: AGG
gagctttgaggggcactgat

SEQ ID NO: 59956 - DNA, 20 bp, Artificial Sequence
  Description of Artificial Sequence: Synthetic oligonucleotide
  Target: ATXN1; (-) strand; PAM type: NRG; PAM sequence: TAG
tgagctttgaggggcactga

SEQ ID NO: 59957 - DNA, 20 bp, Artificial Sequence
  Description of Artificial Sequence: Synthetic oligonucleotide
  Target: ATXN1; (-) strand; PAM type: NRG; PAM sequence: GGG
tgacggacctgagctttgag

SEQ ID NO: 59958 - DNA, 20 bp, Artificial Sequence
  Description of Artificial Sequence: Synthetic oligonucleotide
  Target: ATXN1; (-) strand; PAM type: NRG; PAM sequence: GGG
ctgacggacctgagctttga

SEQ ID NO: 59959 - DNA, 20 bp, Artificial Sequence
  Description of Artificial Sequence: Synthetic oligonucleotide
  Target: ATXN1; (-) strand; PAM type: NRG; PAM sequence: AGG
actgacggacctgagctttg

SEQ ID NO: 59960 - DNA, 20 bp, Artificial Sequence
  Description of Artificial Sequence: Synthetic oligonucleotide
  Target: ATXN1; (-) strand; PAM type: NRG; PAM sequence: GAG
tactgacggacctgagcttt

SEQ ID NO: 59961 - DNA, 20 bp, Artificial Sequence
  Description of Artificial Sequence: Synthetic oligonucleotide
  Target: ATXN1; (-) strand; PAM type: NRG; PAM sequence: GAG
ggccctgtactgacggacct

SEQ ID NO: 59962 - DNA, 20 bp, Artificial Sequence
  Description of Artificial Sequence: Synthetic oligonucleotide
  Target: ATXN1; (-) strand; PAM type: NRG; PAM sequence: CGG
gttgtatggccctgtactga

SEQ ID NO: 59963 - DNA, 20 bp, Artificial Sequence
  Description of Artificial Sequence: Synthetic oligonucleotide
  Target: ATXN1; (-) strand; PAM type: NRG; PAM sequence: TGG
aagtaggggtattagttgta

SEQ ID NO: 59964 - DNA, 20 bp, Artificial Sequence
  Description of Artificial Sequence: Synthetic oligonucleotide
  Target: ATXN1; (-) strand; PAM type: NRG; PAM sequence: TAG
aaccgtataagtaggggtat

SEQ ID NO: 59965 - DNA, 20 bp, Artificial Sequence
  Description of Artificial Sequence: Synthetic oligonucleotide
  Target: ATXN1; (-) strand; PAM type: NRG; PAM sequence: GGG
attcttaaccgtataagtag

SEQ ID NO: 59966 - DNA, 20 bp, Artificial Sequence
  Description of Artificial Sequence: Synthetic oligonucleotide
  Target: ATXN1; (-) strand; PAM type: NRG; PAM sequence: GGG
tattcttaaccgtataagta

SEQ ID NO: 59967 - DNA, 20 bp, Artificial Sequence
  Description of Artificial Sequence: Synthetic oligonucleotide
  Target: ATXN1; (-) strand; PAM type: NRG; PAM sequence: AGG
ctattcttaaccgtataagt

SEQ ID NO: 59968 - DNA, 20 bp, Artificial Sequence
  Description of Artificial Sequence: Synthetic oligonucleotide
  Target: ATXN1; (-) strand; PAM type: NRG; PAM sequence: TAG
gctattcttaaccgtataag

SEQ ID NO: 59969 - DNA, 20 bp, Artificial Sequence
  Description of Artificial Sequence: Synthetic oligonucleotide
  Target: ATXN1; (-) strand; PAM type: NRG; PAM sequence: AAG
gtggctattcttaaccgtat

SEQ ID NO: 59970 - DNA, 20 bp, Artificial Sequence
  Description of Artificial Sequence: Synthetic oligonucleotide
  Target: ATXN1; (-) strand; PAM type: NRG; PAM sequence: TGG
tattctggttcctgtagcag

SEQ ID NO: 59971 - DNA, 20 bp, Artificial Sequence
  Description of Artificial Sequence: Synthetic oligonucleotide
  Target: ATXN1; (-) strand; PAM type: NRG; PAM sequence: CAG
ggctattctggttcctgtag

SEQ ID NO: 59972 - DNA, 20 bp, Artificial Sequence
  Description of Artificial Sequence: Synthetic oligonucleotide
  Target: ATXN1; (-) strand; PAM type: NRG; PAM sequence: TAG
actggctattctggttcctg

SEQ ID NO: 59973 - DNA, 20 bp, Artificial Sequence
  Description of Artificial Sequence: Synthetic oligonucleotide
  Target: ATXN1; (-) strand; PAM type: NRG; PAM sequence: TGG
agtagataaactggctattc

SEQ ID NO: 59974 - DNA, 20 bp, Artificial Sequence
  Description of Artificial Sequence: Synthetic oligonucleotide
  Target: ATXN1; (-) strand; PAM type: NRG; PAM sequence: TGG
ggataatgaagtagataaac

SEQ ID NO: 59975 - DNA, 20 bp, Artificial Sequence
  Description of Artificial Sequence: Synthetic oligonucleotide
  Target: ATXN1; (-) strand; PAM type: NRG; PAM sequence: TAG
gtggtagtaggataatgaag

SEQ ID NO: 59976 - DNA, 20 bp, Artificial Sequence
  Description of Artificial Sequence: Synthetic oligonucleotide
  Target: ATXN1; (-) strand; PAM type: NRG; PAM sequence: AAG
tgtgtggtagtaggataatg

SEQ ID NO: 59977 - DNA, 20 bp, Artificial Sequence
  Description of Artificial Sequence: Synthetic oligonucleotide
  Target: ATXN1; (-) strand; PAM type: NRG; PAM sequence: AGG
ctttgagagtgtgtggtagt

SEQ ID NO: 59978 - DNA, 20 bp, Artificial Sequence
  Description of Artificial Sequence: Synthetic oligonucleotide
  Target: ATXN1; (-) strand; PAM type: NRG; PAM sequence: TAG
cctttgagagtgtgtggtag

SEQ ID NO: 59979 - DNA, 20 bp, Artificial Sequence
  Description of Artificial Sequence: Synthetic oligonucleotide
  Target: ATXN1; (-) strand; PAM type: NRG; PAM sequence: TAG
aatcctttgagagtgtgtgg

SEQ ID NO: 59980 - DNA, 20 bp, Artificial Sequence
  Description of Artificial Sequence: Synthetic oligonucleotide
  Target: ATXN1; (-) strand; PAM type: NRG; PAM sequence: TGG
agaaatcctttgagagtgtg

SEQ ID NO: 59981 - DNA, 20 bp, Artificial Sequence
  Description of Artificial Sequence: Synthetic oligonucleotide
  Target: ATXN1; (-) strand; PAM type: NRG; PAM sequence: GAG
tgtcttgagaaatcctttga

SEQ ID NO: 59982 - DNA, 20 bp, Artificial Sequence
  Description of Artificial Sequence: Synthetic oligonucleotide
  Target: ATXN1; (-) strand; PAM type: NRG; PAM sequence: GAG
actgtcttgagaaatccttt

SEQ ID NO: 59983 - DNA, 20 bp, Artificial Sequence
  Description of Artificial Sequence: Synthetic oligonucleotide
  Target: ATXN1; (-) strand; PAM type: NRG; PAM sequence: GAG
tatttcttgcaaactgtctt

SEQ ID NO: 59984 - DNA, 20 bp, Artificial Sequence
  Description of Artificial Sequence: Synthetic oligonucleotide
  Target: ATXN1; (-) strand; PAM type: NRG; PAM sequence: TAG
ttgggattgcagagtaagga

SEQ ID NO: 59985 - DNA, 20 bp, Artificial Sequence
  Description of Artificial Sequence: Synthetic oligonucleotide
  Target: ATXN1; (-) strand; PAM type: NRG; PAM sequence: AGG
ctatttgggattgcagagta

SEQ ID NO: 59986 - DNA, 20 bp, Artificial Sequence
  Description of Artificial Sequence: Synthetic oligonucleotide
  Target: ATXN1; (-) strand; PAM type: NRG; PAM sequence: AAG
tctatttgggattgcagagt

SEQ ID NO: 59987 - DNA, 20 bp, Artificial Sequence
  Description of Artificial Sequence: Synthetic oligonucleotide
  Target: ATXN1; (-) strand; PAM type: NRG; PAM sequence: GAG
agagtctatttgggattgca

SEQ ID NO: 59988 - DNA, 20 bp, Artificial Sequence
  Description of Artificial Sequence: Synthetic oligonucleotide
  Target: ATXN1; (-) strand; PAM type: NRG; PAM sequence: CAG
aaagagtctatttgggattg

SEQ ID NO: 59989 - DNA, 20 bp, Artificial Sequence
  Description of Artificial Sequence: Synthetic oligonucleotide
  Target: ATXN1; (-) strand; PAM type: NRG; PAM sequence: GGG
tactgccaaagagtctattt

SEQ ID NO: 59990 - DNA, 20 bp, Artificial Sequence
  Description of Artificial Sequence: Synthetic oligonucleotide
  Target: ATXN1; (-) strand; PAM type: NRG; PAM sequence: TGG
ctactgccaaagagtctatt

SEQ ID NO: 59991 - DNA, 20 bp, Artificial Sequence
  Description of Artificial Sequence: Synthetic oligonucleotide
  Target: ATXN1; (-) strand; PAM type: NRG; PAM sequence: GAG
ggatattcactactgccaaa

SEQ ID NO: 59992 - DNA, 20 bp, Artificial Sequence
  Description of Artificial Sequence: Synthetic oligonucleotide
  Target: ATXN1; (-) strand; PAM type: NRG; PAM sequence: AAG
ttggatattcactactgcca

SEQ ID NO: 59993 - DNA, 20 bp, Artificial Sequence
  Description of Artificial Sequence: Synthetic oligonucleotide
  Target: ATXN1; (-) strand; PAM type: NRG; PAM sequence: TGG
ggtctaggccttggcggttt

SEQ ID NO: 59994 - DNA, 20 bp, Artificial Sequence
  Description of Artificial Sequence: Synthetic oligonucleotide
  Target: ATXN1; (-) strand; PAM type: NRG; PAM sequence: CGG
tgaggaggtctaggccttgg

SEQ ID NO: 59995 - DNA, 20 bp, Artificial Sequence
  Description of Artificial Sequence: Synthetic oligonucleotide
  Target: ATXN1; (-) strand; PAM type: NRG; PAM sequence: TGG
cagtgaggaggtctaggcct

SEQ ID NO: 59996 - DNA, 20 bp, Artificial Sequence
  Description of Artificial Sequence: Synthetic oligonucleotide
  Target: ATXN1; (-) strand; PAM type: NRG; PAM sequence: AGG
tctcagcagtgaggaggtct

SEQ ID NO: 59997 - DNA, 20 bp, Artificial Sequence
  Description of Artificial Sequence: Synthetic oligonucleotide
  Target: ATXN1; (-) strand; PAM type: NRG; PAM sequence: TAG
ttctcagcagtgaggaggtc

SEQ ID NO: 59998 - DNA, 20 bp, Artificial Sequence
  Description of Artificial Sequence: Synthetic oligonucleotide
  Target: ATXN1; (-) strand; PAM type: NRG; PAM sequence: AGG
ttcctttctcagcagtgagg

SEQ ID NO: 59999 - DNA, 20 bp, Artificial Sequence
  Description of Artificial Sequence: Synthetic oligonucleotide
  Target: ATXN1; (-) strand; PAM type: NRG; PAM sequence: GAG
cttcctttctcagcagtgag

SEQ ID NO: 60000 - DNA, 20 bp, Artificial Sequence
  Description of Artificial Sequence: Synthetic oligonucleotide
  Target: ATXN1; (-) strand; PAM type: NRG; PAM sequence: AGG
gtcttcctttctcagcagtg

SEQ ID NO: 60001 - DNA, 20 bp, Artificial Sequence
  Description of Artificial Sequence: Synthetic oligonucleotide
  Target: ATXN1; (-) strand; PAM type: NRG; PAM sequence: GAG
agtcttcctttctcagcagt

SEQ ID NO: 60002 - DNA, 20 bp, Artificial Sequence
  Description of Artificial Sequence: Synthetic oligonucleotide
  Target: ATXN1; (-) strand; PAM type: NRG; PAM sequence: CAG
gcagagtcttcctttctcag

SEQ ID NO: 60003 - DNA, 20 bp, Artificial Sequence
  Description of Artificial Sequence: Synthetic oligonucleotide
  Target: ATXN1; (-) strand; PAM type: NRG; PAM sequence: CAG
ggtgcagagtcttcctttct

SEQ ID NO: 60004 - DNA, 20 bp, Artificial Sequence
  Description of Artificial Sequence: Synthetic oligonucleotide
  Target: ATXN1; (-) strand; PAM type: NRG; PAM sequence: GAG
tcttctcctaagaaggtgca

SEQ ID NO: 60005 - DNA, 20 bp, Artificial Sequence
  Description of Artificial Sequence: Synthetic oligonucleotide
  Target: ATXN1; (-) strand; PAM type: NRG; PAM sequence: CAG
agtcttctcctaagaaggtg

SEQ ID NO: 60006 - DNA, 20 bp, Artificial Sequence
  Description of Artificial Sequence: Synthetic oligonucleotide
  Target: ATXN1; (-) strand; PAM type: NRG; PAM sequence: AGG
acaacagtcttctcctaaga

SEQ ID NO: 60007 - DNA, 20 bp, Artificial Sequence
  Description of Artificial Sequence: Synthetic oligonucleotide
  Target: ATXN1; (-) strand; PAM type: NRG; PAM sequence: AAG
aacaacagtcttctcctaag

SEQ ID NO: 60008 - DNA, 20 bp, Artificial Sequence
  Description of Artificial Sequence: Synthetic oligonucleotide
  Target: ATXN1; (-) strand; PAM type: NRG; PAM sequence: AAG
aaaaacaacagtcttctcct

SEQ ID NO: 60009 - DNA, 20 bp, Artificial Sequence
  Description of Artificial Sequence: Synthetic oligonucleotide
  Target: ATXN1; (-) strand; PAM type: NRG; PAM sequence: CAG
agtggttagtgtaaaaacaa

SEQ ID NO: 60010 - DNA, 20 bp, Artificial Sequence
  Description of Artificial Sequence: Synthetic oligonucleotide
  Target: ATXN1; (-) strand; PAM type: NRG; PAM sequence: TAG
ttgtactatccctgagtggt

SEQ ID NO: 60011 - DNA, 20 bp, Artificial Sequence
  Description of Artificial Sequence: Synthetic oligonucleotide
  Target: ATXN1; (-) strand; PAM type: NRG; PAM sequence: TGG
catcttgtactatccctgag

SEQ ID NO: 60012 - DNA, 20 bp, Artificial Sequence
  Description of Artificial Sequence: Synthetic oligonucleotide
  Target: ATXN1; (-) strand; PAM type: NRG; PAM sequence: GAG
cagcatcttgtactatccct

SEQ ID NO: 60013 - DNA, 20 bp, Artificial Sequence
  Description of Artificial Sequence: Synthetic oligonucleotide
  Target: ATXN1; (-) strand; PAM type: NRG; PAM sequence: CAG
cttttcctgtaactgctggg

SEQ ID NO: 60014 - DNA, 20 bp, Artificial Sequence
  Description of Artificial Sequence: Synthetic oligonucleotide
  Target: ATXN1; (-) strand; PAM type: NRG; PAM sequence: GGG
agccttttcctgtaactgct

SEQ ID NO: 60015 - DNA, 20 bp, Artificial Sequence
  Description of Artificial Sequence: Synthetic oligonucleotide
  Target: ATXN1; (-) strand; PAM type: NRG; PAM sequence: TGG
aagccttttcctgtaactgc

SEQ ID NO: 60016 - DNA, 20 bp, Artificial Sequence
  Description of Artificial Sequence: Synthetic oligonucleotide
  Target: ATXN1; (-) strand; PAM type: NRG; PAM sequence: AAG
aaggcattgtctgatttcag

SEQ ID NO: 60017 - DNA, 20 bp, Artificial Sequence
  Description of Artificial Sequence: Synthetic oligonucleotide
  Target: ATXN1; (-) strand; PAM type: NRG; PAM sequence: CAG
tgaaaggcattgtctgattt

SEQ ID NO: 60018 - DNA, 20 bp, Artificial Sequence
  Description of Artificial Sequence: Synthetic oligonucleotide
  Target: ATXN1; (-) strand; PAM type: NRG; PAM sequence: AGG
ggttggtataagagtttgaa

SEQ ID NO: 60019 - DNA, 20 bp, Artificial Sequence
  Description of Artificial Sequence: Synthetic oligonucleotide
  Target: ATXN1; (-) strand; PAM type: NRG; PAM sequence: AAG
aggttggtataagagtttga

SEQ ID NO: 60020 - DNA, 20 bp, Artificial Sequence
  Description of Artificial Sequence: Synthetic oligonucleotide
  Target: ATXN1; (-) strand; PAM type: NRG; PAM sequence: GAG
aactctagaggttggtataa

SEQ ID NO: 60021 - DNA, 20 bp, Artificial Sequence
  Description of Artificial Sequence: Synthetic oligonucleotide
  Target: ATXN1; (-) strand; PAM type: NRG; PAM sequence: AAG
ccaactctagaggttggtat

SEQ ID NO: 60022 - DNA, 20 bp, Artificial Sequence
  Description of Artificial Sequence: Synthetic oligonucleotide
  Target: ATXN1; (-) strand; PAM type: NRG; PAM sequence: TGG
tgttgcccaactctagaggt

SEQ ID NO: 60023 - DNA, 20 bp, Artificial Sequence
  Description of Artificial Sequence: Synthetic oligonucleotide
  Target: ATXN1; (-) strand; PAM type: NRG; PAM sequence: AGG
accatgttgcccaactctag

SEQ ID NO: 60024 - DNA, 20 bp, Artificial Sequence
  Description of Artificial Sequence: Synthetic oligonucleotide
  Target: ATXN1; (-) strand; PAM type: NRG; PAM sequence: GAG
aaccatgttgcccaactcta

SEQ ID NO: 60025 - DNA, 20 bp, Artificial Sequence
  Description of Artificial Sequence: Synthetic oligonucleotide
  Target: ATXN1; (-) strand; PAM type: NRG; PAM sequence: TAG
gaaaccatgttgcccaactc

SEQ ID NO: 60026 - DNA, 20 bp, Artificial Sequence
  Description of Artificial Sequence: Synthetic oligonucleotide
  Target: ATXN1; (-) strand; PAM type: NRG; PAM sequence: GAG
gtcatgggacgtagaaaggg

SEQ ID NO: 60027 - DNA, 20 bp, Artificial Sequence
  Description of Artificial Sequence: Synthetic oligonucleotide
  Target: ATXN1; (-) strand; PAM type: NRG; PAM sequence: GGG
ctgtcatgggacgtagaaag

SEQ ID NO: 60028 - DNA, 20 bp, Artificial Sequence
  Description of Artificial Sequence: Synthetic oligonucleotide
  Target: ATXN1; (-) strand; PAM type: NRG; PAM sequence: GGG
gctgtcatgggacgtagaaa

SEQ ID NO: 60029 - DNA, 20 bp, Artificial Sequence
  Description of Artificial Sequence: Synthetic oligonucleotide
  Target: ATXN1; (-) strand; PAM type: NRG; PAM sequence: AGG
ggctgtcatgggacgtagaa

SEQ ID NO: 60030 - DNA, 20 bp, Artificial Sequence
  Description of Artificial Sequence: Synthetic oligonucleotide
  Target: ATXN1; (-) strand; PAM type: NRG; PAM sequence: AAG
tggctgtcatgggacgtaga

SEQ ID NO: 60031 - DNA, 20 bp, Artificial Sequence
  Description of Artificial Sequence: Synthetic oligonucleotide
  Target: ATXN1; (-) strand; PAM type: NRG; PAM sequence: TAG
aagatggctgtcatgggacg

SEQ ID NO: 60032 - DNA, 20 bp, Artificial Sequence
  Description of Artificial Sequence: Synthetic oligonucleotide
  Target: ATXN1; (-) strand; PAM type: NRG; PAM sequence: GGG
aatagcaagatggctgtcat

SEQ ID NO: 60033 - DNA, 20 bp, Artificial Sequence
  Description of Artificial Sequence: Synthetic oligonucleotide
  Target: ATXN1; (-) strand; PAM type: NRG; PAM sequence: TGG
taatagcaagatggctgtca

SEQ ID NO: 60034 - DNA, 20 bp, Artificial Sequence
  Description of Artificial Sequence: Synthetic oligonucleotide
  Target: ATXN1; (-) strand; PAM type: NRG; PAM sequence: TGG
gaaggtgagtaatagcaaga

SEQ ID NO: 60035 - DNA, 20 bp, Artificial Sequence
  Description of Artificial Sequence: Synthetic oligonucleotide
  Target: ATXN1; (-) strand; PAM type: NRG; PAM sequence: AAG
gcccgaaggtgagtaatagc

SEQ ID NO: 60036 - DNA, 20 bp, Artificial Sequence
  Description of Artificial Sequence: Synthetic oligonucleotide
  Target: ATXN1; (-) strand; PAM type: NRG; PAM sequence: TAG
cagggcccgaaggtgagtaa

SEQ ID NO: 60037 - DNA, 20 bp, Artificial Sequence
  Description of Artificial Sequence: Synthetic oligonucleotide
  Target: ATXN1; (-) strand; PAM type: NRG; PAM sequence: GAG
aaaacacagggcccgaaggt

SEQ ID NO: 60038 - DNA, 20 bp, Artificial Sequence
  Description of Artificial Sequence: Synthetic oligonucleotide
  Target: ATXN1; (-) strand; PAM type: NRG; PAM sequence: AGG
gttaaaaacacagggcccga

SEQ ID NO: 60039 - DNA, 20 bp, Artificial Sequence
  Description of Artificial Sequence: Synthetic oligonucleotide
  Target: ATXN1; (-) strand; PAM type: NRG; PAM sequence: AAG
ggttaaaaacacagggcccg

SEQ ID NO: 60040 - DNA, 20 bp, Artificial Sequence
  Description of Artificial Sequence: Synthetic oligonucleotide
  Target: ATXN1; (-) strand; PAM type: NRG; PAM sequence: GGG
acaaagaggttaaaaacaca

SEQ ID NO: 60041 - DNA, 20 bp, Artificial Sequence
  Description of Artificial Sequence: Synthetic oligonucleotide
  Target: ATXN1; (-) strand; PAM type: NRG; PAM sequence: AGG
gacaaagaggttaaaaacac

SEQ ID NO: 60042 - DNA, 20 bp, Artificial Sequence
  Description of Artificial Sequence: Synthetic oligonucleotide
  Target: ATXN1; (-) strand; PAM type: NRG; PAM sequence: CAG
tgacaaagaggttaaaaaca

SEQ ID NO: 60043 - DNA, 20 bp, Artificial Sequence
  Description of Artificial Sequence: Synthetic oligonucleotide
  Target: ATXN1; (-) strand; PAM type: NRG; PAM sequence: AGG
aggaaacaaatttgacaaag

SEQ ID NO: 60044 - DNA, 20 bp, Artificial Sequence
  Description of Artificial Sequence: Synthetic oligonucleotide
  Target: ATXN1; (-) strand; PAM type: NRG; PAM sequence: GAG
gaggaaacaaatttgacaaa

SEQ ID NO: 60045 - DNA, 20 bp, Artificial Sequence
  Description of Artificial Sequence: Synthetic oligonucleotide
  Target: ATXN1; (-) strand; PAM type: NRG; PAM sequence: AAG
tggaggaaacaaatttgaca

SEQ ID NO: 60046 - DNA, 20 bp, Artificial Sequence
  Description of Artificial Sequence: Synthetic oligonucleotide
  Target: ATXN1; (-) strand; PAM type: NRG; PAM sequence: AGG
cttgatggtatcgatcctgg

SEQ ID NO: 60047 - DNA, 20 bp, Artificial Sequence
  Description of Artificial Sequence: Synthetic oligonucleotide
  Target: ATXN1; (-) strand; PAM type: NRG; PAM sequence: GAG
gcttgatggtatcgatcctg

SEQ ID NO: 60048 - DNA, 20 bp, Artificial Sequence
  Description of Artificial Sequence: Synthetic oligonucleotide
  Target: ATXN1; (-) strand; PAM type: NRG; PAM sequence: TGG
tagcttgatggtatcgatcc

SEQ ID NO: 60049 - DNA, 20 bp, Artificial Sequence
  Description of Artificial Sequence: Synthetic oligonucleotide
  Target: ATXN1; (-) strand; PAM type: NRG; PAM sequence: TGG
taagaccatctgtagcttga

SEQ ID NO: 60050 - DNA, 20 bp, Artificial Sequence
  Description of Artificial Sequence: Synthetic oligonucleotide
  Target: ATXN1; (-) strand; PAM type: NRG; PAM sequence: TAG
tccatttgtaagaccatctg

SEQ ID NO: 60051 - DNA, 20 bp, Artificial Sequence
  Description of Artificial Sequence: Synthetic oligonucleotide
  Target: ATXN1; (-) strand; PAM type: NRG; PAM sequence: AAG
tcatttggggttccatttgt

SEQ ID NO: 60052 - DNA, 20 bp, Artificial Sequence
  Description of Artificial Sequence: Synthetic oligonucleotide
  Target: ATXN1; (-) strand; PAM type: NRG; PAM sequence: GGG
ttgtgagttgagctcatttg

SEQ ID NO: 60053 - DNA, 20 bp, Artificial Sequence
  Description of Artificial Sequence: Synthetic oligonucleotide
  Target: ATXN1; (-) strand; PAM type: NRG; PAM sequence: GGG
gttgtgagttgagctcattt

SEQ ID NO: 60054 - DNA, 20 bp, Artificial Sequence
  Description of Artificial Sequence: Synthetic oligonucleotide
  Target: ATXN1; (-) strand; PAM type: NRG; PAM sequence: TGG
agttgtgagttgagctcatt

SEQ ID NO: 60055 - DNA, 20 bp, Artificial Sequence
  Description of Artificial Sequence: Synthetic oligonucleotide
  Target: ATXN1; (-) strand; PAM type: NRG; PAM sequence: GAG
cttggtagaagttgtgagtt

SEQ ID NO: 60056 - DNA, 20 bp, Artificial Sequence
  Description of Artificial Sequence: Synthetic oligonucleotide
  Target: ATXN1; (-) strand; PAM type: NRG; PAM sequence: GAG
gggtccttggtagaagttgt

SEQ ID NO: 60057 - DNA, 20 bp, Artificial Sequence
  Description of Artificial Sequence: Synthetic oligonucleotide
  Target: ATXN1; (-) strand; PAM type: NRG; PAM sequence: AAG
agtccaggggtccttggtag

SEQ ID NO: 60058 - DNA, 20 bp, Artificial Sequence
  Description of Artificial Sequence: Synthetic oligonucleotide
  Target: ATXN1; (-) strand; PAM type: NRG; PAM sequence: TAG
gtcagtccaggggtccttgg

SEQ ID NO: 60059 - DNA, 20 bp, Artificial Sequence
  Description of Artificial Sequence: Synthetic oligonucleotide
  Target: ATXN1; (-) strand; PAM type: NRG; PAM sequence: TGG
tgggtcagtccaggggtcct

SEQ ID NO: 60060 - DNA, 20 bp, Artificial Sequence
  Description of Artificial Sequence: Synthetic oligonucleotide
  Target: ATXN1; (-) strand; PAM type: NRG; PAM sequence: GGG
gggctggtgggtcagtccag

SEQ ID NO: 60061 - DNA, 20 bp, Artificial Sequence
  Description of Artificial Sequence: Synthetic oligonucleotide
  Target: ATXN1; (-) strand; PAM type: NRG; PAM sequence: GGG
agggctggtgggtcagtcca

SEQ ID NO: 60062 - DNA, 20 bp, Artificial Sequence
  Description of Artificial Sequence: Synthetic oligonucleotide
  Target: ATXN1; (-) strand; PAM type: NRG; PAM sequence: AGG
aagggctggtgggtcagtcc

SEQ ID NO: 60063 - DNA, 20 bp, Artificial Sequence
  Description of Artificial Sequence: Synthetic oligonucleotide
  Target: ATXN1; (-) strand; PAM type: NRG; PAM sequence: CAG
aaagggctggtgggtcagtc

SEQ ID NO: 60064 - DNA, 20 bp, Artificial Sequence
  Description of Artificial Sequence: Synthetic oligonucleotide
  Target: ATXN1; (-) strand; PAM type: NRG; PAM sequence: CAG
aggccaaagggctggtgggt

SEQ ID NO: 60065 - DNA, 20 bp, Artificial Sequence
  Description of Artificial Sequence: Synthetic oligonucleotide
  Target: ATXN1; (-) strand; PAM type: NRG; PAM sequence: GGG
ctctaggccaaagggctggt

SEQ ID NO: 60066 - DNA, 20 bp, Artificial Sequence
  Description of Artificial Sequence: Synthetic oligonucleotide
  Target: ATXN1; (-) strand; PAM type: NRG; PAM sequence: TGG
actctaggccaaagggctgg

SEQ ID NO: 60067 - DNA, 20 bp, Artificial Sequence
  Description of Artificial Sequence: Synthetic oligonucleotide
  Target: ATXN1; (-) strand; PAM type: NRG; PAM sequence: TGG
aacactctaggccaaagggc

SEQ ID NO: 60068 - DNA, 20 bp, Artificial Sequence
  Description of Artificial Sequence: Synthetic oligonucleotide
  Target: ATXN1; (-) strand; PAM type: NRG; PAM sequence: GGG
ggggaacactctaggccaaa

SEQ ID NO: 60069 - DNA, 20 bp, Artificial Sequence
  Description of Artificial Sequence: Synthetic oligonucleotide
  Target: ATXN1; (-) strand; PAM type: NRG; PAM sequence: AGG
aggggaacactctaggccaa

SEQ ID NO: 60070 - DNA, 20 bp, Artificial Sequence
  Description of Artificial Sequence: Synthetic oligonucleotide
  Target: ATXN1; (-) strand; PAM type: NRG; PAM sequence: AAG
gaggggaacactctaggcca

SEQ ID NO: 60071 - DNA, 20 bp, Artificial Sequence
  Description of Artificial Sequence: Synthetic oligonucleotide
  Target: ATXN1; (-) strand; PAM type: NRG; PAM sequence: AGG
cctccagaggggaacactct

SEQ ID NO: 60072 - DNA, 20 bp, Artificial Sequence
  Description of Artificial Sequence: Synthetic oligonucleotide
  Target: ATXN1; (-) strand; PAM type: NRG; PAM sequence: TAG
ccctccagaggggaacactc

SEQ ID NO: 60073 - DNA, 20 bp, Artificial Sequence
  Description of Artificial Sequence: Synthetic oligonucleotide
  Target: ATXN1; (-) strand; PAM type: NRG; PAM sequence: GGG
agttgtagtgccctccagag

SEQ ID NO: 60074 - DNA, 20 bp, Artificial Sequence
  Description of Artificial Sequence: Synthetic oligonucleotide
  Target: ATXN1; (-) strand; PAM type: NRG; PAM sequence: GGG
cagttgtagtgccctccaga

SEQ ID NO: 60075 - DNA, 20 bp, Artificial Sequence
  Description of Artificial Sequence: Synthetic oligonucleotide
  Target: ATXN1; (-) strand; PAM type: NRG; PAM sequence: AGG
gcagttgtagtgccctccag

SEQ ID NO: 60076 - DNA, 20 bp, Artificial Sequence
  Description of Artificial Sequence: Synthetic oligonucleotide
  Target: ATXN1; (-) strand; PAM type: NRG; PAM sequence: GAG
tgcagttgtagtgccctcca

SEQ ID NO: 60077 - DNA, 20 bp, Artificial Sequence
  Description of Artificial Sequence: Synthetic oligonucleotide
  Target: ATXN1; (-) strand; PAM type: NRG; PAM sequence: CAG
cctgcagttgtagtgccctc

SEQ ID NO: 60078 - DNA, 20 bp, Artificial Sequence
  Description of Artificial Sequence: Synthetic oligonucleotide
  Target: ATXN1; (-) strand; PAM type: NRG; PAM sequence: TAG
aagaaggggccctgcagttg

SEQ ID NO: 60079 - DNA, 20 bp, Artificial Sequence
  Description of Artificial Sequence: Synthetic oligonucleotide
  Target: ATXN1; (-) strand; PAM type: NRG; PAM sequence: CAG
ggggtgaagaaggggccctg

SEQ ID NO: 60080 - DNA, 20 bp, Artificial Sequence
  Description of Artificial Sequence: Synthetic oligonucleotide
  Target: ATXN1; (-) strand; PAM type: NRG; PAM sequence: GGG
gctggataggggtgaagaag

SEQ ID NO: 60081 - DNA, 20 bp, Artificial Sequence
  Description of Artificial Sequence: Synthetic oligonucleotide
  Target: ATXN1; (-) strand; PAM type: NRG; PAM sequence: GGG
tgctggataggggtgaagaa

SEQ ID NO: 60082 - DNA, 20 bp, Artificial Sequence
  Description of Artificial Sequence: Synthetic oligonucleotide
  Target: ATXN1; (-) strand; PAM type: NRG; PAM sequence: AGG
ctgctggataggggtgaaga

SEQ ID NO: 60083 - DNA, 20 bp, Artificial Sequence
  Description of Artificial Sequence: Synthetic oligonucleotide
  Target: ATXN1; (-) strand; PAM type: NRG; PAM sequence: AAG
cctgctggataggggtgaag

SEQ ID NO: 60084 - DNA, 20 bp, Artificial Sequence
  Description of Artificial Sequence: Synthetic oligonucleotide
  Target: ATXN1; (-) strand; PAM type: NRG; PAM sequence: AAG
cttcctgctggataggggtg

SEQ ID NO: 60085 - DNA, 20 bp, Artificial Sequence
  Description of Artificial Sequence: Synthetic oligonucleotide
  Target: ATXN1; (-) strand; PAM type: NRG; PAM sequence: GGG
agctacttcctgctggatag

SEQ ID NO: 60086 - DNA, 20 bp, Artificial Sequence
  Description of Artificial Sequence: Synthetic oligonucleotide
  Target: ATXN1; (-) strand; PAM type: NRG; PAM sequence: GGG
tagctacttcctgctggata

SEQ ID NO: 60087 - DNA, 20 bp, Artificial Sequence
  Description of Artificial Sequence: Synthetic oligonucleotide
  Target: ATXN1; (-) strand; PAM type: NRG; PAM sequence: AGG
ctagctacttcctgctggat

SEQ ID NO: 60088 - DNA, 20 bp, Artificial Sequence
  Description of Artificial Sequence: Synthetic oligonucleotide
  Target: ATXN1; (-) strand; PAM type: NRG; PAM sequence: TAG
tctagctacttcctgctgga

SEQ ID NO: 60089 - DNA, 20 bp, Artificial Sequence
  Description of Artificial Sequence: Synthetic oligonucleotide
  Target: ATXN1; (-) strand; PAM type: NRG; PAM sequence: TGG
ctgctctagctacttcctgc

SEQ ID NO: 60090 - DNA, 20 bp, Artificial Sequence
  Description of Artificial Sequence: Synthetic oligonucleotide
  Target: ATXN1; (-) strand; PAM type: NRG; PAM sequence: TAG
gaactgggtgatgactgctc

SEQ ID NO: 60091 - DNA, 20 bp, Artificial Sequence
  Description of Artificial Sequence: Synthetic oligonucleotide
  Target: ATXN1; (-) strand; PAM type: NRG; PAM sequence: GGG
cccagctgctgttgggaact

SEQ ID NO: 60092 - DNA, 20 bp, Artificial Sequence
  Description of Artificial Sequence: Synthetic oligonucleotide
  Target: ATXN1; (-) strand; PAM type: NRG; PAM sequence: TGG
ccccagctgctgttgggaac

SEQ ID NO: 60093 - DNA, 20 bp, Artificial Sequence
  Description of Artificial Sequence: Synthetic oligonucleotide
  Target: ATXN1; (-) strand; PAM type: NRG; PAM sequence: GGG
aggacaccccagctgctgtt

SEQ ID NO: 60094 - DNA, 20 bp, Artificial Sequence
  Description of Artificial Sequence: Synthetic oligonucleotide
  Target: ATXN1; (-) strand; PAM type: NRG; PAM sequence: TGG
caggacaccccagctgctgt

SEQ ID NO: 60095 - DNA, 20 bp, Artificial Sequence
  Description of Artificial Sequence: Synthetic oligonucleotide
  Target: ATXN1; (-) strand; PAM type: NRG; PAM sequence: CAG
cccctctaaacaggacaccc

SEQ ID NO: 60096 - DNA, 20 bp, Artificial Sequence
  Description of Artificial Sequence: Synthetic oligonucleotide
  Target: ATXN1; (-) strand; PAM type: NRG; PAM sequence: AGG
tctcaatcccccctctaaac

SEQ ID NO: 60097 - DNA, 20 bp, Artificial Sequence
  Description of Artificial Sequence: Synthetic oligonucleotide
  Target: ATXN1; (-) strand; PAM type: NRG; PAM sequence: CAG
ctctcaatcccccctctaaa

SEQ ID NO: 60098 - DNA, 20 bp, Artificial Sequence
  Description of Artificial Sequence: Synthetic oligonucleotide
  Target: ATXN1; (-) strand; PAM type: NRG; PAM sequence: TGG
cttgacccaggaagtccagc

SEQ ID NO: 60099 - DNA, 20 bp, Artificial Sequence
  Description of Artificial Sequence: Synthetic oligonucleotide
  Target: ATXN1; (-) strand; PAM type: NRG; PAM sequence: CAG
cctacttgacccaggaagtc

SEQ ID NO: 60100 - DNA, 20 bp, Artificial Sequence
  Description of Artificial Sequence: Synthetic oligonucleotide
  Target: ATXN1; (-) strand; PAM type: NRG; PAM sequence: AAG
aagtccctacttgacccagg

SEQ ID NO: 60101 - DNA, 20 bp, Artificial Sequence
  Description of Artificial Sequence: Synthetic oligonucleotide
  Target: ATXN1; (-) strand; PAM type: NRG; PAM sequence: AGG
ctcaagtccctacttgaccc

SEQ ID NO: 60102 - DNA, 20 bp, Artificial Sequence
  Description of Artificial Sequence: Synthetic oligonucleotide
  Target: ATXN1; (-) strand; PAM type: NRG; PAM sequence: CAG
cctcaagtccctacttgacc

SEQ ID NO: 60103 - DNA, 20 bp, Artificial Sequence
  Description of Artificial Sequence: Synthetic oligonucleotide
  Target: ATXN1; (-) strand; PAM type: NRG; PAM sequence: AAG
gtaagacaggaaagttcctc

SEQ ID NO: 60104 - DNA, 20 bp, Artificial Sequence
  Description of Artificial Sequence: Synthetic oligonucleotide
  Target: ATXN1; (-) strand; PAM type: NRG; PAM sequence: AAG
catcctcttgtaagacagga

SEQ ID NO: 60105 - DNA, 20 bp, Artificial Sequence
  Description of Artificial Sequence: Synthetic oligonucleotide
  Target: ATXN1; (-) strand; PAM type: NRG; PAM sequence: AGG
tttacatcctcttgtaagac

SEQ ID NO: 60106 - DNA, 20 bp, Artificial Sequence
  Description of Artificial Sequence: Synthetic oligonucleotide
  Target: ATXN1; (-) strand; PAM type: NRG; PAM sequence: CAG
ttttacatcctcttgtaaga

SEQ ID NO: 60107 - DNA, 20 bp, Artificial Sequence
  Description of Artificial Sequence: Synthetic oligonucleotide
  Target: ATXN1; (-) strand; PAM type: NRG; PAM sequence: AAG
tgcattttacatcctcttgt

SEQ ID NO: 60108 - DNA, 20 bp, Artificial Sequence
  Description of Artificial Sequence: Synthetic oligonucleotide
  Target: ATXN1; (-) strand; PAM type: NRG; PAM sequence: TGG
aagacaggaaagttcctgat

SEQ ID NO: 60109 - DNA, 20 bp, Artificial Sequence
  Description of Artificial Sequence: Synthetic oligonucleotide
  Target: ATXN1; (-) strand; PAM type: NRG; PAM sequence: AAG
gaacctcttgtaagacagga

SEQ ID NO: 60110 - DNA, 20 bp, Artificial Sequence
  Description of Artificial Sequence: Synthetic oligonucleotide
  Target: ATXN1; (-) strand; PAM type: NRG; PAM sequence: AGG
ttacgaacctcttgtaagac

SEQ ID NO: 60111 - DNA, 20 bp, Artificial Sequence
  Description of Artificial Sequence: Synthetic oligonucleotide
  Target: ATXN1; (-) strand; PAM type: NRG; PAM sequence: CAG
tttacgaacctcttgtaaga

SEQ ID NO: 60112 - DNA, 20 bp, Artificial Sequence
  Description of Artificial Sequence: Synthetic oligonucleotide
  Target: ATXN1; (-) strand; PAM type: NRG; PAM sequence: AAG
gcattttacgaacctcttgt

SEQ ID NO: 60113 - DNA, 20 bp, Artificial Sequence
  Description of Artificial Sequence: Synthetic oligonucleotide
  Target: ATXN1; (-) strand; PAM type: NRG; PAM sequence: TGG
gcattttacaaagtgctgat

SEQ ID NO: 60114 - DNA, 20 bp, Artificial Sequence
  Description of Artificial Sequence: Synthetic oligonucleotide
  Target: ATXN1; (-) strand; PAM type: NRG; PAM sequence: AAG
acttattggtgcattttaca

SEQ ID NO: 60115 - DNA, 20 bp, Artificial Sequence
  Description of Artificial Sequence: Synthetic oligonucleotide
  Target: ATXN1; (-) strand; PAM type: NRG; PAM sequence: TGG
gcgttttacagagcacttat

SEQ ID NO: 60116 - DNA, 20 bp, Artificial Sequence
  Description of Artificial Sequence: Synthetic oligonucleotide
  Target: ATXN1; (-) strand; PAM type: NRG; PAM sequence: GAG
actaattggtgcgttttaca

SEQ ID NO: 60117 - DNA, 20 bp, Artificial Sequence
  Description of Artificial Sequence: Synthetic oligonucleotide
  Target: ATXN1; (-) strand; PAM type: NRG; PAM sequence: CAG
gcactaattggtgcgtttta

SEQ ID NO: 60118 - DNA, 20 bp, Artificial Sequence
  Description of Artificial Sequence: Synthetic oligonucleotide
  Target: ATXN1; (-) strand; PAM type: NRG; PAM sequence: TGG
gcattttacagagcactaat

SEQ ID NO: 60119 - DNA, 20 bp, Artificial Sequence
  Description of Artificial Sequence: Synthetic oligonucleotide
  Target: ATXN1; (-) strand; PAM type: NRG; PAM sequence: GAG
gctgattgatgcattttaca

SEQ ID NO: 60120 - DNA, 20 bp, Artificial Sequence
  Description of Artificial Sequence: Synthetic oligonucleotide
  Target: ATXN1; (-) strand; PAM type: NRG; PAM sequence: CAG
ctgctgattgatgcatttta

SEQ ID NO: 60121 - DNA, 20 bp, Artificial Sequence
  Description of Artificial Sequence: Synthetic oligonucleotide
  Target: ATXN1; (-) strand; PAM type: NRG; PAM sequence: TAG
tccctgcgattggctacctt

SEQ ID NO: 60122 - DNA, 20 bp, Artificial Sequence
  Description of Artificial Sequence: Synthetic oligonucleotide
  Target: ATXN1; (-) strand; PAM type: NRG; PAM sequence: TGG
ttttcaatcctccctgcgat

SEQ ID NO: 60123 - DNA, 20 bp, Artificial Sequence
  Description of Artificial Sequence: Synthetic oligonucleotide
  Target: ATXN1; (-) strand; PAM type: NRG; PAM sequence: GAG
gttccatttctgttctgtca

SEQ ID NO: 60124 - DNA, 20 bp, Artificial Sequence
  Description of Artificial Sequence: Synthetic oligonucleotide
  Target: ATXN1; (-) strand; PAM type: NRG; PAM sequence: CAG
atgttccatttctgttctgt

SEQ ID NO: 60125 - DNA, 20 bp, Artificial Sequence
  Description of Artificial Sequence: Synthetic oligonucleotide
  Target: ATXN1; (-) strand; PAM type: NRG; PAM sequence: CAG
ctgctgctggctgtggtggc

SEQ ID NO: 60126 - DNA, 20 bp, Artificial Sequence
  Description of Artificial Sequence: Synthetic oligonucleotide
  Target: ATXN1; (-) strand; PAM type: NRG; PAM sequence: TGG
gttgctgctgctggctgtgg

SEQ ID NO: 60127 - DNA, 20 bp, Artificial Sequence
  Description of Artificial Sequence: Synthetic oligonucleotide
  Target: ATXN1; (-) strand; PAM type: NRG; PAM sequence: TGG
tgggttgctgctgctggctg

SEQ ID NO: 60128 - DNA, 20 bp, Artificial Sequence
  Description of Artificial Sequence: Synthetic oligonucleotide
  Target: ATXN1; (-) strand; PAM type: NRG; PAM sequence: TGG
cccaagtgggttgctgctgc

SEQ ID NO: 60129 - DNA, 20 bp, Artificial Sequence
  Description of Artificial Sequence: Synthetic oligonucleotide
  Target: ATXN1; (-) strand; PAM type: NRG; PAM sequence: GGG
gcgtggaaggggacccaagt

SEQ ID NO: 60130 - DNA, 20 bp, Artificial Sequence
  Description of Artificial Sequence: Synthetic oligonucleotide
  Target: ATXN1; (-) strand; PAM type: NRG; PAM sequence: TGG
agcgtggaaggggacccaag

SEQ ID NO: 60131 - DNA, 20 bp, Artificial Sequence
  Description of Artificial Sequence: Synthetic oligonucleotide
  Target: ATXN1; (-) strand; PAM type: NRG; PAM sequence: AAG
cacagcgtggaaggggaccc

SEQ ID NO: 60132 - DNA, 20 bp, Artificial Sequence
  Description of Artificial Sequence: Synthetic oligonucleotide
  Target: ATXN1; (-) strand; PAM type: NRG; PAM sequence: GGG
aagcttccacagcgtggaag

SEQ ID NO: 60133 - DNA, 20 bp, Artificial Sequence
  Description of Artificial Sequence: Synthetic oligonucleotide
  Target: ATXN1; (-) strand; PAM type: NRG; PAM sequence: GGG
aaagcttccacagcgtggaa

SEQ ID NO: 60134 - DNA, 20 bp, Artificial Sequence
  Description of Artificial Sequence: Synthetic oligonucleotide
  Target: ATXN1; (-) strand; PAM type: NRG; PAM sequence: AGG
caaagcttccacagcgtgga

SEQ ID NO: 60135 - DNA, 20 bp, Artificial Sequence
  Description of Artificial Sequence: Synthetic oligonucleotide
  Target: ATXN1; (-) strand; PAM type: NRG; PAM sequence: AAG
acaaagcttccacagcgtgg

SEQ ID NO: 60136 - DNA, 20 bp, Artificial Sequence
  Description of Artificial Sequence: Synthetic oligonucleotide
  Target: ATXN1; (-) strand; PAM type: NRG; PAM sequence: TGG
aggacaaagcttccacagcg

SEQ ID NO: 60137 - DNA, 20 bp, Artificial Sequence
  Description of Artificial Sequence: Synthetic oligonucleotide
  Target: ATXN1; (-) strand; PAM type: NRG; PAM sequence: CAG
gcaaaaggacaaagcttcca

SEQ ID NO: 60138 - DNA, 20 bp, Artificial Sequence
  Description of Artificial Sequence: Synthetic oligonucleotide
  Target: ATXN1; (-) strand; PAM type: NRG; PAM sequence: AAG
ttgtgaagagcaaaaggaca

SEQ ID NO: 60139 - DNA, 20 bp, Artificial Sequence
  Description of Artificial Sequence: Synthetic oligonucleotide
  Target: ATXN1; (-) strand; PAM type: NRG; PAM sequence: AGG
ggtttattgtgaagagcaaa

SEQ ID NO: 60140 - DNA, 20 bp, Artificial Sequence
  Description of Artificial Sequence: Synthetic oligonucleotide
  Target: ATXN1; (-) strand; PAM type: NRG; PAM sequence: AAG
aggtttattgtgaagagcaa

SEQ ID NO: 60141 - DNA, 20 bp, Artificial Sequence
  Description of Artificial Sequence: Synthetic oligonucleotide
  Target: ATXN1; (-) strand; PAM type: NRG; PAM sequence: GAG
gtagcaaggtttattgtgaa

SEQ ID NO: 60142 - DNA, 20 bp, Artificial Sequence
  Description of Artificial Sequence: Synthetic oligonucleotide
  Target: ATXN1; (-) strand; PAM type: NRG; PAM sequence: AAG
cagtagcaaggtttattgtg

SEQ ID NO: 60143 - DNA, 20 bp, Artificial Sequence
  Description of Artificial Sequence: Synthetic oligonucleotide
  Target: ATXN1; (-) strand; PAM type: NRG; PAM sequence: AGG
ccaaagagtgagcagtagca

SEQ ID NO: 60144 - DNA, 20 bp, Artificial Sequence
  Description of Artificial Sequence: Synthetic oligonucleotide
  Target: ATXN1; (-) strand; PAM type: NRG; PAM sequence: AAG
cccaaagagtgagcagtagc

SEQ ID NO: 60145 - DNA, 20 bp, Artificial Sequence
  Description of Artificial Sequence: Synthetic oligonucleotide
  Target: ATXN1; (-) strand; PAM type: NRG; PAM sequence: TAG
tggacccaaagagtgagcag

SEQ ID NO: 60146 - DNA, 20 bp, Artificial Sequence
  Description of Artificial Sequence: Synthetic oligonucleotide
  Target: ATXN1; (-) strand; PAM type: NRG; PAM sequence: CAG
gcatggacccaaagagtgag

SEQ ID NO: 60147 - DNA, 20 bp, Artificial Sequence
  Description of Artificial Sequence: Synthetic oligonucleotide
  Target: ATXN1; (-) strand; PAM type: NRG; PAM sequence: GAG
atggcatggacccaaagagt

SEQ ID NO: 60148 - DNA, 20 bp, Artificial Sequence
  Description of Artificial Sequence: Synthetic oligonucleotide
  Target: ATXN1; (-) strand; PAM type: NRG; PAM sequence: GAG
aaagatggcatggacccaaa

SEQ ID NO: 60149 - DNA, 20 bp, Artificial Sequence
  Description of Artificial Sequence: Synthetic oligonucleotide
  Target: ATXN1; (-) strand; PAM type: NRG; PAM sequence: AAG
ttaaagatggcatggaccca

SEQ ID NO: 60150 - DNA, 20 bp, Artificial Sequence
  Description of Artificial Sequence: Synthetic oligonucleotide
  Target: ATXN1; (-) strand; PAM type: NRG; PAM sequence: TGG
tacagctcttaaagatggca

SEQ ID NO: 60151 - DNA, 20 bp, Artificial Sequence
  Description of Artificial Sequence: Synthetic oligonucleotide
  Target: ATXN1; (-) strand; PAM type: NRG; PAM sequence: TGG
agtgttacagctcttaaaga

SEQ ID NO: 60152 - DNA, 20 bp, Artificial Sequence
  Description of Artificial Sequence: Synthetic oligonucleotide
  Target: ATXN1; (-) strand; PAM type: NRG; PAM sequence: AAG
ggtgagtgttacagctctta

SEQ ID NO: 60153 - DNA, 20 bp, Artificial Sequence
  Description of Artificial Sequence: Synthetic oligonucleotide
  Target: ATXN1; (-) strand; PAM type: NRG; PAM sequence: CAG
gaccttcatggtgagtgtta

SEQ ID NO: 60154 - DNA, 20 bp, Artificial Sequence
  Description of Artificial Sequence: Synthetic oligonucleotide
  Target: ATXN1; (-) strand; PAM type: NRG; PAM sequence: GAG
gagctgcggaccttcatggt

SEQ ID NO: 60155 - DNA, 20 bp, Artificial Sequence
  Description of Artificial Sequence: Synthetic oligonucleotide
  Target: ATXN1; (-) strand; PAM type: NRG; PAM sequence: TGG
aatggagctgcggaccttca

SEQ ID NO: 60156 - DNA, 20 bp, Artificial Sequence
  Description of Artificial Sequence: Synthetic oligonucleotide
  Target: ATXN1; (-) strand; PAM type: NRG; PAM sequence: CGG
tgacttcaagaatggagctg

SEQ ID NO: 60157 - DNA, 20 bp, Artificial Sequence
  Description of Artificial Sequence: Synthetic oligonucleotide
  Target: ATXN1; (-) strand; PAM type: NRG; PAM sequence: GAG
tctcgctgacttcaagaatg

SEQ ID NO: 60158 - DNA, 20 bp, Artificial Sequence
  Description of Artificial Sequence: Synthetic oligonucleotide
  Target: ATXN1; (-) strand; PAM type: NRG; PAM sequence: TGG
ggtctcgctgacttcaagaa

SEQ ID NO: 60159 - DNA, 20 bp, Artificial Sequence
  Description of Artificial Sequence: Synthetic oligonucleotide
  Target: ATXN1; (-) strand; PAM type: NRG; PAM sequence: AAG
tttatggtctcgctgacttc

SEQ ID NO: 60160 - DNA, 20 bp, Artificial Sequence
  Description of Artificial Sequence: Synthetic oligonucleotide
  Target: ATXN1; (-) strand; PAM type: NRG; PAM sequence: TGG
ggttcctaccggtgggttta

SEQ ID NO: 60161 - DNA, 20 bp, Artificial Sequence
  Description of Artificial Sequence: Synthetic oligonucleotide
  Target: ATXN1; (-) strand; PAM type: NRG; PAM sequence: GGG
tggagttggttcctaccggt

SEQ ID NO: 60162 - DNA, 20 bp, Artificial Sequence
  Description of Artificial Sequence: Synthetic oligonucleotide
  Target: ATXN1; (-) strand; PAM type: NRG; PAM sequence: TGG
ctggagttggttcctaccgg

SEQ ID NO: 60163 - DNA, 20 bp, Artificial Sequence
  Description of Artificial Sequence: Synthetic oligonucleotide
  Target: ATXN1; (-) strand; PAM type: NRG; PAM sequence: CGG
tgtctggagttggttcctac

SEQ ID NO: 60164 - DNA, 20 bp, Artificial Sequence
  Description of Artificial Sequence: Synthetic oligonucleotide
  Target: ATXN1; (-) strand; PAM type: NRG; PAM sequence: TGG
tgtctttttgtgtctggagt

SEQ ID NO: 60165 - DNA, 20 bp, Artificial Sequence
  Description of Artificial Sequence: Synthetic oligonucleotide
  Target: ATXN1; (-) strand; PAM type: NRG; PAM sequence: GAG
tctatgtctttttgtgtctg

SEQ ID NO: 60166 - DNA, 20 bp, Artificial Sequence
  Description of Artificial Sequence: Synthetic oligonucleotide
  Target: ATXN1; (-) strand; PAM type: NRG; PAM sequence: TGG
cctctatgtctttttgtgtc

SEQ ID NO: 60167 - DNA, 20 bp, Artificial Sequence
  Description of Artificial Sequence: Synthetic oligonucleotide
  Target: ATXN1; (-) strand; PAM type: NRG; PAM sequence: AAG
tcatgtggcaatatgcgtgt

SEQ ID NO: 60168 - DNA, 20 bp, Artificial Sequence
  Description of Artificial Sequence: Synthetic oligonucleotide
  Target: ATXN1; (-) strand; PAM type: NRG; PAM sequence: TGG
tcacattggcttctttcatg

SEQ ID NO: 60169 - DNA, 20 bp, Artificial Sequence
  Description of Artificial Sequence: Synthetic oligonucleotide
  Target: ATXN1; (-) strand; PAM type: NRG; PAM sequence: TGG
agtatgtacccttttcacat

SEQ ID NO: 60170 - DNA, 20 bp, Artificial Sequence
  Description of Artificial Sequence: Synthetic oligonucleotide
  Target: ATXN1; (-) strand; PAM type: NRG; PAM sequence: CAG
gtcataaagttggaatcata

SEQ ID NO: 60171 - DNA, 20 bp, Artificial Sequence
  Description of Artificial Sequence: Synthetic oligonucleotide
  Target: ATXN1; (-) strand; PAM type: NRG; PAM sequence: TGG
tttccaaaatgtcataaagt

SEQ ID NO: 60172 - DNA, 20 bp, Artificial Sequence
  Description of Artificial Sequence: Synthetic oligonucleotide
  Target: ATXN1; (-) strand; PAM type: NRG; PAM sequence: AAG
gccttttccaaaatgtcata

SEQ ID NO: 60173 - DNA, 20 bp, Artificial Sequence
  Description of Artificial Sequence: Synthetic oligonucleotide
  Target: ATXN1; (-) strand; PAM type: NRG; PAM sequence: TAG
ttttttttttactatccctg

SEQ ID NO: 60174 - DNA, 20 bp, Artificial Sequence
  Description of Artificial Sequence: Synthetic oligonucleotide
  Target: ATXN1; (-) strand; PAM type: NRG; PAM sequence: TAG
tacattctgtgtttgacaaa

SEQ ID NO: 60175 - DNA, 20 bp, Artificial Sequence
  Description of Artificial Sequence: Synthetic oligonucleotide
  Target: ATXN1; (-) strand; PAM type: NRG; PAM sequence: GAG
aaagtctatagttcatgtta

SEQ ID NO: 60176 - DNA, 20 bp, Artificial Sequence
  Description of Artificial Sequence: Synthetic oligonucleotide
  Target: ATXN1; (-) strand; PAM type: NRG; PAM sequence: TAG
ctaaagtctatagttcatgt

SEQ ID NO: 60177 - DNA, 20 bp, Artificial Sequence
  Description of Artificial Sequence: Synthetic oligonucleotide
  Target: ATXN1; (-) strand; PAM type: NRG; PAM sequence: TAG
ttattattaactaaagtcta

SEQ ID NO: 60178 - DNA, 20 bp, Artificial Sequence
  Description of Artificial Sequence: Synthetic oligonucleotide
  Target: ATXN1; (-) strand; PAM type: NRG; PAM sequence: AAG
ggatacattattattaacta

SEQ ID NO: 60179 - DNA, 20 bp, Artificial Sequence
  Description of Artificial Sequence: Synthetic oligonucleotide
  Target: ATXN1; (-) strand; PAM type: NRG; PAM sequence: TGG
ttgttgaaattgaactaata

SEQ ID NO: 60180 - DNA, 20 bp, Artificial Sequence
  Description of Artificial Sequence: Synthetic oligonucleotide
  Target: ATXN1; (-) strand; PAM type: NRG; PAM sequence: CAG
cctccccgacccctgacaaa

SEQ ID NO: 60181 - DNA, 20 bp, Artificial Sequence
  Description of Artificial Sequence: Synthetic oligonucleotide
  Target: ATXN1; (-) strand; PAM type: NRG; PAM sequence: TAG
acaaagagttcctatattcc

SEQ ID NO: 60182 - DNA, 20 bp, Artificial Sequence
  Description of Artificial Sequence: Synthetic oligonucleotide
  Target: ATXN1; (-) strand; PAM type: NRG; PAM sequence: GAG
aattgatttgaaagtacaaa

SEQ ID NO: 60183 - DNA, 20 bp, Artificial Sequence
  Description of Artificial Sequence: Synthetic oligonucleotide
  Target: ATXN1; (-) strand; PAM type: NRG; PAM sequence: AAG
aaaattgatttgaaagtaca

SEQ ID NO: 60184 - DNA, 20 bp, Artificial Sequence
  Description of Artificial Sequence: Synthetic oligonucleotide
  Target: ATXN1; (-) strand; PAM type: NRG; PAM sequence: AAG
ttacagaaaaattgatttga

SEQ ID NO: 60185 - DNA, 20 bp, Artificial Sequence
  Description of Artificial Sequence: Synthetic oligonucleotide
  Target: ATXN1; (-) strand; PAM type: NRG; PAM sequence: CAG
atagaacagttttaggttta

SEQ ID NO: 60186 - DNA, 20 bp, Artificial Sequence
  Description of Artificial Sequence: Synthetic oligonucleotide
  Target: ATXN1; (-) strand; PAM type: NRG; PAM sequence: AGG
cttttttatagaacagtttt

SEQ ID NO: 60187 - DNA, 20 bp, Artificial Sequence
  Description of Artificial Sequence: Synthetic oligonucleotide
  Target: ATXN1; (-) strand; PAM type: NRG; PAM sequence: TAG
gcttttttatagaacagttt

SEQ ID NO: 60188 - DNA, 20 bp, Artificial Sequence
  Description of Artificial Sequence: Synthetic oligonucleotide
  Target: ATXN1; (-) strand; PAM type: NRG; PAM sequence: CAG
taataggcttttttatagaa

SEQ ID NO: 60189 - DNA, 20 bp, Artificial Sequence
  Description of Artificial Sequence: Synthetic oligonucleotide
  Target: ATXN1; (-) strand; PAM type: NRG; PAM sequence: TAG
ttaattaataggctttttta

SEQ ID NO: 60190 - DNA, 20 bp, Artificial Sequence
  Description of Artificial Sequence: Synthetic oligonucleotide
  Target: ATXN1; (-) strand; PAM type: NRG; PAM sequence: AGG
gtttttgttttttaattaat

SEQ ID NO: 60191 - DNA, 20 bp, Artificial Sequence
  Description of Artificial Sequence: Synthetic oligonucleotide
  Target: ATXN1; (-) strand; PAM type: NRG; PAM sequence: TAG
tgtttttgttttttaattaa

SEQ ID NO: 60192 - DNA, 20 bp, Artificial Sequence
  Description of Artificial Sequence: Synthetic oligonucleotide
  Target: ATXN1; (-) strand; PAM type: NRG; PAM sequence: CAG
acttcaaacagctgtcagtg

SEQ ID NO: 60193 - DNA, 20 bp, Artificial Sequence
  Description of Artificial Sequence: Synthetic oligonucleotide
  Target: ATXN1; (-) strand; PAM type: NRG; PAM sequence: CAG
ggaacacttcaaacagctgt

SEQ ID NO: 60194 - DNA, 20 bp, Artificial Sequence
  Description of Artificial Sequence: Synthetic oligonucleotide
  Target: ATXN1; (-) strand; PAM type: NRG; PAM sequence: CAG
cctgggaggaacacttcaaa

SEQ ID NO: 60195 - DNA, 20 bp, Artificial Sequence
  Description of Artificial Sequence: Synthetic oligonucleotide
  Target: ATXN1; (-) strand; PAM type: NRG; PAM sequence: AGG
tatctggaaggacacctggg

SEQ ID NO: 60196 - DNA, 20 bp, Artificial Sequence
  Description of Artificial Sequence: Synthetic oligonucleotide
  Target: ATXN1; (-) strand; PAM type: NRG; PAM sequence: GAG
gtatctggaaggacacctgg

SEQ ID NO: 60197 - DNA, 20 bp, Artificial Sequence
  Description of Artificial Sequence: Synthetic oligonucleotide
  Target: ATXN1; (-) strand; PAM type: NRG; PAM sequence: GGG
tagtatctggaaggacacct

SEQ ID NO: 60198 - DNA, 20 bp, Artificial Sequence
  Description of Artificial Sequence: Synthetic oligonucleotide
  Target: ATXN1; (-) strand; PAM type: NRG; PAM sequence: TGG
ctagtatctggaaggacacc

SEQ ID NO: 60199 - DNA, 20 bp, Artificial Sequence
  Description of Artificial Sequence: Synthetic oligonucleotide
  Target: ATXN1; (-) strand; PAM type: NRG; PAM sequence: AGG
ggctctagctagtatctgga

SEQ ID NO: 60200 - DNA, 20 bp, Artificial Sequence
  Description of Artificial Sequence: Synthetic oligonucleotide
  Target: ATXN1; (-) strand; PAM type: NRG; PAM sequence: AAG
tggctctagctagtatctgg

SEQ ID NO: 60201 - DNA, 20 bp, Artificial Sequence
  Description of Artificial Sequence: Synthetic oligonucleotide
  Target: ATXN1; (-) strand; PAM type: NRG; PAM sequence: TGG
acttggctctagctagtatc

SEQ ID NO: 60202 - DNA, 20 bp, Artificial Sequence
  Description of Artificial Sequence: Synthetic oligonucleotide
  Target: ATXN1; (-) strand; PAM type: NRG; PAM sequence: TAG
taattccacttggctctagc

SEQ ID NO: 60203 - DNA, 20 bp, Artificial Sequence
  Description of Artificial Sequence: Synthetic oligonucleotide
  Target: ATXN1; (-) strand; PAM type: NRG; PAM sequence: TAG
tgattaattccacttggctc

SEQ ID NO: 60204 - DNA, 20 bp, Artificial Sequence
  Description of Artificial Sequence: Synthetic oligonucleotide
  Target: ATXN1; (-) strand; PAM type: NRG; PAM sequence: TGG
cttgcctgattaattccact

SEQ ID NO: 60205 - DNA, 20 bp, Artificial Sequence
  Description of Artificial Sequence: Synthetic oligonucleotide
  Target: ATXN1; (-) strand; PAM type: NRG; PAM sequence: CAG
caggcatcagctaccacacc

SEQ ID NO: 60206 - DNA, 20 bp, Artificial Sequence
  Description of Artificial Sequence: Synthetic oligonucleotide
  Target: ATXN1; (-) strand; PAM type: NRG; PAM sequence: CAG
agtgctgggattacaggcat

SEQ ID NO: 60207 - DNA, 20 bp, Artificial Sequence
  Description of Artificial Sequence: Synthetic oligonucleotide
  Target: ATXN1; (-) strand; PAM type: NRG; PAM sequence: AGG
tcccaaagtgctgggattac

SEQ ID NO: 60208 - DNA, 20 bp, Artificial Sequence
  Description of Artificial Sequence: Synthetic oligonucleotide
  Target: ATXN1; (-) strand; PAM type: NRG; PAM sequence: CAG
ctcccaaagtgctgggatta

SEQ ID NO: 60209 - DNA, 20 bp, Artificial Sequence
  Description of Artificial Sequence: Synthetic oligonucleotide
  Target: ATXN1; (-) strand; PAM type: NRG; PAM sequence: GGG
ccttggcctcccaaagtgct

SEQ ID NO: 60210 - DNA, 20 bp, Artificial Sequence
  Description of Artificial Sequence: Synthetic oligonucleotide
  Target: ATXN1; (-) strand; PAM type: NRG; PAM sequence: TGG
gccttggcctcccaaagtgc

SEQ ID NO: 60211 - DNA, 20 bp, Artificial Sequence
  Description of Artificial Sequence: Synthetic oligonucleotide
  Target: ATXN1; (-) strand; PAM type: NRG; PAM sequence: AAG
caacctgccttggcctccca

SEQ ID NO: 60212 - DNA, 20 bp, Artificial Sequence
  Description of Artificial Sequence: Synthetic oligonucleotide
  Target: ATXN1; (-) strand; PAM type: NRG; PAM sequence: TGG
ctttggtgatcaacctgcct

SEQ ID NO: 60213 - DNA, 20 bp, Artificial Sequence
  Description of Artificial Sequence: Synthetic oligonucleotide
  Target: ATXN1; (-) strand; PAM type: NRG; PAM sequence: TGG
caggctggtctcctgccctt

SEQ ID NO: 60214 - DNA, 20 bp, Artificial Sequence
  Description of Artificial Sequence: Synthetic oligonucleotide
  Target: ATXN1; (-) strand; PAM type: NRG; PAM sequence: TGG
tttcaccatgttggccaggc

SEQ ID NO: 60215 - DNA, 20 bp, Artificial Sequence
  Description of Artificial Sequence: Synthetic oligonucleotide
  Target: ATXN1; (-) strand; PAM type: NRG; PAM sequence: AGG
ggggtttcaccatgttggcc

SEQ ID NO: 60216 - DNA, 20 bp, Artificial Sequence
  Description of Artificial Sequence: Synthetic oligonucleotide
  Target: ATXN1; (-) strand; PAM type: NRG; PAM sequence: CAG
cggggtttcaccatgttggc

SEQ ID NO: 60217 - DNA, 20 bp, Artificial Sequence
  Description of Artificial Sequence: Synthetic oligonucleotide
  Target: ATXN1; (-) strand; PAM type: NRG; PAM sequence: TGG
gagacggggtttcaccatgt

SEQ ID NO: 60218 - DNA, 20 bp, Artificial Sequence
  Description of Artificial Sequence: Synthetic oligonucleotide
  Target: ATXN1; (-) strand; PAM type: NRG; PAM sequence: GGG
ttctatttttagtagagacg

SEQ ID NO: 60219 - DNA, 20 bp, Artificial Sequence
  Description of Artificial Sequence: Synthetic oligonucleotide
  Target: ATXN1; (-) strand; PAM type: NRG; PAM sequence: GGG
tttctatttttagtagagac

SEQ ID NO: 60220 - DNA, 20 bp, Artificial Sequence
  Description of Artificial Sequence: Synthetic oligonucleotide
  Target: ATXN1; (-) strand; PAM type: NRG; PAM sequence: CGG
ttttctatttttagtagaga

SEQ ID NO: 60221 - DNA, 20 bp, Artificial Sequence
  Description of Artificial Sequence: Synthetic oligonucleotide
  Target: ATXN1; (-) strand; PAM type: NRG; PAM sequence: GAG
taatttttctatttttagta

SEQ ID NO: 60222 - DNA, 20 bp, Artificial Sequence
  Description of Artificial Sequence: Synthetic oligonucleotide
  Target: ATXN1; (-) strand; PAM type: NRG; PAM sequence: TAG
gctaatttttctatttttag

SEQ ID NO: 60223 - DNA, 20 bp, Artificial Sequence
  Description of Artificial Sequence: Synthetic oligonucleotide
  Target: ATXN1; (-) strand; PAM type: NRG; PAM sequence: TAG
ccagctaatttttctatttt

SEQ ID NO: 60224 - DNA, 20 bp, Artificial Sequence
  Description of Artificial Sequence: Synthetic oligonucleotide
  Target: ATXN1; (-) strand; PAM type: NRG; PAM sequence: CAG
cagacacctgccaccatgcc

SEQ ID NO: 60225 - DNA, 20 bp, Artificial Sequence
  Description of Artificial Sequence: Synthetic oligonucleotide
  Target: ATXN1; (-) strand; PAM type: NRG; PAM sequence: CAG
ctcccaagtagctgggacta

SEQ ID NO: 60226 - DNA, 20 bp, Artificial Sequence
  Description of Artificial Sequence: Synthetic oligonucleotide
  Target: ATXN1; (-) strand; PAM type: NRG; PAM sequence: GGG
cctcagcctcccaagtagct

SEQ ID NO: 60227 - DNA, 20 bp, Artificial Sequence
  Description of Artificial Sequence: Synthetic oligonucleotide
  Target: ATXN1; (-) strand; PAM type: NRG; PAM sequence: TGG
gcctcagcctcccaagtagc

SEQ ID NO: 60228 - DNA, 20 bp, Artificial Sequence
  Description of Artificial Sequence: Synthetic oligonucleotide
  Target: ATXN1; (-) strand; PAM type: NRG; PAM sequence: TAG
tcctgcctcagcctcccaag

SEQ ID NO: 60229 - DNA, 20 bp, Artificial Sequence
  Description of Artificial Sequence: Synthetic oligonucleotide
  Target: ATXN1; (-) strand; PAM type: NRG; PAM sequence: AAG
ttctcctgcctcagcctccc

SEQ ID NO: 60230 - DNA, 20 bp, Artificial Sequence
  Description of Artificial Sequence: Synthetic oligonucleotide
  Target: ATXN1; (-) strand; PAM type: NRG; PAM sequence: CAG
ttcaagcaattctcctgcct

SEQ ID NO: 60231 - DNA, 20 bp, Artificial Sequence
  Description of Artificial Sequence: Synthetic oligonucleotide
  Target: ATXN1; (-) strand; PAM type: NRG; PAM sequence: AAG
aacctccgtctcctgggttc

SEQ ID NO: 60232 - DNA, 20 bp, Artificial Sequence
  Description of Artificial Sequence: Synthetic oligonucleotide
  Target: ATXN1; (-) strand; PAM type: NRG; PAM sequence: GGG
cacggcaacctccgtctcct

SEQ ID NO: 60233 - DNA, 20 bp, Artificial Sequence
  Description of Artificial Sequence: Synthetic oligonucleotide
  Target: ATXN1; (-) strand; PAM type: NRG; PAM sequence: TGG
tcacggcaacctccgtctcc

SEQ ID NO: 60234 - DNA, 20 bp, Artificial Sequence
  Description of Artificial Sequence: Synthetic oligonucleotide
  Target: ATXN1; (-) strand; PAM type: NRG; PAM sequence: CGG
agtggcacgatcttggctca

SEQ ID NO: 60235 - DNA, 20 bp, Artificial Sequence
  Description of Artificial Sequence: Synthetic oligonucleotide
  Target: ATXN1; (-) strand; PAM type: NRG; PAM sequence: TGG
ggagtgcagtggcacgatct

SEQ ID NO: 60236 - DNA, 20 bp, Artificial Sequence
  Description of Artificial Sequence: Synthetic oligonucleotide
  Target: ATXN1; (-) strand; PAM type: NRG; PAM sequence: TGG
tcacccaggctggagtgcag

SEQ ID NO: 60237 - DNA, 20 bp, Artificial Sequence
  Description of Artificial Sequence: Synthetic oligonucleotide
  Target: ATXN1; (-) strand; PAM type: NRG; PAM sequence: CAG
ttgtcacccaggctggagtg

SEQ ID NO: 60238 - DNA, 20 bp, Artificial Sequence
  Description of Artificial Sequence: Synthetic oligonucleotide
  Target: ATXN1; (-) strand; PAM type: NRG; PAM sequence: GAG
cactcttgtcacccaggctg

SEQ ID NO: 60239 - DNA, 20 bp, Artificial Sequence
  Description of Artificial Sequence: Synthetic oligonucleotide
  Target: ATXN1; (-) strand; PAM type: NRG; PAM sequence: TGG
ttcactcttgtcacccaggc

SEQ ID NO: 60240 - DNA, 20 bp, Artificial Sequence
  Description of Artificial Sequence: Synthetic oligonucleotide
  Target: ATXN1; (-) strand; PAM type: NRG; PAM sequence: AGG
gaatttcactcttgtcaccc

SEQ ID NO: 60241 - DNA, 20 bp, Artificial Sequence
  Description of Artificial Sequence: Synthetic oligonucleotide
  Target: ATXN1; (-) strand; PAM type: NRG; PAM sequence: CAG
ggaatttcactcttgtcacc

SEQ ID NO: 60242 - DNA, 20 bp, Artificial Sequence
  Description of Artificial Sequence: Synthetic oligonucleotide
  Target: ATXN1; (-) strand; PAM type: NRG; PAM sequence: TGG
ttttgttttgtttttggaaa

SEQ ID NO: 60243 - DNA, 20 bp, Artificial Sequence
  Description of Artificial Sequence: Synthetic oligonucleotide
  Target: ATXN1; (-) strand; PAM type: NRG; PAM sequence: TGG
gttttgttttgttttgtttt

SEQ ID NO: 60244 - DNA, 20 bp, Artificial Sequence
  Description of Artificial Sequence: Synthetic oligonucleotide
  Target: ATXN1; (-) strand; PAM type: NRG; PAM sequence: TGG
ttgcctgggagtcatcttta

SEQ ID NO: 60245 - DNA, 20 bp, Artificial Sequence
  Description of Artificial Sequence: Synthetic oligonucleotide
  Target: ATXN1; (-) strand; PAM type: NRG; PAM sequence: GAG
gcccttcaaaccttgcctgg

SEQ ID NO: 60246 - DNA, 20 bp, Artificial Sequence
  Description of Artificial Sequence: Synthetic oligonucleotide
  Target: ATXN1; (-) strand; PAM type: NRG; PAM sequence: GGG
tagcccttcaaaccttgcct

SEQ ID NO: 60247 - DNA, 20 bp, Artificial Sequence
  Description of Artificial Sequence: Synthetic oligonucleotide
  Target: ATXN1; (-) strand; PAM type: NRG; PAM sequence: TGG
ctagcccttcaaaccttgcc

SEQ ID NO: 60248 - DNA, 20 bp, Artificial Sequence
  Description of Artificial Sequence: Synthetic oligonucleotide
  Target: ATXN1; (-) strand; PAM type: NRG; PAM sequence: TAG
ccaaaaaactggctctcctc

SEQ ID NO: 60249 - DNA, 20 bp, Artificial Sequence
  Description of Artificial Sequence: Synthetic oligonucleotide
  Target: ATXN1; (-) strand; PAM type: NRG; PAM sequence: TGG
ctagttcttggccaaaaaac

SEQ ID NO: 60250 - DNA, 20 bp, Artificial Sequence
  Description of Artificial Sequence: Synthetic oligonucleotide
  Target: ATXN1; (-) strand; PAM type: NRG; PAM sequence: TGG
cattgcatcctcctagttct

SEQ ID NO: 60251 - DNA, 20 bp, Artificial Sequence
  Description of Artificial Sequence: Synthetic oligonucleotide
  Target: ATXN1; (-) strand; PAM type: NRG; PAM sequence: TAG
tctgaatcattgcatcctcc

SEQ ID NO: 60252 - DNA, 20 bp, Artificial Sequence
  Description of Artificial Sequence: Synthetic oligonucleotide
  Target: ATXN1; (-) strand; PAM type: NRG; PAM sequence: CAG
cccatgcattcatcccaccc

SEQ ID NO: 60253 - DNA, 20 bp, Artificial Sequence
  Description of Artificial Sequence: Synthetic oligonucleotide
  Target: ATXN1; (-) strand; PAM type: NRG; PAM sequence: CGG
ggcttgtggctcttgtcttc

SEQ ID NO: 60254 - DNA, 20 bp, Artificial Sequence
  Description of Artificial Sequence: Synthetic oligonucleotide
  Target: ATXN1; (-) strand; PAM type: NRG; PAM sequence: TGG
gctaaagaactggaggcttg

SEQ ID NO: 60255 - DNA, 20 bp, Artificial Sequence
  Description of Artificial Sequence: Synthetic oligonucleotide
  Target: ATXN1; (-) strand; PAM type: NRG; PAM sequence: AGG
ttcttctgctaaagaactgg

SEQ ID NO: 60256 - DNA, 20 bp, Artificial Sequence
  Description of Artificial Sequence: Synthetic oligonucleotide
  Target: ATXN1; (-) strand; PAM type: NRG; PAM sequence: GAG
gttcttctgctaaagaactg

SEQ ID NO: 60257 - DNA, 20 bp, Artificial Sequence
  Description of Artificial Sequence: Synthetic oligonucleotide
  Target: ATXN1; (-) strand; PAM type: NRG; PAM sequence: TGG
cagttcttctgctaaagaac

SEQ ID NO: 60258 - DNA, 20 bp, Artificial Sequence
  Description of Artificial Sequence: Synthetic oligonucleotide
  Target: ATXN1; (-) strand; PAM type: NRG; PAM sequence: AAG
tacctccagttcttctgcta

SEQ ID NO: 60259 - DNA, 20 bp, Artificial Sequence
  Description of Artificial Sequence: Synthetic oligonucleotide
  Target: ATXN1; (-) strand; PAM type: NRG; PAM sequence: CAG
gatgcacctatctttacctc

SEQ ID NO: 60260 - DNA, 20 bp, Artificial Sequence
  Description of Artificial Sequence: Synthetic oligonucleotide
  Target: ATXN1; (-) strand; PAM type: NRG; PAM sequence: AGG
cattttaacctcctaatcac

SEQ ID NO: 60261 - DNA, 20 bp, Artificial Sequence
  Description of Artificial Sequence: Synthetic oligonucleotide
  Target: ATXN1; (-) strand; PAM type: NRG; PAM sequence: CAG
tcattttaacctcctaatca

SEQ ID NO: 60262 - DNA, 20 bp, Artificial Sequence
  Description of Artificial Sequence: Synthetic oligonucleotide
  Target: ATXN1; (-) strand; PAM type: NRG; PAM sequence: CAG
tctggagtgactctgtcttt

SEQ ID NO: 60263 - DNA, 20 bp, Artificial Sequence
  Description of Artificial Sequence: Synthetic oligonucleotide
  Target: ATXN1; (-) strand; PAM type: NRG; PAM sequence: GAG
atgagctttcccagagtctg

SEQ ID NO: 60264 - DNA, 20 bp, Artificial Sequence
  Description of Artificial Sequence: Synthetic oligonucleotide
  Target: ATXN1; (-) strand; PAM type: NRG; PAM sequence: TGG
tcatgagctttcccagagtc

SEQ ID NO: 60265 - DNA, 20 bp, Artificial Sequence
  Description of Artificial Sequence: Synthetic oligonucleotide
  Target: ATXN1; (-) strand; PAM type: NRG; PAM sequence: GAG
ttgcatcatgagctttccca

SEQ ID NO: 60266 - DNA, 20 bp, Artificial Sequence
  Description of Artificial Sequence: Synthetic oligonucleotide
  Target: ATXN1; (-) strand; PAM type: NRG; PAM sequence: CAG
gattgcatcatgagctttcc

SEQ ID NO: 60267 - DNA, 20 bp, Artificial Sequence
  Description of Artificial Sequence: Synthetic oligonucleotide
  Target: ATXN1; (-) strand; PAM type: NRG; PAM sequence: GAG
catcattttgattgcatcat

SEQ ID NO: 60268 - DNA, 20 bp, Artificial Sequence
  Description of Artificial Sequence: Synthetic oligonucleotide
  Target: ATXN1; (-) strand; PAM type: NRG; PAM sequence: TGG
gacttagcagagacacctct

SEQ ID NO: 60269 - DNA, 20 bp, Artificial Sequence
  Description of Artificial Sequence: Synthetic oligonucleotide
  Target: ATXN1; (-) strand; PAM type: NRG; PAM sequence: GAG
tatgtggcccggacttagca

SEQ ID NO: 60270 - DNA, 20 bp, Artificial Sequence
  Description of Artificial Sequence: Synthetic oligonucleotide
  Target: ATXN1; (-) strand; PAM type: NRG; PAM sequence: CAG
tttatgtggcccggacttag

SEQ ID NO: 60271 - DNA, 20 bp, Artificial Sequence
  Description of Artificial Sequence: Synthetic oligonucleotide
  Target: ATXN1; (-) strand; PAM type: NRG; PAM sequence: TAG
gtctttatgtggcccggact

SEQ ID NO: 60272 - DNA, 20 bp, Artificial Sequence
  Description of Artificial Sequence: Synthetic oligonucleotide
  Target: ATXN1; (-) strand; PAM type: NRG; PAM sequence: CGG
tctcatgtctttatgtggcc

SEQ ID NO: 60273 - DNA, 20 bp, Artificial Sequence
  Description of Artificial Sequence: Synthetic oligonucleotide
  Target: ATXN1; (-) strand; PAM type: NRG; PAM sequence: TGG
ccatctctcatgtctttatg

SEQ ID NO: 60274 - DNA, 20 bp, Artificial Sequence
  Description of Artificial Sequence: Synthetic oligonucleotide
  Target: ATXN1; (-) strand; PAM type: NRG; PAM sequence: GGG
ctcatgacctcacctgtagt

SEQ ID NO: 60275 - DNA, 20 bp, Artificial Sequence
  Description of Artificial Sequence: Synthetic oligonucleotide
  Target: ATXN1; (-) strand; PAM type: NRG; PAM sequence: TGG
actcatgacctcacctgtag

SEQ ID NO: 60276 - DNA, 20 bp, Artificial Sequence
  Description of Artificial Sequence: Synthetic oligonucleotide
  Target: ATXN1; (-) strand; PAM type: NRG; PAM sequence: TAG
aggactcatgacctcacctg

SEQ ID NO: 60277 - DNA, 20 bp, Artificial Sequence
  Description of Artificial Sequence: Synthetic oligonucleotide
  Target: ATXN1; (-) strand; PAM type: NRG; PAM sequence: AGG
gtttactttccctcaaagca

SEQ ID NO: 60278 - DNA, 20 bp, Artificial Sequence
  Description of Artificial Sequence: Synthetic oligonucleotide
  Target: ATXN1; (-) strand; PAM type: NRG; PAM sequence: AAG
tgtttactttccctcaaagc

SEQ ID NO: 60279 - DNA, 20 bp, Artificial Sequence
  Description of Artificial Sequence: Synthetic oligonucleotide
  Target: ATXN1; (-) strand; PAM type: NRG; PAM sequence: AAG
tttctgtttactttccctca

SEQ ID NO: 60280 - DNA, 20 bp, Artificial Sequence
  Description of Artificial Sequence: Synthetic oligonucleotide
  Target: ATXN1; (-) strand; PAM type: NRG; PAM sequence: TAG
ttggaaattatgcattccct

SEQ ID NO: 60281 - DNA, 20 bp, Artificial Sequence
  Description of Artificial Sequence: Synthetic oligonucleotide
  Target: ATXN1; (-) strand; PAM type: NRG; PAM sequence: TGG
cagttcgctatgacttttct

SEQ ID NO: 60282 - DNA, 20 bp, Artificial Sequence
  Description of Artificial Sequence: Synthetic oligonucleotide
  Target: ATXN1; (-) strand; PAM type: NRG; PAM sequence: CAG
ccatctcagcttcctggaca

SEQ ID NO: 60283 - DNA, 20 bp, Artificial Sequence
  Description of Artificial Sequence: Synthetic oligonucleotide
  Target: ATXN1; (-) strand; PAM type: NRG; PAM sequence: TGG
cctcttccatctcagcttcc

SEQ ID NO: 60284 - DNA, 20 bp, Artificial Sequence
  Description of Artificial Sequence: Synthetic oligonucleotide
  Target: ATXN1; (-) strand; PAM type: NRG; PAM sequence: CAG
aagttattcctcttccatct

SEQ ID NO: 60285 - DNA, 20 bp, Artificial Sequence
  Description of Artificial Sequence: Synthetic oligonucleotide
  Target: ATXN1; (-) strand; PAM type: NRG; PAM sequence: AAG
ccacatttagtacttttaag

SEQ ID NO: 60286 - DNA, 20 bp, Artificial Sequence
  Description of Artificial Sequence: Synthetic oligonucleotide
  Target: ATXN1; (-) strand; PAM type: NRG; PAM sequence: AAG
tggccacatttagtactttt

SEQ ID NO: 60287 - DNA, 20 bp, Artificial Sequence
  Description of Artificial Sequence: Synthetic oligonucleotide
  Target: ATXN1; (-) strand; PAM type: NRG; PAM sequence: TAG
ccaccgcgcctggccacatt

SEQ ID NO: 60288 - DNA, 20 bp, Artificial Sequence
  Description of Artificial Sequence: Synthetic oligonucleotide
  Target: ATXN1; (-) strand; PAM type: NRG; PAM sequence: TGG
caggcatgagccaccgcgcc

SEQ ID NO: 60289 - DNA, 20 bp, Artificial Sequence
  Description of Artificial Sequence: Synthetic oligonucleotide
  Target: ATXN1; (-) strand; PAM type: NRG; PAM sequence: GAG
agtgctgggattacaggcat

SEQ ID NO: 60290 - DNA, 20 bp, Artificial Sequence
  Description of Artificial Sequence: Synthetic oligonucleotide
  Target: ATXN1; (-) strand; PAM type: NRG; PAM sequence: AGG
tcccaaagtgctgggattac

SEQ ID NO: 60291 - DNA, 20 bp, Artificial Sequence
  Description of Artificial Sequence: Synthetic oligonucleotide
  Target: ATXN1; (-) strand; PAM type: NRG; PAM sequence: CAG
ctcccaaagtgctgggatta

SEQ ID NO: 60292 - DNA, 20 bp, Artificial Sequence
  Description of Artificial Sequence: Synthetic oligonucleotide
  Target: ATXN1; (-) strand; PAM type: NRG; PAM sequence: GGG
ccttggcctcccaaagtgct

SEQ ID NO: 60293 - DNA, 20 bp, Artificial Sequence
  Description of Artificial Sequence: Synthetic oligonucleotide
  Target: ATXN1; (-) strand; PAM type: NRG; PAM sequence: TGG
gccttggcctcccaaagtgc

SEQ ID NO: 60294 - DNA, 20 bp, Artificial Sequence
  Description of Artificial Sequence: Synthetic oligonucleotide
  Target: ATXN1; (-) strand; PAM type: NRG; PAM sequence: AAG
ccacccgccttggcctccca

SEQ ID NO: 60295 - DNA, 20 bp, Artificial Sequence
  Description of Artificial Sequence: Synthetic oligonucleotide
  Target: ATXN1; (-) strand; PAM type: NRG; PAM sequence: TGG
accttgtggtccacccgcct

SEQ ID NO: 60296 - DNA, 20 bp, Artificial Sequence
  Description of Artificial Sequence: Synthetic oligonucleotide
  Target: ATXN1; (-) strand; PAM type: NRG; PAM sequence: TGG
ttctcgatctcctgaccttg

SEQ ID NO: 60297 - DNA, 20 bp, Artificial Sequence
  Description of Artificial Sequence: Synthetic oligonucleotide
  Target: ATXN1; (-) strand; PAM type: NRG; PAM sequence: AGG
ggggtttcactgtgttagcc

SEQ ID NO: 60298 - DNA, 20 bp, Artificial Sequence
  Description of Artificial Sequence: Synthetic oligonucleotide
  Target: ATXN1; (-) strand; PAM type: NRG; PAM sequence: CAG
tggggtttcactgtgttagc

SEQ ID NO: 60299 - DNA, 20 bp, Artificial Sequence
  Description of Artificial Sequence: Synthetic oligonucleotide
  Target: ATXN1; (-) strand; PAM type: NRG; PAM sequence: TAG
gagatggggtttcactgtgt

SEQ ID NO: 60300 - DNA, 20 bp, Artificial Sequence
  Description of Artificial Sequence: Synthetic oligonucleotide
  Target: ATXN1; (-) strand; PAM type: NRG; PAM sequence: GGG
ttgtatttttagtagagatg

SEQ ID NO: 60301 - DNA, 20 bp, Artificial Sequence
  Description of Artificial Sequence: Synthetic oligonucleotide
  Target: ATXN1; (-) strand; PAM type: NRG; PAM sequence: GGG
tttgtatttttagtagagat

SEQ ID NO: 60302 - DNA, 20 bp, Artificial Sequence
  Description of Artificial Sequence: Synthetic oligonucleotide
  Target: ATXN1; (-) strand; PAM type: NRG; PAM sequence: TGG
ttttgtatttttagtagaga

SEQ ID NO: 60303 - DNA, 20 bp, Artificial Sequence
  Description of Artificial Sequence: Synthetic oligonucleotide
  Target: ATXN1; (-) strand; PAM type: NRG; PAM sequence: GAG
taatttttgtatttttagta

SEQ ID NO: 60304 - DNA, 20 bp, Artificial Sequence
  Description of Artificial Sequence: Synthetic oligonucleotide
  Target: ATXN1; (-) strand; PAM type: NRG; PAM sequence: TAG
gctaatttttgtatttttag

SEQ ID NO: 60305 - DNA, 20 bp, Artificial Sequence
  Description of Artificial Sequence: Synthetic oligonucleotide
  Target: ATXN1; (-) strand; PAM type: NRG; PAM sequence: TAG
ccagctaatttttgtatttt

SEQ ID NO: 60306 - DNA, 20 bp, Artificial Sequence
  Description of Artificial Sequence: Synthetic oligonucleotide
  Target: ATXN1; (-) strand; PAM type: NRG; PAM sequence: CAG
caggcacctgccactgcgcc

SEQ ID NO: 60307 - DNA, 20 bp, Artificial Sequence
  Description of Artificial Sequence: Synthetic oligonucleotide
  Target: ATXN1; (-) strand; PAM type: NRG; PAM sequence: AGG
tccctagtagctgggattac

SEQ ID NO: 60308 - DNA, 20 bp, Artificial Sequence
  Description of Artificial Sequence: Synthetic oligonucleotide
  Target: ATXN1; (-) strand; PAM type: NRG; PAM sequence: CAG
ctccctagtagctgggatta

SEQ ID NO: 60309 - DNA, 20 bp, Artificial Sequence
  Description of Artificial Sequence: Synthetic oligonucleotide
  Target: ATXN1; (-) strand; PAM type: NRG; PAM sequence: GGG
cctcagcctccctagtagct

SEQ ID NO: 60310 - DNA, 20 bp, Artificial Sequence
  Description of Artificial Sequence: Synthetic oligonucleotide
  Target: ATXN1; (-) strand; PAM type: NRG; PAM sequence: TGG
gcctcagcctccctagtagc

SEQ ID NO: 60311 - DNA, 20 bp, Artificial Sequence
  Description of Artificial Sequence: Synthetic oligonucleotide
  Target: ATXN1; (-) strand; PAM type: NRG; PAM sequence: TAG
tcctgcctcagcctccctag

SEQ ID NO: 60312 - DNA, 20 bp, Artificial Sequence
  Description of Artificial Sequence: Synthetic oligonucleotide
  Target: ATXN1; (-) strand; PAM type: NRG; PAM sequence: TAG
ttctcctgcctcagcctccc

SEQ ID NO: 60313 - DNA, 20 bp, Artificial Sequence
  Description of Artificial Sequence: Synthetic oligonucleotide
  Target: ATXN1; (-) strand; PAM type: NRG; PAM sequence: CAG
tacaagcgattctcctgcct

SEQ ID NO: 60314 - DNA, 20 bp, Artificial Sequence
  Description of Artificial Sequence: Synthetic oligonucleotide
  Target: ATXN1; (-) strand; PAM type: NRG; PAM sequence: AAG
ctctgcccccgcctgggtac

SEQ ID NO: 60315 - DNA, 20 bp, Artificial Sequence
  Description of Artificial Sequence: Synthetic oligonucleotide
  Target: ATXN1; (-) strand; PAM type: NRG; PAM sequence: GGG
tgcaatctctgcccccgcct

SEQ ID NO: 60316 - DNA, 20 bp, Artificial Sequence
  Description of Artificial Sequence: Synthetic oligonucleotide
  Target: ATXN1; (-) strand; PAM type: NRG; PAM sequence: TGG
ctgcaatctctgcccccgcc

SEQ ID NO: 60317 - DNA, 20 bp, Artificial Sequence
  Description of Artificial Sequence: Synthetic oligonucleotide
  Target: ATXN1; (-) strand; PAM type: NRG; PAM sequence: CGG
ggagtgcagtggcgcaatct

SEQ ID NO: 60318 - DNA, 20 bp, Artificial Sequence
  Description of Artificial Sequence: Synthetic oligonucleotide
  Target: ATXN1; (-) strand; PAM type: NRG; PAM sequence: TGG
tcacccagactggagtgcag

SEQ ID NO: 60319 - DNA, 20 bp, Artificial Sequence
  Description of Artificial Sequence: Synthetic oligonucleotide
  Target: ATXN1; (-) strand; PAM type: NRG; PAM sequence: CAG
ctgtcacccagactggagtg

SEQ ID NO: 60320 - DNA, 20 bp, Artificial Sequence
  Description of Artificial Sequence: Synthetic oligonucleotide
  Target: ATXN1; (-) strand; PAM type: NRG; PAM sequence: GAG
tgactctgtcacccagactg

SEQ ID NO: 60321 - DNA, 20 bp, Artificial Sequence
  Description of Artificial Sequence: Synthetic oligonucleotide
  Target: ATXN1; (-) strand; PAM type: NRG; PAM sequence: TGG
tctgactctgtcacccagac

SEQ ID NO: 60322 - DNA, 20 bp, Artificial Sequence
  Description of Artificial Sequence: Synthetic oligonucleotide
  Target: ATXN1; (-) strand; PAM type: NRG; PAM sequence: CAG
tggggtctgactctgtcacc

SEQ ID NO: 60323 - DNA, 20 bp, Artificial Sequence
  Description of Artificial Sequence: Synthetic oligonucleotide
  Target: ATXN1; (-) strand; PAM type: NRG; PAM sequence: GGG
ttttttttttttttgagatg

SEQ ID NO: 60324 - DNA, 20 bp, Artificial Sequence
  Description of Artificial Sequence: Synthetic oligonucleotide
  Target: ATXN1; (-) strand; PAM type: NRG; PAM sequence: GGG
tttttttttttttttgagat

SEQ ID NO: 60325 - DNA, 20 bp, Artificial Sequence
  Description of Artificial Sequence: Synthetic oligonucleotide
  Target: ATXN1; (-) strand; PAM type: NRG; PAM sequence: TGG
ttttttttttttttttgaga

SEQ ID NO: 60326 - DNA, 20 bp, Artificial Sequence
  Description of Artificial Sequence: Synthetic oligonucleotide
  Target: ATXN1; (-) strand; PAM type: NRG; PAM sequence: GAG
tttttttttttttttttttt

SEQ ID NO: 60327 - DNA, 20 bp, Artificial Sequence
  Description of Artificial Sequence: Synthetic oligonucleotide
  Target: ATXN1; (-) strand; PAM type: NRG; PAM sequence: AGG
tgggttccctcctgacattt

SEQ ID NO: 60328 - DNA, 20 bp, Artificial Sequence
  Description of Artificial Sequence: Synthetic oligonucleotide
  Target: ATXN1; (-) strand; PAM type: NRG; PAM sequence: TAG
ttgggttccctcctgacatt

SEQ ID NO: 60329 - DNA, 20 bp, Artificial Sequence
  Description of Artificial Sequence: Synthetic oligonucleotide
  Target: ATXN1; (-) strand; PAM type: NRG; PAM sequence: GGG
tgatagagagttatcctctt

SEQ ID NO: 60330 - DNA, 20 bp, Artificial Sequence
  Description of Artificial Sequence: Synthetic oligonucleotide
  Target: ATXN1; (-) strand; PAM type: NRG; PAM sequence: TGG
ttgatagagagttatcctct

SEQ ID NO: 60331 - DNA, 20 bp, Artificial Sequence
  Description of Artificial Sequence: Synthetic oligonucleotide
  Target: ATXN1; (-) strand; PAM type: NRG; PAM sequence: GAG
taggaaccctacttgataga

SEQ ID NO: 60332 - DNA, 20 bp, Artificial Sequence
  Description of Artificial Sequence: Synthetic oligonucleotide
  Target: ATXN1; (-) strand; PAM type: NRG; PAM sequence: GAG
tctaggaaccctacttgata

SEQ ID NO: 60333 - DNA, 20 bp, Artificial Sequence
  Description of Artificial Sequence: Synthetic oligonucleotide
  Target: ATXN1; (-) strand; PAM type: NRG; PAM sequence: TAG
aatctaggaaccctacttga

SEQ ID NO: 60334 - DNA, 20 bp, Artificial Sequence
  Description of Artificial Sequence: Synthetic oligonucleotide
  Target: ATXN1; (-) strand; PAM type: NRG; PAM sequence: AGG
ttctgaaagagaagaaatct

SEQ ID NO: 60335 - DNA, 20 bp, Artificial Sequence
  Description of Artificial Sequence: Synthetic oligonucleotide
  Target: ATXN1; (-) strand; PAM type: NRG; PAM sequence: TAG
attctgaaagagaagaaatc

SEQ ID NO: 60336 - DNA, 20 bp, Artificial Sequence
  Description of Artificial Sequence: Synthetic oligonucleotide
  Target: ATXN1; (-) strand; PAM type: NRG; PAM sequence: AAG
agatgagaattctgaaagag

SEQ ID NO: 60337 - DNA, 20 bp, Artificial Sequence
  Description of Artificial Sequence: Synthetic oligonucleotide
  Target: ATXN1; (-) strand; PAM type: NRG; PAM sequence: GAG
atcagatgagaattctgaaa

SEQ ID NO: 60338 - DNA, 20 bp, Artificial Sequence
  Description of Artificial Sequence: Synthetic oligonucleotide
  Target: ATXN1; (-) strand; PAM type: NRG; PAM sequence: AAG
tgatcagatgagaattctga

SEQ ID NO: 60339 - DNA, 20 bp, Artificial Sequence
  Description of Artificial Sequence: Synthetic oligonucleotide
  Target: ATXN1; (-) strand; PAM type: NRG; PAM sequence: GAG
tatcctaaatatgatcagat

SEQ ID NO: 60340 - DNA, 20 bp, Artificial Sequence
  Description of Artificial Sequence: Synthetic oligonucleotide
  Target: ATXN1; (-) strand; PAM type: NRG; PAM sequence: CAG
tgcgctatcctaaatatgat

SEQ ID NO: 60341 - DNA, 20 bp, Artificial Sequence
  Description of Artificial Sequence: Synthetic oligonucleotide
  Target: ATXN1; (-) strand; PAM type: NRG; PAM sequence: TGG
agttcttcgatttcaccagt

SEQ ID NO: 60342 - DNA, 20 bp, Artificial Sequence
  Description of Artificial Sequence: Synthetic oligonucleotide
  Target: ATXN1; (-) strand; PAM type: NRG; PAM sequence: CAG
tgaaagttcttcgatttcac

SEQ ID NO: 60343 - DNA, 20 bp, Artificial Sequence
  Description of Artificial Sequence: Synthetic oligonucleotide
  Target: ATXN1; (-) strand; PAM type: NRG; PAM sequence: AAG
gtatatgaatgtaagagtga

SEQ ID NO: 60344 - DNA, 20 bp, Artificial Sequence
  Description of Artificial Sequence: Synthetic oligonucleotide
  Target: ATXN1; (-) strand; PAM type: NRG; PAM sequence: GAG
tttccagtatatgaatgtaa

SEQ ID NO: 60345 - DNA, 20 bp, Artificial Sequence
  Description of Artificial Sequence: Synthetic oligonucleotide
  Target: ATXN1; (-) strand; PAM type: NRG; PAM sequence: AAG
cttttccagtatatgaatgt

SEQ ID NO: 60346 - DNA, 20 bp, Artificial Sequence
  Description of Artificial Sequence: Synthetic oligonucleotide
  Target: ATXN1; (-) strand; PAM type: NRG; PAM sequence: CAG
tttctggctactgacttttc

SEQ ID NO: 60347 - DNA, 20 bp, Artificial Sequence
  Description of Artificial Sequence: Synthetic oligonucleotide
  Target: ATXN1; (-) strand; PAM type: NRG; PAM sequence: TGG
agattttcaaaatatttttc

SEQ ID NO: 60348 - DNA, 20 bp, Artificial Sequence
  Description of Artificial Sequence: Synthetic oligonucleotide
  Target: ATXN1; (-) strand; PAM type: NRG; PAM sequence: CAG
tctttccatctgaattatta

SEQ ID NO: 60349 - DNA, 20 bp, Artificial Sequence
  Description of Artificial Sequence: Synthetic oligonucleotide
  Target: ATXN1; (-) strand; PAM type: NRG; PAM sequence: AAG
tttcttctctcacattgcaa

SEQ ID NO: 60350 - DNA, 20 bp, Artificial Sequence
  Description of Artificial Sequence: Synthetic oligonucleotide
  Target: ATXN1; (-) strand; PAM type: NRG; PAM sequence: TAG
tacatgtagctttacagaaa

SEQ ID NO: 60351 - DNA, 20 bp, Artificial Sequence
  Description of Artificial Sequence: Synthetic oligonucleotide
  Target: ATXN1; (-) strand; PAM type: NRG; PAM sequence: CAG
aataaatacatgtagcttta

SEQ ID NO: 60352 - DNA, 20 bp, Artificial Sequence
  Description of Artificial Sequence: Synthetic oligonucleotide
  Target: ATXN1; (-) strand; PAM type: NRG; PAM sequence: TAG
tatatacaaataaatacatg

SEQ ID NO: 60353 - DNA, 20 bp, Artificial Sequence
  Description of Artificial Sequence: Synthetic oligonucleotide
  Target: ATXN1; (-) strand; PAM type: NRG; PAM sequence: TGG
ttcttccagaagattttcta

SEQ ID NO: 60354 - DNA, 20 bp, Artificial Sequence
  Description of Artificial Sequence: Synthetic oligonucleotide
  Target: ATXN1; (-) strand; PAM type: NRG; PAM sequence: AAG
ttgagtgtgttttcttccag

SEQ ID NO: 60355 - DNA, 20 bp, Artificial Sequence
  Description of Artificial Sequence: Synthetic oligonucleotide
  Target: ATXN1; (-) strand; PAM type: NRG; PAM sequence: CAG
catttgagtgtgttttcttc

SEQ ID NO: 60356 - DNA, 20 bp, Artificial Sequence
  Description of Artificial Sequence: Synthetic oligonucleotide
  Target: ATXN1; (-) strand; PAM type: NRG; PAM sequence: GAG
gttcaccaccgttagcattt

SEQ ID NO: 60357 - DNA, 20 bp, Artificial Sequence
  Description of Artificial Sequence: Synthetic oligonucleotide
  Target: ATXN1; (-) strand; PAM type: NRG; PAM sequence: TAG
ccatagatgttcaccaccgt

SEQ ID NO: 60358 - DNA, 20 bp, Artificial Sequence
  Description of Artificial Sequence: Synthetic oligonucleotide
  Target: ATXN1; (-) strand; PAM type: NRG; PAM sequence: TAG
cattattatctacctgccca

SEQ ID NO: 60359 - DNA, 20 bp, Artificial Sequence
  Description of Artificial Sequence: Synthetic oligonucleotide
  Target: ATXN1; (-) strand; PAM type: NRG; PAM sequence: TAG
gaaattaaggaaatacaaac

SEQ ID NO: 60360 - DNA, 20 bp, Artificial Sequence
  Description of Artificial Sequence: Synthetic oligonucleotide
  Target: ATXN1; (-) strand; PAM type: NRG; PAM sequence: AGG
aatagcttgaagagaaatta

SEQ ID NO: 60361 - DNA, 20 bp, Artificial Sequence
  Description of Artificial Sequence: Synthetic oligonucleotide
  Target: ATXN1; (-) strand; PAM type: NRG; PAM sequence: AAG
taatagcttgaagagaaatt

SEQ ID NO: 60362 - DNA, 20 bp, Artificial Sequence
  Description of Artificial Sequence: Synthetic oligonucleotide
  Target: ATXN1; (-) strand; PAM type: NRG; PAM sequence: GAG
attctctgtaatagcttgaa

SEQ ID NO: 60363 - DNA, 20 bp, Artificial Sequence
  Description of Artificial Sequence: Synthetic oligonucleotide
  Target: ATXN1; (-) strand; PAM type: NRG; PAM sequence: AAG
ggattctctgtaatagcttg

SEQ ID NO: 60364 - DNA, 20 bp, Artificial Sequence
  Description of Artificial Sequence: Synthetic oligonucleotide
  Target: ATXN1; (-) strand; PAM type: NRG; PAM sequence: TAG
tttacatggattctctgtaa

SEQ ID NO: 60365 - DNA, 20 bp, Artificial Sequence
  Description of Artificial Sequence: Synthetic oligonucleotide
  Target: ATXN1; (-) strand; PAM type: NRG; PAM sequence: TGG
gaaaacattagtcttttaca

SEQ ID NO: 60366 - DNA, 20 bp, Artificial Sequence
  Description of Artificial Sequence: Synthetic oligonucleotide
  Target: ATXN1; (-) strand; PAM type: NRG; PAM sequence: TAG
aatcctttcattgaaaacat

SEQ ID NO: 60367 - DNA, 20 bp, Artificial Sequence
  Description of Artificial Sequence: Synthetic oligonucleotide
  Target: ATXN1; (-) strand; PAM type: NRG; PAM sequence: AAG
aacttgagttatgagatgga

SEQ ID NO: 60368 - DNA, 20 bp, Artificial Sequence
  Description of Artificial Sequence: Synthetic oligonucleotide
  Target: ATXN1; (-) strand; PAM type: NRG; PAM sequence: TGG
tggaaacttgagttatgaga

SEQ ID NO: 60369 - DNA, 20 bp, Artificial Sequence
  Description of Artificial Sequence: Synthetic oligonucleotide
  Target: ATXN1; (-) strand; PAM type: NRG; PAM sequence: GAG
ttattggaaacttgagttat

SEQ ID NO: 60370 - DNA, 20 bp, Artificial Sequence
  Description of Artificial Sequence: Synthetic oligonucleotide
  Target: ATXN1; (-) strand; PAM type: NRG; PAM sequence: GAG
gaagacgttattggaaactt

SEQ ID NO: 60371 - DNA, 20 bp, Artificial Sequence
  Description of Artificial Sequence: Synthetic oligonucleotide
  Target: ATXN1; (-) strand; PAM type: NRG; PAM sequence: TGG
ctcagcgaggaagacgttat

SEQ ID NO: 60372 - DNA, 20 bp, Artificial Sequence
  Description of Artificial Sequence: Synthetic oligonucleotide
  Target: ATXN1; (-) strand; PAM type: NRG; PAM sequence: AAG
ctattctaccctcagcgagg

SEQ ID NO: 60373 - DNA, 20 bp, Artificial Sequence
  Description of Artificial Sequence: Synthetic oligonucleotide
  Target: ATXN1; (-) strand; PAM type: NRG; PAM sequence: AGG
tgactattctaccctcagcg

SEQ ID NO: 60374 - DNA, 20 bp, Artificial Sequence
  Description of Artificial Sequence: Synthetic oligonucleotide
  Target: ATXN1; (-) strand; PAM type: NRG; PAM sequence: GAG
ctgactattctaccctcagc

SEQ ID NO: 60375 - DNA, 20 bp, Artificial Sequence
  Description of Artificial Sequence: Synthetic oligonucleotide
  Target: ATXN1; (-) strand; PAM type: NRG; PAM sequence: CAG
ggcactgactattctaccct

SEQ ID NO: 60376 - DNA, 20 bp, Artificial Sequence
  Description of Artificial Sequence: Synthetic oligonucleotide
  Target: ATXN1; (-) strand; PAM type: NRG; PAM sequence: AGG
caaacactggcttttgtgta

SEQ ID NO: 60377 - DNA, 20 bp, Artificial Sequence
  Description of Artificial Sequence: Synthetic oligonucleotide
  Target: ATXN1; (-) strand; PAM type: NRG; PAM sequence: AAG
gcaaacactggcttttgtgt

SEQ ID NO: 60378 - DNA, 20 bp, Artificial Sequence
  Description of Artificial Sequence: Synthetic oligonucleotide
  Target: ATXN1; (-) strand; PAM type: NRG; PAM sequence: TGG
cagtcatttaatgcaaacac

SEQ ID NO: 60379 - DNA, 20 bp, Artificial Sequence
  Description of Artificial Sequence: Synthetic oligonucleotide
  Target: ATXN1; (-) strand; PAM type: NRG; PAM sequence: CAG
tgttatgcgaggctgcacca

SEQ ID NO: 60380 - DNA, 20 bp, Artificial Sequence
  Description of Artificial Sequence: Synthetic oligonucleotide
  Target: ATXN1; (-) strand; PAM type: NRG; PAM sequence: AGG
gaagtcatttatgttatgcg

SEQ ID NO: 60381 - DNA, 20 bp, Artificial Sequence
  Description of Artificial Sequence: Synthetic oligonucleotide
  Target: ATXN1; (-) strand; PAM type: NRG; PAM sequence: GAG
tgaagtcatttatgttatgc

SEQ ID NO: 60382 - DNA, 20 bp, Artificial Sequence
  Description of Artificial Sequence: Synthetic oligonucleotide
  Target: ATXN1; (-) strand; PAM type: NRG; PAM sequence: AAG
gcatcaggatgtggctgttg

SEQ ID NO: 60383 - DNA, 20 bp, Artificial Sequence
  Description of Artificial Sequence: Synthetic oligonucleotide
  Target: ATXN1; (-) strand; PAM type: NRG; PAM sequence: TGG
ttcccttgtgcatcaggatg

SEQ ID NO: 60384 - DNA, 20 bp, Artificial Sequence
  Description of Artificial Sequence: Synthetic oligonucleotide
  Target: ATXN1; (-) strand; PAM type: NRG; PAM sequence: AGG
tttgttttcccttgtgcatc

SEQ ID NO: 60385 - DNA, 20 bp, Artificial Sequence
  Description of Artificial Sequence: Synthetic oligonucleotide
  Target: ATXN1; (-) strand; PAM type: NRG; PAM sequence: CAG
ctttgttttcccttgtgcat

SEQ ID NO: 60386 - DNA, 20 bp, Artificial Sequence
  Description of Artificial Sequence: Synthetic oligonucleotide
  Target: ATXN1; (-) strand; PAM type: NRG; PAM sequence: TAG
tccattactttttgtgactt

SEQ ID NO: 60387 - DNA, 20 bp, Artificial Sequence
  Description of Artificial Sequence: Synthetic oligonucleotide
  Target: ATXN1; (-) strand; PAM type: NRG; PAM sequence: GGG
ggggtctgtctccccgccca

SEQ ID NO: 60388 - DNA, 20 bp, Artificial Sequence
  Description of Artificial Sequence: Synthetic oligonucleotide
  Target: ATXN1; (-) strand; PAM type: NRG; PAM sequence: AGG
gggggtctgtctccccgccc

SEQ ID NO: 60389 - DNA, 20 bp, Artificial Sequence
  Description of Artificial Sequence: Synthetic oligonucleotide
  Target: ATXN1; (-) strand; PAM type: NRG; PAM sequence: CAG
tgggggtctgtctccccgcc

SEQ ID NO: 60390 - DNA, 20 bp, Artificial Sequence
  Description of Artificial Sequence: Synthetic oligonucleotide
  Target: ATXN1; (-) strand; PAM type: NRG; PAM sequence: GGG
tgctggggatgtgtgggtgg

SEQ ID NO: 60391 - DNA, 20 bp, Artificial Sequence
  Description of Artificial Sequence: Synthetic oligonucleotide
  Target: ATXN1; (-) strand; PAM type: NRG; PAM sequence: GGG
gtgctggggatgtgtgggtg

SEQ ID NO: 60392 - DNA, 20 bp, Artificial Sequence
  Description of Artificial Sequence: Synthetic oligonucleotide
  Target: ATXN1; (-) strand; PAM type: NRG; PAM sequence: GGG
agtgctggggatgtgtgggt

SEQ ID NO: 60393 - DNA, 20 bp, Artificial Sequence
  Description of Artificial Sequence: Synthetic oligonucleotide
  Target: ATXN1; (-) strand; PAM type: NRG; PAM sequence: TGG
aagtgctggggatgtgtggg

SEQ ID NO: 60394 - DNA, 20 bp, Artificial Sequence
  Description of Artificial Sequence: Synthetic oligonucleotide
  Target: ATXN1; (-) strand; PAM type: NRG; PAM sequence: GGG
aacaagtgctggggatgtgt

SEQ ID NO: 60395 - DNA, 20 bp, Artificial Sequence
  Description of Artificial Sequence: Synthetic oligonucleotide
  Target: ATXN1; (-) strand; PAM type: NRG; PAM sequence: TGG
aaacaagtgctggggatgtg

SEQ ID NO: 60396 - DNA, 20 bp, Artificial Sequence
  Description of Artificial Sequence: Synthetic oligonucleotide
  Target: ATXN1; (-) strand; PAM type: NRG; PAM sequence: GGG
agtcaagaaaacaagtgctg

SEQ ID NO: 60397 - DNA, 20 bp, Artificial Sequence
  Description of Artificial Sequence: Synthetic oligonucleotide
  Target: ATXN1; (-) strand; PAM type: NRG; PAM sequence: GGG
gagtcaagaaaacaagtgct

SEQ ID NO: 60398 - DNA, 20 bp, Artificial Sequence
  Description of Artificial Sequence: Synthetic oligonucleotide
  Target: ATXN1; (-) strand; PAM type: NRG; PAM sequence: TGG
agagtcaagaaaacaagtgc

SEQ ID NO: 60399 - DNA, 20 bp, Artificial Sequence
  Description of Artificial Sequence: Synthetic oligonucleotide
  Target: ATXN1; (-) strand; PAM type: NRG; PAM sequence: AAG
gcctccagagtcaagaaaac

SEQ ID NO: 60400 - DNA, 20 bp, Artificial Sequence
  Description of Artificial Sequence: Synthetic oligonucleotide
  Target: ATXN1; (-) strand; PAM type: NRG; PAM sequence: AAG
aagaaagcgcctccagagtc

SEQ ID NO: 60401 - DNA, 20 bp, Artificial Sequence
  Description of Artificial Sequence: Synthetic oligonucleotide
  Target: ATXN1; (-) strand; PAM type: NRG; PAM sequence: GAG
taatcaagaaagcgcctcca

SEQ ID NO: 60402 - DNA, 20 bp, Artificial Sequence
  Description of Artificial Sequence: Synthetic oligonucleotide
  Target: ATXN1; (-) strand; PAM type: NRG; PAM sequence: CAG
actaatcaagaaagcgcctc

SEQ ID NO: 60403 - DNA, 20 bp, Artificial Sequence
  Description of Artificial Sequence: Synthetic oligonucleotide
  Target: ATXN1; (-) strand; PAM type: NRG; PAM sequence: AAG
tttaaatagactaatcaaga

SEQ ID NO: 60404 - DNA, 20 bp, Artificial Sequence
  Description of Artificial Sequence: Synthetic oligonucleotide
  Target: ATXN1; (-) strand; PAM type: NRG; PAM sequence: AAG
tttttttaaatagactaatc

SEQ ID NO: 60405 - DNA, 20 bp, Artificial Sequence
  Description of Artificial Sequence: Synthetic oligonucleotide
  Target: ATXN1; (-) strand; PAM type: NRG; PAM sequence: TAG
aacaataacatttttttaaa

SEQ ID NO: 60406 - DNA, 20 bp, Artificial Sequence
  Description of Artificial Sequence: Synthetic oligonucleotide
  Target: ATXN1; (-) strand; PAM type: NRG; PAM sequence: TAG
gtgcattttgatgttatttt

SEQ ID NO: 60407 - DNA, 20 bp, Artificial Sequence
  Description of Artificial Sequence: Synthetic oligonucleotide
  Target: ATXN1; (-) strand; PAM type: NRG; PAM sequence: GGG
catacataatttgcatcatg

SEQ ID NO: 60408 - DNA, 20 bp, Artificial Sequence
  Description of Artificial Sequence: Synthetic oligonucleotide
  Target: ATXN1; (-) strand; PAM type: NRG; PAM sequence: GGG
tcatacataatttgcatcat

SEQ ID NO: 60409 - DNA, 20 bp, Artificial Sequence
  Description of Artificial Sequence: Synthetic oligonucleotide
  Target: ATXN1; (-) strand; PAM type: NRG; PAM sequence: TGG
ttcatacataatttgcatca

SEQ ID NO: 60410 - DNA, 20 bp, Artificial Sequence
  Description of Artificial Sequence: Synthetic oligonucleotide
  Target: ATXN1; (-) strand; PAM type: NRG; PAM sequence: CGG
ccacgcttcatgctaactcc

SEQ ID NO: 60411 - DNA, 20 bp, Artificial Sequence
  Description of Artificial Sequence: Synthetic oligonucleotide
  Target: ATXN1; (-) strand; PAM type: NRG; PAM sequence: TAG
tgaggagcatatctccgtga

SEQ ID NO: 60412 - DNA, 20 bp, Artificial Sequence
  Description of Artificial Sequence: Synthetic oligonucleotide
  Target: ATXN1; (-) strand; PAM type: NRG; PAM sequence: GAG
ccctctggtttgtggatgag

SEQ ID NO: 60413 - DNA, 20 bp, Artificial Sequence
  Description of Artificial Sequence: Synthetic oligonucleotide
  Target: ATXN1; (-) strand; PAM type: NRG; PAM sequence: AGG
gtccctctggtttgtggatg

SEQ ID NO: 60414 - DNA, 20 bp, Artificial Sequence
  Description of Artificial Sequence: Synthetic oligonucleotide
  Target: ATXN1; (-) strand; PAM type: NRG; PAM sequence: GAG
cgtccctctggtttgtggat

SEQ ID NO: 60415 - DNA, 20 bp, Artificial Sequence
  Description of Artificial Sequence: Synthetic oligonucleotide
  Target: ATXN1; (-) strand; PAM type: NRG; PAM sequence: TGG
ccgtgcgtccctctggtttg

SEQ ID NO: 60416 - DNA, 20 bp, Artificial Sequence
  Description of Artificial Sequence: Synthetic oligonucleotide
  Target: ATXN1; (-) strand; PAM type: NRG; PAM sequence: TGG
gattggaccgtgcgtccctc

SEQ ID NO: 60417 - DNA, 20 bp, Artificial Sequence
  Description of Artificial Sequence: Synthetic oligonucleotide
  Target: ATXN1; (-) strand; PAM type: NRG; PAM sequence: TGG
taaaacctgacactggtgat

SEQ ID NO: 60418 - DNA, 20 bp, Artificial Sequence
  Description of Artificial Sequence: Synthetic oligonucleotide
  Target: ATXN1; (-) strand; PAM type: NRG; PAM sequence: TGG
caaacagtaaaacctgacac

SEQ ID NO: 60419 - DNA, 20 bp, Artificial Sequence
  Description of Artificial Sequence: Synthetic oligonucleotide
  Target: ATXN1; (-) strand; PAM type: NRG; PAM sequence: CAG
ttttgacaaataaaaccaaa

SEQ ID NO: 60420 - DNA, 20 bp, Artificial Sequence
  Description of Artificial Sequence: Synthetic oligonucleotide
  Target: ATXN1; (-) strand; PAM type: NRG; PAM sequence: TAG
ctcctctgcatgtaaagcag

SEQ ID NO: 60421 - DNA, 20 bp, Artificial Sequence
  Description of Artificial Sequence: Synthetic oligonucleotide
  Target: ATXN1; (-) strand; PAM type: NRG; PAM sequence: CAG
tccctcctctgcatgtaaag

SEQ ID NO: 60422 - DNA, 20 bp, Artificial Sequence
  Description of Artificial Sequence: Synthetic oligonucleotide
  Target: ATXN1; (-) strand; PAM type: NRG; PAM sequence: AAG
tcctccctcctctgcatgta

SEQ ID NO: 60423 - DNA, 20 bp, Artificial Sequence
  Description of Artificial Sequence: Synthetic oligonucleotide
  Target: ATXN1; (-) strand; PAM type: NRG; PAM sequence: AAG
ctccctccatcccccacccg

SEQ ID NO: 60424 - DNA, 20 bp, Artificial Sequence
  Description of Artificial Sequence: Synthetic oligonucleotide
  Target: ATXN1; (-) strand; PAM type: NRG; PAM sequence: GGG
tctttaaaaatactgtcact

SEQ ID NO: 60425 - DNA, 20 bp, Artificial Sequence
  Description of Artificial Sequence: Synthetic oligonucleotide
  Target: ATXN1; (-) strand; PAM type: NRG; PAM sequence: TGG
gtctttaaaaatactgtcac

SEQ ID NO: 60426 - DNA, 20 bp, Artificial Sequence
  Description of Artificial Sequence: Synthetic oligonucleotide
  Target: ATXN1; (-) strand; PAM type: NRG; PAM sequence: GAG
ttcagaaaagatggtagata

SEQ ID NO: 60427 - DNA, 20 bp, Artificial Sequence
  Description of Artificial Sequence: Synthetic oligonucleotide
  Target: ATXN1; (-) strand; PAM type: NRG; PAM sequence: TAG
agttcagaaaagatggtaga

SEQ ID NO: 60428 - DNA, 20 bp, Artificial Sequence
  Description of Artificial Sequence: Synthetic oligonucleotide
  Target: ATXN1; (-) strand; PAM type: NRG; PAM sequence: TAG
tgttagttcagaaaagatgg

SEQ ID NO: 60429 - DNA, 20 bp, Artificial Sequence
  Description of Artificial Sequence: Synthetic oligonucleotide
  Target: ATXN1; (-) strand; PAM type: NRG; PAM sequence: TGG
aattgttagttcagaaaaga

SEQ ID NO: 60430 - DNA, 20 bp, Artificial Sequence
  Description of Artificial Sequence: Synthetic oligonucleotide
  Target: ATXN1; (-) strand; PAM type: NRG; PAM sequence: AAG
gtgaaattgttagttcagaa

SEQ ID NO: 60431 - DNA, 20 bp, Artificial Sequence
  Description of Artificial Sequence: Synthetic oligonucleotide
  Target: ATXN1; (-) strand; PAM type: NRG; PAM sequence: CAG
tcaaggtgaaattgttagtt

SEQ ID NO: 60432 - DNA, 20 bp, Artificial Sequence
  Description of Artificial Sequence: Synthetic oligonucleotide
  Target: ATXN1; (-) strand; PAM type: NRG; PAM sequence: TAG
agatttcaaggtgaaattgt

SEQ ID NO: 60433 - DNA, 20 bp, Artificial Sequence
  Description of Artificial Sequence: Synthetic oligonucleotide
  Target: ATXN1; (-) strand; PAM type: NRG; PAM sequence: AGG
acttattgtaacagatttca

SEQ ID NO: 60434 - DNA, 20 bp, Artificial Sequence
  Description of Artificial Sequence: Synthetic oligonucleotide
  Target: ATXN1; (-) strand; PAM type: NRG; PAM sequence: AAG
tacttattgtaacagatttc

SEQ ID NO: 60435 - DNA, 20 bp, Artificial Sequence
  Description of Artificial Sequence: Synthetic oligonucleotide
  Target: ATXN1; (-) strand; PAM type: NRG; PAM sequence: CAG
attaaaggtacttattgtaa

SEQ ID NO: 60436 - DNA, 20 bp, Artificial Sequence
  Description of Artificial Sequence: Synthetic oligonucleotide
  Target: ATXN1; (-) strand; PAM type: NRG; PAM sequence: AGG
aacaaatggcttttgattaa

SEQ ID NO: 60437 - DNA, 20 bp, Artificial Sequence
  Description of Artificial Sequence: Synthetic oligonucleotide
  Target: ATXN1; (-) strand; PAM type: NRG; PAM sequence: AAG
aaacaaatggcttttgatta

SEQ ID NO: 60438 - DNA, 20 bp, Artificial Sequence
  Description of Artificial Sequence: Synthetic oligonucleotide
  Target: ATXN1; (-) strand; PAM type: NRG; PAM sequence: TGG
agaaaagaatggaaaacaaa

SEQ ID NO: 60439 - DNA, 20 bp, Artificial Sequence
  Description of Artificial Sequence: Synthetic oligonucleotide
  Target: ATXN1; (-) strand; PAM type: NRG; PAM sequence: TGG
tgtatgcccatagaaaagaa

SEQ ID NO: 60440 - DNA, 20 bp, Artificial Sequence
  Description of Artificial Sequence: Synthetic oligonucleotide
  Target: ATXN1; (-) strand; PAM type: NRG; PAM sequence: AAG
gtgaatgtatgcccatagaa

SEQ ID NO: 60441 - DNA, 20 bp, Artificial Sequence
  Description of Artificial Sequence: Synthetic oligonucleotide
  Target: ATXN1; (-) strand; PAM type: NRG; PAM sequence: TAG
ctatagtgaatgtatgccca

SEQ ID NO: 60442 - DNA, 20 bp, Artificial Sequence
  Description of Artificial Sequence: Synthetic oligonucleotide
  Target: ATXN1; (-) strand; PAM type: NRG; PAM sequence: TAG
tgaactacagtaaatagcta

SEQ ID NO: 60443 - DNA, 20 bp, Artificial Sequence
  Description of Artificial Sequence: Synthetic oligonucleotide
  Target: ATXN1; (-) strand; PAM type: NRG; PAM sequence: TAG
aaataatgaactacagtaaa

SEQ ID NO: 60444 - DNA, 20 bp, Artificial Sequence
  Description of Artificial Sequence: Synthetic oligonucleotide
  Target: ATXN1; (-) strand; PAM type: NRG; PAM sequence: CAG
tatgctgaaataatgaacta

SEQ ID NO: 60445 - DNA, 20 bp, Artificial Sequence
  Description of Artificial Sequence: Synthetic oligonucleotide
  Target: ATXN1; (-) strand; PAM type: NRG; PAM sequence: AGG
cattaatgcaataggattga

SEQ ID NO: 60446 - DNA, 20 bp, Artificial Sequence
  Description of Artificial Sequence: Synthetic oligonucleotide
  Target: ATXN1; (-) strand; PAM type: NRG; PAM sequence: AAG
acattaatgcaataggattg

SEQ ID NO: 60447 - DNA, 20 bp, Artificial Sequence
  Description of Artificial Sequence: Synthetic oligonucleotide
  Target: ATXN1; (-) strand; PAM type: NRG; PAM sequence: AGG
tactcctacattaatgcaat

SEQ ID NO: 60448 - DNA, 20 bp, Artificial Sequence
  Description of Artificial Sequence: Synthetic oligonucleotide
  Target: ATXN1; (-) strand; PAM type: NRG; PAM sequence: TAG
atactcctacattaatgcaa

SEQ ID NO: 60449 - DNA, 20 bp, Artificial Sequence
  Description of Artificial Sequence: Synthetic oligonucleotide
  Target: ATXN1; (-) strand; PAM type: NRG; PAM sequence: AAG
agtttaaaatgaactgtttt

SEQ ID NO: 60450 - DNA, 20 bp, Artificial Sequence
  Description of Artificial Sequence: Synthetic oligonucleotide
  Target: ATXN1; (-) strand; PAM type: NRG; PAM sequence: CAG
agggttgttaacaggcaata

SEQ ID NO: 60451 - DNA, 20 bp, Artificial Sequence
  Description of Artificial Sequence: Synthetic oligonucleotide
  Target: ATXN1; (-) strand; PAM type: NRG; PAM sequence: AGG
ttttggacagggttgttaac

SEQ ID NO: 60452 - DNA, 20 bp, Artificial Sequence
  Description of Artificial Sequence: Synthetic oligonucleotide
  Target: ATXN1; (-) strand; PAM type: NRG; PAM sequence: CAG
attttggacagggttgttaa

SEQ ID NO: 60453 - DNA, 20 bp, Artificial Sequence
  Description of Artificial Sequence: Synthetic oligonucleotide
  Target: ATXN1; (-) strand; PAM type: NRG; PAM sequence: GGG
acctactaaaattttggaca

SEQ ID NO: 60454 - DNA, 20 bp, Artificial Sequence
  Description of Artificial Sequence: Synthetic oligonucleotide
  Target: ATXN1; (-) strand; PAM type: NRG; PAM sequence: AGG
tacctactaaaattttggac

SEQ ID NO: 60455 - DNA, 20 bp, Artificial Sequence
  Description of Artificial Sequence: Synthetic oligonucleotide
  Target: ATXN1; (-) strand; PAM type: NRG; PAM sequence: CAG
ttacctactaaaattttgga

SEQ ID NO: 60456 - DNA, 20 bp, Artificial Sequence
  Description of Artificial Sequence: Synthetic oligonucleotide
  Target: ATXN1; (-) strand; PAM type: NRG; PAM sequence: TGG
ttttttacctactaaaattt

SEQ ID NO: 60457 - DNA, 20 bp, Artificial Sequence
  Description of Artificial Sequence: Synthetic oligonucleotide
  Target: ATXN1; (-) strand; PAM type: NRG; PAM sequence: CAG
tcttcttgtaggcagtggtt

SEQ ID NO: 60458 - DNA, 20 bp, Artificial Sequence
  Description of Artificial Sequence: Synthetic oligonucleotide
  Target: ATXN1; (-) strand; PAM type: NRG; PAM sequence: TGG
tttggtcttcttgtaggcag

SEQ ID NO: 60459 - DNA, 20 bp, Artificial Sequence
  Description of Artificial Sequence: Synthetic oligonucleotide
  Target: ATXN1; (-) strand; PAM type: NRG; PAM sequence: CAG
tcttttggtcttcttgtagg

SEQ ID NO: 60460 - DNA, 20 bp, Artificial Sequence
  Description of Artificial Sequence: Synthetic oligonucleotide
  Target: ATXN1; (-) strand; PAM type: NRG; PAM sequence: AGG
caatcttttggtcttcttgt

SEQ ID NO: 60461 - DNA, 20 bp, Artificial Sequence
  Description of Artificial Sequence: Synthetic oligonucleotide
  Target: ATXN1; (-) strand; PAM type: NRG; PAM sequence: TAG
acaatcttttggtcttcttg

SEQ ID NO: 60462 - DNA, 20 bp, Artificial Sequence
  Description of Artificial Sequence: Synthetic oligonucleotide
  Target: ATXN1; (-) strand; PAM type: NRG; PAM sequence: TGG
ggaatcttcagacaatcttt

SEQ ID NO: 60463 - DNA, 20 bp, Artificial Sequence
  Description of Artificial Sequence: Synthetic oligonucleotide
  Target: ATXN1; (-) strand; PAM type: NRG; PAM sequence: CAG
caagtactaaatggaatctt

SEQ ID NO: 60464 - DNA, 20 bp, Artificial Sequence
  Description of Artificial Sequence: Synthetic oligonucleotide
  Target: ATXN1; (-) strand; PAM type: NRG; PAM sequence: TGG
aacaggaaacaagtactaaa

SEQ ID NO: 60465 - DNA, 20 bp, Artificial Sequence
  Description of Artificial Sequence: Synthetic oligonucleotide
  Target: ATXN1; (-) strand; PAM type: NRG; PAM sequence: AAG
ttttacagagaacaggaaac

SEQ ID NO: 60466 - DNA, 20 bp, Artificial Sequence
  Description of Artificial Sequence: Synthetic oligonucleotide
  Target: ATXN1; (-) strand; PAM type: NRG; PAM sequence: AGG
atccgtgttttacagagaac

SEQ ID NO: 60467 - DNA, 20 bp, Artificial Sequence
  Description of Artificial Sequence: Synthetic oligonucleotide
  Target: ATXN1; (-) strand; PAM type: NRG; PAM sequence: CAG
tatccgtgttttacagagaa

SEQ ID NO: 60468 - DNA, 20 bp, Artificial Sequence
  Description of Artificial Sequence: Synthetic oligonucleotide
  Target: ATXN1; (-) strand; PAM type: NRG; PAM sequence: GAG
gagaatatccgtgttttaca

SEQ ID NO: 60469 - DNA, 20 bp, Artificial Sequence
  Description of Artificial Sequence: Synthetic oligonucleotide
  Target: ATXN1; (-) strand; PAM type: NRG; PAM sequence: CAG
aagagaatatccgtgtttta

SEQ ID NO: 60470 - DNA, 20 bp, Artificial Sequence
  Description of Artificial Sequence: Synthetic oligonucleotide
  Target: ATXN1; (-) strand; PAM type: NRG; PAM sequence: GAG
aaatggaatgtctttaccaa

SEQ ID NO: 60471 - DNA, 20 bp, Artificial Sequence
  Description of Artificial Sequence: Synthetic oligonucleotide
  Target: ATXN1; (-) strand; PAM type: NRG; PAM sequence: AAG
agaaatggaatgtctttacc

SEQ ID NO: 60472 - DNA, 20 bp, Artificial Sequence
  Description of Artificial Sequence: Synthetic oligonucleotide
  Target: ATXN1; (-) strand; PAM type: NRG; PAM sequence: TGG
tcactagatagaaatagaaa

SEQ ID NO: 60473 - DNA, 20 bp, Artificial Sequence
  Description of Artificial Sequence: Synthetic oligonucleotide
  Target: ATXN1; (-) strand; PAM type: NRG; PAM sequence: TAG
cgatggtcactagatagaaa

SEQ ID NO: 60474 - DNA, 20 bp, Artificial Sequence
  Description of Artificial Sequence: Synthetic oligonucleotide
  Target: ATXN1; (-) strand; PAM type: NRG; PAM sequence: TAG
catattcgatggtcactaga

SEQ ID NO: 60475 - DNA, 20 bp, Artificial Sequence
  Description of Artificial Sequence: Synthetic oligonucleotide
  Target: ATXN1; (-) strand; PAM type: NRG; PAM sequence: TAG
acaacatattcgatggtcac

SEQ ID NO: 60476 - DNA, 20 bp, Artificial Sequence
  Description of Artificial Sequence: Synthetic oligonucleotide
  Target: ATXN1; (-) strand; PAM type: NRG; PAM sequence: TGG
acaagttacaacatattcga

SEQ ID NO: 60477 - DNA, 20 bp, Artificial Sequence
  Description of Artificial Sequence: Synthetic oligonucleotide
  Target: ATXN1; (-) strand; PAM type: NRG; PAM sequence: AAG
tccctatttaataggtaaac

SEQ ID NO: 60478 - DNA, 20 bp, Artificial Sequence
  Description of Artificial Sequence: Synthetic oligonucleotide
  Target: ATXN1; (-) strand; PAM type: NRG; PAM sequence: AGG
gctataattccctatttaat

SEQ ID NO: 60479 - DNA, 20 bp, Artificial Sequence
  Description of Artificial Sequence: Synthetic oligonucleotide
  Target: ATXN1; (-) strand; PAM type: NRG; PAM sequence: TAG
tgctataattccctatttaa

SEQ ID NO: 60480 - DNA, 20 bp, Artificial Sequence
  Description of Artificial Sequence: Synthetic oligonucleotide
  Target: ATXN1; (-) strand; PAM type: NRG; PAM sequence: TGG
taggagacaaattattattc

SEQ ID NO: 60481 - DNA, 20 bp, Artificial Sequence
  Description of Artificial Sequence: Synthetic oligonucleotide
  Target: ATXN1; (-) strand; PAM type: NRG; PAM sequence: GAG
gttactatgaaggcaaatag

SEQ ID NO: 60482 - DNA, 20 bp, Artificial Sequence
  Description of Artificial Sequence: Synthetic oligonucleotide
  Target: ATXN1; (-) strand; PAM type: NRG; PAM sequence: AGG
atgttactatgaaggcaaat

SEQ ID NO: 60483 - DNA, 20 bp, Artificial Sequence
  Description of Artificial Sequence: Synthetic oligonucleotide
  Target: ATXN1; (-) strand; PAM type: NRG; PAM sequence: TAG
aatgttactatgaaggcaaa

SEQ ID NO: 60484 - DNA, 20 bp, Artificial Sequence
  Description of Artificial Sequence: Synthetic oligonucleotide
  Target: ATXN1; (-) strand; PAM type: NRG; PAM sequence: AGG
tcttagtaatgttactatga

SEQ ID NO: 60485 - DNA, 20 bp, Artificial Sequence
  Description of Artificial Sequence: Synthetic oligonucleotide
  Target: ATXN1; (-) strand; PAM type: NRG; PAM sequence: AAG
ttcttagtaatgttactatg

SEQ ID NO: 60486 - DNA, 20 bp, Artificial Sequence
  Description of Artificial Sequence: Synthetic oligonucleotide
  Target: ATXN1; (-) strand; PAM type: NRG; PAM sequence: TAG
cctcagagtttattagttct

SEQ ID NO: 60487 - DNA, 20 bp, Artificial Sequence
  Description of Artificial Sequence: Synthetic oligonucleotide
  Target: ATXN1; (-) strand; PAM type: NRG; PAM sequence: TAG
tctctagcctcagagtttat

SEQ ID NO: 60488 - DNA, 20 bp, Artificial Sequence
  Description of Artificial Sequence: Synthetic oligonucleotide
  Target: ATXN1; (-) strand; PAM type: NRG; PAM sequence: GAG
tactttagtctctagcctca

SEQ ID NO: 60489 - DNA, 20 bp, Artificial Sequence
  Description of Artificial Sequence: Synthetic oligonucleotide
  Target: ATXN1; (-) strand; PAM type: NRG; PAM sequence: CAG
cttactttagtctctagcct

SEQ ID NO: 60490 - DNA, 20 bp, Artificial Sequence
  Description of Artificial Sequence: Synthetic oligonucleotide
  Target: ATXN1; (-) strand; PAM type: NRG; PAM sequence: TAG
caaattcttactttagtctc

SEQ ID NO: 60491 - DNA, 20 bp, Artificial Sequence
  Description of Artificial Sequence: Synthetic oligonucleotide
  Target: ATXN1; (-) strand; PAM type: NRG; PAM sequence: TAG
cctaaaccaaattcttactt

SEQ ID NO: 60492 - DNA, 20 bp, Artificial Sequence
  Description of Artificial Sequence: Synthetic oligonucleotide
  Target: ATXN1; (-) strand; PAM type: NRG; PAM sequence: CAG
ataaaaataataataaaaac

SEQ ID NO: 60493 - DNA, 20 bp, Artificial Sequence
  Description of Artificial Sequence: Synthetic oligonucleotide
  Target: ATXN1; (-) strand; PAM type: NRG; PAM sequence: GAG
tccagcctgggcgacagagt

SEQ ID NO: 60494 - DNA, 20 bp, Artificial Sequence
  Description of Artificial Sequence: Synthetic oligonucleotide
  Target: ATXN1; (-) strand; PAM type: NRG; PAM sequence: GAG
gcactccagcctgggcgaca

SEQ ID NO: 60495 - DNA, 20 bp, Artificial Sequence
  Description of Artificial Sequence: Synthetic oligonucleotide
  Target: ATXN1; (-) strand; PAM type: NRG; PAM sequence: CAG
ctgcactccagcctgggcga

SEQ ID NO: 60496 - DNA, 20 bp, Artificial Sequence
  Description of Artificial Sequence: Synthetic oligonucleotide
  Target: ATXN1; (-) strand; PAM type: NRG; PAM sequence: GGG
gtgccactgcactccagcct

SEQ ID NO: 60497 - DNA, 20 bp, Artificial Sequence
  Description of Artificial Sequence: Synthetic oligonucleotide
  Target: ATXN1; (-) strand; PAM type: NRG; PAM sequence: TGG
cgtgccactgcactccagcc

SEQ ID NO: 60498 - DNA, 20 bp, Artificial Sequence
  Description of Artificial Sequence: Synthetic oligonucleotide
  Target: ATXN1; (-) strand; PAM type: NRG; PAM sequence: CAG
aagatcgtgccactgcactc

SEQ ID NO: 60499 - DNA, 20 bp, Artificial Sequence
  Description of Artificial Sequence: Synthetic oligonucleotide
  Target: ATXN1; (-) strand; PAM type: NRG; PAM sequence: AAG
agtggagcttgcagtgagcc

SEQ ID NO: 60500 - DNA, 20 bp, Artificial Sequence
  Description of Artificial Sequence: Synthetic oligonucleotide
  Target: ATXN1; (-) strand; PAM type: NRG; PAM sequence: GAG
tgggaagtggagcttgcagt

SEQ ID NO: 60501 - DNA, 20 bp, Artificial Sequence
  Description of Artificial Sequence: Synthetic oligonucleotide
  Target: ATXN1; (-) strand; PAM type: NRG; PAM sequence: CAG
aacctgggaagtggagcttg

SEQ ID NO: 60502 - DNA, 20 bp, Artificial Sequence
  Description of Artificial Sequence: Synthetic oligonucleotide
  Target: ATXN1; (-) strand; PAM type: NRG; PAM sequence: GAG
tggcgtgaacctgggaagtg

SEQ ID NO: 60503 - DNA, 20 bp, Artificial Sequence
  Description of Artificial Sequence: Synthetic oligonucleotide
  Target: ATXN1; (-) strand; PAM type: NRG; PAM sequence: TGG
aatggcgtgaacctgggaag

SEQ ID NO: 60504 - DNA, 20 bp, Artificial Sequence
  Description of Artificial Sequence: Synthetic oligonucleotide
  Target: ATXN1; (-) strand; PAM type: NRG; PAM sequence: AAG
gagaatggcgtgaacctggg

SEQ ID NO: 60505 - DNA, 20 bp, Artificial Sequence
  Description of Artificial Sequence: Synthetic oligonucleotide
  Target: ATXN1; (-) strand; PAM type: NRG; PAM sequence: GGG
cgggagaatggcgtgaacct

SEQ ID NO: 60506 - DNA, 20 bp, Artificial Sequence
  Description of Artificial Sequence: Synthetic oligonucleotide
  Target: ATXN1; (-) strand; PAM type: NRG; PAM sequence: TGG
gcgggagaatggcgtgaacc

SEQ ID NO: 60507 - DNA, 20 bp, Artificial Sequence
  Description of Artificial Sequence: Synthetic oligonucleotide
  Target: ATXN1; (-) strand; PAM type: NRG; PAM sequence: TGG
aggaggctgaggcgggagaa

SEQ ID NO: 60508 - DNA, 20 bp, Artificial Sequence
  Description of Artificial Sequence: Synthetic oligonucleotide
  Target: ATXN1; (-) strand; PAM type: NRG; PAM sequence: GAG
tactcaggaggctgaggcgg

SEQ ID NO: 60509 - DNA, 20 bp, Artificial Sequence
  Description of Artificial Sequence: Synthetic oligonucleotide
  Target: ATXN1; (-) strand; PAM type: NRG; PAM sequence: GGG
gctactcaggaggctgaggc

SEQ ID NO: 60510 - DNA, 20 bp, Artificial Sequence
  Description of Artificial Sequence: Synthetic oligonucleotide
  Target: ATXN1; (-) strand; PAM type: NRG; PAM sequence: CGG
agctactcaggaggctgagg

SEQ ID NO: 60511 - DNA, 20 bp, Artificial Sequence
  Description of Artificial Sequence: Synthetic oligonucleotide
  Target: ATXN1; (-) strand; PAM type: NRG; PAM sequence: AGG
cccagctactcaggaggctg

SEQ ID NO: 60512 - DNA, 20 bp, Artificial Sequence
  Description of Artificial Sequence: Synthetic oligonucleotide
  Target: ATXN1; (-) strand; PAM type: NRG; PAM sequence: GAG
tcccagctactcaggaggct

SEQ ID NO: 60513 - DNA, 20 bp, Artificial Sequence
  Description of Artificial Sequence: Synthetic oligonucleotide
  Target: ATXN1; (-) strand; PAM type: NRG; PAM sequence: AGG
tgtagtcccagctactcagg

SEQ ID NO: 60514 - DNA, 20 bp, Artificial Sequence
  Description of Artificial Sequence: Synthetic oligonucleotide
  Target: ATXN1; (-) strand; PAM type: NRG; PAM sequence: GAG
ctgtagtcccagctactcag

SEQ ID NO: 60515 - DNA, 20 bp, Artificial Sequence
  Description of Artificial Sequence: Synthetic oligonucleotide
  Target: ATXN1; (-) strand; PAM type: NRG; PAM sequence: AGG
gcctgtagtcccagctactc

SEQ ID NO: 60516 - DNA, 20 bp, Artificial Sequence
  Description of Artificial Sequence: Synthetic oligonucleotide
  Target: ATXN1; (-) strand; PAM type: NRG; PAM sequence: CAG
cgcctgtagtcccagctact

SEQ ID NO: 60517 - DNA, 20 bp, Artificial Sequence
  Description of Artificial Sequence: Synthetic oligonucleotide
  Target: ATXN1; (-) strand; PAM type: NRG; PAM sequence: CAG
gtggcatgcgcctgtagtcc

SEQ ID NO: 60518 - DNA, 20 bp, Artificial Sequence
  Description of Artificial Sequence: Synthetic oligonucleotide
  Target: ATXN1; (-) strand; PAM type: NRG; PAM sequence: TAG
cgcgtggtggcatgcgcctg

SEQ ID NO: 60519 - DNA, 20 bp, Artificial Sequence
  Description of Artificial Sequence: Synthetic oligonucleotide
  Target: ATXN1; (-) strand; PAM type: NRG; PAM sequence: TGG
accaaattagccacgcgtgg

SEQ ID NO: 60520 - DNA, 20 bp, Artificial Sequence
  Description of Artificial Sequence: Synthetic oligonucleotide
  Target: ATXN1; (-) strand; PAM type: NRG; PAM sequence: TGG
aaaaccaaattagccacgcg

SEQ ID NO: 60521 - DNA, 20 bp, Artificial Sequence
  Description of Artificial Sequence: Synthetic oligonucleotide
  Target: ATXN1; (-) strand; PAM type: NRG; PAM sequence: TAG
taaaaatacaaaaaccaaat

SEQ ID NO: 60522 - DNA, 20 bp, Artificial Sequence
  Description of Artificial Sequence: Synthetic oligonucleotide
  Target: ATXN1; (-) strand; PAM type: NRG; PAM sequence: CAG
caagaccatcctgactaaca

SEQ ID NO: 60523 - DNA, 20 bp, Artificial Sequence
  Description of Artificial Sequence: Synthetic oligonucleotide
  Target: ATXN1; (-) strand; PAM type: NRG; PAM sequence: AAG
gatcacgatgtcaggaaatc

SEQ ID NO: 60524 - DNA, 20 bp, Artificial Sequence
  Description of Artificial Sequence: Synthetic oligonucleotide
  Target: ATXN1; (-) strand; PAM type: NRG; PAM sequence: AGG
ggcgggcagatcacgatgtc

SEQ ID NO: 60525 - DNA, 20 bp, Artificial Sequence
  Description of Artificial Sequence: Synthetic oligonucleotide
  Target: ATXN1; (-) strand; PAM type: NRG; PAM sequence: CAG
aggcgggcagatcacgatgt

SEQ ID NO: 60526 - DNA, 20 bp, Artificial Sequence
  Description of Artificial Sequence: Synthetic oligonucleotide
  Target: ATXN1; (-) strand; PAM type: NRG; PAM sequence: CAG
ctttaggaggccgaggcggg

SEQ ID NO: 60527 - DNA, 20 bp, Artificial Sequence
  Description of Artificial Sequence: Synthetic oligonucleotide
  Target: ATXN1; (-) strand; PAM type: NRG; PAM sequence: GGG
gcactttaggaggccgaggc

SEQ ID NO: 60528 - DNA, 20 bp, Artificial Sequence
  Description of Artificial Sequence: Synthetic oligonucleotide
  Target: ATXN1; (-) strand; PAM type: NRG; PAM sequence: CGG
agcactttaggaggccgagg

SEQ ID NO: 60529 - DNA, 20 bp, Artificial Sequence
  Description of Artificial Sequence: Synthetic oligonucleotide
  Target: ATXN1; (-) strand; PAM type: NRG; PAM sequence: AGG
cccagcactttaggaggccg

SEQ ID NO: 60530 - DNA, 20 bp, Artificial Sequence
  Description of Artificial Sequence: Synthetic oligonucleotide
  Target: ATXN1; (-) strand; PAM type: NRG; PAM sequence: GAG
tcccagcactttaggaggcc

SEQ ID NO: 60531 - DNA, 20 bp, Artificial Sequence
  Description of Artificial Sequence: Synthetic oligonucleotide
  Target: ATXN1; (-) strand; PAM type: NRG; PAM sequence: AGG
tgtaatcccagcactttagg

SEQ ID NO: 60532 - DNA, 20 bp, Artificial Sequence
  Description of Artificial Sequence: Synthetic oligonucleotide
  Target: ATXN1; (-) strand; PAM type: NRG; PAM sequence: GAG
ctgtaatcccagcactttag

SEQ ID NO: 60533 - DNA, 20 bp, Artificial Sequence
  Description of Artificial Sequence: Synthetic oligonucleotide
  Target: ATXN1; (-) strand; PAM type: NRG; PAM sequence: AGG
gcctgtaatcccagcacttt

SEQ ID NO: 60534 - DNA, 20 bp, Artificial Sequence
  Description of Artificial Sequence: Synthetic oligonucleotide
  Target: ATXN1; (-) strand; PAM type: NRG; PAM sequence: TAG
cgcctgtaatcccagcactt

SEQ ID NO: 60535 - DNA, 20 bp, Artificial Sequence
  Description of Artificial Sequence: Synthetic oligonucleotide
  Target: ATXN1; (-) strand; PAM type: NRG; PAM sequence: CAG
gtggctcacgcctgtaatcc

SEQ ID NO: 60536 - DNA, 20 bp, Artificial Sequence
  Description of Artificial Sequence: Synthetic oligonucleotide
  Target: ATXN1; (-) strand; PAM type: NRG; PAM sequence: TGG
ccagtccgggccaggcatgg

SEQ ID NO: 60537 - DNA, 20 bp, Artificial Sequence
  Description of Artificial Sequence: Synthetic oligonucleotide
  Target: ATXN1; (-) strand; PAM type: NRG; PAM sequence: TGG
taaccagtccgggccaggca

SEQ ID NO: 60538 - DNA, 20 bp, Artificial Sequence
  Description of Artificial Sequence: Synthetic oligonucleotide
  Target: ATXN1; (-) strand; PAM type: NRG; PAM sequence: AGG
ggtaataaccagtccgggcc

SEQ ID NO: 60539 - DNA, 20 bp, Artificial Sequence
  Description of Artificial Sequence: Synthetic oligonucleotide
  Target: ATXN1; (-) strand; PAM type: NRG; PAM sequence: CAG
aggtaataaccagtccgggc

SEQ ID NO: 60540 - DNA, 20 bp, Artificial Sequence
  Description of Artificial Sequence: Synthetic oligonucleotide
  Target: ATXN1; (-) strand; PAM type: NRG; PAM sequence: GGG
tataaggtaataaccagtcc

SEQ ID NO: 60541 - DNA, 20 bp, Artificial Sequence
  Description of Artificial Sequence: Synthetic oligonucleotide
  Target: ATXN1; (-) strand; PAM type: NRG; PAM sequence: CGG
ttataaggtaataaccagtc

SEQ ID NO: 60542 - DNA, 20 bp, Artificial Sequence
  Description of Artificial Sequence: Synthetic oligonucleotide
  Target: ATXN1; (-) strand; PAM type: NRG; PAM sequence: CAG
tccctttataaggtaataac

SEQ ID NO: 60543 - DNA, 20 bp, Artificial Sequence
  Description of Artificial Sequence: Synthetic oligonucleotide
  Target: ATXN1; (-) strand; PAM type: NRG; PAM sequence: AGG
tgatggtacttccctttata

SEQ ID NO: 60544 - DNA, 20 bp, Artificial Sequence
  Description of Artificial Sequence: Synthetic oligonucleotide
  Target: ATXN1; (-) strand; PAM type: NRG; PAM sequence: AAG
ttgatggtacttccctttat

SEQ ID NO: 60545 - DNA, 20 bp, Artificial Sequence
  Description of Artificial Sequence: Synthetic oligonucleotide
  Target: ATXN1; (-) strand; PAM type: NRG; PAM sequence: TGG
ttactctgataacaatttga

SEQ ID NO: 60546 - DNA, 20 bp, Artificial Sequence
  Description of Artificial Sequence: Synthetic oligonucleotide
  Target: ATXN1; (-) strand; PAM type: NRG; PAM sequence: AAG
acagtggcttccctggaaac

SEQ ID NO: 60547 - DNA, 20 bp, Artificial Sequence
  Description of Artificial Sequence: Synthetic oligonucleotide
  Target: ATXN1; (-) strand; PAM type: NRG; PAM sequence: TGG
tcatcccacagtggcttccc

SEQ ID NO: 60548 - DNA, 20 bp, Artificial Sequence
  Description of Artificial Sequence: Synthetic oligonucleotide
  Target: ATXN1; (-) strand; PAM type: NRG; PAM sequence: TGG
actgttcattcatcccacag

SEQ ID NO: 60549 - DNA, 20 bp, Artificial Sequence
  Description of Artificial Sequence: Synthetic oligonucleotide
  Target: ATXN1; (-) strand; PAM type: NRG; PAM sequence: CAG
gtgactgttcattcatccca

SEQ ID NO: 60550 - DNA, 20 bp, Artificial Sequence
  Description of Artificial Sequence: Synthetic oligonucleotide
  Target: ATXN1; (-) strand; PAM type: NRG; PAM sequence: CAG
atatactcgcttactggttc

SEQ ID NO: 60551 - DNA, 20 bp, Artificial Sequence
  Description of Artificial Sequence: Synthetic oligonucleotide
  Target: ATXN1; (-) strand; PAM type: NRG; PAM sequence: TGG
gatagcatatactcgcttac

SEQ ID NO: 60552 - DNA, 20 bp, Artificial Sequence
  Description of Artificial Sequence: Synthetic oligonucleotide
  Target: ATXN1; (-) strand; PAM type: NRG; PAM sequence: TAG
agcaactcctagcccaggga

SEQ ID NO: 60553 - DNA, 20 bp, Artificial Sequence
  Description of Artificial Sequence: Synthetic oligonucleotide
  Target: ATXN1; (-) strand; PAM type: NRG; PAM sequence: GGG
taccagcaactcctagccca

SEQ ID NO: 60554 - DNA, 20 bp, Artificial Sequence
  Description of Artificial Sequence: Synthetic oligonucleotide
  Target: ATXN1; (-) strand; PAM type: NRG; PAM sequence: AGG
ataccagcaactcctagccc

SEQ ID NO: 60555 - DNA, 20 bp, Artificial Sequence
  Description of Artificial Sequence: Synthetic oligonucleotide
  Target: ATXN1; (-) strand; PAM type: NRG; PAM sequence: CAG
tataccagcaactcctagcc

SEQ ID NO: 60556 - DNA, 20 bp, Artificial Sequence
  Description of Artificial Sequence: Synthetic oligonucleotide
  Target: ATXN1; (-) strand; PAM type: NRG; PAM sequence: TAG
cagtatataccagcaactcc

SEQ ID NO: 60557 - DNA, 20 bp, Artificial Sequence
  Description of Artificial Sequence: Synthetic oligonucleotide
  Target: ATXN1; (-) strand; PAM type: NRG; PAM sequence: CAG
ctgtgtacttcagtatatac

SEQ ID NO: 60558 - DNA, 20 bp, Artificial Sequence
  Description of Artificial Sequence: Synthetic oligonucleotide
  Target: ATXN1; (-) strand; PAM type: NRG; PAM sequence: CAG
tgatttgtaactgtgtactt

SEQ ID NO: 60559 - DNA, 20 bp, Artificial Sequence
  Description of Artificial Sequence: Synthetic oligonucleotide
  Target: ATXN1; (-) strand; PAM type: NRG; PAM sequence: TGG
ggagtgacttttgcctcttt

SEQ ID NO: 60560 - DNA, 20 bp, Artificial Sequence
  Description of Artificial Sequence: Synthetic oligonucleotide
  Target: ATXN1; (-) strand; PAM type: NRG; PAM sequence: GAG
aacaatctgcttagaaaggg

SEQ ID NO: 60561 - DNA, 20 bp, Artificial Sequence
  Description of Artificial Sequence: Synthetic oligonucleotide
  Target: ATXN1; (-) strand; PAM type: NRG; PAM sequence: GGG
ttaacaatctgcttagaaag

SEQ ID NO: 60562 - DNA, 20 bp, Artificial Sequence
  Description of Artificial Sequence: Synthetic oligonucleotide
  Target: ATXN1; (-) strand; PAM type: NRG; PAM sequence: GGG
gttaacaatctgcttagaaa

SEQ ID NO: 60563 - DNA, 20 bp, Artificial Sequence
  Description of Artificial Sequence: Synthetic oligonucleotide
  Target: ATXN1; (-) strand; PAM type: NRG; PAM sequence: AGG
tgttaacaatctgcttagaa

SEQ ID NO: 60564 - DNA, 20 bp, Artificial Sequence
  Description of Artificial Sequence: Synthetic oligonucleotide
  Target: ATXN1; (-) strand; PAM type: NRG; PAM sequence: AAG
ttgttaacaatctgcttaga

SEQ ID NO: 60565 - DNA, 20 bp, Artificial Sequence
  Description of Artificial Sequence: Synthetic oligonucleotide
  Target: ATXN1; (-) strand; PAM type: NRG; PAM sequence: TAG
gacattgttaacaatctgct

SEQ ID NO: 60566 - DNA, 20 bp, Artificial Sequence
  Description of Artificial Sequence: Synthetic oligonucleotide
  Target: ATXN1; (-) strand; PAM type: NRG; PAM sequence: AGG
ttaaatgcttgcattctctt

SEQ ID NO: 60567 - DNA, 20 bp, Artificial Sequence
  Description of Artificial Sequence: Synthetic oligonucleotide
  Target: ATXN1; (-) strand; PAM type: NRG; PAM sequence: TAG
tttaaatgcttgcattctct

SEQ ID NO: 60568 - DNA, 20 bp, Artificial Sequence
  Description of Artificial Sequence: Synthetic oligonucleotide
  Target: ATXN1; (-) strand; PAM type: NRG; PAM sequence: CAG
tttccaatatcagccatgta

SEQ ID NO: 60569 - DNA, 20 bp, Artificial Sequence
  Description of Artificial Sequence: Synthetic oligonucleotide
  Target: ATXN1; (-) strand; PAM type: NRG; PAM sequence: CAG
aatctcaatatttccaatat

SEQ ID NO: 60570 - DNA, 20 bp, Artificial Sequence
  Description of Artificial Sequence: Synthetic oligonucleotide
  Target: ATXN1; (-) strand; PAM type: NRG; PAM sequence: TAG
caagcatctgaaaacttctc

SEQ ID NO: 60571 - DNA, 20 bp, Artificial Sequence
  Description of Artificial Sequence: Synthetic oligonucleotide
  Target: ATXN1; (-) strand; PAM type: NRG; PAM sequence: AAG
atgtttcaatgtatattctc

SEQ ID NO: 60572 - DNA, 20 bp, Artificial Sequence
  Description of Artificial Sequence: Synthetic oligonucleotide
  Target: ATXN1; (-) strand; PAM type: NRG; PAM sequence: AGG
ttgtgttctgttcaaaagta

SEQ ID NO: 60573 - DNA, 20 bp, Artificial Sequence
  Description of Artificial Sequence: Synthetic oligonucleotide
  Target: ATXN1; (-) strand; PAM type: NRG; PAM sequence: AAG
tttgtgttctgttcaaaagt

SEQ ID NO: 60574 - DNA, 20 bp, Artificial Sequence
  Description of Artificial Sequence: Synthetic oligonucleotide
  Target: ATXN1; (-) strand; PAM type: NRG; PAM sequence: AAG
taagtttgtgttctgttcaa

SEQ ID NO: 60575 - DNA, 20 bp, Artificial Sequence
  Description of Artificial Sequence: Synthetic oligonucleotide
  Target: ATXN1; (-) strand; PAM type: NRG; PAM sequence: AAG
gaagaagcatcgatctaagt

SEQ ID NO: 60576 - DNA, 20 bp, Artificial Sequence
  Description of Artificial Sequence: Synthetic oligonucleotide
  Target: ATXN1; (-) strand; PAM type: NRG; PAM sequence: AAG
ttcagaagaagcatcgatct

SEQ ID NO: 60577 - DNA, 20 bp, Artificial Sequence
  Description of Artificial Sequence: Synthetic oligonucleotide
  Target: ATXN1; (-) strand; PAM type: NRG; PAM sequence: AAG
tttctgcttctattcagaag

SEQ ID NO: 60578 - DNA, 20 bp, Artificial Sequence
  Description of Artificial Sequence: Synthetic oligonucleotide
  Target: ATXN1; (-) strand; PAM type: NRG; PAM sequence: AAG
ttttttctgcttctattcag

SEQ ID NO: 60579 - DNA, 20 bp, Artificial Sequence
  Description of Artificial Sequence: Synthetic oligonucleotide
  Target: ATXN1; (-) strand; PAM type: NRG; PAM sequence: CAG
tttttttttctgcttctatt

SEQ ID NO: 60580 - DNA, 20 bp, Artificial Sequence
  Description of Artificial Sequence: Synthetic oligonucleotide
  Target: ATXN1; (-) strand; PAM type: NRG; PAM sequence: CAG
tctgaaatagttttctatca

SEQ ID NO: 60581 - DNA, 20 bp, Artificial Sequence
  Description of Artificial Sequence: Synthetic oligonucleotide
  Target: ATXN1; (-) strand; PAM type: NRG; PAM sequence: TAG
gagtggatcaacctctgaaa

SEQ ID NO: 60582 - DNA, 20 bp, Artificial Sequence
  Description of Artificial Sequence: Synthetic oligonucleotide
  Target: ATXN1; (-) strand; PAM type: NRG; PAM sequence: TGG
agggacttggtccagatgag

SEQ ID NO: 60583 - DNA, 20 bp, Artificial Sequence
  Description of Artificial Sequence: Synthetic oligonucleotide
  Target: ATXN1; (-) strand; PAM type: NRG; PAM sequence: GAG
tgcagggacttggtccagat

SEQ ID NO: 60584 - DNA, 20 bp, Artificial Sequence
  Description of Artificial Sequence: Synthetic oligonucleotide
  Target: ATXN1; (-) strand; PAM type: NRG; PAM sequence: CAG
ttaggtgcagggacttggtc

SEQ ID NO: 60585 - DNA, 20 bp, Artificial Sequence
  Description of Artificial Sequence: Synthetic oligonucleotide
  Target: ATXN1; (-) strand; PAM type: NRG; PAM sequence: TGG
tatttttaggtgcagggact

SEQ ID NO: 60586 - DNA, 20 bp, Artificial Sequence
  Description of Artificial Sequence: Synthetic oligonucleotide
  Target: ATXN1; (-) strand; PAM type: NRG; PAM sequence: GGG
ttcctgtatttttaggtgca

SEQ ID NO: 60587 - DNA, 20 bp, Artificial Sequence
  Description of Artificial Sequence: Synthetic oligonucleotide
  Target: ATXN1; (-) strand; PAM type: NRG; PAM sequence: AGG
cttcctgtatttttaggtgc

SEQ ID NO: 60588 - DNA, 20 bp, Artificial Sequence
  Description of Artificial Sequence: Synthetic oligonucleotide
  Target: ATXN1; (-) strand; PAM type: NRG; PAM sequence: CAG
acttcctgtatttttaggtg

SEQ ID NO: 60589 - DNA, 20 bp, Artificial Sequence
  Description of Artificial Sequence: Synthetic oligonucleotide
  Target: ATXN1; (-) strand; PAM type: NRG; PAM sequence: AGG
atctaacttcctgtattttt

SEQ ID NO: 60590 - DNA, 20 bp, Artificial Sequence
  Description of Artificial Sequence: Synthetic oligonucleotide
  Target: ATXN1; (-) strand; PAM type: NRG; PAM sequence: TAG
aatctaacttcctgtatttt

SEQ ID NO: 60591 - DNA, 20 bp, Artificial Sequence
  Description of Artificial Sequence: Synthetic oligonucleotide
  Target: ATXN1; (-) strand; PAM type: NRG; PAM sequence: TAG
tgcacagttttggcagattt

SEQ ID NO: 60592 - DNA, 20 bp, Artificial Sequence
  Description of Artificial Sequence: Synthetic oligonucleotide
  Target: ATXN1; (-) strand; PAM type: NRG; PAM sequence: CAG
gctctgttgcacagttttgg

SEQ ID NO: 60593 - DNA, 20 bp, Artificial Sequence
  Description of Artificial Sequence: Synthetic oligonucleotide
  Target: ATXN1; (-) strand; PAM type: NRG; PAM sequence: TGG
ccagctctgttgcacagttt

SEQ ID NO: 60594 - DNA, 20 bp, Artificial Sequence
  Description of Artificial Sequence: Synthetic oligonucleotide
  Target: ATXN1; (-) strand; PAM type: NRG; PAM sequence: CAG
caagggccagctctgttgca

SEQ ID NO: 60595 - DNA, 20 bp, Artificial Sequence
  Description of Artificial Sequence: Synthetic oligonucleotide
  Target: ATXN1; (-) strand; PAM type: NRG; PAM sequence: CAG
aggtttggacagccaagggc

SEQ ID NO: 60596 - DNA, 20 bp, Artificial Sequence
  Description of Artificial Sequence: Synthetic oligonucleotide
  Target: ATXN1; (-) strand; PAM type: NRG; PAM sequence: GGG
tagaaggtttggacagccaa

SEQ ID NO: 60597 - DNA, 20 bp, Artificial Sequence
  Description of Artificial Sequence: Synthetic oligonucleotide
  Target: ATXN1; (-) strand; PAM type: NRG; PAM sequence: AGG
ctagaaggtttggacagcca

SEQ ID NO: 60598 - DNA, 20 bp, Artificial Sequence
  Description of Artificial Sequence: Synthetic oligonucleotide
  Target: ATXN1; (-) strand; PAM type: NRG; PAM sequence: AAG
tctagaaggtttggacagcc

SEQ ID NO: 60599 - DNA, 20 bp, Artificial Sequence
  Description of Artificial Sequence: Synthetic oligonucleotide
  Target: ATXN1; (-) strand; PAM type: NRG; PAM sequence: CAG
gcctttctagaaggtttgga

SEQ ID NO: 60600 - DNA, 20 bp, Artificial Sequence
  Description of Artificial Sequence: Synthetic oligonucleotide
  Target: ATXN1; (-) strand; PAM type: NRG; PAM sequence: TGG
ctctgcctttctagaaggtt

SEQ ID NO: 60601 - DNA, 20 bp, Artificial Sequence
  Description of Artificial Sequence: Synthetic oligonucleotide
  Target: ATXN1; (-) strand; PAM type: NRG; PAM sequence: AGG
taaaactctgcctttctaga

SEQ ID NO: 60602 - DNA, 20 bp, Artificial Sequence
  Description of Artificial Sequence: Synthetic oligonucleotide
  Target: ATXN1; (-) strand; PAM type: NRG; PAM sequence: AAG
ttaaaactctgcctttctag

SEQ ID NO: 60603 - DNA, 20 bp, Artificial Sequence
  Description of Artificial Sequence: Synthetic oligonucleotide
  Target: ATXN1; (-) strand; PAM type: NRG; PAM sequence: TAG
attttaaaactctgcctttc

SEQ ID NO: 60604 - DNA, 20 bp, Artificial Sequence
  Description of Artificial Sequence: Synthetic oligonucleotide
  Target: ATXN1; (-) strand; PAM type: NRG; PAM sequence: AAG
ttattgggtgcccacggtgt

SEQ ID NO: 60605 - DNA, 20 bp, Artificial Sequence
  Description of Artificial Sequence: Synthetic oligonucleotide
  Target: ATXN1; (-) strand; PAM type: NRG; PAM sequence: CGG
aagcatttattgggtgccca

SEQ ID NO: 60606 - DNA, 20 bp, Artificial Sequence
  Description of Artificial Sequence: Synthetic oligonucleotide
  Target: ATXN1; (-) strand; PAM type: NRG; PAM sequence: GGG
ttattcatcaagcatttatt

SEQ ID NO: 60607 - DNA, 20 bp, Artificial Sequence
  Description of Artificial Sequence: Synthetic oligonucleotide
  Target: ATXN1; (-) strand; PAM type: NRG; PAM sequence: TGG
tttattcatcaagcatttat

SEQ ID NO: 60608 - DNA, 20 bp, Artificial Sequence
  Description of Artificial Sequence: Synthetic oligonucleotide
  Target: ATXN1; (-) strand; PAM type: NRG; PAM sequence: AAG
atttcactcatttattcatc

SEQ ID NO: 60609 - DNA, 20 bp, Artificial Sequence
  Description of Artificial Sequence: Synthetic oligonucleotide
  Target: ATXN1; (-) strand; PAM type: NRG; PAM sequence: AAG
tgtcacagacaactttcaat

SEQ ID NO: 60610 - DNA, 20 bp, Artificial Sequence
  Description of Artificial Sequence: Synthetic oligonucleotide
  Target: ATXN1; (-) strand; PAM type: NRG; PAM sequence: CAG
caggccctaatagaatgtca

SEQ ID NO: 60611 - DNA, 20 bp, Artificial Sequence
  Description of Artificial Sequence: Synthetic oligonucleotide
  Target: ATXN1; (-) strand; PAM type: NRG; PAM sequence: TAG
gttggtttttcaggccctaa

SEQ ID NO: 60612 - DNA, 20 bp, Artificial Sequence
  Description of Artificial Sequence: Synthetic oligonucleotide
  Target: ATXN1; (-) strand; PAM type: NRG; PAM sequence: AGG
ataattgctgttggtttttc

SEQ ID NO: 60613 - DNA, 20 bp, Artificial Sequence
  Description of Artificial Sequence: Synthetic oligonucleotide
  Target: ATXN1; (-) strand; PAM type: NRG; PAM sequence: CAG
tataattgctgttggttttt

SEQ ID NO: 60614 - DNA, 20 bp, Artificial Sequence
  Description of Artificial Sequence: Synthetic oligonucleotide
  Target: ATXN1; (-) strand; PAM type: NRG; PAM sequence: TGG
gactcttgtataattgctgt

SEQ ID NO: 60615 - DNA, 20 bp, Artificial Sequence
  Description of Artificial Sequence: Synthetic oligonucleotide
  Target: ATXN1; (-) strand; PAM type: NRG; PAM sequence: AAG
aatagaagcttcttaagggc

SEQ ID NO: 60616 - DNA, 20 bp, Artificial Sequence
  Description of Artificial Sequence: Synthetic oligonucleotide
  Target: ATXN1; (-) strand; PAM type: NRG; PAM sequence: GGG
atagaatagaagcttcttaa

SEQ ID NO: 60617 - DNA, 20 bp, Artificial Sequence
  Description of Artificial Sequence: Synthetic oligonucleotide
  Target: ATXN1; (-) strand; PAM type: NRG; PAM sequence: AGG
gatagaatagaagcttctta

SEQ ID NO: 60618 - DNA, 20 bp, Artificial Sequence
  Description of Artificial Sequence: Synthetic oligonucleotide
  Target: ATXN1; (-) strand; PAM type: NRG; PAM sequence: AAG
tgatagaatagaagcttctt

SEQ ID NO: 60619 - DNA, 20 bp, Artificial Sequence
  Description of Artificial Sequence: Synthetic oligonucleotide
  Target: ATXN1; (-) strand; PAM type: NRG; PAM sequence: AAG
tgcttctcctgatagaatag

SEQ ID NO: 60620 - DNA, 20 bp, Artificial Sequence
  Description of Artificial Sequence: Synthetic oligonucleotide
  Target: ATXN1; (-) strand; PAM type: NRG; PAM sequence: TAG
ttttgcttctcctgatagaa

SEQ ID NO: 60621 - DNA, 20 bp, Artificial Sequence
  Description of Artificial Sequence: Synthetic oligonucleotide
  Target: ATXN1; (-) strand; PAM type: NRG; PAM sequence: TAG
tatatttttgcttctcctga

SEQ ID NO: 60622 - DNA, 20 bp, Artificial Sequence
  Description of Artificial Sequence: Synthetic oligonucleotide
  Target: ATXN1; (-) strand; PAM type: NRG; PAM sequence: AAG
aggtcttgcattattactgc

SEQ ID NO: 60623 - DNA, 20 bp, Artificial Sequence
  Description of Artificial Sequence: Synthetic oligonucleotide
  Target: ATXN1; (-) strand; PAM type: NRG; PAM sequence: AGG
tcactaattgctccctgata

SEQ ID NO: 60624 - DNA, 20 bp, Artificial Sequence
  Description of Artificial Sequence: Synthetic oligonucleotide
  Target: ATXN1; (-) strand; PAM type: NRG; PAM sequence: AAG
ttcactaattgctccctgat

SEQ ID NO: 60625 - DNA, 20 bp, Artificial Sequence
  Description of Artificial Sequence: Synthetic oligonucleotide
  Target: ATXN1; (-) strand; PAM type: NRG; PAM sequence: TAG
gctttctttaaccccttgcc

SEQ ID NO: 60626 - DNA, 20 bp, Artificial Sequence
  Description of Artificial Sequence: Synthetic oligonucleotide
  Target: ATXN1; (-) strand; PAM type: NRG; PAM sequence: AAG
ttaattagatcctatcttag

SEQ ID NO: 60627 - DNA, 20 bp, Artificial Sequence
  Description of Artificial Sequence: Synthetic oligonucleotide
  Target: ATXN1; (-) strand; PAM type: NRG; PAM sequence: TAG
tgtttaattagatcctatct

SEQ ID NO: 60628 - DNA, 20 bp, Artificial Sequence
  Description of Artificial Sequence: Synthetic oligonucleotide
  Target: ATXN1; (-) strand; PAM type: NRG; PAM sequence: TAG
ttggtgtgaatttgtttaat

SEQ ID NO: 60629 - DNA, 20 bp, Artificial Sequence
  Description of Artificial Sequence: Synthetic oligonucleotide
  Target: ATXN1; (-) strand; PAM type: NRG; PAM sequence: TGG
cagataagatattagcacct

SEQ ID NO: 60630 - DNA, 20 bp, Artificial Sequence
  Description of Artificial Sequence: Synthetic oligonucleotide
  Target: ATXN1; (-) strand; PAM type: NRG; PAM sequence: TAG
agaggccacagataagatat

SEQ ID NO: 60631 - DNA, 20 bp, Artificial Sequence
  Description of Artificial Sequence: Synthetic oligonucleotide
  Target: ATXN1; (-) strand; PAM type: NRG; PAM sequence: AAG
ctggggcagaggccacagat

SEQ ID NO: 60632 - DNA, 20 bp, Artificial Sequence
  Description of Artificial Sequence: Synthetic oligonucleotide
  Target: ATXN1; (-) strand; PAM type: NRG; PAM sequence: CAG
tgatcctggggcagaggcca

SEQ ID NO: 60633 - DNA, 20 bp, Artificial Sequence
  Description of Artificial Sequence: Synthetic oligonucleotide
  Target: ATXN1; (-) strand; PAM type: NRG; PAM sequence: AGG
tgcaaatgatcctggggcag

SEQ ID NO: 60634 - DNA, 20 bp, Artificial Sequence
  Description of Artificial Sequence: Synthetic oligonucleotide
  Target: ATXN1; (-) strand; PAM type: NRG; PAM sequence: GAG
atgcaaatgatcctggggca

SEQ ID NO: 60635 - DNA, 20 bp, Artificial Sequence
  Description of Artificial Sequence: Synthetic oligonucleotide
  Target: ATXN1; (-) strand; PAM type: NRG; PAM sequence: CAG
aaatgcaaatgatcctgggg

SEQ ID NO: 60636 - DNA, 20 bp, Artificial Sequence
  Description of Artificial Sequence: Synthetic oligonucleotide
  Target: ATXN1; (-) strand; PAM type: NRG; PAM sequence: GGG
ttaaaatgcaaatgatcctg

SEQ ID NO: 60637 - DNA, 20 bp, Artificial Sequence
  Description of Artificial Sequence: Synthetic oligonucleotide
  Target: ATXN1; (-) strand; PAM type: NRG; PAM sequence: GGG
attaaaatgcaaatgatcct

SEQ ID NO: 60638 - DNA, 20 bp, Artificial Sequence
  Description of Artificial Sequence: Synthetic oligonucleotide
  Target: ATXN1; (-) strand; PAM type: NRG; PAM sequence: TGG
tattaaaatgcaaatgatcc

SEQ ID NO: 60639 - DNA, 20 bp, Artificial Sequence
  Description of Artificial Sequence: Synthetic oligonucleotide
  Target: ATXN1; (-) strand; PAM type: NRG; PAM sequence: TAG
tatcaagcaaagccatcagc

SEQ ID NO: 60640 - DNA, 20 bp, Artificial Sequence
  Description of Artificial Sequence: Synthetic oligonucleotide
  Target: ATXN1; (-) strand; PAM type: NRG; PAM sequence: CAG
caagtatcaagcaaagccat

SEQ ID NO: 60641 - DNA, 20 bp, Artificial Sequence
  Description of Artificial Sequence: Synthetic oligonucleotide
  Target: ATXN1; (-) strand; PAM type: NRG; PAM sequence: AAG
cagtcctcaagtatcaagca

SEQ ID NO: 60642 - DNA, 20 bp, Artificial Sequence
  Description of Artificial Sequence: Synthetic oligonucleotide
  Target: ATXN1; (-) strand; PAM type: NRG; PAM sequence: AAG
tagttcagtcctcaagtatc

SEQ ID NO: 60643 - DNA, 20 bp, Artificial Sequence
  Description of Artificial Sequence: Synthetic oligonucleotide
  Target: ATXN1; (-) strand; PAM type: NRG; PAM sequence: AAG
ctaatagtagttcagtcctc

SEQ ID NO: 60644 - DNA, 20 bp, Artificial Sequence
  Description of Artificial Sequence: Synthetic oligonucleotide
  Target: ATXN1; (-) strand; PAM type: NRG; PAM sequence: CAG
aaatgctactaatagtagtt

SEQ ID NO: 60645 - DNA, 20 bp, Artificial Sequence
  Description of Artificial Sequence: Synthetic oligonucleotide
  Target: ATXN1; (-) strand; PAM type: NRG; PAM sequence: TAG
gcctgaaatgctactaatag

SEQ ID NO: 60646 - DNA, 20 bp, Artificial Sequence
  Description of Artificial Sequence: Synthetic oligonucleotide
  Target: ATXN1; (-) strand; PAM type: NRG; PAM sequence: TAG
gaggcctgaaatgctactaa

SEQ ID NO: 60647 - DNA, 20 bp, Artificial Sequence
  Description of Artificial Sequence: Synthetic oligonucleotide
  Target: ATXN1; (-) strand; PAM type: NRG; PAM sequence: AGG
ttctgctgacctctttcctg

SEQ ID NO: 60648 - DNA, 20 bp, Artificial Sequence
  Description of Artificial Sequence: Synthetic oligonucleotide
  Target: ATXN1; (-) strand; PAM type: NRG; PAM sequence: GAG
tttctgctgacctctttcct

SEQ ID NO: 60649 - DNA, 20 bp, Artificial Sequence
  Description of Artificial Sequence: Synthetic oligonucleotide
  Target: ATXN1; (-) strand; PAM type: NRG; PAM sequence: AAG
ctgcctagtagtgttatttg

SEQ ID NO: 60650 - DNA, 20 bp, Artificial Sequence
  Description of Artificial Sequence: Synthetic oligonucleotide
  Target: ATXN1; (-) strand; PAM type: NRG; PAM sequence: TAG
taggtagactttctgcctag

SEQ ID NO: 60651 - DNA, 20 bp, Artificial Sequence
  Description of Artificial Sequence: Synthetic oligonucleotide
  Target: ATXN1; (-) strand; PAM type: NRG; PAM sequence: TAG
ctgtaggtagactttctgcc

SEQ ID NO: 60652 - DNA, 20 bp, Artificial Sequence
  Description of Artificial Sequence: Synthetic oligonucleotide
  Target: ATXN1; (-) strand; PAM type: NRG; PAM sequence: TAG
tttcatgatagaactgtagg

SEQ ID NO: 60653 - DNA, 20 bp, Artificial Sequence
  Description of Artificial Sequence: Synthetic oligonucleotide
  Target: ATXN1; (-) strand; PAM type: NRG; PAM sequence: AGG
ttttttcatgatagaactgt

SEQ ID NO: 60654 - DNA, 20 bp, Artificial Sequence
  Description of Artificial Sequence: Synthetic oligonucleotide
  Target: ATXN1; (-) strand; PAM type: NRG; PAM sequence: TAG
cttttttcatgatagaactg

SEQ ID NO: 60655 - DNA, 20 bp, Artificial Sequence
  Description of Artificial Sequence: Synthetic oligonucleotide
  Target: ATXN1; (-) strand; PAM type: NRG; PAM sequence: TAG
ctttgaaccttttttcatga

SEQ ID NO: 60656 - DNA, 20 bp, Artificial Sequence
  Description of Artificial Sequence: Synthetic oligonucleotide
  Target: ATXN1; (-) strand; PAM type: NRG; PAM sequence: AAG
ttagatacaagtgtttgaag

SEQ ID NO: 60657 - DNA, 20 bp, Artificial Sequence
  Description of Artificial Sequence: Synthetic oligonucleotide
  Target: ATXN1; (-) strand; PAM type: NRG; PAM sequence: AAG
ttattagatacaagtgtttg

SEQ ID NO: 60658 - DNA, 20 bp, Artificial Sequence
  Description of Artificial Sequence: Synthetic oligonucleotide
  Target: ATXN1; (-) strand; PAM type: NRG; PAM sequence: AAG
ttcacgtctttattagatac

SEQ ID NO: 60659 - DNA, 20 bp, Artificial Sequence
  Description of Artificial Sequence: Synthetic oligonucleotide
  Target: ATXN1; (-) strand; PAM type: NRG; PAM sequence: TAG
actctctttcacgtctttat

SEQ ID NO: 60660 - DNA, 20 bp, Artificial Sequence
  Description of Artificial Sequence: Synthetic oligonucleotide
  Target: ATXN1; (-) strand; PAM type: NRG; PAM sequence: CAG
caggcatgagccaccgcacc

SEQ ID NO: 60661 - DNA, 20 bp, Artificial Sequence
  Description of Artificial Sequence: Synthetic oligonucleotide
  Target: ATXN1; (-) strand; PAM type: NRG; PAM sequence: GAG
agcactgggattacaggcat

SEQ ID NO: 60662 - DNA, 20 bp, Artificial Sequence
  Description of Artificial Sequence: Synthetic oligonucleotide
  Target: ATXN1; (-) strand; PAM type: NRG; PAM sequence: AGG
tcccaaagcactgggattac

SEQ ID NO: 60663 - DNA, 20 bp, Artificial Sequence
  Description of Artificial Sequence: Synthetic oligonucleotide
  Target: ATXN1; (-) strand; PAM type: NRG; PAM sequence: CAG
ctcccaaagcactgggatta

SEQ ID NO: 60664 - DNA, 20 bp, Artificial Sequence
  Description of Artificial Sequence: Synthetic oligonucleotide
  Target: ATXN1; (-) strand; PAM type: NRG; PAM sequence: GGG
cctcggcctcccaaagcact

SEQ ID NO: 60665 - DNA, 20 bp, Artificial Sequence
  Description of Artificial Sequence: Synthetic oligonucleotide
  Target: ATXN1; (-) strand; PAM type: NRG; PAM sequence: TGG
gcctcggcctcccaaagcac

SEQ ID NO: 60666 - DNA, 20 bp, Artificial Sequence
  Description of Artificial Sequence: Synthetic oligonucleotide
  Target: ATXN1; (-) strand; PAM type: NRG; PAM sequence: AAG
ctgcctgcctcggcctccca

SEQ ID NO: 60667 - DNA, 20 bp, Artificial Sequence
  Description of Artificial Sequence: Synthetic oligonucleotide
  Target: ATXN1; (-) strand; PAM type: NRG; PAM sequence: CGG
ctcaggtgatctgcctgcct

SEQ ID NO: 60668 - DNA, 20 bp, Artificial Sequence
  Description of Artificial Sequence: Synthetic oligonucleotide
  Target: ATXN1; (-) strand; PAM type: NRG; PAM sequence: AGG
ggtctcaaattcctgacctc

SEQ ID NO: 60669 - DNA, 20 bp, Artificial Sequence
  Description of Artificial Sequence: Synthetic oligonucleotide
  Target: ATXN1; (-) strand; PAM type: NRG; PAM sequence: CAG
tggtctcaaattcctgacct

SEQ ID NO: 60670 - DNA, 20 bp, Artificial Sequence
  Description of Artificial Sequence: Synthetic oligonucleotide
  Target: ATXN1; (-) strand; PAM type: NRG; PAM sequence: TGG
ttttgccatgttggtcaggc

SEQ ID NO: 60671 - DNA, 20 bp, Artificial Sequence
  Description of Artificial Sequence: Synthetic oligonucleotide
  Target: ATXN1; (-) strand; PAM type: NRG; PAM sequence: AGG
agggttttgccatgttggtc

SEQ ID NO: 60672 - DNA, 20 bp, Artificial Sequence
  Description of Artificial Sequence: Synthetic oligonucleotide
  Target: ATXN1; (-) strand; PAM type: NRG; PAM sequence: CAG
cagggttttgccatgttggt

SEQ ID NO: 60673 - DNA, 20 bp, Artificial Sequence
  Description of Artificial Sequence: Synthetic oligonucleotide
  Target: ATXN1; (-) strand; PAM type: NRG; PAM sequence: TGG
gggtcagggttttgccatgt

SEQ ID NO: 60674 - DNA, 20 bp, Artificial Sequence
  Description of Artificial Sequence: Synthetic oligonucleotide
  Target: ATXN1; (-) strand; PAM type: NRG; PAM sequence: GGG
ttgtatttttagtagggtca

SEQ ID NO: 60675 - DNA, 20 bp, Artificial Sequence
  Description of Artificial Sequence: Synthetic oligonucleotide
  Target: ATXN1; (-) strand; PAM type: NRG; PAM sequence: AGG
tttgtatttttagtagggtc

SEQ ID NO: 60676 - DNA, 20 bp, Artificial Sequence
  Description of Artificial Sequence: Synthetic oligonucleotide
  Target: ATXN1; (-) strand; PAM type: NRG; PAM sequence: CAG
ttttgtatttttagtagggt

SEQ ID NO: 60677 - DNA, 20 bp, Artificial Sequence
  Description of Artificial Sequence: Synthetic oligonucleotide
  Target: ATXN1; (-) strand; PAM type: NRG; PAM sequence: GGG
ctaattttgtatttttagta

SEQ ID NO: 60678 - DNA, 20 bp, Artificial Sequence
  Description of Artificial Sequence: Synthetic oligonucleotide
  Target: ATXN1; (-) strand; PAM type: NRG; PAM sequence: AGG
gctaattttgtatttttagt

SEQ ID NO: 60679 - DNA, 20 bp, Artificial Sequence
  Description of Artificial Sequence: Synthetic oligonucleotide
  Target: ATXN1; (-) strand; PAM type: NRG; PAM sequence: TAG
ggctaattttgtatttttag

SEQ ID NO: 60680 - DNA, 20 bp, Artificial Sequence
  Description of Artificial Sequence: Synthetic oligonucleotide
  Target: ATXN1; (-) strand; PAM type: NRG; PAM sequence: TAG
ccaggctaattttgtatttt

SEQ ID NO: 60681 - DNA, 20 bp, Artificial Sequence
  Description of Artificial Sequence: Synthetic oligonucleotide
  Target: ATXN1; (-) strand; PAM type: NRG; PAM sequence: AGG
caggtgcccgccaccacacc

SEQ ID NO: 60682 - DNA, 20 bp, Artificial Sequence
  Description of Artificial Sequence: Synthetic oligonucleotide
  Target: ATXN1; (-) strand; PAM type: NRG; PAM sequence: CAG
acaggtgcccgccaccacac

SEQ ID NO: 60683 - DNA, 20 bp, Artificial Sequence
  Description of Artificial Sequence: Synthetic oligonucleotide
  Target: ATXN1; (-) strand; PAM type: NRG; PAM sequence: AGG
tcccaagtagctgggattac

SEQ ID NO: 60684 - DNA, 20 bp, Artificial Sequence
  Description of Artificial Sequence: Synthetic oligonucleotide
  Target: ATXN1; (-) strand; PAM type: NRG; PAM sequence: CAG
ctcccaagtagctgggatta

SEQ ID NO: 60685 - DNA, 20 bp, Artificial Sequence
  Description of Artificial Sequence: Synthetic oligonucleotide
  Target: ATXN1; (-) strand; PAM type: NRG; PAM sequence: GGG
cctcagcctcccaagtagct

SEQ ID NO: 60686 - DNA, 20 bp, Artificial Sequence
  Description of Artificial Sequence: Synthetic oligonucleotide
  Target: ATXN1; (-) strand; PAM type: NRG; PAM sequence: TGG
gcctcagcctcccaagtagc

SEQ ID NO: 60687 - DNA, 20 bp, Artificial Sequence
  Description of Artificial Sequence: Synthetic oligonucleotide
  Target: ATXN1; (-) strand; PAM type: NRG; PAM sequence: TAG
tgttgcctcagcctcccaag

SEQ ID NO: 60688 - DNA, 20 bp, Artificial Sequence
  Description of Artificial Sequence: Synthetic oligonucleotide
  Target: ATXN1; (-) strand; PAM type: NRG; PAM sequence: AAG
ttctgttgcctcagcctccc

SEQ ID NO: 60689 - DNA, 20 bp, Artificial Sequence
  Description of Artificial Sequence: Synthetic oligonucleotide
  Target: ATXN1; (-) strand; PAM type: NRG; PAM sequence: CAG
ttcaagcaattctgttgcct

SEQ ID NO: 60690 - DNA, 20 bp, Artificial Sequence
  Description of Artificial Sequence: Synthetic oligonucleotide
  Target: ATXN1; (-) strand; PAM type: NRG; PAM sequence: AAG
aacctctgcctcccaggttc

SEQ ID NO: 60691 - DNA, 20 bp, Artificial Sequence
  Description of Artificial Sequence: Synthetic oligonucleotide
  Target: ATXN1; (-) strand; PAM type: NRG; PAM sequence: AGG
gctcaaaacctctgcctccc

SEQ ID NO: 60692 - DNA, 20 bp, Artificial Sequence
  Description of Artificial Sequence: Synthetic oligonucleotide
  Target: ATXN1; (-) strand; PAM type: NRG; PAM sequence: CAG
ggctcaaaacctctgcctcc

SEQ ID NO: 60693 - DNA, 20 bp, Artificial Sequence
  Description of Artificial Sequence: Synthetic oligonucleotide
  Target: ATXN1; (-) strand; PAM type: NRG; PAM sequence: CGG
ggagtgcagtggtgtgatct

SEQ ID NO: 60694 - DNA, 20 bp, Artificial Sequence
  Description of Artificial Sequence: Synthetic oligonucleotide
  Target: ATXN1; (-) strand; PAM type: NRG; PAM sequence: TGG
ttgcccaggctggagtgcag

SEQ ID NO: 60695 - DNA, 20 bp, Artificial Sequence
  Description of Artificial Sequence: Synthetic oligonucleotide
  Target: ATXN1; (-) strand; PAM type: NRG; PAM sequence: CAG
ttgttgcccaggctggagtg

SEQ ID NO: 60696 - DNA, 20 bp, Artificial Sequence
  Description of Artificial Sequence: Synthetic oligonucleotide
  Target: ATXN1; (-) strand; PAM type: NRG; PAM sequence: GAG
tgctcttgttgcccaggctg

SEQ ID NO: 60697 - DNA, 20 bp, Artificial Sequence
  Description of Artificial Sequence: Synthetic oligonucleotide
  Target: ATXN1; (-) strand; PAM type: NRG; PAM sequence: TGG
tttgctcttgttgcccaggc

SEQ ID NO: 60698 - DNA, 20 bp, Artificial Sequence
  Description of Artificial Sequence: Synthetic oligonucleotide
  Target: ATXN1; (-) strand; PAM type: NRG; PAM sequence: AGG
gagttttgctcttgttgccc

SEQ ID NO: 60699 - DNA, 20 bp, Artificial Sequence
  Description of Artificial Sequence: Synthetic oligonucleotide
  Target: ATXN1; (-) strand; PAM type: NRG; PAM sequence: CAG
agagttttgctcttgttgcc

SEQ ID NO: 60700 - DNA, 20 bp, Artificial Sequence
  Description of Artificial Sequence: Synthetic oligonucleotide
  Target: ATXN1; (-) strand; PAM type: NRG; PAM sequence: GAG
ttttttttttttttgagaca

SEQ ID NO: 60701 - DNA, 20 bp, Artificial Sequence
  Description of Artificial Sequence: Synthetic oligonucleotide
  Target: ATXN1; (-) strand; PAM type: NRG; PAM sequence: CAG
tcttttttttttttttgaga

SEQ ID NO: 60702 - DNA, 20 bp, Artificial Sequence
  Description of Artificial Sequence: Synthetic oligonucleotide
  Target: ATXN1; (-) strand; PAM type: NRG; PAM sequence: GAG
tttttctttttttttttttt

SEQ ID NO: 60703 - DNA, 20 bp, Artificial Sequence
  Description of Artificial Sequence: Synthetic oligonucleotide
  Target: ATXN1; (-) strand; PAM type: NRG; PAM sequence: GAG
aataatgctgctatggatat

SEQ ID NO: 60704 - DNA, 20 bp, Artificial Sequence
  Description of Artificial Sequence: Synthetic oligonucleotide
  Target: ATXN1; (-) strand; PAM type: NRG; PAM sequence: TGG
tattgttaataatgctgcta

SEQ ID NO: 60705 - DNA, 20 bp, Artificial Sequence
  Description of Artificial Sequence: Synthetic oligonucleotide
  Target: ATXN1; (-) strand; PAM type: NRG; PAM sequence: TAG
acttgggttgcttccacctt

SEQ ID NO: 60706 - DNA, 20 bp, Artificial Sequence
  Description of Artificial Sequence: Synthetic oligonucleotide
  Target: ATXN1; (-) strand; PAM type: NRG; PAM sequence: GGG
tcatctatcagtgggcactt

SEQ ID NO: 60707 - DNA, 20 bp, Artificial Sequence
  Description of Artificial Sequence: Synthetic oligonucleotide
  Target: ATXN1; (-) strand; PAM type: NRG; PAM sequence: TGG
ttcatctatcagtgggcact

SEQ ID NO: 60708 - DNA, 20 bp, Artificial Sequence
  Description of Artificial Sequence: Synthetic oligonucleotide
  Target: ATXN1; (-) strand; PAM type: NRG; PAM sequence: GGG
cttatccttcatctatcagt

SEQ ID NO: 60709 - DNA, 20 bp, Artificial Sequence
  Description of Artificial Sequence: Synthetic oligonucleotide
  Target: ATXN1; (-) strand; PAM type: NRG; PAM sequence: TGG
gcttatccttcatctatcag

SEQ ID NO: 60710 - DNA, 20 bp, Artificial Sequence
  Description of Artificial Sequence: Synthetic oligonucleotide
  Target: ATXN1; (-) strand; PAM type: NRG; PAM sequence: CAG
ttagcttatccttcatctat

SEQ ID NO: 60711 - DNA, 20 bp, Artificial Sequence
  Description of Artificial Sequence: Synthetic oligonucleotide
  Target: ATXN1; (-) strand; PAM type: NRG; PAM sequence: TAG
ttgtatgtgtagaccacatt

SEQ ID NO: 60712 - DNA, 20 bp, Artificial Sequence
  Description of Artificial Sequence: Synthetic oligonucleotide
  Target: ATXN1; (-) strand; PAM type: NRG; PAM sequence: TAG
ataatattctgttgtatgtg

SEQ ID NO: 60713 - DNA, 20 bp, Artificial Sequence
  Description of Artificial Sequence: Synthetic oligonucleotide
  Target: ATXN1; (-) strand; PAM type: NRG; PAM sequence: TAG
gtcagaatttccttcctttt

SEQ ID NO: 60714 - DNA, 20 bp, Artificial Sequence
  Description of Artificial Sequence: Synthetic oligonucleotide
  Target: ATXN1; (-) strand; PAM type: NRG; PAM sequence: CAG
ctgtctgtgctatagcatgt

SEQ ID NO: 60715 - DNA, 20 bp, Artificial Sequence
  Description of Artificial Sequence: Synthetic oligonucleotide
  Target: ATXN1; (-) strand; PAM type: NRG; PAM sequence: TAG
cttcaggtctgtctgtgcta

SEQ ID NO: 60716 - DNA, 20 bp, Artificial Sequence
  Description of Artificial Sequence: Synthetic oligonucleotide
  Target: ATXN1; (-) strand; PAM type: NRG; PAM sequence: AGG
cactgagcataatgtccttc

SEQ ID NO: 60717 - DNA, 20 bp, Artificial Sequence
  Description of Artificial Sequence: Synthetic oligonucleotide
  Target: ATXN1; (-) strand; PAM type: NRG; PAM sequence: CAG
tcactgagcataatgtcctt

SEQ ID NO: 60718 - DNA, 20 bp, Artificial Sequence
  Description of Artificial Sequence: Synthetic oligonucleotide
  Target: ATXN1; (-) strand; PAM type: NRG; PAM sequence: GAG
tgtgcctggctcatttcact

SEQ ID NO: 60719 - DNA, 20 bp, Artificial Sequence
  Description of Artificial Sequence: Synthetic oligonucleotide
  Target: ATXN1; (-) strand; PAM type: NRG; PAM sequence: TGG
agtatttgtccttttgtgcc

SEQ ID NO: 60720 - DNA, 20 bp, Artificial Sequence
  Description of Artificial Sequence: Synthetic oligonucleotide
  Target: ATXN1; (-) strand; PAM type: NRG; PAM sequence: TAG
ctcatataagtggaatcatg

SEQ ID NO: 60721 - DNA, 20 bp, Artificial Sequence
  Description of Artificial Sequence: Synthetic oligonucleotide
  Target: ATXN1; (-) strand; PAM type: NRG; PAM sequence: TGG
ctgtaagtggctcatataag

SEQ ID NO: 60722 - DNA, 20 bp, Artificial Sequence
  Description of Artificial Sequence: Synthetic oligonucleotide
  Target: ATXN1; (-) strand; PAM type: NRG; PAM sequence: AAG
ctactgtaagtggctcatat

SEQ ID NO: 60723 - DNA, 20 bp, Artificial Sequence
  Description of Artificial Sequence: Synthetic oligonucleotide
  Target: ATXN1; (-) strand; PAM type: NRG; PAM sequence: TGG
attattttgactactgtaag

SEQ ID NO: 60724 - DNA, 20 bp, Artificial Sequence
  Description of Artificial Sequence: Synthetic oligonucleotide
  Target: ATXN1; (-) strand; PAM type: NRG; PAM sequence: AAG
tctattattttgactactgt

SEQ ID NO: 60725 - DNA, 20 bp, Artificial Sequence
  Description of Artificial Sequence: Synthetic oligonucleotide
  Target: ATXN1; (-) strand; PAM type: NRG; PAM sequence: CAG
ccctccaccctagcccccgg

SEQ ID NO: 60726 - DNA, 20 bp, Artificial Sequence
  Description of Artificial Sequence: Synthetic oligonucleotide
  Target: ATXN1; (-) strand; PAM type: NRG; PAM sequence: CGG
ctaccctccaccctagcccc

SEQ ID NO: 60727 - DNA, 20 bp, Artificial Sequence
  Description of Artificial Sequence: Synthetic oligonucleotide
  Target: ATXN1; (-) strand; PAM type: NRG; PAM sequence: TAG
taatgctctaccctccaccc

SEQ ID NO: 60728 - DNA, 20 bp, Artificial Sequence
  Description of Artificial Sequence: Synthetic oligonucleotide
  Target: ATXN1; (-) strand; PAM type: NRG; PAM sequence: TAG
ttttctggcaaaactgaatc

SEQ ID NO: 60729 - DNA, 20 bp, Artificial Sequence
  Description of Artificial Sequence: Synthetic oligonucleotide
  Target: ATXN1; (-) strand; PAM type: NRG; PAM sequence: TGG
tcttcacacctctttttttc

SEQ ID NO: 60730 - DNA, 20 bp, Artificial Sequence
  Description of Artificial Sequence: Synthetic oligonucleotide
  Target: ATXN1; (-) strand; PAM type: NRG; PAM sequence: AAG
tgtacattcatattgatgtg

SEQ ID NO: 60731 - DNA, 20 bp, Artificial Sequence
  Description of Artificial Sequence: Synthetic oligonucleotide
  Target: ATXN1; (-) strand; PAM type: NRG; PAM sequence: TAG
cttagccatttttaagtgta

SEQ ID NO: 60732 - DNA, 20 bp, Artificial Sequence
  Description of Artificial Sequence: Synthetic oligonucleotide
  Target: ATXN1; (-) strand; PAM type: NRG; PAM sequence: AAG
ttactgtcttagccattttt

SEQ ID NO: 60733 - DNA, 20 bp, Artificial Sequence
  Description of Artificial Sequence: Synthetic oligonucleotide
  Target: ATXN1; (-) strand; PAM type: NRG; PAM sequence: TAG
taacataaaatttactgtct

SEQ ID NO: 60734 - DNA, 20 bp, Artificial Sequence
  Description of Artificial Sequence: Synthetic oligonucleotide
  Target: ATXN1; (-) strand; PAM type: NRG; PAM sequence: AAG
cagttttttttattatagta

SEQ ID NO: 60735 - DNA, 20 bp, Artificial Sequence
  Description of Artificial Sequence: Synthetic oligonucleotide
  Target: ATXN1; (-) strand; PAM type: NRG; PAM sequence: TAG
ttttccagttttttttatta

SEQ ID NO: 60736 - DNA, 20 bp, Artificial Sequence
  Description of Artificial Sequence: Synthetic oligonucleotide
  Target: ATXN1; (-) strand; PAM type: NRG; PAM sequence: CAG
agttcaccaacataattttc

SEQ ID NO: 60737 - DNA, 20 bp, Artificial Sequence
  Description of Artificial Sequence: Synthetic oligonucleotide
  Target: ATXN1; (-) strand; PAM type: NRG; PAM sequence: TAG
taagtttcaaagctatggta

SEQ ID NO: 60738 - DNA, 20 bp, Artificial Sequence
  Description of Artificial Sequence: Synthetic oligonucleotide
  Target: ATXN1; (-) strand; PAM type: NRG; PAM sequence: TGG
gcatgtaagtttcaaagcta

SEQ ID NO: 60739 - DNA, 20 bp, Artificial Sequence
  Description of Artificial Sequence: Synthetic oligonucleotide
  Target: ATXN1; (-) strand; PAM type: NRG; PAM sequence: AAG
aactttgcatgtaagtttca

SEQ ID NO: 60740 - DNA, 20 bp, Artificial Sequence
  Description of Artificial Sequence: Synthetic oligonucleotide
  Target: ATXN1; (-) strand; PAM type: NRG; PAM sequence: AAG
aatcagataactttgcatgt

SEQ ID NO: 60741 - DNA, 20 bp, Artificial Sequence
  Description of Artificial Sequence: Synthetic oligonucleotide
  Target: ATXN1; (-) strand; PAM type: NRG; PAM sequence: CAG
atagctaacataataataat

SEQ ID NO: 60742 - DNA, 20 bp, Artificial Sequence
  Description of Artificial Sequence: Synthetic oligonucleotide
  Target: ATXN1; (-) strand; PAM type: NRG; PAM sequence: TAG
caataactttccatataaaa

SEQ ID NO: 60743 - DNA, 20 bp, Artificial Sequence
  Description of Artificial Sequence: Synthetic oligonucleotide
  Target: ATXN1; (-) strand; PAM type: NRG; PAM sequence: CAG
caagcagctgtctacctaat

SEQ ID NO: 60744 - DNA, 20 bp, Artificial Sequence
  Description of Artificial Sequence: Synthetic oligonucleotide
  Target: ATXN1; (-) strand; PAM type: NRG; PAM sequence: CAG
caaacagattaggaagcaag

SEQ ID NO: 60745 - DNA, 20 bp, Artificial Sequence
  Description of Artificial Sequence: Synthetic oligonucleotide
  Target: ATXN1; (-) strand; PAM type: NRG; PAM sequence: AAG
tttcaaacagattaggaagc

SEQ ID NO: 60746 - DNA, 20 bp, Artificial Sequence
  Description of Artificial Sequence: Synthetic oligonucleotide
  Target: ATXN1; (-) strand; PAM type: NRG; PAM sequence: AAG
catttttcaaacagattagg

SEQ ID NO: 60747 - DNA, 20 bp, Artificial Sequence
  Description of Artificial Sequence: Synthetic oligonucleotide
  Target: ATXN1; (-) strand; PAM type: NRG; PAM sequence: AGG
tgtcatttttcaaacagatt

SEQ ID NO: 60748 - DNA, 20 bp, Artificial Sequence
  Description of Artificial Sequence: Synthetic oligonucleotide
  Target: ATXN1; (-) strand; PAM type: NRG; PAM sequence: TAG
gtgtcatttttcaaacagat

SEQ ID NO: 60749 - DNA, 20 bp, Artificial Sequence
  Description of Artificial Sequence: Synthetic oligonucleotide
  Target: ATXN1; (-) strand; PAM type: NRG; PAM sequence: CAG
tttgggtgtcatttttcaaa

SEQ ID NO: 60750 - DNA, 20 bp, Artificial Sequence
  Description of Artificial Sequence: Synthetic oligonucleotide
  Target: ATXN1; (-) strand; PAM type: NRG; PAM sequence: GGG
gatcccaggggagatctttt

SEQ ID NO: 60751 - DNA, 20 bp, Artificial Sequence
  Description of Artificial Sequence: Synthetic oligonucleotide
  Target: ATXN1; (-) strand; PAM type: NRG; PAM sequence: TGG
tgatcccaggggagatcttt

SEQ ID NO: 60752 - DNA, 20 bp, Artificial Sequence
  Description of Artificial Sequence: Synthetic oligonucleotide
  Target: ATXN1; (-) strand; PAM type: NRG; PAM sequence: GAG
gatttcagctgatcccaggg

SEQ ID NO: 60753 - DNA, 20 bp, Artificial Sequence
  Description of Artificial Sequence: Synthetic oligonucleotide
  Target: ATXN1; (-) strand; PAM type: NRG; PAM sequence: GGG
gtgatttcagctgatcccag

SEQ ID NO: 60754 - DNA, 20 bp, Artificial Sequence
  Description of Artificial Sequence: Synthetic oligonucleotide
  Target: ATXN1; (-) strand; PAM type: NRG; PAM sequence: GGG
ggtgatttcagctgatccca

SEQ ID NO: 60755 - DNA, 20 bp, Artificial Sequence
  Description of Artificial Sequence: Synthetic oligonucleotide
  Target: ATXN1; (-) strand; PAM type: NRG; PAM sequence: AGG
tggtgatttcagctgatccc

SEQ ID NO: 60756 - DNA, 20 bp, Artificial Sequence
  Description of Artificial Sequence: Synthetic oligonucleotide
  Target: ATXN1; (-) strand; PAM type: NRG; PAM sequence: CAG
atggtgatttcagctgatcc

SEQ ID NO: 60757 - DNA, 20 bp, Artificial Sequence
  Description of Artificial Sequence: Synthetic oligonucleotide
  Target: ATXN1; (-) strand; PAM type: NRG; PAM sequence: CAG
aatttttttaatggtgattt

SEQ ID NO: 60758 - DNA, 20 bp, Artificial Sequence
  Description of Artificial Sequence: Synthetic oligonucleotide
  Target: ATXN1; (-) strand; PAM type: NRG; PAM sequence: TGG
catggcctgaatttttttaa

SEQ ID NO: 60759 - DNA, 20 bp, Artificial Sequence
  Description of Artificial Sequence: Synthetic oligonucleotide
  Target: ATXN1; (-) strand; PAM type: NRG; PAM sequence: TGG
aagtgctgaaattacaagca

SEQ ID NO: 60760 - DNA, 20 bp, Artificial Sequence
  Description of Artificial Sequence: Synthetic oligonucleotide
  Target: ATXN1; (-) strand; PAM type: NRG; PAM sequence: AAG
tcccaaagtgctgaaattac

SEQ ID NO: 60761 - DNA, 20 bp, Artificial Sequence
  Description of Artificial Sequence: Synthetic oligonucleotide
  Target: ATXN1; (-) strand; PAM type: NRG; PAM sequence: AAG
cctcctgtcttgacctccca

SEQ ID NO: 60762 - DNA, 20 bp, Artificial Sequence
  Description of Artificial Sequence: Synthetic oligonucleotide
  Target: ATXN1; (-) strand; PAM type: NRG; PAM sequence: AAG
gactcacactccctggcctc

SEQ ID NO: 60763 - DNA, 20 bp, Artificial Sequence
  Description of Artificial Sequence: Synthetic oligonucleotide
  Target: ATXN1; (-) strand; PAM type: NRG; PAM sequence: TGG
caggctggactcacactccc

SEQ ID NO: 60764 - DNA, 20 bp, Artificial Sequence
  Description of Artificial Sequence: Synthetic oligonucleotide
  Target: ATXN1; (-) strand; PAM type: NRG; PAM sequence: TGG
tctcactatgttgcccaggc

SEQ ID NO: 60765 - DNA, 20 bp, Artificial Sequence
  Description of Artificial Sequence: Synthetic oligonucleotide
  Target: ATXN1; (-) strand; PAM type: NRG; PAM sequence: AGG
gaagtctcactatgttgccc

SEQ ID NO: 60766 - DNA, 20 bp, Artificial Sequence
  Description of Artificial Sequence: Synthetic oligonucleotide
  Target: ATXN1; (-) strand; PAM type: NRG; PAM sequence: CAG
tgaagtctcactatgttgcc

SEQ ID NO: 60767 - DNA, 20 bp, Artificial Sequence
  Description of Artificial Sequence: Synthetic oligonucleotide
  Target: ATXN1; (-) strand; PAM type: NRG; PAM sequence: AAG
aattattttttatagagatg

SEQ ID NO: 60768 - DNA, 20 bp, Artificial Sequence
  Description of Artificial Sequence: Synthetic oligonucleotide
  Target: ATXN1; (-) strand; PAM type: NRG; PAM sequence: GAG
tctcttaattattttttata

SEQ ID NO: 60769 - DNA, 20 bp, Artificial Sequence
  Description of Artificial Sequence: Synthetic oligonucleotide
  Target: ATXN1; (-) strand; PAM type: NRG; PAM sequence: TAG
tttctcttaattatttttta

SEQ ID NO: 60770 - DNA, 20 bp, Artificial Sequence
  Description of Artificial Sequence: Synthetic oligonucleotide
  Target: ATXN1; (-) strand; PAM type: NRG; PAM sequence: AGG
ttcaaaggctaagggttgga

SEQ ID NO: 60771 - DNA, 20 bp, Artificial Sequence
  Description of Artificial Sequence: Synthetic oligonucleotide
  Target: ATXN1; (-) strand; PAM type: NRG; PAM sequence: AAG
tttcaaaggctaagggttgg

SEQ ID NO: 60772 - DNA, 20 bp, Artificial Sequence
  Description of Artificial Sequence: Synthetic oligonucleotide
  Target: ATXN1; (-) strand; PAM type: NRG; PAM sequence: TGG
atttttcaaaggctaagggt

SEQ ID NO: 60773 - DNA, 20 bp, Artificial Sequence
  Description of Artificial Sequence: Synthetic oligonucleotide
  Target: ATXN1; (-) strand; PAM type: NRG; PAM sequence: GGG
ttgcatttttcaaaggctaa

SEQ ID NO: 60774 - DNA, 20 bp, Artificial Sequence
  Description of Artificial Sequence: Synthetic oligonucleotide
  Target: ATXN1; (-) strand; PAM type: NRG; PAM sequence: AGG
attgcatttttcaaaggcta

SEQ ID NO: 60775 - DNA, 20 bp, Artificial Sequence
  Description of Artificial Sequence: Synthetic oligonucleotide
  Target: ATXN1; (-) strand; PAM type: NRG; PAM sequence: AAG
aattgcatttttcaaaggct

SEQ ID NO: 60776 - DNA, 20 bp, Artificial Sequence
  Description of Artificial Sequence: Synthetic oligonucleotide
  Target: ATXN1; (-) strand; PAM type: NRG; PAM sequence: AGG
aggataattgcatttttcaa

SEQ ID NO: 60777 - DNA, 20 bp, Artificial Sequence
  Description of Artificial Sequence: Synthetic oligonucleotide
  Target: ATXN1; (-) strand; PAM type: NRG; PAM sequence: AAG
taggataattgcatttttca

SEQ ID NO: 60778 - DNA, 20 bp, Artificial Sequence
  Description of Artificial Sequence: Synthetic oligonucleotide
  Target: ATXN1; (-) strand; PAM type: NRG; PAM sequence: AGG
agctgatagagaccttggct

SEQ ID NO: 60779 - DNA, 20 bp, Artificial Sequence
  Description of Artificial Sequence: Synthetic oligonucleotide
  Target: ATXN1; (-) strand; PAM type: NRG; PAM sequence: TAG
aagctgatagagaccttggc

SEQ ID NO: 60780 - DNA, 20 bp, Artificial Sequence
  Description of Artificial Sequence: Synthetic oligonucleotide
  Target: ATXN1; (-) strand; PAM type: NRG; PAM sequence: TGG
cattaagctgatagagacct

SEQ ID NO: 60781 - DNA, 20 bp, Artificial Sequence
  Description of Artificial Sequence: Synthetic oligonucleotide
  Target: ATXN1; (-) strand; PAM type: NRG; PAM sequence: GAG
acactcacattaagctgata

SEQ ID NO: 60782 - DNA, 20 bp, Artificial Sequence
  Description of Artificial Sequence: Synthetic oligonucleotide
  Target: ATXN1; (-) strand; PAM type: NRG; PAM sequence: TAG
agacactcacattaagctga

SEQ ID NO: 60783 - DNA, 20 bp, Artificial Sequence
  Description of Artificial Sequence: Synthetic oligonucleotide
  Target: ATXN1; (-) strand; PAM type: NRG; PAM sequence: AAG
cttgttgagacactcacatt

SEQ ID NO: 60784 - DNA, 20 bp, Artificial Sequence
  Description of Artificial Sequence: Synthetic oligonucleotide
  Target: ATXN1; (-) strand; PAM type: NRG; PAM sequence: GAG
tggagaaaaacagtcttgtt

SEQ ID NO: 60785 - DNA, 20 bp, Artificial Sequence
  Description of Artificial Sequence: Synthetic oligonucleotide
  Target: ATXN1; (-) strand; PAM type: NRG; PAM sequence: CAG
ggttggcctgtggagaaaaa

SEQ ID NO: 60786 - DNA, 20 bp, Artificial Sequence
  Description of Artificial Sequence: Synthetic oligonucleotide
  Target: ATXN1; (-) strand; PAM type: NRG; PAM sequence: GAG
ggtaccttggttggcctgtg

SEQ ID NO: 60787 - DNA, 20 bp, Artificial Sequence
  Description of Artificial Sequence: Synthetic oligonucleotide
  Target: ATXN1; (-) strand; PAM type: NRG; PAM sequence: TGG
taggtaccttggttggcctg

SEQ ID NO: 60788 - DNA, 20 bp, Artificial Sequence
  Description of Artificial Sequence: Synthetic oligonucleotide
  Target: ATXN1; (-) strand; PAM type: NRG; PAM sequence: TGG
atcagtctaggtaccttggt

SEQ ID NO: 60789 - DNA, 20 bp, Artificial Sequence
  Description of Artificial Sequence: Synthetic oligonucleotide
  Target: ATXN1; (-) strand; PAM type: NRG; PAM sequence: TGG
tcacatcagtctaggtacct

SEQ ID NO: 60790 - DNA, 20 bp, Artificial Sequence
  Description of Artificial Sequence: Synthetic oligonucleotide
  Target: ATXN1; (-) strand; PAM type: NRG; PAM sequence: AGG
caaatgcctcacatcagtct

SEQ ID NO: 60791 - DNA, 20 bp, Artificial Sequence
  Description of Artificial Sequence: Synthetic oligonucleotide
  Target: ATXN1; (-) strand; PAM type: NRG; PAM sequence: TAG
ccaaatgcctcacatcagtc

SEQ ID NO: 60792 - DNA, 20 bp, Artificial Sequence
  Description of Artificial Sequence: Synthetic oligonucleotide
  Target: ATXN1; (-) strand; PAM type: NRG; PAM sequence: CAG
ctcttccaaatgcctcacat

SEQ ID NO: 60793 - DNA, 20 bp, Artificial Sequence
  Description of Artificial Sequence: Synthetic oligonucleotide
  Target: ATXN1; (-) strand; PAM type: NRG; PAM sequence: CAG
gtcactctctgttccctttc

SEQ ID NO: 60794 - DNA, 20 bp, Artificial Sequence
  Description of Artificial Sequence: Synthetic oligonucleotide
  Target: ATXN1; (-) strand; PAM type: NRG; PAM sequence: TGG
ctgcctgtcctttcagtggc

SEQ ID NO: 60795 - DNA, 20 bp, Artificial Sequence
  Description of Artificial Sequence: Synthetic oligonucleotide
  Target: ATXN1; (-) strand; PAM type: NRG; PAM sequence: TGG
gttcctgcctgtcctttcag

SEQ ID NO: 60796 - DNA, 20 bp, Artificial Sequence
  Description of Artificial Sequence: Synthetic oligonucleotide
  Target: ATXN1; (-) strand; PAM type: NRG; PAM sequence: CAG
gtggttcctgcctgtccttt

SEQ ID NO: 60797 - DNA, 20 bp, Artificial Sequence
  Description of Artificial Sequence: Synthetic oligonucleotide
  Target: ATXN1; (-) strand; PAM type: NRG; PAM sequence: TGG
taggcgcagtttgtttccag

SEQ ID NO: 60798 - DNA, 20 bp, Artificial Sequence
  Description of Artificial Sequence: Synthetic oligonucleotide
  Target: ATXN1; (-) strand; PAM type: NRG; PAM sequence: CAG
aagtaggcgcagtttgtttc

SEQ ID NO: 60799 - DNA, 20 bp, Artificial Sequence
  Description of Artificial Sequence: Synthetic oligonucleotide
  Target: ATXN1; (-) strand; PAM type: NRG; PAM sequence: CAG
gggaaatttcaaagtaggcg

SEQ ID NO: 60800 - DNA, 20 bp, Artificial Sequence
  Description of Artificial Sequence: Synthetic oligonucleotide
  Target: ATXN1; (-) strand; PAM type: NRG; PAM sequence: AGG
tgtgggggaaatttcaaagt

SEQ ID NO: 60801 - DNA, 20 bp, Artificial Sequence
  Description of Artificial Sequence: Synthetic oligonucleotide
  Target: ATXN1; (-) strand; PAM type: NRG; PAM sequence: TAG
ctgtgggggaaatttcaaag

SEQ ID NO: 60802 - DNA, 20 bp, Artificial Sequence
  Description of Artificial Sequence: Synthetic oligonucleotide
  Target: ATXN1; (-) strand; PAM type: NRG; PAM sequence: AAG
gtgctgtgggggaaatttca

SEQ ID NO: 60803 - DNA, 20 bp, Artificial Sequence
  Description of Artificial Sequence: Synthetic oligonucleotide
  Target: ATXN1; (-) strand; PAM type: NRG; PAM sequence: GGG
aaaggtcatctgtgctgtgg

SEQ ID NO: 60804 - DNA, 20 bp, Artificial Sequence
  Description of Artificial Sequence: Synthetic oligonucleotide
  Target: ATXN1; (-) strand; PAM type: NRG; PAM sequence: GGG
aaaaggtcatctgtgctgtg

SEQ ID NO: 60805 - DNA, 20 bp, Artificial Sequence
  Description of Artificial Sequence: Synthetic oligonucleotide
  Target: ATXN1; (-) strand; PAM type: NRG; PAM sequence: GGG
caaaaggtcatctgtgctgt

SEQ ID NO: 60806 - DNA, 20 bp, Artificial Sequence
  Description of Artificial Sequence: Synthetic oligonucleotide
  Target: ATXN1; (-) strand; PAM type: NRG; PAM sequence: TGG
gcaaaaggtcatctgtgctg

SEQ ID NO: 60807 - DNA, 20 bp, Artificial Sequence
  Description of Artificial Sequence: Synthetic oligonucleotide
  Target: ATXN1; (-) strand; PAM type: NRG; PAM sequence: AGG
gtatgaaaacttgtggcaaa

SEQ ID NO: 60808 - DNA, 20 bp, Artificial Sequence
  Description of Artificial Sequence: Synthetic oligonucleotide
  Target: ATXN1; (-) strand; PAM type: NRG; PAM sequence: AAG
tgtatgaaaacttgtggcaa

SEQ ID NO: 60809 - DNA, 20 bp, Artificial Sequence
  Description of Artificial Sequence: Synthetic oligonucleotide
  Target: ATXN1; (-) strand; PAM type: NRG; PAM sequence: TGG
aaagcttgtatgaaaacttg

SEQ ID NO: 60810 - DNA, 20 bp, Artificial Sequence
  Description of Artificial Sequence: Synthetic oligonucleotide
  Target: ATXN1; (-) strand; PAM type: NRG; PAM sequence: AAG
attattggaatgagaaagca

SEQ ID NO: 60811 - DNA, 20 bp, Artificial Sequence
  Description of Artificial Sequence: Synthetic oligonucleotide
  Target: ATXN1; (-) strand; PAM type: NRG; PAM sequence: AAG
gggagattattggaatgaga

SEQ ID NO: 60812 - DNA, 20 bp, Artificial Sequence
  Description of Artificial Sequence: Synthetic oligonucleotide
  Target: ATXN1; (-) strand; PAM type: NRG; PAM sequence: GAG
agcagggagattattggaat

SEQ ID NO: 60813 - DNA, 20 bp, Artificial Sequence
  Description of Artificial Sequence: Synthetic oligonucleotide
  Target: ATXN1; (-) strand; PAM type: NRG; PAM sequence: TGG
tcagatagcagggagattat

SEQ ID NO: 60814 - DNA, 20 bp, Artificial Sequence
  Description of Artificial Sequence: Synthetic oligonucleotide
  Target: ATXN1; (-) strand; PAM type: NRG; PAM sequence: GAG
gaagtctttcagatagcagg

SEQ ID NO: 60815 - DNA, 20 bp, Artificial Sequence
  Description of Artificial Sequence: Synthetic oligonucleotide
  Target: ATXN1; (-) strand; PAM type: NRG; PAM sequence: GGG
cagaagtctttcagatagca

SEQ ID NO: 60816 - DNA, 20 bp, Artificial Sequence
  Description of Artificial Sequence: Synthetic oligonucleotide
  Target: ATXN1; (-) strand; PAM type: NRG; PAM sequence: AGG
ccagaagtctttcagatagc

SEQ ID NO: 60817 - DNA, 20 bp, Artificial Sequence
  Description of Artificial Sequence: Synthetic oligonucleotide
  Target: ATXN1; (-) strand; PAM type: NRG; PAM sequence: CAG
gccagaagtctttcagatag

SEQ ID NO: 60818 - DNA, 20 bp, Artificial Sequence
  Description of Artificial Sequence: Synthetic oligonucleotide
  Target: ATXN1; (-) strand; PAM type: NRG; PAM sequence: TAG
attgccagaagtctttcaga

SEQ ID NO: 60819 - DNA, 20 bp, Artificial Sequence
  Description of Artificial Sequence: Synthetic oligonucleotide
  Target: ATXN1; (-) strand; PAM type: NRG; PAM sequence: CAG
tttaattgccagaagtcttt

SEQ ID NO: 60820 - DNA, 20 bp, Artificial Sequence
  Description of Artificial Sequence: Synthetic oligonucleotide
  Target: ATXN1; (-) strand; PAM type: NRG; PAM sequence: AAG
gtgtgtgttttaattgccag

SEQ ID NO: 60821 - DNA, 20 bp, Artificial Sequence
  Description of Artificial Sequence: Synthetic oligonucleotide
  Target: ATXN1; (-) strand; PAM type: NRG; PAM sequence: CAG
tgtgtgtgtgttttaattgc

SEQ ID NO: 60822 - DNA, 20 bp, Artificial Sequence
  Description of Artificial Sequence: Synthetic oligonucleotide
  Target: ATXN1; (-) strand; PAM type: NRG; PAM sequence: AAG
cttctgatgaagcccttttc

SEQ ID NO: 60823 - DNA, 20 bp, Artificial Sequence
  Description of Artificial Sequence: Synthetic oligonucleotide
  Target: ATXN1; (-) strand; PAM type: NRG; PAM sequence: AAG
gacctgttcatcttctgatg

SEQ ID NO: 60824 - DNA, 20 bp, Artificial Sequence
  Description of Artificial Sequence: Synthetic oligonucleotide
  Target: ATXN1; (-) strand; PAM type: NRG; PAM sequence: AAG
ggttgggaattatttcgcag

SEQ ID NO: 60825 - DNA, 20 bp, Artificial Sequence
  Description of Artificial Sequence: Synthetic oligonucleotide
  Target: ATXN1; (-) strand; PAM type: NRG; PAM sequence: CAG
gatggttgggaattatttcg

SEQ ID NO: 60826 - DNA, 20 bp, Artificial Sequence
  Description of Artificial Sequence: Synthetic oligonucleotide
  Target: ATXN1; (-) strand; PAM type: NRG; PAM sequence: GGG
taacttacattgtgatggtt

SEQ ID NO: 60827 - DNA, 20 bp, Artificial Sequence
  Description of Artificial Sequence: Synthetic oligonucleotide
  Target: ATXN1; (-) strand; PAM type: NRG; PAM sequence: TGG
ttaacttacattgtgatggt

SEQ ID NO: 60828 - DNA, 20 bp, Artificial Sequence
  Description of Artificial Sequence: Synthetic oligonucleotide
  Target: ATXN1; (-) strand; PAM type: NRG; PAM sequence: TGG
gtgattaacttacattgtga

SEQ ID NO: 60829 - DNA, 20 bp, Artificial Sequence
  Description of Artificial Sequence: Synthetic oligonucleotide
  Target: ATXN1; (-) strand; PAM type: NRG; PAM sequence: AGG
actaaccatagttcagtttc

SEQ ID NO: 60830 - DNA, 20 bp, Artificial Sequence
  Description of Artificial Sequence: Synthetic oligonucleotide
  Target: ATXN1; (-) strand; PAM type: NRG; PAM sequence: CAG
tactaaccatagttcagttt

SEQ ID NO: 60831 - DNA, 20 bp, Artificial Sequence
  Description of Artificial Sequence: Synthetic oligonucleotide
  Target: ATXN1; (-) strand; PAM type: NRG; PAM sequence: CAG
tcaaattactaaccatagtt

SEQ ID NO: 60832 - DNA, 20 bp, Artificial Sequence
  Description of Artificial Sequence: Synthetic oligonucleotide
  Target: ATXN1; (-) strand; PAM type: NRG; PAM sequence: TAG
caatctcaaattactaacca

SEQ ID NO: 60833 - DNA, 20 bp, Artificial Sequence
  Description of Artificial Sequence: Synthetic oligonucleotide
  Target: ATXN1; (-) strand; PAM type: NRG; PAM sequence: AGG
ctcaggaatgccgagctcta

SEQ ID NO: 60834 - DNA, 20 bp, Artificial Sequence
  Description of Artificial Sequence: Synthetic oligonucleotide
  Target: ATXN1; (-) strand; PAM type: NRG; PAM sequence: AAG
actcaggaatgccgagctct

SEQ ID NO: 60835 - DNA, 20 bp, Artificial Sequence
  Description of Artificial Sequence: Synthetic oligonucleotide
  Target: ATXN1; (-) strand; PAM type: NRG; PAM sequence: GAG
gcagcaaactcaggaatgcc

SEQ ID NO: 60836 - DNA, 20 bp, Artificial Sequence
  Description of Artificial Sequence: Synthetic oligonucleotide
  Target: ATXN1; (-) strand; PAM type: NRG; PAM sequence: AGG
ctactcattgcagcaaactc

SEQ ID NO: 60837 - DNA, 20 bp, Artificial Sequence
  Description of Artificial Sequence: Synthetic oligonucleotide
  Target: ATXN1; (-) strand; PAM type: NRG; PAM sequence: CAG
actactcattgcagcaaact

SEQ ID NO: 60838 - DNA, 20 bp, Artificial Sequence
  Description of Artificial Sequence: Synthetic oligonucleotide
  Target: ATXN1; (-) strand; PAM type: NRG; PAM sequence: CAG
tcaaacttaactactcattg

SEQ ID NO: 60839 - DNA, 20 bp, Artificial Sequence
  Description of Artificial Sequence: Synthetic oligonucleotide
  Target: ATXN1; (-) strand; PAM type: NRG; PAM sequence: TAG
tattacatcattcacatatc

SEQ ID NO: 60840 - DNA, 20 bp, Artificial Sequence
  Description of Artificial Sequence: Synthetic oligonucleotide
  Target: ATXN1; (-) strand; PAM type: NRG; PAM sequence: GAG
aggcataaggtcatgactgt

SEQ ID NO: 60841 - DNA, 20 bp, Artificial Sequence
  Description of Artificial Sequence: Synthetic oligonucleotide
  Target: ATXN1; (-) strand; PAM type: NRG; PAM sequence: AGG
cactctatgatataggcata

SEQ ID NO: 60842 - DNA, 20 bp, Artificial Sequence
  Description of Artificial Sequence: Synthetic oligonucleotide
  Target: ATXN1; (-) strand; PAM type: NRG; PAM sequence: AAG
tcactctatgatataggcat

SEQ ID NO: 60843 - DNA, 20 bp, Artificial Sequence
  Description of Artificial Sequence: Synthetic oligonucleotide
  Target: ATXN1; (-) strand; PAM type: NRG; PAM sequence: AGG
ctagtgtcactctatgatat

SEQ ID NO: 60844 - DNA, 20 bp, Artificial Sequence
  Description of Artificial Sequence: Synthetic oligonucleotide
  Target: ATXN1; (-) strand; PAM type: NRG; PAM sequence: TAG
tctagtgtcactctatgata

SEQ ID NO: 60845 - DNA, 20 bp, Artificial Sequence
  Description of Artificial Sequence: Synthetic oligonucleotide
  Target: ATXN1; (-) strand; PAM type: NRG; PAM sequence: TAG
tttgcatttcactggctgtc

SEQ ID NO: 60846 - DNA, 20 bp, Artificial Sequence
  Description of Artificial Sequence: Synthetic oligonucleotide
  Target: ATXN1; (-) strand; PAM type: NRG; PAM sequence: TGG
atggctgctttgcatttcac

SEQ ID NO: 60847 - DNA, 20 bp, Artificial Sequence
  Description of Artificial Sequence: Synthetic oligonucleotide
  Target: ATXN1; (-) strand; PAM type: NRG; PAM sequence: TGG
cgaatctaatccagggcaca

SEQ ID NO: 60848 - DNA, 20 bp, Artificial Sequence
  Description of Artificial Sequence: Synthetic oligonucleotide
  Target: ATXN1; (-) strand; PAM type: NRG; PAM sequence: GGG
agaggtgcgaatctaatcca

SEQ ID NO: 60849 - DNA, 20 bp, Artificial Sequence
  Description of Artificial Sequence: Synthetic oligonucleotide
  Target: ATXN1; (-) strand; PAM type: NRG; PAM sequence: AGG
gagaggtgcgaatctaatcc

SEQ ID NO: 60850 - DNA, 20 bp, Artificial Sequence
  Description of Artificial Sequence: Synthetic oligonucleotide
  Target: ATXN1; (-) strand; PAM type: NRG; PAM sequence: CAG
agagaggtgcgaatctaatc

SEQ ID NO: 60851 - DNA, 20 bp, Artificial Sequence
  Description of Artificial Sequence: Synthetic oligonucleotide
  Target: ATXN1; (-) strand; PAM type: NRG; PAM sequence: AGG
aaagctgcccagctacagag

SEQ ID NO: 60852 - DNA, 20 bp, Artificial Sequence
  Description of Artificial Sequence: Synthetic oligonucleotide
  Target: ATXN1; (-) strand; PAM type: NRG; PAM sequence: GAG
gaaagctgcccagctacaga

SEQ ID NO: 60853 - DNA, 20 bp, Artificial Sequence
  Description of Artificial Sequence: Synthetic oligonucleotide
  Target: ATXN1; (-) strand; PAM type: NRG; PAM sequence: GAG
ctgaaagctgcccagctaca

SEQ ID NO: 60854 - DNA, 20 bp, Artificial Sequence
  Description of Artificial Sequence: Synthetic oligonucleotide
  Target: ATXN1; (-) strand; PAM type: NRG; PAM sequence: CAG
tactgaaagctgcccagcta

SEQ ID NO: 60855 - DNA, 20 bp, Artificial Sequence
  Description of Artificial Sequence: Synthetic oligonucleotide
  Target: ATXN1; (-) strand; PAM type: NRG; PAM sequence: CAG
atgctctactgaaagctgcc

SEQ ID NO: 60856 - DNA, 20 bp, Artificial Sequence
  Description of Artificial Sequence: Synthetic oligonucleotide
  Target: ATXN1; (-) strand; PAM type: NRG; PAM sequence: AAG
ctcctgacatgctctactga

SEQ ID NO: 60857 - DNA, 20 bp, Artificial Sequence
  Description of Artificial Sequence: Synthetic oligonucleotide
  Target: ATXN1; (-) strand; PAM type: NRG; PAM sequence: CAG
ctccctgtatattacaatga

SEQ ID NO: 60858 - DNA, 20 bp, Artificial Sequence
  Description of Artificial Sequence: Synthetic oligonucleotide
  Target: ATXN1; (-) strand; PAM type: NRG; PAM sequence: AGG
agtgtcttataaagaaaaat

SEQ ID NO: 60859 - DNA, 20 bp, Artificial Sequence
  Description of Artificial Sequence: Synthetic oligonucleotide
  Target: ATXN1; (-) strand; PAM type: NRG; PAM sequence: TAG
gagtgtcttataaagaaaaa

SEQ ID NO: 60860 - DNA, 20 bp, Artificial Sequence
  Description of Artificial Sequence: Synthetic oligonucleotide
  Target: ATXN1; (-) strand; PAM type: NRG; PAM sequence: AAG
ggtattccgagtgtcttata

SEQ ID NO: 60861 - DNA, 20 bp, Artificial Sequence
  Description of Artificial Sequence: Synthetic oligonucleotide
  Target: ATXN1; (-) strand; PAM type: NRG; PAM sequence: GAG
taaggcctgttaggtattcc

SEQ ID NO: 60862 - DNA, 20 bp, Artificial Sequence
  Description of Artificial Sequence: Synthetic oligonucleotide
  Target: ATXN1; (-) strand; PAM type: NRG; PAM sequence: AGG
tgatgaagttaaggcctgtt

SEQ ID NO: 60863 - DNA, 20 bp, Artificial Sequence
  Description of Artificial Sequence: Synthetic oligonucleotide
  Target: ATXN1; (-) strand; PAM type: NRG; PAM sequence: TAG
ttgatgaagttaaggcctgt

SEQ ID NO: 60864 - DNA, 20 bp, Artificial Sequence
  Description of Artificial Sequence: Synthetic oligonucleotide
  Target: ATXN1; (-) strand; PAM type: NRG; PAM sequence: AGG
tgcggagattgatgaagtta

SEQ ID NO: 60865 - DNA, 20 bp, Artificial Sequence
  Description of Artificial Sequence: Synthetic oligonucleotide
  Target: ATXN1; (-) strand; PAM type: NRG; PAM sequence: AAG
gtgcggagattgatgaagtt

SEQ ID NO: 60866 - DNA, 20 bp, Artificial Sequence
  Description of Artificial Sequence: Synthetic oligonucleotide
  Target: ATXN1; (-) strand; PAM type: NRG; PAM sequence: AAG
agatggtgcggagattgatg

SEQ ID NO: 60867 - DNA, 20 bp, Artificial Sequence
  Description of Artificial Sequence: Synthetic oligonucleotide
  Target: ATXN1; (-) strand; PAM type: NRG; PAM sequence: GAG
aaggtctgacagatggtgcg

SEQ ID NO: 60868 - DNA, 20 bp, Artificial Sequence
  Description of Artificial Sequence: Synthetic oligonucleotide
  Target: ATXN1; (-) strand; PAM type: NRG; PAM sequence: CGG
ctaaggtctgacagatggtg

SEQ ID NO: 60869 - DNA, 20 bp, Artificial Sequence
  Description of Artificial Sequence: Synthetic oligonucleotide
  Target: ATXN1; (-) strand; PAM type: NRG; PAM sequence: TGG
gtaacctaaggtctgacaga

SEQ ID NO: 60870 - DNA, 20 bp, Artificial Sequence
  Description of Artificial Sequence: Synthetic oligonucleotide
  Target: ATXN1; (-) strand; PAM type: NRG; PAM sequence: CAG
cactgtaacctaaggtctga

SEQ ID NO: 60871 - DNA, 20 bp, Artificial Sequence
  Description of Artificial Sequence: Synthetic oligonucleotide
  Target: ATXN1; (-) strand; PAM type: NRG; PAM sequence: AGG
ggggtggtcactgtaaccta

SEQ ID NO: 60872 - DNA, 20 bp, Artificial Sequence
  Description of Artificial Sequence: Synthetic oligonucleotide
  Target: ATXN1; (-) strand; PAM type: NRG; PAM sequence: AAG
gggggtggtcactgtaacct

SEQ ID NO: 60873 - DNA, 20 bp, Artificial Sequence
  Description of Artificial Sequence: Synthetic oligonucleotide
  Target: ATXN1; (-) strand; PAM type: NRG; PAM sequence: TGG
tcttgattaatgcatggggg

SEQ ID NO: 60874 - DNA, 20 bp, Artificial Sequence
  Description of Artificial Sequence: Synthetic oligonucleotide
  Target: ATXN1; (-) strand; PAM type: NRG; PAM sequence: GGG
tcttcttgattaatgcatgg

SEQ ID NO: 60875 - DNA, 20 bp, Artificial Sequence
  Description of Artificial Sequence: Synthetic oligonucleotide
  Target: ATXN1; (-) strand; PAM type: NRG; PAM sequence: GGG
ctcttcttgattaatgcatg

SEQ ID NO: 60876 - DNA, 20 bp, Artificial Sequence
  Description of Artificial Sequence: Synthetic oligonucleotide
  Target: ATXN1; (-) strand; PAM type: NRG; PAM sequence: GGG
cctcttcttgattaatgcat

SEQ ID NO: 60877 - DNA, 20 bp, Artificial Sequence
  Description of Artificial Sequence: Synthetic oligonucleotide
  Target: ATXN1; (-) strand; PAM type: NRG; PAM sequence: TGG
gcctcttcttgattaatgca

SEQ ID NO: 60878 - DNA, 20 bp, Artificial Sequence
  Description of Artificial Sequence: Synthetic oligonucleotide
  Target: ATXN1; (-) strand; PAM type: NRG; PAM sequence: TGG
ttttctcaaagctacacact

SEQ ID NO: 60879 - DNA, 20 bp, Artificial Sequence
  Description of Artificial Sequence: Synthetic oligonucleotide
  Target: ATXN1; (-) strand; PAM type: NRG; PAM sequence: AAG
aaagagcagaacttttctca

SEQ ID NO: 60880 - DNA, 20 bp, Artificial Sequence
  Description of Artificial Sequence: Synthetic oligonucleotide
  Target: ATXN1; (-) strand; PAM type: NRG; PAM sequence: CAG
tacagtcaagtctgaaagag

SEQ ID NO: 60881 - DNA, 20 bp, Artificial Sequence
  Description of Artificial Sequence: Synthetic oligonucleotide
  Target: ATXN1; (-) strand; PAM type: NRG; PAM sequence: GAG
taatacagtcaagtctgaaa

SEQ ID NO: 60882 - DNA, 20 bp, Artificial Sequence
  Description of Artificial Sequence: Synthetic oligonucleotide
  Target: ATXN1; (-) strand; PAM type: NRG; PAM sequence: AAG
aataatacagtcaagtctga

SEQ ID NO: 60883 - DNA, 20 bp, Artificial Sequence
  Description of Artificial Sequence: Synthetic oligonucleotide
  Target: ATXN1; (-) strand; PAM type: NRG; PAM sequence: AAG
gaaattttaataatacagtc

SEQ ID NO: 60884 - DNA, 20 bp, Artificial Sequence
  Description of Artificial Sequence: Synthetic oligonucleotide
  Target: ATXN1; (-) strand; PAM type: NRG; PAM sequence: CAG
ttttagaaattttaataata

SEQ ID NO: 60885 - DNA, 20 bp, Artificial Sequence
  Description of Artificial Sequence: Synthetic oligonucleotide
  Target: ATXN1; (-) strand; PAM type: NRG; PAM sequence: TAG
cctcctgttgtttacctttt

SEQ ID NO: 60886 - DNA, 20 bp, Artificial Sequence
  Description of Artificial Sequence: Synthetic oligonucleotide
  Target: ATXN1; (-) strand; PAM type: NRG; PAM sequence: AAG
gggacatgggtatgcaatca

SEQ ID NO: 60887 - DNA, 20 bp, Artificial Sequence
  Description of Artificial Sequence: Synthetic oligonucleotide
  Target: ATXN1; (-) strand; PAM type: NRG; PAM sequence: GGG
ttctaagctgccagggacat

SEQ ID NO: 60888 - DNA, 20 bp, Artificial Sequence
  Description of Artificial Sequence: Synthetic oligonucleotide
  Target: ATXN1; (-) strand; PAM type: NRG; PAM sequence: TGG
attctaagctgccagggaca

SEQ ID NO: 60889 - DNA, 20 bp, Artificial Sequence
  Description of Artificial Sequence: Synthetic oligonucleotide
  Target: ATXN1; (-) strand; PAM type: NRG; PAM sequence: GGG
gtaaccattctaagctgcca

SEQ ID NO: 60890 - DNA, 20 bp, Artificial Sequence
  Description of Artificial Sequence: Synthetic oligonucleotide
  Target: ATXN1; (-) strand; PAM type: NRG; PAM sequence: AGG
tgtaaccattctaagctgcc

SEQ ID NO: 60891 - DNA, 20 bp, Artificial Sequence
  Description of Artificial Sequence: Synthetic oligonucleotide
  Target: ATXN1; (-) strand; PAM type: NRG; PAM sequence: CAG
ctgtaaccattctaagctgc

SEQ ID NO: 60892 - DNA, 20 bp, Artificial Sequence
  Description of Artificial Sequence: Synthetic oligonucleotide
  Target: ATXN1; (-) strand; PAM type: NRG; PAM sequence: AAG
ttaagcgctgtaaccattct

SEQ ID NO: 60893 - DNA, 20 bp, Artificial Sequence
  Description of Artificial Sequence: Synthetic oligonucleotide
  Target: ATXN1; (-) strand; PAM type: NRG; PAM sequence: AAG
tgcactttgtatgttacctt

SEQ ID NO: 60894 - DNA, 20 bp, Artificial Sequence
  Description of Artificial Sequence: Synthetic oligonucleotide
  Target: ATXN1; (-) strand; PAM type: NRG; PAM sequence: AGG
ttatttcactgagttttgtc

SEQ ID NO: 60895 - DNA, 20 bp, Artificial Sequence
  Description of Artificial Sequence: Synthetic oligonucleotide
  Target: ATXN1; (-) strand; PAM type: NRG; PAM sequence: CAG
gttatttcactgagttttgt

SEQ ID NO: 60896 - DNA, 20 bp, Artificial Sequence
  Description of Artificial Sequence: Synthetic oligonucleotide
  Target: ATXN1; (-) strand; PAM type: NRG; PAM sequence: GAG
cacctgcgtgttatttcact

SEQ ID NO: 60897 - DNA, 20 bp, Artificial Sequence
  Description of Artificial Sequence: Synthetic oligonucleotide
  Target: ATXN1; (-) strand; PAM type: NRG; PAM sequence: AGG
tggaagtggggtgaagacgc

SEQ ID NO: 60898 - DNA, 20 bp, Artificial Sequence
  Description of Artificial Sequence: Synthetic oligonucleotide
  Target: ATXN1; (-) strand; PAM type: NRG; PAM sequence: CAG
ttggaagtggggtgaagacg

SEQ ID NO: 60899 - DNA, 20 bp, Artificial Sequence
  Description of Artificial Sequence: Synthetic oligonucleotide
  Target: ATXN1; (-) strand; PAM type: NRG; PAM sequence: AAG
ttatttttggaagtggggtg

SEQ ID NO: 60900 - DNA, 20 bp, Artificial Sequence
  Description of Artificial Sequence: Synthetic oligonucleotide
  Target: ATXN1; (-) strand; PAM type: NRG; PAM sequence: GGG
tcttcttatttttggaagtg

SEQ ID NO: 60901 - DNA, 20 bp, Artificial Sequence
  Description of Artificial Sequence: Synthetic oligonucleotide
  Target: ATXN1; (-) strand; PAM type: NRG; PAM sequence: GGG
atcttcttatttttggaagt

SEQ ID NO: 60902 - DNA, 20 bp, Artificial Sequence
  Description of Artificial Sequence: Synthetic oligonucleotide
  Target: ATXN1; (-) strand; PAM type: NRG; PAM sequence: TGG
aatcttcttatttttggaag

SEQ ID NO: 60903 - DNA, 20 bp, Artificial Sequence
  Description of Artificial Sequence: Synthetic oligonucleotide
  Target: ATXN1; (-) strand; PAM type: NRG; PAM sequence: AAG
tagaatcttcttatttttgg

SEQ ID NO: 60904 - DNA, 20 bp, Artificial Sequence
  Description of Artificial Sequence: Synthetic oligonucleotide
  Target: ATXN1; (-) strand; PAM type: NRG; PAM sequence: TGG
aaatagaatcttcttatttt

SEQ ID NO: 60905 - DNA, 20 bp, Artificial Sequence
  Description of Artificial Sequence: Synthetic oligonucleotide
  Target: ATXN1; (-) strand; PAM type: NRG; PAM sequence: TAG
gagtagacagtaaaaaaaaa

SEQ ID NO: 60906 - DNA, 20 bp, Artificial Sequence
  Description of Artificial Sequence: Synthetic oligonucleotide
  Target: ATXN1; (-) strand; PAM type: NRG; PAM sequence: CAG
tctagagtgtatggagtaga

SEQ ID NO: 60907 - DNA, 20 bp, Artificial Sequence
  Description of Artificial Sequence: Synthetic oligonucleotide
  Target: ATXN1; (-) strand; PAM type: NRG; PAM sequence: TAG
ctgttctagagtgtatggag

SEQ ID NO: 60908 - DNA, 20 bp, Artificial Sequence
  Description of Artificial Sequence: Synthetic oligonucleotide
  Target: ATXN1; (-) strand; PAM type: NRG; PAM sequence: GAG
aatctgttctagagtgtatg

SEQ ID NO: 60909 - DNA, 20 bp, Artificial Sequence
  Description of Artificial Sequence: Synthetic oligonucleotide
  Target: ATXN1; (-) strand; PAM type: NRG; PAM sequence: TGG
gtaatctgttctagagtgta

SEQ ID NO: 60910 - DNA, 20 bp, Artificial Sequence
  Description of Artificial Sequence: Synthetic oligonucleotide
  Target: ATXN1; (-) strand; PAM type: NRG; PAM sequence: GAG
tatgtatgtaatctgttcta

SEQ ID NO: 60911 - DNA, 20 bp, Artificial Sequence
  Description of Artificial Sequence: Synthetic oligonucleotide
  Target: ATXN1; (-) strand; PAM type: NRG; PAM sequence: TAG
aatatgtatgtaatctgttc

SEQ ID NO: 60912 - DNA, 20 bp, Artificial Sequence
  Description of Artificial Sequence: Synthetic oligonucleotide
  Target: ATXN1; (-) strand; PAM type: NRG; PAM sequence: AAG
caaacacatgaccttacatg

SEQ ID NO: 60913 - DNA, 20 bp, Artificial Sequence
  Description of Artificial Sequence: Synthetic oligonucleotide
  Target: ATXN1; (-) strand; PAM type: NRG; PAM sequence: GAG
cagctttataggtgactgga

SEQ ID NO: 60914 - DNA, 20 bp, Artificial Sequence
  Description of Artificial Sequence: Synthetic oligonucleotide
  Target: ATXN1; (-) strand; PAM type: NRG; PAM sequence: GAG
ctcagctttataggtgactg

SEQ ID NO: 60915 - DNA, 20 bp, Artificial Sequence
  Description of Artificial Sequence: Synthetic oligonucleotide
  Target: ATXN1; (-) strand; PAM type: NRG; PAM sequence: TGG
agctcagctttataggtgac

SEQ ID NO: 60916 - DNA, 20 bp, Artificial Sequence
  Description of Artificial Sequence: Synthetic oligonucleotide
  Target: ATXN1; (-) strand; PAM type: NRG; PAM sequence: AGG
agggatgagctcagctttat

SEQ ID NO: 60917 - DNA, 20 bp, Artificial Sequence
  Description of Artificial Sequence: Synthetic oligonucleotide
  Target: ATXN1; (-) strand; PAM type: NRG; PAM sequence: TAG
aagggatgagctcagcttta

SEQ ID NO: 60918 - DNA, 20 bp, Artificial Sequence
  Description of Artificial Sequence: Synthetic oligonucleotide
  Target: ATXN1; (-) strand; PAM type: NRG; PAM sequence: CAG
gccagaagaagggatgagct

SEQ ID NO: 60919 - DNA, 20 bp, Artificial Sequence
  Description of Artificial Sequence: Synthetic oligonucleotide
  Target: ATXN1; (-) strand; PAM type: NRG; PAM sequence: GAG
caagtgccagaagaagggat

SEQ ID NO: 60920 - DNA, 20 bp, Artificial Sequence
  Description of Artificial Sequence: Synthetic oligonucleotide
  Target: ATXN1; (-) strand; PAM type: NRG; PAM sequence: GGG
tagaacaagtgccagaagaa

SEQ ID NO: 60921 - DNA, 20 bp, Artificial Sequence
  Description of Artificial Sequence: Synthetic oligonucleotide
  Target: ATXN1; (-) strand; PAM type: NRG; PAM sequence: AGG
atagaacaagtgccagaaga

SEQ ID NO: 60922 - DNA, 20 bp, Artificial Sequence
  Description of Artificial Sequence: Synthetic oligonucleotide
  Target: ATXN1; (-) strand; PAM type: NRG; PAM sequence: AAG
tatagaacaagtgccagaag

SEQ ID NO: 60923 - DNA, 20 bp, Artificial Sequence
  Description of Artificial Sequence: Synthetic oligonucleotide
  Target: ATXN1; (-) strand; PAM type: NRG; PAM sequence: AAG
cagtatagaacaagtgccag

SEQ ID NO: 60924 - DNA, 20 bp, Artificial Sequence
  Description of Artificial Sequence: Synthetic oligonucleotide
  Target: ATXN1; (-) strand; PAM type: NRG; PAM sequence: CAG
acacagtatagaacaagtgc

SEQ ID NO: 60925 - DNA, 20 bp, Artificial Sequence
  Description of Artificial Sequence: Synthetic oligonucleotide
  Target: ATXN1; (-) strand; PAM type: NRG; PAM sequence: AAG
tccagaacacagtatagaac

SEQ ID NO: 60926 - DNA, 20 bp, Artificial Sequence
  Description of Artificial Sequence: Synthetic oligonucleotide
  Target: ATXN1; (-) strand; PAM type: NRG; PAM sequence: TAG
ctggcttccagaacacagta

SEQ ID NO: 60927 - DNA, 20 bp, Artificial Sequence
  Description of Artificial Sequence: Synthetic oligonucleotide
  Target: ATXN1; (-) strand; PAM type: NRG; PAM sequence: CAG
ctggtctggcttccagaaca

SEQ ID NO: 60928 - DNA, 20 bp, Artificial Sequence
  Description of Artificial Sequence: Synthetic oligonucleotide
  Target: ATXN1; (-) strand; PAM type: NRG; PAM sequence: CAG
gttcaatctggtctggcttc

SEQ ID NO: 60929 - DNA, 20 bp, Artificial Sequence
  Description of Artificial Sequence: Synthetic oligonucleotide
  Target: ATXN1; (-) strand; PAM type: NRG; PAM sequence: TGG
ttgctgtgttcaatctggtc

SEQ ID NO: 60930 - DNA, 20 bp, Artificial Sequence
  Description of Artificial Sequence: Synthetic oligonucleotide
  Target: ATXN1; (-) strand; PAM type: NRG; PAM sequence: TGG
atggtttgctgtgttcaatc

SEQ ID NO: 60931 - DNA, 20 bp, Artificial Sequence
  Description of Artificial Sequence: Synthetic oligonucleotide
  Target: ATXN1; (-) strand; PAM type: NRG; PAM sequence: TGG
tctatactgaaaggaagata

SEQ ID NO: 60932 - DNA, 20 bp, Artificial Sequence
  Description of Artificial Sequence: Synthetic oligonucleotide
  Target: ATXN1; (-) strand; PAM type: NRG; PAM sequence: AAG
ttgcattctatactgaaagg

SEQ ID NO: 60933 - DNA, 20 bp, Artificial Sequence
  Description of Artificial Sequence: Synthetic oligonucleotide
  Target: ATXN1; (-) strand; PAM type: NRG; PAM sequence: AGG
tcattgcattctatactgaa

SEQ ID NO: 60934 - DNA, 20 bp, Artificial Sequence
  Description of Artificial Sequence: Synthetic oligonucleotide
  Target: ATXN1; (-) strand; PAM type: NRG; PAM sequence: AAG
ctcattgcattctatactga

SEQ ID NO: 60935 - DNA, 20 bp, Artificial Sequence
  Description of Artificial Sequence: Synthetic oligonucleotide
  Target: ATXN1; (-) strand; PAM type: NRG; PAM sequence: CAG
ctgcttatttgctttaatag

SEQ ID NO: 60936 - DNA, 20 bp, Artificial Sequence
  Description of Artificial Sequence: Synthetic oligonucleotide
  Target: ATXN1; (-) strand; PAM type: NRG; PAM sequence: TAG
attctgcttatttgctttaa

SEQ ID NO: 60937 - DNA, 20 bp, Artificial Sequence
  Description of Artificial Sequence: Synthetic oligonucleotide
  Target: ATXN1; (-) strand; PAM type: NRG; PAM sequence: TGG
aatgaaaacatggcatgttt

SEQ ID NO: 60938 - DNA, 20 bp, Artificial Sequence
  Description of Artificial Sequence: Synthetic oligonucleotide
  Target: ATXN1; (-) strand; PAM type: NRG; PAM sequence: TGG
gtgaaatggaaatgaaaaca

SEQ ID NO: 60939 - DNA, 20 bp, Artificial Sequence
  Description of Artificial Sequence: Synthetic oligonucleotide
  Target: ATXN1; (-) strand; PAM type: NRG; PAM sequence: TGG
agctttatactcatgtgaaa

SEQ ID NO: 60940 - DNA, 20 bp, Artificial Sequence
  Description of Artificial Sequence: Synthetic oligonucleotide
  Target: ATXN1; (-) strand; PAM type: NRG; PAM sequence: GAG
ttaaagtgcccaaatttggt

SEQ ID NO: 60941 - DNA, 20 bp, Artificial Sequence
  Description of Artificial Sequence: Synthetic oligonucleotide
  Target: ATXN1; (-) strand; PAM type: NRG; PAM sequence: TGG
taatttaaagtgcccaaatt

SEQ ID NO: 60942 - DNA, 20 bp, Artificial Sequence
  Description of Artificial Sequence: Synthetic oligonucleotide
  Target: ATXN1; (-) strand; PAM type: NRG; PAM sequence: AAG
ataggagacttcataattta

SEQ ID NO: 60943 - DNA, 20 bp, Artificial Sequence
  Description of Artificial Sequence: Synthetic oligonucleotide
  Target: ATXN1; (-) strand; PAM type: NRG; PAM sequence: GAG
gataaagaagtgtgtgatag

SEQ ID NO: 60944 - DNA, 20 bp, Artificial Sequence
  Description of Artificial Sequence: Synthetic oligonucleotide
  Target: ATXN1; (-) strand; PAM type: NRG; PAM sequence: AGG
ctgataaagaagtgtgtgat

SEQ ID NO: 60945 - DNA, 20 bp, Artificial Sequence
  Description of Artificial Sequence: Synthetic oligonucleotide
  Target: ATXN1; (-) strand; PAM type: NRG; PAM sequence: TAG
actgataaagaagtgtgtga

SEQ ID NO: 60946 - DNA, 20 bp, Artificial Sequence
  Description of Artificial Sequence: Synthetic oligonucleotide
  Target: ATXN1; (-) strand; PAM type: NRG; PAM sequence: AAG
tatgtggaggactgataaag

SEQ ID NO: 60947 - DNA, 20 bp, Artificial Sequence
  Description of Artificial Sequence: Synthetic oligonucleotide
  Target: ATXN1; (-) strand; PAM type: NRG; PAM sequence: AAG
aattatgtggaggactgata

SEQ ID NO: 60948 - DNA, 20 bp, Artificial Sequence
  Description of Artificial Sequence: Synthetic oligonucleotide
  Target: ATXN1; (-) strand; PAM type: NRG; PAM sequence: AGG
ttagttaaacaattatgtgg

SEQ ID NO: 60949 - DNA, 20 bp, Artificial Sequence
  Description of Artificial Sequence: Synthetic oligonucleotide
  Target: ATXN1; (-) strand; PAM type: NRG; PAM sequence: GAG
cttagttaaacaattatgtg

SEQ ID NO: 60950 - DNA, 20 bp, Artificial Sequence
  Description of Artificial Sequence: Synthetic oligonucleotide
  Target: ATXN1; (-) strand; PAM type: NRG; PAM sequence: TGG
gtcttagttaaacaattatg

SEQ ID NO: 60951 - DNA, 20 bp, Artificial Sequence
  Description of Artificial Sequence: Synthetic oligonucleotide
  Target: ATXN1; (-) strand; PAM type: NRG; PAM sequence: TAG
tgacatttttatcagagtct

SEQ ID NO: 60952 - DNA, 20 bp, Artificial Sequence
  Description of Artificial Sequence: Synthetic oligonucleotide
  Target: ATXN1; (-) strand; PAM type: NRG; PAM sequence: GAG
catttttgacatttttatca

SEQ ID NO: 60953 - DNA, 20 bp, Artificial Sequence
  Description of Artificial Sequence: Synthetic oligonucleotide
  Target: ATXN1; (-) strand; PAM type: NRG; PAM sequence: CAG
agcatttttgacatttttat

SEQ ID NO: 60954 - DNA, 20 bp, Artificial Sequence
  Description of Artificial Sequence: Synthetic oligonucleotide
  Target: ATXN1; (-) strand; PAM type: NRG; PAM sequence: AAG
ttgctgctgagaaccatggc

SEQ ID NO: 60955 - DNA, 20 bp, Artificial Sequence
  Description of Artificial Sequence: Synthetic oligonucleotide
  Target: ATXN1; (-) strand; PAM type: NRG; PAM sequence: TGG
ttgtttgctgctgagaacca

SEQ ID NO: 60956 - DNA, 20 bp, Artificial Sequence
  Description of Artificial Sequence: Synthetic oligonucleotide
  Target: ATXN1; (-) strand; PAM type: NRG; PAM sequence: GAG
gcaggcatttgtttgctgct

SEQ ID NO: 60957 - DNA, 20 bp, Artificial Sequence
  Description of Artificial Sequence: Synthetic oligonucleotide
  Target: ATXN1; (-) strand; PAM type: NRG; PAM sequence: AGG
agggcatgctcggagcctgc

SEQ ID NO: 60958 - DNA, 20 bp, Artificial Sequence
  Description of Artificial Sequence: Synthetic oligonucleotide
  Target: ATXN1; (-) strand; PAM type: NRG; PAM sequence: CAG
cagggcatgctcggagcctg

SEQ ID NO: 60959 - DNA, 20 bp, Artificial Sequence
  Description of Artificial Sequence: Synthetic oligonucleotide
  Target: ATXN1; (-) strand; PAM type: NRG; PAM sequence: GAG
aaaaccccagggcatgctcg

SEQ ID NO: 60960 - DNA, 20 bp, Artificial Sequence
  Description of Artificial Sequence: Synthetic oligonucleotide
  Target: ATXN1; (-) strand; PAM type: NRG; PAM sequence: CGG
gaaaaaccccagggcatgct

SEQ ID NO: 60961 - DNA, 20 bp, Artificial Sequence
  Description of Artificial Sequence: Synthetic oligonucleotide
  Target: ATXN1; (-) strand; PAM type: NRG; PAM sequence: GGG
agagggtttgaaaaacccca

SEQ ID NO: 60962 - DNA, 20 bp, Artificial Sequence
  Description of Artificial Sequence: Synthetic oligonucleotide
  Target: ATXN1; (-) strand; PAM type: NRG; PAM sequence: AGG
gagagggtttgaaaaacccc

SEQ ID NO: 60963 - DNA, 20 bp, Artificial Sequence
  Description of Artificial Sequence: Synthetic oligonucleotide
  Target: ATXN1; (-) strand; PAM type: NRG; PAM sequence: CAG
ggagagggtttgaaaaaccc

SEQ ID NO: 60964 - DNA, 20 bp, Artificial Sequence
  Description of Artificial Sequence: Synthetic oligonucleotide
  Target: ATXN1; (-) strand; PAM type: NRG; PAM sequence: GGG
gcattttcaaagacaggaga

SEQ ID NO: 60965 - DNA, 20 bp, Artificial Sequence
  Description of Artificial Sequence: Synthetic oligonucleotide
  Target: ATXN1; (-) strand; PAM type: NRG; PAM sequence: AGG
tgcattttcaaagacaggag

SEQ ID NO: 60966 - DNA, 20 bp, Artificial Sequence
  Description of Artificial Sequence: Synthetic oligonucleotide
  Target: ATXN1; (-) strand; PAM type: NRG; PAM sequence: GAG
atgcattttcaaagacagga

SEQ ID NO: 60967 - DNA, 20 bp, Artificial Sequence
  Description of Artificial Sequence: Synthetic oligonucleotide
  Target: ATXN1; (-) strand; PAM type: NRG; PAM sequence: GAG
ggatgcattttcaaagacag

SEQ ID NO: 60968 - DNA, 20 bp, Artificial Sequence
  Description of Artificial Sequence: Synthetic oligonucleotide
  Target: ATXN1; (-) strand; PAM type: NRG; PAM sequence: AGG
tgggatgcattttcaaagac

SEQ ID NO: 60969 - DNA, 20 bp, Artificial Sequence
  Description of Artificial Sequence: Synthetic oligonucleotide
  Target: ATXN1; (-) strand; PAM type: NRG; PAM sequence: CAG
atgggatgcattttcaaaga

SEQ ID NO: 60970 - DNA, 20 bp, Artificial Sequence
  Description of Artificial Sequence: Synthetic oligonucleotide
  Target: ATXN1; (-) strand; PAM type: NRG; PAM sequence: AAG
ctgaatgggatgcattttca

SEQ ID NO: 60971 - DNA, 20 bp, Artificial Sequence
  Description of Artificial Sequence: Synthetic oligonucleotide
  Target: ATXN1; (-) strand; PAM type: NRG; PAM sequence: GGG
accagcactgctaactgaat

SEQ ID NO: 60972 - DNA, 20 bp, Artificial Sequence
  Description of Artificial Sequence: Synthetic oligonucleotide
  Target: ATXN1; (-) strand; PAM type: NRG; PAM sequence: TGG
caccagcactgctaactgaa

SEQ ID NO: 60973 - DNA, 20 bp, Artificial Sequence
  Description of Artificial Sequence: Synthetic oligonucleotide
  Target: ATXN1; (-) strand; PAM type: NRG; PAM sequence: CAG
tgcgtgccatgtcttatcac

SEQ ID NO: 60974 - DNA, 20 bp, Artificial Sequence
  Description of Artificial Sequence: Synthetic oligonucleotide
  Target: ATXN1; (-) strand; PAM type: NRG; PAM sequence: TAG
cacctttaggggtggtggtt

SEQ ID NO: 60975 - DNA, 20 bp, Artificial Sequence
  Description of Artificial Sequence: Synthetic oligonucleotide
  Target: ATXN1; (-) strand; PAM type: NRG; PAM sequence: TGG
tctggcacctttaggggtgg

SEQ ID NO: 60976 - DNA, 20 bp, Artificial Sequence
  Description of Artificial Sequence: Synthetic oligonucleotide
  Target: ATXN1; (-) strand; PAM type: NRG; PAM sequence: TGG
tgctctggcacctttagggg

SEQ ID NO: 60977 - DNA, 20 bp, Artificial Sequence
  Description of Artificial Sequence: Synthetic oligonucleotide
  Target: ATXN1; (-) strand; PAM type: NRG; PAM sequence: GGG
ttctgctctggcacctttag

SEQ ID NO: 60978 - DNA, 20 bp, Artificial Sequence
  Description of Artificial Sequence: Synthetic oligonucleotide
  Target: ATXN1; (-) strand; PAM type: NRG; PAM sequence: GGG
gttctgctctggcaccttta

SEQ ID NO: 60979 - DNA, 20 bp, Artificial Sequence
  Description of Artificial Sequence: Synthetic oligonucleotide
  Target: ATXN1; (-) strand; PAM type: NRG; PAM sequence: AGG
ggttctgctctggcaccttt

SEQ ID NO: 60980 - DNA, 20 bp, Artificial Sequence
  Description of Artificial Sequence: Synthetic oligonucleotide
  Target: ATXN1; (-) strand; PAM type: NRG; PAM sequence: TAG
gggttctgctctggcacctt

SEQ ID NO: 60981 - DNA, 20 bp, Artificial Sequence
  Description of Artificial Sequence: Synthetic oligonucleotide
  Target: ATXN1; (-) strand; PAM type: NRG; PAM sequence: TGG
ctcaatgcagggttctgctc

SEQ ID NO: 60982 - DNA, 20 bp, Artificial Sequence
  Description of Artificial Sequence: Synthetic oligonucleotide
  Target: ATXN1; (-) strand; PAM type: NRG; PAM sequence: GGG
tcagcattaaactcaatgca

SEQ ID NO: 60983 - DNA, 20 bp, Artificial Sequence
  Description of Artificial Sequence: Synthetic oligonucleotide
  Target: ATXN1; (-) strand; PAM type: NRG; PAM sequence: AGG
gtcagcattaaactcaatgc

SEQ ID NO: 60984 - DNA, 20 bp, Artificial Sequence
  Description of Artificial Sequence: Synthetic oligonucleotide
  Target: ATXN1; (-) strand; PAM type: NRG; PAM sequence: CAG
tgtcagcattaaactcaatg

SEQ ID NO: 60985 - DNA, 20 bp, Artificial Sequence
  Description of Artificial Sequence: Synthetic oligonucleotide
  Target: ATXN1; (-) strand; PAM type: NRG; PAM sequence: CAG
gactgattggagtgctctgt

SEQ ID NO: 60986 - DNA, 20 bp, Artificial Sequence
  Description of Artificial Sequence: Synthetic oligonucleotide
  Target: ATXN1; (-) strand; PAM type: NRG; PAM sequence: GAG
tcgaacagactgactgattg

SEQ ID NO: 60987 - DNA, 20 bp, Artificial Sequence
  Description of Artificial Sequence: Synthetic oligonucleotide
  Target: ATXN1; (-) strand; PAM type: NRG; PAM sequence: TGG
gttcgaacagactgactgat

SEQ ID NO: 60988 - DNA, 20 bp, Artificial Sequence
  Description of Artificial Sequence: Synthetic oligonucleotide
  Target: ATXN1; (-) strand; PAM type: NRG; PAM sequence: CAG
ctccaatcaaagagttcgaa

SEQ ID NO: 60989 - DNA, 20 bp, Artificial Sequence
  Description of Artificial Sequence: Synthetic oligonucleotide
  Target: ATXN1; (-) strand; PAM type: NRG; PAM sequence: GAG
tgaccttttctccaatcaaa

SEQ ID NO: 60990 - DNA, 20 bp, Artificial Sequence
  Description of Artificial Sequence: Synthetic oligonucleotide
  Target: ATXN1; (-) strand; PAM type: NRG; PAM sequence: AAG
tctgaccttttctccaatca

SEQ ID NO: 60991 - DNA, 20 bp, Artificial Sequence
  Description of Artificial Sequence: Synthetic oligonucleotide
  Target: ATXN1; (-) strand; PAM type: NRG; PAM sequence: CAG
ggcaggccacttttgtagct

SEQ ID NO: 60992 - DNA, 20 bp, Artificial Sequence
  Description of Artificial Sequence: Synthetic oligonucleotide
  Target: ATXN1; (-) strand; PAM type: NRG; PAM sequence: TAG
gggcaggcaggccacttttg

SEQ ID NO: 60993 - DNA, 20 bp, Artificial Sequence
  Description of Artificial Sequence: Synthetic oligonucleotide
  Target: ATXN1; (-) strand; PAM type: NRG; PAM sequence: AGG
ctaatcttccaggggcaggc

SEQ ID NO: 60994 - DNA, 20 bp, Artificial Sequence
  Description of Artificial Sequence: Synthetic oligonucleotide
  Target: ATXN1; (-) strand; PAM type: NRG; PAM sequence: CAG
cctaatcttccaggggcagg

SEQ ID NO: 60995 - DNA, 20 bp, Artificial Sequence
  Description of Artificial Sequence: Synthetic oligonucleotide
  Target: ATXN1; (-) strand; PAM type: NRG; PAM sequence: AGG
ggacctaatcttccaggggc

SEQ ID NO: 60996 - DNA, 20 bp, Artificial Sequence
  Description of Artificial Sequence: Synthetic oligonucleotide
  Target: ATXN1; (-) strand; PAM type: NRG; PAM sequence: CAG
aggacctaatcttccagggg

SEQ ID NO: 60997 - DNA, 20 bp, Artificial Sequence
  Description of Artificial Sequence: Synthetic oligonucleotide
  Target: ATXN1; (-) strand; PAM type: NRG; PAM sequence: GGG
cccaggacctaatcttccag

SEQ ID NO: 60998 - DNA, 20 bp, Artificial Sequence
  Description of Artificial Sequence: Synthetic oligonucleotide
  Target: ATXN1; (-) strand; PAM type: NRG; PAM sequence: GGG
acccaggacctaatcttcca

SEQ ID NO: 60999 - DNA, 20 bp, Artificial Sequence
  Description of Artificial Sequence: Synthetic oligonucleotide
  Target: ATXN1; (-) strand; PAM type: NRG; PAM sequence: AGG
aacccaggacctaatcttcc

SEQ ID NO: 61000 - DNA, 20 bp, Artificial Sequence
  Description of Artificial Sequence: Synthetic oligonucleotide
  Target: ATXN1; (-) strand; PAM type: NRG; PAM sequence: CAG
aaacccaggacctaatcttc

SEQ ID NO: 61001 - DNA, 20 bp, Artificial Sequence
  Description of Artificial Sequence: Synthetic oligonucleotide
  Target: ATXN1; (-) strand; PAM type: NRG; PAM sequence: AGG
agaaggaaaactaaaaaccc

SEQ ID NO: 61002 - DNA, 20 bp, Artificial Sequence
  Description of Artificial Sequence: Synthetic oligonucleotide
  Target: ATXN1; (-) strand; PAM type: NRG; PAM sequence: CAG
aagaaggaaaactaaaaacc

SEQ ID NO: 61003 - DNA, 20 bp, Artificial Sequence
  Description of Artificial Sequence: Synthetic oligonucleotide
  Target: ATXN1; (-) strand; PAM type: NRG; PAM sequence: AGG
gggaacagaggaagacaaga

SEQ ID NO: 61004 - DNA, 20 bp, Artificial Sequence
  Description of Artificial Sequence: Synthetic oligonucleotide
  Target: ATXN1; (-) strand; PAM type: NRG; PAM sequence: AAG
tgggaacagaggaagacaag

SEQ ID NO: 61005 - DNA, 20 bp, Artificial Sequence
  Description of Artificial Sequence: Synthetic oligonucleotide
  Target: ATXN1; (-) strand; PAM type: NRG; PAM sequence: AAG
ttgtgggaacagaggaagac

SEQ ID NO: 61006 - DNA, 20 bp, Artificial Sequence
  Description of Artificial Sequence: Synthetic oligonucleotide
  Target: ATXN1; (-) strand; PAM type: NRG; PAM sequence: AAG
gggaattgtgggaacagagg

SEQ ID NO: 61007 - DNA, 20 bp, Artificial Sequence
  Description of Artificial Sequence: Synthetic oligonucleotide
  Target: ATXN1; (-) strand; PAM type: NRG; PAM sequence: AGG
aatgggaattgtgggaacag

SEQ ID NO: 61008 - DNA, 20 bp, Artificial Sequence
  Description of Artificial Sequence: Synthetic oligonucleotide
  Target: ATXN1; (-) strand; PAM type: NRG; PAM sequence: GAG
aaatgggaattgtgggaaca

SEQ ID NO: 61009 - DNA, 20 bp, Artificial Sequence
  Description of Artificial Sequence: Synthetic oligonucleotide
  Target: ATXN1; (-) strand; PAM type: NRG; PAM sequence: CAG
ataaatgggaattgtgggaa

SEQ ID NO: 61010 - DNA, 20 bp, Artificial Sequence
  Description of Artificial Sequence: Synthetic oligonucleotide
  Target: ATXN1; (-) strand; PAM type: NRG; PAM sequence: GGG
tgaaaataaatgggaattgt

SEQ ID NO: 61011 - DNA, 20 bp, Artificial Sequence
  Description of Artificial Sequence: Synthetic oligonucleotide
  Target: ATXN1; (-) strand; PAM type: NRG; PAM sequence: TGG
ttgaaaataaatgggaattg

SEQ ID NO: 61012 - DNA, 20 bp, Artificial Sequence
  Description of Artificial Sequence: Synthetic oligonucleotide
  Target: ATXN1; (-) strand; PAM type: NRG; PAM sequence: GGG
ccaaataattgaaaataaat

SEQ ID NO: 61013 - DNA, 20 bp, Artificial Sequence
  Description of Artificial Sequence: Synthetic oligonucleotide
  Target: ATXN1; (-) strand; PAM type: NRG; PAM sequence: TGG
accaaataattgaaaataaa

SEQ ID NO: 61014 - DNA, 20 bp, Artificial Sequence
  Description of Artificial Sequence: Synthetic oligonucleotide
  Target: ATXN1; (-) strand; PAM type: NRG; PAM sequence: GGG
tcctatgctcttttccttga

SEQ ID NO: 61015 - DNA, 20 bp, Artificial Sequence
  Description of Artificial Sequence: Synthetic oligonucleotide
  Target: ATXN1; (-) strand; PAM type: NRG; PAM sequence: AGG
ttcctatgctcttttccttg

SEQ ID NO: 61016 - DNA, 20 bp, Artificial Sequence
  Description of Artificial Sequence: Synthetic oligonucleotide
  Target: ATXN1; (-) strand; PAM type: NRG; PAM sequence: GAG
attcctatgctcttttcctt

SEQ ID NO: 61017 - DNA, 20 bp, Artificial Sequence
  Description of Artificial Sequence: Synthetic oligonucleotide
  Target: ATXN1; (-) strand; PAM type: NRG; PAM sequence: CAG
gagtctacaagtagggcagg

SEQ ID NO: 61018 - DNA, 20 bp, Artificial Sequence
  Description of Artificial Sequence: Synthetic oligonucleotide
  Target: ATXN1; (-) strand; PAM type: NRG; PAM sequence: AGG
gaagagtctacaagtagggc

SEQ ID NO: 61019 - DNA, 20 bp, Artificial Sequence
  Description of Artificial Sequence: Synthetic oligonucleotide
  Target: ATXN1; (-) strand; PAM type: NRG; PAM sequence: CAG
agaagagtctacaagtaggg

SEQ ID NO: 61020 - DNA, 20 bp, Artificial Sequence
  Description of Artificial Sequence: Synthetic oligonucleotide
  Target: ATXN1; (-) strand; PAM type: NRG; PAM sequence: GGG
tacagaagagtctacaagta

SEQ ID NO: 61021 - DNA, 20 bp, Artificial Sequence
  Description of Artificial Sequence: Synthetic oligonucleotide
  Target: ATXN1; (-) strand; PAM type: NRG; PAM sequence: AGG
atacagaagagtctacaagt

SEQ ID NO: 61022 - DNA, 20 bp, Artificial Sequence
  Description of Artificial Sequence: Synthetic oligonucleotide
  Target: ATXN1; (-) strand; PAM type: NRG; PAM sequence: TAG
catacagaagagtctacaag

SEQ ID NO: 61023 - DNA, 20 bp, Artificial Sequence
  Description of Artificial Sequence: Synthetic oligonucleotide
  Target: ATXN1; (-) strand; PAM type: NRG; PAM sequence: AAG
gaacatacagaagagtctac

SEQ ID NO: 61024 - DNA, 20 bp, Artificial Sequence
  Description of Artificial Sequence: Synthetic oligonucleotide
  Target: ATXN1; (-) strand; PAM type: NRG; PAM sequence: GAG
ttaaaaaagaacatacagaa

SEQ ID NO: 61025 - DNA, 20 bp, Artificial Sequence
  Description of Artificial Sequence: Synthetic oligonucleotide
  Target: ATXN1; (-) strand; PAM type: NRG; PAM sequence: AAG
cattaaaaaagaacatacag

SEQ ID NO: 61026 - DNA, 20 bp, Artificial Sequence
  Description of Artificial Sequence: Synthetic oligonucleotide
  Target: ATXN1; (-) strand; PAM type: NRG; PAM sequence: CAG
tttcattaaaaaagaacata

SEQ ID NO: 61027 - DNA, 20 bp, Artificial Sequence
  Description of Artificial Sequence: Synthetic oligonucleotide
  Target: ATXN1; (-) strand; PAM type: NRG; PAM sequence: AAG
tctaatttttttcattaaaa

SEQ ID NO: 61028 - DNA, 20 bp, Artificial Sequence
  Description of Artificial Sequence: Synthetic oligonucleotide
  Target: ATXN1; (-) strand; PAM type: NRG; PAM sequence: AAG
gatgcagataataatttgcc

SEQ ID NO: 61029 - DNA, 20 bp, Artificial Sequence
  Description of Artificial Sequence: Synthetic oligonucleotide
  Target: ATXN1; (-) strand; PAM type: NRG; PAM sequence: CAG
gcatcaaaatgtgtgcgatg

SEQ ID NO: 61030 - DNA, 20 bp, Artificial Sequence
  Description of Artificial Sequence: Synthetic oligonucleotide
  Target: ATXN1; (-) strand; PAM type: NRG; PAM sequence: GAG
taggtaaaattgagggaggg

SEQ ID NO: 61031 - DNA, 20 bp, Artificial Sequence
  Description of Artificial Sequence: Synthetic oligonucleotide
  Target: ATXN1; (-) strand; PAM type: NRG; PAM sequence: GGG
tataggtaaaattgagggag

SEQ ID NO: 61032 - DNA, 20 bp, Artificial Sequence
  Description of Artificial Sequence: Synthetic oligonucleotide
  Target: ATXN1; (-) strand; PAM type: NRG; PAM sequence: GGG
ttataggtaaaattgaggga

SEQ ID NO: 61033 - DNA, 20 bp, Artificial Sequence
  Description of Artificial Sequence: Synthetic oligonucleotide
  Target: ATXN1; (-) strand; PAM type: NRG; PAM sequence: AGG
tttataggtaaaattgaggg

SEQ ID NO: 61034 - DNA, 20 bp, Artificial Sequence
  Description of Artificial Sequence: Synthetic oligonucleotide
  Target: ATXN1; (-) strand; PAM type: NRG; PAM sequence: GAG
ttttataggtaaaattgagg

SEQ ID NO: 61035 - DNA, 20 bp, Artificial Sequence
  Description of Artificial Sequence: Synthetic oligonucleotide
  Target: ATXN1; (-) strand; PAM type: NRG; PAM sequence: GGG
tcttttataggtaaaattga

SEQ ID NO: 61036 - DNA, 20 bp, Artificial Sequence
  Description of Artificial Sequence: Synthetic oligonucleotide
  Target: ATXN1; (-) strand; PAM type: NRG; PAM sequence: AGG
atcttttataggtaaaattg

SEQ ID NO: 61037 - DNA, 20 bp, Artificial Sequence
  Description of Artificial Sequence: Synthetic oligonucleotide
  Target: ATXN1; (-) strand; PAM type: NRG; PAM sequence: GAG
tatcttttataggtaaaatt

SEQ ID NO: 61038 - DNA, 20 bp, Artificial Sequence
  Description of Artificial Sequence: Synthetic oligonucleotide
  Target: ATXN1; (-) strand; PAM type: NRG; PAM sequence: AGG
ttggaagtggtatcttttat

SEQ ID NO: 61039 - DNA, 20 bp, Artificial Sequence
  Description of Artificial Sequence: Synthetic oligonucleotide
  Target: ATXN1; (-) strand; PAM type: NRG; PAM sequence: TAG
gttggaagtggtatctttta

SEQ ID NO: 61040 - DNA, 20 bp, Artificial Sequence
  Description of Artificial Sequence: Synthetic oligonucleotide
  Target: ATXN1; (-) strand; PAM type: NRG; PAM sequence: TGG
tataactcaaatgttggaag

SEQ ID NO: 61041 - DNA, 20 bp, Artificial Sequence
  Description of Artificial Sequence: Synthetic oligonucleotide
  Target: ATXN1; (-) strand; PAM type: NRG; PAM sequence: AAG
ggttataactcaaatgttgg

SEQ ID NO: 61042 - DNA, 20 bp, Artificial Sequence
  Description of Artificial Sequence: Synthetic oligonucleotide
  Target: ATXN1; (-) strand; PAM type: NRG; PAM sequence: TGG
tggggttataactcaaatgt

SEQ ID NO: 61043 - DNA, 20 bp, Artificial Sequence
  Description of Artificial Sequence: Synthetic oligonucleotide
  Target: ATXN1; (-) strand; PAM type: NRG; PAM sequence: GGG
tgggtatttttcagtccttg

SEQ ID NO: 61044 - DNA, 20 bp, Artificial Sequence
  Description of Artificial Sequence: Synthetic oligonucleotide
  Target: ATXN1; (-) strand; PAM type: NRG; PAM sequence: GGG
ctgggtatttttcagtcctt

SEQ ID NO: 61045 - DNA, 20 bp, Artificial Sequence
  Description of Artificial Sequence: Synthetic oligonucleotide
  Target: ATXN1; (-) strand; PAM type: NRG; PAM sequence: TGG
gctgggtatttttcagtcct

SEQ ID NO: 61046 - DNA, 20 bp, Artificial Sequence
  Description of Artificial Sequence: Synthetic oligonucleotide
  Target: ATXN1; (-) strand; PAM type: NRG; PAM sequence: CAG
cggagtggctgggtattttt

SEQ ID NO: 61047 - DNA, 20 bp, Artificial Sequence
  Description of Artificial Sequence: Synthetic oligonucleotide
  Target: ATXN1; (-) strand; PAM type: NRG; PAM sequence: GGG
gatatcgggtcggagtggct

SEQ ID NO: 61048 - DNA, 20 bp, Artificial Sequence
  Description of Artificial Sequence: Synthetic oligonucleotide
  Target: ATXN1; (-) strand; PAM type: NRG; PAM sequence: TGG
tgatatcgggtcggagtggc

SEQ ID NO: 61049 - DNA, 20 bp, Artificial Sequence
  Description of Artificial Sequence: Synthetic oligonucleotide
  Target: ATXN1; (-) strand; PAM type: NRG; PAM sequence: TGG
tgcctgatatcgggtcggag

SEQ ID NO: 61050 - DNA, 20 bp, Artificial Sequence
  Description of Artificial Sequence: Synthetic oligonucleotide
  Target: ATXN1; (-) strand; PAM type: NRG; PAM sequence: GAG
aactgcctgatatcgggtcg

SEQ ID NO: 61051 - DNA, 20 bp, Artificial Sequence
  Description of Artificial Sequence: Synthetic oligonucleotide
  Target: ATXN1; (-) strand; PAM type: NRG; PAM sequence: CGG
gaaactgcctgatatcgggt

SEQ ID NO: 61052 - DNA, 20 bp, Artificial Sequence
  Description of Artificial Sequence: Synthetic oligonucleotide
  Target: ATXN1; (-) strand; PAM type: NRG; PAM sequence: GGG
cactgaaactgcctgatatc

SEQ ID NO: 61053 - DNA, 20 bp, Artificial Sequence
  Description of Artificial Sequence: Synthetic oligonucleotide
  Target: ATXN1; (-) strand; PAM type: NRG; PAM sequence: CGG
tcactgaaactgcctgatat

SEQ ID NO: 61054 - DNA, 20 bp, Artificial Sequence
  Description of Artificial Sequence: Synthetic oligonucleotide
  Target: ATXN1; (-) strand; PAM type: NRG; PAM sequence: CAG
tcaccggtacgtttggggac

SEQ ID NO: 61055 - DNA, 20 bp, Artificial Sequence
  Description of Artificial Sequence: Synthetic oligonucleotide
  Target: ATXN1; (-) strand; PAM type: NRG; PAM sequence: GGG
ggttttcaccggtacgtttg

SEQ ID NO: 61056 - DNA, 20 bp, Artificial Sequence
  Description of Artificial Sequence: Synthetic oligonucleotide
  Target: ATXN1; (-) strand; PAM type: NRG; PAM sequence: GGG
tggttttcaccggtacgttt

SEQ ID NO: 61057 - DNA, 20 bp, Artificial Sequence
  Description of Artificial Sequence: Synthetic oligonucleotide
  Target: ATXN1; (-) strand; PAM type: NRG; PAM sequence: TGG
gtggttttcaccggtacgtt

SEQ ID NO: 61058 - DNA, 20 bp, Artificial Sequence
  Description of Artificial Sequence: Synthetic oligonucleotide
  Target: ATXN1; (-) strand; PAM type: NRG; PAM sequence: CGG
tgagaacgtgtggttttcac

SEQ ID NO: 61059 - DNA, 20 bp, Artificial Sequence
  Description of Artificial Sequence: Synthetic oligonucleotide
  Target: ATXN1; (-) strand; PAM type: NRG; PAM sequence: TGG
tcgccaagagtgagaacgtg

SEQ ID NO: 61060 - DNA, 20 bp, Artificial Sequence
  Description of Artificial Sequence: Synthetic oligonucleotide
  Target: ATXN1; (-) strand; PAM type: NRG; PAM sequence: GAG
aaattcaagtcgccaagagt

SEQ ID NO: 61061 - DNA, 20 bp, Artificial Sequence
  Description of Artificial Sequence: Synthetic oligonucleotide
  Target: ATXN1; (-) strand; PAM type: NRG; PAM sequence: GAG
caccaaattcaagtcgccaa

SEQ ID NO: 61062 - DNA, 20 bp, Artificial Sequence
  Description of Artificial Sequence: Synthetic oligonucleotide
  Target: ATXN1; (-) strand; PAM type: NRG; PAM sequence: AAG
ttcaccaaattcaagtcgcc

SEQ ID NO: 61063 - DNA, 20 bp, Artificial Sequence
  Description of Artificial Sequence: Synthetic oligonucleotide
  Target: ATXN1; (-) strand; PAM type: NRG; PAM sequence: AAG
tgtttcatttcaccaaattc

SEQ ID NO: 61064 - DNA, 20 bp, Artificial Sequence
  Description of Artificial Sequence: Synthetic oligonucleotide
  Target: ATXN1; (-) strand; PAM type: NRG; PAM sequence: TAG
actctttcaaaaggcaaaaa

SEQ ID NO: 61065 - DNA, 20 bp, Artificial Sequence
  Description of Artificial Sequence: Synthetic oligonucleotide
  Target: ATXN1; (-) strand; PAM type: NRG; PAM sequence: AGG
ttaagcataactctttcaaa

SEQ ID NO: 61066 - DNA, 20 bp, Artificial Sequence
  Description of Artificial Sequence: Synthetic oligonucleotide
  Target: ATXN1; (-) strand; PAM type: NRG; PAM sequence: AAG
tttaagcataactctttcaa

SEQ ID NO: 61067 - DNA, 20 bp, Artificial Sequence
  Description of Artificial Sequence: Synthetic oligonucleotide
  Target: ATXN1; (-) strand; PAM type: NRG; PAM sequence: AAG
gaccttttcactacaccttt

SEQ ID NO: 61068 - DNA, 20 bp, Artificial Sequence
  Description of Artificial Sequence: Synthetic oligonucleotide
  Target: ATXN1; (-) strand; PAM type: NRG; PAM sequence: CAG
catgcttacccattaatttc

SEQ ID NO: 61069 - DNA, 20 bp, Artificial Sequence
  Description of Artificial Sequence: Synthetic oligonucleotide
  Target: ATXN1; (-) strand; PAM type: NRG; PAM sequence: AGG
atgcttctctgacctcggat

SEQ ID NO: 61070 - DNA, 20 bp, Artificial Sequence
  Description of Artificial Sequence: Synthetic oligonucleotide
  Target: ATXN1; (-) strand; PAM type: NRG; PAM sequence: TAG
aatgcttctctgacctcgga

SEQ ID NO: 61071 - DNA, 20 bp, Artificial Sequence
  Description of Artificial Sequence: Synthetic oligonucleotide
  Target: ATXN1; (-) strand; PAM type: NRG; PAM sequence: CGG
tcaaaatgcttctctgacct

SEQ ID NO: 61072 - DNA, 20 bp, Artificial Sequence
  Description of Artificial Sequence: Synthetic oligonucleotide
  Target: ATXN1; (-) strand; PAM type: NRG; PAM sequence: GGG
aatgtgttctaaaggctctg

SEQ ID NO: 61073 - DNA, 20 bp, Artificial Sequence
  Description of Artificial Sequence: Synthetic oligonucleotide
  Target: ATXN1; (-) strand; PAM type: NRG; PAM sequence: GGG
caatgtgttctaaaggctct

SEQ ID NO: 61074 - DNA, 20 bp, Artificial Sequence
  Description of Artificial Sequence: Synthetic oligonucleotide
  Target: ATXN1; (-) strand; PAM type: NRG; PAM sequence: TGG
acaatgtgttctaaaggctc

SEQ ID NO: 61075 - DNA, 20 bp, Artificial Sequence
  Description of Artificial Sequence: Synthetic oligonucleotide
  Target: ATXN1; (-) strand; PAM type: NRG; PAM sequence: AGG
aaataaacaatgtgttctaa

SEQ ID NO: 61076 - DNA, 20 bp, Artificial Sequence
  Description of Artificial Sequence: Synthetic oligonucleotide
  Target: ATXN1; (-) strand; PAM type: NRG; PAM sequence: AAG
aaaataaacaatgtgttcta

SEQ ID NO: 61077 - DNA, 20 bp, Artificial Sequence
  Description of Artificial Sequence: Synthetic oligonucleotide
  Target: ATXN1; (-) strand; PAM type: NRG; PAM sequence: AAG
tcattgtcatcacccagcca

SEQ ID NO: 61078 - DNA, 20 bp, Artificial Sequence
  Description of Artificial Sequence: Synthetic oligonucleotide
  Target: ATXN1; (-) strand; PAM type: NRG; PAM sequence: CAG
ttcttgtcattgtcatcacc

SEQ ID NO: 61079 - DNA, 20 bp, Artificial Sequence
  Description of Artificial Sequence: Synthetic oligonucleotide
  Target: ATXN1; (-) strand; PAM type: NRG; PAM sequence: AAG
aaagagattccagtctctgg

SEQ ID NO: 61080 - DNA, 20 bp, Artificial Sequence
  Description of Artificial Sequence: Synthetic oligonucleotide
  Target: ATXN1; (-) strand; PAM type: NRG; PAM sequence: TGG
gtcaaagagattccagtctc

SEQ ID NO: 61081 - DNA, 20 bp, Artificial Sequence
  Description of Artificial Sequence: Synthetic oligonucleotide
  Target: ATXN1; (-) strand; PAM type: NRG; PAM sequence: CAG
gggctgagtcaaagagattc

SEQ ID NO: 61082 - DNA, 20 bp, Artificial Sequence
  Description of Artificial Sequence: Synthetic oligonucleotide
  Target: ATXN1; (-) strand; PAM type: NRG; PAM sequence: GAG
taccaaggggctgagtcaaa

SEQ ID NO: 61083 - DNA, 20 bp, Artificial Sequence
  Description of Artificial Sequence: Synthetic oligonucleotide
  Target: ATXN1; (-) strand; PAM type: NRG; PAM sequence: AAG
cctaccaaggggctgagtca

SEQ ID NO: 61084 - DNA, 20 bp, Artificial Sequence
  Description of Artificial Sequence: Synthetic oligonucleotide
  Target: ATXN1; (-) strand; PAM type: NRG; PAM sequence: GAG
taaacacctaccaaggggct

SEQ ID NO: 61085 - DNA, 20 bp, Artificial Sequence
  Description of Artificial Sequence: Synthetic oligonucleotide
  Target: ATXN1; (-) strand; PAM type: NRG; PAM sequence: GGG
ctaaataaacacctaccaag

SEQ ID NO: 61086 - DNA, 20 bp, Artificial Sequence
  Description of Artificial Sequence: Synthetic oligonucleotide
  Target: ATXN1; (-) strand; PAM type: NRG; PAM sequence: GGG
tctaaataaacacctaccaa

SEQ ID NO: 61087 - DNA, 20 bp, Artificial Sequence
  Description of Artificial Sequence: Synthetic oligonucleotide
  Target: ATXN1; (-) strand; PAM type: NRG; PAM sequence: AGG
ttctaaataaacacctacca

SEQ ID NO: 61088 - DNA, 20 bp, Artificial Sequence
  Description of Artificial Sequence: Synthetic oligonucleotide
  Target: ATXN1; (-) strand; PAM type: NRG; PAM sequence: AAG
gttctaaataaacacctacc

SEQ ID NO: 61089 - DNA, 20 bp, Artificial Sequence
  Description of Artificial Sequence: Synthetic oligonucleotide
  Target: ATXN1; (-) strand; PAM type: NRG; PAM sequence: GGG
tgccagactccaatgtcctt

SEQ ID NO: 61090 - DNA, 20 bp, Artificial Sequence
  Description of Artificial Sequence: Synthetic oligonucleotide
  Target: ATXN1; (-) strand; PAM type: NRG; PAM sequence: TGG
ctgccagactccaatgtcct

SEQ ID NO: 61091 - DNA, 20 bp, Artificial Sequence
  Description of Artificial Sequence: Synthetic oligonucleotide
  Target: ATXN1; (-) strand; PAM type: NRG; PAM sequence: CAG
gctcctttgtgggatcctgc

SEQ ID NO: 61092 - DNA, 20 bp, Artificial Sequence
  Description of Artificial Sequence: Synthetic oligonucleotide
  Target: ATXN1; (-) strand; PAM type: NRG; PAM sequence: GGG
tcctcacctcgctcctttgt

SEQ ID NO: 61093 - DNA, 20 bp, Artificial Sequence
  Description of Artificial Sequence: Synthetic oligonucleotide
  Target: ATXN1; (-) strand; PAM type: NRG; PAM sequence: TGG
ttcctcacctcgctcctttg

SEQ ID NO: 61094 - DNA, 20 bp, Artificial Sequence
  Description of Artificial Sequence: Synthetic oligonucleotide
  Target: ATXN1; (-) strand; PAM type: NRG; PAM sequence: CAG
atctggtgggagaactccac

SEQ ID NO: 61095 - DNA, 20 bp, Artificial Sequence
  Description of Artificial Sequence: Synthetic oligonucleotide
  Target: ATXN1; (-) strand; PAM type: NRG; PAM sequence: GAG
tatccgtatgaatctggtgg

SEQ ID NO: 61096 - DNA, 20 bp, Artificial Sequence
  Description of Artificial Sequence: Synthetic oligonucleotide
  Target: ATXN1; (-) strand; PAM type: NRG; PAM sequence: GGG
aatatccgtatgaatctggt

SEQ ID NO: 61097 - DNA, 20 bp, Artificial Sequence
  Description of Artificial Sequence: Synthetic oligonucleotide
  Target: ATXN1; (-) strand; PAM type: NRG; PAM sequence: TGG
caatatccgtatgaatctgg

SEQ ID NO: 61098 - DNA, 20 bp, Artificial Sequence
  Description of Artificial Sequence: Synthetic oligonucleotide
  Target: ATXN1; (-) strand; PAM type: NRG; PAM sequence: TGG
cagcaatatccgtatgaatc

SEQ ID NO: 61099 - DNA, 20 bp, Artificial Sequence
  Description of Artificial Sequence: Synthetic oligonucleotide
  Target: ATXN1; (-) strand; PAM type: NRG; PAM sequence: CAG
aagacagaggctcaggtcat

SEQ ID NO: 61100 - DNA, 20 bp, Artificial Sequence
  Description of Artificial Sequence: Synthetic oligonucleotide
  Target: ATXN1; (-) strand; PAM type: NRG; PAM sequence: AGG
agcagaaaagacagaggctc

SEQ ID NO: 61101 - DNA, 20 bp, Artificial Sequence
  Description of Artificial Sequence: Synthetic oligonucleotide
  Target: ATXN1; (-) strand; PAM type: NRG; PAM sequence: CAG
gagcagaaaagacagaggct

SEQ ID NO: 61102 - DNA, 20 bp, Artificial Sequence
  Description of Artificial Sequence: Synthetic oligonucleotide
  Target: ATXN1; (-) strand; PAM type: NRG; PAM sequence: AGG
aggtagagcagaaaagacag

SEQ ID NO: 61103 - DNA, 20 bp, Artificial Sequence
  Description of Artificial Sequence: Synthetic oligonucleotide
  Target: ATXN1; (-) strand; PAM type: NRG; PAM sequence: GAG
aaggtagagcagaaaagaca

SEQ ID NO: 61104 - DNA, 20 bp, Artificial Sequence
  Description of Artificial Sequence: Synthetic oligonucleotide
  Target: ATXN1; (-) strand; PAM type: NRG; PAM sequence: CAG
tcaaggtagagcagaaaaga

SEQ ID NO: 61105 - DNA, 20 bp, Artificial Sequence
  Description of Artificial Sequence: Synthetic oligonucleotide
  Target: ATXN1; (-) strand; PAM type: NRG; PAM sequence: AAG
cccttcaaggtagagcagaa

SEQ ID NO: 61106 - DNA, 20 bp, Artificial Sequence
  Description of Artificial Sequence: Synthetic oligonucleotide
  Target: ATXN1; (-) strand; PAM type: NRG; PAM sequence: CAG
ggaggcccttcaaggtagag

SEQ ID NO: 61107 - DNA, 20 bp, Artificial Sequence
  Description of Artificial Sequence: Synthetic oligonucleotide
  Target: ATXN1; (-) strand; PAM type: NRG; PAM sequence: GAG
gttggaggcccttcaaggta

SEQ ID NO: 61108 - DNA, 20 bp, Artificial Sequence
  Description of Artificial Sequence: Synthetic oligonucleotide
  Target: ATXN1; (-) strand; PAM type: NRG; PAM sequence: TAG
aggttggaggcccttcaagg

SEQ ID NO: 61109 - DNA, 20 bp, Artificial Sequence
  Description of Artificial Sequence: Synthetic oligonucleotide
  Target: ATXN1; (-) strand; PAM type: NRG; PAM sequence: AGG
aagaggttggaggcccttca

SEQ ID NO: 61110 - DNA, 20 bp, Artificial Sequence
  Description of Artificial Sequence: Synthetic oligonucleotide
  Target: ATXN1; (-) strand; PAM type: NRG; PAM sequence: AAG
aaagaggttggaggcccttc

SEQ ID NO: 61111 - DNA, 20 bp, Artificial Sequence
  Description of Artificial Sequence: Synthetic oligonucleotide
  Target: ATXN1; (-) strand; PAM type: NRG; PAM sequence: AGG
gtgaccagaaaagaggttgg

SEQ ID NO: 61112 - DNA, 20 bp, Artificial Sequence
  Description of Artificial Sequence: Synthetic oligonucleotide
  Target: ATXN1; (-) strand; PAM type: NRG; PAM sequence: GAG
tgtgaccagaaaagaggttg

SEQ ID NO: 61113 - DNA, 20 bp, Artificial Sequence
  Description of Artificial Sequence: Synthetic oligonucleotide
  Target: ATXN1; (-) strand; PAM type: NRG; PAM sequence: TGG
aatgtgaccagaaaagaggt

SEQ ID NO: 61114 - DNA, 20 bp, Artificial Sequence
  Description of Artificial Sequence: Synthetic oligonucleotide
  Target: ATXN1; (-) strand; PAM type: NRG; PAM sequence: AGG
gaacaatgtgaccagaaaag

SEQ ID NO: 61115 - DNA, 20 bp, Artificial Sequence
  Description of Artificial Sequence: Synthetic oligonucleotide
  Target: ATXN1; (-) strand; PAM type: NRG; PAM sequence: GAG
agaacaatgtgaccagaaaa

SEQ ID NO: 61116 - DNA, 20 bp, Artificial Sequence
  Description of Artificial Sequence: Synthetic oligonucleotide
  Target: ATXN1; (-) strand; PAM type: NRG; PAM sequence: AAG
tcagaacaatgtgaccagaa

SEQ ID NO: 61117 - DNA, 20 bp, Artificial Sequence
  Description of Artificial Sequence: Synthetic oligonucleotide
  Target: ATXN1; (-) strand; PAM type: NRG; PAM sequence: CAG
tactttcagaacaatgtgac

SEQ ID NO: 61118 - DNA, 20 bp, Artificial Sequence
  Description of Artificial Sequence: Synthetic oligonucleotide
  Target: ATXN1; (-) strand; PAM type: NRG; PAM sequence: CAG
tcaaagctgacgtgtacttt

SEQ ID NO: 61119 - DNA, 20 bp, Artificial Sequence
  Description of Artificial Sequence: Synthetic oligonucleotide
  Target: ATXN1; (-) strand; PAM type: NRG; PAM sequence: AAG
cttgactgagaggtggctca

SEQ ID NO: 61120 - DNA, 20 bp, Artificial Sequence
  Description of Artificial Sequence: Synthetic oligonucleotide
  Target: ATXN1; (-) strand; PAM type: NRG; PAM sequence: TGG
ggaaggacttgactgagagg

SEQ ID NO: 61121 - DNA, 20 bp, Artificial Sequence
  Description of Artificial Sequence: Synthetic oligonucleotide
  Target: ATXN1; (-) strand; PAM type: NRG; PAM sequence: AGG
gatggaaggacttgactgag

SEQ ID NO: 61122 - DNA, 20 bp, Artificial Sequence
  Description of Artificial Sequence: Synthetic oligonucleotide
  Target: ATXN1; (-) strand; PAM type: NRG; PAM sequence: GAG
agatggaaggacttgactga

SEQ ID NO: 61123 - DNA, 20 bp, Artificial Sequence
  Description of Artificial Sequence: Synthetic oligonucleotide
  Target: ATXN1; (-) strand; PAM type: NRG; PAM sequence: GAG
gaagatggaaggacttgact

SEQ ID NO: 61124 - DNA, 20 bp, Artificial Sequence
  Description of Artificial Sequence: Synthetic oligonucleotide
  Target: ATXN1; (-) strand; PAM type: NRG; PAM sequence: AGG
atagcataggagaagatgga

SEQ ID NO: 61125 - DNA, 20 bp, Artificial Sequence
  Description of Artificial Sequence: Synthetic oligonucleotide
  Target: ATXN1; (-) strand; PAM type: NRG; PAM sequence: AAG
gatagcataggagaagatgg

SEQ ID NO: 61126 - DNA, 20 bp, Artificial Sequence
  Description of Artificial Sequence: Synthetic oligonucleotide
  Target: ATXN1; (-) strand; PAM type: NRG; PAM sequence: TGG
agggatagcataggagaaga

SEQ ID NO: 61127 - DNA, 20 bp, Artificial Sequence
  Description of Artificial Sequence: Synthetic oligonucleotide
  Target: ATXN1; (-) strand; PAM type: NRG; PAM sequence: AAG
acccagggatagcataggag

SEQ ID NO: 61128 - DNA, 20 bp, Artificial Sequence
  Description of Artificial Sequence: Synthetic oligonucleotide
  Target: ATXN1; (-) strand; PAM type: NRG; PAM sequence: GAG
atgacccagggatagcatag

SEQ ID NO: 61129 - DNA, 20 bp, Artificial Sequence
  Description of Artificial Sequence: Synthetic oligonucleotide
  Target: ATXN1; (-) strand; PAM type: NRG; PAM sequence: AGG
agatgacccagggatagcat

SEQ ID NO: 61130 - DNA, 20 bp, Artificial Sequence
  Description of Artificial Sequence: Synthetic oligonucleotide
  Target: ATXN1; (-) strand; PAM type: NRG; PAM sequence: TAG
gagatgacccagggatagca

SEQ ID NO: 61131 - DNA, 20 bp, Artificial Sequence
  Description of Artificial Sequence: Synthetic oligonucleotide
  Target: ATXN1; (-) strand; PAM type: NRG; PAM sequence: TAG
ccaaagagatgacccaggga

SEQ ID NO: 61132 - DNA, 20 bp, Artificial Sequence
  Description of Artificial Sequence: Synthetic oligonucleotide
  Target: ATXN1; (-) strand; PAM type: NRG; PAM sequence: GGG
gtttccaaagagatgaccca

SEQ ID NO: 61133 - DNA, 20 bp, Artificial Sequence
  Description of Artificial Sequence: Synthetic oligonucleotide
  Target: ATXN1; (-) strand; PAM type: NRG; PAM sequence: AGG
agtttccaaagagatgaccc

SEQ ID NO: 61134 - DNA, 20 bp, Artificial Sequence
  Description of Artificial Sequence: Synthetic oligonucleotide
  Target: ATXN1; (-) strand; PAM type: NRG; PAM sequence: CAG
aagtttccaaagagatgacc

SEQ ID NO: 61135 - DNA, 20 bp, Artificial Sequence
  Description of Artificial Sequence: Synthetic oligonucleotide
  Target: ATXN1; (-) strand; PAM type: NRG; PAM sequence: GAG
caattcaggaagtttccaaa

SEQ ID NO: 61136 - DNA, 20 bp, Artificial Sequence
  Description of Artificial Sequence: Synthetic oligonucleotide
  Target: ATXN1; (-) strand; PAM type: NRG; PAM sequence: AAG
gacaattcaggaagtttcca

SEQ ID NO: 61137 - DNA, 20 bp, Artificial Sequence
  Description of Artificial Sequence: Synthetic oligonucleotide
  Target: ATXN1; (-) strand; PAM type: NRG; PAM sequence: AAG
gttagcctagacaattcagg

SEQ ID NO: 61138 - DNA, 20 bp, Artificial Sequence
  Description of Artificial Sequence: Synthetic oligonucleotide
  Target: ATXN1; (-) strand; PAM type: NRG; PAM sequence: AGG
ctcgttagcctagacaattc

SEQ ID NO: 61139 - DNA, 20 bp, Artificial Sequence
  Description of Artificial Sequence: Synthetic oligonucleotide
  Target: ATXN1; (-) strand; PAM type: NRG; PAM sequence: CAG
actcgttagcctagacaatt

SEQ ID NO: 61140 - DNA, 20 bp, Artificial Sequence
  Description of Artificial Sequence: Synthetic oligonucleotide
  Target: ATXN1; (-) strand; PAM type: NRG; PAM sequence: TAG
cctaaaaacactcgttagcc

SEQ ID NO: 61141 - DNA, 20 bp, Artificial Sequence
  Description of Artificial Sequence: Synthetic oligonucleotide
  Target: ATXN1; (-) strand; PAM type: NRG; PAM sequence: TAG
agaagcctaaaaacactcgt

SEQ ID NO: 61142 - DNA, 20 bp, Artificial Sequence
  Description of Artificial Sequence: Synthetic oligonucleotide
  Target: ATXN1; (-) strand; PAM type: NRG; PAM sequence: AAG
gagacatggttaggtggtag

SEQ ID NO: 61143 - DNA, 20 bp, Artificial Sequence
  Description of Artificial Sequence: Synthetic oligonucleotide
  Target: ATXN1; (-) strand; PAM type: NRG; PAM sequence: TAG
gtagagacatggttaggtgg

SEQ ID NO: 61144 - DNA, 20 bp, Artificial Sequence
  Description of Artificial Sequence: Synthetic oligonucleotide
  Target: ATXN1; (-) strand; PAM type: NRG; PAM sequence: TGG
tgtgtagagacatggttagg

SEQ ID NO: 61145 - DNA, 20 bp, Artificial Sequence
  Description of Artificial Sequence: Synthetic oligonucleotide
  Target: ATXN1; (-) strand; PAM type: NRG; PAM sequence: AGG
agatgtgtagagacatggtt

SEQ ID NO: 61146 - DNA, 20 bp, Artificial Sequence
  Description of Artificial Sequence: Synthetic oligonucleotide
  Target: ATXN1; (-) strand; PAM type: NRG; PAM sequence: TAG
gagatgtgtagagacatggt

SEQ ID NO: 61147 - DNA, 20 bp, Artificial Sequence
  Description of Artificial Sequence: Synthetic oligonucleotide
  Target: ATXN1; (-) strand; PAM type: NRG; PAM sequence: TGG
caatgagatgtgtagagaca

SEQ ID NO: 61148 - DNA, 20 bp, Artificial Sequence
  Description of Artificial Sequence: Synthetic oligonucleotide
  Target: ATXN1; (-) strand; PAM type: NRG; PAM sequence: GAG
catgatcaatgagatgtgta

SEQ ID NO: 61149 - DNA, 20 bp, Artificial Sequence
  Description of Artificial Sequence: Synthetic oligonucleotide
  Target: ATXN1; (-) strand; PAM type: NRG; PAM sequence: TAG
gacatgatcaatgagatgtg

SEQ ID NO: 61150 - DNA, 20 bp, Artificial Sequence
  Description of Artificial Sequence: Synthetic oligonucleotide
  Target: ATXN1; (-) strand; PAM type: NRG; PAM sequence: GAG
aggatgttgacatgatcaat

SEQ ID NO: 61151 - DNA, 20 bp, Artificial Sequence
  Description of Artificial Sequence: Synthetic oligonucleotide
  Target: ATXN1; (-) strand; PAM type: NRG; PAM sequence: AGG
gtcattgaaagagtttaagc

SEQ ID NO: 61152 - DNA, 20 bp, Artificial Sequence
  Description of Artificial Sequence: Synthetic oligonucleotide
  Target: ATXN1; (-) strand; PAM type: NRG; PAM sequence: CAG
ggtcattgaaagagtttaag

SEQ ID NO: 61153 - DNA, 20 bp, Artificial Sequence
  Description of Artificial Sequence: Synthetic oligonucleotide
  Target: ATXN1; (-) strand; PAM type: NRG; PAM sequence: AAG
agtggtcattgaaagagttt

SEQ ID NO: 61154 - DNA, 20 bp, Artificial Sequence
  Description of Artificial Sequence: Synthetic oligonucleotide
  Target: ATXN1; (-) strand; PAM type: NRG; PAM sequence: GAG
caggggagtggtcattgaaa

SEQ ID NO: 61155 - DNA, 20 bp, Artificial Sequence
  Description of Artificial Sequence: Synthetic oligonucleotide
  Target: ATXN1; (-) strand; PAM type: NRG; PAM sequence: AAG
gacaggggagtggtcattga

SEQ ID NO: 61156 - DNA, 20 bp, Artificial Sequence
  Description of Artificial Sequence: Synthetic oligonucleotide
  Target: ATXN1; (-) strand; PAM type: NRG; PAM sequence: TGG
ttatcttgaagacaggggag

SEQ ID NO: 61157 - DNA, 20 bp, Artificial Sequence
  Description of Artificial Sequence: Synthetic oligonucleotide
  Target: ATXN1; (-) strand; PAM type: NRG; PAM sequence: GAG
agtttatcttgaagacaggg

SEQ ID NO: 61158 - DNA, 20 bp, Artificial Sequence
  Description of Artificial Sequence: Synthetic oligonucleotide
  Target: ATXN1; (-) strand; PAM type: NRG; PAM sequence: GGG
agagtttatcttgaagacag

SEQ ID NO: 61159 - DNA, 20 bp, Artificial Sequence
  Description of Artificial Sequence: Synthetic oligonucleotide
  Target: ATXN1; (-) strand; PAM type: NRG; PAM sequence: GGG
tagagtttatcttgaagaca

SEQ ID NO: 61160 - DNA, 20 bp, Artificial Sequence
  Description of Artificial Sequence: Synthetic oligonucleotide
  Target: ATXN1; (-) strand; PAM type: NRG; PAM sequence: AGG
ttagagtttatcttgaagac

SEQ ID NO: 61161 - DNA, 20 bp, Artificial Sequence
  Description of Artificial Sequence: Synthetic oligonucleotide
  Target: ATXN1; (-) strand; PAM type: NRG; PAM sequence: CAG
tttagagtttatcttgaaga

SEQ ID NO: 61162 - DNA, 20 bp, Artificial Sequence
  Description of Artificial Sequence: Synthetic oligonucleotide
  Target: ATXN1; (-) strand; PAM type: NRG; PAM sequence: AAG
ggagtttagagtttatcttg

SEQ ID NO: 61163 - DNA, 20 bp, Artificial Sequence
  Description of Artificial Sequence: Synthetic oligonucleotide
  Target: ATXN1; (-) strand; PAM type: NRG; PAM sequence: GAG
aagttctgctgaggagttta

SEQ ID NO: 61164 - DNA, 20 bp, Artificial Sequence
  Description of Artificial Sequence: Synthetic oligonucleotide
  Target: ATXN1; (-) strand; PAM type: NRG; PAM sequence: TAG
gtaagttctgctgaggagtt

SEQ ID NO: 61165 - DNA, 20 bp, Artificial Sequence
  Description of Artificial Sequence: Synthetic oligonucleotide
  Target: ATXN1; (-) strand; PAM type: NRG; PAM sequence: GAG
tttcagtaagttctgctgag

SEQ ID NO: 61166 - DNA, 20 bp, Artificial Sequence
  Description of Artificial Sequence: Synthetic oligonucleotide
  Target: ATXN1; (-) strand; PAM type: NRG; PAM sequence: AGG
cttttcagtaagttctgctg

SEQ ID NO: 61167 - DNA, 20 bp, Artificial Sequence
  Description of Artificial Sequence: Synthetic oligonucleotide
  Target: ATXN1; (-) strand; PAM type: NRG; PAM sequence: GAG
tcttttcagtaagttctgct

SEQ ID NO: 61168 - DNA, 20 bp, Artificial Sequence
  Description of Artificial Sequence: Synthetic oligonucleotide
  Target: ATXN1; (-) strand; PAM type: NRG; PAM sequence: AAG
tcataaagtgtcttttcagt

SEQ ID NO: 61169 - DNA, 20 bp, Artificial Sequence
  Description of Artificial Sequence: Synthetic oligonucleotide
  Target: ATXN1; (-) strand; PAM type: NRG; PAM sequence: CAG
cagatcataaagtgtctttt

SEQ ID NO: 61170 - DNA, 20 bp, Artificial Sequence
  Description of Artificial Sequence: Synthetic oligonucleotide
  Target: ATXN1; (-) strand; PAM type: NRG; PAM sequence: AAG
gaagaaaaagccagatcata

SEQ ID NO: 61171 - DNA, 20 bp, Artificial Sequence
  Description of Artificial Sequence: Synthetic oligonucleotide
  Target: ATXN1; (-) strand; PAM type: NRG; PAM sequence: CAG
aagtctcatgaagaaaaagc

SEQ ID NO: 61172 - DNA, 20 bp, Artificial Sequence
  Description of Artificial Sequence: Synthetic oligonucleotide
  Target: ATXN1; (-) strand; PAM type: NRG; PAM sequence: AAG
tgtgaagtctcatgaagaaa

SEQ ID NO: 61173 - DNA, 20 bp, Artificial Sequence
  Description of Artificial Sequence: Synthetic oligonucleotide
  Target: ATXN1; (-) strand; PAM type: NRG; PAM sequence: AAG
ggcatatgtgaagtctcatg

SEQ ID NO: 61174 - DNA, 20 bp, Artificial Sequence
  Description of Artificial Sequence: Synthetic oligonucleotide
  Target: ATXN1; (-) strand; PAM type: NRG; PAM sequence: AAG
gctggagtcaggcatatgtg

SEQ ID NO: 61175 - DNA, 20 bp, Artificial Sequence
  Description of Artificial Sequence: Synthetic oligonucleotide
  Target: ATXN1; (-) strand; PAM type: NRG; PAM sequence: AGG
agtttggagtggctggagtc

SEQ ID NO: 61176 - DNA, 20 bp, Artificial Sequence
  Description of Artificial Sequence: Synthetic oligonucleotide
  Target: ATXN1; (-) strand; PAM type: NRG; PAM sequence: CAG
tagtttggagtggctggagt

SEQ ID NO: 61177 - DNA, 20 bp, Artificial Sequence
  Description of Artificial Sequence: Synthetic oligonucleotide
  Target: ATXN1; (-) strand; PAM type: NRG; PAM sequence: GAG
caagtagtttggagtggctg

SEQ ID NO: 61178 - DNA, 20 bp, Artificial Sequence
  Description of Artificial Sequence: Synthetic oligonucleotide
  Target: ATXN1; (-) strand; PAM type: NRG; PAM sequence: TGG
agcaagtagtttggagtggc

SEQ ID NO: 61179 - DNA, 20 bp, Artificial Sequence
  Description of Artificial Sequence: Synthetic oligonucleotide
  Target: ATXN1; (-) strand; PAM type: NRG; PAM sequence: TGG
agacagcaagtagtttggag

SEQ ID NO: 61180 - DNA, 20 bp, Artificial Sequence
  Description of Artificial Sequence: Synthetic oligonucleotide
  Target: ATXN1; (-) strand; PAM type: NRG; PAM sequence: GAG
ggaagacagcaagtagtttg

SEQ ID NO: 61181 - DNA, 20 bp, Artificial Sequence
  Description of Artificial Sequence: Synthetic oligonucleotide
  Target: ATXN1; (-) strand; PAM type: NRG; PAM sequence: TGG
ttggaagacagcaagtagtt

SEQ ID NO: 61182 - DNA, 20 bp, Artificial Sequence
  Description of Artificial Sequence: Synthetic oligonucleotide
  Target: ATXN1; (-) strand; PAM type: NRG; PAM sequence: TAG
gcatgttggaagacagcaag

SEQ ID NO: 61183 - DNA, 20 bp, Artificial Sequence
  Description of Artificial Sequence: Synthetic oligonucleotide
  Target: ATXN1; (-) strand; PAM type: NRG; PAM sequence: AAG
atggcatgttggaagacagc

SEQ ID NO: 61184 - DNA, 20 bp, Artificial Sequence
  Description of Artificial Sequence: Synthetic oligonucleotide
  Target: ATXN1; (-) strand; PAM type: NRG; PAM sequence: CAG
gaacatggcatgttggaaga

SEQ ID NO: 61185 - DNA, 20 bp, Artificial Sequence
  Description of Artificial Sequence: Synthetic oligonucleotide
  Target: ATXN1; (-) strand; PAM type: NRG; PAM sequence: AAG
gagagaacatggcatgttgg

SEQ ID NO: 61186 - DNA, 20 bp, Artificial Sequence
  Description of Artificial Sequence: Synthetic oligonucleotide
  Target: ATXN1; (-) strand; PAM type: NRG; PAM sequence: TGG
taagagagaacatggcatgt

SEQ ID NO: 61187 - DNA, 20 bp, Artificial Sequence
  Description of Artificial Sequence: Synthetic oligonucleotide
  Target: ATXN1; (-) strand; PAM type: NRG; PAM sequence: TGG
ctcaaaggtaagagagaaca

SEQ ID NO: 61188 - DNA, 20 bp, Artificial Sequence
  Description of Artificial Sequence: Synthetic oligonucleotide
  Target: ATXN1; (-) strand; PAM type: NRG; PAM sequence: GAG
agcaaagctcaaaggtaaga

SEQ ID NO: 61189 - DNA, 20 bp, Artificial Sequence
  Description of Artificial Sequence: Synthetic oligonucleotide
  Target: ATXN1; (-) strand; PAM type: NRG; PAM sequence: GAG
tgagcaaagctcaaaggtaa

SEQ ID NO: 61190 - DNA, 20 bp, Artificial Sequence
  Description of Artificial Sequence: Synthetic oligonucleotide
  Target: ATXN1; (-) strand; PAM type: NRG; PAM sequence: AAG
catgagcaaagctcaaaggt

SEQ ID NO: 61191 - DNA, 20 bp, Artificial Sequence
  Description of Artificial Sequence: Synthetic oligonucleotide
  Target: ATXN1; (-) strand; PAM type: NRG; PAM sequence: AGG
acaacatgagcaaagctcaa

SEQ ID NO: 61192 - DNA, 20 bp, Artificial Sequence
  Description of Artificial Sequence: Synthetic oligonucleotide
  Target: ATXN1; (-) strand; PAM type: NRG; PAM sequence: AAG
gacaacatgagcaaagctca

SEQ ID NO: 61193 - DNA, 20 bp, Artificial Sequence
  Description of Artificial Sequence: Synthetic oligonucleotide
  Target: ATXN1; (-) strand; PAM type: NRG; PAM sequence: AAG
acatgaggacaacatgagca

SEQ ID NO: 61194 - DNA, 20 bp, Artificial Sequence
  Description of Artificial Sequence: Synthetic oligonucleotide
  Target: ATXN1; (-) strand; PAM type: NRG; PAM sequence: GAG
tagtcacatgaggacaacat

SEQ ID NO: 61195 - DNA, 20 bp, Artificial Sequence
  Description of Artificial Sequence: Synthetic oligonucleotide
  Target: ATXN1; (-) strand; PAM type: NRG; PAM sequence: AGG
actccagctctagtcacatg

SEQ ID NO: 61196 - DNA, 20 bp, Artificial Sequence
  Description of Artificial Sequence: Synthetic oligonucleotide
  Target: ATXN1; (-) strand; PAM type: NRG; PAM sequence: GAG
aactccagctctagtcacat

SEQ ID NO: 61197 - DNA, 20 bp, Artificial Sequence
  Description of Artificial Sequence: Synthetic oligonucleotide
  Target: ATXN1; (-) strand; PAM type: NRG; PAM sequence: TAG
ggatggggaaactccagctc

SEQ ID NO: 61198 - DNA, 20 bp, Artificial Sequence
  Description of Artificial Sequence: Synthetic oligonucleotide
  Target: ATXN1; (-) strand; PAM type: NRG; PAM sequence: CAG
ttcaaaggatggggaaactc

SEQ ID NO: 61199 - DNA, 20 bp, Artificial Sequence
  Description of Artificial Sequence: Synthetic oligonucleotide
  Target: ATXN1; (-) strand; PAM type: NRG; PAM sequence: GGG
tttgttcagttcaaaggatg

SEQ ID NO: 61200 - DNA, 20 bp, Artificial Sequence
  Description of Artificial Sequence: Synthetic oligonucleotide
  Target: ATXN1; (-) strand; PAM type: NRG; PAM sequence: GGG
atttgttcagttcaaaggat

SEQ ID NO: 61201 - DNA, 20 bp, Artificial Sequence
  Description of Artificial Sequence: Synthetic oligonucleotide
  Target: ATXN1; (-) strand; PAM type: NRG; PAM sequence: TGG
aatttgttcagttcaaagga

SEQ ID NO: 61202 - DNA, 20 bp, Artificial Sequence
  Description of Artificial Sequence: Synthetic oligonucleotide
  Target: ATXN1; (-) strand; PAM type: NRG; PAM sequence: AGG
acttaatttgttcagttcaa

SEQ ID NO: 61203 - DNA, 20 bp, Artificial Sequence
  Description of Artificial Sequence: Synthetic oligonucleotide
  Target: ATXN1; (-) strand; PAM type: NRG; PAM sequence: AAG
tacttaatttgttcagttca

SEQ ID NO: 61204 - DNA, 20 bp, Artificial Sequence
  Description of Artificial Sequence: Synthetic oligonucleotide
  Target: ATXN1; (-) strand; PAM type: NRG; PAM sequence: CAG
agcaaattacttaatttgtt

SEQ ID NO: 61205 - DNA, 20 bp, Artificial Sequence
  Description of Artificial Sequence: Synthetic oligonucleotide
  Target: ATXN1; (-) strand; PAM type: NRG; PAM sequence: AAG
tgctaatttccctttaacca

SEQ ID NO: 61206 - DNA, 20 bp, Artificial Sequence
  Description of Artificial Sequence: Synthetic oligonucleotide
  Target: ATXN1; (-) strand; PAM type: NRG; PAM sequence: AAG
tgcttttcaagctctgcttc

SEQ ID NO: 61207 - DNA, 20 bp, Artificial Sequence
  Description of Artificial Sequence: Synthetic oligonucleotide
  Target: ATXN1; (-) strand; PAM type: NRG; PAM sequence: AAG
ccagtgcatgagtgcttttc

SEQ ID NO: 61208 - DNA, 20 bp, Artificial Sequence
  Description of Artificial Sequence: Synthetic oligonucleotide
  Target: ATXN1; (-) strand; PAM type: NRG; PAM sequence: GAG
aagggcaagccccagtgcat

SEQ ID NO: 61209 - DNA, 20 bp, Artificial Sequence
  Description of Artificial Sequence: Synthetic oligonucleotide
  Target: ATXN1; (-) strand; PAM type: NRG; PAM sequence: CAG
cagcaagaaagggcaagccc

SEQ ID NO: 61210 - DNA, 20 bp, Artificial Sequence
  Description of Artificial Sequence: Synthetic oligonucleotide
  Target: ATXN1; (-) strand; PAM type: NRG; PAM sequence: AAG
caaaagcagcaagaaagggc

SEQ ID NO: 61211 - DNA, 20 bp, Artificial Sequence
  Description of Artificial Sequence: Synthetic oligonucleotide
  Target: ATXN1; (-) strand; PAM type: NRG; PAM sequence: GGG
ttcccaaaagcagcaagaaa

SEQ ID NO: 61212 - DNA, 20 bp, Artificial Sequence
  Description of Artificial Sequence: Synthetic oligonucleotide
  Target: ATXN1; (-) strand; PAM type: NRG; PAM sequence: AGG
gttcccaaaagcagcaagaa

SEQ ID NO: 61213 - DNA, 20 bp, Artificial Sequence
  Description of Artificial Sequence: Synthetic oligonucleotide
  Target: ATXN1; (-) strand; PAM type: NRG; PAM sequence: AAG
ggttcccaaaagcagcaaga

SEQ ID NO: 61214 - DNA, 20 bp, Artificial Sequence
  Description of Artificial Sequence: Synthetic oligonucleotide
  Target: ATXN1; (-) strand; PAM type: NRG; PAM sequence: AAG
taagggttcccaaaagcagc

SEQ ID NO: 61215 - DNA, 20 bp, Artificial Sequence
  Description of Artificial Sequence: Synthetic oligonucleotide
  Target: ATXN1; (-) strand; PAM type: NRG; PAM sequence: CAG
aggctaagggttcccaaaag

SEQ ID NO: 61216 - DNA, 20 bp, Artificial Sequence
  Description of Artificial Sequence: Synthetic oligonucleotide
  Target: ATXN1; (-) strand; PAM type: NRG; PAM sequence: AAG
tgcaggctaagggttcccaa

SEQ ID NO: 61217 - DNA, 20 bp, Artificial Sequence
  Description of Artificial Sequence: Synthetic oligonucleotide
  Target: ATXN1; (-) strand; PAM type: NRG; PAM sequence: GGG
ttcttcactttgcaggctaa

SEQ ID NO: 61218 - DNA, 20 bp, Artificial Sequence
  Description of Artificial Sequence: Synthetic oligonucleotide
  Target: ATXN1; (-) strand; PAM type: NRG; PAM sequence: AGG
cttcttcactttgcaggcta

SEQ ID NO: 61219 - DNA, 20 bp, Artificial Sequence
  Description of Artificial Sequence: Synthetic oligonucleotide
  Target: ATXN1; (-) strand; PAM type: NRG; PAM sequence: AAG
gcttcttcactttgcaggct

SEQ ID NO: 61220 - DNA, 20 bp, Artificial Sequence
  Description of Artificial Sequence: Synthetic oligonucleotide
  Target: ATXN1; (-) strand; PAM type: NRG; PAM sequence: AGG
tctgagcttcttcactttgc

SEQ ID NO: 61221 - DNA, 20 bp, Artificial Sequence
  Description of Artificial Sequence: Synthetic oligonucleotide
  Target: ATXN1; (-) strand; PAM type: NRG; PAM sequence: CAG
gtctgagcttcttcactttg

SEQ ID NO: 61222 - DNA, 20 bp, Artificial Sequence
  Description of Artificial Sequence: Synthetic oligonucleotide
  Target: ATXN1; (-) strand; PAM type: NRG; PAM sequence: GAG
atcctccagtagactagtct

SEQ ID NO: 61223 - DNA, 20 bp, Artificial Sequence
  Description of Artificial Sequence: Synthetic oligonucleotide
  Target: ATXN1; (-) strand; PAM type: NRG; PAM sequence: TAG
cctctcatcctccagtagac

SEQ ID NO: 61224 - DNA, 20 bp, Artificial Sequence
  Description of Artificial Sequence: Synthetic oligonucleotide
  Target: ATXN1; (-) strand; PAM type: NRG; PAM sequence: TAG
ggtggcctctcatcctccag

SEQ ID NO: 61225 - DNA, 20 bp, Artificial Sequence
  Description of Artificial Sequence: Synthetic oligonucleotide
  Target: ATXN1; (-) strand; PAM type: NRG; PAM sequence: CAG
tcaggtggcctctcatcctc

SEQ ID NO: 61226 - DNA, 20 bp, Artificial Sequence
  Description of Artificial Sequence: Synthetic oligonucleotide
  Target: ATXN1; (-) strand; PAM type: NRG; PAM sequence: TGG
cagcttgtctctgcttcagg

SEQ ID NO: 61227 - DNA, 20 bp, Artificial Sequence
  Description of Artificial Sequence: Synthetic oligonucleotide
  Target: ATXN1; (-) strand; PAM type: NRG; PAM sequence: AGG
ggacagcttgtctctgcttc

SEQ ID NO: 61228 - DNA, 20 bp, Artificial Sequence
  Description of Artificial Sequence: Synthetic oligonucleotide
  Target: ATXN1; (-) strand; PAM type: NRG; PAM sequence: CAG
gggacagcttgtctctgctt

SEQ ID NO: 61229 - DNA, 20 bp, Artificial Sequence
  Description of Artificial Sequence: Synthetic oligonucleotide
  Target: ATXN1; (-) strand; PAM type: NRG; PAM sequence: CAG
tgggtgatcttcagctggga

SEQ ID NO: 61230 - DNA, 20 bp, Artificial Sequence
  Description of Artificial Sequence: Synthetic oligonucleotide
  Target: ATXN1; (-) strand; PAM type: NRG; PAM sequence: GGG
gagatgggtgatcttcagct

SEQ ID NO: 61231 - DNA, 20 bp, Artificial Sequence
  Description of Artificial Sequence: Synthetic oligonucleotide
  Target: ATXN1; (-) strand; PAM type: NRG; PAM sequence: TGG
agagatgggtgatcttcagc

SEQ ID NO: 61232 - DNA, 20 bp, Artificial Sequence
  Description of Artificial Sequence: Synthetic oligonucleotide
  Target: ATXN1; (-) strand; PAM type: NRG; PAM sequence: CAG
cctgagagatgggtgatctt

SEQ ID NO: 61233 - DNA, 20 bp, Artificial Sequence
  Description of Artificial Sequence: Synthetic oligonucleotide
  Target: ATXN1; (-) strand; PAM type: NRG; PAM sequence: GGG
ggctggtttgcctgagagat

SEQ ID NO: 61234 - DNA, 20 bp, Artificial Sequence
  Description of Artificial Sequence: Synthetic oligonucleotide
  Target: ATXN1; (-) strand; PAM type: NRG; PAM sequence: TGG
aggctggtttgcctgagaga

SEQ ID NO: 61235 - DNA, 20 bp, Artificial Sequence
  Description of Artificial Sequence: Synthetic oligonucleotide
  Target: ATXN1; (-) strand; PAM type: NRG; PAM sequence: GAG
tagaaggctggtttgcctga

SEQ ID NO: 61236 - DNA, 20 bp, Artificial Sequence
  Description of Artificial Sequence: Synthetic oligonucleotide
  Target: ATXN1; (-) strand; PAM type: NRG; PAM sequence: GAG
actagaaggctggtttgcct

SEQ ID NO: 61237 - DNA, 20 bp, Artificial Sequence
  Description of Artificial Sequence: Synthetic oligonucleotide
  Target: ATXN1; (-) strand; PAM type: NRG; PAM sequence: TGG
tcacatagctactagaaggc

SEQ ID NO: 61238 - DNA, 20 bp, Artificial Sequence
  Description of Artificial Sequence: Synthetic oligonucleotide
  Target: ATXN1; (-) strand; PAM type: NRG; PAM sequence: AGG
tcactcacatagctactaga

SEQ ID NO: 61239 - DNA, 20 bp, Artificial Sequence
  Description of Artificial Sequence: Synthetic oligonucleotide
  Target: ATXN1; (-) strand; PAM type: NRG; PAM sequence: AAG
ctcactcacatagctactag

SEQ ID NO: 61240 - DNA, 20 bp, Artificial Sequence
  Description of Artificial Sequence: Synthetic oligonucleotide
  Target: ATXN1; (-) strand; PAM type: NRG; PAM sequence: TAG
ggtctcactcacatagctac

SEQ ID NO: 61241 - DNA, 20 bp, Artificial Sequence
  Description of Artificial Sequence: Synthetic oligonucleotide
  Target: ATXN1; (-) strand; PAM type: NRG; PAM sequence: TAG
ccagcatggtctcactcaca

SEQ ID NO: 61242 - DNA, 20 bp, Artificial Sequence
  Description of Artificial Sequence: Synthetic oligonucleotide
  Target: ATXN1; (-) strand; PAM type: NRG; PAM sequence: TGG
tgggactggttaatccagca

SEQ ID NO: 61243 - DNA, 20 bp, Artificial Sequence
  Description of Artificial Sequence: Synthetic oligonucleotide
  Target: ATXN1; (-) strand; PAM type: NRG; PAM sequence: CAG
ttggctgggactggttaatc

SEQ ID NO: 61244 - DNA, 20 bp, Artificial Sequence
  Description of Artificial Sequence: Synthetic oligonucleotide
  Target: ATXN1; (-) strand; PAM type: NRG; PAM sequence: TGG
tgggccagcttggctgggac

SEQ ID NO: 61245 - DNA, 20 bp, Artificial Sequence
  Description of Artificial Sequence: Synthetic oligonucleotide
  Target: ATXN1; (-) strand; PAM type: NRG; PAM sequence: GGG
tagtctgggccagcttggct

SEQ ID NO: 61246 - DNA, 20 bp, Artificial Sequence
  Description of Artificial Sequence: Synthetic oligonucleotide
  Target: ATXN1; (-) strand; PAM type: NRG; PAM sequence: TGG
ttagtctgggccagcttggc

SEQ ID NO: 61247 - DNA, 20 bp, Artificial Sequence
  Description of Artificial Sequence: Synthetic oligonucleotide
  Target: ATXN1; (-) strand; PAM type: NRG; PAM sequence: TGG
tattttagtctgggccagct

SEQ ID NO: 61248 - DNA, 20 bp, Artificial Sequence
  Description of Artificial Sequence: Synthetic oligonucleotide
  Target: ATXN1; (-) strand; PAM type: NRG; PAM sequence: CAG
tggactattttagtctgggc

SEQ ID NO: 61249 - DNA, 20 bp, Artificial Sequence
  Description of Artificial Sequence: Synthetic oligonucleotide
  Target: ATXN1; (-) strand; PAM type: NRG; PAM sequence: GGG
cacctggactattttagtct

SEQ ID NO: 61250 - DNA, 20 bp, Artificial Sequence
  Description of Artificial Sequence: Synthetic oligonucleotide
  Target: ATXN1; (-) strand; PAM type: NRG; PAM sequence: TGG
tcacctggactattttagtc

SEQ ID NO: 61251 - DNA, 20 bp, Artificial Sequence
  Description of Artificial Sequence: Synthetic oligonucleotide
  Target: ATXN1; (-) strand; PAM type: NRG; PAM sequence: TAG
gtgggtcacctggactattt

SEQ ID NO: 61252 - DNA, 20 bp, Artificial Sequence
  Description of Artificial Sequence: Synthetic oligonucleotide
  Target: ATXN1; (-) strand; PAM type: NRG; PAM sequence: TGG
tcttatgattgtgggtcacc

SEQ ID NO: 61253 - DNA, 20 bp, Artificial Sequence
  Description of Artificial Sequence: Synthetic oligonucleotide
  Target: ATXN1; (-) strand; PAM type: NRG; PAM sequence: GGG
gaccacaatcttatgattgt

SEQ ID NO: 61254 - DNA, 20 bp, Artificial Sequence
  Description of Artificial Sequence: Synthetic oligonucleotide
  Target: ATXN1; (-) strand; PAM type: NRG; PAM sequence: TGG
agaccacaatcttatgattg

SEQ ID NO: 61255 - DNA, 20 bp, Artificial Sequence
  Description of Artificial Sequence: Synthetic oligonucleotide
  Target: ATXN1; (-) strand; PAM type: NRG; PAM sequence: AAG
catcccaacagttaagggcc

SEQ ID NO: 61256 - DNA, 20 bp, Artificial Sequence
  Description of Artificial Sequence: Synthetic oligonucleotide
  Target: ATXN1; (-) strand; PAM type: NRG; PAM sequence: GGG
caagccatcccaacagttaa

SEQ ID NO: 61257 - DNA, 20 bp, Artificial Sequence
  Description of Artificial Sequence: Synthetic oligonucleotide
  Target: ATXN1; (-) strand; PAM type: NRG; PAM sequence: AGG
acaagccatcccaacagtta

SEQ ID NO: 61258 - DNA, 20 bp, Artificial Sequence
  Description of Artificial Sequence: Synthetic oligonucleotide
  Target: ATXN1; (-) strand; PAM type: NRG; PAM sequence: AAG
aacaagccatcccaacagtt

SEQ ID NO: 61259 - DNA, 20 bp, Artificial Sequence
  Description of Artificial Sequence: Synthetic oligonucleotide
  Target: ATXN1; (-) strand; PAM type: NRG; PAM sequence: CAG
tgtgtaacaagccatcccaa

SEQ ID NO: 61260 - DNA, 20 bp, Artificial Sequence
  Description of Artificial Sequence: Synthetic oligonucleotide
  Target: ATXN1; (-) strand; PAM type: NRG; PAM sequence: AAG
gttagcatatactgtgtaac

SEQ ID NO: 61261 - DNA, 20 bp, Artificial Sequence
  Description of Artificial Sequence: Synthetic oligonucleotide
  Target: ATXN1; (-) strand; PAM type: NRG; PAM sequence: TAG
aacaaagtggatgtatcagt

SEQ ID NO: 61262 - DNA, 20 bp, Artificial Sequence
  Description of Artificial Sequence: Synthetic oligonucleotide
  Target: ATXN1; (-) strand; PAM type: NRG; PAM sequence: CAG
agaaaacaaagtggatgtat

SEQ ID NO: 61263 - DNA, 20 bp, Artificial Sequence
  Description of Artificial Sequence: Synthetic oligonucleotide
  Target: ATXN1; (-) strand; PAM type: NRG; PAM sequence: TGG
atgttaaccagaaaacaaag

SEQ ID NO: 61264 - DNA, 20 bp, Artificial Sequence
  Description of Artificial Sequence: Synthetic oligonucleotide
  Target: ATXN1; (-) strand; PAM type: NRG; PAM sequence: AAG
tagatgttaaccagaaaaca

SEQ ID NO: 61265 - DNA, 20 bp, Artificial Sequence
  Description of Artificial Sequence: Synthetic oligonucleotide
  Target: ATXN1; (-) strand; PAM type: NRG; PAM sequence: CAG
aatgaggagtagatgttaac

SEQ ID NO: 61266 - DNA, 20 bp, Artificial Sequence
  Description of Artificial Sequence: Synthetic oligonucleotide
  Target: ATXN1; (-) strand; PAM type: NRG; PAM sequence: TAG
cctcagacttgaatgaggag

SEQ ID NO: 61267 - DNA, 20 bp, Artificial Sequence
  Description of Artificial Sequence: Synthetic oligonucleotide
  Target: ATXN1; (-) strand; PAM type: NRG; PAM sequence: GAG
catcctcagacttgaatgag

SEQ ID NO: 61268 - DNA, 20 bp, Artificial Sequence
  Description of Artificial Sequence: Synthetic oligonucleotide
  Target: ATXN1; (-) strand; PAM type: NRG; PAM sequence: AGG
ttcatcctcagacttgaatg

SEQ ID NO: 61269 - DNA, 20 bp, Artificial Sequence
  Description of Artificial Sequence: Synthetic oligonucleotide
  Target: ATXN1; (-) strand; PAM type: NRG; PAM sequence: GAG
tttcatcctcagacttgaat

SEQ ID NO: 61270 - DNA, 20 bp, Artificial Sequence
  Description of Artificial Sequence: Synthetic oligonucleotide
  Target: ATXN1; (-) strand; PAM type: NRG; PAM sequence: CAG
atcagggaagctttcatcct

SEQ ID NO: 61271 - DNA, 20 bp, Artificial Sequence
  Description of Artificial Sequence: Synthetic oligonucleotide
  Target: ATXN1; (-) strand; PAM type: NRG; PAM sequence: AAG
ggcatcttctgggatcaggg

SEQ ID NO: 61272 - DNA, 20 bp, Artificial Sequence
  Description of Artificial Sequence: Synthetic oligonucleotide
  Target: ATXN1; (-) strand; PAM type: NRG; PAM sequence: GGG
catggcatcttctgggatca

SEQ ID NO: 61273 - DNA, 20 bp, Artificial Sequence
  Description of Artificial Sequence: Synthetic oligonucleotide
  Target: ATXN1; (-) strand; PAM type: NRG; PAM sequence: AGG
gcatggcatcttctgggatc

SEQ ID NO: 61274 - DNA, 20 bp, Artificial Sequence
  Description of Artificial Sequence: Synthetic oligonucleotide
  Target: ATXN1; (-) strand; PAM type: NRG; PAM sequence: CAG
agcatggcatcttctgggat

SEQ ID NO: 61275 - DNA, 20 bp, Artificial Sequence
  Description of Artificial Sequence: Synthetic oligonucleotide
  Target: ATXN1; (-) strand; PAM type: NRG; PAM sequence: GGG
agaccagcatggcatcttct

SEQ ID NO: 61276 - DNA, 20 bp, Artificial Sequence
  Description of Artificial Sequence: Synthetic oligonucleotide
  Target: ATXN1; (-) strand; PAM type: NRG; PAM sequence: TGG
cagaccagcatggcatcttc

SEQ ID NO: 61277 - DNA, 20 bp, Artificial Sequence
  Description of Artificial Sequence: Synthetic oligonucleotide
  Target: ATXN1; (-) strand; PAM type: NRG; PAM sequence: TGG
gccatggatgcagaccagca

SEQ ID NO: 61278 - DNA, 20 bp, Artificial Sequence
  Description of Artificial Sequence: Synthetic oligonucleotide
  Target: ATXN1; (-) strand; PAM type: NRG; PAM sequence: CAG
aggttgccatggatgcagac

SEQ ID NO: 61279 - DNA, 20 bp, Artificial Sequence
  Description of Artificial Sequence: Synthetic oligonucleotide
  Target: ATXN1; (-) strand; PAM type: NRG; PAM sequence: CAG
cccacaggttgccatggatg

SEQ ID NO: 61280 - DNA, 20 bp, Artificial Sequence
  Description of Artificial Sequence: Synthetic oligonucleotide
  Target: ATXN1; (-) strand; PAM type: NRG; PAM sequence: TGG
atggtacccacaggttgcca

SEQ ID NO: 61281 - DNA, 20 bp, Artificial Sequence
  Description of Artificial Sequence: Synthetic oligonucleotide
  Target: ATXN1; (-) strand; PAM type: NRG; PAM sequence: AGG
tctctcctaatggtacccac

SEQ ID NO: 61282 - DNA, 20 bp, Artificial Sequence
  Description of Artificial Sequence: Synthetic oligonucleotide
  Target: ATXN1; (-) strand; PAM type: NRG; PAM sequence: CAG
ctctctcctaatggtaccca

SEQ ID NO: 61283 - DNA, 20 bp, Artificial Sequence
  Description of Artificial Sequence: Synthetic oligonucleotide
  Target: ATXN1; (-) strand; PAM type: NRG; PAM sequence: TGG
catgaccagctctctcctaa

SEQ ID NO: 61284 - DNA, 20 bp, Artificial Sequence
  Description of Artificial Sequence: Synthetic oligonucleotide
  Target: ATXN1; (-) strand; PAM type: NRG; PAM sequence: CAG
caattcctttacaccatgac

SEQ ID NO: 61285 - DNA, 20 bp, Artificial Sequence
  Description of Artificial Sequence: Synthetic oligonucleotide
  Target: ATXN1; (-) strand; PAM type: NRG; PAM sequence: AGG
ggggaaagaaatgagaaaac

SEQ ID NO: 61286 - DNA, 20 bp, Artificial Sequence
  Description of Artificial Sequence: Synthetic oligonucleotide
  Target: ATXN1; (-) strand; PAM type: NRG; PAM sequence: CAG
tggggaaagaaatgagaaaa

SEQ ID NO: 61287 - DNA, 20 bp, Artificial Sequence
  Description of Artificial Sequence: Synthetic oligonucleotide
  Target: ATXN1; (-) strand; PAM type: NRG; PAM sequence: GAG
cagtcactggggaaagaaat

SEQ ID NO: 61288 - DNA, 20 bp, Artificial Sequence
  Description of Artificial Sequence: Synthetic oligonucleotide
  Target: ATXN1; (-) strand; PAM type: NRG; PAM sequence: AAG
gagctttcagtcactgggga

SEQ ID NO: 61289 - DNA, 20 bp, Artificial Sequence
  Description of Artificial Sequence: Synthetic oligonucleotide
  Target: ATXN1; (-) strand; PAM type: NRG; PAM sequence: GGG
aaaggagctttcagtcactg

SEQ ID NO: 61290 - DNA, 20 bp, Artificial Sequence
  Description of Artificial Sequence: Synthetic oligonucleotide
  Target: ATXN1; (-) strand; PAM type: NRG; PAM sequence: GGG
taaaggagctttcagtcact

SEQ ID NO: 61291 - DNA, 20 bp, Artificial Sequence
  Description of Artificial Sequence: Synthetic oligonucleotide
  Target: ATXN1; (-) strand; PAM type: NRG; PAM sequence: TGG
ttaaaggagctttcagtcac

SEQ ID NO: 61292 - DNA, 20 bp, Artificial Sequence
  Description of Artificial Sequence: Synthetic oligonucleotide
  Target: ATXN1; (-) strand; PAM type: NRG; PAM sequence: CAG
acagtagttaaaggagcttt

SEQ ID NO: 61293 - DNA, 20 bp, Artificial Sequence
  Description of Artificial Sequence: Synthetic oligonucleotide
  Target: ATXN1; (-) strand; PAM type: NRG; PAM sequence: GAG
ggcacctacagtagttaaag

SEQ ID NO: 61294 - DNA, 20 bp, Artificial Sequence
  Description of Artificial Sequence: Synthetic oligonucleotide
  Target: ATXN1; (-) strand; PAM type: NRG; PAM sequence: AGG
taggcacctacagtagttaa

SEQ ID NO: 61295 - DNA, 20 bp, Artificial Sequence
  Description of Artificial Sequence: Synthetic oligonucleotide
  Target: ATXN1; (-) strand; PAM type: NRG; PAM sequence: AAG
ctaggcacctacagtagtta

SEQ ID NO: 61296 - DNA, 20 bp, Artificial Sequence
  Description of Artificial Sequence: Synthetic oligonucleotide
  Target: ATXN1; (-) strand; PAM type: NRG; PAM sequence: TAG
tacaggctaggcacctacag

SEQ ID NO: 61297 - DNA, 20 bp, Artificial Sequence
  Description of Artificial Sequence: Synthetic oligonucleotide
  Target: ATXN1; (-) strand; PAM type: NRG; PAM sequence: CAG
tgctacaggctaggcaccta

SEQ ID NO: 61298 - DNA, 20 bp, Artificial Sequence
  Description of Artificial Sequence: Synthetic oligonucleotide
  Target: ATXN1; (-) strand; PAM type: NRG; PAM sequence: AGG
acacacatatgctacaggct

SEQ ID NO: 61299 - DNA, 20 bp, Artificial Sequence
  Description of Artificial Sequence: Synthetic oligonucleotide
  Target: ATXN1; (-) strand; PAM type: NRG; PAM sequence: TAG
cacacacatatgctacaggc

SEQ ID NO: 61300 - DNA, 20 bp, Artificial Sequence
  Description of Artificial Sequence: Synthetic oligonucleotide
  Target: ATXN1; (-) strand; PAM type: NRG; PAM sequence: AGG
tatgcacacacatatgctac

SEQ ID NO: 61301 - DNA, 20 bp, Artificial Sequence
  Description of Artificial Sequence: Synthetic oligonucleotide
  Target: ATXN1; (-) strand; PAM type: NRG; PAM sequence: CAG
gtatgcacacacatatgcta

SEQ ID NO: 61302 - DNA, 20 bp, Artificial Sequence
  Description of Artificial Sequence: Synthetic oligonucleotide
  Target: ATXN1; (-) strand; PAM type: NRG; PAM sequence: GAG
tatttacagaaagagagaga

SEQ ID NO: 61303 - DNA, 20 bp, Artificial Sequence
  Description of Artificial Sequence: Synthetic oligonucleotide
  Target: ATXN1; (-) strand; PAM type: NRG; PAM sequence: GAG
aatatttacagaaagagaga

SEQ ID NO: 61304 - DNA, 20 bp, Artificial Sequence
  Description of Artificial Sequence: Synthetic oligonucleotide
  Target: ATXN1; (-) strand; PAM type: NRG; PAM sequence: GAG
caaatatttacagaaagaga

SEQ ID NO: 61305 - DNA, 20 bp, Artificial Sequence
  Description of Artificial Sequence: Synthetic oligonucleotide
  Target: ATXN1; (-) strand; PAM type: NRG; PAM sequence: GAG
agcaaatatttacagaaaga

SEQ ID NO: 61306 - DNA, 20 bp, Artificial Sequence
  Description of Artificial Sequence: Synthetic oligonucleotide
  Target: ATXN1; (-) strand; PAM type: NRG; PAM sequence: GAG
tcagcaaatatttacagaaa

SEQ ID NO: 61307 - DNA, 20 bp, Artificial Sequence
  Description of Artificial Sequence: Synthetic oligonucleotide
  Target: ATXN1; (-) strand; PAM type: NRG; PAM sequence: AAG
tttcagcaaatatttacaga

SEQ ID NO: 61308 - DNA, 20 bp, Artificial Sequence
  Description of Artificial Sequence: Synthetic oligonucleotide
  Target: ATXN1; (-) strand; PAM type: NRG; PAM sequence: CAG
cttctttcagcaaatattta

SEQ ID NO: 61309 - DNA, 20 bp, Artificial Sequence
  Description of Artificial Sequence: Synthetic oligonucleotide
  Target: ATXN1; (-) strand; PAM type: NRG; PAM sequence: CAG
tacattcttgtatcttcttt

SEQ ID NO: 61310 - DNA, 20 bp, Artificial Sequence
  Description of Artificial Sequence: Synthetic oligonucleotide
  Target: ATXN1; (-) strand; PAM type: NRG; PAM sequence: TGG
gatagaagaaagcctgaaga

SEQ ID NO: 61311 - DNA, 20 bp, Artificial Sequence
  Description of Artificial Sequence: Synthetic oligonucleotide
  Target: ATXN1; (-) strand; PAM type: NRG; PAM sequence: AAG
ttaggatagaagaaagcctg

SEQ ID NO: 61312 - DNA, 20 bp, Artificial Sequence
  Description of Artificial Sequence: Synthetic oligonucleotide
  Target: ATXN1; (-) strand; PAM type: NRG; PAM sequence: AAG
ttgaaatttaggatagaaga

SEQ ID NO: 61313 - DNA, 20 bp, Artificial Sequence
  Description of Artificial Sequence: Synthetic oligonucleotide
  Target: ATXN1; (-) strand; PAM type: NRG; PAM sequence: AAG
ttctttgaaatttaggatag

SEQ ID NO: 61314 - DNA, 20 bp, Artificial Sequence
  Description of Artificial Sequence: Synthetic oligonucleotide
  Target: ATXN1; (-) strand; PAM type: NRG; PAM sequence: TAG
taattctttgaaatttagga

SEQ ID NO: 61315 - DNA, 20 bp, Artificial Sequence
  Description of Artificial Sequence: Synthetic oligonucleotide
  Target: ATXN1; (-) strand; PAM type: NRG; PAM sequence: AGG
agtctaattctttgaaattt

SEQ ID NO: 61316 - DNA, 20 bp, Artificial Sequence
  Description of Artificial Sequence: Synthetic oligonucleotide
  Target: ATXN1; (-) strand; PAM type: NRG; PAM sequence: TAG
tagtctaattctttgaaatt

SEQ ID NO: 61317 - DNA, 20 bp, Artificial Sequence
  Description of Artificial Sequence: Synthetic oligonucleotide
  Target: ATXN1; (-) strand; PAM type: NRG; PAM sequence: TAG
ggtgataggtaaaaacagtc

SEQ ID NO: 61318 - DNA, 20 bp, Artificial Sequence
  Description of Artificial Sequence: Synthetic oligonucleotide
  Target: ATXN1; (-) strand; PAM type: NRG; PAM sequence: CAG
taggtggtgataggtaaaaa

SEQ ID NO: 61319 - DNA, 20 bp, Artificial Sequence
  Description of Artificial Sequence: Synthetic oligonucleotide
  Target: ATXN1; (-) strand; PAM type: NRG; PAM sequence: AGG
taccgtgtctaggtggtgat

SEQ ID NO: 61320 - DNA, 20 bp, Artificial Sequence
  Description of Artificial Sequence: Synthetic oligonucleotide
  Target: ATXN1; (-) strand; PAM type: NRG; PAM sequence: TAG
ttaccgtgtctaggtggtga

SEQ ID NO: 61321 - DNA, 20 bp, Artificial Sequence
  Description of Artificial Sequence: Synthetic oligonucleotide
  Target: ATXN1; (-) strand; PAM type: NRG; PAM sequence: TGG
atgtggttaccgtgtctagg

SEQ ID NO: 61322 - DNA, 20 bp, Artificial Sequence
  Description of Artificial Sequence: Synthetic oligonucleotide
  Target: ATXN1; (-) strand; PAM type: NRG; PAM sequence: AGG
ttgatgtggttaccgtgtct

SEQ ID NO: 61323 - DNA, 20 bp, Artificial Sequence
  Description of Artificial Sequence: Synthetic oligonucleotide
  Target: ATXN1; (-) strand; PAM type: NRG; PAM sequence: TAG
tttgatgtggttaccgtgtc

SEQ ID NO: 61324 - DNA, 20 bp, Artificial Sequence
  Description of Artificial Sequence: Synthetic oligonucleotide
  Target: ATXN1; (-) strand; PAM type: NRG; PAM sequence: TGG
cattaaaatacattttgatg

SEQ ID NO: 61325 - DNA, 20 bp, Artificial Sequence
  Description of Artificial Sequence: Synthetic oligonucleotide
  Target: ATXN1; (-) strand; PAM type: NRG; PAM sequence: AAG
atatgagtagaactctgaaa

SEQ ID NO: 61326 - DNA, 20 bp, Artificial Sequence
  Description of Artificial Sequence: Synthetic oligonucleotide
  Target: ATXN1; (-) strand; PAM type: NRG; PAM sequence: TAG
ccaaaggctgttgatatgag

SEQ ID NO: 61327 - DNA, 20 bp, Artificial Sequence
  Description of Artificial Sequence: Synthetic oligonucleotide
  Target: ATXN1; (-) strand; PAM type: NRG; PAM sequence: GAG
ttcccaaaggctgttgatat

SEQ ID NO: 61328 - DNA, 20 bp, Artificial Sequence
  Description of Artificial Sequence: Synthetic oligonucleotide
  Target: ATXN1; (-) strand; PAM type: NRG; PAM sequence: AGG
aggagtagggagattcccaa

SEQ ID NO: 61329 - DNA, 20 bp, Artificial Sequence
  Description of Artificial Sequence: Synthetic oligonucleotide
  Target: ATXN1; (-) strand; PAM type: NRG; PAM sequence: AAG
aaggagtagggagattccca

SEQ ID NO: 61330 - DNA, 20 bp, Artificial Sequence
  Description of Artificial Sequence: Synthetic oligonucleotide
  Target: ATXN1; (-) strand; PAM type: NRG; PAM sequence: GAG
tcatctataaaaggagtagg

SEQ ID NO: 61331 - DNA, 20 bp, Artificial Sequence
  Description of Artificial Sequence: Synthetic oligonucleotide
  Target: ATXN1; (-) strand; PAM type: NRG; PAM sequence: GGG
tctcatctataaaaggagta

SEQ ID NO: 61332 - DNA, 20 bp, Artificial Sequence
  Description of Artificial Sequence: Synthetic oligonucleotide
  Target: ATXN1; (-) strand; PAM type: NRG; PAM sequence: AGG
gtctcatctataaaaggagt

SEQ ID NO: 61333 - DNA, 20 bp, Artificial Sequence
  Description of Artificial Sequence: Synthetic oligonucleotide
  Target: ATXN1; (-) strand; PAM type: NRG; PAM sequence: TAG
agtctcatctataaaaggag

SEQ ID NO: 61334 - DNA, 20 bp, Artificial Sequence
  Description of Artificial Sequence: Synthetic oligonucleotide
  Target: ATXN1; (-) strand; PAM type: NRG; PAM sequence: GAG
aatagtctcatctataaaag

SEQ ID NO: 61335 - DNA, 20 bp, Artificial Sequence
  Description of Artificial Sequence: Synthetic oligonucleotide
  Target: ATXN1; (-) strand; PAM type: NRG; PAM sequence: AGG
ataatagtctcatctataaa

SEQ ID NO: 61336 - DNA, 20 bp, Artificial Sequence
  Description of Artificial Sequence: Synthetic oligonucleotide
  Target: ATXN1; (-) strand; PAM type: NRG; PAM sequence: AAG
tataatagtctcatctataa

SEQ ID NO: 61337 - DNA, 20 bp, Artificial Sequence
  Description of Artificial Sequence: Synthetic oligonucleotide
  Target: ATXN1; (-) strand; PAM type: NRG; PAM sequence: TAG
agtgagtttggaaactataa

SEQ ID NO: 61338 - DNA, 20 bp, Artificial Sequence
  Description of Artificial Sequence: Synthetic oligonucleotide
  Target: ATXN1; (-) strand; PAM type: NRG; PAM sequence: TGG
actgaaaggcacagtgagtt

SEQ ID NO: 61339 - DNA, 20 bp, Artificial Sequence
  Description of Artificial Sequence: Synthetic oligonucleotide
  Target: ATXN1; (-) strand; PAM type: NRG; PAM sequence: GAG
gtcaaactgaaaggcacagt

SEQ ID NO: 61340 - DNA, 20 bp, Artificial Sequence
  Description of Artificial Sequence: Synthetic oligonucleotide
  Target: ATXN1; (-) strand; PAM type: NRG; PAM sequence: CAG
attagtcaaactgaaaggca

SEQ ID NO: 61341 - DNA, 20 bp, Artificial Sequence
  Description of Artificial Sequence: Synthetic oligonucleotide
  Target: ATXN1; (-) strand; PAM type: NRG; PAM sequence: AGG
atagtattagtcaaactgaa

SEQ ID NO: 61342 - DNA, 20 bp, Artificial Sequence
  Description of Artificial Sequence: Synthetic oligonucleotide
  Target: ATXN1; (-) strand; PAM type: NRG; PAM sequence: AAG
tatagtattagtcaaactga

SEQ ID NO: 61343 - DNA, 20 bp, Artificial Sequence
  Description of Artificial Sequence: Synthetic oligonucleotide
  Target: ATXN1; (-) strand; PAM type: NRG; PAM sequence: TAG
ttaggtgaattttatagtat

SEQ ID NO: 61344 - DNA, 20 bp, Artificial Sequence
  Description of Artificial Sequence: Synthetic oligonucleotide
  Target: ATXN1; (-) strand; PAM type: NRG; PAM sequence: TAG
ggaattttaggtgaatttta

SEQ ID NO: 61345 - DNA, 20 bp, Artificial Sequence
  Description of Artificial Sequence: Synthetic oligonucleotide
  Target: ATXN1; (-) strand; PAM type: NRG; PAM sequence: AGG
ctgagggcccttggaatttt

SEQ ID NO: 61346 - DNA, 20 bp, Artificial Sequence
  Description of Artificial Sequence: Synthetic oligonucleotide
  Target: ATXN1; (-) strand; PAM type: NRG; PAM sequence: TAG
gctgagggcccttggaattt

SEQ ID NO: 61347 - DNA, 20 bp, Artificial Sequence
  Description of Artificial Sequence: Synthetic oligonucleotide
  Target: ATXN1; (-) strand; PAM type: NRG; PAM sequence: TGG
gtgcatatgctgagggccct

SEQ ID NO: 61348 - DNA, 20 bp, Artificial Sequence
  Description of Artificial Sequence: Synthetic oligonucleotide
  Target: ATXN1; (-) strand; PAM type: NRG; PAM sequence: GGG
tatccatgtgcatatgctga

SEQ ID NO: 61349 - DNA, 20 bp, Artificial Sequence
  Description of Artificial Sequence: Synthetic oligonucleotide
  Target: ATXN1; (-) strand; PAM type: NRG; PAM sequence: AGG
ttatccatgtgcatatgctg

SEQ ID NO: 61350 - DNA, 20 bp, Artificial Sequence
  Description of Artificial Sequence: Synthetic oligonucleotide
  Target: ATXN1; (-) strand; PAM type: NRG; PAM sequence: GAG
attatccatgtgcatatgct

SEQ ID NO: 61351 - DNA, 20 bp, Artificial Sequence
  Description of Artificial Sequence: Synthetic oligonucleotide
  Target: ATXN1; (-) strand; PAM type: NRG; PAM sequence: CAG
agtgaaggtgacacatttgt

SEQ ID NO: 61352 - DNA, 20 bp, Artificial Sequence
  Description of Artificial Sequence: Synthetic oligonucleotide
  Target: ATXN1; (-) strand; PAM type: NRG; PAM sequence: AGG
tagaataattatgacagtga

SEQ ID NO: 61353 - DNA, 20 bp, Artificial Sequence
  Description of Artificial Sequence: Synthetic oligonucleotide
  Target: ATXN1; (-) strand; PAM type: NRG; PAM sequence: AAG
gtagaataattatgacagtg

SEQ ID NO: 61354 - DNA, 20 bp, Artificial Sequence
  Description of Artificial Sequence: Synthetic oligonucleotide
  Target: ATXN1; (-) strand; PAM type: NRG; PAM sequence: CAG
atatagtagaataattatga

SEQ ID NO: 61355 - DNA, 20 bp, Artificial Sequence
  Description of Artificial Sequence: Synthetic oligonucleotide
  Target: ATXN1; (-) strand; PAM type: NRG; PAM sequence: TAG
cttccttgacatgtatatag

SEQ ID NO: 61356 - DNA, 20 bp, Artificial Sequence
  Description of Artificial Sequence: Synthetic oligonucleotide
  Target: ATXN1; (-) strand; PAM type: NRG; PAM sequence: TAG
ctgcttccttgacatgtata

SEQ ID NO: 61357 - DNA, 20 bp, Artificial Sequence
  Description of Artificial Sequence: Synthetic oligonucleotide
  Target: ATXN1; (-) strand; PAM type: NRG; PAM sequence: AAG
gaattcggttatgtattgtt

SEQ ID NO: 61358 - DNA, 20 bp, Artificial Sequence
  Description of Artificial Sequence: Synthetic oligonucleotide
  Target: ATXN1; (-) strand; PAM type: NRG; PAM sequence: CGG
cattacactgacagtgaatt

SEQ ID NO: 61359 - DNA, 20 bp, Artificial Sequence
  Description of Artificial Sequence: Synthetic oligonucleotide
  Target: ATXN1; (-) strand; PAM type: NRG; PAM sequence: CAG
tgtcattgtcattacactga

SEQ ID NO: 61360 - DNA, 20 bp, Artificial Sequence
  Description of Artificial Sequence: Synthetic oligonucleotide
  Target: ATXN1; (-) strand; PAM type: NRG; PAM sequence: GAG
agacatttctgctataatag

SEQ ID NO: 61361 - DNA, 20 bp, Artificial Sequence
  Description of Artificial Sequence: Synthetic oligonucleotide
  Target: ATXN1; (-) strand; PAM type: NRG; PAM sequence: AGG
agagacatttctgctataat

SEQ ID NO: 61362 - DNA, 20 bp, Artificial Sequence
  Description of Artificial Sequence: Synthetic oligonucleotide
  Target: ATXN1; (-) strand; PAM type: NRG; PAM sequence: TAG
tagagacatttctgctataa

SEQ ID NO: 61363 - DNA, 20 bp, Artificial Sequence
  Description of Artificial Sequence: Synthetic oligonucleotide
  Target: ATXN1; (-) strand; PAM type: NRG; PAM sequence: GAG
ttgctcatctctttgttgta

SEQ ID NO: 61364 - DNA, 20 bp, Artificial Sequence
  Description of Artificial Sequence: Synthetic oligonucleotide
  Target: ATXN1; (-) strand; PAM type: NRG; PAM sequence: TAG
acttgctcatctctttgttg

SEQ ID NO: 61365 - DNA, 20 bp, Artificial Sequence
  Description of Artificial Sequence: Synthetic oligonucleotide
  Target: ATXN1; (-) strand; PAM type: NRG; PAM sequence: CAG
tgctgaagtgaacaggtgag

SEQ ID NO: 61366 - DNA, 20 bp, Artificial Sequence
  Description of Artificial Sequence: Synthetic oligonucleotide
  Target: ATXN1; (-) strand; PAM type: NRG; PAM sequence: GAG
cgttgctgaagtgaacaggt

SEQ ID NO: 61367 - DNA, 20 bp, Artificial Sequence
  Description of Artificial Sequence: Synthetic oligonucleotide
  Target: ATXN1; (-) strand; PAM type: NRG; PAM sequence: AGG
gatgcgttgctgaagtgaac

SEQ ID NO: 61368 - DNA, 20 bp, Artificial Sequence
  Description of Artificial Sequence: Synthetic oligonucleotide
  Target: ATXN1; (-) strand; PAM type: NRG; PAM sequence: CAG
tgatgcgttgctgaagtgaa

SEQ ID NO: 61369 - DNA, 20 bp, Artificial Sequence
  Description of Artificial Sequence: Synthetic oligonucleotide
  Target: ATXN1; (-) strand; PAM type: NRG; PAM sequence: AAG
tctatcatgatgcgttgctg

SEQ ID NO: 61370 - DNA, 20 bp, Artificial Sequence
  Description of Artificial Sequence: Synthetic oligonucleotide
  Target: ATXN1; (-) strand; PAM type: NRG; PAM sequence: CAG
ttgctccctaataactgtgg

SEQ ID NO: 61371 - DNA, 20 bp, Artificial Sequence
  Description of Artificial Sequence: Synthetic oligonucleotide
  Target: ATXN1; (-) strand; PAM type: NRG; PAM sequence: TGG
tgattgctccctaataactg

SEQ ID NO: 61372 - DNA, 20 bp, Artificial Sequence
  Description of Artificial Sequence: Synthetic oligonucleotide
  Target: ATXN1; (-) strand; PAM type: NRG; PAM sequence: CAG
agtctgttaagtttttagcc

SEQ ID NO: 61373 - DNA, 20 bp, Artificial Sequence
  Description of Artificial Sequence: Synthetic oligonucleotide
  Target: ATXN1; (-) strand; PAM type: NRG; PAM sequence: TAG
gataaagtctgttaagtttt

SEQ ID NO: 61374 - DNA, 20 bp, Artificial Sequence
  Description of Artificial Sequence: Synthetic oligonucleotide
  Target: ATXN1; (-) strand; PAM type: NRG; PAM sequence: AAG
taaatgcgataaagtctgtt

SEQ ID NO: 61375 - DNA, 20 bp, Artificial Sequence
  Description of Artificial Sequence: Synthetic oligonucleotide
  Target: ATXN1; (-) strand; PAM type: NRG; PAM sequence: AAG
taagagagttaaatgcgata

SEQ ID NO: 61376 - DNA, 20 bp, Artificial Sequence
  Description of Artificial Sequence: Synthetic oligonucleotide
  Target: ATXN1; (-) strand; PAM type: NRG; PAM sequence: GAG
accctgatgacctgttaaga

SEQ ID NO: 61377 - DNA, 20 bp, Artificial Sequence
  Description of Artificial Sequence: Synthetic oligonucleotide
  Target: ATXN1; (-) strand; PAM type: NRG; PAM sequence: GAG
ctaccctgatgacctgttaa

SEQ ID NO: 61378 - DNA, 20 bp, Artificial Sequence
  Description of Artificial Sequence: Synthetic oligonucleotide
  Target: ATXN1; (-) strand; PAM type: NRG; PAM sequence: AAG
acctaccctgatgacctgtt

SEQ ID NO: 61379 - DNA, 20 bp, Artificial Sequence
  Description of Artificial Sequence: Synthetic oligonucleotide
  Target: ATXN1; (-) strand; PAM type: NRG; PAM sequence: AGG
atttacttcatctataaaga

SEQ ID NO: 61380 - DNA, 20 bp, Artificial Sequence
  Description of Artificial Sequence: Synthetic oligonucleotide
  Target: ATXN1; (-) strand; PAM type: NRG; PAM sequence: AAG
tatttacttcatctataaag

SEQ ID NO: 61381 - DNA, 20 bp, Artificial Sequence
  Description of Artificial Sequence: Synthetic oligonucleotide
  Target: ATXN1; (-) strand; PAM type: NRG; PAM sequence: AAG
ccttatttacttcatctata

SEQ ID NO: 61382 - DNA, 20 bp, Artificial Sequence
  Description of Artificial Sequence: Synthetic oligonucleotide
  Target: ATXN1; (-) strand; PAM type: NRG; PAM sequence: GAG
ggaaattgcccaacttctct

SEQ ID NO: 61383 - DNA, 20 bp, Artificial Sequence
  Description of Artificial Sequence: Synthetic oligonucleotide
  Target: ATXN1; (-) strand; PAM type: NRG; PAM sequence: GGG
ccagtagctgtgtgtccttt

SEQ ID NO: 61384 - DNA, 20 bp, Artificial Sequence
  Description of Artificial Sequence: Synthetic oligonucleotide
  Target: ATXN1; (-) strand; PAM type: NRG; PAM sequence: TGG
cccagtagctgtgtgtcctt

SEQ ID NO: 61385 - DNA, 20 bp, Artificial Sequence
  Description of Artificial Sequence: Synthetic oligonucleotide
  Target: ATXN1; (-) strand; PAM type: NRG; PAM sequence: TAG
atttcagacctgccacccag

SEQ ID NO: 61386 - DNA, 20 bp, Artificial Sequence
  Description of Artificial Sequence: Synthetic oligonucleotide
  Target: ATXN1; (-) strand; PAM type: NRG; PAM sequence: CAG
cagatttcagacctgccacc

SEQ ID NO: 61387 - DNA, 20 bp, Artificial Sequence
  Description of Artificial Sequence: Synthetic oligonucleotide
  Target: ATXN1; (-) strand; PAM type: NRG; PAM sequence: CAG
tcacatttgggttcagattt

SEQ ID NO: 61388 - DNA, 20 bp, Artificial Sequence
  Description of Artificial Sequence: Synthetic oligonucleotide
  Target: ATXN1; (-) strand; PAM type: NRG; PAM sequence: CAG
ctttgaatcacatttgggtt

SEQ ID NO: 61389 - DNA, 20 bp, Artificial Sequence
  Description of Artificial Sequence: Synthetic oligonucleotide
  Target: ATXN1; (-) strand; PAM type: NRG; PAM sequence: GGG
agactctttgaatcacattt

SEQ ID NO: 61390 - DNA, 20 bp, Artificial Sequence
  Description of Artificial Sequence: Synthetic oligonucleotide
  Target: ATXN1; (-) strand; PAM type: NRG; PAM sequence: TGG
gagactctttgaatcacatt

SEQ ID NO: 61391 - DNA, 20 bp, Artificial Sequence
  Description of Artificial Sequence: Synthetic oligonucleotide
  Target: ATXN1; (-) strand; PAM type: NRG; PAM sequence: GAG
taaagtattagttcatataa

SEQ ID NO: 61392 - DNA, 20 bp, Artificial Sequence
  Description of Artificial Sequence: Synthetic oligonucleotide
  Target: ATXN1; (-) strand; PAM type: NRG; PAM sequence: AAG
tttaaagtattagttcatat

SEQ ID NO: 61393 - DNA, 20 bp, Artificial Sequence
  Description of Artificial Sequence: Synthetic oligonucleotide
  Target: ATXN1; (-) strand; PAM type: NRG; PAM sequence: TAG
cagcatcagatttaaagtat

SEQ ID NO: 61394 - DNA, 20 bp, Artificial Sequence
  Description of Artificial Sequence: Synthetic oligonucleotide
  Target: ATXN1; (-) strand; PAM type: NRG; PAM sequence: AAG
acttaacagcatcagattta

SEQ ID NO: 61395 - DNA, 20 bp, Artificial Sequence
  Description of Artificial Sequence: Synthetic oligonucleotide
  Target: ATXN1; (-) strand; PAM type: NRG; PAM sequence: CAG
tcactgccacttaacagcat

SEQ ID NO: 61396 - DNA, 20 bp, Artificial Sequence
  Description of Artificial Sequence: Synthetic oligonucleotide
  Target: ATXN1; (-) strand; PAM type: NRG; PAM sequence: CAG
tcattatcactgccacttaa

SEQ ID NO: 61397 - DNA, 20 bp, Artificial Sequence
  Description of Artificial Sequence: Synthetic oligonucleotide
  Target: ATXN1; (-) strand; PAM type: NRG; PAM sequence: AAG
atttccttatcttccaaagg

SEQ ID NO: 61398 - DNA, 20 bp, Artificial Sequence
  Description of Artificial Sequence: Synthetic oligonucleotide
  Target: ATXN1; (-) strand; PAM type: NRG; PAM sequence: AGG
tctatttccttatcttccaa

SEQ ID NO: 61399 - DNA, 20 bp, Artificial Sequence
  Description of Artificial Sequence: Synthetic oligonucleotide
  Target: ATXN1; (-) strand; PAM type: NRG; PAM sequence: AAG
ctctatttccttatcttcca

SEQ ID NO: 61400 - DNA, 20 bp, Artificial Sequence
  Description of Artificial Sequence: Synthetic oligonucleotide
  Target: ATXN1; (-) strand; PAM type: NRG; PAM sequence: GGG
tggcaagctactctctatct

SEQ ID NO: 61401 - DNA, 20 bp, Artificial Sequence
  Description of Artificial Sequence: Synthetic oligonucleotide
  Target: ATXN1; (-) strand; PAM type: NRG; PAM sequence: TGG
gtggcaagctactctctatc

SEQ ID NO: 61402 - DNA, 20 bp, Artificial Sequence
  Description of Artificial Sequence: Synthetic oligonucleotide
  Target: ATXN1; (-) strand; PAM type: NRG; PAM sequence: AAG
tgcccttttagaccagtggc

SEQ ID NO: 61403 - DNA, 20 bp, Artificial Sequence
  Description of Artificial Sequence: Synthetic oligonucleotide
  Target: ATXN1; (-) strand; PAM type: NRG; PAM sequence: TGG
tccctgcccttttagaccag

SEQ ID NO: 61404 - DNA, 20 bp, Artificial Sequence
  Description of Artificial Sequence: Synthetic oligonucleotide
  Target: ATXN1; (-) strand; PAM type: NRG; PAM sequence: CAG
ccatccctgcccttttagac

SEQ ID NO: 61405 - DNA, 20 bp, Artificial Sequence
  Description of Artificial Sequence: Synthetic oligonucleotide
  Target: ATXN1; (-) strand; PAM type: NRG; PAM sequence: TAG
tcttcccatccctgcccttt

SEQ ID NO: 61406 - DNA, 20 bp, Artificial Sequence
  Description of Artificial Sequence: Synthetic oligonucleotide
  Target: ATXN1; (-) strand; PAM type: NRG; PAM sequence: GGG
caggctaagaagggacacct

SEQ ID NO: 61407 - DNA, 20 bp, Artificial Sequence
  Description of Artificial Sequence: Synthetic oligonucleotide
  Target: ATXN1; (-) strand; PAM type: NRG; PAM sequence: TGG
tcaggctaagaagggacacc

SEQ ID NO: 61408 - DNA, 20 bp, Artificial Sequence
  Description of Artificial Sequence: Synthetic oligonucleotide
  Target: ATXN1; (-) strand; PAM type: NRG; PAM sequence: GGG
caggaacctcaggctaagaa

SEQ ID NO: 61409 - DNA, 20 bp, Artificial Sequence
  Description of Artificial Sequence: Synthetic oligonucleotide
  Target: ATXN1; (-) strand; PAM type: NRG; PAM sequence: AGG
gcaggaacctcaggctaaga

SEQ ID NO: 61410 - DNA, 20 bp, Artificial Sequence
  Description of Artificial Sequence: Synthetic oligonucleotide
  Target: ATXN1; (-) strand; PAM type: NRG; PAM sequence: AAG
agcaggaacctcaggctaag

SEQ ID NO: 61411 - DNA, 20 bp, Artificial Sequence
  Description of Artificial Sequence: Synthetic oligonucleotide
  Target: ATXN1; (-) strand; PAM type: NRG; PAM sequence: AAG
agtagcaggaacctcaggct

SEQ ID NO: 61412 - DNA, 20 bp, Artificial Sequence
  Description of Artificial Sequence: Synthetic oligonucleotide
  Target: ATXN1; (-) strand; PAM type: NRG; PAM sequence: AGG
tgtccagtagcaggaacctc

SEQ ID NO: 61413 - DNA, 20 bp, Artificial Sequence
  Description of Artificial Sequence: Synthetic oligonucleotide
  Target: ATXN1; (-) strand; PAM type: NRG; PAM sequence: CAG
ctgtccagtagcaggaacct

SEQ ID NO: 61414 - DNA, 20 bp, Artificial Sequence
  Description of Artificial Sequence: Synthetic oligonucleotide
  Target: ATXN1; (-) strand; PAM type: NRG; PAM sequence: AGG
cttgggctctgtccagtagc

SEQ ID NO: 61415 - DNA, 20 bp, Artificial Sequence
  Description of Artificial Sequence: Synthetic oligonucleotide
  Target: ATXN1; (-) strand; PAM type: NRG; PAM sequence: CAG
ccttgggctctgtccagtag

SEQ ID NO: 61416 - DNA, 20 bp, Artificial Sequence
  Description of Artificial Sequence: Synthetic oligonucleotide
  Target: ATXN1; (-) strand; PAM type: NRG; PAM sequence: TAG
acaccttgggctctgtccag

SEQ ID NO: 61417 - DNA, 20 bp, Artificial Sequence
  Description of Artificial Sequence: Synthetic oligonucleotide
  Target: ATXN1; (-) strand; PAM type: NRG; PAM sequence: CAG
gggacaccttgggctctgtc

SEQ ID NO: 61418 - DNA, 20 bp, Artificial Sequence
  Description of Artificial Sequence: Synthetic oligonucleotide
  Target: ATXN1; (-) strand; PAM type: NRG; PAM sequence: GGG
ggagaagatagggacacctt

SEQ ID NO: 61419 - DNA, 20 bp, Artificial Sequence
  Description of Artificial Sequence: Synthetic oligonucleotide
  Target: ATXN1; (-) strand; PAM type: NRG; PAM sequence: TGG
aggagaagatagggacacct

SEQ ID NO: 61420 - DNA, 20 bp, Artificial Sequence
  Description of Artificial Sequence: Synthetic oligonucleotide
  Target: ATXN1; (-) strand; PAM type: NRG; PAM sequence: GGG
taatgactaaggagaagata

SEQ ID NO: 61421 - DNA, 20 bp, Artificial Sequence
  Description of Artificial Sequence: Synthetic oligonucleotide
  Target: ATXN1; (-) strand; PAM type: NRG; PAM sequence: AGG
gtaatgactaaggagaagat

SEQ ID NO: 61422 - DNA, 20 bp, Artificial Sequence
  Description of Artificial Sequence: Synthetic oligonucleotide
  Target: ATXN1; (-) strand; PAM type: NRG; PAM sequence: TAG
agtaatgactaaggagaaga

SEQ ID NO: 61423 - DNA, 20 bp, Artificial Sequence
  Description of Artificial Sequence: Synthetic oligonucleotide
  Target: ATXN1; (-) strand; PAM type: NRG; PAM sequence: AAG
aaaaagtaatgactaaggag

SEQ ID NO: 61424 - DNA, 20 bp, Artificial Sequence
  Description of Artificial Sequence: Synthetic oligonucleotide
  Target: ATXN1; (-) strand; PAM type: NRG; PAM sequence: GAG
aaaaaaaagtaatgactaag

SEQ ID NO: 61425 - DNA, 20 bp, Artificial Sequence
  Description of Artificial Sequence: Synthetic oligonucleotide
  Target: ATXN1; (-) strand; PAM type: NRG; PAM sequence: AGG
aaaaaaaaaagtaatgacta

SEQ ID NO: 61426 - DNA, 20 bp, Artificial Sequence
  Description of Artificial Sequence: Synthetic oligonucleotide
  Target: ATXN1; (-) strand; PAM type: NRG; PAM sequence: AAG
aaaaaaaaaaagtaatgact

SEQ ID NO: 61427 - DNA, 20 bp, Artificial Sequence
  Description of Artificial Sequence: Synthetic oligonucleotide
  Target: ATXN1; (-) strand; PAM type: NRG; PAM sequence: AAG
catctcaaaaaaaaaaaaaa

SEQ ID NO: 61428 - DNA, 20 bp, Artificial Sequence
  Description of Artificial Sequence: Synthetic oligonucleotide
  Target: ATXN1; (-) strand; PAM type: NRG; PAM sequence: GAG
tccagtctgggtaacagagt

SEQ ID NO: 61429 - DNA, 20 bp, Artificial Sequence
  Description of Artificial Sequence: Synthetic oligonucleotide
  Target: ATXN1; (-) strand; PAM type: NRG; PAM sequence: GAG
gcactccagtctgggtaaca

SEQ ID NO: 61430 - DNA, 20 bp, Artificial Sequence
  Description of Artificial Sequence: Synthetic oligonucleotide
  Target: ATXN1; (-) strand; PAM type: NRG; PAM sequence: CAG
ctgcactccagtctgggtaa

SEQ ID NO: 61431 - DNA, 20 bp, Artificial Sequence
  Description of Artificial Sequence: Synthetic oligonucleotide
  Target: ATXN1; (-) strand; PAM type: NRG; PAM sequence: GGG
atgccactgcactccagtct

SEQ ID NO: 61432 - DNA, 20 bp, Artificial Sequence
  Description of Artificial Sequence: Synthetic oligonucleotide
  Target: ATXN1; (-) strand; PAM type: NRG; PAM sequence: TGG
catgccactgcactccagtc

SEQ ID NO: 61433 - DNA, 20 bp, Artificial Sequence
  Description of Artificial Sequence: Synthetic oligonucleotide
  Target: ATXN1; (-) strand; PAM type: NRG; PAM sequence: CAG
aagatcatgccactgcactc

SEQ ID NO: 61434 - DNA, 20 bp, Artificial Sequence
  Description of Artificial Sequence: Synthetic oligonucleotide
  Target: ATXN1; (-) strand; PAM type: NRG; PAM sequence: AAG
ggtggaggttgcagtgagcc

SEQ ID NO: 61435 - DNA, 20 bp, Artificial Sequence
  Description of Artificial Sequence: Synthetic oligonucleotide
  Target: ATXN1; (-) strand; PAM type: NRG; PAM sequence: GAG
cgggaggtggaggttgcagt

SEQ ID NO: 61436 - DNA, 20 bp, Artificial Sequence
  Description of Artificial Sequence: Synthetic oligonucleotide
  Target: ATXN1; (-) strand; PAM type: NRG; PAM sequence: CAG
gacccgggaggtggaggttg

SEQ ID NO: 61437 - DNA, 20 bp, Artificial Sequence
  Description of Artificial Sequence: Synthetic oligonucleotide
  Target: ATXN1; (-) strand; PAM type: NRG; PAM sequence: AGG
cacttggacccgggaggtgg

SEQ ID NO: 61438 - DNA, 20 bp, Artificial Sequence
  Description of Artificial Sequence: Synthetic oligonucleotide
  Target: ATXN1; (-) strand; PAM type: NRG; PAM sequence: GAG
tcacttggacccgggaggtg

SEQ ID NO: 61439 - DNA, 20 bp, Artificial Sequence
  Description of Artificial Sequence: Synthetic oligonucleotide
  Target: ATXN1; (-) strand; PAM type: NRG; PAM sequence: TGG
aatcacttggacccgggagg

SEQ ID NO: 61440 - DNA, 20 bp, Artificial Sequence
  Description of Artificial Sequence: Synthetic oligonucleotide
  Target: ATXN1; (-) strand; PAM type: NRG; PAM sequence: AGG
gagaatcacttggacccggg

SEQ ID NO: 61441 - DNA, 20 bp, Artificial Sequence
  Description of Artificial Sequence: Synthetic oligonucleotide
  Target: ATXN1; (-) strand; PAM type: NRG; PAM sequence: GAG
ggagaatcacttggacccgg

SEQ ID NO: 61442 - DNA, 20 bp, Artificial Sequence
  Description of Artificial Sequence: Synthetic oligonucleotide
  Target: ATXN1; (-) strand; PAM type: NRG; PAM sequence: GGG
caggagaatcacttggaccc

SEQ ID NO: 61443 - DNA, 20 bp, Artificial Sequence
  Description of Artificial Sequence: Synthetic oligonucleotide
  Target: ATXN1; (-) strand; PAM type: NRG; PAM sequence: CGG
gcaggagaatcacttggacc

SEQ ID NO: 61444 - DNA, 20 bp, Artificial Sequence
  Description of Artificial Sequence: Synthetic oligonucleotide
  Target: ATXN1; (-) strand; PAM type: NRG; PAM sequence: TGG
gctgaggcaggagaatcact

SEQ ID NO: 61445 - DNA, 20 bp, Artificial Sequence
  Description of Artificial Sequence: Synthetic oligonucleotide
  Target: ATXN1; (-) strand; PAM type: NRG; PAM sequence: GAG
tactcgggaggctgaggcag

SEQ ID NO: 61446 - DNA, 20 bp, Artificial Sequence
  Description of Artificial Sequence: Synthetic oligonucleotide
  Target: ATXN1; (-) strand; PAM type: NRG; PAM sequence: AGG
gctactcgggaggctgaggc

SEQ ID NO: 61447 - DNA, 20 bp, Artificial Sequence
  Description of Artificial Sequence: Synthetic oligonucleotide
  Target: ATXN1; (-) strand; PAM type: NRG; PAM sequence: CAG
agctactcgggaggctgagg

SEQ ID NO: 61448 - DNA, 20 bp, Artificial Sequence
  Description of Artificial Sequence: Synthetic oligonucleotide
  Target: ATXN1; (-) strand; PAM type: NRG; PAM sequence: AGG
cccagctactcgggaggctg

SEQ ID NO: 61449 - DNA, 20 bp, Artificial Sequence
  Description of Artificial Sequence: Synthetic oligonucleotide
  Target: ATXN1; (-) strand; PAM type: NRG; PAM sequence: GAG
tcccagctactcgggaggct

SEQ ID NO: 61450 - DNA, 20 bp, Artificial Sequence
  Description of Artificial Sequence: Synthetic oligonucleotide
  Target: ATXN1; (-) strand; PAM type: NRG; PAM sequence: AGG
tgtagtcccagctactcggg

SEQ ID NO: 61451 - DNA, 20 bp, Artificial Sequence
  Description of Artificial Sequence: Synthetic oligonucleotide
  Target: ATXN1; (-) strand; PAM type: NRG; PAM sequence: GAG
ctgtagtcccagctactcgg

SEQ ID NO: 61452 - DNA, 20 bp, Artificial Sequence
  Description of Artificial Sequence: Synthetic oligonucleotide
  Target: ATXN1; (-) strand; PAM type: NRG; PAM sequence: GGG
gcctgtagtcccagctactc

SEQ ID NO: 61453 - DNA, 20 bp, Artificial Sequence
  Description of Artificial Sequence: Synthetic oligonucleotide
  Target: ATXN1; (-) strand; PAM type: NRG; PAM sequence: CGG
tgcctgtagtcccagctact

SEQ ID NO: 61454 - DNA, 20 bp, Artificial Sequence
  Description of Artificial Sequence: Synthetic oligonucleotide
  Target: ATXN1; (-) strand; PAM type: NRG; PAM sequence: CAG
gtggtgcatgcctgtagtcc

SEQ ID NO: 61455 - DNA, 20 bp, Artificial Sequence
  Description of Artificial Sequence: Synthetic oligonucleotide
  Target: ATXN1; (-) strand; PAM type: NRG; PAM sequence: TAG
ggcatggtggtgcatgcctg

SEQ ID NO: 61456 - DNA, 20 bp, Artificial Sequence
  Description of Artificial Sequence: Synthetic oligonucleotide
  Target: ATXN1; (-) strand; PAM type: NRG; PAM sequence: TGG
ataaaattagctgggcatgg

SEQ ID NO: 61457 - DNA, 20 bp, Artificial Sequence
  Description of Artificial Sequence: Synthetic oligonucleotide
  Target: ATXN1; (-) strand; PAM type: NRG; PAM sequence: TGG
tatataaaattagctgggca

SEQ ID NO: 61458 - DNA, 20 bp, Artificial Sequence
  Description of Artificial Sequence: Synthetic oligonucleotide
  Target: ATXN1; (-) strand; PAM type: NRG; PAM sequence: GGG
aaatatatataaaattagct

SEQ ID NO: 61459 - DNA, 20 bp, Artificial Sequence
  Description of Artificial Sequence: Synthetic oligonucleotide
  Target: ATXN1; (-) strand; PAM type: NRG; PAM sequence: TGG
aaaatatatataaaattagc

SEQ ID NO: 61460 - DNA, 20 bp, Artificial Sequence
  Description of Artificial Sequence: Synthetic oligonucleotide
  Target: ATXN1; (-) strand; PAM type: NRG; PAM sequence: TAG
actaaaaatatatataaaat

SEQ ID NO: 61461 - DNA, 20 bp, Artificial Sequence
  Description of Artificial Sequence: Synthetic oligonucleotide
  Target: ATXN1; (-) strand; PAM type: NRG; PAM sequence: TGG
caagaccagcctggccaaca

SEQ ID NO: 61462 - DNA, 20 bp, Artificial Sequence
  Description of Artificial Sequence: Synthetic oligonucleotide
  Target: ATXN1; (-) strand; PAM type: NRG; PAM sequence: TGG
tcaggagttcaagaccagcc

SEQ ID NO: 61463 - DNA, 20 bp, Artificial Sequence
  Description of Artificial Sequence: Synthetic oligonucleotide
  Target: ATXN1; (-) strand; PAM type: NRG; PAM sequence: CAG
tgaggtcaggagttcaagac

SEQ ID NO: 61464 - DNA, 20 bp, Artificial Sequence
  Description of Artificial Sequence: Synthetic oligonucleotide
  Target: ATXN1; (-) strand; PAM type: NRG; PAM sequence: AAG
tcacctgaggtcaggagttc

SEQ ID NO: 61465 - DNA, 20 bp, Artificial Sequence
  Description of Artificial Sequence: Synthetic oligonucleotide
  Target: ATXN1; (-) strand; PAM type: NRG; PAM sequence: GAG
ggtggatcacctgaggtcag

SEQ ID NO: 61466 - DNA, 20 bp, Artificial Sequence
  Description of Artificial Sequence: Synthetic oligonucleotide
  Target: ATXN1; (-) strand; PAM type: NRG; PAM sequence: AGG
cgggtggatcacctgaggtc

SEQ ID NO: 61467 - DNA, 20 bp, Artificial Sequence
  Description of Artificial Sequence: Synthetic oligonucleotide
  Target: ATXN1; (-) strand; PAM type: NRG; PAM sequence: CAG
gcgggtggatcacctgaggt

SEQ ID NO: 61468 - DNA, 20 bp, Artificial Sequence
  Description of Artificial Sequence: Synthetic oligonucleotide
  Target: ATXN1; (-) strand; PAM type: NRG; PAM sequence: AGG
caaggcgggtggatcacctg

SEQ ID NO: 61469 - DNA, 20 bp, Artificial Sequence
  Description of Artificial Sequence: Synthetic oligonucleotide
  Target: ATXN1; (-) strand; PAM type: NRG; PAM sequence: GAG
ccaaggcgggtggatcacct

SEQ ID NO: 61470 - DNA, 20 bp, Artificial Sequence
  Description of Artificial Sequence: Synthetic oligonucleotide
  Target: ATXN1; (-) strand; PAM type: NRG; PAM sequence: TGG
ctttgggaagccaaggcggg

SEQ ID NO: 61471 - DNA, 20 bp, Artificial Sequence
  Description of Artificial Sequence: Synthetic oligonucleotide
  Target: ATXN1; (-) strand; PAM type: NRG; PAM sequence: GGG
gcactttgggaagccaaggc

SEQ ID NO: 61472 - DNA, 20 bp, Artificial Sequence
  Description of Artificial Sequence: Synthetic oligonucleotide
  Target: ATXN1; (-) strand; PAM type: NRG; PAM sequence: CGG
agcactttgggaagccaagg

SEQ ID NO: 61473 - DNA, 20 bp, Artificial Sequence
  Description of Artificial Sequence: Synthetic oligonucleotide
  Target: ATXN1; (-) strand; PAM type: NRG; PAM sequence: AGG
tccagcactttgggaagcca

SEQ ID NO: 61474 - DNA, 20 bp, Artificial Sequence
  Description of Artificial Sequence: Synthetic oligonucleotide
  Target: ATXN1; (-) strand; PAM type: NRG; PAM sequence: AAG
ttccagcactttgggaagcc

SEQ ID NO: 61475 - DNA, 20 bp, Artificial Sequence
  Description of Artificial Sequence: Synthetic oligonucleotide
  Target: ATXN1; (-) strand; PAM type: NRG; PAM sequence: AAG
agtaattccagcactttggg

SEQ ID NO: 61476 - DNA, 20 bp, Artificial Sequence
  Description of Artificial Sequence: Synthetic oligonucleotide
  Target: ATXN1; (-) strand; PAM type: NRG; PAM sequence: GGG
cacagtaattccagcacttt

SEQ ID NO: 61477 - DNA, 20 bp, Artificial Sequence
  Description of Artificial Sequence: Synthetic oligonucleotide
  Target: ATXN1; (-) strand; PAM type: NRG; PAM sequence: TGG
gcacagtaattccagcactt

SEQ ID NO: 61478 - DNA, 20 bp, Artificial Sequence
  Description of Artificial Sequence: Synthetic oligonucleotide
  Target: ATXN1; (-) strand; PAM type: NRG; PAM sequence: CAG
taggccaggcacagtaattc

SEQ ID NO: 61479 - DNA, 20 bp, Artificial Sequence
  Description of Artificial Sequence: Synthetic oligonucleotide
  Target: ATXN1; (-) strand; PAM type: NRG; PAM sequence: CAG
attaatgactaggccaggca

SEQ ID NO: 61480 - DNA, 20 bp, Artificial Sequence
  Description of Artificial Sequence: Synthetic oligonucleotide
  Target: ATXN1; (-) strand; PAM type: NRG; PAM sequence: AGG
aaaatattaatgactaggcc

SEQ ID NO: 61481 - DNA, 20 bp, Artificial Sequence
  Description of Artificial Sequence: Synthetic oligonucleotide
  Target: ATXN1; (-) strand; PAM type: NRG; PAM sequence: CAG
caaaatattaatgactaggc

SEQ ID NO: 61482 - DNA, 20 bp, Artificial Sequence
  Description of Artificial Sequence: Synthetic oligonucleotide
  Target: ATXN1; (-) strand; PAM type: NRG; PAM sequence: AGG
taatcaaaatattaatgact

SEQ ID NO: 61483 - DNA, 20 bp, Artificial Sequence
  Description of Artificial Sequence: Synthetic oligonucleotide
  Target: ATXN1; (-) strand; PAM type: NRG; PAM sequence: TAG
ttaatcaaaatattaatgac

SEQ ID NO: 61484 - DNA, 20 bp, Artificial Sequence
  Description of Artificial Sequence: Synthetic oligonucleotide
  Target: ATXN1; (-) strand; PAM type: NRG; PAM sequence: AGG
ttgtcgttgatcacaggggt

SEQ ID NO: 61485 - DNA, 20 bp, Artificial Sequence
  Description of Artificial Sequence: Synthetic oligonucleotide
  Target: ATXN1; (-) strand; PAM type: NRG; PAM sequence: TAG
gttgtcgttgatcacagggg

SEQ ID NO: 61486 - DNA, 20 bp, Artificial Sequence
  Description of Artificial Sequence: Synthetic oligonucleotide
  Target: ATXN1; (-) strand; PAM type: NRG; PAM sequence: GGG
taagttgtcgttgatcacag

SEQ ID NO: 61487 - DNA, 20 bp, Artificial Sequence
  Description of Artificial Sequence: Synthetic oligonucleotide
  Target: ATXN1; (-) strand; PAM type: NRG; PAM sequence: GGG
ataagttgtcgttgatcaca

SEQ ID NO: 61488 - DNA, 20 bp, Artificial Sequence
  Description of Artificial Sequence: Synthetic oligonucleotide
  Target: ATXN1; (-) strand; PAM type: NRG; PAM sequence: AGG
aataagttgtcgttgatcac

SEQ ID NO: 61489 - DNA, 20 bp, Artificial Sequence
  Description of Artificial Sequence: Synthetic oligonucleotide
  Target: ATXN1; (-) strand; PAM type: NRG; PAM sequence: CAG
gaataagttgtcgttgatca

SEQ ID NO: 61490 - DNA, 20 bp, Artificial Sequence
  Description of Artificial Sequence: Synthetic oligonucleotide
  Target: ATXN1; (-) strand; PAM type: NRG; PAM sequence: AAG
aagaacccttcttcctgaat

SEQ ID NO: 61491 - DNA, 20 bp, Artificial Sequence
  Description of Artificial Sequence: Synthetic oligonucleotide
  Target: ATXN1; (-) strand; PAM type: NRG; PAM sequence: AAG
tggaagcatactagagtaga

SEQ ID NO: 61492 - DNA, 20 bp, Artificial Sequence
  Description of Artificial Sequence: Synthetic oligonucleotide
  Target: ATXN1; (-) strand; PAM type: NRG; PAM sequence: TAG
taactggaagcatactagag

SEQ ID NO: 61493 - DNA, 20 bp, Artificial Sequence
  Description of Artificial Sequence: Synthetic oligonucleotide
  Target: ATXN1; (-) strand; PAM type: NRG; PAM sequence: GAG
aaataactggaagcatacta

SEQ ID NO: 61494 - DNA, 20 bp, Artificial Sequence
  Description of Artificial Sequence: Synthetic oligonucleotide
  Target: ATXN1; (-) strand; PAM type: NRG; PAM sequence: TAG
gtaaataactggaagcatac

SEQ ID NO: 61495 - DNA, 20 bp, Artificial Sequence
  Description of Artificial Sequence: Synthetic oligonucleotide
  Target: ATXN1; (-) strand; PAM type: NRG; PAM sequence: AAG
gatacacagtaaataactgg

SEQ ID NO: 61496 - DNA, 20 bp, Artificial Sequence
  Description of Artificial Sequence: Synthetic oligonucleotide
  Target: ATXN1; (-) strand; PAM type: NRG; PAM sequence: TGG
ctagatacacagtaaataac

SEQ ID NO: 61497 - DNA, 20 bp, Artificial Sequence
  Description of Artificial Sequence: Synthetic oligonucleotide
  Target: ATXN1; (-) strand; PAM type: NRG; PAM sequence: CAG
tcacaacctagctagataca

SEQ ID NO: 61498 - DNA, 20 bp, Artificial Sequence
  Description of Artificial Sequence: Synthetic oligonucleotide
  Target: ATXN1; (-) strand; PAM type: NRG; PAM sequence: TAG
ttttcttttcacaacctagc

SEQ ID NO: 61499 - DNA, 20 bp, Artificial Sequence
  Description of Artificial Sequence: Synthetic oligonucleotide
  Target: ATXN1; (-) strand; PAM type: NRG; PAM sequence: TAG
attcttttcttttcacaacc

SEQ ID NO: 61500 - DNA, 20 bp, Artificial Sequence
  Description of Artificial Sequence: Synthetic oligonucleotide
  Target: ATXN1; (-) strand; PAM type: NRG; PAM sequence: AGG
aagtagatgatagaccagtt

SEQ ID NO: 61501 - DNA, 20 bp, Artificial Sequence
  Description of Artificial Sequence: Synthetic oligonucleotide
  Target: ATXN1; (-) strand; PAM type: NRG; PAM sequence: TAG
aaagtagatgatagaccagt

SEQ ID NO: 61502 - DNA, 20 bp, Artificial Sequence
  Description of Artificial Sequence: Synthetic oligonucleotide
  Target: ATXN1; (-) strand; PAM type: NRG; PAM sequence: CAG
tggtaaagtagatgatagac

SEQ ID NO: 61503 - DNA, 20 bp, Artificial Sequence
  Description of Artificial Sequence: Synthetic oligonucleotide
  Target: ATXN1; (-) strand; PAM type: NRG; PAM sequence: TAG
aaatttggtaaagtagatga

SEQ ID NO: 61504 - DNA, 20 bp, Artificial Sequence
  Description of Artificial Sequence: Synthetic oligonucleotide
  Target: ATXN1; (-) strand; PAM type: NRG; PAM sequence: TAG
ttagaagaaatttggtaaag

SEQ ID NO: 61505 - DNA, 20 bp, Artificial Sequence
  Description of Artificial Sequence: Synthetic oligonucleotide
  Target: ATXN1; (-) strand; PAM type: NRG; PAM sequence: AAG
tttttagaagaaatttggta

SEQ ID NO: 61506 - DNA, 20 bp, Artificial Sequence
  Description of Artificial Sequence: Synthetic oligonucleotide
  Target: ATXN1; (-) strand; PAM type: NRG; PAM sequence: TGG
ttgcttttttagaagaaatt

SEQ ID NO: 61507 - DNA, 20 bp, Artificial Sequence
  Description of Artificial Sequence: Synthetic oligonucleotide
  Target: ATXN1; (-) strand; PAM type: NRG; PAM sequence: AAG
tttgatggttgcttttttag

SEQ ID NO: 61508 - DNA, 20 bp, Artificial Sequence
  Description of Artificial Sequence: Synthetic oligonucleotide
  Target: ATXN1; (-) strand; PAM type: NRG; PAM sequence: TAG
gggtttgatggttgcttttt

SEQ ID NO: 61509 - DNA, 20 bp, Artificial Sequence
  Description of Artificial Sequence: Synthetic oligonucleotide
  Target: ATXN1; (-) strand; PAM type: NRG; PAM sequence: TGG
aaattcttctctgggtttga

SEQ ID NO: 61510 - DNA, 20 bp, Artificial Sequence
  Description of Artificial Sequence: Synthetic oligonucleotide
  Target: ATXN1; (-) strand; PAM type: NRG; PAM sequence: GGG
gaagcttcaaattcttctct

SEQ ID NO: 61511 - DNA, 20 bp, Artificial Sequence
  Description of Artificial Sequence: Synthetic oligonucleotide
  Target: ATXN1; (-) strand; PAM type: NRG; PAM sequence: TGG
agaagcttcaaattcttctc

SEQ ID NO: 61512 - DNA, 20 bp, Artificial Sequence
  Description of Artificial Sequence: Synthetic oligonucleotide
  Target: ATXN1; (-) strand; PAM type: NRG; PAM sequence: AAG
gtgaatggcattaaagttag

SEQ ID NO: 61513 - DNA, 20 bp, Artificial Sequence
  Description of Artificial Sequence: Synthetic oligonucleotide
  Target: ATXN1; (-) strand; PAM type: NRG; PAM sequence: TAG
aatgtgaatggcattaaagt

SEQ ID NO: 61514 - DNA, 20 bp, Artificial Sequence
  Description of Artificial Sequence: Synthetic oligonucleotide
  Target: ATXN1; (-) strand; PAM type: NRG; PAM sequence: AAG
aactaatgtgaatggcatta

SEQ ID NO: 61515 - DNA, 20 bp, Artificial Sequence
  Description of Artificial Sequence: Synthetic oligonucleotide
  Target: ATXN1; (-) strand; PAM type: NRG; PAM sequence: TGG
agaaatacaactaatgtgaa

SEQ ID NO: 61516 - DNA, 20 bp, Artificial Sequence
  Description of Artificial Sequence: Synthetic oligonucleotide
  Target: ATXN1; (-) strand; PAM type: NRG; PAM sequence: AAG
gatagttctctcatatgaat

SEQ ID NO: 61517 - DNA, 20 bp, Artificial Sequence
  Description of Artificial Sequence: Synthetic oligonucleotide
  Target: ATXN1; (-) strand; PAM type: NRG; PAM sequence: TAG
tagtgcacaggtcataaaga

SEQ ID NO: 61518 - DNA, 20 bp, Artificial Sequence
  Description of Artificial Sequence: Synthetic oligonucleotide
  Target: ATXN1; (-) strand; PAM type: NRG; PAM sequence: AAG
tttatagtgcacaggtcata

SEQ ID NO: 61519 - DNA, 20 bp, Artificial Sequence
  Description of Artificial Sequence: Synthetic oligonucleotide
  Target: ATXN1; (-) strand; PAM type: NRG; PAM sequence: AGG
catcattctttatagtgcac

SEQ ID NO: 61520 - DNA, 20 bp, Artificial Sequence
  Description of Artificial Sequence: Synthetic oligonucleotide
  Target: ATXN1; (-) strand; PAM type: NRG; PAM sequence: CAG
tcatcattctttatagtgca

SEQ ID NO: 61521 - DNA, 20 bp, Artificial Sequence
  Description of Artificial Sequence: Synthetic oligonucleotide
  Target: ATXN1; (-) strand; PAM type: NRG; PAM sequence: TAG
taaatactcatcattcttta

SEQ ID NO: 61522 - DNA, 20 bp, Artificial Sequence
  Description of Artificial Sequence: Synthetic oligonucleotide
  Target: ATXN1; (-) strand; PAM type: NRG; PAM sequence: TAG
ataactgttaattcaacact

SEQ ID NO: 61523 - DNA, 20 bp, Artificial Sequence
  Description of Artificial Sequence: Synthetic oligonucleotide
  Target: ATXN1; (-) strand; PAM type: NRG; PAM sequence: TGG
ttgttttttgtttttttttt

SEQ ID NO: 61524 - DNA, 20 bp, Artificial Sequence
  Description of Artificial Sequence: Synthetic oligonucleotide
  Target: ATXN1; (-) strand; PAM type: NRG; PAM sequence: CAG
tttgatacagtggagaagta

SEQ ID NO: 61525 - DNA, 20 bp, Artificial Sequence
  Description of Artificial Sequence: Synthetic oligonucleotide
  Target: ATXN1; (-) strand; PAM type: NRG; PAM sequence: AAG
tacattttgatacagtggag

SEQ ID NO: 61526 - DNA, 20 bp, Artificial Sequence
  Description of Artificial Sequence: Synthetic oligonucleotide
  Target: ATXN1; (-) strand; PAM type: NRG; PAM sequence: GAG
aagtacattttgatacagtg

SEQ ID NO: 61527 - DNA, 20 bp, Artificial Sequence
  Description of Artificial Sequence: Synthetic oligonucleotide
  Target: ATXN1; (-) strand; PAM type: NRG; PAM sequence: TGG
ttaagtacattttgatacag

SEQ ID NO: 61528 - DNA, 20 bp, Artificial Sequence
  Description of Artificial Sequence: Synthetic oligonucleotide
  Target: ATXN1; (-) strand; PAM type: NRG; PAM sequence: CAG
ctattaagtacattttgata

SEQ ID NO: 61529 - DNA, 20 bp, Artificial Sequence
  Description of Artificial Sequence: Synthetic oligonucleotide
  Target: ATXN1; (-) strand; PAM type: NRG; PAM sequence: AAG
tgaaacaataaatacctatt

SEQ ID NO: 61530 - DNA, 20 bp, Artificial Sequence
  Description of Artificial Sequence: Synthetic oligonucleotide
  Target: ATXN1; (-) strand; PAM type: NRG; PAM sequence: AAG
caaaatgatttaaatgatag

SEQ ID NO: 61531 - DNA, 20 bp, Artificial Sequence
  Description of Artificial Sequence: Synthetic oligonucleotide
  Target: ATXN1; (-) strand; PAM type: NRG; PAM sequence: TAG
tgacaaaatgatttaaatga

SEQ ID NO: 61532 - DNA, 20 bp, Artificial Sequence
  Description of Artificial Sequence: Synthetic oligonucleotide
  Target: ATXN1; (-) strand; PAM type: NRG; PAM sequence: AGG
agggtgtagtgtgcccagcc

SEQ ID NO: 61533 - DNA, 20 bp, Artificial Sequence
  Description of Artificial Sequence: Synthetic oligonucleotide
  Target: ATXN1; (-) strand; PAM type: NRG; PAM sequence: CAG
cagggtgtagtgtgcccagc

SEQ ID NO: 61534 - DNA, 20 bp, Artificial Sequence
  Description of Artificial Sequence: Synthetic oligonucleotide
  Target: ATXN1; (-) strand; PAM type: NRG; PAM sequence: CAG
ttgacagggtgtagtgtgcc

SEQ ID NO: 61535 - DNA, 20 bp, Artificial Sequence
  Description of Artificial Sequence: Synthetic oligonucleotide
  Target: ATXN1; (-) strand; PAM type: NRG; PAM sequence: TAG
cagttttgtttgacagggtg

SEQ ID NO: 61536 - DNA, 20 bp, Artificial Sequence
  Description of Artificial Sequence: Synthetic oligonucleotide
  Target: ATXN1; (-) strand; PAM type: NRG; PAM sequence: GGG
taaatcagttttgtttgaca

SEQ ID NO: 61537 - DNA, 20 bp, Artificial Sequence
  Description of Artificial Sequence: Synthetic oligonucleotide
  Target: ATXN1; (-) strand; PAM type: NRG; PAM sequence: AGG
gtaaatcagttttgtttgac

SEQ ID NO: 61538 - DNA, 20 bp, Artificial Sequence
  Description of Artificial Sequence: Synthetic oligonucleotide
  Target: ATXN1; (-) strand; PAM type: NRG; PAM sequence: CAG
agtaaatcagttttgtttga

SEQ ID NO: 61539 - DNA, 20 bp, Artificial Sequence
  Description of Artificial Sequence: Synthetic oligonucleotide
  Target: ATXN1; (-) strand; PAM type: NRG; PAM sequence: CAG
ttgtatgagataaagtaaat

SEQ ID NO: 61540 - DNA, 20 bp, Artificial Sequence
  Description of Artificial Sequence: Synthetic oligonucleotide
  Target: ATXN1; (-) strand; PAM type: NRG; PAM sequence: AAG
aggatgttttgtatgagata

SEQ ID NO: 61541 - DNA, 20 bp, Artificial Sequence
  Description of Artificial Sequence: Synthetic oligonucleotide
  Target: ATXN1; (-) strand; PAM type: NRG; PAM sequence: GAG
attttcaggatgttttgtat

SEQ ID NO: 61542 - DNA, 20 bp, Artificial Sequence
  Description of Artificial Sequence: Synthetic oligonucleotide
  Target: ATXN1; (-) strand; PAM type: NRG; PAM sequence: AGG
tcagagcatcccatattttc

SEQ ID NO: 61543 - DNA, 20 bp, Artificial Sequence
  Description of Artificial Sequence: Synthetic oligonucleotide
  Target: ATXN1; (-) strand; PAM type: NRG; PAM sequence: CAG
ttcagagcatcccatatttt

SEQ ID NO: 61544 - DNA, 20 bp, Artificial Sequence
  Description of Artificial Sequence: Synthetic oligonucleotide
  Target: ATXN1; (-) strand; PAM type: NRG; PAM sequence: GAG
ggtagctgttggcactttca

SEQ ID NO: 61545 - DNA, 20 bp, Artificial Sequence
  Description of Artificial Sequence: Synthetic oligonucleotide
  Target: ATXN1; (-) strand; PAM type: NRG; PAM sequence: CAG
agggtagctgttggcacttt

SEQ ID NO: 61546 - DNA, 20 bp, Artificial Sequence
  Description of Artificial Sequence: Synthetic oligonucleotide
  Target: ATXN1; (-) strand; PAM type: NRG; PAM sequence: TGG
aaaactccaagggtagctgt

SEQ ID NO: 61547 - DNA, 20 bp, Artificial Sequence
  Description of Artificial Sequence: Synthetic oligonucleotide
  Target: ATXN1; (-) strand; PAM type: NRG; PAM sequence: TAG
aaaaagaaaaactccaaggg

SEQ ID NO: 61548 - DNA, 20 bp, Artificial Sequence
  Description of Artificial Sequence: Synthetic oligonucleotide
  Target: ATXN1; (-) strand; PAM type: NRG; PAM sequence: GGG
tggaaaaagaaaaactccaa

SEQ ID NO: 61549 - DNA, 20 bp, Artificial Sequence
  Description of Artificial Sequence: Synthetic oligonucleotide
  Target: ATXN1; (-) strand; PAM type: NRG; PAM sequence: AGG
ttggaaaaagaaaaactcca

SEQ ID NO: 61550 - DNA, 20 bp, Artificial Sequence
  Description of Artificial Sequence: Synthetic oligonucleotide
  Target: ATXN1; (-) strand; PAM type: NRG; PAM sequence: AAG
tttggaaaaagaaaaactcc

SEQ ID NO: 61551 - DNA, 20 bp, Artificial Sequence
  Description of Artificial Sequence: Synthetic oligonucleotide
  Target: ATXN1; (-) strand; PAM type: NRG; PAM sequence: AAG
aaagaaataatttttggaaa

SEQ ID NO: 61552 - DNA, 20 bp, Artificial Sequence
  Description of Artificial Sequence: Synthetic oligonucleotide
  Target: ATXN1; (-) strand; PAM type: NRG; PAM sequence: TGG
gaattgaaagaaataatttt

SEQ ID NO: 61553 - DNA, 20 bp, Artificial Sequence
  Description of Artificial Sequence: Synthetic oligonucleotide
  Target: ATXN1; (-) strand; PAM type: NRG; PAM sequence: AAG
agatctgggactggaattga

SEQ ID NO: 61554 - DNA, 20 bp, Artificial Sequence
  Description of Artificial Sequence: Synthetic oligonucleotide
  Target: ATXN1; (-) strand; PAM type: NRG; PAM sequence: TGG
tggtagtgaagatctgggac

SEQ ID NO: 61555 - DNA, 20 bp, Artificial Sequence
  Description of Artificial Sequence: Synthetic oligonucleotide
  Target: ATXN1; (-) strand; PAM type: NRG; PAM sequence: GGG
agggctggtagtgaagatct

SEQ ID NO: 61556 - DNA, 20 bp, Artificial Sequence
  Description of Artificial Sequence: Synthetic oligonucleotide
  Target: ATXN1; (-) strand; PAM type: NRG; PAM sequence: TGG
aagggctggtagtgaagatc

SEQ ID NO: 61557 - DNA, 20 bp, Artificial Sequence
  Description of Artificial Sequence: Synthetic oligonucleotide
  Target: ATXN1; (-) strand; PAM type: NRG; PAM sequence: AAG
tgaaataagggctggtagtg

SEQ ID NO: 61558 - DNA, 20 bp, Artificial Sequence
  Description of Artificial Sequence: Synthetic oligonucleotide
  Target: ATXN1; (-) strand; PAM type: NRG; PAM sequence: TAG
atagctgaaataagggctgg

SEQ ID NO: 61559 - DNA, 20 bp, Artificial Sequence
  Description of Artificial Sequence: Synthetic oligonucleotide
  Target: ATXN1; (-) strand; PAM type: NRG; PAM sequence: TGG
accatagctgaaataagggc

SEQ ID NO: 61560 - DNA, 20 bp, Artificial Sequence
  Description of Artificial Sequence: Synthetic oligonucleotide
  Target: ATXN1; (-) strand; PAM type: NRG; PAM sequence: GGG
ttctaccatagctgaaataa

SEQ ID NO: 61561 - DNA, 20 bp, Artificial Sequence
  Description of Artificial Sequence: Synthetic oligonucleotide
  Target: ATXN1; (-) strand; PAM type: NRG; PAM sequence: AGG
cttctaccatagctgaaata

SEQ ID NO: 61562 - DNA, 20 bp, Artificial Sequence
  Description of Artificial Sequence: Synthetic oligonucleotide
  Target: ATXN1; (-) strand; PAM type: NRG; PAM sequence: AAG
ccttctaccatagctgaaat

SEQ ID NO: 61563 - DNA, 20 bp, Artificial Sequence
  Description of Artificial Sequence: Synthetic oligonucleotide
  Target: ATXN1; (-) strand; PAM type: NRG; PAM sequence: TAG
tatattcactccttctacca

SEQ ID NO: 61564 - DNA, 20 bp, Artificial Sequence
  Description of Artificial Sequence: Synthetic oligonucleotide
  Target: ATXN1; (-) strand; PAM type: NRG; PAM sequence: AGG
cgttttgtatactcaacaga

SEQ ID NO: 61565 - DNA, 20 bp, Artificial Sequence
  Description of Artificial Sequence: Synthetic oligonucleotide
  Target: ATXN1; (-) strand; PAM type: NRG; PAM sequence: AAG
acgttttgtatactcaacag

SEQ ID NO: 61566 - DNA, 20 bp, Artificial Sequence
  Description of Artificial Sequence: Synthetic oligonucleotide
  Target: ATXN1; (-) strand; PAM type: NRG; PAM sequence: CAG
agcacgttttgtatactcaa

SEQ ID NO: 61567 - DNA, 20 bp, Artificial Sequence
  Description of Artificial Sequence: Synthetic oligonucleotide
  Target: ATXN1; (-) strand; PAM type: NRG; PAM sequence: TAG
agggtgtaactgaccatttc

SEQ ID NO: 61568 - DNA, 20 bp, Artificial Sequence
  Description of Artificial Sequence: Synthetic oligonucleotide
  Target: ATXN1; (-) strand; PAM type: NRG; PAM sequence: GGG
tatgatgggaaagacattta

SEQ ID NO: 61569 - DNA, 20 bp, Artificial Sequence
  Description of Artificial Sequence: Synthetic oligonucleotide
  Target: ATXN1; (-) strand; PAM type: NRG; PAM sequence: AGG
ttatgatgggaaagacattt

SEQ ID NO: 61570 - DNA, 20 bp, Artificial Sequence
  Description of Artificial Sequence: Synthetic oligonucleotide
  Target: ATXN1; (-) strand; PAM type: NRG; PAM sequence: TAG
cttatgatgggaaagacatt

SEQ ID NO: 61571 - DNA, 20 bp, Artificial Sequence
  Description of Artificial Sequence: Synthetic oligonucleotide
  Target: ATXN1; (-) strand; PAM type: NRG; PAM sequence: AAG
actgtgtgcttatgatggga

SEQ ID NO: 61572 - DNA, 20 bp, Artificial Sequence
  Description of Artificial Sequence: Synthetic oligonucleotide
  Target: ATXN1; (-) strand; PAM type: NRG; PAM sequence: GGG
tgaaactgtgtgcttatgat

SEQ ID NO: 61573 - DNA, 20 bp, Artificial Sequence
  Description of Artificial Sequence: Synthetic oligonucleotide
  Target: ATXN1; (-) strand; PAM type: NRG; PAM sequence: TGG
atgaaactgtgtgcttatga

SEQ ID NO: 61574 - DNA, 20 bp, Artificial Sequence
  Description of Artificial Sequence: Synthetic oligonucleotide
  Target: ATXN1; (-) strand; PAM type: NRG; PAM sequence: GAG
tgaatgaccacactcaagtc

SEQ ID NO: 61575 - DNA, 20 bp, Artificial Sequence
  Description of Artificial Sequence: Synthetic oligonucleotide
  Target: ATXN1; (-) strand; PAM type: NRG; PAM sequence: AAG
tccactgaatgaccacactc

SEQ ID NO: 61576 - DNA, 20 bp, Artificial Sequence
  Description of Artificial Sequence: Synthetic oligonucleotide
  Target: ATXN1; (-) strand; PAM type: NRG; PAM sequence: TAG
cacgactaaaagagtttttg

SEQ ID NO: 61577 - DNA, 20 bp, Artificial Sequence
  Description of Artificial Sequence: Synthetic oligonucleotide
  Target: ATXN1; (-) strand; PAM type: NRG; PAM sequence: GAG
ctttcccttcacgactaaaa

SEQ ID NO: 61578 - DNA, 20 bp, Artificial Sequence
  Description of Artificial Sequence: Synthetic oligonucleotide
  Target: ATXN1; (-) strand; PAM type: NRG; PAM sequence: AAG
gcctttcccttcacgactaa

SEQ ID NO: 61579 - DNA, 20 bp, Artificial Sequence
  Description of Artificial Sequence: Synthetic oligonucleotide
  Target: ATXN1; (-) strand; PAM type: NRG; PAM sequence: AAG
gaagacccacagatgacagg

SEQ ID NO: 61580 - DNA, 20 bp, Artificial Sequence
  Description of Artificial Sequence: Synthetic oligonucleotide
  Target: ATXN1; (-) strand; PAM type: NRG; PAM sequence: AGG
attgaagacccacagatgac

SEQ ID NO: 61581 - DNA, 20 bp, Artificial Sequence
  Description of Artificial Sequence: Synthetic oligonucleotide
  Target: ATXN1; (-) strand; PAM type: NRG; PAM sequence: CAG
cattgaagacccacagatga

SEQ ID NO: 61582 - DNA, 20 bp, Artificial Sequence
  Description of Artificial Sequence: Synthetic oligonucleotide
  Target: ATXN1; (-) strand; PAM type: NRG; PAM sequence: CAG
cccagagcattgaagaccca

SEQ ID NO: 61583 - DNA, 20 bp, Artificial Sequence
  Description of Artificial Sequence: Synthetic oligonucleotide
  Target: ATXN1; (-) strand; PAM type: NRG; PAM sequence: AAG
agggtgtccccagagcattg

SEQ ID NO: 61584 - DNA, 20 bp, Artificial Sequence
  Description of Artificial Sequence: Synthetic oligonucleotide
  Target: ATXN1; (-) strand; PAM type: NRG; PAM sequence: GAG
ctgatgaaagggtgtcccca

SEQ ID NO: 61585 - DNA, 20 bp, Artificial Sequence
  Description of Artificial Sequence: Synthetic oligonucleotide
  Target: ATXN1; (-) strand; PAM type: NRG; PAM sequence: CAG
gactgatgaaagggtgtccc

SEQ ID NO: 61586 - DNA, 20 bp, Artificial Sequence
  Description of Artificial Sequence: Synthetic oligonucleotide
  Target: ATXN1; (-) strand; PAM type: NRG; PAM sequence: GGG
aacaagggagactgatgaaa

SEQ ID NO: 61587 - DNA, 20 bp, Artificial Sequence
  Description of Artificial Sequence: Synthetic oligonucleotide
  Target: ATXN1; (-) strand; PAM type: NRG; PAM sequence: AGG
gaacaagggagactgatgaa

SEQ ID NO: 61588 - DNA, 20 bp, Artificial Sequence
  Description of Artificial Sequence: Synthetic oligonucleotide
  Target: ATXN1; (-) strand; PAM type: NRG; PAM sequence: AAG
ggaacaagggagactgatga

SEQ ID NO: 61589 - DNA, 20 bp, Artificial Sequence
  Description of Artificial Sequence: Synthetic oligonucleotide
  Target: ATXN1; (-) strand; PAM type: NRG; PAM sequence: GAG
caaggaaatggggaacaagg

SEQ ID NO: 61590 - DNA, 20 bp, Artificial Sequence
  Description of Artificial Sequence: Synthetic oligonucleotide
  Target: ATXN1; (-) strand; PAM type: NRG; PAM sequence: GGG
tgcaaggaaatggggaacaa

SEQ ID NO: 61591 - DNA, 20 bp, Artificial Sequence
  Description of Artificial Sequence: Synthetic oligonucleotide
  Target: ATXN1; (-) strand; PAM type: NRG; PAM sequence: AGG
ttgcaaggaaatggggaaca

SEQ ID NO: 61592 - DNA, 20 bp, Artificial Sequence
  Description of Artificial Sequence: Synthetic oligonucleotide
  Target: ATXN1; (-) strand; PAM type: NRG; PAM sequence: AAG
tttgcaaggaaatggggaac

SEQ ID NO: 61593 - DNA, 20 bp, Artificial Sequence
  Description of Artificial Sequence: Synthetic oligonucleotide
  Target: ATXN1; (-) strand; PAM type: NRG; PAM sequence: GGG
tgggtctttgcaaggaaatg

SEQ ID NO: 61594 - DNA, 20 bp, Artificial Sequence
  Description of Artificial Sequence: Synthetic oligonucleotide
  Target: ATXN1; (-) strand; PAM type: NRG; PAM sequence: GGG
gtgggtctttgcaaggaaat

SEQ ID NO: 61595 - DNA, 20 bp, Artificial Sequence
  Description of Artificial Sequence: Synthetic oligonucleotide
  Target: ATXN1; (-) strand; PAM type: NRG; PAM sequence: TGG
ggtgggtctttgcaaggaaa

SEQ ID NO: 61596 - DNA, 20 bp, Artificial Sequence
  Description of Artificial Sequence: Synthetic oligonucleotide
  Target: ATXN1; (-) strand; PAM type: NRG; PAM sequence: AGG
actcaaggtgggtctttgca

SEQ ID NO: 61597 - DNA, 20 bp, Artificial Sequence
  Description of Artificial Sequence: Synthetic oligonucleotide
  Target: ATXN1; (-) strand; PAM type: NRG; PAM sequence: AAG
gactcaaggtgggtctttgc

SEQ ID NO: 61598 - DNA, 20 bp, Artificial Sequence
  Description of Artificial Sequence: Synthetic oligonucleotide
  Target: ATXN1; (-) strand; PAM type: NRG; PAM sequence: GGG
cgaagaaagagactcaaggt

SEQ ID NO: 61599 - DNA, 20 bp, Artificial Sequence
  Description of Artificial Sequence: Synthetic oligonucleotide
  Target: ATXN1; (-) strand; PAM type: NRG; PAM sequence: TGG
acgaagaaagagactcaagg

SEQ ID NO: 61600 - DNA, 20 bp, Artificial Sequence
  Description of Artificial Sequence: Synthetic oligonucleotide
  Target: ATXN1; (-) strand; PAM type: NRG; PAM sequence: AGG
ttcacgaagaaagagactca

SEQ ID NO: 61601 - DNA, 20 bp, Artificial Sequence
  Description of Artificial Sequence: Synthetic oligonucleotide
  Target: ATXN1; (-) strand; PAM type: NRG; PAM sequence: AAG
tttcacgaagaaagagactc

SEQ ID NO: 61602 - DNA, 20 bp, Artificial Sequence
  Description of Artificial Sequence: Synthetic oligonucleotide
  Target: ATXN1; (-) strand; PAM type: NRG; PAM sequence: GAG
agacatttttcacgaagaaa

SEQ ID NO: 61603 - DNA, 20 bp, Artificial Sequence
  Description of Artificial Sequence: Synthetic oligonucleotide
  Target: ATXN1; (-) strand; PAM type: NRG; PAM sequence: AAG
caagacatttttcacgaaga

SEQ ID NO: 61604 - DNA, 20 bp, Artificial Sequence
  Description of Artificial Sequence: Synthetic oligonucleotide
  Target: ATXN1; (-) strand; PAM type: NRG; PAM sequence: AAG
atgccaagacatttttcacg

SEQ ID NO: 61605 - DNA, 20 bp, Artificial Sequence
  Description of Artificial Sequence: Synthetic oligonucleotide
  Target: ATXN1; (-) strand; PAM type: NRG; PAM sequence: AAG
tgtgtggccctggagatgcc

SEQ ID NO: 61606 - DNA, 20 bp, Artificial Sequence
  Description of Artificial Sequence: Synthetic oligonucleotide
  Target: ATXN1; (-) strand; PAM type: NRG; PAM sequence: GAG
gcttcgtctgtgtggccctg

SEQ ID NO: 61607 - DNA, 20 bp, Artificial Sequence
  Description of Artificial Sequence: Synthetic oligonucleotide
  Target: ATXN1; (-) strand; PAM type: NRG; PAM sequence: TGG
gtgcttcgtctgtgtggccc

SEQ ID NO: 61608 - DNA, 20 bp, Artificial Sequence
  Description of Artificial Sequence: Synthetic oligonucleotide
  Target: ATXN1; (-) strand; PAM type: NRG; PAM sequence: TGG
ctgagagtgcttcgtctgtg

SEQ ID NO: 61609 - DNA, 20 bp, Artificial Sequence
  Description of Artificial Sequence: Synthetic oligonucleotide
  Target: ATXN1; (-) strand; PAM type: NRG; PAM sequence: GAG
tgggtgacattttctcctga

SEQ ID NO: 61610 - DNA, 20 bp, Artificial Sequence
  Description of Artificial Sequence: Synthetic oligonucleotide
  Target: ATXN1; (-) strand; PAM type: NRG; PAM sequence: GAG
tttgggtgacattttctcct

SEQ ID NO: 61611 - DNA, 20 bp, Artificial Sequence
  Description of Artificial Sequence: Synthetic oligonucleotide
  Target: ATXN1; (-) strand; PAM type: NRG; PAM sequence: GGG
agcccctaggcaatgggttt

SEQ ID NO: 61612 - DNA, 20 bp, Artificial Sequence
  Description of Artificial Sequence: Synthetic oligonucleotide
  Target: ATXN1; (-) strand; PAM type: NRG; PAM sequence: TGG
aagcccctaggcaatgggtt

SEQ ID NO: 61613 - DNA, 20 bp, Artificial Sequence
  Description of Artificial Sequence: Synthetic oligonucleotide
  Target: ATXN1; (-) strand; PAM type: NRG; PAM sequence: GGG
tgtggaagcccctaggcaat

SEQ ID NO: 61614 - DNA, 20 bp, Artificial Sequence
  Description of Artificial Sequence: Synthetic oligonucleotide
  Target: ATXN1; (-) strand; PAM type: NRG; PAM sequence: TGG
ctgtggaagcccctaggcaa

SEQ ID NO: 61615 - DNA, 20 bp, Artificial Sequence
  Description of Artificial Sequence: Synthetic oligonucleotide
  Target: ATXN1; (-) strand; PAM type: NRG; PAM sequence: AGG
acttctctgtggaagcccct

SEQ ID NO: 61616 - DNA, 20 bp, Artificial Sequence
  Description of Artificial Sequence: Synthetic oligonucleotide
  Target: ATXN1; (-) strand; PAM type: NRG; PAM sequence: TAG
cacttctctgtggaagcccc

SEQ ID NO: 61617 - DNA, 20 bp, Artificial Sequence
  Description of Artificial Sequence: Synthetic oligonucleotide
  Target: ATXN1; (-) strand; PAM type: NRG; PAM sequence: AAG
ccatggccacttctctgtgg

SEQ ID NO: 61618 - DNA, 20 bp, Artificial Sequence
  Description of Artificial Sequence: Synthetic oligonucleotide
  Target: ATXN1; (-) strand; PAM type: NRG; PAM sequence: TGG
cctccatggccacttctctg

SEQ ID NO: 61619 - DNA, 20 bp, Artificial Sequence
  Description of Artificial Sequence: Synthetic oligonucleotide
  Target: ATXN1; (-) strand; PAM type: NRG; PAM sequence: TGG
gagctgggggcttccctcca

SEQ ID NO: 61620 - DNA, 20 bp, Artificial Sequence
  Description of Artificial Sequence: Synthetic oligonucleotide
  Target: ATXN1; (-) strand; PAM type: NRG; PAM sequence: GGG
agtgacattggcagagctgg

SEQ ID NO: 61621 - DNA, 20 bp, Artificial Sequence
  Description of Artificial Sequence: Synthetic oligonucleotide
  Target: ATXN1; (-) strand; PAM type: NRG; PAM sequence: GGG
aagtgacattggcagagctg

SEQ ID NO: 61622 - DNA, 20 bp, Artificial Sequence
  Description of Artificial Sequence: Synthetic oligonucleotide
  Target: ATXN1; (-) strand; PAM type: NRG; PAM sequence: GGG
caagtgacattggcagagct

SEQ ID NO: 61623 - DNA, 20 bp, Artificial Sequence
  Description of Artificial Sequence: Synthetic oligonucleotide
  Target: ATXN1; (-) strand; PAM type: NRG; PAM sequence: TGG
tcaagtgacattggcagagc

SEQ ID NO: 61624 - DNA, 20 bp, Artificial Sequence
  Description of Artificial Sequence: Synthetic oligonucleotide
  Target: ATXN1; (-) strand; PAM type: NRG; PAM sequence: GAG
acagtcaagtgacattggca

SEQ ID NO: 61625 - DNA, 20 bp, Artificial Sequence
  Description of Artificial Sequence: Synthetic oligonucleotide
  Target: ATXN1; (-) strand; PAM type: NRG; PAM sequence: CAG
ggacagtcaagtgacattgg

SEQ ID NO: 61626 - DNA, 20 bp, Artificial Sequence
  Description of Artificial Sequence: Synthetic oligonucleotide
  Target: ATXN1; (-) strand; PAM type: NRG; PAM sequence: TGG
aatggacagtcaagtgacat

SEQ ID NO: 61627 - DNA, 20 bp, Artificial Sequence
  Description of Artificial Sequence: Synthetic oligonucleotide
  Target: ATXN1; (-) strand; PAM type: NRG; PAM sequence: AAG
gaaatctaaaatggacagtc

SEQ ID NO: 61628 - DNA, 20 bp, Artificial Sequence
  Description of Artificial Sequence: Synthetic oligonucleotide
  Target: ATXN1; (-) strand; PAM type: NRG; PAM sequence: CAG
tagatgaaatctaaaatgga

SEQ ID NO: 61629 - DNA, 20 bp, Artificial Sequence
  Description of Artificial Sequence: Synthetic oligonucleotide
  Target: ATXN1; (-) strand; PAM type: NRG; PAM sequence: TGG
tgcctagatgaaatctaaaa

SEQ ID NO: 61630 - DNA, 20 bp, Artificial Sequence
  Description of Artificial Sequence: Synthetic oligonucleotide
  Target: ATXN1; (-) strand; PAM type: NRG; PAM sequence: TAG
ctgtccaaagtggccttgcc

SEQ ID NO: 61631 - DNA, 20 bp, Artificial Sequence
  Description of Artificial Sequence: Synthetic oligonucleotide
  Target: ATXN1; (-) strand; PAM type: NRG; PAM sequence: TGG
cttaaagtccctgtccaaag

SEQ ID NO: 61632 - DNA, 20 bp, Artificial Sequence
  Description of Artificial Sequence: Synthetic oligonucleotide
  Target: ATXN1; (-) strand; PAM type: NRG; PAM sequence: AAG
tatcttaaagtccctgtcca

SEQ ID NO: 61633 - DNA, 20 bp, Artificial Sequence
  Description of Artificial Sequence: Synthetic oligonucleotide
  Target: ATXN1; (-) strand; PAM type: NRG; PAM sequence: AAG
atactgtggattgtatctta

SEQ ID NO: 61634 - DNA, 20 bp, Artificial Sequence
  Description of Artificial Sequence: Synthetic oligonucleotide
  Target: ATXN1; (-) strand; PAM type: NRG; PAM sequence: TGG
caaagaacatagaaatactg

SEQ ID NO: 61635 - DNA, 20 bp, Artificial Sequence
  Description of Artificial Sequence: Synthetic oligonucleotide
  Target: ATXN1; (-) strand; PAM type: NRG; PAM sequence: TAG
cgatttggatccaaagaaca

SEQ ID NO: 61636 - DNA, 20 bp, Artificial Sequence
  Description of Artificial Sequence: Synthetic oligonucleotide
  Target: ATXN1; (-) strand; PAM type: NRG; PAM sequence: AAG
cattttccgatttggatcca

SEQ ID NO: 61637 - DNA, 20 bp, Artificial Sequence
  Description of Artificial Sequence: Synthetic oligonucleotide
  Target: ATXN1; (-) strand; PAM type: NRG; PAM sequence: TGG
ttttctgccattttccgatt

SEQ ID NO: 61638 - DNA, 20 bp, Artificial Sequence
  Description of Artificial Sequence: Synthetic oligonucleotide
  Target: ATXN1; (-) strand; PAM type: NRG; PAM sequence: TGG
ctcattatgccacattgaat

SEQ ID NO: 61639 - DNA, 20 bp, Artificial Sequence
  Description of Artificial Sequence: Synthetic oligonucleotide
  Target: ATXN1; (-) strand; PAM type: NRG; PAM sequence: TGG
cccagccttgaagaggaata

SEQ ID NO: 61640 - DNA, 20 bp, Artificial Sequence
  Description of Artificial Sequence: Synthetic oligonucleotide
  Target: ATXN1; (-) strand; PAM type: NRG; PAM sequence: AGG
ccatgcacccagccttgaag

SEQ ID NO: 61641 - DNA, 20 bp, Artificial Sequence
  Description of Artificial Sequence: Synthetic oligonucleotide
  Target: ATXN1; (-) strand; PAM type: NRG; PAM sequence: GAG
tccatgcacccagccttgaa

SEQ ID NO: 61642 - DNA, 20 bp, Artificial Sequence
  Description of Artificial Sequence: Synthetic oligonucleotide
  Target: ATXN1; (-) strand; PAM type: NRG; PAM sequence: AAG
tatccatgcacccagccttg

SEQ ID NO: 61643 - DNA, 20 bp, Artificial Sequence
  Description of Artificial Sequence: Synthetic oligonucleotide
  Target: ATXN1; (-) strand; PAM type: NRG; PAM sequence: CAG
tggtaatttatccatgcacc

SEQ ID NO: 61644 - DNA, 20 bp, Artificial Sequence
  Description of Artificial Sequence: Synthetic oligonucleotide
  Target: ATXN1; (-) strand; PAM type: NRG; PAM sequence: TGG
agagccttcttactgagctc

SEQ ID NO: 61645 - DNA, 20 bp, Artificial Sequence
  Description of Artificial Sequence: Synthetic oligonucleotide
  Target: ATXN1; (-) strand; PAM type: NRG; PAM sequence: GAG
gtaacgagagccttcttact

SEQ ID NO: 61646 - DNA, 20 bp, Artificial Sequence
  Description of Artificial Sequence: Synthetic oligonucleotide
  Target: ATXN1; (-) strand; PAM type: NRG; PAM sequence: GAG
aaagccatccagtgtaacga

SEQ ID NO: 61647 - DNA, 20 bp, Artificial Sequence
  Description of Artificial Sequence: Synthetic oligonucleotide
  Target: ATXN1; (-) strand; PAM type: NRG; PAM sequence: GAG
tgaaagccatccagtgtaac

SEQ ID NO: 61648 - DNA, 20 bp, Artificial Sequence
  Description of Artificial Sequence: Synthetic oligonucleotide
  Target: ATXN1; (-) strand; PAM type: NRG; PAM sequence: CAG
ggtctggcctgaaagccatc

SEQ ID NO: 61649 - DNA, 20 bp, Artificial Sequence
  Description of Artificial Sequence: Synthetic oligonucleotide
  Target: ATXN1; (-) strand; PAM type: NRG; PAM sequence: AAG
tgttgacaggtctggcctga

SEQ ID NO: 61650 - DNA, 20 bp, Artificial Sequence
  Description of Artificial Sequence: Synthetic oligonucleotide
  Target: ATXN1; (-) strand; PAM type: NRG; PAM sequence: TGG
ccttttcctgttgacaggtc

SEQ ID NO: 61651 - DNA, 20 bp, Artificial Sequence
  Description of Artificial Sequence: Synthetic oligonucleotide
  Target: ATXN1; (-) strand; PAM type: NRG; PAM sequence: AGG
tggccccttttcctgttgac

SEQ ID NO: 61652 - DNA, 20 bp, Artificial Sequence
  Description of Artificial Sequence: Synthetic oligonucleotide
  Target: ATXN1; (-) strand; PAM type: NRG; PAM sequence: CAG
ttggccccttttcctgttga

SEQ ID NO: 61653 - DNA, 20 bp, Artificial Sequence
  Description of Artificial Sequence: Synthetic oligonucleotide
  Target: ATXN1; (-) strand; PAM type: NRG; PAM sequence: TGG
aacaccatgacagtccctct

SEQ ID NO: 61654 - DNA, 20 bp, Artificial Sequence
  Description of Artificial Sequence: Synthetic oligonucleotide
  Target: ATXN1; (-) strand; PAM type: NRG; PAM sequence: CAG
aaggaagggaaacaccatga

SEQ ID NO: 61655 - DNA, 20 bp, Artificial Sequence
  Description of Artificial Sequence: Synthetic oligonucleotide
  Target: ATXN1; (-) strand; PAM type: NRG; PAM sequence: GGG
gtcaagggaggcagaaggaa

SEQ ID NO: 61656 - DNA, 20 bp, Artificial Sequence
  Description of Artificial Sequence: Synthetic oligonucleotide
  Target: ATXN1; (-) strand; PAM type: NRG; PAM sequence: AGG
ggtcaagggaggcagaagga

SEQ ID NO: 61657 - DNA, 20 bp, Artificial Sequence
  Description of Artificial Sequence: Synthetic oligonucleotide
  Target: ATXN1; (-) strand; PAM type: NRG; PAM sequence: AAG
aggtcaagggaggcagaagg

SEQ ID NO: 61658 - DNA, 20 bp, Artificial Sequence
  Description of Artificial Sequence: Synthetic oligonucleotide
  Target: ATXN1; (-) strand; PAM type: NRG; PAM sequence: AGG
cagaggtcaagggaggcaga

SEQ ID NO: 61659 - DNA, 20 bp, Artificial Sequence
  Description of Artificial Sequence: Synthetic oligonucleotide
  Target: ATXN1; (-) strand; PAM type: NRG; PAM sequence: AAG
tcagaggtcaagggaggcag

SEQ ID NO: 61660 - DNA, 20 bp, Artificial Sequence
  Description of Artificial Sequence: Synthetic oligonucleotide
  Target: ATXN1; (-) strand; PAM type: NRG; PAM sequence: CAG
gaatcagaggtcaagggagg

SEQ ID NO: 61661 - DNA, 20 bp, Artificial Sequence
  Description of Artificial Sequence: Synthetic oligonucleotide
  Target: ATXN1; (-) strand; PAM type: NRG; PAM sequence: AGG
gaggaatcagaggtcaaggg

SEQ ID NO: 61662 - DNA, 20 bp, Artificial Sequence
  Description of Artificial Sequence: Synthetic oligonucleotide
  Target: ATXN1; (-) strand; PAM type: NRG; PAM sequence: GAG
ggaggaatcagaggtcaagg

SEQ ID NO: 61663 - DNA, 20 bp, Artificial Sequence
  Description of Artificial Sequence: Synthetic oligonucleotide
  Target: ATXN1; (-) strand; PAM type: NRG; PAM sequence: GGG
tgggaggaatcagaggtcaa

SEQ ID NO: 61664 - DNA, 20 bp, Artificial Sequence
  Description of Artificial Sequence: Synthetic oligonucleotide
  Target: ATXN1; (-) strand; PAM type: NRG; PAM sequence: AGG
ttgggaggaatcagaggtca

SEQ ID NO: 61665 - DNA, 20 bp, Artificial Sequence
  Description of Artificial Sequence: Synthetic oligonucleotide
  Target: ATXN1; (-) strand; PAM type: NRG; PAM sequence: AAG
tttgggaggaatcagaggtc

SEQ ID NO: 61666 - DNA, 20 bp, Artificial Sequence
  Description of Artificial Sequence: Synthetic oligonucleotide
  Target: ATXN1; (-) strand; PAM type: NRG; PAM sequence: AGG
agatgtttgggaggaatcag

SEQ ID NO: 61667 - DNA, 20 bp, Artificial Sequence
  Description of Artificial Sequence: Synthetic oligonucleotide
  Target: ATXN1; (-) strand; PAM type: NRG; PAM sequence: GAG
tagatgtttgggaggaatca

SEQ ID NO: 61668 - DNA, 20 bp, Artificial Sequence
  Description of Artificial Sequence: Synthetic oligonucleotide
  Target: ATXN1; (-) strand; PAM type: NRG; PAM sequence: CAG
agtagatgtttgggaggaat

SEQ ID NO: 61669 - DNA, 20 bp, Artificial Sequence
  Description of Artificial Sequence: Synthetic oligonucleotide
  Target: ATXN1; (-) strand; PAM type: NRG; PAM sequence: AGG
gacatgagtagatgtttggg

SEQ ID NO: 61670 - DNA, 20 bp, Artificial Sequence
  Description of Artificial Sequence: Synthetic oligonucleotide
  Target: ATXN1; (-) strand; PAM type: NRG; PAM sequence: GAG
agacatgagtagatgtttgg

SEQ ID NO: 61671 - DNA, 20 bp, Artificial Sequence
  Description of Artificial Sequence: Synthetic oligonucleotide
  Target: ATXN1; (-) strand; PAM type: NRG; PAM sequence: GGG
ggagacatgagtagatgttt

SEQ ID NO: 61672 - DNA, 20 bp, Artificial Sequence
  Description of Artificial Sequence: Synthetic oligonucleotide
  Target: ATXN1; (-) strand; PAM type: NRG; PAM sequence: TGG
tggagacatgagtagatgtt

SEQ ID NO: 61673 - DNA, 20 bp, Artificial Sequence
  Description of Artificial Sequence: Synthetic oligonucleotide
  Target: ATXN1; (-) strand; PAM type: NRG; PAM sequence: TAG
tgcagagttggagacatgag

SEQ ID NO: 61674 - DNA, 20 bp, Artificial Sequence
  Description of Artificial Sequence: Synthetic oligonucleotide
  Target: ATXN1; (-) strand; PAM type: NRG; PAM sequence: GAG
gcatgcagagttggagacat

SEQ ID NO: 61675 - DNA, 20 bp, Artificial Sequence
  Description of Artificial Sequence: Synthetic oligonucleotide
  Target: ATXN1; (-) strand; PAM type: NRG; PAM sequence: GAG
agcactggcatgcagagttg

SEQ ID NO: 61676 - DNA, 20 bp, Artificial Sequence
  Description of Artificial Sequence: Synthetic oligonucleotide
  Target: ATXN1; (-) strand; PAM type: NRG; PAM sequence: TGG
tcagcactggcatgcagagt

SEQ ID NO: 61677 - DNA, 20 bp, Artificial Sequence
  Description of Artificial Sequence: Synthetic oligonucleotide
  Target: ATXN1; (-) strand; PAM type: NRG; PAM sequence: GAG
tttatcagcactggcatgca

SEQ ID NO: 61678 - DNA, 20 bp, Artificial Sequence
  Description of Artificial Sequence: Synthetic oligonucleotide
  Target: ATXN1; (-) strand; PAM type: NRG; PAM sequence: CAG
tgtttatcagcactggcatg

SEQ ID NO: 61679 - DNA, 20 bp, Artificial Sequence
  Description of Artificial Sequence: Synthetic oligonucleotide
  Target: ATXN1; (-) strand; PAM type: NRG; PAM sequence: TGG
ttttgcttgtttatcagcac

SEQ ID NO: 61680 - DNA, 20 bp, Artificial Sequence
  Description of Artificial Sequence: Synthetic oligonucleotide
  Target: ATXN1; (-) strand; PAM type: NRG; PAM sequence: CAG
ttaatgttttgcttgtttat

SEQ ID NO: 61681 - DNA, 20 bp, Artificial Sequence
  Description of Artificial Sequence: Synthetic oligonucleotide
  Target: ATXN1; (-) strand; PAM type: NRG; PAM sequence: AGG
atcagtttttcttgtgaatt

SEQ ID NO: 61682 - DNA, 20 bp, Artificial Sequence
  Description of Artificial Sequence: Synthetic oligonucleotide
  Target: ATXN1; (-) strand; PAM type: NRG; PAM sequence: TAG
tatcagtttttcttgtgaat

SEQ ID NO: 61683 - DNA, 20 bp, Artificial Sequence
  Description of Artificial Sequence: Synthetic oligonucleotide
  Target: ATXN1; (-) strand; PAM type: NRG; PAM sequence: CAG
ctcaaagcatctgatggtat

SEQ ID NO: 61684 - DNA, 20 bp, Artificial Sequence
  Description of Artificial Sequence: Synthetic oligonucleotide
  Target: ATXN1; (-) strand; PAM type: NRG; PAM sequence: TGG
ggcgatctcaaagcatctga

SEQ ID NO: 61685 - DNA, 20 bp, Artificial Sequence
  Description of Artificial Sequence: Synthetic oligonucleotide
  Target: ATXN1; (-) strand; PAM type: NRG; PAM sequence: AAG
caagatgttaggcgatctca

SEQ ID NO: 61686 - DNA, 20 bp, Artificial Sequence
  Description of Artificial Sequence: Synthetic oligonucleotide
  Target: ATXN1; (-) strand; PAM type: NRG; PAM sequence: AGG
gactgccgggccaagatgtt

SEQ ID NO: 61687 - DNA, 20 bp, Artificial Sequence
  Description of Artificial Sequence: Synthetic oligonucleotide
  Target: ATXN1; (-) strand; PAM type: NRG; PAM sequence: TAG
ggactgccgggccaagatgt

SEQ ID NO: 61688 - DNA, 20 bp, Artificial Sequence
  Description of Artificial Sequence: Synthetic oligonucleotide
  Target: ATXN1; (-) strand; PAM type: NRG; PAM sequence: AAG
aatgtggggactgccgggcc

SEQ ID NO: 61689 - DNA, 20 bp, Artificial Sequence
  Description of Artificial Sequence: Synthetic oligonucleotide
  Target: ATXN1; (-) strand; PAM type: NRG; PAM sequence: GGG
ggcagaatgtggggactgcc

SEQ ID NO: 61690 - DNA, 20 bp, Artificial Sequence
  Description of Artificial Sequence: Synthetic oligonucleotide
  Target: ATXN1; (-) strand; PAM type: NRG; PAM sequence: CGG
aggcagaatgtggggactgc

SEQ ID NO: 61691 - DNA, 20 bp, Artificial Sequence
  Description of Artificial Sequence: Synthetic oligonucleotide
  Target: ATXN1; (-) strand; PAM type: NRG; PAM sequence: GGG
ggtagtccaggcagaatgtg

SEQ ID NO: 61692 - DNA, 20 bp, Artificial Sequence
  Description of Artificial Sequence: Synthetic oligonucleotide
  Target: ATXN1; (-) strand; PAM type: NRG; PAM sequence: GGG
gggtagtccaggcagaatgt

SEQ ID NO: 61693 - DNA, 20 bp, Artificial Sequence
  Description of Artificial Sequence: Synthetic oligonucleotide
  Target: ATXN1; (-) strand; PAM type: NRG; PAM sequence: TGG
tgggtagtccaggcagaatg

SEQ ID NO: 61694 - DNA, 20 bp, Artificial Sequence
  Description of Artificial Sequence: Synthetic oligonucleotide
  Target: ATXN1; (-) strand; PAM type: NRG; PAM sequence: CAG
gaattaatgggtagtccagg

SEQ ID NO: 61695 - DNA, 20 bp, Artificial Sequence
  Description of Artificial Sequence: Synthetic oligonucleotide
  Target: ATXN1; (-) strand; PAM type: NRG; PAM sequence: AGG
aatgaattaatgggtagtcc

SEQ ID NO: 61696 - DNA, 20 bp, Artificial Sequence
  Description of Artificial Sequence: Synthetic oligonucleotide
  Target: ATXN1; (-) strand; PAM type: NRG; PAM sequence: CAG
aaatgaattaatgggtagtc

SEQ ID NO: 61697 - DNA, 20 bp, Artificial Sequence
  Description of Artificial Sequence: Synthetic oligonucleotide
  Target: ATXN1; (-) strand; PAM type: NRG; PAM sequence: TAG
ataacaaatgaattaatggg

SEQ ID NO: 61698 - DNA, 20 bp, Artificial Sequence
  Description of Artificial Sequence: Synthetic oligonucleotide
  Target: ATXN1; (-) strand; PAM type: NRG; PAM sequence: GGG
agaataacaaatgaattaat

SEQ ID NO: 61699 - DNA, 20 bp, Artificial Sequence
  Description of Artificial Sequence: Synthetic oligonucleotide
  Target: ATXN1; (-) strand; PAM type: NRG; PAM sequence: TGG
gagaataacaaatgaattaa

SEQ ID NO: 61700 - DNA, 20 bp, Artificial Sequence
  Description of Artificial Sequence: Synthetic oligonucleotide
  Target: ATXN1; (-) strand; PAM type: NRG; PAM sequence: GAG
ggtacagatagaatcccacg

SEQ ID NO: 61701 - DNA, 20 bp, Artificial Sequence
  Description of Artificial Sequence: Synthetic oligonucleotide
  Target: ATXN1; (-) strand; PAM type: NRG; PAM sequence: CGG
ctggtacagatagaatccca

SEQ ID NO: 61702 - DNA, 20 bp, Artificial Sequence
  Description of Artificial Sequence: Synthetic oligonucleotide
  Target: ATXN1; (-) strand; PAM type: NRG; PAM sequence: TAG
catggtctttctggtacaga

SEQ ID NO: 61703 - DNA, 20 bp, Artificial Sequence
  Description of Artificial Sequence: Synthetic oligonucleotide
  Target: ATXN1; (-) strand; PAM type: NRG; PAM sequence: CAG
accacatggtctttctggta

SEQ ID NO: 61704 - DNA, 20 bp, Artificial Sequence
  Description of Artificial Sequence: Synthetic oligonucleotide
  Target: ATXN1; (-) strand; PAM type: NRG; PAM sequence: TGG
catggaccacatggtctttc

SEQ ID NO: 61705 - DNA, 20 bp, Artificial Sequence
  Description of Artificial Sequence: Synthetic oligonucleotide
  Target: ATXN1; (-) strand; PAM type: NRG; PAM sequence: TGG
actaaggatcatggaccaca

SEQ ID NO: 61706 - DNA, 20 bp, Artificial Sequence
  Description of Artificial Sequence: Synthetic oligonucleotide
  Target: ATXN1; (-) strand; PAM type: NRG; PAM sequence: TGG
gtgtcacttactaaggatca

SEQ ID NO: 61707 - DNA, 20 bp, Artificial Sequence
  Description of Artificial Sequence: Synthetic oligonucleotide
  Target: ATXN1; (-) strand; PAM type: NRG; PAM sequence: AGG
catgggagtgtcacttacta

SEQ ID NO: 61708 - DNA, 20 bp, Artificial Sequence
  Description of Artificial Sequence: Synthetic oligonucleotide
  Target: ATXN1; (-) strand; PAM type: NRG; PAM sequence: AAG
tcatgggagtgtcacttact

SEQ ID NO: 61709 - DNA, 20 bp, Artificial Sequence
  Description of Artificial Sequence: Synthetic oligonucleotide
  Target: ATXN1; (-) strand; PAM type: NRG; PAM sequence: GAG
acttactaagtgtatcatgg

SEQ ID NO: 61710 - DNA, 20 bp, Artificial Sequence
  Description of Artificial Sequence: Synthetic oligonucleotide
  Target: ATXN1; (-) strand; PAM type: NRG; PAM sequence: GGG
tcacttactaagtgtatcat

SEQ ID NO: 61711 - DNA, 20 bp, Artificial Sequence
  Description of Artificial Sequence: Synthetic oligonucleotide
  Target: ATXN1; (-) strand; PAM type: NRG; PAM sequence: TGG
gtcacttactaagtgtatca

SEQ ID NO: 61712 - DNA, 20 bp, Artificial Sequence
  Description of Artificial Sequence: Synthetic oligonucleotide
  Target: ATXN1; (-) strand; PAM type: NRG; PAM sequence: AAG
ggaggaaaacgtcacttact

SEQ ID NO: 61713 - DNA, 20 bp, Artificial Sequence
  Description of Artificial Sequence: Synthetic oligonucleotide
  Target: ATXN1; (-) strand; PAM type: NRG; PAM sequence: AGG
catctgggcaggcctccagg

SEQ ID NO: 61714 - DNA, 20 bp, Artificial Sequence
  Description of Artificial Sequence: Synthetic oligonucleotide
  Target: ATXN1; (-) strand; PAM type: NRG; PAM sequence: GAG
tcatctgggcaggcctccag

SEQ ID NO: 61715 - DNA, 20 bp, Artificial Sequence
  Description of Artificial Sequence: Synthetic oligonucleotide
  Target: ATXN1; (-) strand; PAM type: NRG; PAM sequence: AGG
cctcatctgggcaggcctcc

SEQ ID NO: 61716 - DNA, 20 bp, Artificial Sequence
  Description of Artificial Sequence: Synthetic oligonucleotide
  Target: ATXN1; (-) strand; PAM type: NRG; PAM sequence: CAG
ccctcatctgggcaggcctc

SEQ ID NO: 61717 - DNA, 20 bp, Artificial Sequence
  Description of Artificial Sequence: Synthetic oligonucleotide
  Target: ATXN1; (-) strand; PAM type: NRG; PAM sequence: AGG
tccatttccctcatctgggc

SEQ ID NO: 61718 - DNA, 20 bp, Artificial Sequence
  Description of Artificial Sequence: Synthetic oligonucleotide
  Target: ATXN1; (-) strand; PAM type: NRG; PAM sequence: CAG
ttccatttccctcatctggg

SEQ ID NO: 61719 - DNA, 20 bp, Artificial Sequence
  Description of Artificial Sequence: Synthetic oligonucleotide
  Target: ATXN1; (-) strand; PAM type: NRG; PAM sequence: GGG
attttccatttccctcatct

SEQ ID NO: 61720 - DNA, 20 bp, Artificial Sequence
  Description of Artificial Sequence: Synthetic oligonucleotide
  Target: ATXN1; (-) strand; PAM type: NRG; PAM sequence: TGG
gattttccatttccctcatc

SEQ ID NO: 61721 - DNA, 20 bp, Artificial Sequence
  Description of Artificial Sequence: Synthetic oligonucleotide
  Target: ATXN1; (-) strand; PAM type: NRG; PAM sequence: AGG
ggcagtcaccttgctcaaag

SEQ ID NO: 61722 - DNA, 20 bp, Artificial Sequence
  Description of Artificial Sequence: Synthetic oligonucleotide
  Target: ATXN1; (-) strand; PAM type: NRG; PAM sequence: GAG
tggcagtcaccttgctcaaa

SEQ ID NO: 61723 - DNA, 20 bp, Artificial Sequence
  Description of Artificial Sequence: Synthetic oligonucleotide
  Target: ATXN1; (-) strand; PAM type: NRG; PAM sequence: AAG
gttggcagtcaccttgctca

SEQ ID NO: 61724 - DNA, 20 bp, Artificial Sequence
  Description of Artificial Sequence: Synthetic oligonucleotide
  Target: ATXN1; (-) strand; PAM type: NRG; PAM sequence: CAG
gagggtcagaagggagttgg

SEQ ID NO: 61725 - DNA, 20 bp, Artificial Sequence
  Description of Artificial Sequence: Synthetic oligonucleotide
  Target: ATXN1; (-) strand; PAM type: NRG; PAM sequence: TGG
cgagagggtcagaagggagt

SEQ ID NO: 61726 - DNA, 20 bp, Artificial Sequence
  Description of Artificial Sequence: Synthetic oligonucleotide
  Target: ATXN1; (-) strand; PAM type: NRG; PAM sequence: GAG
gcctcgagagggtcagaagg

SEQ ID NO: 61727 - DNA, 20 bp, Artificial Sequence
  Description of Artificial Sequence: Synthetic oligonucleotide
  Target: ATXN1; (-) strand; PAM type: NRG; PAM sequence: GGG
tggcctcgagagggtcagaa

SEQ ID NO: 61728 - DNA, 20 bp, Artificial Sequence
  Description of Artificial Sequence: Synthetic oligonucleotide
  Target: ATXN1; (-) strand; PAM type: NRG; PAM sequence: AGG
gtggcctcgagagggtcaga

SEQ ID NO: 61729 - DNA, 20 bp, Artificial Sequence
  Description of Artificial Sequence: Synthetic oligonucleotide
  Target: ATXN1; (-) strand; PAM type: NRG; PAM sequence: AAG
ggtggcctcgagagggtcag

SEQ ID NO: 61730 - DNA, 20 bp, Artificial Sequence
  Description of Artificial Sequence: Synthetic oligonucleotide
  Target: ATXN1; (-) strand; PAM type: NRG; PAM sequence: CAG
gagggtggcctcgagagggt

SEQ ID NO: 61731 - DNA, 20 bp, Artificial Sequence
  Description of Artificial Sequence: Synthetic oligonucleotide
  Target: ATXN1; (-) strand; PAM type: NRG; PAM sequence: GGG
ggaagagggtggcctcgaga

SEQ ID NO: 61732 - DNA, 20 bp, Artificial Sequence
  Description of Artificial Sequence: Synthetic oligonucleotide
  Target: ATXN1; (-) strand; PAM type: NRG; PAM sequence: AGG
tggaagagggtggcctcgag

SEQ ID NO: 61733 - DNA, 20 bp, Artificial Sequence
  Description of Artificial Sequence: Synthetic oligonucleotide
  Target: ATXN1; (-) strand; PAM type: NRG; PAM sequence: GAG
gtggaagagggtggcctcga

SEQ ID NO: 61734 - DNA, 20 bp, Artificial Sequence
  Description of Artificial Sequence: Synthetic oligonucleotide
  Target: ATXN1; (-) strand; PAM type: NRG; PAM sequence: GAG
tggtggaagagggtggcctc

SEQ ID NO: 61735 - DNA, 20 bp, Artificial Sequence
  Description of Artificial Sequence: Synthetic oligonucleotide
  Target: ATXN1; (-) strand; PAM type: NRG; PAM sequence: TGG
ggagtggtggtggaagaggg

SEQ ID NO: 61736 - DNA, 20 bp, Artificial Sequence
  Description of Artificial Sequence: Synthetic oligonucleotide
  Target: ATXN1; (-) strand; PAM type: NRG; PAM sequence: GGG
aagggagtggtggtggaaga

SEQ ID NO: 61737 - DNA, 20 bp, Artificial Sequence
  Description of Artificial Sequence: Synthetic oligonucleotide
  Target: ATXN1; (-) strand; PAM type: NRG; PAM sequence: AGG
taagggagtggtggtggaag

SEQ ID NO: 61738 - DNA, 20 bp, Artificial Sequence
  Description of Artificial Sequence: Synthetic oligonucleotide
  Target: ATXN1; (-) strand; PAM type: NRG; PAM sequence: GAG
gtaagggagtggtggtggaa

SEQ ID NO: 61739 - DNA, 20 bp, Artificial Sequence
  Description of Artificial Sequence: Synthetic oligonucleotide
  Target: ATXN1; (-) strand; PAM type: NRG; PAM sequence: AAG
aagtaagggagtggtggtgg

SEQ ID NO: 61740 - DNA, 20 bp, Artificial Sequence
  Description of Artificial Sequence: Synthetic oligonucleotide
  Target: ATXN1; (-) strand; PAM type: NRG; PAM sequence: TGG
ggcaagtaagggagtggtgg

SEQ ID NO: 61741 - DNA, 20 bp, Artificial Sequence
  Description of Artificial Sequence: Synthetic oligonucleotide
  Target: ATXN1; (-) strand; PAM type: NRG; PAM sequence: TGG
aaaggcaagtaagggagtgg

SEQ ID NO: 61742 - DNA, 20 bp, Artificial Sequence
  Description of Artificial Sequence: Synthetic oligonucleotide
  Target: ATXN1; (-) strand; PAM type: NRG; PAM sequence: TGG
gttaaaggcaagtaagggag

SEQ ID NO: 61743 - DNA, 20 bp, Artificial Sequence
  Description of Artificial Sequence: Synthetic oligonucleotide
  Target: ATXN1; (-) strand; PAM type: NRG; PAM sequence: GAG
ttcgttaaaggcaagtaagg

SEQ ID NO: 61744 - DNA, 20 bp, Artificial Sequence
  Description of Artificial Sequence: Synthetic oligonucleotide
  Target: ATXN1; (-) strand; PAM type: NRG; PAM sequence: GGG
acttcgttaaaggcaagtaa

SEQ ID NO: 61745 - DNA, 20 bp, Artificial Sequence
  Description of Artificial Sequence: Synthetic oligonucleotide
  Target: ATXN1; (-) strand; PAM type: NRG; PAM sequence: AGG
cacttcgttaaaggcaagta

SEQ ID NO: 61746 - DNA, 20 bp, Artificial Sequence
  Description of Artificial Sequence: Synthetic oligonucleotide
  Target: ATXN1; (-) strand; PAM type: NRG; PAM sequence: AAG
gcacttcgttaaaggcaagt

SEQ ID NO: 61747 - DNA, 20 bp, Artificial Sequence
  Description of Artificial Sequence: Synthetic oligonucleotide
  Target: ATXN1; (-) strand; PAM type: NRG; PAM sequence: AAG
gctggcacttcgttaaaggc

SEQ ID NO: 61748 - DNA, 20 bp, Artificial Sequence
  Description of Artificial Sequence: Synthetic oligonucleotide
  Target: ATXN1; (-) strand; PAM type: NRG; PAM sequence: AGG
gctggctggcacttcgttaa

SEQ ID NO: 61749 - DNA, 20 bp, Artificial Sequence
  Description of Artificial Sequence: Synthetic oligonucleotide
  Target: ATXN1; (-) strand; PAM type: NRG; PAM sequence: AAG
tgctggctggcacttcgtta

SEQ ID NO: 61750 - DNA, 20 bp, Artificial Sequence
  Description of Artificial Sequence: Synthetic oligonucleotide
  Target: ATXN1; (-) strand; PAM type: NRG; PAM sequence: TGG
tgtcctagcaacgtgctggc

SEQ ID NO: 61751 - DNA, 20 bp, Artificial Sequence
  Description of Artificial Sequence: Synthetic oligonucleotide
  Target: ATXN1; (-) strand; PAM type: NRG; PAM sequence: TGG
cagttgtcctagcaacgtgc

SEQ ID NO: 61752 - DNA, 20 bp, Artificial Sequence
  Description of Artificial Sequence: Synthetic oligonucleotide
  Target: ATXN1; (-) strand; PAM type: NRG; PAM sequence: TAG
cgcagtgacgccagttgtcc

SEQ ID NO: 61753 - DNA, 20 bp, Artificial Sequence
  Description of Artificial Sequence: Synthetic oligonucleotide
  Target: ATXN1; (-) strand; PAM type: NRG; PAM sequence: CAG
ctgtgcctccgcagtgacgc

SEQ ID NO: 61754 - DNA, 20 bp, Artificial Sequence
  Description of Artificial Sequence: Synthetic oligonucleotide
  Target: ATXN1; (-) strand; PAM type: NRG; PAM sequence: CAG
gatctatttctgtgcctccg

SEQ ID NO: 61755 - DNA, 20 bp, Artificial Sequence
  Description of Artificial Sequence: Synthetic oligonucleotide
  Target: ATXN1; (-) strand; PAM type: NRG; PAM sequence: TGG
atccaggttcctagccccac

SEQ ID NO: 61756 - DNA, 20 bp, Artificial Sequence
  Description of Artificial Sequence: Synthetic oligonucleotide
  Target: ATXN1; (-) strand; PAM type: NRG; PAM sequence: TAG
gcgtttataatccaggttcc

SEQ ID NO: 61757 - DNA, 20 bp, Artificial Sequence
  Description of Artificial Sequence: Synthetic oligonucleotide
  Target: ATXN1; (-) strand; PAM type: NRG; PAM sequence: AGG
gtcattggcgtttataatcc

SEQ ID NO: 61758 - DNA, 20 bp, Artificial Sequence
  Description of Artificial Sequence: Synthetic oligonucleotide
  Target: ATXN1; (-) strand; PAM type: NRG; PAM sequence: CAG
tgtcattggcgtttataatc

SEQ ID NO: 61759 - DNA, 20 bp, Artificial Sequence
  Description of Artificial Sequence: Synthetic oligonucleotide
  Target: ATXN1; (-) strand; PAM type: NRG; PAM sequence: TGG
cagtatctcatcactgtcat

SEQ ID NO: 61760 - DNA, 20 bp, Artificial Sequence
  Description of Artificial Sequence: Synthetic oligonucleotide
  Target: ATXN1; (-) strand; PAM type: NRG; PAM sequence: CAG
gggacagattagctgccaat

SEQ ID NO: 61761 - DNA, 20 bp, Artificial Sequence
  Description of Artificial Sequence: Synthetic oligonucleotide
  Target: ATXN1; (-) strand; PAM type: NRG; PAM sequence: TAG
acttgctataggggacagat

SEQ ID NO: 61762 - DNA, 20 bp, Artificial Sequence
  Description of Artificial Sequence: Synthetic oligonucleotide
  Target: ATXN1; (-) strand; PAM type: NRG; PAM sequence: CAG
cggtcacttgctatagggga

SEQ ID NO: 61763 - DNA, 20 bp, Artificial Sequence
  Description of Artificial Sequence: Synthetic oligonucleotide
  Target: ATXN1; (-) strand; PAM type: NRG; PAM sequence: GGG
tactcggtcacttgctatag

SEQ ID NO: 61764 - DNA, 20 bp, Artificial Sequence
  Description of Artificial Sequence: Synthetic oligonucleotide
  Target: ATXN1; (-) strand; PAM type: NRG; PAM sequence: GGG
ttactcggtcacttgctata

SEQ ID NO: 61765 - DNA, 20 bp, Artificial Sequence
  Description of Artificial Sequence: Synthetic oligonucleotide
  Target: ATXN1; (-) strand; PAM type: NRG; PAM sequence: AGG
gttactcggtcacttgctat

SEQ ID NO: 61766 - DNA, 20 bp, Artificial Sequence
  Description of Artificial Sequence: Synthetic oligonucleotide
  Target: ATXN1; (-) strand; PAM type: NRG; PAM sequence: TAG
tgttactcggtcacttgcta

SEQ ID NO: 61767 - DNA, 20 bp, Artificial Sequence
  Description of Artificial Sequence: Synthetic oligonucleotide
  Target: ATXN1; (-) strand; PAM type: NRG; PAM sequence: CGG
gcccactgggtagtgttact

SEQ ID NO: 61768 - DNA, 20 bp, Artificial Sequence
  Description of Artificial Sequence: Synthetic oligonucleotide
  Target: ATXN1; (-) strand; PAM type: NRG; PAM sequence: TAG
ggtgagagctgcccactggg

SEQ ID NO: 61769 - DNA, 20 bp, Artificial Sequence
  Description of Artificial Sequence: Synthetic oligonucleotide
  Target: ATXN1; (-) strand; PAM type: NRG; PAM sequence: GGG
caaggtgagagctgcccact

SEQ ID NO: 61770 - DNA, 20 bp, Artificial Sequence
  Description of Artificial Sequence: Synthetic oligonucleotide
  Target: ATXN1; (-) strand; PAM type: NRG; PAM sequence: TGG
tcaaggtgagagctgcccac

SEQ ID NO: 61771 - DNA, 20 bp, Artificial Sequence
  Description of Artificial Sequence: Synthetic oligonucleotide
  Target: ATXN1; (-) strand; PAM type: NRG; PAM sequence: GAG
agggtagtgtgtcaaggtga

SEQ ID NO: 61772 - DNA, 20 bp, Artificial Sequence
  Description of Artificial Sequence: Synthetic oligonucleotide
  Target: ATXN1; (-) strand; PAM type: NRG; PAM sequence: GAG
aaagggtagtgtgtcaaggt

SEQ ID NO: 61773 - DNA, 20 bp, Artificial Sequence
  Description of Artificial Sequence: Synthetic oligonucleotide
  Target: ATXN1; (-) strand; PAM type: NRG; PAM sequence: AGG
gatgaaagggtagtgtgtca

SEQ ID NO: 61774 - DNA, 20 bp, Artificial Sequence
  Description of Artificial Sequence: Synthetic oligonucleotide
  Target: ATXN1; (-) strand; PAM type: NRG; PAM sequence: AAG
agatgaaagggtagtgtgtc

SEQ ID NO: 61775 - DNA, 20 bp, Artificial Sequence
  Description of Artificial Sequence: Synthetic oligonucleotide
  Target: ATXN1; (-) strand; PAM type: NRG; PAM sequence: TAG
cacaaatgtagatgaaaggg

SEQ ID NO: 61776 - DNA, 20 bp, Artificial Sequence
  Description of Artificial Sequence: Synthetic oligonucleotide
  Target: ATXN1; (-) strand; PAM type: NRG; PAM sequence: GGG
aagcacaaatgtagatgaaa

SEQ ID NO: 61777 - DNA, 20 bp, Artificial Sequence
  Description of Artificial Sequence: Synthetic oligonucleotide
  Target: ATXN1; (-) strand; PAM type: NRG; PAM sequence: AGG
caagcacaaatgtagatgaa

SEQ ID NO: 61778 - DNA, 20 bp, Artificial Sequence
  Description of Artificial Sequence: Synthetic oligonucleotide
  Target: ATXN1; (-) strand; PAM type: NRG; PAM sequence: AAG
tcaagcacaaatgtagatga

SEQ ID NO: 61779 - DNA, 20 bp, Artificial Sequence
  Description of Artificial Sequence: Synthetic oligonucleotide
  Target: ATXN1; (-) strand; PAM type: NRG; PAM sequence: TAG
taccacatcaagcacaaatg

SEQ ID NO: 61780 - DNA, 20 bp, Artificial Sequence
  Description of Artificial Sequence: Synthetic oligonucleotide
  Target: ATXN1; (-) strand; PAM type: NRG; PAM sequence: AAG
ttctcagtcactaccacatc

SEQ ID NO: 61781 - DNA, 20 bp, Artificial Sequence
  Description of Artificial Sequence: Synthetic oligonucleotide
  Target: ATXN1; (-) strand; PAM type: NRG; PAM sequence: CAG
gctagttccttgccccttct

SEQ ID NO: 61782 - DNA, 20 bp, Artificial Sequence
  Description of Artificial Sequence: Synthetic oligonucleotide
  Target: ATXN1; (-) strand; PAM type: NRG; PAM sequence: TAG
atgcagctcctatctaaagc

SEQ ID NO: 61783 - DNA, 20 bp, Artificial Sequence
  Description of Artificial Sequence: Synthetic oligonucleotide
  Target: ATXN1; (-) strand; PAM type: NRG; PAM sequence: AAG
agtcatgcagctcctatcta

SEQ ID NO: 61784 - DNA, 20 bp, Artificial Sequence
  Description of Artificial Sequence: Synthetic oligonucleotide
  Target: ATXN1; (-) strand; PAM type: NRG; PAM sequence: CAG
taattcaaaacagagtcatg

SEQ ID NO: 61785 - DNA, 20 bp, Artificial Sequence
  Description of Artificial Sequence: Synthetic oligonucleotide
  Target: ATXN1; (-) strand; PAM type: NRG; PAM sequence: GAG
ggctcacataattcaaaaca

SEQ ID NO: 61786 - DNA, 20 bp, Artificial Sequence
  Description of Artificial Sequence: Synthetic oligonucleotide
  Target: ATXN1; (-) strand; PAM type: NRG; PAM sequence: CAG
ctggctcacataattcaaaa

SEQ ID NO: 61787 - DNA, 20 bp, Artificial Sequence
  Description of Artificial Sequence: Synthetic oligonucleotide
  Target: ATXN1; (-) strand; PAM type: NRG; PAM sequence: TGG
ggtggttactacatatctac

SEQ ID NO: 61788 - DNA, 20 bp, Artificial Sequence
  Description of Artificial Sequence: Synthetic oligonucleotide
  Target: ATXN1; (-) strand; PAM type: NRG; PAM sequence: TGG
ttaaaggtgcaaatgtcagg

SEQ ID NO: 61789 - DNA, 20 bp, Artificial Sequence
  Description of Artificial Sequence: Synthetic oligonucleotide
  Target: ATXN1; (-) strand; PAM type: NRG; PAM sequence: AGG
aaattaaaggtgcaaatgtc

SEQ ID NO: 61790 - DNA, 20 bp, Artificial Sequence
  Description of Artificial Sequence: Synthetic oligonucleotide
  Target: ATXN1; (-) strand; PAM type: NRG; PAM sequence: CAG
caaattaaaggtgcaaatgt

SEQ ID NO: 61791 - DNA, 20 bp, Artificial Sequence
  Description of Artificial Sequence: Synthetic oligonucleotide
  Target: ATXN1; (-) strand; PAM type: NRG; PAM sequence: AGG
tcaggaaactaacaaattaa

SEQ ID NO: 61792 - DNA, 20 bp, Artificial Sequence
  Description of Artificial Sequence: Synthetic oligonucleotide
  Target: ATXN1; (-) strand; PAM type: NRG; PAM sequence: AAG
ttcaggaaactaacaaatta

SEQ ID NO: 61793 - DNA, 20 bp, Artificial Sequence
  Description of Artificial Sequence: Synthetic oligonucleotide
  Target: ATXN1; (-) strand; PAM type: NRG; PAM sequence: AGG
agccttcctccctaattttc

SEQ ID NO: 61794 - DNA, 20 bp, Artificial Sequence
  Description of Artificial Sequence: Synthetic oligonucleotide
  Target: ATXN1; (-) strand; PAM type: NRG; PAM sequence: CAG
cagccttcctccctaatttt

SEQ ID NO: 61795 - DNA, 20 bp, Artificial Sequence
  Description of Artificial Sequence: Synthetic oligonucleotide
  Target: ATXN1; (-) strand; PAM type: NRG; PAM sequence: CAG
gtcatacttcggcttgtgaa

SEQ ID NO: 61796 - DNA, 20 bp, Artificial Sequence
  Description of Artificial Sequence: Synthetic oligonucleotide
  Target: ATXN1; (-) strand; PAM type: NRG; PAM sequence: CGG
tgtttctggctgtcatactt

SEQ ID NO: 61797 - DNA, 20 bp, Artificial Sequence
  Description of Artificial Sequence: Synthetic oligonucleotide
  Target: ATXN1; (-) strand; PAM type: NRG; PAM sequence: TGG
tcaatggctctacctgtttc

SEQ ID NO: 61798 - DNA, 20 bp, Artificial Sequence
  Description of Artificial Sequence: Synthetic oligonucleotide
  Target: ATXN1; (-) strand; PAM type: NRG; PAM sequence: TGG
cttctgtttggcaacctcaa

SEQ ID NO: 61799 - DNA, 20 bp, Artificial Sequence
  Description of Artificial Sequence: Synthetic oligonucleotide
  Target: ATXN1; (-) strand; PAM type: NRG; PAM sequence: TGG
gattgttttttccttctgtt

SEQ ID NO: 61800 - DNA, 20 bp, Artificial Sequence
  Description of Artificial Sequence: Synthetic oligonucleotide
  Target: ATXN1; (-) strand; PAM type: NRG; PAM sequence: CAG
aaagctattgcttgtccaaa

SEQ ID NO: 61801 - DNA, 20 bp, Artificial Sequence
  Description of Artificial Sequence: Synthetic oligonucleotide
  Target: ATXN1; (-) strand; PAM type: NRG; PAM sequence: AAG
gctattgttcagaaaggaga

SEQ ID NO: 61802 - DNA, 20 bp, Artificial Sequence
  Description of Artificial Sequence: Synthetic oligonucleotide
  Target: ATXN1; (-) strand; PAM type: NRG; PAM sequence: GAG
gaacgctattgttcagaaag

SEQ ID NO: 61803 - DNA, 20 bp, Artificial Sequence
  Description of Artificial Sequence: Synthetic oligonucleotide
  Target: ATXN1; (-) strand; PAM type: NRG; PAM sequence: AGG
tagaacgctattgttcagaa

SEQ ID NO: 61804 - DNA, 20 bp, Artificial Sequence
  Description of Artificial Sequence: Synthetic oligonucleotide
  Target: ATXN1; (-) strand; PAM type: NRG; PAM sequence: AAG
gtagaacgctattgttcaga

SEQ ID NO: 61805 - DNA, 20 bp, Artificial Sequence
  Description of Artificial Sequence: Synthetic oligonucleotide
  Target: ATXN1; (-) strand; PAM type: NRG; PAM sequence: CAG
aagagtagaacgctattgtt

SEQ ID NO: 61806 - DNA, 20 bp, Artificial Sequence
  Description of Artificial Sequence: Synthetic oligonucleotide
  Target: ATXN1; (-) strand; PAM type: NRG; PAM sequence: TAG
tctaaaagaaggtagaagag

SEQ ID NO: 61807 - DNA, 20 bp, Artificial Sequence
  Description of Artificial Sequence: Synthetic oligonucleotide
  Target: ATXN1; (-) strand; PAM type: NRG; PAM sequence: GAG
atctctaaaagaaggtagaa

SEQ ID NO: 61808 - DNA, 20 bp, Artificial Sequence
  Description of Artificial Sequence: Synthetic oligonucleotide
  Target: ATXN1; (-) strand; PAM type: NRG; PAM sequence: AAG
tgatctctaaaagaaggtag

SEQ ID NO: 61809 - DNA, 20 bp, Artificial Sequence
  Description of Artificial Sequence: Synthetic oligonucleotide
  Target: ATXN1; (-) strand; PAM type: NRG; PAM sequence: TAG
ctttgatctctaaaagaagg

SEQ ID NO: 61810 - DNA, 20 bp, Artificial Sequence
  Description of Artificial Sequence: Synthetic oligonucleotide
  Target: ATXN1; (-) strand; PAM type: NRG; PAM sequence: AGG
cttctttgatctctaaaaga

SEQ ID NO: 61811 - DNA, 20 bp, Artificial Sequence
  Description of Artificial Sequence: Synthetic oligonucleotide
  Target: ATXN1; (-) strand; PAM type: NRG; PAM sequence: AAG
ccttctttgatctctaaaag

SEQ ID NO: 61812 - DNA, 20 bp, Artificial Sequence
  Description of Artificial Sequence: Synthetic oligonucleotide
  Target: ATXN1; (-) strand; PAM type: NRG; PAM sequence: AAG
tttccttctttgatctctaa

SEQ ID NO: 61813 - DNA, 20 bp, Artificial Sequence
  Description of Artificial Sequence: Synthetic oligonucleotide
  Target: ATXN1; (-) strand; PAM type: NRG; PAM sequence: CGG
catggcaagccctagttttc

SEQ ID NO: 61814 - DNA, 20 bp, Artificial Sequence
  Description of Artificial Sequence: Synthetic oligonucleotide
  Target: ATXN1; (-) strand; PAM type: NRG; PAM sequence: TAG
tcttcaaccatggcaagccc

SEQ ID NO: 61815 - DNA, 20 bp, Artificial Sequence
  Description of Artificial Sequence: Synthetic oligonucleotide
  Target: ATXN1; (-) strand; PAM type: NRG; PAM sequence: AAG
ttctcttcttcaaccatggc

SEQ ID NO: 61816 - DNA, 20 bp, Artificial Sequence
  Description of Artificial Sequence: Synthetic oligonucleotide
  Target: ATXN1; (-) strand; PAM type: NRG; PAM sequence: TGG
attattctcttcttcaacca

SEQ ID NO: 61817 - DNA, 20 bp, Artificial Sequence
  Description of Artificial Sequence: Synthetic oligonucleotide
  Target: ATXN1; (-) strand; PAM type: NRG; PAM sequence: AAG
aacaaagagaactgggcaca

SEQ ID NO: 61818 - DNA, 20 bp, Artificial Sequence
  Description of Artificial Sequence: Synthetic oligonucleotide
  Target: ATXN1; (-) strand; PAM type: NRG; PAM sequence: GGG
cctgcagaacaaagagaact

SEQ ID NO: 61819 - DNA, 20 bp, Artificial Sequence
  Description of Artificial Sequence: Synthetic oligonucleotide
  Target: ATXN1; (-) strand; PAM type: NRG; PAM sequence: TGG
ccctgcagaacaaagagaac

SEQ ID NO: 61820 - DNA, 20 bp, Artificial Sequence
  Description of Artificial Sequence: Synthetic oligonucleotide
  Target: ATXN1; (-) strand; PAM type: NRG; PAM sequence: GAG
aactcaccctgcagaacaaa

SEQ ID NO: 61821 - DNA, 20 bp, Artificial Sequence
  Description of Artificial Sequence: Synthetic oligonucleotide
  Target: ATXN1; (-) strand; PAM type: NRG; PAM sequence: AAG
aaaactcaccctgcagaaca

SEQ ID NO: 61822 - DNA, 20 bp, Artificial Sequence
  Description of Artificial Sequence: Synthetic oligonucleotide
  Target: ATXN1; (-) strand; PAM type: NRG; PAM sequence: CAG
gcattgtaaaactcaccctg

SEQ ID NO: 61823 - DNA, 20 bp, Artificial Sequence
  Description of Artificial Sequence: Synthetic oligonucleotide
  Target: ATXN1; (-) strand; PAM type: NRG; PAM sequence: AAG
tacgagttgctacccgttat

SEQ ID NO: 61824 - DNA, 20 bp, Artificial Sequence
  Description of Artificial Sequence: Synthetic oligonucleotide
  Target: ATXN1; (-) strand; PAM type: NRG; PAM sequence: GAG
ttaatgcatggggctcctac

SEQ ID NO: 61825 - DNA, 20 bp, Artificial Sequence
  Description of Artificial Sequence: Synthetic oligonucleotide
  Target: ATXN1; (-) strand; PAM type: NRG; PAM sequence: GGG
ataggcagtcttaatgcatg

SEQ ID NO: 61826 - DNA, 20 bp, Artificial Sequence
  Description of Artificial Sequence: Synthetic oligonucleotide
  Target: ATXN1; (-) strand; PAM type: NRG; PAM sequence: GGG
gataggcagtcttaatgcat

SEQ ID NO: 61827 - DNA, 20 bp, Artificial Sequence
  Description of Artificial Sequence: Synthetic oligonucleotide
  Target: ATXN1; (-) strand; PAM type: NRG; PAM sequence: TGG
tgataggcagtcttaatgca

SEQ ID NO: 61828 - DNA, 20 bp, Artificial Sequence
  Description of Artificial Sequence: Synthetic oligonucleotide
  Target: ATXN1; (-) strand; PAM type: NRG; PAM sequence: CAG
aaatccaagactttgatagg

SEQ ID NO: 61829 - DNA, 20 bp, Artificial Sequence
  Description of Artificial Sequence: Synthetic oligonucleotide
  Target: ATXN1; (-) strand; PAM type: NRG; PAM sequence: AGG
ctaaaatccaagactttgat

SEQ ID NO: 61830 - DNA, 20 bp, Artificial Sequence
  Description of Artificial Sequence: Synthetic oligonucleotide
  Target: ATXN1; (-) strand; PAM type: NRG; PAM sequence: TAG
gctaaaatccaagactttga

SEQ ID NO: 61831 - DNA, 20 bp, Artificial Sequence
  Description of Artificial Sequence: Synthetic oligonucleotide
  Target: ATXN1; (-) strand; PAM type: NRG; PAM sequence: AAG
tttctccagggctaaaatcc

SEQ ID NO: 61832 - DNA, 20 bp, Artificial Sequence
  Description of Artificial Sequence: Synthetic oligonucleotide
  Target: ATXN1; (-) strand; PAM type: NRG; PAM sequence: GGG
aaaaaaatgtaatttctcca

SEQ ID NO: 61833 - DNA, 20 bp, Artificial Sequence
  Description of Artificial Sequence: Synthetic oligonucleotide
  Target: ATXN1; (-) strand; PAM type: NRG; PAM sequence: AGG
aaaaaaaatgtaatttctcc

SEQ ID NO: 61834 - DNA, 20 bp, Artificial Sequence
  Description of Artificial Sequence: Synthetic oligonucleotide
  Target: ATXN1; (-) strand; PAM type: NRG; PAM sequence: CAG
aaaaaaaaatgtaatttctc

SEQ ID NO: 61835 - DNA, 20 bp, Artificial Sequence
  Description of Artificial Sequence: Synthetic oligonucleotide
  Target: ATXN1; (-) strand; PAM type: NRG; PAM sequence: TAG
ccaagcctttgtggcttgca

SEQ ID NO: 61836 - DNA, 20 bp, Artificial Sequence
  Description of Artificial Sequence: Synthetic oligonucleotide
  Target: ATXN1; (-) strand; PAM type: NRG; PAM sequence: TGG
ttcttcttcccaagcctttg

SEQ ID NO: 61837 - DNA, 20 bp, Artificial Sequence
  Description of Artificial Sequence: Synthetic oligonucleotide
  Target: ATXN1; (-) strand; PAM type: NRG; PAM sequence: AAG
atttttcctttcttcttccc

SEQ ID NO: 61838 - DNA, 20 bp, Artificial Sequence
  Description of Artificial Sequence: Synthetic oligonucleotide
  Target: ATXN1; (-) strand; PAM type: NRG; PAM sequence: AGG
ggttttctaaagtttccatt

SEQ ID NO: 61839 - DNA, 20 bp, Artificial Sequence
  Description of Artificial Sequence: Synthetic oligonucleotide
  Target: ATXN1; (-) strand; PAM type: NRG; PAM sequence: TAG
tggttttctaaagtttccat

SEQ ID NO: 61840 - DNA, 20 bp, Artificial Sequence
  Description of Artificial Sequence: Synthetic oligonucleotide
  Target: ATXN1; (-) strand; PAM type: NRG; PAM sequence: AAG
cttgataaaatggttttcta

SEQ ID NO: 61841 - DNA, 20 bp, Artificial Sequence
  Description of Artificial Sequence: Synthetic oligonucleotide
  Target: ATXN1; (-) strand; PAM type: NRG; PAM sequence: TGG
taaaaatgctcttgataaaa

SEQ ID NO: 61842 - DNA, 20 bp, Artificial Sequence
  Description of Artificial Sequence: Synthetic oligonucleotide
  Target: ATXN1; (-) strand; PAM type: NRG; PAM sequence: TGG
ccagccttcctttgtgcatc

SEQ ID NO: 61843 - DNA, 20 bp, Artificial Sequence
  Description of Artificial Sequence: Synthetic oligonucleotide
  Target: ATXN1; (-) strand; PAM type: NRG; PAM sequence: CAG
tgcacatcagccatcctcac

SEQ ID NO: 61844 - DNA, 20 bp, Artificial Sequence
  Description of Artificial Sequence: Synthetic oligonucleotide
  Target: ATXN1; (-) strand; PAM type: NRG; PAM sequence: CAG
acgtgtttcaatctgcacat

SEQ ID NO: 61845 - DNA, 20 bp, Artificial Sequence
  Description of Artificial Sequence: Synthetic oligonucleotide
  Target: ATXN1; (-) strand; PAM type: NRG; PAM sequence: TGG
ctgcacaggtcccaggctgt

SEQ ID NO: 61846 - DNA, 20 bp, Artificial Sequence
  Description of Artificial Sequence: Synthetic oligonucleotide
  Target: ATXN1; (-) strand; PAM type: NRG; PAM sequence: AGG
tggacccctgcacaggtccc

SEQ ID NO: 61847 - DNA, 20 bp, Artificial Sequence
  Description of Artificial Sequence: Synthetic oligonucleotide
  Target: ATXN1; (-) strand; PAM type: NRG; PAM sequence: CAG
ctggacccctgcacaggtcc

SEQ ID NO: 61848 - DNA, 20 bp, Artificial Sequence
  Description of Artificial Sequence: Synthetic oligonucleotide
  Target: ATXN1; (-) strand; PAM type: NRG; PAM sequence: AGG
tcgctgctggacccctgcac

SEQ ID NO: 61849 - DNA, 20 bp, Artificial Sequence
  Description of Artificial Sequence: Synthetic oligonucleotide
  Target: ATXN1; (-) strand; PAM type: NRG; PAM sequence: CAG
ttcgctgctggacccctgca

SEQ ID NO: 61850 - DNA, 20 bp, Artificial Sequence
  Description of Artificial Sequence: Synthetic oligonucleotide
  Target: ATXN1; (-) strand; PAM type: NRG; PAM sequence: TGG
ttgctgtcagaattcgctgc

SEQ ID NO: 61851 - DNA, 20 bp, Artificial Sequence
  Description of Artificial Sequence: Synthetic oligonucleotide
  Target: ATXN1; (-) strand; PAM type: NRG; PAM sequence: CAG
tgacctgcccacattgctgt

SEQ ID NO: 61852 - DNA, 20 bp, Artificial Sequence
  Description of Artificial Sequence: Synthetic oligonucleotide
  Target: ATXN1; (-) strand; PAM type: NRG; PAM sequence: AGG
cttgagtgcctggcactggg

SEQ ID NO: 61853 - DNA, 20 bp, Artificial Sequence
  Description of Artificial Sequence: Synthetic oligonucleotide
  Target: ATXN1; (-) strand; PAM type: NRG; PAM sequence: GAG
tcttgagtgcctggcactgg

SEQ ID NO: 61854 - DNA, 20 bp, Artificial Sequence
  Description of Artificial Sequence: Synthetic oligonucleotide
  Target: ATXN1; (-) strand; PAM type: NRG; PAM sequence: GGG
agtcttgagtgcctggcact

SEQ ID NO: 61855 - DNA, 20 bp, Artificial Sequence
  Description of Artificial Sequence: Synthetic oligonucleotide
  Target: ATXN1; (-) strand; PAM type: NRG; PAM sequence: TGG
cagtcttgagtgcctggcac

SEQ ID NO: 61856 - DNA, 20 bp, Artificial Sequence
  Description of Artificial Sequence: Synthetic oligonucleotide
  Target: ATXN1; (-) strand; PAM type: NRG; PAM sequence: TGG
atttcccagtcttgagtgcc

SEQ ID NO: 61857 - DNA, 20 bp, Artificial Sequence
  Description of Artificial Sequence: Synthetic oligonucleotide
  Target: ATXN1; (-) strand; PAM type: NRG; PAM sequence: GAG
tgtgatcatttcccagtctt

SEQ ID NO: 61858 - DNA, 20 bp, Artificial Sequence
  Description of Artificial Sequence: Synthetic oligonucleotide
  Target: ATXN1; (-) strand; PAM type: NRG; PAM sequence: CAG
agcatcttgtgatcatttcc

SEQ ID NO: 61859 - DNA, 20 bp, Artificial Sequence
  Description of Artificial Sequence: Synthetic oligonucleotide
  Target: ATXN1; (-) strand; PAM type: NRG; PAM sequence: CAG
tttctcaatacatttttaaa

SEQ ID NO: 61860 - DNA, 20 bp, Artificial Sequence
  Description of Artificial Sequence: Synthetic oligonucleotide
  Target: ATXN1; (-) strand; PAM type: NRG; PAM sequence: TGG
gtttttatcatcatgctctt

SEQ ID NO: 61861 - DNA, 20 bp, Artificial Sequence
  Description of Artificial Sequence: Synthetic oligonucleotide
  Target: ATXN1; (-) strand; PAM type: NRG; PAM sequence: AGG
tttatttccaaaactcagac

SEQ ID NO: 61862 - DNA, 20 bp, Artificial Sequence
  Description of Artificial Sequence: Synthetic oligonucleotide
  Target: ATXN1; (-) strand; PAM type: NRG; PAM sequence: CAG
ttttatttccaaaactcaga

SEQ ID NO: 61863 - DNA, 20 bp, Artificial Sequence
  Description of Artificial Sequence: Synthetic oligonucleotide
  Target: ATXN1; (-) strand; PAM type: NRG; PAM sequence: CAG
aatcttttatttccaaaact

SEQ ID NO: 61864 - DNA, 20 bp, Artificial Sequence
  Description of Artificial Sequence: Synthetic oligonucleotide
  Target: ATXN1; (-) strand; PAM type: NRG; PAM sequence: TGG
aaacataaatggtatacaaa

SEQ ID NO: 61865 - DNA, 20 bp, Artificial Sequence
  Description of Artificial Sequence: Synthetic oligonucleotide
  Target: ATXN1; (-) strand; PAM type: NRG; PAM sequence: TGG
tccttaaatggaaacataaa

SEQ ID NO: 61866 - DNA, 20 bp, Artificial Sequence
  Description of Artificial Sequence: Synthetic oligonucleotide
  Target: ATXN1; (-) strand; PAM type: NRG; PAM sequence: TGG
ttaaggagagtctccttaaa

SEQ ID NO: 61867 - DNA, 20 bp, Artificial Sequence
  Description of Artificial Sequence: Synthetic oligonucleotide
  Target: ATXN1; (-) strand; PAM type: NRG; PAM sequence: GAG
tgaaacaacttgcttaagga

SEQ ID NO: 61868 - DNA, 20 bp, Artificial Sequence
  Description of Artificial Sequence: Synthetic oligonucleotide
  Target: ATXN1; (-) strand; PAM type: NRG; PAM sequence: GAG
cctgaaacaacttgcttaag

SEQ ID NO: 61869 - DNA, 20 bp, Artificial Sequence
  Description of Artificial Sequence: Synthetic oligonucleotide
  Target: ATXN1; (-) strand; PAM type: NRG; PAM sequence: AGG
ttcctgaaacaacttgctta

SEQ ID NO: 61870 - DNA, 20 bp, Artificial Sequence
  Description of Artificial Sequence: Synthetic oligonucleotide
  Target: ATXN1; (-) strand; PAM type: NRG; PAM sequence: AAG
attcctgaaacaacttgctt

SEQ ID NO: 61871 - DNA, 20 bp, Artificial Sequence
  Description of Artificial Sequence: Synthetic oligonucleotide
  Target: ATXN1; (-) strand; PAM type: NRG; PAM sequence: GAG
ttagagaaattaagttttca

SEQ ID NO: 61872 - DNA, 20 bp, Artificial Sequence
  Description of Artificial Sequence: Synthetic oligonucleotide
  Target: ATXN1; (-) strand; PAM type: NRG; PAM sequence: CAG
tgttagagaaattaagtttt

SEQ ID NO: 61873 - DNA, 20 bp, Artificial Sequence
  Description of Artificial Sequence: Synthetic oligonucleotide
  Target: ATXN1; (-) strand; PAM type: NRG; PAM sequence: AAG
aaacctatgttagagaaatt

SEQ ID NO: 61874 - DNA, 20 bp, Artificial Sequence
  Description of Artificial Sequence: Synthetic oligonucleotide
  Target: ATXN1; (-) strand; PAM type: NRG; PAM sequence: GAG
gctgtttcaaacctatgtta

SEQ ID NO: 61875 - DNA, 20 bp, Artificial Sequence
  Description of Artificial Sequence: Synthetic oligonucleotide
  Target: ATXN1; (-) strand; PAM type: NRG; PAM sequence: TAG
tagctgtttcaaacctatgt

SEQ ID NO: 61876 - DNA, 20 bp, Artificial Sequence
  Description of Artificial Sequence: Synthetic oligonucleotide
  Target: ATXN1; (-) strand; PAM type: NRG; PAM sequence: TAG
tttgaggtgtgatagcaaat

SEQ ID NO: 61877 - DNA, 20 bp, Artificial Sequence
  Description of Artificial Sequence: Synthetic oligonucleotide
  Target: ATXN1; (-) strand; PAM type: NRG; PAM sequence: TAG
aaaatgattttgaggtgtga

SEQ ID NO: 61878 - DNA, 20 bp, Artificial Sequence
  Description of Artificial Sequence: Synthetic oligonucleotide
  Target: ATXN1; (-) strand; PAM type: NRG; PAM sequence: AGG
acaagtataaaatgattttg

SEQ ID NO: 61879 - DNA, 20 bp, Artificial Sequence
  Description of Artificial Sequence: Synthetic oligonucleotide
  Target: ATXN1; (-) strand; PAM type: NRG; PAM sequence: GAG
gacaagtataaaatgatttt

SEQ ID NO: 61880 - DNA, 20 bp, Artificial Sequence
  Description of Artificial Sequence: Synthetic oligonucleotide
  Target: ATXN1; (-) strand; PAM type: NRG; PAM sequence: AAG
cagaaaaagtcatttttgac

SEQ ID NO: 61881 - DNA, 20 bp, Artificial Sequence
  Description of Artificial Sequence: Synthetic oligonucleotide
  Target: ATXN1; (-) strand; PAM type: NRG; PAM sequence: AAG
tatgttacatgattcagaaa

SEQ ID NO: 61882 - DNA, 20 bp, Artificial Sequence
  Description of Artificial Sequence: Synthetic oligonucleotide
  Target: ATXN1; (-) strand; PAM type: NRG; PAM sequence: CAG
aacaagtatgttacatgatt

SEQ ID NO: 61883 - DNA, 20 bp, Artificial Sequence
  Description of Artificial Sequence: Synthetic oligonucleotide
  Target: ATXN1; (-) strand; PAM type: NRG; PAM sequence: AAG
ccttttccagacacctaaac

SEQ ID NO: 61884 - DNA, 20 bp, Artificial Sequence
  Description of Artificial Sequence: Synthetic oligonucleotide
  Target: ATXN1; (-) strand; PAM type: NRG; PAM sequence: CAG
aagattatgttaaccttttc

SEQ ID NO: 61885 - DNA, 20 bp, Artificial Sequence
  Description of Artificial Sequence: Synthetic oligonucleotide
  Target: ATXN1; (-) strand; PAM type: NRG; PAM sequence: AAG
tccatcttctataaatcctg

SEQ ID NO: 61886 - DNA, 20 bp, Artificial Sequence
  Description of Artificial Sequence: Synthetic oligonucleotide
  Target: ATXN1; (-) strand; PAM type: NRG; PAM sequence: AAG
taagtagaattgtagactga

SEQ ID NO: 61887 - DNA, 20 bp, Artificial Sequence
  Description of Artificial Sequence: Synthetic oligonucleotide
  Target: ATXN1; (-) strand; PAM type: NRG; PAM sequence: TAG
attattgctaagtagaattg

SEQ ID NO: 61888 - DNA, 20 bp, Artificial Sequence
  Description of Artificial Sequence: Synthetic oligonucleotide
  Target: ATXN1; (-) strand; PAM type: NRG; PAM sequence: TAG
tgtaataaattattgctaag

SEQ ID NO: 61889 - DNA, 20 bp, Artificial Sequence
  Description of Artificial Sequence: Synthetic oligonucleotide
  Target: ATXN1; (-) strand; PAM type: NRG; PAM sequence: AAG
ctatgtaataaattattgct

SEQ ID NO: 61890 - DNA, 20 bp, Artificial Sequence
  Description of Artificial Sequence: Synthetic oligonucleotide
  Target: ATXN1; (-) strand; PAM type: NRG; PAM sequence: TAG
tcatgttaaatttccagtgg

SEQ ID NO: 61891 - DNA, 20 bp, Artificial Sequence
  Description of Artificial Sequence: Synthetic oligonucleotide
  Target: ATXN1; (-) strand; PAM type: NRG; PAM sequence: TGG
aattcatgttaaatttccag

SEQ ID NO: 61892 - DNA, 20 bp, Artificial Sequence
  Description of Artificial Sequence: Synthetic oligonucleotide
  Target: ATXN1; (-) strand; PAM type: NRG; PAM sequence: CAG
ttaaattcatgttaaatttc

SEQ ID NO: 61893 - DNA, 20 bp, Artificial Sequence
  Description of Artificial Sequence: Synthetic oligonucleotide
  Target: ATXN1; (-) strand; PAM type: NRG; PAM sequence: AAG
taaatttttcacttttgtaa

SEQ ID NO: 61894 - DNA, 20 bp, Artificial Sequence
  Description of Artificial Sequence: Synthetic oligonucleotide
  Target: ATXN1; (-) strand; PAM type: NRG; PAM sequence: AGG
atgtaaacagacaaatagaa

SEQ ID NO: 61895 - DNA, 20 bp, Artificial Sequence
  Description of Artificial Sequence: Synthetic oligonucleotide
  Target: ATXN1; (-) strand; PAM type: NRG; PAM sequence: AAG
aatgtaaacagacaaataga

SEQ ID NO: 61896 - DNA, 20 bp, Artificial Sequence
  Description of Artificial Sequence: Synthetic oligonucleotide
  Target: ATXN1; (-) strand; PAM type: NRG; PAM sequence: TAG
gactaatgtaaacagacaaa

SEQ ID NO: 61897 - DNA, 20 bp, Artificial Sequence
  Description of Artificial Sequence: Synthetic oligonucleotide
  Target: ATXN1; (-) strand; PAM type: NRG; PAM sequence: CAG
ctccttaggactaatgtaaa

SEQ ID NO: 61898 - DNA, 20 bp, Artificial Sequence
  Description of Artificial Sequence: Synthetic oligonucleotide
  Target: ATXN1; (-) strand; PAM type: NRG; PAM sequence: AGG
caacacataaattactcctt

SEQ ID NO: 61899 - DNA, 20 bp, Artificial Sequence
  Description of Artificial Sequence: Synthetic oligonucleotide
  Target: ATXN1; (-) strand; PAM type: NRG; PAM sequence: TAG
acaacacataaattactcct

SEQ ID NO: 61900 - DNA, 20 bp, Artificial Sequence
  Description of Artificial Sequence: Synthetic oligonucleotide
  Target: ATXN1; (-) strand; PAM type: NRG; PAM sequence: TGG
agaacccaaacaaaatctat

SEQ ID NO: 61901 - DNA, 20 bp, Artificial Sequence
  Description of Artificial Sequence: Synthetic oligonucleotide
  Target: ATXN1; (-) strand; PAM type: NRG; PAM sequence: TAG
tagttgacattgtttagtca

SEQ ID NO: 61902 - DNA, 20 bp, Artificial Sequence
  Description of Artificial Sequence: Synthetic oligonucleotide
  Target: ATXN1; (-) strand; PAM type: NRG; PAM sequence: TAG
aagaactagttgacattgtt

SEQ ID NO: 61903 - DNA, 20 bp, Artificial Sequence
  Description of Artificial Sequence: Synthetic oligonucleotide
  Target: ATXN1; (-) strand; PAM type: NRG; PAM sequence: TAG
gactgaatagtgataagaac

SEQ ID NO: 61904 - DNA, 20 bp, Artificial Sequence
  Description of Artificial Sequence: Synthetic oligonucleotide
  Target: ATXN1; (-) strand; PAM type: NRG; PAM sequence: AAG
agggatgactgaatagtgat

SEQ ID NO: 61905 - DNA, 20 bp, Artificial Sequence
  Description of Artificial Sequence: Synthetic oligonucleotide
  Target: ATXN1; (-) strand; PAM type: NRG; PAM sequence: TAG
gaagggcagggatgactgaa

SEQ ID NO: 61906 - DNA, 20 bp, Artificial Sequence
  Description of Artificial Sequence: Synthetic oligonucleotide
  Target: ATXN1; (-) strand; PAM type: NRG; PAM sequence: GGG
atccacaataaagaagggca

SEQ ID NO: 61907 - DNA, 20 bp, Artificial Sequence
  Description of Artificial Sequence: Synthetic oligonucleotide
  Target: ATXN1; (-) strand; PAM type: NRG; PAM sequence: AGG
aatccacaataaagaagggc

SEQ ID NO: 61908 - DNA, 20 bp, Artificial Sequence
  Description of Artificial Sequence: Synthetic oligonucleotide
  Target: ATXN1; (-) strand; PAM type: NRG; PAM sequence: CAG
gaatccacaataaagaaggg

SEQ ID NO: 61909 - DNA, 20 bp, Artificial Sequence
  Description of Artificial Sequence: Synthetic oligonucleotide
  Target: ATXN1; (-) strand; PAM type: NRG; PAM sequence: GGG
caagaatccacaataaagaa

SEQ ID NO: 61910 - DNA, 20 bp, Artificial Sequence
  Description of Artificial Sequence: Synthetic oligonucleotide
  Target: ATXN1; (-) strand; PAM type: NRG; PAM sequence: AGG
tcaagaatccacaataaaga

SEQ ID NO: 61911 - DNA, 20 bp, Artificial Sequence
  Description of Artificial Sequence: Synthetic oligonucleotide
  Target: ATXN1; (-) strand; PAM type: NRG; PAM sequence: AAG
ttcaagaatccacaataaag

SEQ ID NO: 61912 - DNA, 20 bp, Artificial Sequence
  Description of Artificial Sequence: Synthetic oligonucleotide
  Target: ATXN1; (-) strand; PAM type: NRG; PAM sequence: AAG
atgttcaagaatccacaata

SEQ ID NO: 61913 - DNA, 20 bp, Artificial Sequence
  Description of Artificial Sequence: Synthetic oligonucleotide
  Target: ATXN1; (-) strand; PAM type: NRG; PAM sequence: AAG
attcgaagtgctcaatgttc

SEQ ID NO: 61914 - DNA, 20 bp, Artificial Sequence
  Description of Artificial Sequence: Synthetic oligonucleotide
  Target: ATXN1; (-) strand; PAM type: NRG; PAM sequence: AAG
ttttaggtggtataaattcg

SEQ ID NO: 61915 - DNA, 20 bp, Artificial Sequence
  Description of Artificial Sequence: Synthetic oligonucleotide
  Target: ATXN1; (-) strand; PAM type: NRG; PAM sequence: TGG
ctaaagatgtattttttagg

SEQ ID NO: 61916 - DNA, 20 bp, Artificial Sequence
  Description of Artificial Sequence: Synthetic oligonucleotide
  Target: ATXN1; (-) strand; PAM type: NRG; PAM sequence: AGG
aaactaaagatgtatttttt

SEQ ID NO: 61917 - DNA, 20 bp, Artificial Sequence
  Description of Artificial Sequence: Synthetic oligonucleotide
  Target: ATXN1; (-) strand; PAM type: NRG; PAM sequence: TAG
aaaactaaagatgtattttt

SEQ ID NO: 61918 - DNA, 20 bp, Artificial Sequence
  Description of Artificial Sequence: Synthetic oligonucleotide
  Target: ATXN1; (-) strand; PAM type: NRG; PAM sequence: AAG
gaaaaacccaaacaaaacta

SEQ ID NO: 61919 - DNA, 20 bp, Artificial Sequence
  Description of Artificial Sequence: Synthetic oligonucleotide
  Target: ATXN1; (-) strand; PAM type: NRG; PAM sequence: CAG
gtttccaactgaactttgta

SEQ ID NO: 61920 - DNA, 20 bp, Artificial Sequence
  Description of Artificial Sequence: Synthetic oligonucleotide
  Target: ATXN1; (-) strand; PAM type: NRG; PAM sequence: CAG
cctcccagcattagtaaggg

SEQ ID NO: 61921 - DNA, 20 bp, Artificial Sequence
  Description of Artificial Sequence: Synthetic oligonucleotide
  Target: ATXN1; (-) strand; PAM type: NRG; PAM sequence: GGG
atgcctcccagcattagtaa

SEQ ID NO: 61922 - DNA, 20 bp, Artificial Sequence
  Description of Artificial Sequence: Synthetic oligonucleotide
  Target: ATXN1; (-) strand; PAM type: NRG; PAM sequence: AGG
gatgcctcccagcattagta

SEQ ID NO: 61923 - DNA, 20 bp, Artificial Sequence
  Description of Artificial Sequence: Synthetic oligonucleotide
  Target: ATXN1; (-) strand; PAM type: NRG; PAM sequence: AAG
tgatgcctcccagcattagt

SEQ ID NO: 61924 - DNA, 20 bp, Artificial Sequence
  Description of Artificial Sequence: Synthetic oligonucleotide
  Target: ATXN1; (-) strand; PAM type: NRG; PAM sequence: TAG
agaatgatgcctcccagcat

SEQ ID NO: 61925 - DNA, 20 bp, Artificial Sequence
  Description of Artificial Sequence: Synthetic oligonucleotide
  Target: ATXN1; (-) strand; PAM type: NRG; PAM sequence: CAG
gcctaaagaatgatgcctcc

SEQ ID NO: 61926 - DNA, 20 bp, Artificial Sequence
  Description of Artificial Sequence: Synthetic oligonucleotide
  Target: ATXN1; (-) strand; PAM type: NRG; PAM sequence: AAG
gcaagaacttgggatgccta

SEQ ID NO: 61927 - DNA, 20 bp, Artificial Sequence
  Description of Artificial Sequence: Synthetic oligonucleotide
  Target: ATXN1; (-) strand; PAM type: NRG; PAM sequence: GGG
aaaagttgaagcaagaactt

SEQ ID NO: 61928 - DNA, 20 bp, Artificial Sequence
  Description of Artificial Sequence: Synthetic oligonucleotide
  Target: ATXN1; (-) strand; PAM type: NRG; PAM sequence: TGG
taaaagttgaagcaagaact

SEQ ID NO: 61929 - DNA, 20 bp, Artificial Sequence
  Description of Artificial Sequence: Synthetic oligonucleotide
  Target: ATXN1; (-) strand; PAM type: NRG; PAM sequence: AAG
ttatatgtaaaagttgaagc

SEQ ID NO: 61930 - DNA, 20 bp, Artificial Sequence
  Description of Artificial Sequence: Synthetic oligonucleotide
  Target: ATXN1; (-) strand; PAM type: NRG; PAM sequence: AAG
atctttatatgtaaaagttg

SEQ ID NO: 61931 - DNA, 20 bp, Artificial Sequence
  Description of Artificial Sequence: Synthetic oligonucleotide
  Target: ATXN1; (-) strand; PAM type: NRG; PAM sequence: AAG
ttttggatctttatatgtaa

SEQ ID NO: 61932 - DNA, 20 bp, Artificial Sequence
  Description of Artificial Sequence: Synthetic oligonucleotide
  Target: ATXN1; (-) strand; PAM type: NRG; PAM sequence: TGG
ccactacgcctggcacattt

SEQ ID NO: 61933 - DNA, 20 bp, Artificial Sequence
  Description of Artificial Sequence: Synthetic oligonucleotide
  Target: ATXN1; (-) strand; PAM type: NRG; PAM sequence: TGG
taggcatcagccactacgcc

SEQ ID NO: 61934 - DNA, 20 bp, Artificial Sequence
  Description of Artificial Sequence: Synthetic oligonucleotide
  Target: ATXN1; (-) strand; PAM type: NRG; PAM sequence: CAG
aatgctgggattataggcat

SEQ ID NO: 61935 - DNA, 20 bp, Artificial Sequence
  Description of Artificial Sequence: Synthetic oligonucleotide
  Target: ATXN1; (-) strand; PAM type: NRG; PAM sequence: AGG
tcccaaaatgctgggattat

SEQ ID NO: 61936 - DNA, 20 bp, Artificial Sequence
  Description of Artificial Sequence: Synthetic oligonucleotide
  Target: ATXN1; (-) strand; PAM type: NRG; PAM sequence: TAG
ttcccaaaatgctgggatta

SEQ ID NO: 61937 - DNA, 20 bp, Artificial Sequence
  Description of Artificial Sequence: Synthetic oligonucleotide
  Target: ATXN1; (-) strand; PAM type: NRG; PAM sequence: GGG
cctcggcttcccaaaatgct

SEQ ID NO: 61938 - DNA, 20 bp, Artificial Sequence
  Description of Artificial Sequence: Synthetic oligonucleotide
  Target: ATXN1; (-) strand; PAM type: NRG; PAM sequence: TGG
acctcggcttcccaaaatgc

SEQ ID NO: 61939 - DNA, 20 bp, Artificial Sequence
  Description of Artificial Sequence: Synthetic oligonucleotide
  Target: ATXN1; (-) strand; PAM type: NRG; PAM sequence: CGG
ctcaagtgatctgcccacct

SEQ ID NO: 61940 - DNA, 20 bp, Artificial Sequence
  Description of Artificial Sequence: Synthetic oligonucleotide
  Target: ATXN1; (-) strand; PAM type: NRG; PAM sequence: AAG
gatctcaaactcttgagctc

SEQ ID NO: 61941 - DNA, 20 bp, Artificial Sequence
  Description of Artificial Sequence: Synthetic oligonucleotide
  Target: ATXN1; (-) strand; PAM type: NRG; PAM sequence: GAG
caggctgatctcaaactctt

SEQ ID NO: 61942 - DNA, 20 bp, Artificial Sequence
  Description of Artificial Sequence: Synthetic oligonucleotide
  Target: ATXN1; (-) strand; PAM type: NRG; PAM sequence: AGG
aaggtttcaccatgttggcc

SEQ ID NO: 61943 - DNA, 20 bp, Artificial Sequence
  Description of Artificial Sequence: Synthetic oligonucleotide
  Target: ATXN1; (-) strand; PAM type: NRG; PAM sequence: CAG
caaggtttcaccatgttggc

SEQ ID NO: 61944 - DNA, 20 bp, Artificial Sequence
  Description of Artificial Sequence: Synthetic oligonucleotide
  Target: ATXN1; (-) strand; PAM type: NRG; PAM sequence: TGG
gagacaaggtttcaccatgt

SEQ ID NO: 61945 - DNA, 20 bp, Artificial Sequence
  Description of Artificial Sequence: Synthetic oligonucleotide
  Target: ATXN1; (-) strand; PAM type: NRG; PAM sequence: AGG
ttgtattttttgtagagaca

SEQ ID NO: 61946 - DNA, 20 bp, Artificial Sequence
  Description of Artificial Sequence: Synthetic oligonucleotide
  Target: ATXN1; (-) strand; PAM type: NRG; PAM sequence: AAG
tttgtattttttgtagagac

SEQ ID NO: 61947 - DNA, 20 bp, Artificial Sequence
  Description of Artificial Sequence: Synthetic oligonucleotide
  Target: ATXN1; (-) strand; PAM type: NRG; PAM sequence: GAG
taatttttgtattttttgta

SEQ ID NO: 61948 - DNA, 20 bp, Artificial Sequence
  Description of Artificial Sequence: Synthetic oligonucleotide
  Target: ATXN1; (-) strand; PAM type: NRG; PAM sequence: TAG
gctaatttttgtattttttg

SEQ ID NO: 61949 - DNA, 20 bp, Artificial Sequence
  Description of Artificial Sequence: Synthetic oligonucleotide
  Target: ATXN1; (-) strand; PAM type: NRG; PAM sequence: CGG
caggtgtgcctcacaatgcc

SEQ ID NO: 61950 - DNA, 20 bp, Artificial Sequence
  Description of Artificial Sequence: Synthetic oligonucleotide
  Target: ATXN1; (-) strand; PAM type: NRG; PAM sequence: AGG
tcccaagtagctgggattac

SEQ ID NO: 61951 - DNA, 20 bp, Artificial Sequence
  Description of Artificial Sequence: Synthetic oligonucleotide
  Target: ATXN1; (-) strand; PAM type: NRG; PAM sequence: CAG
ctcccaagtagctgggatta

SEQ ID NO: 61952 - DNA, 20 bp, Artificial Sequence
  Description of Artificial Sequence: Synthetic oligonucleotide
  Target: ATXN1; (-) strand; PAM type: NRG; PAM sequence: GGG
cctcagcctcccaagtagct

SEQ ID NO: 61953 - DNA, 20 bp, Artificial Sequence
  Description of Artificial Sequence: Synthetic oligonucleotide
  Target: ATXN1; (-) strand; PAM type: NRG; PAM sequence: TGG
gcctcagcctcccaagtagc

SEQ ID NO: 61954 - DNA, 20 bp, Artificial Sequence
  Description of Artificial Sequence: Synthetic oligonucleotide
  Target: ATXN1; (-) strand; PAM type: NRG; PAM sequence: TAG
tcctgcctcagcctcccaag

SEQ ID NO: 61955 - DNA, 20 bp, Artificial Sequence
  Description of Artificial Sequence: Synthetic oligonucleotide
  Target: ATXN1; (-) strand; PAM type: NRG; PAM sequence: AAG
ttctcctgcctcagcctccc

SEQ ID NO: 61956 - DNA, 20 bp, Artificial Sequence
  Description of Artificial Sequence: Synthetic oligonucleotide
  Target: ATXN1; (-) strand; PAM type: NRG; PAM sequence: CAG
ttcaagcgattctcctgcct

SEQ ID NO: 61957 - DNA, 20 bp, Artificial Sequence
  Description of Artificial Sequence: Synthetic oligonucleotide
  Target: ATXN1; (-) strand; PAM type: NRG; PAM sequence: AAG
aacctccaccttctgggttc

SEQ ID NO: 61958 - DNA, 20 bp, Artificial Sequence
  Description of Artificial Sequence: Synthetic oligonucleotide
  Target: ATXN1; (-) strand; PAM type: NRG; PAM sequence: GGG
cactgcaacctccaccttct

SEQ ID NO: 61959 - DNA, 20 bp, Artificial Sequence
  Description of Artificial Sequence: Synthetic oligonucleotide
  Target: ATXN1; (-) strand; PAM type: NRG; PAM sequence: TGG
tcactgcaacctccaccttc

SEQ ID NO: 61960 - DNA, 20 bp, Artificial Sequence
  Description of Artificial Sequence: Synthetic oligonucleotide
  Target: ATXN1; (-) strand; PAM type: NRG; PAM sequence: TGG
ttgcccaggctggagggcag

SEQ ID NO: 61961 - DNA, 20 bp, Artificial Sequence
  Description of Artificial Sequence: Synthetic oligonucleotide
  Target: ATXN1; (-) strand; PAM type: NRG; PAM sequence: CAG
gtgttgcccaggctggaggg

SEQ ID NO: 61962 - DNA, 20 bp, Artificial Sequence
  Description of Artificial Sequence: Synthetic oligonucleotide
  Target: ATXN1; (-) strand; PAM type: NRG; PAM sequence: GGG
gctgtgttgcccaggctgga

SEQ ID NO: 61963 - DNA, 20 bp, Artificial Sequence
  Description of Artificial Sequence: Synthetic oligonucleotide
  Target: ATXN1; (-) strand; PAM type: NRG; PAM sequence: AGG
tgctgtgttgcccaggctgg

SEQ ID NO: 61964 - DNA, 20 bp, Artificial Sequence
  Description of Artificial Sequence: Synthetic oligonucleotide
  Target: ATXN1; (-) strand; PAM type: NRG; PAM sequence: GAG
ttgctgtgttgcccaggctg

SEQ ID NO: 61965 - DNA, 20 bp, Artificial Sequence
  Description of Artificial Sequence: Synthetic oligonucleotide
  Target: ATXN1; (-) strand; PAM type: NRG; PAM sequence: TGG
tcttgctgtgttgcccaggc

SEQ ID NO: 61966 - DNA, 20 bp, Artificial Sequence
  Description of Artificial Sequence: Synthetic oligonucleotide
  Target: ATXN1; (-) strand; PAM type: NRG; PAM sequence: AGG
agtctcttgctgtgttgccc

SEQ ID NO: 61967 - DNA, 20 bp, Artificial Sequence
  Description of Artificial Sequence: Synthetic oligonucleotide
  Target: ATXN1; (-) strand; PAM type: NRG; PAM sequence: CAG
aagtctcttgctgtgttgcc

SEQ ID NO: 61968 - DNA, 20 bp, Artificial Sequence
  Description of Artificial Sequence: Synthetic oligonucleotide
  Target: ATXN1; (-) strand; PAM type: NRG; PAM sequence: AAG
tttttttttttttgcagatg

SEQ ID NO: 61969 - DNA, 20 bp, Artificial Sequence
  Description of Artificial Sequence: Synthetic oligonucleotide
  Target: ATXN1; (-) strand; PAM type: NRG; PAM sequence: CAG
tttttttttttttttttttg

SEQ ID NO: 61970 - DNA, 20 bp, Artificial Sequence
  Description of Artificial Sequence: Synthetic oligonucleotide
  Target: ATXN1; (-) strand; PAM type: NRG; PAM sequence: TAG
cattttcttcaggatcattt

SEQ ID NO: 61971 - DNA, 20 bp, Artificial Sequence
  Description of Artificial Sequence: Synthetic oligonucleotide
  Target: ATXN1; (-) strand; PAM type: NRG; PAM sequence: AGG
accaggccaccattttcttc

SEQ ID NO: 61972 - DNA, 20 bp, Artificial Sequence
  Description of Artificial Sequence: Synthetic oligonucleotide
  Target: ATXN1; (-) strand; PAM type: NRG; PAM sequence: CAG
caccaggccaccattttctt

SEQ ID NO: 61973 - DNA, 20 bp, Artificial Sequence
  Description of Artificial Sequence: Synthetic oligonucleotide
  Target: ATXN1; (-) strand; PAM type: NRG; PAM sequence: AGG
atttgtagcacatggccacc

SEQ ID NO: 61974 - DNA, 20 bp, Artificial Sequence
  Description of Artificial Sequence: Synthetic oligonucleotide
  Target: ATXN1; (-) strand; PAM type: NRG; PAM sequence: CAG
gatttgtagcacatggccac

SEQ ID NO: 61975 - DNA, 20 bp, Artificial Sequence
  Description of Artificial Sequence: Synthetic oligonucleotide
  Target: ATXN1; (-) strand; PAM type: NRG; PAM sequence: TGG
gcatgaggatttgtagcaca

SEQ ID NO: 61976 - DNA, 20 bp, Artificial Sequence
  Description of Artificial Sequence: Synthetic oligonucleotide
  Target: ATXN1; (-) strand; PAM type: NRG; PAM sequence: TAG
aaacatagcatgaggatttg

SEQ ID NO: 61977 - DNA, 20 bp, Artificial Sequence
  Description of Artificial Sequence: Synthetic oligonucleotide
  Target: ATXN1; (-) strand; PAM type: NRG; PAM sequence: AGG
actgacaaaaacatagcatg

SEQ ID NO: 61978 - DNA, 20 bp, Artificial Sequence
  Description of Artificial Sequence: Synthetic oligonucleotide
  Target: ATXN1; (-) strand; PAM type: NRG; PAM sequence: GAG
cactgacaaaaacatagcat

SEQ ID NO: 61979 - DNA, 20 bp, Artificial Sequence
  Description of Artificial Sequence: Synthetic oligonucleotide
  Target: ATXN1; (-) strand; PAM type: NRG; PAM sequence: TAG
tttgaacactgacaaaaaca

SEQ ID NO: 61980 - DNA, 20 bp, Artificial Sequence
  Description of Artificial Sequence: Synthetic oligonucleotide
  Target: ATXN1; (-) strand; PAM type: NRG; PAM sequence: TGG
tccttccatcagaaattgtt

SEQ ID NO: 61981 - DNA, 20 bp, Artificial Sequence
  Description of Artificial Sequence: Synthetic oligonucleotide
  Target: ATXN1; (-) strand; PAM type: NRG; PAM sequence: CAG
agccagagctttccttccat

SEQ ID NO: 61982 - DNA, 20 bp, Artificial Sequence
  Description of Artificial Sequence: Synthetic oligonucleotide
  Target: ATXN1; (-) strand; PAM type: NRG; PAM sequence: GAG
catgtgagagctcagagcca

SEQ ID NO: 61983 - DNA, 20 bp, Artificial Sequence
  Description of Artificial Sequence: Synthetic oligonucleotide
  Target: ATXN1; (-) strand; PAM type: NRG; PAM sequence: CAG
ggcatgtgagagctcagagc

SEQ ID NO: 61984 - DNA, 20 bp, Artificial Sequence
  Description of Artificial Sequence: Synthetic oligonucleotide
  Target: ATXN1; (-) strand; PAM type: NRG; PAM sequence: GAG
tctgggcatgtgagagctca

SEQ ID NO: 61985 - DNA, 20 bp, Artificial Sequence
  Description of Artificial Sequence: Synthetic oligonucleotide
  Target: ATXN1; (-) strand; PAM type: NRG; PAM sequence: CAG
tgtctgggcatgtgagagct

SEQ ID NO: 61986 - DNA, 20 bp, Artificial Sequence
  Description of Artificial Sequence: Synthetic oligonucleotide
  Target: ATXN1; (-) strand; PAM type: NRG; PAM sequence: GAG
ttctgtgtctgggcatgtga

SEQ ID NO: 61987 - DNA, 20 bp, Artificial Sequence
  Description of Artificial Sequence: Synthetic oligonucleotide
  Target: ATXN1; (-) strand; PAM type: NRG; PAM sequence: GAG
acttctgtgtctgggcatgt

SEQ ID NO: 61988 - DNA, 20 bp, Artificial Sequence
  Description of Artificial Sequence: Synthetic oligonucleotide
  Target: ATXN1; (-) strand; PAM type: NRG; PAM sequence: GGG
tatgtactacttctgtgtct

SEQ ID NO: 61989 - DNA, 20 bp, Artificial Sequence
  Description of Artificial Sequence: Synthetic oligonucleotide
  Target: ATXN1; (-) strand; PAM type: NRG; PAM sequence: TGG
ttatgtactacttctgtgtc

SEQ ID NO: 61990 - DNA, 20 bp, Artificial Sequence
  Description of Artificial Sequence: Synthetic oligonucleotide
  Target: ATXN1; (-) strand; PAM type: NRG; PAM sequence: TAG
ctttgagaagagactaggaa

SEQ ID NO: 61991 - DNA, 20 bp, Artificial Sequence
  Description of Artificial Sequence: Synthetic oligonucleotide
  Target: ATXN1; (-) strand; PAM type: NRG; PAM sequence: AGG
ggatgctttgagaagagact

SEQ ID NO: 61992 - DNA, 20 bp, Artificial Sequence
  Description of Artificial Sequence: Synthetic oligonucleotide
  Target: ATXN1; (-) strand; PAM type: NRG; PAM sequence: TAG
aggatgctttgagaagagac

SEQ ID NO: 61993 - DNA, 20 bp, Artificial Sequence
  Description of Artificial Sequence: Synthetic oligonucleotide
  Target: ATXN1; (-) strand; PAM type: NRG; PAM sequence: GAG
gacaaaggatgctttgagaa

SEQ ID NO: 61994 - DNA, 20 bp, Artificial Sequence
  Description of Artificial Sequence: Synthetic oligonucleotide
  Target: ATXN1; (-) strand; PAM type: NRG; PAM sequence: AAG
aagacaaaggatgctttgag

SEQ ID NO: 61995 - DNA, 20 bp, Artificial Sequence
  Description of Artificial Sequence: Synthetic oligonucleotide
  Target: ATXN1; (-) strand; PAM type: NRG; PAM sequence: GAG
gagaagacaaaggatgcttt

SEQ ID NO: 61996 - DNA, 20 bp, Artificial Sequence
  Description of Artificial Sequence: Synthetic oligonucleotide
  Target: ATXN1; (-) strand; PAM type: NRG; PAM sequence: AGG
tgtgtatttagagaagacaa

SEQ ID NO: 61997 - DNA, 20 bp, Artificial Sequence
  Description of Artificial Sequence: Synthetic oligonucleotide
  Target: ATXN1; (-) strand; PAM type: NRG; PAM sequence: AAG
atgtgtatttagagaagaca

SEQ ID NO: 61998 - DNA, 20 bp, Artificial Sequence
  Description of Artificial Sequence: Synthetic oligonucleotide
  Target: ATXN1; (-) strand; PAM type: NRG; PAM sequence: AAG
atatatatgtgtatttagag

SEQ ID NO: 61999 - DNA, 20 bp, Artificial Sequence
  Description of Artificial Sequence: Synthetic oligonucleotide
  Target: ATXN1; (-) strand; PAM type: NRG; PAM sequence: GAG
ccaatatatatgtgtattta

SEQ ID NO: 62000 - DNA, 20 bp, Artificial Sequence
  Description of Artificial Sequence: Synthetic oligonucleotide
  Target: ATXN1; (-) strand; PAM type: NRG; PAM sequence: TAG
acccaatatatatgtgtatt

SEQ ID NO: 62001 - DNA, 20 bp, Artificial Sequence
  Description of Artificial Sequence: Synthetic oligonucleotide
  Target: ATXN1; (-) strand; PAM type: NRG; PAM sequence: TGG
attgagccttcaagcagagg

SEQ ID NO: 62002 - DNA, 20 bp, Artificial Sequence
  Description of Artificial Sequence: Synthetic oligonucleotide
  Target: ATXN1; (-) strand; PAM type: NRG; PAM sequence: AGG
taaattgagccttcaagcag

SEQ ID NO: 62003 - DNA, 20 bp, Artificial Sequence
  Description of Artificial Sequence: Synthetic oligonucleotide
  Target: ATXN1; (-) strand; PAM type: NRG; PAM sequence: GAG
ctaaattgagccttcaagca

SEQ ID NO: 62004 - DNA, 20 bp, Artificial Sequence
  Description of Artificial Sequence: Synthetic oligonucleotide
  Target: ATXN1; (-) strand; PAM type: NRG; PAM sequence: CAG
atctaaattgagccttcaag

SEQ ID NO: 62005 - DNA, 20 bp, Artificial Sequence
  Description of Artificial Sequence: Synthetic oligonucleotide
  Target: ATXN1; (-) strand; PAM type: NRG; PAM sequence: AAG
gacatctaaattgagccttc

SEQ ID NO: 62006 - DNA, 20 bp, Artificial Sequence
  Description of Artificial Sequence: Synthetic oligonucleotide
  Target: ATXN1; (-) strand; PAM type: NRG; PAM sequence: GAG
tcagggaagacatctaaatt

SEQ ID NO: 62007 - DNA, 20 bp, Artificial Sequence
  Description of Artificial Sequence: Synthetic oligonucleotide
  Target: ATXN1; (-) strand; PAM type: NRG; PAM sequence: AAG
tcagcgctggaatttcaggg

SEQ ID NO: 62008 - DNA, 20 bp, Artificial Sequence
  Description of Artificial Sequence: Synthetic oligonucleotide
  Target: ATXN1; (-) strand; PAM type: NRG; PAM sequence: GGG
ttgtcagcgctggaatttca

SEQ ID NO: 62009 - DNA, 20 bp, Artificial Sequence
  Description of Artificial Sequence: Synthetic oligonucleotide
  Target: ATXN1; (-) strand; PAM type: NRG; PAM sequence: AGG
gttgtcagcgctggaatttc

SEQ ID NO: 62010 - DNA, 20 bp, Artificial Sequence
  Description of Artificial Sequence: Synthetic oligonucleotide
  Target: ATXN1; (-) strand; PAM type: NRG; PAM sequence: CAG
agttgtcagcgctggaattt

SEQ ID NO: 62011 - DNA, 20 bp, Artificial Sequence
  Description of Artificial Sequence: Synthetic oligonucleotide
  Target: ATXN1; (-) strand; PAM type: NRG; PAM sequence: TGG
tgggtaagagttgtcagcgc

SEQ ID NO: 62012 - DNA, 20 bp, Artificial Sequence
  Description of Artificial Sequence: Synthetic oligonucleotide
  Target: ATXN1; (-) strand; PAM type: NRG; PAM sequence: CAG
ggacgatgggtaagagttgt

SEQ ID NO: 62013 - DNA, 20 bp, Artificial Sequence
  Description of Artificial Sequence: Synthetic oligonucleotide
  Target: ATXN1; (-) strand; PAM type: NRG; PAM sequence: GAG
ccgaaagggacgatgggtaa

SEQ ID NO: 62014 - DNA, 20 bp, Artificial Sequence
  Description of Artificial Sequence: Synthetic oligonucleotide
  Target: ATXN1; (-) strand; PAM type: NRG; PAM sequence: AAG
taccgaaagggacgatgggt

SEQ ID NO: 62015 - DNA, 20 bp, Artificial Sequence
  Description of Artificial Sequence: Synthetic oligonucleotide
  Target: ATXN1; (-) strand; PAM type: NRG; PAM sequence: GGG
ggtgtaccgaaagggacgat

SEQ ID NO: 62016 - DNA, 20 bp, Artificial Sequence
  Description of Artificial Sequence: Synthetic oligonucleotide
  Target: ATXN1; (-) strand; PAM type: NRG; PAM sequence: TGG
aggtgtaccgaaagggacga

SEQ ID NO: 62017 - DNA, 20 bp, Artificial Sequence
  Description of Artificial Sequence: Synthetic oligonucleotide
  Target: ATXN1; (-) strand; PAM type: NRG; PAM sequence: GGG
cggagtcaggtgtaccgaaa

SEQ ID NO: 62018 - DNA, 20 bp, Artificial Sequence
  Description of Artificial Sequence: Synthetic oligonucleotide
  Target: ATXN1; (-) strand; PAM type: NRG; PAM sequence: AGG
gcggagtcaggtgtaccgaa

SEQ ID NO: 62019 - DNA, 20 bp, Artificial Sequence
  Description of Artificial Sequence: Synthetic oligonucleotide
  Target: ATXN1; (-) strand; PAM type: NRG; PAM sequence: AAG
ggcggagtcaggtgtaccga

SEQ ID NO: 62020 - DNA, 20 bp, Artificial Sequence
  Description of Artificial Sequence: Synthetic oligonucleotide
  Target: ATXN1; (-) strand; PAM type: NRG; PAM sequence: AGG
atgtacttggtggcggagtc

SEQ ID NO: 62021 - DNA, 20 bp, Artificial Sequence
  Description of Artificial Sequence: Synthetic oligonucleotide
  Target: ATXN1; (-) strand; PAM type: NRG; PAM sequence: CAG
gatgtacttggtggcggagt

SEQ ID NO: 62022 - DNA, 20 bp, Artificial Sequence
  Description of Artificial Sequence: Synthetic oligonucleotide
  Target: ATXN1; (-) strand; PAM type: NRG; PAM sequence: GAG
gaaggatgtacttggtggcg

SEQ ID NO: 62023 - DNA, 20 bp, Artificial Sequence
  Description of Artificial Sequence: Synthetic oligonucleotide
  Target: ATXN1; (-) strand; PAM type: NRG; PAM sequence: CGG
gggaaggatgtacttggtgg

SEQ ID NO: 62024 - DNA, 20 bp, Artificial Sequence
  Description of Artificial Sequence: Synthetic oligonucleotide
  Target: ATXN1; (-) strand; PAM type: NRG; PAM sequence: TGG
tatgggaaggatgtacttgg

SEQ ID NO: 62025 - DNA, 20 bp, Artificial Sequence
  Description of Artificial Sequence: Synthetic oligonucleotide
  Target: ATXN1; (-) strand; PAM type: NRG; PAM sequence: TGG
tgctatgggaaggatgtact

SEQ ID NO: 62026 - DNA, 20 bp, Artificial Sequence
  Description of Artificial Sequence: Synthetic oligonucleotide
  Target: ATXN1; (-) strand; PAM type: NRG; PAM sequence: AGG
tctaggaaggtgctatggga

SEQ ID NO: 62027 - DNA, 20 bp, Artificial Sequence
  Description of Artificial Sequence: Synthetic oligonucleotide
  Target: ATXN1; (-) strand; PAM type: NRG; PAM sequence: AAG
ctctaggaaggtgctatggg

SEQ ID NO: 62028 - DNA, 20 bp, Artificial Sequence
  Description of Artificial Sequence: Synthetic oligonucleotide
  Target: ATXN1; (-) strand; PAM type: NRG; PAM sequence: GGG
agactctaggaaggtgctat

SEQ ID NO: 62029 - DNA, 20 bp, Artificial Sequence
  Description of Artificial Sequence: Synthetic oligonucleotide
  Target: ATXN1; (-) strand; PAM type: NRG; PAM sequence: TGG
gagactctaggaaggtgcta

SEQ ID NO: 62030 - DNA, 20 bp, Artificial Sequence
  Description of Artificial Sequence: Synthetic oligonucleotide
  Target: ATXN1; (-) strand; PAM type: NRG; PAM sequence: AGG
tgccctttgagactctagga

SEQ ID NO: 62031 - DNA, 20 bp, Artificial Sequence
  Description of Artificial Sequence: Synthetic oligonucleotide
  Target: ATXN1; (-) strand; PAM type: NRG; PAM sequence: AAG
ctgccctttgagactctagg

SEQ ID NO: 62032 - DNA, 20 bp, Artificial Sequence
  Description of Artificial Sequence: Synthetic oligonucleotide
  Target: ATXN1; (-) strand; PAM type: NRG; PAM sequence: AGG
ttactgccctttgagactct

SEQ ID NO: 62033 - DNA, 20 bp, Artificial Sequence
  Description of Artificial Sequence: Synthetic oligonucleotide
  Target: ATXN1; (-) strand; PAM type: NRG; PAM sequence: TAG
cttactgccctttgagactc

SEQ ID NO: 62034 - DNA, 20 bp, Artificial Sequence
  Description of Artificial Sequence: Synthetic oligonucleotide
  Target: ATXN1; (-) strand; PAM type: NRG; PAM sequence: GAG
atctgtacttactgcccttt

SEQ ID NO: 62035 - DNA, 20 bp, Artificial Sequence
  Description of Artificial Sequence: Synthetic oligonucleotide
  Target: ATXN1; (-) strand; PAM type: NRG; PAM sequence: GAG
tctatcagggatccagggct

SEQ ID NO: 62036 - DNA, 20 bp, Artificial Sequence
  Description of Artificial Sequence: Synthetic oligonucleotide
  Target: ATXN1; (-) strand; PAM type: NRG; PAM sequence: GGG
ttgagtctatcagggatcca

SEQ ID NO: 62037 - DNA, 20 bp, Artificial Sequence
  Description of Artificial Sequence: Synthetic oligonucleotide
  Target: ATXN1; (-) strand; PAM type: NRG; PAM sequence: AGG
cttgagtctatcagggatcc

SEQ ID NO: 62038 - DNA, 20 bp, Artificial Sequence
  Description of Artificial Sequence: Synthetic oligonucleotide
  Target: ATXN1; (-) strand; PAM type: NRG; PAM sequence: CAG
tcttgagtctatcagggatc

SEQ ID NO: 62039 - DNA, 20 bp, Artificial Sequence
  Description of Artificial Sequence: Synthetic oligonucleotide
  Target: ATXN1; (-) strand; PAM type: NRG; PAM sequence: GGG
ggatgttcttgagtctatca

SEQ ID NO: 62040 - DNA, 20 bp, Artificial Sequence
  Description of Artificial Sequence: Synthetic oligonucleotide
  Target: ATXN1; (-) strand; PAM type: NRG; PAM sequence: AGG
aggatgttcttgagtctatc

SEQ ID NO: 62041 - DNA, 20 bp, Artificial Sequence
  Description of Artificial Sequence: Synthetic oligonucleotide
  Target: ATXN1; (-) strand; PAM type: NRG; PAM sequence: CAG
caggatgttcttgagtctat

SEQ ID NO: 62042 - DNA, 20 bp, Artificial Sequence
  Description of Artificial Sequence: Synthetic oligonucleotide
  Target: ATXN1; (-) strand; PAM type: NRG; PAM sequence: GAG
ttgtgtgccaggatgttctt

SEQ ID NO: 62043 - DNA, 20 bp, Artificial Sequence
  Description of Artificial Sequence: Synthetic oligonucleotide
  Target: ATXN1; (-) strand; PAM type: NRG; PAM sequence: AGG
ttaaaagagtgttgtgtgcc

SEQ ID NO: 62044 - DNA, 20 bp, Artificial Sequence
  Description of Artificial Sequence: Synthetic oligonucleotide
  Target: ATXN1; (-) strand; PAM type: NRG; PAM sequence: CAG
attaaaagagtgttgtgtgc

SEQ ID NO: 62045 - DNA, 20 bp, Artificial Sequence
  Description of Artificial Sequence: Synthetic oligonucleotide
  Target: ATXN1; (-) strand; PAM type: NRG; PAM sequence: GAG
ttacatgatatttattaaaa

SEQ ID NO: 62046 - DNA, 20 bp, Artificial Sequence
  Description of Artificial Sequence: Synthetic oligonucleotide
  Target: ATXN1; (-) strand; PAM type: NRG; PAM sequence: AAG
aattacatgatatttattaa

SEQ ID NO: 62047 - DNA, 20 bp, Artificial Sequence
  Description of Artificial Sequence: Synthetic oligonucleotide
  Target: ATXN1; (-) strand; PAM type: NRG; PAM sequence: GAG
ttgtgtcctctttaagttta

SEQ ID NO: 62048 - DNA, 20 bp, Artificial Sequence
  Description of Artificial Sequence: Synthetic oligonucleotide
  Target: ATXN1; (-) strand; PAM type: NRG; PAM sequence: TAG
ttttgtgtcctctttaagtt

SEQ ID NO: 62049 - DNA, 20 bp, Artificial Sequence
  Description of Artificial Sequence: Synthetic oligonucleotide
  Target: ATXN1; (-) strand; PAM type: NRG; PAM sequence: AAG
aatgcttttgtgtcctcttt

SEQ ID NO: 62050 - DNA, 20 bp, Artificial Sequence
  Description of Artificial Sequence: Synthetic oligonucleotide
  Target: ATXN1; (-) strand; PAM type: NRG; PAM sequence: AGG
tttgtaactgaatagtgcca

SEQ ID NO: 62051 - DNA, 20 bp, Artificial Sequence
  Description of Artificial Sequence: Synthetic oligonucleotide
  Target: ATXN1; (-) strand; PAM type: NRG; PAM sequence: AAG
ctttgtaactgaatagtgcc

SEQ ID NO: 62052 - DNA, 20 bp, Artificial Sequence
  Description of Artificial Sequence: Synthetic oligonucleotide
  Target: ATXN1; (-) strand; PAM type: NRG; PAM sequence: TAG
caggctgctttgtaactgaa

SEQ ID NO: 62053 - DNA, 20 bp, Artificial Sequence
  Description of Artificial Sequence: Synthetic oligonucleotide
  Target: ATXN1; (-) strand; PAM type: NRG; PAM sequence: AGG
acaacatcaacagcctggtc

SEQ ID NO: 62054 - DNA, 20 bp, Artificial Sequence
  Description of Artificial Sequence: Synthetic oligonucleotide
  Target: ATXN1; (-) strand; PAM type: NRG; PAM sequence: CAG
aacaacatcaacagcctggt

SEQ ID NO: 62055 - DNA, 20 bp, Artificial Sequence
  Description of Artificial Sequence: Synthetic oligonucleotide
  Target: ATXN1; (-) strand; PAM type: NRG; PAM sequence: TGG
gtgaaacaacatcaacagcc

SEQ ID NO: 62056 - DNA, 20 bp, Artificial Sequence
  Description of Artificial Sequence: Synthetic oligonucleotide
  Target: ATXN1; (-) strand; PAM type: NRG; PAM sequence: CAG
atggggtgaaacaacatcaa

SEQ ID NO: 62057 - DNA, 20 bp, Artificial Sequence
  Description of Artificial Sequence: Synthetic oligonucleotide
  Target: ATXN1; (-) strand; PAM type: NRG; PAM sequence: GGG
tacaacatttgtgttctatg

SEQ ID NO: 62058 - DNA, 20 bp, Artificial Sequence
  Description of Artificial Sequence: Synthetic oligonucleotide
  Target: ATXN1; (-) strand; PAM type: NRG; PAM sequence: GGG
ttacaacatttgtgttctat

SEQ ID NO: 62059 - DNA, 20 bp, Artificial Sequence
  Description of Artificial Sequence: Synthetic oligonucleotide
  Target: ATXN1; (-) strand; PAM type: NRG; PAM sequence: TGG
tttacaacatttgtgttcta

SEQ ID NO: 62060 - DNA, 20 bp, Artificial Sequence
  Description of Artificial Sequence: Synthetic oligonucleotide
  Target: ATXN1; (-) strand; PAM type: NRG; PAM sequence: TGG
tgtggaaggaaaaaagttca

SEQ ID NO: 62061 - DNA, 20 bp, Artificial Sequence
  Description of Artificial Sequence: Synthetic oligonucleotide
  Target: ATXN1; (-) strand; PAM type: NRG; PAM sequence: AAG
cagacgttgtggaaggaaaa

SEQ ID NO: 62062 - DNA, 20 bp, Artificial Sequence
  Description of Artificial Sequence: Synthetic oligonucleotide
  Target: ATXN1; (-) strand; PAM type: NRG; PAM sequence: AGG
gaacacccagacgttgtgga

SEQ ID NO: 62063 - DNA, 20 bp, Artificial Sequence
  Description of Artificial Sequence: Synthetic oligonucleotide
  Target: ATXN1; (-) strand; PAM type: NRG; PAM sequence: AAG
agaacacccagacgttgtgg

SEQ ID NO: 62064 - DNA, 20 bp, Artificial Sequence
  Description of Artificial Sequence: Synthetic oligonucleotide
  Target: ATXN1; (-) strand; PAM type: NRG; PAM sequence: TGG
caaagaacacccagacgttg

SEQ ID NO: 62065 - DNA, 20 bp, Artificial Sequence
  Description of Artificial Sequence: Synthetic oligonucleotide
  Target: ATXN1; (-) strand; PAM type: NRG; PAM sequence: CAG
aggaaaatgcaaagaacacc

SEQ ID NO: 62066 - DNA, 20 bp, Artificial Sequence
  Description of Artificial Sequence: Synthetic oligonucleotide
  Target: ATXN1; (-) strand; PAM type: NRG; PAM sequence: AAG
gagaggaggaggaaaatgca

SEQ ID NO: 62067 - DNA, 20 bp, Artificial Sequence
  Description of Artificial Sequence: Synthetic oligonucleotide
  Target: ATXN1; (-) strand; PAM type: NRG; PAM sequence: AGG
tcagcatcttggagaggagg

SEQ ID NO: 62068 - DNA, 20 bp, Artificial Sequence
  Description of Artificial Sequence: Synthetic oligonucleotide
  Target: ATXN1; (-) strand; PAM type: NRG; PAM sequence: GAG
ctcagcatcttggagaggag

SEQ ID NO: 62069 - DNA, 20 bp, Artificial Sequence
  Description of Artificial Sequence: Synthetic oligonucleotide
  Target: ATXN1; (-) strand; PAM type: NRG; PAM sequence: AGG
ctctcagcatcttggagagg

SEQ ID NO: 62070 - DNA, 20 bp, Artificial Sequence
  Description of Artificial Sequence: Synthetic oligonucleotide
  Target: ATXN1; (-) strand; PAM type: NRG; PAM sequence: GAG
cctctcagcatcttggagag

SEQ ID NO: 62071 - DNA, 20 bp, Artificial Sequence
  Description of Artificial Sequence: Synthetic oligonucleotide
  Target: ATXN1; (-) strand; PAM type: NRG; PAM sequence: AGG
ctcctctcagcatcttggag

SEQ ID NO: 62072 - DNA, 20 bp, Artificial Sequence
  Description of Artificial Sequence: Synthetic oligonucleotide
  Target: ATXN1; (-) strand; PAM type: NRG; PAM sequence: GAG
cctcctctcagcatcttgga

SEQ ID NO: 62073 - DNA, 20 bp, Artificial Sequence
  Description of Artificial Sequence: Synthetic oligonucleotide
  Target: ATXN1; (-) strand; PAM type: NRG; PAM sequence: GAG
ctcctcctctcagcatcttg

SEQ ID NO: 62074 - DNA, 20 bp, Artificial Sequence
  Description of Artificial Sequence: Synthetic oligonucleotide
  Target: ATXN1; (-) strand; PAM type: NRG; PAM sequence: TGG
agctcctcctctcagcatct

SEQ ID NO: 62075 - DNA, 20 bp, Artificial Sequence
  Description of Artificial Sequence: Synthetic oligonucleotide
  Target: ATXN1; (-) strand; PAM type: NRG; PAM sequence: CAG
aagtactcagctcctcctct

SEQ ID NO: 62076 - DNA, 20 bp, Artificial Sequence
  Description of Artificial Sequence: Synthetic oligonucleotide
  Target: ATXN1; (-) strand; PAM type: NRG; PAM sequence: CAG
caccttcttcctcaagtact

SEQ ID NO: 62077 - DNA, 20 bp, Artificial Sequence
  Description of Artificial Sequence: Synthetic oligonucleotide
  Target: ATXN1; (-) strand; PAM type: NRG; PAM sequence: AAG
ccctcagcaccttcttcctc

SEQ ID NO: 62078 - DNA, 20 bp, Artificial Sequence
  Description of Artificial Sequence: Synthetic oligonucleotide
  Target: ATXN1; (-) strand; PAM type: NRG; PAM sequence: CAG
ccaggcacaccctttcccct

SEQ ID NO: 62079 - DNA, 20 bp, Artificial Sequence
  Description of Artificial Sequence: Synthetic oligonucleotide
  Target: ATXN1; (-) strand; PAM type: NRG; PAM sequence: AGG
gacaaagcgtagcccatccc

SEQ ID NO: 62080 - DNA, 20 bp, Artificial Sequence
  Description of Artificial Sequence: Synthetic oligonucleotide
  Target: ATXN1; (-) strand; PAM type: NRG; PAM sequence: CAG
tgacaaagcgtagcccatcc

SEQ ID NO: 62081 - DNA, 20 bp, Artificial Sequence
  Description of Artificial Sequence: Synthetic oligonucleotide
  Target: ATXN1; (-) strand; PAM type: NRG; PAM sequence: TAG
ctgaggcaactgacaaagcg

SEQ ID NO: 62082 - DNA, 20 bp, Artificial Sequence
  Description of Artificial Sequence: Synthetic oligonucleotide
  Target: ATXN1; (-) strand; PAM type: NRG; PAM sequence: AAG
acctcctgaggcaactgaca

SEQ ID NO: 62083 - DNA, 20 bp, Artificial Sequence
  Description of Artificial Sequence: Synthetic oligonucleotide
  Target: ATXN1; (-) strand; PAM type: NRG; PAM sequence: AGG
ggtgtcagagctacctcctg

SEQ ID NO: 62084 - DNA, 20 bp, Artificial Sequence
  Description of Artificial Sequence: Synthetic oligonucleotide
  Target: ATXN1; (-) strand; PAM type: NRG; PAM sequence: GAG
tggtgtcagagctacctcct

SEQ ID NO: 62085 - DNA, 20 bp, Artificial Sequence
  Description of Artificial Sequence: Synthetic oligonucleotide
  Target: ATXN1; (-) strand; PAM type: NRG; PAM sequence: GAG
gcttctaagaagtggtgtca

SEQ ID NO: 62086 - DNA, 20 bp, Artificial Sequence
  Description of Artificial Sequence: Synthetic oligonucleotide
  Target: ATXN1; (-) strand; PAM type: NRG; PAM sequence: CAG
ctgcttctaagaagtggtgt

SEQ ID NO: 62087 - DNA, 20 bp, Artificial Sequence
  Description of Artificial Sequence: Synthetic oligonucleotide
  Target: ATXN1; (-) strand; PAM type: NRG; PAM sequence: TGG
gagtcactgcttctaagaag

SEQ ID NO: 62088 - DNA, 20 bp, Artificial Sequence
  Description of Artificial Sequence: Synthetic oligonucleotide
  Target: ATXN1; (-) strand; PAM type: NRG; PAM sequence: AAG
caggagtcactgcttctaag

SEQ ID NO: 62089 - DNA, 20 bp, Artificial Sequence
  Description of Artificial Sequence: Synthetic oligonucleotide
  Target: ATXN1; (-) strand; PAM type: NRG; PAM sequence: AAG
ttgcaggagtcactgcttct

SEQ ID NO: 62090 - DNA, 20 bp, Artificial Sequence
  Description of Artificial Sequence: Synthetic oligonucleotide
  Target: ATXN1; (-) strand; PAM type: NRG; PAM sequence: GAG
ctttggcagggtctttgcag

SEQ ID NO: 62091 - DNA, 20 bp, Artificial Sequence
  Description of Artificial Sequence: Synthetic oligonucleotide
  Target: ATXN1; (-) strand; PAM type: NRG; PAM sequence: AGG
acctttggcagggtctttgc

SEQ ID NO: 62092 - DNA, 20 bp, Artificial Sequence
  Description of Artificial Sequence: Synthetic oligonucleotide
  Target: ATXN1; (-) strand; PAM type: NRG; PAM sequence: CAG
cacctttggcagggtctttg

SEQ ID NO: 62093 - DNA, 20 bp, Artificial Sequence
  Description of Artificial Sequence: Synthetic oligonucleotide
  Target: ATXN1; (-) strand; PAM type: NRG; PAM sequence: GGG
tgggatgggcacctttggca

SEQ ID NO: 62094 - DNA, 20 bp, Artificial Sequence
  Description of Artificial Sequence: Synthetic oligonucleotide
  Target: ATXN1; (-) strand; PAM type: NRG; PAM sequence: AGG
ttgggatgggcacctttggc

SEQ ID NO: 62095 - DNA, 20 bp, Artificial Sequence
  Description of Artificial Sequence: Synthetic oligonucleotide
  Target: ATXN1; (-) strand; PAM type: NRG; PAM sequence: CAG
tttgggatgggcacctttgg

SEQ ID NO: 62096 - DNA, 20 bp, Artificial Sequence
  Description of Artificial Sequence: Synthetic oligonucleotide
  Target: ATXN1; (-) strand; PAM type: NRG; PAM sequence: TGG
ttatttgggatgggcacctt

SEQ ID NO: 62097 - DNA, 20 bp, Artificial Sequence
  Description of Artificial Sequence: Synthetic oligonucleotide
  Target: ATXN1; (-) strand; PAM type: NRG; PAM sequence: GGG
cctggtgtgttatttgggat

SEQ ID NO: 62098 - DNA, 20 bp, Artificial Sequence
  Description of Artificial Sequence: Synthetic oligonucleotide
  Target: ATXN1; (-) strand; PAM type: NRG; PAM sequence: TGG
ccctggtgtgttatttggga

SEQ ID NO: 62099 - DNA, 20 bp, Artificial Sequence
  Description of Artificial Sequence: Synthetic oligonucleotide
  Target: ATXN1; (-) strand; PAM type: NRG; PAM sequence: GGG
ttgcccctggtgtgttattt

SEQ ID NO: 62100 - DNA, 20 bp, Artificial Sequence
  Description of Artificial Sequence: Synthetic oligonucleotide
  Target: ATXN1; (-) strand; PAM type: NRG; PAM sequence: TGG
attgcccctggtgtgttatt

SEQ ID NO: 62101 - DNA, 20 bp, Artificial Sequence
  Description of Artificial Sequence: Synthetic oligonucleotide
  Target: ATXN1; (-) strand; PAM type: NRG; PAM sequence: TGG
tagttcctggccattgcccc

SEQ ID NO: 62102 - DNA, 20 bp, Artificial Sequence
  Description of Artificial Sequence: Synthetic oligonucleotide
  Target: ATXN1; (-) strand; PAM type: NRG; PAM sequence: TGG
ttgacagcttcactagttcc

SEQ ID NO: 62103 - DNA, 20 bp, Artificial Sequence
  Description of Artificial Sequence: Synthetic oligonucleotide
  Target: ATXN1; (-) strand; PAM type: NRG; PAM sequence: TAG
cttctgattgacagcttcac

SEQ ID NO: 62104 - DNA, 20 bp, Artificial Sequence
  Description of Artificial Sequence: Synthetic oligonucleotide
  Target: ATXN1; (-) strand; PAM type: NRG; PAM sequence: CAG
cttgaatggcttctgattga

SEQ ID NO: 62105 - DNA, 20 bp, Artificial Sequence
  Description of Artificial Sequence: Synthetic oligonucleotide
  Target: ATXN1; (-) strand; PAM type: NRG; PAM sequence: TGG
cttcctcagacttccttgaa

SEQ ID NO: 62106 - DNA, 20 bp, Artificial Sequence
  Description of Artificial Sequence: Synthetic oligonucleotide
  Target: ATXN1; (-) strand; PAM type: NRG; PAM sequence: CAG
acccatttctctctcttcct

SEQ ID NO: 62107 - DNA, 20 bp, Artificial Sequence
  Description of Artificial Sequence: Synthetic oligonucleotide
  Target: ATXN1; (-) strand; PAM type: NRG; PAM sequence: GAG
ggatagcttcaagtcttcta

SEQ ID NO: 62108 - DNA, 20 bp, Artificial Sequence
  Description of Artificial Sequence: Synthetic oligonucleotide
  Target: ATXN1; (-) strand; PAM type: NRG; PAM sequence: TAG
ggggatagcttcaagtcttc

SEQ ID NO: 62109 - DNA, 20 bp, Artificial Sequence
  Description of Artificial Sequence: Synthetic oligonucleotide
  Target: ATXN1; (-) strand; PAM type: NRG; PAM sequence: AAG
agtgcactggggatagcttc

SEQ ID NO: 62110 - DNA, 20 bp, Artificial Sequence
  Description of Artificial Sequence: Synthetic oligonucleotide
  Target: ATXN1; (-) strand; PAM type: NRG; PAM sequence: TAG
ccatccaagtgcactgggga

SEQ ID NO: 62111 - DNA, 20 bp, Artificial Sequence
  Description of Artificial Sequence: Synthetic oligonucleotide
  Target: ATXN1; (-) strand; PAM type: NRG; PAM sequence: GGG
cattccatccaagtgcactg

SEQ ID NO: 62112 - DNA, 20 bp, Artificial Sequence
  Description of Artificial Sequence: Synthetic oligonucleotide
  Target: ATXN1; (-) strand; PAM type: NRG; PAM sequence: GGG
tcattccatccaagtgcact

SEQ ID NO: 62113 - DNA, 20 bp, Artificial Sequence
  Description of Artificial Sequence: Synthetic oligonucleotide
  Target: ATXN1; (-) strand; PAM type: NRG; PAM sequence: TGG
ctcattccatccaagtgcac

SEQ ID NO: 62114 - DNA, 20 bp, Artificial Sequence
  Description of Artificial Sequence: Synthetic oligonucleotide
  Target: ATXN1; (-) strand; PAM type: NRG; PAM sequence: AAG
tgactgagctcattccatcc

SEQ ID NO: 62115 - DNA, 20 bp, Artificial Sequence
  Description of Artificial Sequence: Synthetic oligonucleotide
  Target: ATXN1; (-) strand; PAM type: NRG; PAM sequence: GAG
aaggcagagaggttatgact

SEQ ID NO: 62116 - DNA, 20 bp, Artificial Sequence
  Description of Artificial Sequence: Synthetic oligonucleotide
  Target: ATXN1; (-) strand; PAM type: NRG; PAM sequence: AGG
tacagattgtaaaggcagag

SEQ ID NO: 62117 - DNA, 20 bp, Artificial Sequence
  Description of Artificial Sequence: Synthetic oligonucleotide
  Target: ATXN1; (-) strand; PAM type: NRG; PAM sequence: GAG
ctacagattgtaaaggcaga

SEQ ID NO: 62118 - DNA, 20 bp, Artificial Sequence
  Description of Artificial Sequence: Synthetic oligonucleotide
  Target: ATXN1; (-) strand; PAM type: NRG; PAM sequence: GAG
acctacagattgtaaaggca

SEQ ID NO: 62119 - DNA, 20 bp, Artificial Sequence
  Description of Artificial Sequence: Synthetic oligonucleotide
  Target: ATXN1; (-) strand; PAM type: NRG; PAM sequence: CAG
tgacctacagattgtaaagg

SEQ ID NO: 62120 - DNA, 20 bp, Artificial Sequence
  Description of Artificial Sequence: Synthetic oligonucleotide
  Target: ATXN1; (-) strand; PAM type: NRG; PAM sequence: AGG
gattgacctacagattgtaa

SEQ ID NO: 62121 - DNA, 20 bp, Artificial Sequence
  Description of Artificial Sequence: Synthetic oligonucleotide
  Target: ATXN1; (-) strand; PAM type: NRG; PAM sequence: AAG
agattgacctacagattgta

SEQ ID NO: 62122 - DNA, 20 bp, Artificial Sequence
  Description of Artificial Sequence: Synthetic oligonucleotide
  Target: ATXN1; (-) strand; PAM type: NRG; PAM sequence: CAG
tgctcctgcagattgaccta

SEQ ID NO: 62123 - DNA, 20 bp, Artificial Sequence
  Description of Artificial Sequence: Synthetic oligonucleotide
  Target: ATXN1; (-) strand; PAM type: NRG; PAM sequence: CAG
ccttgcttgtaatgctcctg

SEQ ID NO: 62124 - DNA, 20 bp, Artificial Sequence
  Description of Artificial Sequence: Synthetic oligonucleotide
  Target: ATXN1; (-) strand; PAM type: NRG; PAM sequence: GAG
ccacttttggacaagtgagg

SEQ ID NO: 62125 - DNA, 20 bp, Artificial Sequence
  Description of Artificial Sequence: Synthetic oligonucleotide
  Target: ATXN1; (-) strand; PAM type: NRG; PAM sequence: GGG
caccacttttggacaagtga

SEQ ID NO: 62126 - DNA, 20 bp, Artificial Sequence
  Description of Artificial Sequence: Synthetic oligonucleotide
  Target: ATXN1; (-) strand; PAM type: NRG; PAM sequence: AGG
ccaccacttttggacaagtg

SEQ ID NO: 62127 - DNA, 20 bp, Artificial Sequence
  Description of Artificial Sequence: Synthetic oligonucleotide
  Target: ATXN1; (-) strand; PAM type: NRG; PAM sequence: GAG
tccaccacttttggacaagt

SEQ ID NO: 62128 - DNA, 20 bp, Artificial Sequence
  Description of Artificial Sequence: Synthetic oligonucleotide
  Target: ATXN1; (-) strand; PAM type: NRG; PAM sequence: AAG
agattccaccacttttggac

SEQ ID NO: 62129 - DNA, 20 bp, Artificial Sequence
  Description of Artificial Sequence: Synthetic oligonucleotide
  Target: ATXN1; (-) strand; PAM type: NRG; PAM sequence: TGG
aggggagattccaccacttt

SEQ ID NO: 62130 - DNA, 20 bp, Artificial Sequence
  Description of Artificial Sequence: Synthetic oligonucleotide
  Target: ATXN1; (-) strand; PAM type: NRG; PAM sequence: GAG
agagggtcaggagagaaggg

SEQ ID NO: 62131 - DNA, 20 bp, Artificial Sequence
  Description of Artificial Sequence: Synthetic oligonucleotide
  Target: ATXN1; (-) strand; PAM type: NRG; PAM sequence: GGG
taagagggtcaggagagaag

SEQ ID NO: 62132 - DNA, 20 bp, Artificial Sequence
  Description of Artificial Sequence: Synthetic oligonucleotide
  Target: ATXN1; (-) strand; PAM type: NRG; PAM sequence: GGG
ataagagggtcaggagagaa

SEQ ID NO: 62133 - DNA, 20 bp, Artificial Sequence
  Description of Artificial Sequence: Synthetic oligonucleotide
  Target: ATXN1; (-) strand; PAM type: NRG; PAM sequence: AGG
gataagagggtcaggagaga

SEQ ID NO: 62134 - DNA, 20 bp, Artificial Sequence
  Description of Artificial Sequence: Synthetic oligonucleotide
  Target: ATXN1; (-) strand; PAM type: NRG; PAM sequence: AAG
agataagagggtcaggagag

SEQ ID NO: 62135 - DNA, 20 bp, Artificial Sequence
  Description of Artificial Sequence: Synthetic oligonucleotide
  Target: ATXN1; (-) strand; PAM type: NRG; PAM sequence: GAG
agtagataagagggtcagga

SEQ ID NO: 62136 - DNA, 20 bp, Artificial Sequence
  Description of Artificial Sequence: Synthetic oligonucleotide
  Target: ATXN1; (-) strand; PAM type: NRG; PAM sequence: GAG
gaagtagataagagggtcag

SEQ ID NO: 62137 - DNA, 20 bp, Artificial Sequence
  Description of Artificial Sequence: Synthetic oligonucleotide
  Target: ATXN1; (-) strand; PAM type: NRG; PAM sequence: AGG
ctgaagtagataagagggtc

SEQ ID NO: 62138 - DNA, 20 bp, Artificial Sequence
  Description of Artificial Sequence: Synthetic oligonucleotide
  Target: ATXN1; (-) strand; PAM type: NRG; PAM sequence: CAG
tctgaagtagataagagggt

SEQ ID NO: 62139 - DNA, 20 bp, Artificial Sequence
  Description of Artificial Sequence: Synthetic oligonucleotide
  Target: ATXN1; (-) strand; PAM type: NRG; PAM sequence: GGG
aaaatctgaagtagataaga

SEQ ID NO: 62140 - DNA, 20 bp, Artificial Sequence
  Description of Artificial Sequence: Synthetic oligonucleotide
  Target: ATXN1; (-) strand; PAM type: NRG; PAM sequence: AGG
aaaaatctgaagtagataag

SEQ ID NO: 62141 - DNA, 20 bp, Artificial Sequence
  Description of Artificial Sequence: Synthetic oligonucleotide
  Target: ATXN1; (-) strand; PAM type: NRG; PAM sequence: GAG
aaaaaatctgaagtagataa

SEQ ID NO: 62142 - DNA, 20 bp, Artificial Sequence
  Description of Artificial Sequence: Synthetic oligonucleotide
  Target: ATXN1; (-) strand; PAM type: NRG; PAM sequence: AAG
aaaaaaaatctgaagtagat

SEQ ID NO: 62143 - DNA, 20 bp, Artificial Sequence
  Description of Artificial Sequence: Synthetic oligonucleotide
  Target: ATXN1; (-) strand; PAM type: NRG; PAM sequence: TAG
tacaaaaaaaaaatctgaag

SEQ ID NO: 62144 - DNA, 20 bp, Artificial Sequence
  Description of Artificial Sequence: Synthetic oligonucleotide
  Target: ATXN1; (-) strand; PAM type: NRG; PAM sequence: AAG
cgttacaaaaaaaaaatctg

SEQ ID NO: 62145 - DNA, 20 bp, Artificial Sequence
  Description of Artificial Sequence: Synthetic oligonucleotide
  Target: ATXN1; (-) strand; PAM type: NRG; PAM sequence: CAG
atctgtgataccaaattctc

SEQ ID NO: 62146 - DNA, 20 bp, Artificial Sequence
  Description of Artificial Sequence: Synthetic oligonucleotide
  Target: ATXN1; (-) strand; PAM type: NRG; PAM sequence: TAG
gtctgtcagtttgtaccttt

SEQ ID NO: 62147 - DNA, 20 bp, Artificial Sequence
  Description of Artificial Sequence: Synthetic oligonucleotide
  Target: ATXN1; (-) strand; PAM type: NRG; PAM sequence: CAG
gaatttccctctgtgtctgt

SEQ ID NO: 62148 - DNA, 20 bp, Artificial Sequence
  Description of Artificial Sequence: Synthetic oligonucleotide
  Target: ATXN1; (-) strand; PAM type: NRG; PAM sequence: GGG
cactctaataagagcaatct

SEQ ID NO: 62149 - DNA, 20 bp, Artificial Sequence
  Description of Artificial Sequence: Synthetic oligonucleotide
  Target: ATXN1; (-) strand; PAM type: NRG; PAM sequence: TGG
acactctaataagagcaatc

SEQ ID NO: 62150 - DNA, 20 bp, Artificial Sequence
  Description of Artificial Sequence: Synthetic oligonucleotide
  Target: ATXN1; (-) strand; PAM type: NRG; PAM sequence: GAG
acacacgcacactctaataa

SEQ ID NO: 62151 - DNA, 20 bp, Artificial Sequence
  Description of Artificial Sequence: Synthetic oligonucleotide
  Target: ATXN1; (-) strand; PAM type: NRG; PAM sequence: AAG
acacacacgcacactctaat

SEQ ID NO: 62152 - DNA, 20 bp, Artificial Sequence
  Description of Artificial Sequence: Synthetic oligonucleotide
  Target: ATXN1; (-) strand; PAM type: NRG; PAM sequence: GAG
actctgaatctccagactaa

SEQ ID NO: 62153 - DNA, 20 bp, Artificial Sequence
  Description of Artificial Sequence: Synthetic oligonucleotide
  Target: ATXN1; (-) strand; PAM type: NRG; PAM sequence: AAG
ttactctgaatctccagact

SEQ ID NO: 62154 - DNA, 20 bp, Artificial Sequence
  Description of Artificial Sequence: Synthetic oligonucleotide
  Target: ATXN1; (-) strand; PAM type: NRG; PAM sequence: CAG
tttctcttactctgaatctc

SEQ ID NO: 62155 - DNA, 20 bp, Artificial Sequence
  Description of Artificial Sequence: Synthetic oligonucleotide
  Target: ATXN1; (-) strand; PAM type: NRG; PAM sequence: GAG
gtgtaagtcttaaaaaatgg

SEQ ID NO: 62156 - DNA, 20 bp, Artificial Sequence
  Description of Artificial Sequence: Synthetic oligonucleotide
  Target: ATXN1; (-) strand; PAM type: NRG; PAM sequence: GGG
ctgtgtaagtcttaaaaaat

SEQ ID NO: 62157 - DNA, 20 bp, Artificial Sequence
  Description of Artificial Sequence: Synthetic oligonucleotide
  Target: ATXN1; (-) strand; PAM type: NRG; PAM sequence: TGG
tctgtgtaagtcttaaaaaa

SEQ ID NO: 62158 - DNA, 20 bp, Artificial Sequence
  Description of Artificial Sequence: Synthetic oligonucleotide
  Target: ATXN1; (-) strand; PAM type: NRG; PAM sequence: AAG
cagcattatgctgtctgtgt

SEQ ID NO: 62159 - DNA, 20 bp, Artificial Sequence
  Description of Artificial Sequence: Synthetic oligonucleotide
  Target: ATXN1; (-) strand; PAM type: NRG; PAM sequence: CAG
tacctctgtacctgtgtaaa

SEQ ID NO: 62160 - DNA, 20 bp, Artificial Sequence
  Description of Artificial Sequence: Synthetic oligonucleotide
  Target: ATXN1; (-) strand; PAM type: NRG; PAM sequence: GAG
tattcctaggaagaaatgga

SEQ ID NO: 62161 - DNA, 20 bp, Artificial Sequence
  Description of Artificial Sequence: Synthetic oligonucleotide
  Target: ATXN1; (-) strand; PAM type: NRG; PAM sequence: GAG
tttattcctaggaagaaatg

SEQ ID NO: 62162 - DNA, 20 bp, Artificial Sequence
  Description of Artificial Sequence: Synthetic oligonucleotide
  Target: ATXN1; (-) strand; PAM type: NRG; PAM sequence: TGG
actttattcctaggaagaaa

SEQ ID NO: 62163 - DNA, 20 bp, Artificial Sequence
  Description of Artificial Sequence: Synthetic oligonucleotide
  Target: ATXN1; (-) strand; PAM type: NRG; PAM sequence: AAG
ggcattactttattcctagg

SEQ ID NO: 62164 - DNA, 20 bp, Artificial Sequence
  Description of Artificial Sequence: Synthetic oligonucleotide
  Target: ATXN1; (-) strand; PAM type: NRG; PAM sequence: AGG
gcaggcattactttattcct

SEQ ID NO: 62165 - DNA, 20 bp, Artificial Sequence
  Description of Artificial Sequence: Synthetic oligonucleotide
  Target: ATXN1; (-) strand; PAM type: NRG; PAM sequence: TAG
tgcaggcattactttattcc

SEQ ID NO: 62166 - DNA, 20 bp, Artificial Sequence
  Description of Artificial Sequence: Synthetic oligonucleotide
  Target: ATXN1; (-) strand; PAM type: NRG; PAM sequence: AGG
agaataactgctctgagtgc

SEQ ID NO: 62167 - DNA, 20 bp, Artificial Sequence
  Description of Artificial Sequence: Synthetic oligonucleotide
  Target: ATXN1; (-) strand; PAM type: NRG; PAM sequence: CAG
cagaataactgctctgagtg

SEQ ID NO: 62168 - DNA, 20 bp, Artificial Sequence
  Description of Artificial Sequence: Synthetic oligonucleotide
  Target: ATXN1; (-) strand; PAM type: NRG; PAM sequence: GAG
cttttcagaataactgctct

SEQ ID NO: 62169 - DNA, 20 bp, Artificial Sequence
  Description of Artificial Sequence: Synthetic oligonucleotide
  Target: ATXN1; (-) strand; PAM type: NRG; PAM sequence: CAG
gtgtctatggactccctttt

SEQ ID NO: 62170 - DNA, 20 bp, Artificial Sequence
  Description of Artificial Sequence: Synthetic oligonucleotide
  Target: ATXN1; (-) strand; PAM type: NRG; PAM sequence: TGG
tctggaattttgtgtgtcta

SEQ ID NO: 62171 - DNA, 20 bp, Artificial Sequence
  Description of Artificial Sequence: Synthetic oligonucleotide
  Target: ATXN1; (-) strand; PAM type: NRG; PAM sequence: TGG
acagcaataataaaggtttc

SEQ ID NO: 62172 - DNA, 20 bp, Artificial Sequence
  Description of Artificial Sequence: Synthetic oligonucleotide
  Target: ATXN1; (-) strand; PAM type: NRG; PAM sequence: AGG
tttgaggacagcaataataa

SEQ ID NO: 62173 - DNA, 20 bp, Artificial Sequence
  Description of Artificial Sequence: Synthetic oligonucleotide
  Target: ATXN1; (-) strand; PAM type: NRG; PAM sequence: AAG
ttttgaggacagcaataata

SEQ ID NO: 62174 - DNA, 20 bp, Artificial Sequence
  Description of Artificial Sequence: Synthetic oligonucleotide
  Target: ATXN1; (-) strand; PAM type: NRG; PAM sequence: CAG
tgctagttagcttttgagga

SEQ ID NO: 62175 - DNA, 20 bp, Artificial Sequence
  Description of Artificial Sequence: Synthetic oligonucleotide
  Target: ATXN1; (-) strand; PAM type: NRG; PAM sequence: AGG
attgtgctagttagcttttg

SEQ ID NO: 62176 - DNA, 20 bp, Artificial Sequence
  Description of Artificial Sequence: Synthetic oligonucleotide
  Target: ATXN1; (-) strand; PAM type: NRG; PAM sequence: GAG
cattgtgctagttagctttt

SEQ ID NO: 62177 - DNA, 20 bp, Artificial Sequence
  Description of Artificial Sequence: Synthetic oligonucleotide
  Target: ATXN1; (-) strand; PAM type: NRG; PAM sequence: TAG
tagggaggcattgtgctagt

SEQ ID NO: 62178 - DNA, 20 bp, Artificial Sequence
  Description of Artificial Sequence: Synthetic oligonucleotide
  Target: ATXN1; (-) strand; PAM type: NRG; PAM sequence: TAG
ttcttagggaggcattgtgc

SEQ ID NO: 62179 - DNA, 20 bp, Artificial Sequence
  Description of Artificial Sequence: Synthetic oligonucleotide
  Target: ATXN1; (-) strand; PAM type: NRG; PAM sequence: AGG
tcacaaaagctttcttaggg

SEQ ID NO: 62180 - DNA, 20 bp, Artificial Sequence
  Description of Artificial Sequence: Synthetic oligonucleotide
  Target: ATXN1; (-) strand; PAM type: NRG; PAM sequence: GAG
ttcacaaaagctttcttagg

SEQ ID NO: 62181 - DNA, 20 bp, Artificial Sequence
  Description of Artificial Sequence: Synthetic oligonucleotide
  Target: ATXN1; (-) strand; PAM type: NRG; PAM sequence: GGG
agttcacaaaagctttctta

SEQ ID NO: 62182 - DNA, 20 bp, Artificial Sequence
  Description of Artificial Sequence: Synthetic oligonucleotide
  Target: ATXN1; (-) strand; PAM type: NRG; PAM sequence: AGG
aagttcacaaaagctttctt

SEQ ID NO: 62183 - DNA, 20 bp, Artificial Sequence
  Description of Artificial Sequence: Synthetic oligonucleotide
  Target: ATXN1; (-) strand; PAM type: NRG; PAM sequence: TAG
gaagttcacaaaagctttct

SEQ ID NO: 62184 - DNA, 20 bp, Artificial Sequence
  Description of Artificial Sequence: Synthetic oligonucleotide
  Target: ATXN1; (-) strand; PAM type: NRG; PAM sequence: AAG
gtgtgatgggaagttcacaa

SEQ ID NO: 62185 - DNA, 20 bp, Artificial Sequence
  Description of Artificial Sequence: Synthetic oligonucleotide
  Target: ATXN1; (-) strand; PAM type: NRG; PAM sequence: AAG
tctctgtggtgtgtgatggg

SEQ ID NO: 62186 - DNA, 20 bp, Artificial Sequence
  Description of Artificial Sequence: Synthetic oligonucleotide
  Target: ATXN1; (-) strand; PAM type: NRG; PAM sequence: GGG
atgtctctgtggtgtgtgat

SEQ ID NO: 62187 - DNA, 20 bp, Artificial Sequence
  Description of Artificial Sequence: Synthetic oligonucleotide
  Target: ATXN1; (-) strand; PAM type: NRG; PAM sequence: TGG
aatgtctctgtggtgtgtga

SEQ ID NO: 62188 - DNA, 20 bp, Artificial Sequence
  Description of Artificial Sequence: Synthetic oligonucleotide
  Target: ATXN1; (-) strand; PAM type: NRG; PAM sequence: TGG
aaacccatttaatgtctctg

SEQ ID NO: 62189 - DNA, 20 bp, Artificial Sequence
  Description of Artificial Sequence: Synthetic oligonucleotide
  Target: ATXN1; (-) strand; PAM type: NRG; PAM sequence: TGG
agaatgaaaaaatggtgtgc

SEQ ID NO: 62190 - DNA, 20 bp, Artificial Sequence
  Description of Artificial Sequence: Synthetic oligonucleotide
  Target: ATXN1; (-) strand; PAM type: NRG; PAM sequence: TGG
cacaccttagaatgaaaaaa

SEQ ID NO: 62191 - DNA, 20 bp, Artificial Sequence
  Description of Artificial Sequence: Synthetic oligonucleotide
  Target: ATXN1; (-) strand; PAM type: NRG; PAM sequence: TAG
cttcattctagtgcacacct

SEQ ID NO: 62192 - DNA, 20 bp, Artificial Sequence
  Description of Artificial Sequence: Synthetic oligonucleotide
  Target: ATXN1; (-) strand; PAM type: NRG; PAM sequence: TAG
gactgaataacacttcattc

SEQ ID NO: 62193 - DNA, 20 bp, Artificial Sequence
  Description of Artificial Sequence: Synthetic oligonucleotide
  Target: ATXN1; (-) strand; PAM type: NRG; PAM sequence: GGG
tgctgtatctccctagaaag

SEQ ID NO: 62194 - DNA, 20 bp, Artificial Sequence
  Description of Artificial Sequence: Synthetic oligonucleotide
  Target: ATXN1; (-) strand; PAM type: NRG; PAM sequence: GGG
gtgctgtatctccctagaaa

SEQ ID NO: 62195 - DNA, 20 bp, Artificial Sequence
  Description of Artificial Sequence: Synthetic oligonucleotide
  Target: ATXN1; (-) strand; PAM type: NRG; PAM sequence: AGG
agtgctgtatctccctagaa

SEQ ID NO: 62196 - DNA, 20 bp, Artificial Sequence
  Description of Artificial Sequence: Synthetic oligonucleotide
  Target: ATXN1; (-) strand; PAM type: NRG; PAM sequence: AAG
aagtgctgtatctccctaga

SEQ ID NO: 62197 - DNA, 20 bp, Artificial Sequence
  Description of Artificial Sequence: Synthetic oligonucleotide
  Target: ATXN1; (-) strand; PAM type: NRG; PAM sequence: TAG
cctgaagtgctgtatctccc

SEQ ID NO: 62198 - DNA, 20 bp, Artificial Sequence
  Description of Artificial Sequence: Synthetic oligonucleotide
  Target: ATXN1; (-) strand; PAM type: NRG; PAM sequence: AAG
tcaaagtagggatgggcctg

SEQ ID NO: 62199 - DNA, 20 bp, Artificial Sequence
  Description of Artificial Sequence: Synthetic oligonucleotide
  Target: ATXN1; (-) strand; PAM type: NRG; PAM sequence: GGG
tttcttttcaaagtagggat

SEQ ID NO: 62200 - DNA, 20 bp, Artificial Sequence
  Description of Artificial Sequence: Synthetic oligonucleotide
  Target: ATXN1; (-) strand; PAM type: NRG; PAM sequence: TGG
atttcttttcaaagtaggga

SEQ ID NO: 62201 - DNA, 20 bp, Artificial Sequence
  Description of Artificial Sequence: Synthetic oligonucleotide
  Target: ATXN1; (-) strand; PAM type: NRG; PAM sequence: GGG
tcatatttcttttcaaagta

SEQ ID NO: 62202 - DNA, 20 bp, Artificial Sequence
  Description of Artificial Sequence: Synthetic oligonucleotide
  Target: ATXN1; (-) strand; PAM type: NRG; PAM sequence: AGG
ttcatatttcttttcaaagt

SEQ ID NO: 62203 - DNA, 20 bp, Artificial Sequence
  Description of Artificial Sequence: Synthetic oligonucleotide
  Target: ATXN1; (-) strand; PAM type: NRG; PAM sequence: TAG
gttcatatttcttttcaaag

SEQ ID NO: 62204 - DNA, 20 bp, Artificial Sequence
  Description of Artificial Sequence: Synthetic oligonucleotide
  Target: ATXN1; (-) strand; PAM type: NRG; PAM sequence: AAG
tacgttcatatttcttttca

SEQ ID NO: 62205 - DNA, 20 bp, Artificial Sequence
  Description of Artificial Sequence: Synthetic oligonucleotide
  Target: ATXN1; (-) strand; PAM type: NRG; PAM sequence: TGG
tggctttctgtgaacggcgg

SEQ ID NO: 62206 - DNA, 20 bp, Artificial Sequence
  Description of Artificial Sequence: Synthetic oligonucleotide
  Target: ATXN1; (-) strand; PAM type: NRG; PAM sequence: CGG
ccctggctttctgtgaacgg

SEQ ID NO: 62207 - DNA, 20 bp, Artificial Sequence
  Description of Artificial Sequence: Synthetic oligonucleotide
  Target: ATXN1; (-) strand; PAM type: NRG; PAM sequence: CGG
ctgccctggctttctgtgaa

SEQ ID NO: 62208 - DNA, 20 bp, Artificial Sequence
  Description of Artificial Sequence: Synthetic oligonucleotide
  Target: ATXN1; (-) strand; PAM type: NRG; PAM sequence: TGG
tgtttgtgagcatcctgccc

SEQ ID NO: 62209 - DNA, 20 bp, Artificial Sequence
  Description of Artificial Sequence: Synthetic oligonucleotide
  Target: ATXN1; (-) strand; PAM type: NRG; PAM sequence: GAG
ttgctttgtcacttgtttgt

SEQ ID NO: 62210 - DNA, 20 bp, Artificial Sequence
  Description of Artificial Sequence: Synthetic oligonucleotide
  Target: ATXN1; (-) strand; PAM type: NRG; PAM sequence: TGG
cctctccttttccatttgag

SEQ ID NO: 62211 - DNA, 20 bp, Artificial Sequence
  Description of Artificial Sequence: Synthetic oligonucleotide
  Target: ATXN1; (-) strand; PAM type: NRG; PAM sequence: GAG
tttcctctccttttccattt

SEQ ID NO: 62212 - DNA, 20 bp, Artificial Sequence
  Description of Artificial Sequence: Synthetic oligonucleotide
  Target: ATXN1; (-) strand; PAM type: NRG; PAM sequence: AAG
ttttctaatactttttttaa

SEQ ID NO: 62213 - DNA, 20 bp, Artificial Sequence
  Description of Artificial Sequence: Synthetic oligonucleotide
  Target: ATXN1; (-) strand; PAM type: NRG; PAM sequence: GGG
agacctatcagtagagtttg

SEQ ID NO: 62214 - DNA, 20 bp, Artificial Sequence
  Description of Artificial Sequence: Synthetic oligonucleotide
  Target: ATXN1; (-) strand; PAM type: NRG; PAM sequence: GGG
tagacctatcagtagagttt

SEQ ID NO: 62215 - DNA, 20 bp, Artificial Sequence
  Description of Artificial Sequence: Synthetic oligonucleotide
  Target: ATXN1; (-) strand; PAM type: NRG; PAM sequence: TGG
ctagacctatcagtagagtt

SEQ ID NO: 62216 - DNA, 20 bp, Artificial Sequence
  Description of Artificial Sequence: Synthetic oligonucleotide
  Target: ATXN1; (-) strand; PAM type: NRG; PAM sequence: GAG
aaattctagacctatcagta

SEQ ID NO: 62217 - DNA, 20 bp, Artificial Sequence
  Description of Artificial Sequence: Synthetic oligonucleotide
  Target: ATXN1; (-) strand; PAM type: NRG; PAM sequence: TAG
aaaaattctagacctatcag

SEQ ID NO: 62218 - DNA, 20 bp, Artificial Sequence
  Description of Artificial Sequence: Synthetic oligonucleotide
  Target: ATXN1; (-) strand; PAM type: NRG; PAM sequence: CAG
aaaaaaaattctagacctat

SEQ ID NO: 62219 - DNA, 20 bp, Artificial Sequence
  Description of Artificial Sequence: Synthetic oligonucleotide
  Target: ATXN1; (-) strand; PAM type: NRG; PAM sequence: TAG
gtgtaaaaaaaaaaaaattc

SEQ ID NO: 62220 - DNA, 20 bp, Artificial Sequence
  Description of Artificial Sequence: Synthetic oligonucleotide
  Target: ATXN1; (-) strand; PAM type: NRG; PAM sequence: GGG
tgtataaagaaatgtgagga

SEQ ID NO: 62221 - DNA, 20 bp, Artificial Sequence
  Description of Artificial Sequence: Synthetic oligonucleotide
  Target: ATXN1; (-) strand; PAM type: NRG; PAM sequence: AGG
gtgtataaagaaatgtgagg

SEQ ID NO: 62222 - DNA, 20 bp, Artificial Sequence
  Description of Artificial Sequence: Synthetic oligonucleotide
  Target: ATXN1; (-) strand; PAM type: NRG; PAM sequence: GAG
tgtgtataaagaaatgtgag

SEQ ID NO: 62223 - DNA, 20 bp, Artificial Sequence
  Description of Artificial Sequence: Synthetic oligonucleotide
  Target: ATXN1; (-) strand; PAM type: NRG; PAM sequence: AGG
gatgtgtataaagaaatgtg

SEQ ID NO: 62224 - DNA, 20 bp, Artificial Sequence
  Description of Artificial Sequence: Synthetic oligonucleotide
  Target: ATXN1; (-) strand; PAM type: NRG; PAM sequence: GAG
tgatgtgtataaagaaatgt

SEQ ID NO: 62225 - DNA, 20 bp, Artificial Sequence
  Description of Artificial Sequence: Synthetic oligonucleotide
  Target: ATXN1; (-) strand; PAM type: NRG; PAM sequence: AAG
gtggatacttgatgtgtata

SEQ ID NO: 62226 - DNA, 20 bp, Artificial Sequence
  Description of Artificial Sequence: Synthetic oligonucleotide
  Target: ATXN1; (-) strand; PAM type: NRG; PAM sequence: TGG
tagactattttccttagaag

SEQ ID NO: 62227 - DNA, 20 bp, Artificial Sequence
  Description of Artificial Sequence: Synthetic oligonucleotide
  Target: ATXN1; (-) strand; PAM type: NRG; PAM sequence: AAG
gtctagactattttccttag

SEQ ID NO: 62228 - DNA, 20 bp, Artificial Sequence
  Description of Artificial Sequence: Synthetic oligonucleotide
  Target: ATXN1; (-) strand; PAM type: NRG; PAM sequence: TAG
agagtctagactattttcct

SEQ ID NO: 62229 - DNA, 20 bp, Artificial Sequence
  Description of Artificial Sequence: Synthetic oligonucleotide
  Target: ATXN1; (-) strand; PAM type: NRG; PAM sequence: TAG
tggggaagggatggagagtc

SEQ ID NO: 62230 - DNA, 20 bp, Artificial Sequence
  Description of Artificial Sequence: Synthetic oligonucleotide
  Target: ATXN1; (-) strand; PAM type: NRG; PAM sequence: GAG
gggtgtggggaagggatgga

SEQ ID NO: 62231 - DNA, 20 bp, Artificial Sequence
  Description of Artificial Sequence: Synthetic oligonucleotide
  Target: ATXN1; (-) strand; PAM type: NRG; PAM sequence: GAG
aagggtgtggggaagggatg

SEQ ID NO: 62232 - DNA, 20 bp, Artificial Sequence
  Description of Artificial Sequence: Synthetic oligonucleotide
  Target: ATXN1; (-) strand; PAM type: NRG; PAM sequence: TGG
ttaagggtgtggggaaggga

SEQ ID NO: 62233 - DNA, 20 bp, Artificial Sequence
  Description of Artificial Sequence: Synthetic oligonucleotide
  Target: ATXN1; (-) strand; PAM type: NRG; PAM sequence: GGG
cagtttaagggtgtggggaa

SEQ ID NO: 62234 - DNA, 20 bp, Artificial Sequence
  Description of Artificial Sequence: Synthetic oligonucleotide
  Target: ATXN1; (-) strand; PAM type: NRG; PAM sequence: AGG
gcagtttaagggtgtgggga

SEQ ID NO: 62235 - DNA, 20 bp, Artificial Sequence
  Description of Artificial Sequence: Synthetic oligonucleotide
  Target: ATXN1; (-) strand; PAM type: NRG; PAM sequence: AAG
agcagtttaagggtgtgggg

SEQ ID NO: 62236 - DNA, 20 bp, Artificial Sequence
  Description of Artificial Sequence: Synthetic oligonucleotide
  Target: ATXN1; (-) strand; PAM type: NRG; PAM sequence: GGG
gatagcagtttaagggtgtg

SEQ ID NO: 62237 - DNA, 20 bp, Artificial Sequence
  Description of Artificial Sequence: Synthetic oligonucleotide
  Target: ATXN1; (-) strand; PAM type: NRG; PAM sequence: GGG
tgatagcagtttaagggtgt

SEQ ID NO: 62238 - DNA, 20 bp, Artificial Sequence
  Description of Artificial Sequence: Synthetic oligonucleotide
  Target: ATXN1; (-) strand; PAM type: NRG; PAM sequence: TGG
ctgatagcagtttaagggtg

SEQ ID NO: 62239 - DNA, 20 bp, Artificial Sequence
  Description of Artificial Sequence: Synthetic oligonucleotide
  Target: ATXN1; (-) strand; PAM type: NRG; PAM sequence: GGG
tgaatctgatagcagtttaa

SEQ ID NO: 62240 - DNA, 20 bp, Artificial Sequence
  Description of Artificial Sequence: Synthetic oligonucleotide
  Target: ATXN1; (-) strand; PAM type: NRG; PAM sequence: AGG
ttgaatctgatagcagttta

SEQ ID NO: 62241 - DNA, 20 bp, Artificial Sequence
  Description of Artificial Sequence: Synthetic oligonucleotide
  Target: ATXN1; (-) strand; PAM type: NRG; PAM sequence: AAG
cttgaatctgatagcagttt

SEQ ID NO: 62242 - DNA, 20 bp, Artificial Sequence
  Description of Artificial Sequence: Synthetic oligonucleotide
  Target: ATXN1; (-) strand; PAM type: NRG; PAM sequence: CAG
agaatgcttgaatctgatag

SEQ ID NO: 62243 - DNA, 20 bp, Artificial Sequence
  Description of Artificial Sequence: Synthetic oligonucleotide
  Target: ATXN1; (-) strand; PAM type: NRG; PAM sequence: TAG
atgagaatgcttgaatctga

SEQ ID NO: 62244 - DNA, 20 bp, Artificial Sequence
  Description of Artificial Sequence: Synthetic oligonucleotide
  Target: ATXN1; (-) strand; PAM type: NRG; PAM sequence: GAG
aacatacatgctgttctgat

SEQ ID NO: 62245 - DNA, 20 bp, Artificial Sequence
  Description of Artificial Sequence: Synthetic oligonucleotide
  Target: ATXN1; (-) strand; PAM type: NRG; PAM sequence: AGG
gggcctgagccattaggaaa

SEQ ID NO: 62246 - DNA, 20 bp, Artificial Sequence
  Description of Artificial Sequence: Synthetic oligonucleotide
  Target: ATXN1; (-) strand; PAM type: NRG; PAM sequence: AAG
tgggcctgagccattaggaa

SEQ ID NO: 62247 - DNA, 20 bp, Artificial Sequence
  Description of Artificial Sequence: Synthetic oligonucleotide
  Target: ATXN1; (-) strand; PAM type: NRG; PAM sequence: AGG
atgtgtgggcctgagccatt

SEQ ID NO: 62248 - DNA, 20 bp, Artificial Sequence
  Description of Artificial Sequence: Synthetic oligonucleotide
  Target: ATXN1; (-) strand; PAM type: NRG; PAM sequence: TAG
catgtgtgggcctgagccat

SEQ ID NO: 62249 - DNA, 20 bp, Artificial Sequence
  Description of Artificial Sequence: Synthetic oligonucleotide
  Target: ATXN1; (-) strand; PAM type: NRG; PAM sequence: GAG
tgcctctcatgtgtgggcct

SEQ ID NO: 62250 - DNA, 20 bp, Artificial Sequence
  Description of Artificial Sequence: Synthetic oligonucleotide
  Target: ATXN1; (-) strand; PAM type: NRG; PAM sequence: GGG
agtgaatgcctctcatgtgt

SEQ ID NO: 62251 - DNA, 20 bp, Artificial Sequence
  Description of Artificial Sequence: Synthetic oligonucleotide
  Target: ATXN1; (-) strand; PAM type: NRG; PAM sequence: TGG
aagtgaatgcctctcatgtg

SEQ ID NO: 62252 - DNA, 20 bp, Artificial Sequence
  Description of Artificial Sequence: Synthetic oligonucleotide
  Target: ATXN1; (-) strand; PAM type: NRG; PAM sequence: AAG
atgcctaaatgacattcact

SEQ ID NO: 62253 - DNA, 20 bp, Artificial Sequence
  Description of Artificial Sequence: Synthetic oligonucleotide
  Target: ATXN1; (-) strand; PAM type: NRG; PAM sequence: GAG
gcagtcagtaaatattcatt

SEQ ID NO: 62254 - DNA, 20 bp, Artificial Sequence
  Description of Artificial Sequence: Synthetic oligonucleotide
  Target: ATXN1; (-) strand; PAM type: NRG; PAM sequence: CAG
ttgttcccataatgggcagt

SEQ ID NO: 62255 - DNA, 20 bp, Artificial Sequence
  Description of Artificial Sequence: Synthetic oligonucleotide
  Target: ATXN1; (-) strand; PAM type: NRG; PAM sequence: CAG
ctgcttgttcccataatggg

SEQ ID NO: 62256 - DNA, 20 bp, Artificial Sequence
  Description of Artificial Sequence: Synthetic oligonucleotide
  Target: ATXN1; (-) strand; PAM type: NRG; PAM sequence: GGG
atactgcttgttcccataat

SEQ ID NO: 62257 - DNA, 20 bp, Artificial Sequence
  Description of Artificial Sequence: Synthetic oligonucleotide
  Target: ATXN1; (-) strand; PAM type: NRG; PAM sequence: TGG
aatactgcttgttcccataa

SEQ ID NO: 62258 - DNA, 20 bp, Artificial Sequence
  Description of Artificial Sequence: Synthetic oligonucleotide
  Target: ATXN1; (-) strand; PAM type: NRG; PAM sequence: TAG
attcttccctggtgaatgaa

SEQ ID NO: 62259 - DNA, 20 bp, Artificial Sequence
  Description of Artificial Sequence: Synthetic oligonucleotide
  Target: ATXN1; (-) strand; PAM type: NRG; PAM sequence: TGG
ttctcattcttattcttccc

SEQ ID NO: 62260 - DNA, 20 bp, Artificial Sequence
  Description of Artificial Sequence: Synthetic oligonucleotide
  Target: ATXN1; (-) strand; PAM type: NRG; PAM sequence: TGG
aagctctgcaaaaggaggga

SEQ ID NO: 62261 - DNA, 20 bp, Artificial Sequence
  Description of Artificial Sequence: Synthetic oligonucleotide
  Target: ATXN1; (-) strand; PAM type: NRG; PAM sequence: GGG
ctgcaagctctgcaaaagga

SEQ ID NO: 62262 - DNA, 20 bp, Artificial Sequence
  Description of Artificial Sequence: Synthetic oligonucleotide
  Target: ATXN1; (-) strand; PAM type: NRG; PAM sequence: AGG
tctgcaagctctgcaaaagg

SEQ ID NO: 62263 - DNA, 20 bp, Artificial Sequence
  Description of Artificial Sequence: Synthetic oligonucleotide
  Target: ATXN1; (-) strand; PAM type: NRG; PAM sequence: GAG
gtctgcaagctctgcaaaag

SEQ ID NO: 62264 - DNA, 20 bp, Artificial Sequence
  Description of Artificial Sequence: Synthetic oligonucleotide
  Target: ATXN1; (-) strand; PAM type: NRG; PAM sequence: AGG
tagtctgcaagctctgcaaa

SEQ ID NO: 62265 - DNA, 20 bp, Artificial Sequence
  Description of Artificial Sequence: Synthetic oligonucleotide
  Target: ATXN1; (-) strand; PAM type: NRG; PAM sequence: AAG
ctagtctgcaagctctgcaa

SEQ ID NO: 62266 - DNA, 20 bp, Artificial Sequence
  Description of Artificial Sequence: Synthetic oligonucleotide
  Target: ATXN1; (-) strand; PAM type: NRG; PAM sequence: AAG
agtctcctcaactagtctgc

SEQ ID NO: 62267 - DNA, 20 bp, Artificial Sequence
  Description of Artificial Sequence: Synthetic oligonucleotide
  Target: ATXN1; (-) strand; PAM type: NRG; PAM sequence: TAG
taatcatcagtctcctcaac

SEQ ID NO: 62268 - DNA, 20 bp, Artificial Sequence
  Description of Artificial Sequence: Synthetic oligonucleotide
  Target: ATXN1; (-) strand; PAM type: NRG; PAM sequence: CAG
tatatttatttgttaatcat

SEQ ID NO: 62269 - DNA, 20 bp, Artificial Sequence
  Description of Artificial Sequence: Synthetic oligonucleotide
  Target: ATXN1; (-) strand; PAM type: NRG; PAM sequence: AAG
gccttctgtgtttttctttt

SEQ ID NO: 62270 - DNA, 20 bp, Artificial Sequence
  Description of Artificial Sequence: Synthetic oligonucleotide
  Target: ATXN1; (-) strand; PAM type: NRG; PAM sequence: TAG
ccccatccctctcagtcctc

SEQ ID NO: 62271 - DNA, 20 bp, Artificial Sequence
  Description of Artificial Sequence: Synthetic oligonucleotide
  Target: ATXN1; (-) strand; PAM type: NRG; PAM sequence: CAG
agcatccaccccatccctct

SEQ ID NO: 62272 - DNA, 20 bp, Artificial Sequence
  Description of Artificial Sequence: Synthetic oligonucleotide
  Target: ATXN1; (-) strand; PAM type: NRG; PAM sequence: TAG
cttccctgatctacataaaa

SEQ ID NO: 62273 - DNA, 20 bp, Artificial Sequence
  Description of Artificial Sequence: Synthetic oligonucleotide
  Target: ATXN1; (-) strand; PAM type: NRG; PAM sequence: CAG
cttgagttaccttatcaaag

SEQ ID NO: 62274 - DNA, 20 bp, Artificial Sequence
  Description of Artificial Sequence: Synthetic oligonucleotide
  Target: ATXN1; (-) strand; PAM type: NRG; PAM sequence: AAG
attcttgagttaccttatca

SEQ ID NO: 62275 - DNA, 20 bp, Artificial Sequence
  Description of Artificial Sequence: Synthetic oligonucleotide
  Target: ATXN1; (-) strand; PAM type: NRG; PAM sequence: GAG
ttccttaagtaggaattctt

SEQ ID NO: 62276 - DNA, 20 bp, Artificial Sequence
  Description of Artificial Sequence: Synthetic oligonucleotide
  Target: ATXN1; (-) strand; PAM type: NRG; PAM sequence: AGG
gcttctctgcttccttaagt

SEQ ID NO: 62277 - DNA, 20 bp, Artificial Sequence
  Description of Artificial Sequence: Synthetic oligonucleotide
  Target: ATXN1; (-) strand; PAM type: NRG; PAM sequence: TAG
agcttctctgcttccttaag

SEQ ID NO: 62278 - DNA, 20 bp, Artificial Sequence
  Description of Artificial Sequence: Synthetic oligonucleotide
  Target: ATXN1; (-) strand; PAM type: NRG; PAM sequence: AAG
ctaagcttctctgcttcctt

SEQ ID NO: 62279 - DNA, 20 bp, Artificial Sequence
  Description of Artificial Sequence: Synthetic oligonucleotide
  Target: ATXN1; (-) strand; PAM type: NRG; PAM sequence: AAG
gtgatccatatttcattcct

SEQ ID NO: 62280 - DNA, 20 bp, Artificial Sequence
  Description of Artificial Sequence: Synthetic oligonucleotide
  Target: ATXN1; (-) strand; PAM type: NRG; PAM sequence: AAG
ttagagtctaagcaaggaga

SEQ ID NO: 62281 - DNA, 20 bp, Artificial Sequence
  Description of Artificial Sequence: Synthetic oligonucleotide
  Target: ATXN1; (-) strand; PAM type: NRG; PAM sequence: GAG
ttggttagagtctaagcaag

SEQ ID NO: 62282 - DNA, 20 bp, Artificial Sequence
  Description of Artificial Sequence: Synthetic oligonucleotide
  Target: ATXN1; (-) strand; PAM type: NRG; PAM sequence: AGG
tattggttagagtctaagca

SEQ ID NO: 62283 - DNA, 20 bp, Artificial Sequence
  Description of Artificial Sequence: Synthetic oligonucleotide
  Target: ATXN1; (-) strand; PAM type: NRG; PAM sequence: AAG
atattggttagagtctaagc

SEQ ID NO: 62284 - DNA, 20 bp, Artificial Sequence
  Description of Artificial Sequence: Synthetic oligonucleotide
  Target: ATXN1; (-) strand; PAM type: NRG; PAM sequence: AAG
tcaaatattggttagagtct

SEQ ID NO: 62285 - DNA, 20 bp, Artificial Sequence
  Description of Artificial Sequence: Synthetic oligonucleotide
  Target: ATXN1; (-) strand; PAM type: NRG; PAM sequence: GAG
ctgtgctcaaatattggtta

SEQ ID NO: 62286 - DNA, 20 bp, Artificial Sequence
  Description of Artificial Sequence: Synthetic oligonucleotide
  Target: ATXN1; (-) strand; PAM type: NRG; PAM sequence: TAG
ctctgtgctcaaatattggt

SEQ ID NO: 62287 - DNA, 20 bp, Artificial Sequence
  Description of Artificial Sequence: Synthetic oligonucleotide
  Target: ATXN1; (-) strand; PAM type: NRG; PAM sequence: TGG
ccacctctgtgctcaaatat

SEQ ID NO: 62288 - DNA, 20 bp, Artificial Sequence
  Description of Artificial Sequence: Synthetic oligonucleotide
  Target: ATXN1; (-) strand; PAM type: NRG; PAM sequence: GAG
caggaacgatttttgaactt

SEQ ID NO: 62289 - DNA, 20 bp, Artificial Sequence
  Description of Artificial Sequence: Synthetic oligonucleotide
  Target: ATXN1; (-) strand; PAM type: NRG; PAM sequence: AGG
tggtccttttgaaaataaac

SEQ ID NO: 62290 - DNA, 20 bp, Artificial Sequence
  Description of Artificial Sequence: Synthetic oligonucleotide
  Target: ATXN1; (-) strand; PAM type: NRG; PAM sequence: CAG
ttggtccttttgaaaataaa

SEQ ID NO: 62291 - DNA, 20 bp, Artificial Sequence
  Description of Artificial Sequence: Synthetic oligonucleotide
  Target: ATXN1; (-) strand; PAM type: NRG; PAM sequence: TGG
aatttagggtccacactcat

SEQ ID NO: 62292 - DNA, 20 bp, Artificial Sequence
  Description of Artificial Sequence: Synthetic oligonucleotide
  Target: ATXN1; (-) strand; PAM type: NRG; PAM sequence: GGG
gctttagctgtttaaattta

SEQ ID NO: 62293 - DNA, 20 bp, Artificial Sequence
  Description of Artificial Sequence: Synthetic oligonucleotide
  Target: ATXN1; (-) strand; PAM type: NRG; PAM sequence: AGG
agctttagctgtttaaattt

SEQ ID NO: 62294 - DNA, 20 bp, Artificial Sequence
  Description of Artificial Sequence: Synthetic oligonucleotide
  Target: ATXN1; (-) strand; PAM type: NRG; PAM sequence: TAG
tagctttagctgtttaaatt

SEQ ID NO: 62295 - DNA, 20 bp, Artificial Sequence
  Description of Artificial Sequence: Synthetic oligonucleotide
  Target: ATXN1; (-) strand; PAM type: NRG; PAM sequence: TAG
ctgtccttagactatagctt

SEQ ID NO: 62296 - DNA, 20 bp, Artificial Sequence
  Description of Artificial Sequence: Synthetic oligonucleotide
  Target: ATXN1; (-) strand; PAM type: NRG; PAM sequence: TAG
ttgagactgtccttagacta

SEQ ID NO: 62297 - DNA, 20 bp, Artificial Sequence
  Description of Artificial Sequence: Synthetic oligonucleotide
  Target: ATXN1; (-) strand; PAM type: NRG; PAM sequence: TAG
tatttatttgagactgtcct

SEQ ID NO: 62298 - DNA, 20 bp, Artificial Sequence
  Description of Artificial Sequence: Synthetic oligonucleotide
  Target: ATXN1; (-) strand; PAM type: NRG; PAM sequence: GAG
caattcaaaggtatttattt

SEQ ID NO: 62299 - DNA, 20 bp, Artificial Sequence
  Description of Artificial Sequence: Synthetic oligonucleotide
  Target: ATXN1; (-) strand; PAM type: NRG; PAM sequence: AGG
ggcaccatatgacaattcaa

SEQ ID NO: 62300 - DNA, 20 bp, Artificial Sequence
  Description of Artificial Sequence: Synthetic oligonucleotide
  Target: ATXN1; (-) strand; PAM type: NRG; PAM sequence: AAG
gggcaccatatgacaattca

SEQ ID NO: 62301 - DNA, 20 bp, Artificial Sequence
  Description of Artificial Sequence: Synthetic oligonucleotide
  Target: ATXN1; (-) strand; PAM type: NRG; PAM sequence: GGG
cctttccacaagaccctcct

SEQ ID NO: 62302 - DNA, 20 bp, Artificial Sequence
  Description of Artificial Sequence: Synthetic oligonucleotide
  Target: ATXN1; (-) strand; PAM type: NRG; PAM sequence: TGG
ccctttccacaagaccctcc

SEQ ID NO: 62303 - DNA, 20 bp, Artificial Sequence
  Description of Artificial Sequence: Synthetic oligonucleotide
  Target: ATXN1; (-) strand; PAM type: NRG; PAM sequence: AAG
taccatgaaaccctttccac

SEQ ID NO: 62304 - DNA, 20 bp, Artificial Sequence
  Description of Artificial Sequence: Synthetic oligonucleotide
  Target: ATXN1; (-) strand; PAM type: NRG; PAM sequence: GAG
ttagggttaaaagaaaaaaa

SEQ ID NO: 62305 - DNA, 20 bp, Artificial Sequence
  Description of Artificial Sequence: Synthetic oligonucleotide
  Target: ATXN1; (-) strand; PAM type: NRG; PAM sequence: AAG
tcttagggttaaaagaaaaa

SEQ ID NO: 62306 - DNA, 20 bp, Artificial Sequence
  Description of Artificial Sequence: Synthetic oligonucleotide
  Target: ATXN1; (-) strand; PAM type: NRG; PAM sequence: AAG
gagcacagtcttagggttaa

SEQ ID NO: 62307 - DNA, 20 bp, Artificial Sequence
  Description of Artificial Sequence: Synthetic oligonucleotide
  Target: ATXN1; (-) strand; PAM type: NRG; PAM sequence: GGG
aaacattgagcacagtctta

SEQ ID NO: 62308 - DNA, 20 bp, Artificial Sequence
  Description of Artificial Sequence: Synthetic oligonucleotide
  Target: ATXN1; (-) strand; PAM type: NRG; PAM sequence: AGG
aaaacattgagcacagtctt

SEQ ID NO: 62309 - DNA, 20 bp, Artificial Sequence
  Description of Artificial Sequence: Synthetic oligonucleotide
  Target: ATXN1; (-) strand; PAM type: NRG; PAM sequence: TAG
taaaacattgagcacagtct

SEQ ID NO: 62310 - DNA, 20 bp, Artificial Sequence
  Description of Artificial Sequence: Synthetic oligonucleotide
  Target: ATXN1; (-) strand; PAM type: NRG; PAM sequence: CAG
tgtttttaaaacattgagca

SEQ ID NO: 62311 - DNA, 20 bp, Artificial Sequence
  Description of Artificial Sequence: Synthetic oligonucleotide
  Target: ATXN1; (-) strand; PAM type: NRG; PAM sequence: GAG
acaactgtttttaaaacatt

SEQ ID NO: 62312 - DNA, 20 bp, Artificial Sequence
  Description of Artificial Sequence: Synthetic oligonucleotide
  Target: ATXN1; (-) strand; PAM type: NRG; PAM sequence: TGG
gttcctaaaaatcaatgatt

SEQ ID NO: 62313 - DNA, 20 bp, Artificial Sequence
  Description of Artificial Sequence: Synthetic oligonucleotide
  Target: ATXN1; (-) strand; PAM type: NRG; PAM sequence: GGG
aacgtttattttaccttctt

SEQ ID NO: 62314 - DNA, 20 bp, Artificial Sequence
  Description of Artificial Sequence: Synthetic oligonucleotide
  Target: ATXN1; (-) strand; PAM type: NRG; PAM sequence: TGG
gaacgtttattttaccttct

SEQ ID NO: 62315 - DNA, 20 bp, Artificial Sequence
  Description of Artificial Sequence: Synthetic oligonucleotide
  Target: ATXN1; (-) strand; PAM type: NRG; PAM sequence: AGG
taaagtatcagccttagatg

SEQ ID NO: 62316 - DNA, 20 bp, Artificial Sequence
  Description of Artificial Sequence: Synthetic oligonucleotide
  Target: ATXN1; (-) strand; PAM type: NRG; PAM sequence: GAG
ataaagtatcagccttagat

SEQ ID NO: 62317 - DNA, 20 bp, Artificial Sequence
  Description of Artificial Sequence: Synthetic oligonucleotide
  Target: ATXN1; (-) strand; PAM type: NRG; PAM sequence: TAG
gttgcataaagtatcagcct

SEQ ID NO: 62318 - DNA, 20 bp, Artificial Sequence
  Description of Artificial Sequence: Synthetic oligonucleotide
  Target: ATXN1; (-) strand; PAM type: NRG; PAM sequence: CAG
tctcaagttgcataaagtat

SEQ ID NO: 62319 - DNA, 20 bp, Artificial Sequence
  Description of Artificial Sequence: Synthetic oligonucleotide
  Target: ATXN1; (-) strand; PAM type: NRG; PAM sequence: AAG
taagtgtctcaagttgcata

SEQ ID NO: 62320 - DNA, 20 bp, Artificial Sequence
  Description of Artificial Sequence: Synthetic oligonucleotide
  Target: ATXN1; (-) strand; PAM type: NRG; PAM sequence: AAG
gtttttaccctaagtgtctc

SEQ ID NO: 62321 - DNA, 20 bp, Artificial Sequence
  Description of Artificial Sequence: Synthetic oligonucleotide
  Target: ATXN1; (-) strand; PAM type: NRG; PAM sequence: AAG
ccagtggtggtttttaccct

SEQ ID NO: 62322 - DNA, 20 bp, Artificial Sequence
  Description of Artificial Sequence: Synthetic oligonucleotide
  Target: ATXN1; (-) strand; PAM type: NRG; PAM sequence: TGG
agttaaatcacctccagtgg

SEQ ID NO: 62323 - DNA, 20 bp, Artificial Sequence
  Description of Artificial Sequence: Synthetic oligonucleotide
  Target: ATXN1; (-) strand; PAM type: NRG; PAM sequence: TGG
ttgagttaaatcacctccag

SEQ ID NO: 62324 - DNA, 20 bp, Artificial Sequence
  Description of Artificial Sequence: Synthetic oligonucleotide
  Target: ATXN1; (-) strand; PAM type: NRG; PAM sequence: CAG
aaattgagttaaatcacctc

SEQ ID NO: 62325 - DNA, 20 bp, Artificial Sequence
  Description of Artificial Sequence: Synthetic oligonucleotide
  Target: ATXN1; (-) strand; PAM type: NRG; PAM sequence: GAG
atggacaacttgagaaaatt

SEQ ID NO: 62326 - DNA, 20 bp, Artificial Sequence
  Description of Artificial Sequence: Synthetic oligonucleotide
  Target: ATXN1; (-) strand; PAM type: NRG; PAM sequence: GAG
cattttatgatggacaactt

SEQ ID NO: 62327 - DNA, 20 bp, Artificial Sequence
  Description of Artificial Sequence: Synthetic oligonucleotide
  Target: ATXN1; (-) strand; PAM type: NRG; PAM sequence: TGG
catggggactcattttatga

SEQ ID NO: 62328 - DNA, 20 bp, Artificial Sequence
  Description of Artificial Sequence: Synthetic oligonucleotide
  Target: ATXN1; (-) strand; PAM type: NRG; PAM sequence: GGG
cttgggtcctctctaccatg

SEQ ID NO: 62329 - DNA, 20 bp, Artificial Sequence
  Description of Artificial Sequence: Synthetic oligonucleotide
  Target: ATXN1; (-) strand; PAM type: NRG; PAM sequence: GGG
ccttgggtcctctctaccat

SEQ ID NO: 62330 - DNA, 20 bp, Artificial Sequence
  Description of Artificial Sequence: Synthetic oligonucleotide
  Target: ATXN1; (-) strand; PAM type: NRG; PAM sequence: TGG
accttgggtcctctctacca

SEQ ID NO: 62331 - DNA, 20 bp, Artificial Sequence
  Description of Artificial Sequence: Synthetic oligonucleotide
  Target: ATXN1; (-) strand; PAM type: NRG; PAM sequence: GGG
gttgttagccatataacctt

SEQ ID NO: 62332 - DNA, 20 bp, Artificial Sequence
  Description of Artificial Sequence: Synthetic oligonucleotide
  Target: ATXN1; (-) strand; PAM type: NRG; PAM sequence: TGG
tgttgttagccatataacct

SEQ ID NO: 62333 - DNA, 20 bp, Artificial Sequence
  Description of Artificial Sequence: Synthetic oligonucleotide
  Target: ATXN1; (-) strand; PAM type: NRG; PAM sequence: TAG
tttatgcacaatgctgttgt

SEQ ID NO: 62334 - DNA, 20 bp, Artificial Sequence
  Description of Artificial Sequence: Synthetic oligonucleotide
  Target: ATXN1; (-) strand; PAM type: NRG; PAM sequence: TGG
gaactcagagttagcagacc

SEQ ID NO: 62335 - DNA, 20 bp, Artificial Sequence
  Description of Artificial Sequence: Synthetic oligonucleotide
  Target: ATXN1; (-) strand; PAM type: NRG; PAM sequence: CAG
gacactgaactcagagttag

SEQ ID NO: 62336 - DNA, 20 bp, Artificial Sequence
  Description of Artificial Sequence: Synthetic oligonucleotide
  Target: ATXN1; (-) strand; PAM type: NRG; PAM sequence: TAG
gctgacactgaactcagagt

SEQ ID NO: 62337 - DNA, 20 bp, Artificial Sequence
  Description of Artificial Sequence: Synthetic oligonucleotide
  Target: ATXN1; (-) strand; PAM type: NRG; PAM sequence: GAG
tgatgctgacactgaactca

SEQ ID NO: 62338 - DNA, 20 bp, Artificial Sequence
  Description of Artificial Sequence: Synthetic oligonucleotide
  Target: ATXN1; (-) strand; PAM type: NRG; PAM sequence: CAG
aatgatgctgacactgaact

SEQ ID NO: 62339 - DNA, 20 bp, Artificial Sequence
  Description of Artificial Sequence: Synthetic oligonucleotide
  Target: ATXN1; (-) strand; PAM type: NRG; PAM sequence: GAG
ggggggatcttgtacaagaa

SEQ ID NO: 62340 - DNA, 20 bp, Artificial Sequence
  Description of Artificial Sequence: Synthetic oligonucleotide
  Target: ATXN1; (-) strand; PAM type: NRG; PAM sequence: AAG
gaggggggatcttgtacaag

SEQ ID NO: 62341 - DNA, 20 bp, Artificial Sequence
  Description of Artificial Sequence: Synthetic oligonucleotide
  Target: ATXN1; (-) strand; PAM type: NRG; PAM sequence: AAG
ggggaggggggatcttgtac

SEQ ID NO: 62342 - DNA, 20 bp, Artificial Sequence
  Description of Artificial Sequence: Synthetic oligonucleotide
  Target: ATXN1; (-) strand; PAM type: NRG; PAM sequence: GGG
tgtaagggctggggggaggg

SEQ ID NO: 62343 - DNA, 20 bp, Artificial Sequence
  Description of Artificial Sequence: Synthetic oligonucleotide
  Target: ATXN1; (-) strand; PAM type: NRG; PAM sequence: GGG
ctgtaagggctggggggagg

SEQ ID NO: 62344 - DNA, 20 bp, Artificial Sequence
  Description of Artificial Sequence: Synthetic oligonucleotide
  Target: ATXN1; (-) strand; PAM type: NRG; PAM sequence: GGG
gctgtaagggctggggggag

SEQ ID NO: 62345 - DNA, 20 bp, Artificial Sequence
  Description of Artificial Sequence: Synthetic oligonucleotide
  Target: ATXN1; (-) strand; PAM type: NRG; PAM sequence: GGG
ggctgtaagggctgggggga

SEQ ID NO: 62346 - DNA, 20 bp, Artificial Sequence
  Description of Artificial Sequence: Synthetic oligonucleotide
  Target: ATXN1; (-) strand; PAM type: NRG; PAM sequence: AGG
tggctgtaagggctgggggg

SEQ ID NO: 62347 - DNA, 20 bp, Artificial Sequence
  Description of Artificial Sequence: Synthetic oligonucleotide
  Target: ATXN1; (-) strand; PAM type: NRG; PAM sequence: GAG
ctggctgtaagggctggggg

SEQ ID NO: 62348 - DNA, 20 bp, Artificial Sequence
  Description of Artificial Sequence: Synthetic oligonucleotide
  Target: ATXN1; (-) strand; PAM type: NRG; PAM sequence: GGG
gactggctgtaagggctggg

SEQ ID NO: 62349 - DNA, 20 bp, Artificial Sequence
  Description of Artificial Sequence: Synthetic oligonucleotide
  Target: ATXN1; (-) strand; PAM type: NRG; PAM sequence: GGG
agactggctgtaagggctgg

SEQ ID NO: 62350 - DNA, 20 bp, Artificial Sequence
  Description of Artificial Sequence: Synthetic oligonucleotide
  Target: ATXN1; (-) strand; PAM type: NRG; PAM sequence: GGG
cagactggctgtaagggctg

SEQ ID NO: 62351 - DNA, 20 bp, Artificial Sequence
  Description of Artificial Sequence: Synthetic oligonucleotide
  Target: ATXN1; (-) strand; PAM type: NRG; PAM sequence: GGG
tcagactggctgtaagggct

SEQ ID NO: 62352 - DNA, 20 bp, Artificial Sequence
  Description of Artificial Sequence: Synthetic oligonucleotide
  Target: ATXN1; (-) strand; PAM type: NRG; PAM sequence: TGG
ttcagactggctgtaagggc

SEQ ID NO: 62353 - DNA, 20 bp, Artificial Sequence
  Description of Artificial Sequence: Synthetic oligonucleotide
  Target: ATXN1; (-) strand; PAM type: NRG; PAM sequence: GGG
atgtttcagactggctgtaa

SEQ ID NO: 62354 - DNA, 20 bp, Artificial Sequence
  Description of Artificial Sequence: Synthetic oligonucleotide
  Target: ATXN1; (-) strand; PAM type: NRG; PAM sequence: AGG
gatgtttcagactggctgta

SEQ ID NO: 62355 - DNA, 20 bp, Artificial Sequence
  Description of Artificial Sequence: Synthetic oligonucleotide
  Target: ATXN1; (-) strand; PAM type: NRG; PAM sequence: AAG
agatgtttcagactggctgt

SEQ ID NO: 62356 - DNA, 20 bp, Artificial Sequence
  Description of Artificial Sequence: Synthetic oligonucleotide
  Target: ATXN1; (-) strand; PAM type: NRG; PAM sequence: TGG
cccctgaagatgtttcagac

SEQ ID NO: 62357 - DNA, 20 bp, Artificial Sequence
  Description of Artificial Sequence: Synthetic oligonucleotide
  Target: ATXN1; (-) strand; PAM type: NRG; PAM sequence: CAG
ctttgcccctgaagatgttt

SEQ ID NO: 62358 - DNA, 20 bp, Artificial Sequence
  Description of Artificial Sequence: Synthetic oligonucleotide
  Target: ATXN1; (-) strand; PAM type: NRG; PAM sequence: AAG
gcagatggcctttgcccctg

SEQ ID NO: 62359 - DNA, 20 bp, Artificial Sequence
  Description of Artificial Sequence: Synthetic oligonucleotide
  Target: ATXN1; (-) strand; PAM type: NRG; PAM sequence: TGG
tgccaccacttgccagcaga

SEQ ID NO: 62360 - DNA, 20 bp, Artificial Sequence
  Description of Artificial Sequence: Synthetic oligonucleotide
  Target: ATXN1; (-) strand; PAM type: NRG; PAM sequence: CAG
aatctgccaccacttgccag

SEQ ID NO: 62361 - DNA, 20 bp, Artificial Sequence
  Description of Artificial Sequence: Synthetic oligonucleotide
  Target: ATXN1; (-) strand; PAM type: NRG; PAM sequence: CAG
tcaaatctgccaccacttgc

SEQ ID NO: 62362 - DNA, 20 bp, Artificial Sequence
  Description of Artificial Sequence: Synthetic oligonucleotide
  Target: ATXN1; (-) strand; PAM type: NRG; PAM sequence: TGG
gtccttgcagatgttactcc

SEQ ID NO: 62363 - DNA, 20 bp, Artificial Sequence
  Description of Artificial Sequence: Synthetic oligonucleotide
  Target: ATXN1; (-) strand; PAM type: NRG; PAM sequence: CAG
cccatgctcagcagtccttg

SEQ ID NO: 62364 - DNA, 20 bp, Artificial Sequence
  Description of Artificial Sequence: Synthetic oligonucleotide
  Target: ATXN1; (-) strand; PAM type: NRG; PAM sequence: CAG
gtagtggttcccatgctcag

SEQ ID NO: 62365 - DNA, 20 bp, Artificial Sequence
  Description of Artificial Sequence: Synthetic oligonucleotide
  Target: ATXN1; (-) strand; PAM type: NRG; PAM sequence: CAG
gaagtagtggttcccatgct

SEQ ID NO: 62366 - DNA, 20 bp, Artificial Sequence
  Description of Artificial Sequence: Synthetic oligonucleotide
  Target: ATXN1; (-) strand; PAM type: NRG; PAM sequence: TGG
acagcagccattggaagtag

SEQ ID NO: 62367 - DNA, 20 bp, Artificial Sequence
  Description of Artificial Sequence: Synthetic oligonucleotide
  Target: ATXN1; (-) strand; PAM type: NRG; PAM sequence: TAG
atcacagcagccattggaag

SEQ ID NO: 62368 - DNA, 20 bp, Artificial Sequence
  Description of Artificial Sequence: Synthetic oligonucleotide
  Target: ATXN1; (-) strand; PAM type: NRG; PAM sequence: AAG
ataatcacagcagccattgg

SEQ ID NO: 62369 - DNA, 20 bp, Artificial Sequence
  Description of Artificial Sequence: Synthetic oligonucleotide
  Target: ATXN1; (-) strand; PAM type: NRG; PAM sequence: TGG
gtgataatcacagcagccat

SEQ ID NO: 62370 - DNA, 20 bp, Artificial Sequence
  Description of Artificial Sequence: Synthetic oligonucleotide
  Target: ATXN1; (-) strand; PAM type: NRG; PAM sequence: CAG
tgtgtgagtgataatcacag

SEQ ID NO: 62371 - DNA, 20 bp, Artificial Sequence
  Description of Artificial Sequence: Synthetic oligonucleotide
  Target: ATXN1; (-) strand; PAM type: NRG; PAM sequence: CAG
aaatgtgtgagtgataatca

SEQ ID NO: 62372 - DNA, 20 bp, Artificial Sequence
  Description of Artificial Sequence: Synthetic oligonucleotide
  Target: ATXN1; (-) strand; PAM type: NRG; PAM sequence: GAG
gagtgggtgtataaatgtgt

SEQ ID NO: 62373 - DNA, 20 bp, Artificial Sequence
  Description of Artificial Sequence: Synthetic oligonucleotide
  Target: ATXN1; (-) strand; PAM type: NRG; PAM sequence: GGG
cataaacagggtctaggagt

SEQ ID NO: 62374 - DNA, 20 bp, Artificial Sequence
  Description of Artificial Sequence: Synthetic oligonucleotide
  Target: ATXN1; (-) strand; PAM type: NRG; PAM sequence: TGG
acataaacagggtctaggag

SEQ ID NO: 62375 - DNA, 20 bp, Artificial Sequence
  Description of Artificial Sequence: Synthetic oligonucleotide
  Target: ATXN1; (-) strand; PAM type: NRG; PAM sequence: GAG
tgcacataaacagggtctag

SEQ ID NO: 62376 - DNA, 20 bp, Artificial Sequence
  Description of Artificial Sequence: Synthetic oligonucleotide
  Target: ATXN1; (-) strand; PAM type: NRG; PAM sequence: AGG
tttgcacataaacagggtct

SEQ ID NO: 62377 - DNA, 20 bp, Artificial Sequence
  Description of Artificial Sequence: Synthetic oligonucleotide
  Target: ATXN1; (-) strand; PAM type: NRG; PAM sequence: TAG
gtttgcacataaacagggtc

SEQ ID NO: 62378 - DNA, 20 bp, Artificial Sequence
  Description of Artificial Sequence: Synthetic oligonucleotide
  Target: ATXN1; (-) strand; PAM type: NRG; PAM sequence: GGG
tgcatgtttgcacataaaca

SEQ ID NO: 62379 - DNA, 20 bp, Artificial Sequence
  Description of Artificial Sequence: Synthetic oligonucleotide
  Target: ATXN1; (-) strand; PAM type: NRG; PAM sequence: AGG
atgcatgtttgcacataaac

SEQ ID NO: 62380 - DNA, 20 bp, Artificial Sequence
  Description of Artificial Sequence: Synthetic oligonucleotide
  Target: ATXN1; (-) strand; PAM type: NRG; PAM sequence: CAG
aatgcatgtttgcacataaa

SEQ ID NO: 62381 - DNA, 20 bp, Artificial Sequence
  Description of Artificial Sequence: Synthetic oligonucleotide
  Target: ATXN1; (-) strand; PAM type: NRG; PAM sequence: AAG
gagaaggcaggcaattttca

SEQ ID NO: 62382 - DNA, 20 bp, Artificial Sequence
  Description of Artificial Sequence: Synthetic oligonucleotide
  Target: ATXN1; (-) strand; PAM type: NRG; PAM sequence: AGG
actgttgcagtagagaaggc

SEQ ID NO: 62383 - DNA, 20 bp, Artificial Sequence
  Description of Artificial Sequence: Synthetic oligonucleotide
  Target: ATXN1; (-) strand; PAM type: NRG; PAM sequence: CAG
aactgttgcagtagagaagg

SEQ ID NO: 62384 - DNA, 20 bp, Artificial Sequence
  Description of Artificial Sequence: Synthetic oligonucleotide
  Target: ATXN1; (-) strand; PAM type: NRG; PAM sequence: AGG
gagaactgttgcagtagaga

SEQ ID NO: 62385 - DNA, 20 bp, Artificial Sequence
  Description of Artificial Sequence: Synthetic oligonucleotide
  Target: ATXN1; (-) strand; PAM type: NRG; PAM sequence: AAG
ggagaactgttgcagtagag

SEQ ID NO: 62386 - DNA, 20 bp, Artificial Sequence
  Description of Artificial Sequence: Synthetic oligonucleotide
  Target: ATXN1; (-) strand; PAM type: NRG; PAM sequence: GAG
catggagaactgttgcagta

SEQ ID NO: 62387 - DNA, 20 bp, Artificial Sequence
  Description of Artificial Sequence: Synthetic oligonucleotide
  Target: ATXN1; (-) strand; PAM type: NRG; PAM sequence: TAG
gccatggagaactgttgcag

SEQ ID NO: 62388 - DNA, 20 bp, Artificial Sequence
  Description of Artificial Sequence: Synthetic oligonucleotide
  Target: ATXN1; (-) strand; PAM type: NRG; PAM sequence: CAG
tgtgccatggagaactgttg

SEQ ID NO: 62389 - DNA, 20 bp, Artificial Sequence
  Description of Artificial Sequence: Synthetic oligonucleotide
  Target: ATXN1; (-) strand; PAM type: NRG; PAM sequence: GAG
gccccaaagcctgtgccatg

SEQ ID NO: 62390 - DNA, 20 bp, Artificial Sequence
  Description of Artificial Sequence: Synthetic oligonucleotide
  Target: ATXN1; (-) strand; PAM type: NRG; PAM sequence: TGG
atgccccaaagcctgtgcca

SEQ ID NO: 62391 - DNA, 20 bp, Artificial Sequence
  Description of Artificial Sequence: Synthetic oligonucleotide
  Target: ATXN1; (-) strand; PAM type: NRG; PAM sequence: AAG
ttagtgtcctgcatgcccca

SEQ ID NO: 62392 - DNA, 20 bp, Artificial Sequence
  Description of Artificial Sequence: Synthetic oligonucleotide
  Target: ATXN1; (-) strand; PAM type: NRG; PAM sequence: TAG
gttttctgtcttcctgggtt

SEQ ID NO: 62393 - DNA, 20 bp, Artificial Sequence
  Description of Artificial Sequence: Synthetic oligonucleotide
  Target: ATXN1; (-) strand; PAM type: NRG; PAM sequence: GGG
cactggttttctgtcttcct

SEQ ID NO: 62394 - DNA, 20 bp, Artificial Sequence
  Description of Artificial Sequence: Synthetic oligonucleotide
  Target: ATXN1; (-) strand; PAM type: NRG; PAM sequence: TGG
acactggttttctgtcttcc

SEQ ID NO: 62395 - DNA, 20 bp, Artificial Sequence
  Description of Artificial Sequence: Synthetic oligonucleotide
  Target: ATXN1; (-) strand; PAM type: NRG; PAM sequence: TGG
tgggcacatgtttacaacac

SEQ ID NO: 62396 - DNA, 20 bp, Artificial Sequence
  Description of Artificial Sequence: Synthetic oligonucleotide
  Target: ATXN1; (-) strand; PAM type: NRG; PAM sequence: GGG
ttggtaacctttcattatct

SEQ ID NO: 62397 - DNA, 20 bp, Artificial Sequence
  Description of Artificial Sequence: Synthetic oligonucleotide
  Target: ATXN1; (-) strand; PAM type: NRG; PAM sequence: TGG
gttggtaacctttcattatc

SEQ ID NO: 62398 - DNA, 20 bp, Artificial Sequence
  Description of Artificial Sequence: Synthetic oligonucleotide
  Target: ATXN1; (-) strand; PAM type: NRG; PAM sequence: TGG
ttcttagtaaactgtgatgt

SEQ ID NO: 62399 - DNA, 20 bp, Artificial Sequence
  Description of Artificial Sequence: Synthetic oligonucleotide
  Target: ATXN1; (-) strand; PAM type: NRG; PAM sequence: TAG
tggggggttcctagttttct

SEQ ID NO: 62400 - DNA, 20 bp, Artificial Sequence
  Description of Artificial Sequence: Synthetic oligonucleotide
  Target: ATXN1; (-) strand; PAM type: NRG; PAM sequence: TAG
taggggcagtggggggttcc

SEQ ID NO: 62401 - DNA, 20 bp, Artificial Sequence
  Description of Artificial Sequence: Synthetic oligonucleotide
  Target: ATXN1; (-) strand; PAM type: NRG; PAM sequence: GGG
tgcttggtaggggcagtggg

SEQ ID NO: 62402 - DNA, 20 bp, Artificial Sequence
  Description of Artificial Sequence: Synthetic oligonucleotide
  Target: ATXN1; (-) strand; PAM type: NRG; PAM sequence: GGG
ttgcttggtaggggcagtgg

SEQ ID NO: 62403 - DNA, 20 bp, Artificial Sequence
  Description of Artificial Sequence: Synthetic oligonucleotide
  Target: ATXN1; (-) strand; PAM type: NRG; PAM sequence: GGG
tttgcttggtaggggcagtg

SEQ ID NO: 62404 - DNA, 20 bp, Artificial Sequence
  Description of Artificial Sequence: Synthetic oligonucleotide
  Target: ATXN1; (-) strand; PAM type: NRG; PAM sequence: GGG
atttgcttggtaggggcagt

SEQ ID NO: 62405 - DNA, 20 bp, Artificial Sequence
  Description of Artificial Sequence: Synthetic oligonucleotide
  Target: ATXN1; (-) strand; PAM type: NRG; PAM sequence: TGG
catttgcttggtaggggcag

SEQ ID NO: 62406 - DNA, 20 bp, Artificial Sequence
  Description of Artificial Sequence: Synthetic oligonucleotide
  Target: ATXN1; (-) strand; PAM type: NRG; PAM sequence: CAG
ccgcatttgcttggtagggg

SEQ ID NO: 62407 - DNA, 20 bp, Artificial Sequence
  Description of Artificial Sequence: Synthetic oligonucleotide
  Target: ATXN1; (-) strand; PAM type: NRG; PAM sequence: GGG
aaaccgcatttgcttggtag

SEQ ID NO: 62408 - DNA, 20 bp, Artificial Sequence
  Description of Artificial Sequence: Synthetic oligonucleotide
  Target: ATXN1; (-) strand; PAM type: NRG; PAM sequence: GGG
aaaaccgcatttgcttggta

SEQ ID NO: 62409 - DNA, 20 bp, Artificial Sequence
  Description of Artificial Sequence: Synthetic oligonucleotide
  Target: ATXN1; (-) strand; PAM type: NRG; PAM sequence: AGG
caaaaccgcatttgcttggt

SEQ ID NO: 62410 - DNA, 20 bp, Artificial Sequence
  Description of Artificial Sequence: Synthetic oligonucleotide
  Target: ATXN1; (-) strand; PAM type: NRG; PAM sequence: TAG
tcaaaaccgcatttgcttgg

SEQ ID NO: 62411 - DNA, 20 bp, Artificial Sequence
  Description of Artificial Sequence: Synthetic oligonucleotide
  Target: ATXN1; (-) strand; PAM type: NRG; PAM sequence: TGG
ttttcaaaaccgcatttgct

SEQ ID NO: 62412 - DNA, 20 bp, Artificial Sequence
  Description of Artificial Sequence: Synthetic oligonucleotide
  Target: ATXN1; (-) strand; PAM type: NRG; PAM sequence: AAG
gtgaactctttgtgcatgct

SEQ ID NO: 62413 - DNA, 20 bp, Artificial Sequence
  Description of Artificial Sequence: Synthetic oligonucleotide
  Target: ATXN1; (-) strand; PAM type: NRG; PAM sequence: TAG
agcaaggaaataccaaattc

SEQ ID NO: 62414 - DNA, 20 bp, Artificial Sequence
  Description of Artificial Sequence: Synthetic oligonucleotide
  Target: ATXN1; (-) strand; PAM type: NRG; PAM sequence: AGG
tggagtgtgttgagagagca

SEQ ID NO: 62415 - DNA, 20 bp, Artificial Sequence
  Description of Artificial Sequence: Synthetic oligonucleotide
  Target: ATXN1; (-) strand; PAM type: NRG; PAM sequence: AAG
atggagtgtgttgagagagc

SEQ ID NO: 62416 - DNA, 20 bp, Artificial Sequence
  Description of Artificial Sequence: Synthetic oligonucleotide
  Target: ATXN1; (-) strand; PAM type: NRG; PAM sequence: GAG
gtaaatggagtgtgttgaga

SEQ ID NO: 62417 - DNA, 20 bp, Artificial Sequence
  Description of Artificial Sequence: Synthetic oligonucleotide
  Target: ATXN1; (-) strand; PAM type: NRG; PAM sequence: GAG
ctgtaaatggagtgtgttga

SEQ ID NO: 62418 - DNA, 20 bp, Artificial Sequence
  Description of Artificial Sequence: Synthetic oligonucleotide
  Target: ATXN1; (-) strand; PAM type: NRG; PAM sequence: GAG
ttctgtaaatggagtgtgtt

SEQ ID NO: 62419 - DNA, 20 bp, Artificial Sequence
  Description of Artificial Sequence: Synthetic oligonucleotide
  Target: ATXN1; (-) strand; PAM type: NRG; PAM sequence: GAG
ttaaaatccttctgtaaatg

SEQ ID NO: 62420 - DNA, 20 bp, Artificial Sequence
  Description of Artificial Sequence: Synthetic oligonucleotide
  Target: ATXN1; (-) strand; PAM type: NRG; PAM sequence: TGG
ttttaaaatccttctgtaaa

SEQ ID NO: 62421 - DNA, 20 bp, Artificial Sequence
  Description of Artificial Sequence: Synthetic oligonucleotide
  Target: ATXN1; (-) strand; PAM type: NRG; PAM sequence: AAG
gatgccacatggcagacttg

SEQ ID NO: 62422 - DNA, 20 bp, Artificial Sequence
  Description of Artificial Sequence: Synthetic oligonucleotide
  Target: ATXN1; (-) strand; PAM type: NRG; PAM sequence: CAG
cactttaagatgccacatgg

SEQ ID NO: 62423 - DNA, 20 bp, Artificial Sequence
  Description of Artificial Sequence: Synthetic oligonucleotide
  Target: ATXN1; (-) strand; PAM type: NRG; PAM sequence: TGG
gtacactttaagatgccaca

SEQ ID NO: 62424 - DNA, 20 bp, Artificial Sequence
  Description of Artificial Sequence: Synthetic oligonucleotide
  Target: ATXN1; (-) strand; PAM type: NRG; PAM sequence: AAG
acttctgaagtgtacacttt

SEQ ID NO: 62425 - DNA, 20 bp, Artificial Sequence
  Description of Artificial Sequence: Synthetic oligonucleotide
  Target: ATXN1; (-) strand; PAM type: NRG; PAM sequence: AAG
aggttttcaaaggacttctg

SEQ ID NO: 62426 - DNA, 20 bp, Artificial Sequence
  Description of Artificial Sequence: Synthetic oligonucleotide
  Target: ATXN1; (-) strand; PAM type: NRG; PAM sequence: AGG
agattgagtgaggttttcaa

SEQ ID NO: 62427 - DNA, 20 bp, Artificial Sequence
  Description of Artificial Sequence: Synthetic oligonucleotide
  Target: ATXN1; (-) strand; PAM type: NRG; PAM sequence: AAG
aagattgagtgaggttttca

SEQ ID NO: 62428 - DNA, 20 bp, Artificial Sequence
  Description of Artificial Sequence: Synthetic oligonucleotide
  Target: ATXN1; (-) strand; PAM type: NRG; PAM sequence: AGG
cagacctcaaagattgagtg

SEQ ID NO: 62429 - DNA, 20 bp, Artificial Sequence
  Description of Artificial Sequence: Synthetic oligonucleotide
  Target: ATXN1; (-) strand; PAM type: NRG; PAM sequence: GAG
tcagacctcaaagattgagt

SEQ ID NO: 62430 - DNA, 20 bp, Artificial Sequence
  Description of Artificial Sequence: Synthetic oligonucleotide
  Target: ATXN1; (-) strand; PAM type: NRG; PAM sequence: GAG
cctgtcagacctcaaagatt

SEQ ID NO: 62431 - DNA, 20 bp, Artificial Sequence
  Description of Artificial Sequence: Synthetic oligonucleotide
  Target: ATXN1; (-) strand; PAM type: NRG; PAM sequence: AAG
tgacaccctgtcagacctca

SEQ ID NO: 62432 - DNA, 20 bp, Artificial Sequence
  Description of Artificial Sequence: Synthetic oligonucleotide
  Target: ATXN1; (-) strand; PAM type: NRG; PAM sequence: CAG
ctgttcatgtgacaccctgt

SEQ ID NO: 62433 - DNA, 20 bp, Artificial Sequence
  Description of Artificial Sequence: Synthetic oligonucleotide
  Target: ATXN1; (-) strand; PAM type: NRG; PAM sequence: GGG
ttttgtttcaaatctagtgg

SEQ ID NO: 62434 - DNA, 20 bp, Artificial Sequence
  Description of Artificial Sequence: Synthetic oligonucleotide
  Target: ATXN1; (-) strand; PAM type: NRG; PAM sequence: GGG
cttttgtttcaaatctagtg

SEQ ID NO: 62435 - DNA, 20 bp, Artificial Sequence
  Description of Artificial Sequence: Synthetic oligonucleotide
  Target: ATXN1; (-) strand; PAM type: NRG; PAM sequence: GGG
gcttttgtttcaaatctagt

SEQ ID NO: 62436 - DNA, 20 bp, Artificial Sequence
  Description of Artificial Sequence: Synthetic oligonucleotide
  Target: ATXN1; (-) strand; PAM type: NRG; PAM sequence: TGG
agcttttgtttcaaatctag

SEQ ID NO: 62437 - DNA, 20 bp, Artificial Sequence
  Description of Artificial Sequence: Synthetic oligonucleotide
  Target: ATXN1; (-) strand; PAM type: NRG; PAM sequence: TAG
gatagcttttgtttcaaatc

SEQ ID NO: 62438 - DNA, 20 bp, Artificial Sequence
  Description of Artificial Sequence: Synthetic oligonucleotide
  Target: ATXN1; (-) strand; PAM type: NRG; PAM sequence: TAG
tgcagttaccataatcaaga

SEQ ID NO: 62439 - DNA, 20 bp, Artificial Sequence
  Description of Artificial Sequence: Synthetic oligonucleotide
  Target: ATXN1; (-) strand; PAM type: NRG; PAM sequence: AAG
ctcatgcagttaccataatc

SEQ ID NO: 62440 - DNA, 20 bp, Artificial Sequence
  Description of Artificial Sequence: Synthetic oligonucleotide
  Target: ATXN1; (-) strand; PAM type: NRG; PAM sequence: CAG
ctctatttaaataactcatg

SEQ ID NO: 62441 - DNA, 20 bp, Artificial Sequence
  Description of Artificial Sequence: Synthetic oligonucleotide
  Target: ATXN1; (-) strand; PAM type: NRG; PAM sequence: AGG
gtaaaactgctttaggtttc

SEQ ID NO: 62442 - DNA, 20 bp, Artificial Sequence
  Description of Artificial Sequence: Synthetic oligonucleotide
  Target: ATXN1; (-) strand; PAM type: NRG; PAM sequence: CAG
tgtaaaactgctttaggttt

SEQ ID NO: 62443 - DNA, 20 bp, Artificial Sequence
  Description of Artificial Sequence: Synthetic oligonucleotide
  Target: ATXN1; (-) strand; PAM type: NRG; PAM sequence: AGG
gtcttatgtaaaactgcttt

SEQ ID NO: 62444 - DNA, 20 bp, Artificial Sequence
  Description of Artificial Sequence: Synthetic oligonucleotide
  Target: ATXN1; (-) strand; PAM type: NRG; PAM sequence: TAG
tgtcttatgtaaaactgctt

SEQ ID NO: 62445 - DNA, 20 bp, Artificial Sequence
  Description of Artificial Sequence: Synthetic oligonucleotide
  Target: ATXN1; (-) strand; PAM type: NRG; PAM sequence: AAG
gcatttttatcctaggaaac

SEQ ID NO: 62446 - DNA, 20 bp, Artificial Sequence
  Description of Artificial Sequence: Synthetic oligonucleotide
  Target: ATXN1; (-) strand; PAM type: NRG; PAM sequence: AGG
ttttaaagcatttttatcct

SEQ ID NO: 62447 - DNA, 20 bp, Artificial Sequence
  Description of Artificial Sequence: Synthetic oligonucleotide
  Target: ATXN1; (-) strand; PAM type: NRG; PAM sequence: TAG
tttttaaagcatttttatcc

SEQ ID NO: 62448 - DNA, 20 bp, Artificial Sequence
  Description of Artificial Sequence: Synthetic oligonucleotide
  Target: ATXN1; (-) strand; PAM type: NRG; PAM sequence: AAG
acttctggtggtatttttta

SEQ ID NO: 62449 - DNA, 20 bp, Artificial Sequence
  Description of Artificial Sequence: Synthetic oligonucleotide
  Target: ATXN1; (-) strand; PAM type: NRG; PAM sequence: TGG
ctgttagaatgcacttctgg

SEQ ID NO: 62450 - DNA, 20 bp, Artificial Sequence
  Description of Artificial Sequence: Synthetic oligonucleotide
  Target: ATXN1; (-) strand; PAM type: NRG; PAM sequence: TGG
taactgttagaatgcacttc

SEQ ID NO: 62451 - DNA, 20 bp, Artificial Sequence
  Description of Artificial Sequence: Synthetic oligonucleotide
  Target: ATXN1; (-) strand; PAM type: NRG; PAM sequence: TAG
tttcccaatcaggtaactgt

SEQ ID NO: 62452 - DNA, 20 bp, Artificial Sequence
  Description of Artificial Sequence: Synthetic oligonucleotide
  Target: ATXN1; (-) strand; PAM type: NRG; PAM sequence: AGG
tagaaatcattttcccaatc

SEQ ID NO: 62453 - DNA, 20 bp, Artificial Sequence
  Description of Artificial Sequence: Synthetic oligonucleotide
  Target: ATXN1; (-) strand; PAM type: NRG; PAM sequence: CAG
ctagaaatcattttcccaat

SEQ ID NO: 62454 - DNA, 20 bp, Artificial Sequence
  Description of Artificial Sequence: Synthetic oligonucleotide
  Target: ATXN1; (-) strand; PAM type: NRG; PAM sequence: TAG
ccagttacagtgtgttttac

SEQ ID NO: 62455 - DNA, 20 bp, Artificial Sequence
  Description of Artificial Sequence: Synthetic oligonucleotide
  Target: ATXN1; (-) strand; PAM type: NRG; PAM sequence: CAG
agatttgggtactccagtta

SEQ ID NO: 62456 - DNA, 20 bp, Artificial Sequence
  Description of Artificial Sequence: Synthetic oligonucleotide
  Target: ATXN1; (-) strand; PAM type: NRG; PAM sequence: CAG
catgttagatttgggtactc

SEQ ID NO: 62457 - DNA, 20 bp, Artificial Sequence
  Description of Artificial Sequence: Synthetic oligonucleotide
  Target: ATXN1; (-) strand; PAM type: NRG; PAM sequence: GGG
ttgtgggccatgttagattt

SEQ ID NO: 62458 - DNA, 20 bp, Artificial Sequence
  Description of Artificial Sequence: Synthetic oligonucleotide
  Target: ATXN1; (-) strand; PAM type: NRG; PAM sequence: TGG
attgtgggccatgttagatt

SEQ ID NO: 62459 - DNA, 20 bp, Artificial Sequence
  Description of Artificial Sequence: Synthetic oligonucleotide
  Target: ATXN1; (-) strand; PAM type: NRG; PAM sequence: TAG
ggaataattgtgggccatgt

SEQ ID NO: 62460 - DNA, 20 bp, Artificial Sequence
  Description of Artificial Sequence: Synthetic oligonucleotide
  Target: ATXN1; (-) strand; PAM type: NRG; PAM sequence: GGG
cactatcaaggaataattgt

SEQ ID NO: 62461 - DNA, 20 bp, Artificial Sequence
  Description of Artificial Sequence: Synthetic oligonucleotide
  Target: ATXN1; (-) strand; PAM type: NRG; PAM sequence: TGG
tcactatcaaggaataattg

SEQ ID NO: 62462 - DNA, 20 bp, Artificial Sequence
  Description of Artificial Sequence: Synthetic oligonucleotide
  Target: ATXN1; (-) strand; PAM type: NRG; PAM sequence: AGG
aaaagtttctgtcactatca

SEQ ID NO: 62463 - DNA, 20 bp, Artificial Sequence
  Description of Artificial Sequence: Synthetic oligonucleotide
  Target: ATXN1; (-) strand; PAM type: NRG; PAM sequence: AAG
taaaagtttctgtcactatc

SEQ ID NO: 62464 - DNA, 20 bp, Artificial Sequence
  Description of Artificial Sequence: Synthetic oligonucleotide
  Target: ATXN1; (-) strand; PAM type: NRG; PAM sequence: AAG
taaaaaaaaccttattgtaa

SEQ ID NO: 62465 - DNA, 20 bp, Artificial Sequence
  Description of Artificial Sequence: Synthetic oligonucleotide
  Target: ATXN1; (-) strand; PAM type: NRG; PAM sequence: AAG
taaggggaagagcattgtga

SEQ ID NO: 62466 - DNA, 20 bp, Artificial Sequence
  Description of Artificial Sequence: Synthetic oligonucleotide
  Target: ATXN1; (-) strand; PAM type: NRG; PAM sequence: GAG
tagggtcctcataaggggaa

SEQ ID NO: 62467 - DNA, 20 bp, Artificial Sequence
  Description of Artificial Sequence: Synthetic oligonucleotide
  Target: ATXN1; (-) strand; PAM type: NRG; PAM sequence: AAG
tttagggtcctcataagggg

SEQ ID NO: 62468 - DNA, 20 bp, Artificial Sequence
  Description of Artificial Sequence: Synthetic oligonucleotide
  Target: ATXN1; (-) strand; PAM type: NRG; PAM sequence: GGG
tggtttagggtcctcataag

SEQ ID NO: 62469 - DNA, 20 bp, Artificial Sequence
  Description of Artificial Sequence: Synthetic oligonucleotide
  Target: ATXN1; (-) strand; PAM type: NRG; PAM sequence: GGG
ttggtttagggtcctcataa

SEQ ID NO: 62470 - DNA, 20 bp, Artificial Sequence
  Description of Artificial Sequence: Synthetic oligonucleotide
  Target: ATXN1; (-) strand; PAM type: NRG; PAM sequence: AGG
cttggtttagggtcctcata

SEQ ID NO: 62471 - DNA, 20 bp, Artificial Sequence
  Description of Artificial Sequence: Synthetic oligonucleotide
  Target: ATXN1; (-) strand; PAM type: NRG; PAM sequence: AAG
tcttggtttagggtcctcat

SEQ ID NO: 62472 - DNA, 20 bp, Artificial Sequence
  Description of Artificial Sequence: Synthetic oligonucleotide
  Target: ATXN1; (-) strand; PAM type: NRG; PAM sequence: GGG
gcaatcagcatcttggttta

SEQ ID NO: 62473 - DNA, 20 bp, Artificial Sequence
  Description of Artificial Sequence: Synthetic oligonucleotide
  Target: ATXN1; (-) strand; PAM type: NRG; PAM sequence: AGG
agcaatcagcatcttggttt

SEQ ID NO: 62474 - DNA, 20 bp, Artificial Sequence
  Description of Artificial Sequence: Synthetic oligonucleotide
  Target: ATXN1; (-) strand; PAM type: NRG; PAM sequence: TAG
aagcaatcagcatcttggtt

SEQ ID NO: 62475 - DNA, 20 bp, Artificial Sequence
  Description of Artificial Sequence: Synthetic oligonucleotide
  Target: ATXN1; (-) strand; PAM type: NRG; PAM sequence: TGG
ttattaagcaatcagcatct

SEQ ID NO: 62476 - DNA, 20 bp, Artificial Sequence
  Description of Artificial Sequence: Synthetic oligonucleotide
  Target: ATXN1; (-) strand; PAM type: NRG; PAM sequence: CAG
ctacctttttattaagcaat

SEQ ID NO: 62477 - DNA, 20 bp, Artificial Sequence
  Description of Artificial Sequence: Synthetic oligonucleotide
  Target: ATXN1; (-) strand; PAM type: NRG; PAM sequence: AAG
gcccatactacctttttatt

SEQ ID NO: 62478 - DNA, 20 bp, Artificial Sequence
  Description of Artificial Sequence: Synthetic oligonucleotide
  Target: ATXN1; (-) strand; PAM type: NRG; PAM sequence: CAG
caggcatgagccaccatccc

SEQ ID NO: 62479 - DNA, 20 bp, Artificial Sequence
  Description of Artificial Sequence: Synthetic oligonucleotide
  Target: ATXN1; (-) strand; PAM type: NRG; PAM sequence: GAG
aatgttttgattacaggcat

SEQ ID NO: 62480 - DNA, 20 bp, Artificial Sequence
  Description of Artificial Sequence: Synthetic oligonucleotide
  Target: ATXN1; (-) strand; PAM type: NRG; PAM sequence: AGG
tcccaaaatgttttgattac

SEQ ID NO: 62481 - DNA, 20 bp, Artificial Sequence
  Description of Artificial Sequence: Synthetic oligonucleotide
  Target: ATXN1; (-) strand; PAM type: NRG; PAM sequence: CAG
ttcccaaaatgttttgatta

SEQ ID NO: 62482 - DNA, 20 bp, Artificial Sequence
  Description of Artificial Sequence: Synthetic oligonucleotide
  Target: ATXN1; (-) strand; PAM type: NRG; PAM sequence: AAG
ggtcttgaactactgagctc

SEQ ID NO: 62483 - DNA, 20 bp, Artificial Sequence
  Description of Artificial Sequence: Synthetic oligonucleotide
  Target: ATXN1; (-) strand; PAM type: NRG; PAM sequence: GAG
caggctggtcttgaactact

SEQ ID NO: 62484 - DNA, 20 bp, Artificial Sequence
  Description of Artificial Sequence: Synthetic oligonucleotide
  Target: ATXN1; (-) strand; PAM type: NRG; PAM sequence: TGG
tttcaccatgttgctcaggc

SEQ ID NO: 62485 - DNA, 20 bp, Artificial Sequence
  Description of Artificial Sequence: Synthetic oligonucleotide
  Target: ATXN1; (-) strand; PAM type: NRG; PAM sequence: AGG
agagtttcaccatgttgctc

SEQ ID NO: 62486 - DNA, 20 bp, Artificial Sequence
  Description of Artificial Sequence: Synthetic oligonucleotide
  Target: ATXN1; (-) strand; PAM type: NRG; PAM sequence: CAG
cagagtttcaccatgttgct

SEQ ID NO: 62487 - DNA, 20 bp, Artificial Sequence
  Description of Artificial Sequence: Synthetic oligonucleotide
  Target: ATXN1; (-) strand; PAM type: NRG; PAM sequence: GAG
ttgtatttttggtagagaca

SEQ ID NO: 62488 - DNA, 20 bp, Artificial Sequence
  Description of Artificial Sequence: Synthetic oligonucleotide
  Target: ATXN1; (-) strand; PAM type: NRG; PAM sequence: CAG
ttttgtatttttggtagaga

SEQ ID NO: 62489 - DNA, 20 bp, Artificial Sequence
  Description of Artificial Sequence: Synthetic oligonucleotide
  Target: ATXN1; (-) strand; PAM type: NRG; PAM sequence: GAG
aattttttgtatttttggta

SEQ ID NO: 62490 - DNA, 20 bp, Artificial Sequence
  Description of Artificial Sequence: Synthetic oligonucleotide
  Target: ATXN1; (-) strand; PAM type: NRG; PAM sequence: TAG
ctaattttttgtatttttgg

SEQ ID NO: 62491 - DNA, 20 bp, Artificial Sequence
  Description of Artificial Sequence: Synthetic oligonucleotide
  Target: ATXN1; (-) strand; PAM type: NRG; PAM sequence: TGG
tggctaattttttgtatttt

SEQ ID NO: 62492 - DNA, 20 bp, Artificial Sequence
  Description of Artificial Sequence: Synthetic oligonucleotide
  Target: ATXN1; (-) strand; PAM type: NRG; PAM sequence: TGG
caggtgcacaccaccatgcc

SEQ ID NO: 62493 - DNA, 20 bp, Artificial Sequence
  Description of Artificial Sequence: Synthetic oligonucleotide
  Target: ATXN1; (-) strand; PAM type: NRG; PAM sequence: AGG
ttcagagtagctgggaccac

SEQ ID NO: 62494 - DNA, 20 bp, Artificial Sequence
  Description of Artificial Sequence: Synthetic oligonucleotide
  Target: ATXN1; (-) strand; PAM type: NRG; PAM sequence: CAG
cttcagagtagctgggacca

SEQ ID NO: 62495 - DNA, 20 bp, Artificial Sequence
  Description of Artificial Sequence: Synthetic oligonucleotide
  Target: ATXN1; (-) strand; PAM type: NRG; PAM sequence: GGG
cctcagccttcagagtagct

SEQ ID NO: 62496 - DNA, 20 bp, Artificial Sequence
  Description of Artificial Sequence: Synthetic oligonucleotide
  Target: ATXN1; (-) strand; PAM type: NRG; PAM sequence: TGG
acctcagccttcagagtagc

SEQ ID NO: 62497 - DNA, 20 bp, Artificial Sequence
  Description of Artificial Sequence: Synthetic oligonucleotide
  Target: ATXN1; (-) strand; PAM type: NRG; PAM sequence: TAG
tcccacctcagccttcagag

SEQ ID NO: 62498 - DNA, 20 bp, Artificial Sequence
  Description of Artificial Sequence: Synthetic oligonucleotide
  Target: ATXN1; (-) strand; PAM type: NRG; PAM sequence: GAG
ccctcccacctcagccttca

SEQ ID NO: 62499 - DNA, 20 bp, Artificial Sequence
  Description of Artificial Sequence: Synthetic oligonucleotide
  Target: ATXN1; (-) strand; PAM type: NRG; PAM sequence: CAG
gaccctcccacctcagcctt

SEQ ID NO: 62500 - DNA, 20 bp, Artificial Sequence
  Description of Artificial Sequence: Synthetic oligonucleotide
  Target: ATXN1; (-) strand; PAM type: NRG; PAM sequence: CAG
ctcaagtgaccctcccacct

SEQ ID NO: 62501 - DNA, 20 bp, Artificial Sequence
  Description of Artificial Sequence: Synthetic oligonucleotide
  Target: ATXN1; (-) strand; PAM type: NRG; PAM sequence: AAG
aacctctgcctcccaagctc

SEQ ID NO: 62502 - DNA, 20 bp, Artificial Sequence
  Description of Artificial Sequence: Synthetic oligonucleotide
  Target: ATXN1; (-) strand; PAM type: NRG; PAM sequence: AAG
cactgcaacctctgcctccc

SEQ ID NO: 62503 - DNA, 20 bp, Artificial Sequence
  Description of Artificial Sequence: Synthetic oligonucleotide
  Target: ATXN1; (-) strand; PAM type: NRG; PAM sequence: AAG
ccaggctggagtgcaatggc

SEQ ID NO: 62504 - DNA, 20 bp, Artificial Sequence
  Description of Artificial Sequence: Synthetic oligonucleotide
  Target: ATXN1; (-) strand; PAM type: NRG; PAM sequence: TGG
tcacccaggctggagtgcaa

SEQ ID NO: 62505 - DNA, 20 bp, Artificial Sequence
  Description of Artificial Sequence: Synthetic oligonucleotide
  Target: ATXN1; (-) strand; PAM type: NRG; PAM sequence: GAG
ttactctgtcacccaggctg

SEQ ID NO: 62506 - DNA, 20 bp, Artificial Sequence
  Description of Artificial Sequence: Synthetic oligonucleotide
  Target: ATXN1; (-) strand; PAM type: NRG; PAM sequence: TGG
ccttactctgtcacccaggc

SEQ ID NO: 62507 - DNA, 20 bp, Artificial Sequence
  Description of Artificial Sequence: Synthetic oligonucleotide
  Target: ATXN1; (-) strand; PAM type: NRG; PAM sequence: AGG
ggtgccttactctgtcaccc

SEQ ID NO: 62508 - DNA, 20 bp, Artificial Sequence
  Description of Artificial Sequence: Synthetic oligonucleotide
  Target: ATXN1; (-) strand; PAM type: NRG; PAM sequence: CAG
tggtgccttactctgtcacc

SEQ ID NO: 62509 - DNA, 20 bp, Artificial Sequence
  Description of Artificial Sequence: Synthetic oligonucleotide
  Target: ATXN1; (-) strand; PAM type: NRG; PAM sequence: TGG
ttttttctttttaattgagg

SEQ ID NO: 62510 - DNA, 20 bp, Artificial Sequence
  Description of Artificial Sequence: Synthetic oligonucleotide
  Target: ATXN1; (-) strand; PAM type: NRG; PAM sequence: AGG
catttttttctttttaattg

SEQ ID NO: 62511 - DNA, 20 bp, Artificial Sequence
  Description of Artificial Sequence: Synthetic oligonucleotide
  Target: ATXN1; (-) strand; PAM type: NRG; PAM sequence: GAG
tcatttttttctttttaatt

SEQ ID NO: 62512 - DNA, 20 bp, Artificial Sequence
  Description of Artificial Sequence: Synthetic oligonucleotide
  Target: ATXN1; (-) strand; PAM type: NRG; PAM sequence: AAG
cccataaaacaatattttgc

SEQ ID NO: 62513 - DNA, 20 bp, Artificial Sequence
  Description of Artificial Sequence: Synthetic oligonucleotide
  Target: ATXN1; (-) strand; PAM type: NRG; PAM sequence: GAG
ggcaaccttgggcaagtcgc

SEQ ID NO: 62514 - DNA, 20 bp, Artificial Sequence
  Description of Artificial Sequence: Synthetic oligonucleotide
  Target: ATXN1; (-) strand; PAM type: NRG; PAM sequence: AAG
gtacactggcaaccttgggc

SEQ ID NO: 62515 - DNA, 20 bp, Artificial Sequence
  Description of Artificial Sequence: Synthetic oligonucleotide
  Target: ATXN1; (-) strand; PAM type: NRG; PAM sequence: GGG
tcaagtacactggcaacctt

SEQ ID NO: 62516 - DNA, 20 bp, Artificial Sequence
  Description of Artificial Sequence: Synthetic oligonucleotide
  Target: ATXN1; (-) strand; PAM type: NRG; PAM sequence: TGG
atcaagtacactggcaacct

SEQ ID NO: 62517 - DNA, 20 bp, Artificial Sequence
  Description of Artificial Sequence: Synthetic oligonucleotide
  Target: ATXN1; (-) strand; PAM type: NRG; PAM sequence: TGG
actgttgagatcaagtacac

SEQ ID NO: 62518 - DNA, 20 bp, Artificial Sequence
  Description of Artificial Sequence: Synthetic oligonucleotide
  Target: ATXN1; (-) strand; PAM type: NRG; PAM sequence: AAG
ctattcctactgttgagatc

SEQ ID NO: 62519 - DNA, 20 bp, Artificial Sequence
  Description of Artificial Sequence: Synthetic oligonucleotide
  Target: ATXN1; (-) strand; PAM type: NRG; PAM sequence: GAG
tgaatcctattcctactgtt

SEQ ID NO: 62520 - DNA, 20 bp, Artificial Sequence
  Description of Artificial Sequence: Synthetic oligonucleotide
  Target: ATXN1; (-) strand; PAM type: NRG; PAM sequence: CAG
gaaatcagtcagcctggaat

SEQ ID NO: 62521 - DNA, 20 bp, Artificial Sequence
  Description of Artificial Sequence: Synthetic oligonucleotide
  Target: ATXN1; (-) strand; PAM type: NRG; PAM sequence: TGG
ctagtggaaatcagtcagcc

SEQ ID NO: 62522 - DNA, 20 bp, Artificial Sequence
  Description of Artificial Sequence: Synthetic oligonucleotide
  Target: ATXN1; (-) strand; PAM type: NRG; PAM sequence: CAG
tgggtctagtggaaatcagt

SEQ ID NO: 62523 - DNA, 20 bp, Artificial Sequence
  Description of Artificial Sequence: Synthetic oligonucleotide
  Target: ATXN1; (-) strand; PAM type: NRG; PAM sequence: CAG
acgttgggtctagtggaaat

SEQ ID NO: 62524 - DNA, 20 bp, Artificial Sequence
  Description of Artificial Sequence: Synthetic oligonucleotide
  Target: ATXN1; (-) strand; PAM type: NRG; PAM sequence: TGG
tctgtacacgttgggtctag

SEQ ID NO: 62525 - DNA, 20 bp, Artificial Sequence
  Description of Artificial Sequence: Synthetic oligonucleotide
  Target: ATXN1; (-) strand; PAM type: NRG; PAM sequence: TAG
cattctgtacacgttgggtc

SEQ ID NO: 62526 - DNA, 20 bp, Artificial Sequence
  Description of Artificial Sequence: Synthetic oligonucleotide
  Target: ATXN1; (-) strand; PAM type: NRG; PAM sequence: GGG
gtttccattctgtacacgtt

SEQ ID NO: 62527 - DNA, 20 bp, Artificial Sequence
  Description of Artificial Sequence: Synthetic oligonucleotide
  Target: ATXN1; (-) strand; PAM type: NRG; PAM sequence: TGG
tgtttccattctgtacacgt

SEQ ID NO: 62528 - DNA, 20 bp, Artificial Sequence
  Description of Artificial Sequence: Synthetic oligonucleotide
  Target: ATXN1; (-) strand; PAM type: NRG; PAM sequence: AAG
gcagacagtgggagacactg

SEQ ID NO: 62529 - DNA, 20 bp, Artificial Sequence
  Description of Artificial Sequence: Synthetic oligonucleotide
  Target: ATXN1; (-) strand; PAM type: NRG; PAM sequence: GAG
tcattgaaagcagacagtgg

SEQ ID NO: 62530 - DNA, 20 bp, Artificial Sequence
  Description of Artificial Sequence: Synthetic oligonucleotide
  Target: ATXN1; (-) strand; PAM type: NRG; PAM sequence: GGG
cttcattgaaagcagacagt

SEQ ID NO: 62531 - DNA, 20 bp, Artificial Sequence
  Description of Artificial Sequence: Synthetic oligonucleotide
  Target: ATXN1; (-) strand; PAM type: NRG; PAM sequence: TGG
gcttcattgaaagcagacag

SEQ ID NO: 62532 - DNA, 20 bp, Artificial Sequence
  Description of Artificial Sequence: Synthetic oligonucleotide
  Target: ATXN1; (-) strand; PAM type: NRG; PAM sequence: CAG
agtgcttcattgaaagcaga

SEQ ID NO: 62533 - DNA, 20 bp, Artificial Sequence
  Description of Artificial Sequence: Synthetic oligonucleotide
  Target: ATXN1; (-) strand; PAM type: NRG; PAM sequence: CAG
tcccagtgcttcattgaaag

SEQ ID NO: 62534 - DNA, 20 bp, Artificial Sequence
  Description of Artificial Sequence: Synthetic oligonucleotide
  Target: ATXN1; (-) strand; PAM type: NRG; PAM sequence: AAG
ttttcccagtgcttcattga

SEQ ID NO: 62535 - DNA, 20 bp, Artificial Sequence
  Description of Artificial Sequence: Synthetic oligonucleotide
  Target: ATXN1; (-) strand; PAM type: NRG; PAM sequence: CAG
ttattaaattcaaattttcc

SEQ ID NO: 62536 - DNA, 20 bp, Artificial Sequence
  Description of Artificial Sequence: Synthetic oligonucleotide
  Target: ATXN1; (-) strand; PAM type: NRG; PAM sequence: GAG
ataatcagtaatattaatat

SEQ ID NO: 62537 - DNA, 20 bp, Artificial Sequence
  Description of Artificial Sequence: Synthetic oligonucleotide
  Target: ATXN1; (-) strand; PAM type: NRG; PAM sequence: CAG
tctcctcagggttaaataat

SEQ ID NO: 62538 - DNA, 20 bp, Artificial Sequence
  Description of Artificial Sequence: Synthetic oligonucleotide
  Target: ATXN1; (-) strand; PAM type: NRG; PAM sequence: GGG
gtatccatatcatctcctca

SEQ ID NO: 62539 - DNA, 20 bp, Artificial Sequence
  Description of Artificial Sequence: Synthetic oligonucleotide
  Target: ATXN1; (-) strand; PAM type: NRG; PAM sequence: AGG
tgtatccatatcatctcctc

SEQ ID NO: 62540 - DNA, 20 bp, Artificial Sequence
  Description of Artificial Sequence: Synthetic oligonucleotide
  Target: ATXN1; (-) strand; PAM type: NRG; PAM sequence: CAG
atgtatccatatcatctcct

SEQ ID NO: 62541 - DNA, 20 bp, Artificial Sequence
  Description of Artificial Sequence: Synthetic oligonucleotide
  Target: ATXN1; (-) strand; PAM type: NRG; PAM sequence: TAG
tcctaatttttttggtttca

SEQ ID NO: 62542 - DNA, 20 bp, Artificial Sequence
  Description of Artificial Sequence: Synthetic oligonucleotide
  Target: ATXN1; (-) strand; PAM type: NRG; PAM sequence: TGG
aaaaatgttcctaatttttt

SEQ ID NO: 62543 - DNA, 20 bp, Artificial Sequence
  Description of Artificial Sequence: Synthetic oligonucleotide
  Target: ATXN1; (-) strand; PAM type: NRG; PAM sequence: AGG
cagggagaaaagtattgaca

SEQ ID NO: 62544 - DNA, 20 bp, Artificial Sequence
  Description of Artificial Sequence: Synthetic oligonucleotide
  Target: ATXN1; (-) strand; PAM type: NRG; PAM sequence: AAG
tcagggagaaaagtattgac

SEQ ID NO: 62545 - DNA, 20 bp, Artificial Sequence
  Description of Artificial Sequence: Synthetic oligonucleotide
  Target: ATXN1; (-) strand; PAM type: NRG; PAM sequence: AAG
gtagcatatatcagggagaa

SEQ ID NO: 62546 - DNA, 20 bp, Artificial Sequence
  Description of Artificial Sequence: Synthetic oligonucleotide
  Target: ATXN1; (-) strand; PAM type: NRG; PAM sequence: GAG
aaagtgtagcatatatcagg

SEQ ID NO: 62547 - DNA, 20 bp, Artificial Sequence
  Description of Artificial Sequence: Synthetic oligonucleotide
  Target: ATXN1; (-) strand; PAM type: NRG; PAM sequence: GGG
gcaaagtgtagcatatatca

SEQ ID NO: 62548 - DNA, 20 bp, Artificial Sequence
  Description of Artificial Sequence: Synthetic oligonucleotide
  Target: ATXN1; (-) strand; PAM type: NRG; PAM sequence: AGG
agcaaagtgtagcatatatc

SEQ ID NO: 62549 - DNA, 20 bp, Artificial Sequence
  Description of Artificial Sequence: Synthetic oligonucleotide
  Target: ATXN1; (-) strand; PAM type: NRG; PAM sequence: CAG
gagcaaagtgtagcatatat

SEQ ID NO: 62550 - DNA, 20 bp, Artificial Sequence
  Description of Artificial Sequence: Synthetic oligonucleotide
  Target: ATXN1; (-) strand; PAM type: NRG; PAM sequence: TAG
gatttgtaaagagcaaagtg

SEQ ID NO: 62551 - DNA, 20 bp, Artificial Sequence
  Description of Artificial Sequence: Synthetic oligonucleotide
  Target: ATXN1; (-) strand; PAM type: NRG; PAM sequence: AAG
tacaagatttgtaaagagca

SEQ ID NO: 62552 - DNA, 20 bp, Artificial Sequence
  Description of Artificial Sequence: Synthetic oligonucleotide
  Target: ATXN1; (-) strand; PAM type: NRG; PAM sequence: GAG
ttgcctacaagatttgtaaa

SEQ ID NO: 62553 - DNA, 20 bp, Artificial Sequence
  Description of Artificial Sequence: Synthetic oligonucleotide
  Target: ATXN1; (-) strand; PAM type: NRG; PAM sequence: AAG
agttgcctacaagatttgta

SEQ ID NO: 62554 - DNA, 20 bp, Artificial Sequence
  Description of Artificial Sequence: Synthetic oligonucleotide
  Target: ATXN1; (-) strand; PAM type: NRG; PAM sequence: AAG
ttttttttgcagttgcctac

SEQ ID NO: 62555 - DNA, 20 bp, Artificial Sequence
  Description of Artificial Sequence: Synthetic oligonucleotide
  Target: ATXN1; (-) strand; PAM type: NRG; PAM sequence: CAG
tgtattacctattttttttg

SEQ ID NO: 62556 - DNA, 20 bp, Artificial Sequence
  Description of Artificial Sequence: Synthetic oligonucleotide
  Target: ATXN1; (-) strand; PAM type: NRG; PAM sequence: CAG
ttccagcttcttaactcagc

SEQ ID NO: 62557 - DNA, 20 bp, Artificial Sequence
  Description of Artificial Sequence: Synthetic oligonucleotide
  Target: ATXN1; (-) strand; PAM type: NRG; PAM sequence: CAG
aggtttccagcttcttaact

SEQ ID NO: 62558 - DNA, 20 bp, Artificial Sequence
  Description of Artificial Sequence: Synthetic oligonucleotide
  Target: ATXN1; (-) strand; PAM type: NRG; PAM sequence: CAG
cacatatatatttaggtttc

SEQ ID NO: 62559 - DNA, 20 bp, Artificial Sequence
  Description of Artificial Sequence: Synthetic oligonucleotide
  Target: ATXN1; (-) strand; PAM type: NRG; PAM sequence: AGG
acacacacacatatatattt

SEQ ID NO: 62560 - DNA, 20 bp, Artificial Sequence
  Description of Artificial Sequence: Synthetic oligonucleotide
  Target: ATXN1; (-) strand; PAM type: NRG; PAM sequence: TAG
cacacacacacatatatatt

SEQ ID NO: 62561 - DNA, 20 bp, Artificial Sequence
  Description of Artificial Sequence: Synthetic oligonucleotide
  Target: ATXN1; (-) strand; PAM type: NRG; PAM sequence: AGG
atgacaagccaatttcttct

SEQ ID NO: 62562 - DNA, 20 bp, Artificial Sequence
  Description of Artificial Sequence: Synthetic oligonucleotide
  Target: ATXN1; (-) strand; PAM type: NRG; PAM sequence: TAG
aatgacaagccaatttcttc

SEQ ID NO: 62563 - DNA, 20 bp, Artificial Sequence
  Description of Artificial Sequence: Synthetic oligonucleotide
  Target: ATXN1; (-) strand; PAM type: NRG; PAM sequence: AAG
ttcaaattttaggaaatgac

SEQ ID NO: 62564 - DNA, 20 bp, Artificial Sequence
  Description of Artificial Sequence: Synthetic oligonucleotide
  Target: ATXN1; (-) strand; PAM type: NRG; PAM sequence: AGG
agatattatcttcaaatttt

SEQ ID NO: 62565 - DNA, 20 bp, Artificial Sequence
  Description of Artificial Sequence: Synthetic oligonucleotide
  Target: ATXN1; (-) strand; PAM type: NRG; PAM sequence: TAG
aagatattatcttcaaattt

SEQ ID NO: 62566 - DNA, 20 bp, Artificial Sequence
  Description of Artificial Sequence: Synthetic oligonucleotide
  Target: ATXN1; (-) strand; PAM type: NRG; PAM sequence: AAG
tgaatacctctgaggacgag

SEQ ID NO: 62567 - DNA, 20 bp, Artificial Sequence
  Description of Artificial Sequence: Synthetic oligonucleotide
  Target: ATXN1; (-) strand; PAM type: NRG; PAM sequence: GAG
ctatgaatacctctgaggac

SEQ ID NO: 62568 - DNA, 20 bp, Artificial Sequence
  Description of Artificial Sequence: Synthetic oligonucleotide
  Target: ATXN1; (-) strand; PAM type: NRG; PAM sequence: AGG
atggcctatgaatacctctg

SEQ ID NO: 62569 - DNA, 20 bp, Artificial Sequence
  Description of Artificial Sequence: Synthetic oligonucleotide
  Target: ATXN1; (-) strand; PAM type: NRG; PAM sequence: GAG
gatggcctatgaatacctct

SEQ ID NO: 62570 - DNA, 20 bp, Artificial Sequence
  Description of Artificial Sequence: Synthetic oligonucleotide
  Target: ATXN1; (-) strand; PAM type: NRG; PAM sequence: TGG
tagctacatgaaacccagga

SEQ ID NO: 62571 - DNA, 20 bp, Artificial Sequence
  Description of Artificial Sequence: Synthetic oligonucleotide
  Target: ATXN1; (-) strand; PAM type: NRG; PAM sequence: AGG
aaaatagctacatgaaaccc

SEQ ID NO: 62572 - DNA, 20 bp, Artificial Sequence
  Description of Artificial Sequence: Synthetic oligonucleotide
  Target: ATXN1; (-) strand; PAM type: NRG; PAM sequence: CAG
gaaaatagctacatgaaacc

SEQ ID NO: 62573 - DNA, 20 bp, Artificial Sequence
  Description of Artificial Sequence: Synthetic oligonucleotide
  Target: ATXN1; (-) strand; PAM type: NRG; PAM sequence: TAG
attttgaccaggaaagaaaa

SEQ ID NO: 62574 - DNA, 20 bp, Artificial Sequence
  Description of Artificial Sequence: Synthetic oligonucleotide
  Target: ATXN1; (-) strand; PAM type: NRG; PAM sequence: AAG
ttaggagattttgaccagga

SEQ ID NO: 62575 - DNA, 20 bp, Artificial Sequence
  Description of Artificial Sequence: Synthetic oligonucleotide
  Target: ATXN1; (-) strand; PAM type: NRG; PAM sequence: AGG
acagttaggagattttgacc

SEQ ID NO: 62576 - DNA, 20 bp, Artificial Sequence
  Description of Artificial Sequence: Synthetic oligonucleotide
  Target: ATXN1; (-) strand; PAM type: NRG; PAM sequence: CAG
cacagttaggagattttgac

SEQ ID NO: 62577 - DNA, 20 bp, Artificial Sequence
  Description of Artificial Sequence: Synthetic oligonucleotide
  Target: ATXN1; (-) strand; PAM type: NRG; PAM sequence: GAG
gtgtcacaaaacacagttag

SEQ ID NO: 62578 - DNA, 20 bp, Artificial Sequence
  Description of Artificial Sequence: Synthetic oligonucleotide
  Target: ATXN1; (-) strand; PAM type: NRG; PAM sequence: AGG
ctgtgtcacaaaacacagtt

SEQ ID NO: 62579 - DNA, 20 bp, Artificial Sequence
  Description of Artificial Sequence: Synthetic oligonucleotide
  Target: ATXN1; (-) strand; PAM type: NRG; PAM sequence: TAG
actgtgtcacaaaacacagt

SEQ ID NO: 62580 - DNA, 20 bp, Artificial Sequence
  Description of Artificial Sequence: Synthetic oligonucleotide
  Target: ATXN1; (-) strand; PAM type: NRG; PAM sequence: CAG
ctggactgtgtcacaaaaca

SEQ ID NO: 62581 - DNA, 20 bp, Artificial Sequence
  Description of Artificial Sequence: Synthetic oligonucleotide
  Target: ATXN1; (-) strand; PAM type: NRG; PAM sequence: TGG
tagagaatttaccttgttgc

SEQ ID NO: 62582 - DNA, 20 bp, Artificial Sequence
  Description of Artificial Sequence: Synthetic oligonucleotide
  Target: ATXN1; (-) strand; PAM type: NRG; PAM sequence: GAG
ctcagccctcctactttcta

SEQ ID NO: 62583 - DNA, 20 bp, Artificial Sequence
  Description of Artificial Sequence: Synthetic oligonucleotide
  Target: ATXN1; (-) strand; PAM type: NRG; PAM sequence: TAG
tgctcagccctcctactttc

SEQ ID NO: 62584 - DNA, 20 bp, Artificial Sequence
  Description of Artificial Sequence: Synthetic oligonucleotide
  Target: ATXN1; (-) strand; PAM type: NRG; PAM sequence: CAG
ggaaataatgcaaaggtgct

SEQ ID NO: 62585 - DNA, 20 bp, Artificial Sequence
  Description of Artificial Sequence: Synthetic oligonucleotide
  Target: ATXN1; (-) strand; PAM type: NRG; PAM sequence: AGG
tccactaggaaataatgcaa

SEQ ID NO: 62586 - DNA, 20 bp, Artificial Sequence
  Description of Artificial Sequence: Synthetic oligonucleotide
  Target: ATXN1; (-) strand; PAM type: NRG; PAM sequence: AAG
ttccactaggaaataatgca

SEQ ID NO: 62587 - DNA, 20 bp, Artificial Sequence
  Description of Artificial Sequence: Synthetic oligonucleotide
  Target: ATXN1; (-) strand; PAM type: NRG; PAM sequence: AGG
cttcagggagcccttccact

SEQ ID NO: 62588 - DNA, 20 bp, Artificial Sequence
  Description of Artificial Sequence: Synthetic oligonucleotide
  Target: ATXN1; (-) strand; PAM type: NRG; PAM sequence: TAG
acttcagggagcccttccac

SEQ ID NO: 62589 - DNA, 20 bp, Artificial Sequence
  Description of Artificial Sequence: Synthetic oligonucleotide
  Target: ATXN1; (-) strand; PAM type: NRG; PAM sequence: GAG
tgacatagtgtgacttcagg

SEQ ID NO: 62590 - DNA, 20 bp, Artificial Sequence
  Description of Artificial Sequence: Synthetic oligonucleotide
  Target: ATXN1; (-) strand; PAM type: NRG; PAM sequence: GGG
gatgacatagtgtgacttca

SEQ ID NO: 62591 - DNA, 20 bp, Artificial Sequence
  Description of Artificial Sequence: Synthetic oligonucleotide
  Target: ATXN1; (-) strand; PAM type: NRG; PAM sequence: AGG
agatgacatagtgtgacttc

SEQ ID NO: 62592 - DNA, 20 bp, Artificial Sequence
  Description of Artificial Sequence: Synthetic oligonucleotide
  Target: ATXN1; (-) strand; PAM type: NRG; PAM sequence: CAG
gagatgacatagtgtgactt

SEQ ID NO: 62593 - DNA, 20 bp, Artificial Sequence
  Description of Artificial Sequence: Synthetic oligonucleotide
  Target: ATXN1; (-) strand; PAM type: NRG; PAM sequence: TAG
aggtaatggaagagatgaca

SEQ ID NO: 62594 - DNA, 20 bp, Artificial Sequence
  Description of Artificial Sequence: Synthetic oligonucleotide
  Target: ATXN1; (-) strand; PAM type: NRG; PAM sequence: GAG
tttagtgtcaggtaatggaa

SEQ ID NO: 62595 - DNA, 20 bp, Artificial Sequence
  Description of Artificial Sequence: Synthetic oligonucleotide
  Target: ATXN1; (-) strand; PAM type: NRG; PAM sequence: AAG
gttttagtgtcaggtaatgg

SEQ ID NO: 62596 - DNA, 20 bp, Artificial Sequence
  Description of Artificial Sequence: Synthetic oligonucleotide
  Target: ATXN1; (-) strand; PAM type: NRG; PAM sequence: TGG
gaagttttagtgtcaggtaa

SEQ ID NO: 62597 - DNA, 20 bp, Artificial Sequence
  Description of Artificial Sequence: Synthetic oligonucleotide
  Target: ATXN1; (-) strand; PAM type: NRG; PAM sequence: AGG
gcatgagaagttttagtgtc

SEQ ID NO: 62598 - DNA, 20 bp, Artificial Sequence
  Description of Artificial Sequence: Synthetic oligonucleotide
  Target: ATXN1; (-) strand; PAM type: NRG; PAM sequence: CAG
tgcatgagaagttttagtgt

SEQ ID NO: 62599 - DNA, 20 bp, Artificial Sequence
  Description of Artificial Sequence: Synthetic oligonucleotide
  Target: ATXN1; (-) strand; PAM type: NRG; PAM sequence: TAG
ccgccttgcatgagaagttt

SEQ ID NO: 62600 - DNA, 20 bp, Artificial Sequence
  Description of Artificial Sequence: Synthetic oligonucleotide
  Target: ATXN1; (-) strand; PAM type: NRG; PAM sequence: AAG
tgatggccgccttgcatgag

SEQ ID NO: 62601 - DNA, 20 bp, Artificial Sequence
  Description of Artificial Sequence: Synthetic oligonucleotide
  Target: ATXN1; (-) strand; PAM type: NRG; PAM sequence: GAG
acctgatggccgccttgcat

SEQ ID NO: 62602 - DNA, 20 bp, Artificial Sequence
  Description of Artificial Sequence: Synthetic oligonucleotide
  Target: ATXN1; (-) strand; PAM type: NRG; PAM sequence: TGG
tgttcccacatgtcacctga

SEQ ID NO: 62603 - DNA, 20 bp, Artificial Sequence
  Description of Artificial Sequence: Synthetic oligonucleotide
  Target: ATXN1; (-) strand; PAM type: NRG; PAM sequence: AAG
ttgggattttgagattagta

SEQ ID NO: 62604 - DNA, 20 bp, Artificial Sequence
  Description of Artificial Sequence: Synthetic oligonucleotide
  Target: ATXN1; (-) strand; PAM type: NRG; PAM sequence: TAG
ctggcttgggattttgagat

SEQ ID NO: 62605 - DNA, 20 bp, Artificial Sequence
  Description of Artificial Sequence: Synthetic oligonucleotide
  Target: ATXN1; (-) strand; PAM type: NRG; PAM sequence: GAG
agttactggcttgggatttt

SEQ ID NO: 62606 - DNA, 20 bp, Artificial Sequence
  Description of Artificial Sequence: Synthetic oligonucleotide
  Target: ATXN1; (-) strand; PAM type: NRG; PAM sequence: GGG
ttttgatcagttactggctt

SEQ ID NO: 62607 - DNA, 20 bp, Artificial Sequence
  Description of Artificial Sequence: Synthetic oligonucleotide
  Target: ATXN1; (-) strand; PAM type: NRG; PAM sequence: TGG
gttttgatcagttactggct

SEQ ID NO: 62608 - DNA, 20 bp, Artificial Sequence
  Description of Artificial Sequence: Synthetic oligonucleotide
  Target: ATXN1; (-) strand; PAM type: NRG; PAM sequence: TGG
tactggttttgatcagttac

SEQ ID NO: 62609 - DNA, 20 bp, Artificial Sequence
  Description of Artificial Sequence: Synthetic oligonucleotide
  Target: ATXN1; (-) strand; PAM type: NRG; PAM sequence: CAG
gctgatttactggttttgat

SEQ ID NO: 62610 - DNA, 20 bp, Artificial Sequence
  Description of Artificial Sequence: Synthetic oligonucleotide
  Target: ATXN1; (-) strand; PAM type: NRG; PAM sequence: TGG
cttaaaatgagctgatttac

SEQ ID NO: 62611 - DNA, 20 bp, Artificial Sequence
  Description of Artificial Sequence: Synthetic oligonucleotide
  Target: ATXN1; (-) strand; PAM type: NRG; PAM sequence: GAG
gtgcttcccttacttaaaat

SEQ ID NO: 62612 - DNA, 20 bp, Artificial Sequence
  Description of Artificial Sequence: Synthetic oligonucleotide
  Target: ATXN1; (-) strand; PAM type: NRG; PAM sequence: TGG
aagttacaagcagttatgtt

SEQ ID NO: 62613 - DNA, 20 bp, Artificial Sequence
  Description of Artificial Sequence: Synthetic oligonucleotide
  Target: ATXN1; (-) strand; PAM type: NRG; PAM sequence: CAG
tgaggtatgcaagttacaag

SEQ ID NO: 62614 - DNA, 20 bp, Artificial Sequence
  Description of Artificial Sequence: Synthetic oligonucleotide
  Target: ATXN1; (-) strand; PAM type: NRG; PAM sequence: AAG
tcttgaggtatgcaagttac

SEQ ID NO: 62615 - DNA, 20 bp, Artificial Sequence
  Description of Artificial Sequence: Synthetic oligonucleotide
  Target: ATXN1; (-) strand; PAM type: NRG; PAM sequence: AAG
tgtaaaatcttgaggtatgc

SEQ ID NO: 62616 - DNA, 20 bp, Artificial Sequence
  Description of Artificial Sequence: Synthetic oligonucleotide
  Target: ATXN1; (-) strand; PAM type: NRG; PAM sequence: AGG
ctctggcttgtaaaatcttg

SEQ ID NO: 62617 - DNA, 20 bp, Artificial Sequence
  Description of Artificial Sequence: Synthetic oligonucleotide
  Target: ATXN1; (-) strand; PAM type: NRG; PAM sequence: GAG
tctctggcttgtaaaatctt

SEQ ID NO: 62618 - DNA, 20 bp, Artificial Sequence
  Description of Artificial Sequence: Synthetic oligonucleotide
  Target: ATXN1; (-) strand; PAM type: NRG; PAM sequence: TGG
gaaaatgacatttttctctc

SEQ ID NO: 62619 - DNA, 20 bp, Artificial Sequence
  Description of Artificial Sequence: Synthetic oligonucleotide
  Target: ATXN1; (-) strand; PAM type: NRG; PAM sequence: CAG
caattattcttctgtatgtg

SEQ ID NO: 62620 - DNA, 20 bp, Artificial Sequence
  Description of Artificial Sequence: Synthetic oligonucleotide
  Target: ATXN1; (-) strand; PAM type: NRG; PAM sequence: CAG
tagcaatcagagtttccatc

SEQ ID NO: 62621 - DNA, 20 bp, Artificial Sequence
  Description of Artificial Sequence: Synthetic oligonucleotide
  Target: ATXN1; (-) strand; PAM type: NRG; PAM sequence: GAG
aggctaaggattagcaatca

SEQ ID NO: 62622 - DNA, 20 bp, Artificial Sequence
  Description of Artificial Sequence: Synthetic oligonucleotide
  Target: ATXN1; (-) strand; PAM type: NRG; PAM sequence: CAG
ccaggctaaggattagcaat

SEQ ID NO: 62623 - DNA, 20 bp, Artificial Sequence
  Description of Artificial Sequence: Synthetic oligonucleotide
  Target: ATXN1; (-) strand; PAM type: NRG; PAM sequence: TAG
aaattctccaggctaaggat

SEQ ID NO: 62624 - DNA, 20 bp, Artificial Sequence
  Description of Artificial Sequence: Synthetic oligonucleotide
  Target: ATXN1; (-) strand; PAM type: NRG; PAM sequence: AGG
gggtaaaattctccaggcta

SEQ ID NO: 62625 - DNA, 20 bp, Artificial Sequence
  Description of Artificial Sequence: Synthetic oligonucleotide
  Target: ATXN1; (-) strand; PAM type: NRG; PAM sequence: AAG
ggggtaaaattctccaggct

SEQ ID NO: 62626 - DNA, 20 bp, Artificial Sequence
  Description of Artificial Sequence: Synthetic oligonucleotide
  Target: ATXN1; (-) strand; PAM type: NRG; PAM sequence: AGG
agtagggggtaaaattctcc

SEQ ID NO: 62627 - DNA, 20 bp, Artificial Sequence
  Description of Artificial Sequence: Synthetic oligonucleotide
  Target: ATXN1; (-) strand; PAM type: NRG; PAM sequence: CAG
gagtagggggtaaaattctc

SEQ ID NO: 62628 - DNA, 20 bp, Artificial Sequence
  Description of Artificial Sequence: Synthetic oligonucleotide
  Target: ATXN1; (-) strand; PAM type: NRG; PAM sequence: GGG
cttttaggttggtgagtagg

SEQ ID NO: 62629 - DNA, 20 bp, Artificial Sequence
  Description of Artificial Sequence: Synthetic oligonucleotide
  Target: ATXN1; (-) strand; PAM type: NRG; PAM sequence: GGG
tcttttaggttggtgagtag

SEQ ID NO: 62630 - DNA, 20 bp, Artificial Sequence
  Description of Artificial Sequence: Synthetic oligonucleotide
  Target: ATXN1; (-) strand; PAM type: NRG; PAM sequence: GGG
ttcttttaggttggtgagta

SEQ ID NO: 62631 - DNA, 20 bp, Artificial Sequence
  Description of Artificial Sequence: Synthetic oligonucleotide
  Target: ATXN1; (-) strand; PAM type: NRG; PAM sequence: AGG
gttcttttaggttggtgagt

SEQ ID NO: 62632 - DNA, 20 bp, Artificial Sequence
  Description of Artificial Sequence: Synthetic oligonucleotide
  Target: ATXN1; (-) strand; PAM type: NRG; PAM sequence: TAG
agttcttttaggttggtgag

SEQ ID NO: 62633 - DNA, 20 bp, Artificial Sequence
  Description of Artificial Sequence: Synthetic oligonucleotide
  Target: ATXN1; (-) strand; PAM type: NRG; PAM sequence: GAG
tgcagttcttttaggttggt

SEQ ID NO: 62634 - DNA, 20 bp, Artificial Sequence
  Description of Artificial Sequence: Synthetic oligonucleotide
  Target: ATXN1; (-) strand; PAM type: NRG; PAM sequence: TGG
ctgttgcagttcttttaggt

SEQ ID NO: 62635 - DNA, 20 bp, Artificial Sequence
  Description of Artificial Sequence: Synthetic oligonucleotide
  Target: ATXN1; (-) strand; PAM type: NRG; PAM sequence: AGG
tgggctgttgcagttctttt

SEQ ID NO: 62636 - DNA, 20 bp, Artificial Sequence
  Description of Artificial Sequence: Synthetic oligonucleotide
  Target: ATXN1; (-) strand; PAM type: NRG; PAM sequence: TAG
ctgggctgttgcagttcttt

SEQ ID NO: 62637 - DNA, 20 bp, Artificial Sequence
  Description of Artificial Sequence: Synthetic oligonucleotide
  Target: ATXN1; (-) strand; PAM type: NRG; PAM sequence: CAG
ccctttaaactgggctgttg

SEQ ID NO: 62638 - DNA, 20 bp, Artificial Sequence
  Description of Artificial Sequence: Synthetic oligonucleotide
  Target: ATXN1; (-) strand; PAM type: NRG; PAM sequence: GGG
tagagcagcccctttaaact

SEQ ID NO: 62639 - DNA, 20 bp, Artificial Sequence
  Description of Artificial Sequence: Synthetic oligonucleotide
  Target: ATXN1; (-) strand; PAM type: NRG; PAM sequence: TGG
ttagagcagcccctttaaac

SEQ ID NO: 62640 - DNA, 20 bp, Artificial Sequence
  Description of Artificial Sequence: Synthetic oligonucleotide
  Target: ATXN1; (-) strand; PAM type: NRG; PAM sequence: CAG
aaatagtatcagatttagag

SEQ ID NO: 62641 - DNA, 20 bp, Artificial Sequence
  Description of Artificial Sequence: Synthetic oligonucleotide
  Target: ATXN1; (-) strand; PAM type: NRG; PAM sequence: GAG
gtcaaatagtatcagattta

SEQ ID NO: 62642 - DNA, 20 bp, Artificial Sequence
  Description of Artificial Sequence: Synthetic oligonucleotide
  Target: ATXN1; (-) strand; PAM type: NRG; PAM sequence: TAG
cagtcaaatagtatcagatt

SEQ ID NO: 62643 - DNA, 20 bp, Artificial Sequence
  Description of Artificial Sequence: Synthetic oligonucleotide
  Target: ATXN1; (-) strand; PAM type: NRG; PAM sequence: CAG
ctggtacagtcaaatagtat

SEQ ID NO: 62644 - DNA, 20 bp, Artificial Sequence
  Description of Artificial Sequence: Synthetic oligonucleotide
  Target: ATXN1; (-) strand; PAM type: NRG; PAM sequence: TAG
tttctactggtacagtcaaa

SEQ ID NO: 62645 - DNA, 20 bp, Artificial Sequence
  Description of Artificial Sequence: Synthetic oligonucleotide
  Target: ATXN1; (-) strand; PAM type: NRG; PAM sequence: CAG
gaacaccttttctactggta

SEQ ID NO: 62646 - DNA, 20 bp, Artificial Sequence
  Description of Artificial Sequence: Synthetic oligonucleotide
  Target: ATXN1; (-) strand; PAM type: NRG; PAM sequence: TGG
tgtaggaacaccttttctac

SEQ ID NO: 62647 - DNA, 20 bp, Artificial Sequence
  Description of Artificial Sequence: Synthetic oligonucleotide
  Target: ATXN1; (-) strand; PAM type: NRG; PAM sequence: AGG
tacagtgattctttcattgt

SEQ ID NO: 62648 - DNA, 20 bp, Artificial Sequence
  Description of Artificial Sequence: Synthetic oligonucleotide
  Target: ATXN1; (-) strand; PAM type: NRG; PAM sequence: TAG
atacagtgattctttcattg

SEQ ID NO: 62649 - DNA, 20 bp, Artificial Sequence
  Description of Artificial Sequence: Synthetic oligonucleotide
  Target: ATXN1; (-) strand; PAM type: NRG; PAM sequence: CAG
aggaataaaaggatggaata

SEQ ID NO: 62650 - DNA, 20 bp, Artificial Sequence
  Description of Artificial Sequence: Synthetic oligonucleotide
  Target: ATXN1; (-) strand; PAM type: NRG; PAM sequence: TGG
ctacttcaggaataaaagga

SEQ ID NO: 62651 - DNA, 20 bp, Artificial Sequence
  Description of Artificial Sequence: Synthetic oligonucleotide
  Target: ATXN1; (-) strand; PAM type: NRG; PAM sequence: AGG
ctatctacttcaggaataaa

SEQ ID NO: 62652 - DNA, 20 bp, Artificial Sequence
  Description of Artificial Sequence: Synthetic oligonucleotide
  Target: ATXN1; (-) strand; PAM type: NRG; PAM sequence: AAG
actatctacttcaggaataa

SEQ ID NO: 62653 - DNA, 20 bp, Artificial Sequence
  Description of Artificial Sequence: Synthetic oligonucleotide
  Target: ATXN1; (-) strand; PAM type: NRG; PAM sequence: AGG
tgctgcaaactatctacttc

SEQ ID NO: 62654 - DNA, 20 bp, Artificial Sequence
  Description of Artificial Sequence: Synthetic oligonucleotide
  Target: ATXN1; (-) strand; PAM type: NRG; PAM sequence: CAG
atgctgcaaactatctactt

SEQ ID NO: 62655 - DNA, 20 bp, Artificial Sequence
  Description of Artificial Sequence: Synthetic oligonucleotide
  Target: ATXN1; (-) strand; PAM type: NRG; PAM sequence: TGG
tgcctttctctcggcttcta

SEQ ID NO: 62656 - DNA, 20 bp, Artificial Sequence
  Description of Artificial Sequence: Synthetic oligonucleotide
  Target: ATXN1; (-) strand; PAM type: NRG; PAM sequence: CGG
gctggaacttgcctttctct

SEQ ID NO: 62657 - DNA, 20 bp, Artificial Sequence
  Description of Artificial Sequence: Synthetic oligonucleotide
  Target: ATXN1; (-) strand; PAM type: NRG; PAM sequence: TGG
gaggtcctgtttgtatttgc

SEQ ID NO: 62658 - DNA, 20 bp, Artificial Sequence
  Description of Artificial Sequence: Synthetic oligonucleotide
  Target: ATXN1; (-) strand; PAM type: NRG; PAM sequence: AGG
atttaattttttaagggaag

SEQ ID NO: 62659 - DNA, 20 bp, Artificial Sequence
  Description of Artificial Sequence: Synthetic oligonucleotide
  Target: ATXN1; (-) strand; PAM type: NRG; PAM sequence: GAG
aatttaattttttaagggaa

SEQ ID NO: 62660 - DNA, 20 bp, Artificial Sequence
  Description of Artificial Sequence: Synthetic oligonucleotide
  Target: ATXN1; (-) strand; PAM type: NRG; PAM sequence: AAG
ggaatttaattttttaaggg

SEQ ID NO: 62661 - DNA, 20 bp, Artificial Sequence
  Description of Artificial Sequence: Synthetic oligonucleotide
  Target: ATXN1; (-) strand; PAM type: NRG; PAM sequence: GGG
aagggaatttaattttttaa

SEQ ID NO: 62662 - DNA, 20 bp, Artificial Sequence
  Description of Artificial Sequence: Synthetic oligonucleotide
  Target: ATXN1; (-) strand; PAM type: NRG; PAM sequence: AGG
gaagggaatttaatttttta

SEQ ID NO: 62663 - DNA, 20 bp, Artificial Sequence
  Description of Artificial Sequence: Synthetic oligonucleotide
  Target: ATXN1; (-) strand; PAM type: NRG; PAM sequence: AAG
ggaagggaatttaatttttt

SEQ ID NO: 62664 - DNA, 20 bp, Artificial Sequence
  Description of Artificial Sequence: Synthetic oligonucleotide
  Target: ATXN1; (-) strand; PAM type: NRG; PAM sequence: GGG
atttctttttttaattggaa

SEQ ID NO: 62665 - DNA, 20 bp, Artificial Sequence
  Description of Artificial Sequence: Synthetic oligonucleotide
  Target: ATXN1; (-) strand; PAM type: NRG; PAM sequence: AGG
aatttctttttttaattgga

SEQ ID NO: 62666 - DNA, 20 bp, Artificial Sequence
  Description of Artificial Sequence: Synthetic oligonucleotide
  Target: ATXN1; (-) strand; PAM type: NRG; PAM sequence: AAG
taatttctttttttaattgg

SEQ ID NO: 62667 - DNA, 20 bp, Artificial Sequence
  Description of Artificial Sequence: Synthetic oligonucleotide
  Target: ATXN1; (-) strand; PAM type: NRG; PAM sequence: TGG
aattaatttctttttttaat

SEQ ID NO: 62668 - DNA, 20 bp, Artificial Sequence
  Description of Artificial Sequence: Synthetic oligonucleotide
  Target: ATXN1; (-) strand; PAM type: NRG; PAM sequence: AGG
ggggtattagcatgagctct

SEQ ID NO: 62669 - DNA, 20 bp, Artificial Sequence
  Description of Artificial Sequence: Synthetic oligonucleotide
  Target: ATXN1; (-) strand; PAM type: NRG; PAM sequence: TAG
aggggtattagcatgagctc

SEQ ID NO: 62670 - DNA, 20 bp, Artificial Sequence
  Description of Artificial Sequence: Synthetic oligonucleotide
  Target: ATXN1; (-) strand; PAM type: NRG; PAM sequence: GAG
tgttgaaggggtattagcat

SEQ ID NO: 62671 - DNA, 20 bp, Artificial Sequence
  Description of Artificial Sequence: Synthetic oligonucleotide
  Target: ATXN1; (-) strand; PAM type: NRG; PAM sequence: TAG
gccaggtgttgaaggggtat

SEQ ID NO: 62672 - DNA, 20 bp, Artificial Sequence
  Description of Artificial Sequence: Synthetic oligonucleotide
  Target: ATXN1; (-) strand; PAM type: NRG; PAM sequence: GGG
aaccgagccaggtgttgaag

SEQ ID NO: 62673 - DNA, 20 bp, Artificial Sequence
  Description of Artificial Sequence: Synthetic oligonucleotide
  Target: ATXN1; (-) strand; PAM type: NRG; PAM sequence: GGG
taaccgagccaggtgttgaa

SEQ ID NO: 62674 - DNA, 20 bp, Artificial Sequence
  Description of Artificial Sequence: Synthetic oligonucleotide
  Target: ATXN1; (-) strand; PAM type: NRG; PAM sequence: AGG
gtaaccgagccaggtgttga

SEQ ID NO: 62675 - DNA, 20 bp, Artificial Sequence
  Description of Artificial Sequence: Synthetic oligonucleotide
  Target: ATXN1; (-) strand; PAM type: NRG; PAM sequence: AAG
tgtaaccgagccaggtgttg

SEQ ID NO: 62676 - DNA, 20 bp, Artificial Sequence
  Description of Artificial Sequence: Synthetic oligonucleotide
  Target: ATXN1; (-) strand; PAM type: NRG; PAM sequence: AGG
tcacttgatgtaaccgagcc

SEQ ID NO: 62677 - DNA, 20 bp, Artificial Sequence
  Description of Artificial Sequence: Synthetic oligonucleotide
  Target: ATXN1; (-) strand; PAM type: NRG; PAM sequence: CAG
atcacttgatgtaaccgagc

SEQ ID NO: 62678 - DNA, 20 bp, Artificial Sequence
  Description of Artificial Sequence: Synthetic oligonucleotide
  Target: ATXN1; (-) strand; PAM type: NRG; PAM sequence: GAG
atgaatcacttgatgtaacc

SEQ ID NO: 62679 - DNA, 20 bp, Artificial Sequence
  Description of Artificial Sequence: Synthetic oligonucleotide
  Target: ATXN1; (-) strand; PAM type: NRG; PAM sequence: AGG
tgtgtagtggcttgccttgt

SEQ ID NO: 62680 - DNA, 20 bp, Artificial Sequence
  Description of Artificial Sequence: Synthetic oligonucleotide
  Target: ATXN1; (-) strand; PAM type: NRG; PAM sequence: TAG
atgtgtagtggcttgccttg

SEQ ID NO: 62681 - DNA, 20 bp, Artificial Sequence
  Description of Artificial Sequence: Synthetic oligonucleotide
  Target: ATXN1; (-) strand; PAM type: NRG; PAM sequence: TGG
accaagaacaatatgtgtag

SEQ ID NO: 62682 - DNA, 20 bp, Artificial Sequence
  Description of Artificial Sequence: Synthetic oligonucleotide
  Target: ATXN1; (-) strand; PAM type: NRG; PAM sequence: TAG
acaaccaagaacaatatgtg

SEQ ID NO: 62683 - DNA, 20 bp, Artificial Sequence
  Description of Artificial Sequence: Synthetic oligonucleotide
  Target: ATXN1; (-) strand; PAM type: NRG; PAM sequence: AAG
aatgttgtaagttaacaacc

SEQ ID NO: 62684 - DNA, 20 bp, Artificial Sequence
  Description of Artificial Sequence: Synthetic oligonucleotide
  Target: ATXN1; (-) strand; PAM type: NRG; PAM sequence: AAG
cagtacgcagtgaatgttgt

SEQ ID NO: 62685 - DNA, 20 bp, Artificial Sequence
  Description of Artificial Sequence: Synthetic oligonucleotide
  Target: ATXN1; (-) strand; PAM type: NRG; PAM sequence: CAG
ggctacctgtgaacagtacg

SEQ ID NO: 62686 - DNA, 20 bp, Artificial Sequence
  Description of Artificial Sequence: Synthetic oligonucleotide
  Target: ATXN1; (-) strand; PAM type: NRG; PAM sequence: CAG
aggctgaggctacctgtgaa

SEQ ID NO: 62687 - DNA, 20 bp, Artificial Sequence
  Description of Artificial Sequence: Synthetic oligonucleotide
  Target: ATXN1; (-) strand; PAM type: NRG; PAM sequence: AGG
ccatggtgaagtataggctg

SEQ ID NO: 62688 - DNA, 20 bp, Artificial Sequence
  Description of Artificial Sequence: Synthetic oligonucleotide
  Target: ATXN1; (-) strand; PAM type: NRG; PAM sequence: GAG
tccatggtgaagtataggct

SEQ ID NO: 62689 - DNA, 20 bp, Artificial Sequence
  Description of Artificial Sequence: Synthetic oligonucleotide
  Target: ATXN1; (-) strand; PAM type: NRG; PAM sequence: AGG
aagtctccatggtgaagtat

SEQ ID NO: 62690 - DNA, 20 bp, Artificial Sequence
  Description of Artificial Sequence: Synthetic oligonucleotide
  Target: ATXN1; (-) strand; PAM type: NRG; PAM sequence: TAG
gaagtctccatggtgaagta

SEQ ID NO: 62691 - DNA, 20 bp, Artificial Sequence
  Description of Artificial Sequence: Synthetic oligonucleotide
  Target: ATXN1; (-) strand; PAM type: NRG; PAM sequence: AAG
tgtgggaagtctccatggtg

SEQ ID NO: 62692 - DNA, 20 bp, Artificial Sequence
  Description of Artificial Sequence: Synthetic oligonucleotide
  Target: ATXN1; (-) strand; PAM type: NRG; PAM sequence: TGG
gagcctgtgggaagtctcca

SEQ ID NO: 62693 - DNA, 20 bp, Artificial Sequence
  Description of Artificial Sequence: Synthetic oligonucleotide
  Target: ATXN1; (-) strand; PAM type: NRG; PAM sequence: AAG
agccctccagagcctgtggg

SEQ ID NO: 62694 - DNA, 20 bp, Artificial Sequence
  Description of Artificial Sequence: Synthetic oligonucleotide
  Target: ATXN1; (-) strand; PAM type: NRG; PAM sequence: GGG
aggagccctccagagcctgt

SEQ ID NO: 62695 - DNA, 20 bp, Artificial Sequence
  Description of Artificial Sequence: Synthetic oligonucleotide
  Target: ATXN1; (-) strand; PAM type: NRG; PAM sequence: TGG
caggagccctccagagcctg

SEQ ID NO: 62696 - DNA, 20 bp, Artificial Sequence
  Description of Artificial Sequence: Synthetic oligonucleotide
  Target: ATXN1; (-) strand; PAM type: NRG; PAM sequence: GAG
gagccctcaggagccctcca

SEQ ID NO: 62697 - DNA, 20 bp, Artificial Sequence
  Description of Artificial Sequence: Synthetic oligonucleotide
  Target: ATXN1; (-) strand; PAM type: NRG; PAM sequence: CAG
aagagccctcaggagccctc

SEQ ID NO: 62698 - DNA, 20 bp, Artificial Sequence
  Description of Artificial Sequence: Synthetic oligonucleotide
  Target: ATXN1; (-) strand; PAM type: NRG; PAM sequence: GAG
ctgagcccaagagccctcag

SEQ ID NO: 62699 - DNA, 20 bp, Artificial Sequence
  Description of Artificial Sequence: Synthetic oligonucleotide
  Target: ATXN1; (-) strand; PAM type: NRG; PAM sequence: AGG
gcctgagcccaagagccctc

SEQ ID NO: 62700 - DNA, 20 bp, Artificial Sequence
  Description of Artificial Sequence: Synthetic oligonucleotide
  Target: ATXN1; (-) strand; PAM type: NRG; PAM sequence: CAG
cgcctgagcccaagagccct

SEQ ID NO: 62701 - DNA, 20 bp, Artificial Sequence
  Description of Artificial Sequence: Synthetic oligonucleotide
  Target: ATXN1; (-) strand; PAM type: NRG; PAM sequence: GAG
aagaacacgcctgagcccaa

SEQ ID NO: 62702 - DNA, 20 bp, Artificial Sequence
  Description of Artificial Sequence: Synthetic oligonucleotide
  Target: ATXN1; (-) strand; PAM type: NRG; PAM sequence: AAG
gaaagaacacgcctgagccc

SEQ ID NO: 62703 - DNA, 20 bp, Artificial Sequence
  Description of Artificial Sequence: Synthetic oligonucleotide
  Target: ATXN1; (-) strand; PAM type: NRG; PAM sequence: GAG
aaggaagaaagaacacgcct

SEQ ID NO: 62704 - DNA, 20 bp, Artificial Sequence
  Description of Artificial Sequence: Synthetic oligonucleotide
  Target: ATXN1; (-) strand; PAM type: NRG; PAM sequence: AAG
acttctctgtgaaaggaaga

SEQ ID NO: 62705 - DNA, 20 bp, Artificial Sequence
  Description of Artificial Sequence: Synthetic oligonucleotide
  Target: ATXN1; (-) strand; PAM type: NRG; PAM sequence: AAG
tctcacttctctgtgaaagg

SEQ ID NO: 62706 - DNA, 20 bp, Artificial Sequence
  Description of Artificial Sequence: Synthetic oligonucleotide
  Target: ATXN1; (-) strand; PAM type: NRG; PAM sequence: AGG
atttctcacttctctgtgaa

SEQ ID NO: 62707 - DNA, 20 bp, Artificial Sequence
  Description of Artificial Sequence: Synthetic oligonucleotide
  Target: ATXN1; (-) strand; PAM type: NRG; PAM sequence: AAG
tatttctcacttctctgtga

SEQ ID NO: 62708 - DNA, 20 bp, Artificial Sequence
  Description of Artificial Sequence: Synthetic oligonucleotide
  Target: ATXN1; (-) strand; PAM type: NRG; PAM sequence: AGG
ttctgttctatttccatgct

SEQ ID NO: 62709 - DNA, 20 bp, Artificial Sequence
  Description of Artificial Sequence: Synthetic oligonucleotide
  Target: ATXN1; (-) strand; PAM type: NRG; PAM sequence: TAG
cttctgttctatttccatgc

SEQ ID NO: 62710 - DNA, 20 bp, Artificial Sequence
  Description of Artificial Sequence: Synthetic oligonucleotide
  Target: ATXN1; (-) strand; PAM type: NRG; PAM sequence: AAG
actgtatttgttcagataac

SEQ ID NO: 62711 - DNA, 20 bp, Artificial Sequence
  Description of Artificial Sequence: Synthetic oligonucleotide
  Target: ATXN1; (-) strand; PAM type: NRG; PAM sequence: CAG
gtcgtgagactgtatttgtt

SEQ ID NO: 62712 - DNA, 20 bp, Artificial Sequence
  Description of Artificial Sequence: Synthetic oligonucleotide
  Target: ATXN1; (-) strand; PAM type: NRG; PAM sequence: GAG
caattcgtctaattggtcgt

SEQ ID NO: 62713 - DNA, 20 bp, Artificial Sequence
  Description of Artificial Sequence: Synthetic oligonucleotide
  Target: ATXN1; (-) strand; PAM type: NRG; PAM sequence: TGG
gaactatcaattcgtctaat

SEQ ID NO: 62714 - DNA, 20 bp, Artificial Sequence
  Description of Artificial Sequence: Synthetic oligonucleotide
  Target: ATXN1; (-) strand; PAM type: NRG; PAM sequence: TGG
ttttttaagaaaatggtctt

SEQ ID NO: 62715 - DNA, 20 bp, Artificial Sequence
  Description of Artificial Sequence: Synthetic oligonucleotide
  Target: ATXN1; (-) strand; PAM type: NRG; PAM sequence: TGG
gaacttcttttttaagaaaa

SEQ ID NO: 62716 - DNA, 20 bp, Artificial Sequence
  Description of Artificial Sequence: Synthetic oligonucleotide
  Target: ATXN1; (-) strand; PAM type: NRG; PAM sequence: AAG
gaacattgaacttctttttt

SEQ ID NO: 62717 - DNA, 20 bp, Artificial Sequence
  Description of Artificial Sequence: Synthetic oligonucleotide
  Target: ATXN1; (-) strand; PAM type: NRG; PAM sequence: AAG
gttctttttgggaaaagagc

SEQ ID NO: 62718 - DNA, 20 bp, Artificial Sequence
  Description of Artificial Sequence: Synthetic oligonucleotide
  Target: ATXN1; (-) strand; PAM type: NRG; PAM sequence: GAG
ttgtgttctttttgggaaaa

SEQ ID NO: 62719 - DNA, 20 bp, Artificial Sequence
  Description of Artificial Sequence: Synthetic oligonucleotide
  Target: ATXN1; (-) strand; PAM type: NRG; PAM sequence: AAG
tgttgtgttctttttgggaa

SEQ ID NO: 62720 - DNA, 20 bp, Artificial Sequence
  Description of Artificial Sequence: Synthetic oligonucleotide
  Target: ATXN1; (-) strand; PAM type: NRG; PAM sequence: GGG
taccatgttgtgttcttttt

SEQ ID NO: 62721 - DNA, 20 bp, Artificial Sequence
  Description of Artificial Sequence: Synthetic oligonucleotide
  Target: ATXN1; (-) strand; PAM type: NRG; PAM sequence: TGG
gtaccatgttgtgttctttt

SEQ ID NO: 62722 - DNA, 20 bp, Artificial Sequence
  Description of Artificial Sequence: Synthetic oligonucleotide
  Target: ATXN1; (-) strand; PAM type: NRG; PAM sequence: TGG
actttggggtgaggagaggc

SEQ ID NO: 62723 - DNA, 20 bp, Artificial Sequence
  Description of Artificial Sequence: Synthetic oligonucleotide
  Target: ATXN1; (-) strand; PAM type: NRG; PAM sequence: AGG
ttcaactttggggtgaggag

SEQ ID NO: 62724 - DNA, 20 bp, Artificial Sequence
  Description of Artificial Sequence: Synthetic oligonucleotide
  Target: ATXN1; (-) strand; PAM type: NRG; PAM sequence: GAG
cttcaactttggggtgagga

SEQ ID NO: 62725 - DNA, 20 bp, Artificial Sequence
  Description of Artificial Sequence: Synthetic oligonucleotide
  Target: ATXN1; (-) strand; PAM type: NRG; PAM sequence: GAG
ggcttcaactttggggtgag

SEQ ID NO: 62726 - DNA, 20 bp, Artificial Sequence
  Description of Artificial Sequence: Synthetic oligonucleotide
  Target: ATXN1; (-) strand; PAM type: NRG; PAM sequence: AGG
atggcttcaactttggggtg

SEQ ID NO: 62727 - DNA, 20 bp, Artificial Sequence
  Description of Artificial Sequence: Synthetic oligonucleotide
  Target: ATXN1; (-) strand; PAM type: NRG; PAM sequence: GAG
aatggcttcaactttggggt

SEQ ID NO: 62728 - DNA, 20 bp, Artificial Sequence
  Description of Artificial Sequence: Synthetic oligonucleotide
  Target: ATXN1; (-) strand; PAM type: NRG; PAM sequence: GGG
cagaaatggcttcaactttg

SEQ ID NO: 62729 - DNA, 20 bp, Artificial Sequence
  Description of Artificial Sequence: Synthetic oligonucleotide
  Target: ATXN1; (-) strand; PAM type: NRG; PAM sequence: GGG
ccagaaatggcttcaacttt

SEQ ID NO: 62730 - DNA, 20 bp, Artificial Sequence
  Description of Artificial Sequence: Synthetic oligonucleotide
  Target: ATXN1; (-) strand; PAM type: NRG; PAM sequence: TGG
cccagaaatggcttcaactt

SEQ ID NO: 62731 - DNA, 20 bp, Artificial Sequence
  Description of Artificial Sequence: Synthetic oligonucleotide
  Target: ATXN1; (-) strand; PAM type: NRG; PAM sequence: TGG
tgtctgaagtctcccagaaa

SEQ ID NO: 62732 - DNA, 20 bp, Artificial Sequence
  Description of Artificial Sequence: Synthetic oligonucleotide
  Target: ATXN1; (-) strand; PAM type: NRG; PAM sequence: CAG
agattgtgtctgaagtctcc

SEQ ID NO: 62733 - DNA, 20 bp, Artificial Sequence
  Description of Artificial Sequence: Synthetic oligonucleotide
  Target: ATXN1; (-) strand; PAM type: NRG; PAM sequence: AAG
ctcagctaagattgtgtctg

SEQ ID NO: 62734 - DNA, 20 bp, Artificial Sequence
  Description of Artificial Sequence: Synthetic oligonucleotide
  Target: ATXN1; (-) strand; PAM type: NRG; PAM sequence: AAG
tgcaagtttgcatctcagct

SEQ ID NO: 62735 - DNA, 20 bp, Artificial Sequence
  Description of Artificial Sequence: Synthetic oligonucleotide
  Target: ATXN1; (-) strand; PAM type: NRG; PAM sequence: CAG
gcttttgcaagtttgcatct

SEQ ID NO: 62736 - DNA, 20 bp, Artificial Sequence
  Description of Artificial Sequence: Synthetic oligonucleotide
  Target: ATXN1; (-) strand; PAM type: NRG; PAM sequence: AAG
gcctgttttgaggcttttgc

SEQ ID NO: 62737 - DNA, 20 bp, Artificial Sequence
  Description of Artificial Sequence: Synthetic oligonucleotide
  Target: ATXN1; (-) strand; PAM type: NRG; PAM sequence: AGG
aagccaagtggcctgttttg

SEQ ID NO: 62738 - DNA, 20 bp, Artificial Sequence
  Description of Artificial Sequence: Synthetic oligonucleotide
  Target: ATXN1; (-) strand; PAM type: NRG; PAM sequence: GAG
aaagccaagtggcctgtttt

SEQ ID NO: 62739 - DNA, 20 bp, Artificial Sequence
  Description of Artificial Sequence: Synthetic oligonucleotide
  Target: ATXN1; (-) strand; PAM type: NRG; PAM sequence: TGG
tgcagaagagtaaagccaag

SEQ ID NO: 62740 - DNA, 20 bp, Artificial Sequence
  Description of Artificial Sequence: Synthetic oligonucleotide
  Target: ATXN1; (-) strand; PAM type: NRG; PAM sequence: AAG
ttttgcagaagagtaaagcc

SEQ ID NO: 62741 - DNA, 20 bp, Artificial Sequence
  Description of Artificial Sequence: Synthetic oligonucleotide
  Target: ATXN1; (-) strand; PAM type: NRG; PAM sequence: AAG
cctccttttgcagaagagta

SEQ ID NO: 62742 - DNA, 20 bp, Artificial Sequence
  Description of Artificial Sequence: Synthetic oligonucleotide
  Target: ATXN1; (-) strand; PAM type: NRG; PAM sequence: GAG
ccttgcctccttttgcagaa

SEQ ID NO: 62743 - DNA, 20 bp, Artificial Sequence
  Description of Artificial Sequence: Synthetic oligonucleotide
  Target: ATXN1; (-) strand; PAM type: NRG; PAM sequence: AAG
gtccttgcctccttttgcag

SEQ ID NO: 62744 - DNA, 20 bp, Artificial Sequence
  Description of Artificial Sequence: Synthetic oligonucleotide
  Target: ATXN1; (-) strand; PAM type: NRG; PAM sequence: CAG
ctagtccttgcctccttttg

SEQ ID NO: 62745 - DNA, 20 bp, Artificial Sequence
  Description of Artificial Sequence: Synthetic oligonucleotide
  Target: ATXN1; (-) strand; PAM type: NRG; PAM sequence: TAG
atgacagtggcagaaggtgc

SEQ ID NO: 62746 - DNA, 20 bp, Artificial Sequence
  Description of Artificial Sequence: Synthetic oligonucleotide
  Target: ATXN1; (-) strand; PAM type: NRG; PAM sequence: AGG
taagatatgacagtggcaga

SEQ ID NO: 62747 - DNA, 20 bp, Artificial Sequence
  Description of Artificial Sequence: Synthetic oligonucleotide
  Target: ATXN1; (-) strand; PAM type: NRG; PAM sequence: AAG
gtaagatatgacagtggcag

SEQ ID NO: 62748 - DNA, 20 bp, Artificial Sequence
  Description of Artificial Sequence: Synthetic oligonucleotide
  Target: ATXN1; (-) strand; PAM type: NRG; PAM sequence: CAG
ccagtaagatatgacagtgg

SEQ ID NO: 62749 - DNA, 20 bp, Artificial Sequence
  Description of Artificial Sequence: Synthetic oligonucleotide
  Target: ATXN1; (-) strand; PAM type: NRG; PAM sequence: TGG
gacccagtaagatatgacag

SEQ ID NO: 62750 - DNA, 20 bp, Artificial Sequence
  Description of Artificial Sequence: Synthetic oligonucleotide
  Target: ATXN1; (-) strand; PAM type: NRG; PAM sequence: CAG
catgacccagtaagatatga

SEQ ID NO: 62751 - DNA, 20 bp, Artificial Sequence
  Description of Artificial Sequence: Synthetic oligonucleotide
  Target: ATXN1; (-) strand; PAM type: NRG; PAM sequence: AAG
gatcttctccatgacccagt

SEQ ID NO: 62752 - DNA, 20 bp, Artificial Sequence
  Description of Artificial Sequence: Synthetic oligonucleotide
  Target: ATXN1; (-) strand; PAM type: NRG; PAM sequence: CAG
tcttgatcttctccatgacc

SEQ ID NO: 62753 - DNA, 20 bp, Artificial Sequence
  Description of Artificial Sequence: Synthetic oligonucleotide
  Target: ATXN1; (-) strand; PAM type: NRG; PAM sequence: AAG
gggaactgtgtgtgctttgc

SEQ ID NO: 62754 - DNA, 20 bp, Artificial Sequence
  Description of Artificial Sequence: Synthetic oligonucleotide
  Target: ATXN1; (-) strand; PAM type: NRG; PAM sequence: GGG
aacatagtggatttcttctc

SEQ ID NO: 62755 - DNA, 20 bp, Artificial Sequence
  Description of Artificial Sequence: Synthetic oligonucleotide
  Target: ATXN1; (-) strand; PAM type: NRG; PAM sequence: CGG
taacatagtggatttcttct

SEQ ID NO: 62756 - DNA, 20 bp, Artificial Sequence
  Description of Artificial Sequence: Synthetic oligonucleotide
  Target: ATXN1; (-) strand; PAM type: NRG; PAM sequence: TGG
aacgctttgcattaacatag

SEQ ID NO: 62757 - DNA, 20 bp, Artificial Sequence
  Description of Artificial Sequence: Synthetic oligonucleotide
  Target: ATXN1; (-) strand; PAM type: NRG; PAM sequence: TAG
aacaacgctttgcattaaca

SEQ ID NO: 62758 - DNA, 20 bp, Artificial Sequence
  Description of Artificial Sequence: Synthetic oligonucleotide
  Target: ATXN1; (-) strand; PAM type: NRG; PAM sequence: AGG
tggctccagagctcaggaac

SEQ ID NO: 62759 - DNA, 20 bp, Artificial Sequence
  Description of Artificial Sequence: Synthetic oligonucleotide
  Target: ATXN1; (-) strand; PAM type: NRG; PAM sequence: CAG
ctggctccagagctcaggaa

SEQ ID NO: 62760 - DNA, 20 bp, Artificial Sequence
  Description of Artificial Sequence: Synthetic oligonucleotide
  Target: ATXN1; (-) strand; PAM type: NRG; PAM sequence: AGG
gtattctggctccagagctc

SEQ ID NO: 62761 - DNA, 20 bp, Artificial Sequence
  Description of Artificial Sequence: Synthetic oligonucleotide
  Target: ATXN1; (-) strand; PAM type: NRG; PAM sequence: CAG
tgtattctggctccagagct

SEQ ID NO: 62762 - DNA, 20 bp, Artificial Sequence
  Description of Artificial Sequence: Synthetic oligonucleotide
  Target: ATXN1; (-) strand; PAM type: NRG; PAM sequence: GAG
gcttttgtattctggctcca

SEQ ID NO: 62763 - DNA, 20 bp, Artificial Sequence
  Description of Artificial Sequence: Synthetic oligonucleotide
  Target: ATXN1; (-) strand; PAM type: NRG; PAM sequence: CAG
tggcttttgtattctggctc

SEQ ID NO: 62764 - DNA, 20 bp, Artificial Sequence
  Description of Artificial Sequence: Synthetic oligonucleotide
  Target: ATXN1; (-) strand; PAM type: NRG; PAM sequence: TGG
cagtgctggcttttgtattc

SEQ ID NO: 62765 - DNA, 20 bp, Artificial Sequence
  Description of Artificial Sequence: Synthetic oligonucleotide
  Target: ATXN1; (-) strand; PAM type: NRG; PAM sequence: TGG
gattggtgccttaccagtgc

SEQ ID NO: 62766 - DNA, 20 bp, Artificial Sequence
  Description of Artificial Sequence: Synthetic oligonucleotide
  Target: ATXN1; (-) strand; PAM type: NRG; PAM sequence: CAG
gttgatgattggtgccttac

SEQ ID NO: 62767 - DNA, 20 bp, Artificial Sequence
  Description of Artificial Sequence: Synthetic oligonucleotide
  Target: ATXN1; (-) strand; PAM type: NRG; PAM sequence: TGG
ctcccgggatagttgatgat

SEQ ID NO: 62768 - DNA, 20 bp, Artificial Sequence
  Description of Artificial Sequence: Synthetic oligonucleotide
  Target: ATXN1; (-) strand; PAM type: NRG; PAM sequence: TAG
acgtttggatgctcccggga

SEQ ID NO: 62769 - DNA, 20 bp, Artificial Sequence
  Description of Artificial Sequence: Synthetic oligonucleotide
  Target: ATXN1; (-) strand; PAM type: NRG; PAM sequence: GGG
gcagacgtttggatgctccc

SEQ ID NO: 62770 - DNA, 20 bp, Artificial Sequence
  Description of Artificial Sequence: Synthetic oligonucleotide
  Target: ATXN1; (-) strand; PAM type: NRG; PAM sequence: CGG
tgcagacgtttggatgctcc

SEQ ID NO: 62771 - DNA, 20 bp, Artificial Sequence
  Description of Artificial Sequence: Synthetic oligonucleotide
  Target: ATXN1; (-) strand; PAM type: NRG; PAM sequence: TGG
cagtagggcatgcagacgtt

SEQ ID NO: 62772 - DNA, 20 bp, Artificial Sequence
  Description of Artificial Sequence: Synthetic oligonucleotide
  Target: ATXN1; (-) strand; PAM type: NRG; PAM sequence: CAG
actcagcacagtagggcatg

SEQ ID NO: 62773 - DNA, 20 bp, Artificial Sequence
  Description of Artificial Sequence: Synthetic oligonucleotide
  Target: ATXN1; (-) strand; PAM type: NRG; PAM sequence: GGG
tcctgaaactcagcacagta

SEQ ID NO: 62774 - DNA, 20 bp, Artificial Sequence
  Description of Artificial Sequence: Synthetic oligonucleotide
  Target: ATXN1; (-) strand; PAM type: NRG; PAM sequence: AGG
ttcctgaaactcagcacagt

SEQ ID NO: 62775 - DNA, 20 bp, Artificial Sequence
  Description of Artificial Sequence: Synthetic oligonucleotide
  Target: ATXN1; (-) strand; PAM type: NRG; PAM sequence: TAG
tttcctgaaactcagcacag

SEQ ID NO: 62776 - DNA, 20 bp, Artificial Sequence
  Description of Artificial Sequence: Synthetic oligonucleotide
  Target: ATXN1; (-) strand; PAM type: NRG; PAM sequence: CAG
ttctttcctgaaactcagca

SEQ ID NO: 62777 - DNA, 20 bp, Artificial Sequence
  Description of Artificial Sequence: Synthetic oligonucleotide
  Target: ATXN1; (-) strand; PAM type: NRG; PAM sequence: CAG
tcctattctttcctgaaact

SEQ ID NO: 62778 - DNA, 20 bp, Artificial Sequence
  Description of Artificial Sequence: Synthetic oligonucleotide
  Target: ATXN1; (-) strand; PAM type: NRG; PAM sequence: CAG
tttctttttcccggagattc

SEQ ID NO: 62779 - DNA, 20 bp, Artificial Sequence
  Description of Artificial Sequence: Synthetic oligonucleotide
  Target: ATXN1; (-) strand; PAM type: NRG; PAM sequence: GAG
ccttcactttctttttcccg

SEQ ID NO: 62780 - DNA, 20 bp, Artificial Sequence
  Description of Artificial Sequence: Synthetic oligonucleotide
  Target: ATXN1; (-) strand; PAM type: NRG; PAM sequence: CGG
tgccttcactttctttttcc

SEQ ID NO: 62781 - DNA, 20 bp, Artificial Sequence
  Description of Artificial Sequence: Synthetic oligonucleotide
  Target: ATXN1; (-) strand; PAM type: NRG; PAM sequence: TAG
ccaccttacactctttctcc

SEQ ID NO: 62782 - DNA, 20 bp, Artificial Sequence
  Description of Artificial Sequence: Synthetic oligonucleotide
  Target: ATXN1; (-) strand; PAM type: NRG; PAM sequence: GAG
tgcaaaccagcaatctgagg

SEQ ID NO: 62783 - DNA, 20 bp, Artificial Sequence
  Description of Artificial Sequence: Synthetic oligonucleotide
  Target: ATXN1; (-) strand; PAM type: NRG; PAM sequence: GGG
gctgcaaaccagcaatctga

SEQ ID NO: 62784 - DNA, 20 bp, Artificial Sequence
  Description of Artificial Sequence: Synthetic oligonucleotide
  Target: ATXN1; (-) strand; PAM type: NRG; PAM sequence: AGG
cgctgcaaaccagcaatctg

SEQ ID NO: 62785 - DNA, 20 bp, Artificial Sequence
  Description of Artificial Sequence: Synthetic oligonucleotide
  Target: ATXN1; (-) strand; PAM type: NRG; PAM sequence: GAG
acgctgcaaaccagcaatct

SEQ ID NO: 62786 - DNA, 20 bp, Artificial Sequence
  Description of Artificial Sequence: Synthetic oligonucleotide
  Target: ATXN1; (-) strand; PAM type: NRG; PAM sequence: CAG
gtgcacgaaacgctgcaaac

SEQ ID NO: 62787 - DNA, 20 bp, Artificial Sequence
  Description of Artificial Sequence: Synthetic oligonucleotide
  Target: ATXN1; (-) strand; PAM type: NRG; PAM sequence: CAG
ttcacagtgtcgcaaacatt

SEQ ID NO: 62788 - DNA, 20 bp, Artificial Sequence
  Description of Artificial Sequence: Synthetic oligonucleotide
  Target: ATXN1; (-) strand; PAM type: NRG; PAM sequence: CAG
cagccaagtggaaaatttca

SEQ ID NO: 62789 - DNA, 20 bp, Artificial Sequence
  Description of Artificial Sequence: Synthetic oligonucleotide
  Target: ATXN1; (-) strand; PAM type: NRG; PAM sequence: TGG
ggaaatggcagacagccaag

SEQ ID NO: 62790 - DNA, 20 bp, Artificial Sequence
  Description of Artificial Sequence: Synthetic oligonucleotide
  Target: ATXN1; (-) strand; PAM type: NRG; PAM sequence: AAG
ggcggaaatggcagacagcc

SEQ ID NO: 62791 - DNA, 20 bp, Artificial Sequence
  Description of Artificial Sequence: Synthetic oligonucleotide
  Target: ATXN1; (-) strand; PAM type: NRG; PAM sequence: CAG
cggtgggcggaaatggcaga

SEQ ID NO: 62792 - DNA, 20 bp, Artificial Sequence
  Description of Artificial Sequence: Synthetic oligonucleotide
  Target: ATXN1; (-) strand; PAM type: NRG; PAM sequence: CAG
tcttcggtgggcggaaatgg

SEQ ID NO: 62793 - DNA, 20 bp, Artificial Sequence
  Description of Artificial Sequence: Synthetic oligonucleotide
  Target: ATXN1; (-) strand; PAM type: NRG; PAM sequence: TGG
ttgtcttcggtgggcggaaa

SEQ ID NO: 62794 - DNA, 20 bp, Artificial Sequence
  Description of Artificial Sequence: Synthetic oligonucleotide
  Target: ATXN1; (-) strand; PAM type: NRG; PAM sequence: CGG
taagtgttgtcttcggtggg

SEQ ID NO: 62795 - DNA, 20 bp, Artificial Sequence
  Description of Artificial Sequence: Synthetic oligonucleotide
  Target: ATXN1; (-) strand; PAM type: NRG; PAM sequence: GGG
gtgtaagtgttgtcttcggt

SEQ ID NO: 62796 - DNA, 20 bp, Artificial Sequence
  Description of Artificial Sequence: Synthetic oligonucleotide
  Target: ATXN1; (-) strand; PAM type: NRG; PAM sequence: TGG
ggtgtaagtgttgtcttcgg

SEQ ID NO: 62797 - DNA, 20 bp, Artificial Sequence
  Description of Artificial Sequence: Synthetic oligonucleotide
  Target: ATXN1; (-) strand; PAM type: NRG; PAM sequence: CGG
gtgggtgtaagtgttgtctt

SEQ ID NO: 62798 - DNA, 20 bp, Artificial Sequence
  Description of Artificial Sequence: Synthetic oligonucleotide
  Target: ATXN1; (-) strand; PAM type: NRG; PAM sequence: AAG
tgtgccactctggtgggtgt

SEQ ID NO: 62799 - DNA, 20 bp, Artificial Sequence
  Description of Artificial Sequence: Synthetic oligonucleotide
  Target: ATXN1; (-) strand; PAM type: NRG; PAM sequence: GGG
cctcgctgtgccactctggt

SEQ ID NO: 62800 - DNA, 20 bp, Artificial Sequence
  Description of Artificial Sequence: Synthetic oligonucleotide
  Target: ATXN1; (-) strand; PAM type: NRG; PAM sequence: TGG
gcctcgctgtgccactctgg

SEQ ID NO: 62801 - DNA, 20 bp, Artificial Sequence
  Description of Artificial Sequence: Synthetic oligonucleotide
  Target: ATXN1; (-) strand; PAM type: NRG; PAM sequence: TGG
agggcctcgctgtgccactc

SEQ ID NO: 62802 - DNA, 20 bp, Artificial Sequence
  Description of Artificial Sequence: Synthetic oligonucleotide
  Target: ATXN1; (-) strand; PAM type: NRG; PAM sequence: GGG
tatccaatccttttccagca

SEQ ID NO: 62803 - DNA, 20 bp, Artificial Sequence
  Description of Artificial Sequence: Synthetic oligonucleotide
  Target: ATXN1; (-) strand; PAM type: NRG; PAM sequence: AGG
ttatccaatccttttccagc

SEQ ID NO: 62804 - DNA, 20 bp, Artificial Sequence
  Description of Artificial Sequence: Synthetic oligonucleotide
  Target: ATXN1; (-) strand; PAM type: NRG; PAM sequence: CAG
gttatccaatccttttccag

SEQ ID NO: 62805 - DNA, 20 bp, Artificial Sequence
  Description of Artificial Sequence: Synthetic oligonucleotide
  Target: ATXN1; (-) strand; PAM type: NRG; PAM sequence: CAG
aaagttatccaatccttttc

SEQ ID NO: 62806 - DNA, 20 bp, Artificial Sequence
  Description of Artificial Sequence: Synthetic oligonucleotide
  Target: ATXN1; (-) strand; PAM type: NRG; PAM sequence: AAG
agcaacagcaaataaacaaa

SEQ ID NO: 62807 - DNA, 20 bp, Artificial Sequence
  Description of Artificial Sequence: Synthetic oligonucleotide
  Target: ATXN1; (-) strand; PAM type: NRG; PAM sequence: CAG
agtcttttcattaaaagcaa

SEQ ID NO: 62808 - DNA, 20 bp, Artificial Sequence
  Description of Artificial Sequence: Synthetic oligonucleotide
  Target: ATXN1; (-) strand; PAM type: NRG; PAM sequence: AAG
tgaataagtcttttcattaa

SEQ ID NO: 62809 - DNA, 20 bp, Artificial Sequence
  Description of Artificial Sequence: Synthetic oligonucleotide
  Target: ATXN1; (-) strand; PAM type: NRG; PAM sequence: AAG
ttaatgatcaggatatgaat

SEQ ID NO: 62810 - DNA, 20 bp, Artificial Sequence
  Description of Artificial Sequence: Synthetic oligonucleotide
  Target: ATXN1; (-) strand; PAM type: NRG; PAM sequence: AGG
tgtggaaaatattaatgatc

SEQ ID NO: 62811 - DNA, 20 bp, Artificial Sequence
  Description of Artificial Sequence: Synthetic oligonucleotide
  Target: ATXN1; (-) strand; PAM type: NRG; PAM sequence: CAG
gtgtggaaaatattaatgat

SEQ ID NO: 62812 - DNA, 20 bp, Artificial Sequence
  Description of Artificial Sequence: Synthetic oligonucleotide
  Target: ATXN1; (-) strand; PAM type: NRG; PAM sequence: TGG
aaaatcaagaaatccaggtg

SEQ ID NO: 62813 - DNA, 20 bp, Artificial Sequence
  Description of Artificial Sequence: Synthetic oligonucleotide
  Target: ATXN1; (-) strand; PAM type: NRG; PAM sequence: AGG
ggaaaaaaatcaagaaatcc

SEQ ID NO: 62814 - DNA, 20 bp, Artificial Sequence
  Description of Artificial Sequence: Synthetic oligonucleotide
  Target: ATXN1; (-) strand; PAM type: NRG; PAM sequence: CAG
gggaaaaaaatcaagaaatc

SEQ ID NO: 62815 - DNA, 20 bp, Artificial Sequence
  Description of Artificial Sequence: Synthetic oligonucleotide
  Target: ATXN1; (-) strand; PAM type: NRG; PAM sequence: AAG
ttgaaagggggaaaaaaatc

SEQ ID NO: 62816 - DNA, 20 bp, Artificial Sequence
  Description of Artificial Sequence: Synthetic oligonucleotide
  Target: ATXN1; (-) strand; PAM type: NRG; PAM sequence: GGG
cctgggtcagccttgaaagg

SEQ ID NO: 62817 - DNA, 20 bp, Artificial Sequence
  Description of Artificial Sequence: Synthetic oligonucleotide
  Target: ATXN1; (-) strand; PAM type: NRG; PAM sequence: GGG
tcctgggtcagccttgaaag

SEQ ID NO: 62818 - DNA, 20 bp, Artificial Sequence
  Description of Artificial Sequence: Synthetic oligonucleotide
  Target: ATXN1; (-) strand; PAM type: NRG; PAM sequence: GGG
ttcctgggtcagccttgaaa

SEQ ID NO: 62819 - DNA, 20 bp, Artificial Sequence
  Description of Artificial Sequence: Synthetic oligonucleotide
  Target: ATXN1; (-) strand; PAM type: NRG; PAM sequence: AGG
gttcctgggtcagccttgaa

SEQ ID NO: 62820 - DNA, 20 bp, Artificial Sequence
  Description of Artificial Sequence: Synthetic oligonucleotide
  Target: ATXN1; (-) strand; PAM type: NRG; PAM sequence: AAG
tgttcctgggtcagccttga

SEQ ID NO: 62821 - DNA, 20 bp, Artificial Sequence
  Description of Artificial Sequence: Synthetic oligonucleotide
  Target: ATXN1; (-) strand; PAM type: NRG; PAM sequence: CAG
aggagaagctgttcctgggt

SEQ ID NO: 62822 - DNA, 20 bp, Artificial Sequence
  Description of Artificial Sequence: Synthetic oligonucleotide
  Target: ATXN1; (-) strand; PAM type: NRG; PAM sequence: GGG
ttccaggagaagctgttcct

SEQ ID NO: 62823 - DNA, 20 bp, Artificial Sequence
  Description of Artificial Sequence: Synthetic oligonucleotide
  Target: ATXN1; (-) strand; PAM type: NRG; PAM sequence: TGG
gttccaggagaagctgttcc

SEQ ID NO: 62824 - DNA, 20 bp, Artificial Sequence
  Description of Artificial Sequence: Synthetic oligonucleotide
  Target: ATXN1; (-) strand; PAM type: NRG; PAM sequence: AAG
tgatagtatcgttccaggag

SEQ ID NO: 62825 - DNA, 20 bp, Artificial Sequence
  Description of Artificial Sequence: Synthetic oligonucleotide
  Target: ATXN1; (-) strand; PAM type: NRG; PAM sequence: GAG
agttgatagtatcgttccag

SEQ ID NO: 62826 - DNA, 20 bp, Artificial Sequence
  Description of Artificial Sequence: Synthetic oligonucleotide
  Target: ATXN1; (-) strand; PAM type: NRG; PAM sequence: AGG
taagttgatagtatcgttcc

SEQ ID NO: 62827 - DNA, 20 bp, Artificial Sequence
  Description of Artificial Sequence: Synthetic oligonucleotide
  Target: ATXN1; (-) strand; PAM type: NRG; PAM sequence: CAG
ataagttgatagtatcgttc

SEQ ID NO: 62828 - DNA, 20 bp, Artificial Sequence
  Description of Artificial Sequence: Synthetic oligonucleotide
  Target: ATXN1; (-) strand; PAM type: NRG; PAM sequence: TAG
tacaaggcgaaataagttga

SEQ ID NO: 62829 - DNA, 20 bp, Artificial Sequence
  Description of Artificial Sequence: Synthetic oligonucleotide
  Target: ATXN1; (-) strand; PAM type: NRG; PAM sequence: AAG
aaaagtatacaaggcgaaat

SEQ ID NO: 62830 - DNA, 20 bp, Artificial Sequence
  Description of Artificial Sequence: Synthetic oligonucleotide
  Target: ATXN1; (-) strand; PAM type: NRG; PAM sequence: AGG
gtgcttctcaaaagtataca

SEQ ID NO: 62831 - DNA, 20 bp, Artificial Sequence
  Description of Artificial Sequence: Synthetic oligonucleotide
  Target: ATXN1; (-) strand; PAM type: NRG; PAM sequence: AAG
tgtgcttctcaaaagtatac

SEQ ID NO: 62832 - DNA, 20 bp, Artificial Sequence
  Description of Artificial Sequence: Synthetic oligonucleotide
  Target: ATXN1; (-) strand; PAM type: NRG; PAM sequence: AAG
gcctcaagtgtgcttctcaa

SEQ ID NO: 62833 - DNA, 20 bp, Artificial Sequence
  Description of Artificial Sequence: Synthetic oligonucleotide
  Target: ATXN1; (-) strand; PAM type: NRG; PAM sequence: AAG
aatacaagttcctttgcctc

SEQ ID NO: 62834 - DNA, 20 bp, Artificial Sequence
  Description of Artificial Sequence: Synthetic oligonucleotide
  Target: ATXN1; (-) strand; PAM type: NRG; PAM sequence: AAG
atcctcaaagctgctaatac

SEQ ID NO: 62835 - DNA, 20 bp, Artificial Sequence
  Description of Artificial Sequence: Synthetic oligonucleotide
  Target: ATXN1; (-) strand; PAM type: NRG; PAM sequence: AAG
tctgtttcttgtcatcctca

SEQ ID NO: 62836 - DNA, 20 bp, Artificial Sequence
  Description of Artificial Sequence: Synthetic oligonucleotide
  Target: ATXN1; (-) strand; PAM type: NRG; PAM sequence: TAG
gaagcaacaagattctagtg

SEQ ID NO: 62837 - DNA, 20 bp, Artificial Sequence
  Description of Artificial Sequence: Synthetic oligonucleotide
  Target: ATXN1; (-) strand; PAM type: NRG; PAM sequence: TAG
tttgggaagcaacaagattc

SEQ ID NO: 62838 - DNA, 20 bp, Artificial Sequence
  Description of Artificial Sequence: Synthetic oligonucleotide
  Target: ATXN1; (-) strand; PAM type: NRG; PAM sequence: AAG
tgatgtatttgggaagcaac

SEQ ID NO: 62839 - DNA, 20 bp, Artificial Sequence
  Description of Artificial Sequence: Synthetic oligonucleotide
  Target: ATXN1; (-) strand; PAM type: NRG; PAM sequence: AAG
ttgtcgatgatgtatttggg

SEQ ID NO: 62840 - DNA, 20 bp, Artificial Sequence
  Description of Artificial Sequence: Synthetic oligonucleotide
  Target: ATXN1; (-) strand; PAM type: NRG; PAM sequence: GGG
cctttgtcgatgatgtattt

SEQ ID NO: 62841 - DNA, 20 bp, Artificial Sequence
  Description of Artificial Sequence: Synthetic oligonucleotide
  Target: ATXN1; (-) strand; PAM type: NRG; PAM sequence: TGG
gcctttgtcgatgatgtatt

SEQ ID NO: 62842 - DNA, 20 bp, Artificial Sequence
  Description of Artificial Sequence: Synthetic oligonucleotide
  Target: ATXN1; (-) strand; PAM type: NRG; PAM sequence: TGG
tttgaaaggaaaaacatgac

SEQ ID NO: 62843 - DNA, 20 bp, Artificial Sequence
  Description of Artificial Sequence: Synthetic oligonucleotide
  Target: ATXN1; (-) strand; PAM type: NRG; PAM sequence: AGG
gtgcatgctcatgatttgaa

SEQ ID NO: 62844 - DNA, 20 bp, Artificial Sequence
  Description of Artificial Sequence: Synthetic oligonucleotide
  Target: ATXN1; (-) strand; PAM type: NRG; PAM sequence: AAG
tgtgcatgctcatgatttga

SEQ ID NO: 62845 - DNA, 20 bp, Artificial Sequence
  Description of Artificial Sequence: Synthetic oligonucleotide
  Target: ATXN1; (-) strand; PAM type: NRG; PAM sequence: CAG
tcttttttgttttttttcct

SEQ ID NO: 62846 - DNA, 20 bp, Artificial Sequence
  Description of Artificial Sequence: Synthetic oligonucleotide
  Target: ATXN1; (-) strand; PAM type: NRG; PAM sequence: AGG
ttgcctttttttagagataa

SEQ ID NO: 62847 - DNA, 20 bp, Artificial Sequence
  Description of Artificial Sequence: Synthetic oligonucleotide
  Target: ATXN1; (-) strand; PAM type: NRG; PAM sequence: AAG
cttgcctttttttagagata

SEQ ID NO: 62848 - DNA, 20 bp, Artificial Sequence
  Description of Artificial Sequence: Synthetic oligonucleotide
  Target: ATXN1; (-) strand; PAM type: NRG; PAM sequence: GAG
ttcattcttgccttttttta

SEQ ID NO: 62849 - DNA, 20 bp, Artificial Sequence
  Description of Artificial Sequence: Synthetic oligonucleotide
  Target: ATXN1; (-) strand; PAM type: NRG; PAM sequence: TAG
tattcattcttgcctttttt

SEQ ID NO: 62850 - DNA, 20 bp, Artificial Sequence
  Description of Artificial Sequence: Synthetic oligonucleotide
  Target: ATXN1; (-) strand; PAM type: NRG; PAM sequence: AAG
gtgttaccaattccaaatct

SEQ ID NO: 62851 - DNA, 20 bp, Artificial Sequence
  Description of Artificial Sequence: Synthetic oligonucleotide
  Target: ATXN1; (-) strand; PAM type: NRG; PAM sequence: CAG
ttattttgagatatacttgt

SEQ ID NO: 62852 - DNA, 20 bp, Artificial Sequence
  Description of Artificial Sequence: Synthetic oligonucleotide
  Target: ATXN1; (-) strand; PAM type: NRG; PAM sequence: GAG
ttttattagttctttatttt

SEQ ID NO: 62853 - DNA, 20 bp, Artificial Sequence
  Description of Artificial Sequence: Synthetic oligonucleotide
  Target: ATXN1; (-) strand; PAM type: NRG; PAM sequence: TAG
tttgtctctccattttttat

SEQ ID NO: 62854 - DNA, 20 bp, Artificial Sequence
  Description of Artificial Sequence: Synthetic oligonucleotide
  Target: ATXN1; (-) strand; PAM type: NRG; PAM sequence: CAG
atggttaattatgtgagtag

SEQ ID NO: 62855 - DNA, 20 bp, Artificial Sequence
  Description of Artificial Sequence: Synthetic oligonucleotide
  Target: ATXN1; (-) strand; PAM type: NRG; PAM sequence: TAG
gtgatggttaattatgtgag

SEQ ID NO: 62856 - DNA, 20 bp, Artificial Sequence
  Description of Artificial Sequence: Synthetic oligonucleotide
  Target: ATXN1; (-) strand; PAM type: NRG; PAM sequence: GAG
aaagtgatggttaattatgt

SEQ ID NO: 62857 - DNA, 20 bp, Artificial Sequence
  Description of Artificial Sequence: Synthetic oligonucleotide
  Target: ATXN1; (-) strand; PAM type: NRG; PAM sequence: TGG
tgtattcattatgaaagtga

SEQ ID NO: 62858 - DNA, 20 bp, Artificial Sequence
  Description of Artificial Sequence: Synthetic oligonucleotide
  Target: ATXN1; (-) strand; PAM type: NRG; PAM sequence: AAG
gtaaactgtattcattatga

SEQ ID NO: 62859 - DNA, 20 bp, Artificial Sequence
  Description of Artificial Sequence: Synthetic oligonucleotide
  Target: ATXN1; (-) strand; PAM type: NRG; PAM sequence: TGG
ttaattaatgagaaagcact

SEQ ID NO: 62860 - DNA, 20 bp, Artificial Sequence
  Description of Artificial Sequence: Synthetic oligonucleotide
  Target: ATXN1; (-) strand; PAM type: NRG; PAM sequence: AAG
gaatgatttaattaatgaga

SEQ ID NO: 62861 - DNA, 20 bp, Artificial Sequence
  Description of Artificial Sequence: Synthetic oligonucleotide
  Target: ATXN1; (-) strand; PAM type: NRG; PAM sequence: GAG
aagcgaatgatttaattaat

SEQ ID NO: 62862 - DNA, 20 bp, Artificial Sequence
  Description of Artificial Sequence: Synthetic oligonucleotide
  Target: ATXN1; (-) strand; PAM type: NRG; PAM sequence: AAG
gtaccaagtaaaattgtatc

SEQ ID NO: 62863 - DNA, 20 bp, Artificial Sequence
  Description of Artificial Sequence: Synthetic oligonucleotide
  Target: ATXN1; (-) strand; PAM type: NRG; PAM sequence: AAG
tggtggatttagcaagtacc

SEQ ID NO: 62864 - DNA, 20 bp, Artificial Sequence
  Description of Artificial Sequence: Synthetic oligonucleotide
  Target: ATXN1; (-) strand; PAM type: NRG; PAM sequence: AAG
cagagcctggtggatttagc

SEQ ID NO: 62865 - DNA, 20 bp, Artificial Sequence
  Description of Artificial Sequence: Synthetic oligonucleotide
  Target: ATXN1; (-) strand; PAM type: NRG; PAM sequence: TAG
aacacagagcctggtggatt

SEQ ID NO: 62866 - DNA, 20 bp, Artificial Sequence
  Description of Artificial Sequence: Synthetic oligonucleotide
  Target: ATXN1; (-) strand; PAM type: NRG; PAM sequence: TGG
cagttgaacacagagcctgg

SEQ ID NO: 62867 - DNA, 20 bp, Artificial Sequence
  Description of Artificial Sequence: Synthetic oligonucleotide
  Target: ATXN1; (-) strand; PAM type: NRG; PAM sequence: TGG
ccccagttgaacacagagcc

SEQ ID NO: 62868 - DNA, 20 bp, Artificial Sequence
  Description of Artificial Sequence: Synthetic oligonucleotide
  Target: ATXN1; (-) strand; PAM type: NRG; PAM sequence: GAG
gtattccccagttgaacaca

SEQ ID NO: 62869 - DNA, 20 bp, Artificial Sequence
  Description of Artificial Sequence: Synthetic oligonucleotide
  Target: ATXN1; (-) strand; PAM type: NRG; PAM sequence: CAG
atgtattccccagttgaaca

SEQ ID NO: 62870 - DNA, 20 bp, Artificial Sequence
  Description of Artificial Sequence: Synthetic oligonucleotide
  Target: ATXN1; (-) strand; PAM type: NRG; PAM sequence: CAG
tttgtttaccatgtattccc

SEQ ID NO: 62871 - DNA, 20 bp, Artificial Sequence
  Description of Artificial Sequence: Synthetic oligonucleotide
  Target: ATXN1; (-) strand; PAM type: NRG; PAM sequence: GGG
ctccttgggtgcagggtcct

SEQ ID NO: 62872 - DNA, 20 bp, Artificial Sequence
  Description of Artificial Sequence: Synthetic oligonucleotide
  Target: ATXN1; (-) strand; PAM type: NRG; PAM sequence: TGG
gctccttgggtgcagggtcc

SEQ ID NO: 62873 - DNA, 20 bp, Artificial Sequence
  Description of Artificial Sequence: Synthetic oligonucleotide
  Target: ATXN1; (-) strand; PAM type: NRG; PAM sequence: GGG
cagtgagctccttgggtgca

SEQ ID NO: 62874 - DNA, 20 bp, Artificial Sequence
  Description of Artificial Sequence: Synthetic oligonucleotide
  Target: ATXN1; (-) strand; PAM type: NRG; PAM sequence: AGG
gcagtgagctccttgggtgc

SEQ ID NO: 62875 - DNA, 20 bp, Artificial Sequence
  Description of Artificial Sequence: Synthetic oligonucleotide
  Target: ATXN1; (-) strand; PAM type: NRG; PAM sequence: CAG
ggcagtgagctccttgggtg

SEQ ID NO: 62876 - DNA, 20 bp, Artificial Sequence
  Description of Artificial Sequence: Synthetic oligonucleotide
  Target: ATXN1; (-) strand; PAM type: NRG; PAM sequence: GGG
cttgaggcagtgagctcctt

SEQ ID NO: 62877 - DNA, 20 bp, Artificial Sequence
  Description of Artificial Sequence: Synthetic oligonucleotide
  Target: ATXN1; (-) strand; PAM type: NRG; PAM sequence: TGG
tcttgaggcagtgagctcct

SEQ ID NO: 62878 - DNA, 20 bp, Artificial Sequence
  Description of Artificial Sequence: Synthetic oligonucleotide
  Target: ATXN1; (-) strand; PAM type: NRG; PAM sequence: GAG
tctgtccctcttgaggcagt

SEQ ID NO: 62879 - DNA, 20 bp, Artificial Sequence
  Description of Artificial Sequence: Synthetic oligonucleotide
  Target: ATXN1; (-) strand; PAM type: NRG; PAM sequence: CAG
taattctgtccctcttgagg

SEQ ID NO: 62880 - DNA, 20 bp, Artificial Sequence
  Description of Artificial Sequence: Synthetic oligonucleotide
  Target: ATXN1; (-) strand; PAM type: NRG; PAM sequence: AGG
atttaattctgtccctcttg

SEQ ID NO: 62881 - DNA, 20 bp, Artificial Sequence
  Description of Artificial Sequence: Synthetic oligonucleotide
  Target: ATXN1; (-) strand; PAM type: NRG; PAM sequence: GAG
tatttaattctgtccctctt

SEQ ID NO: 62882 - DNA, 20 bp, Artificial Sequence
  Description of Artificial Sequence: Synthetic oligonucleotide
  Target: ATXN1; (-) strand; PAM type: NRG; PAM sequence: CAG
tttccttcatattgcctatc

SEQ ID NO: 62883 - DNA, 20 bp, Artificial Sequence
  Description of Artificial Sequence: Synthetic oligonucleotide
  Target: ATXN1; (-) strand; PAM type: NRG; PAM sequence: AGG
tgagaccctccttctaagtg

SEQ ID NO: 62884 - DNA, 20 bp, Artificial Sequence
  Description of Artificial Sequence: Synthetic oligonucleotide
  Target: ATXN1; (-) strand; PAM type: NRG; PAM sequence: GAG
ctgagaccctccttctaagt

SEQ ID NO: 62885 - DNA, 20 bp, Artificial Sequence
  Description of Artificial Sequence: Synthetic oligonucleotide
  Target: ATXN1; (-) strand; PAM type: NRG; PAM sequence: AAG
cttcctgagaccctccttct

SEQ ID NO: 62886 - DNA, 20 bp, Artificial Sequence
  Description of Artificial Sequence: Synthetic oligonucleotide
  Target: ATXN1; (-) strand; PAM type: NRG; PAM sequence: GAG
tttgtaagagaagccttcct

SEQ ID NO: 62887 - DNA, 20 bp, Artificial Sequence
  Description of Artificial Sequence: Synthetic oligonucleotide
  Target: ATXN1; (-) strand; PAM type: NRG; PAM sequence: AAG
gaatgttagttttgtaagag

SEQ ID NO: 62888 - DNA, 20 bp, Artificial Sequence
  Description of Artificial Sequence: Synthetic oligonucleotide
  Target: ATXN1; (-) strand; PAM type: NRG; PAM sequence: GAG
ttcgaatgttagttttgtaa

SEQ ID NO: 62889 - DNA, 20 bp, Artificial Sequence
  Description of Artificial Sequence: Synthetic oligonucleotide
  Target: ATXN1; (-) strand; PAM type: NRG; PAM sequence: AAG
tgttcgaatgttagttttgt

SEQ ID NO: 62890 - DNA, 20 bp, Artificial Sequence
  Description of Artificial Sequence: Synthetic oligonucleotide
  Target: ATXN1; (-) strand; PAM type: NRG; PAM sequence: TAG
tgactttcctgttcgaatgt

SEQ ID NO: 62891 - DNA, 20 bp, Artificial Sequence
  Description of Artificial Sequence: Synthetic oligonucleotide
  Target: ATXN1; (-) strand; PAM type: NRG; PAM sequence: TGG
ctacctggaaacctgatgcc

SEQ ID NO: 62892 - DNA, 20 bp, Artificial Sequence
  Description of Artificial Sequence: Synthetic oligonucleotide
  Target: ATXN1; (-) strand; PAM type: NRG; PAM sequence: TGG
tacagactgtttcctctacc

SEQ ID NO: 62893 - DNA, 20 bp, Artificial Sequence
  Description of Artificial Sequence: Synthetic oligonucleotide
  Target: ATXN1; (-) strand; PAM type: NRG; PAM sequence: CAG
ctagatcagttcgtataata

SEQ ID NO: 62894 - DNA, 20 bp, Artificial Sequence
  Description of Artificial Sequence: Synthetic oligonucleotide
  Target: ATXN1; (-) strand; PAM type: NRG; PAM sequence: CAG
acagttgtacatcactagat

SEQ ID NO: 62895 - DNA, 20 bp, Artificial Sequence
  Description of Artificial Sequence: Synthetic oligonucleotide
  Target: ATXN1; (-) strand; PAM type: NRG; PAM sequence: TAG
agaacacagttgtacatcac

SEQ ID NO: 62896 - DNA, 20 bp, Artificial Sequence
  Description of Artificial Sequence: Synthetic oligonucleotide
  Target: ATXN1; (-) strand; PAM type: NRG; PAM sequence: CAG
aagagagaaataacagaaca

SEQ ID NO: 62897 - DNA, 20 bp, Artificial Sequence
  Description of Artificial Sequence: Synthetic oligonucleotide
  Target: ATXN1; (-) strand; PAM type: NRG; PAM sequence: CAG
aataaaaaagagagaaataa

SEQ ID NO: 62898 - DNA, 20 bp, Artificial Sequence
  Description of Artificial Sequence: Synthetic oligonucleotide
  Target: ATXN1; (-) strand; PAM type: NRG; PAM sequence: GAG
aaatggcaaaataaaaaaga

SEQ ID NO: 62899 - DNA, 20 bp, Artificial Sequence
  Description of Artificial Sequence: Synthetic oligonucleotide
  Target: ATXN1; (-) strand; PAM type: NRG; PAM sequence: GAG
tgaaatggcaaaataaaaaa

SEQ ID NO: 62900 - DNA, 20 bp, Artificial Sequence
  Description of Artificial Sequence: Synthetic oligonucleotide
  Target: ATXN1; (-) strand; PAM type: NRG; PAM sequence: AAG
gttgaaatggcaaaataaaa

SEQ ID NO: 62901 - DNA, 20 bp, Artificial Sequence
  Description of Artificial Sequence: Synthetic oligonucleotide
  Target: ATXN1; (-) strand; PAM type: NRG; PAM sequence: TGG
tcaaggagactcagttgaaa

SEQ ID NO: 62902 - DNA, 20 bp, Artificial Sequence
  Description of Artificial Sequence: Synthetic oligonucleotide
  Target: ATXN1; (-) strand; PAM type: NRG; PAM sequence: CAG
atttctttttcaaggagact

SEQ ID NO: 62903 - DNA, 20 bp, Artificial Sequence
  Description of Artificial Sequence: Synthetic oligonucleotide
  Target: ATXN1; (-) strand; PAM type: NRG; PAM sequence: GAG
tcactcatttctttttcaag

SEQ ID NO: 62904 - DNA, 20 bp, Artificial Sequence
  Description of Artificial Sequence: Synthetic oligonucleotide
  Target: ATXN1; (-) strand; PAM type: NRG; PAM sequence: AGG
tgtcactcatttctttttca

SEQ ID NO: 62905 - DNA, 20 bp, Artificial Sequence
  Description of Artificial Sequence: Synthetic oligonucleotide
  Target: ATXN1; (-) strand; PAM type: NRG; PAM sequence: AAG
gtgtcactcatttctttttc

SEQ ID NO: 62906 - DNA, 20 bp, Artificial Sequence
  Description of Artificial Sequence: Synthetic oligonucleotide
  Target: ATXN1; (-) strand; PAM type: NRG; PAM sequence: CAG
ttatttcaaggtatggagaa

SEQ ID NO: 62907 - DNA, 20 bp, Artificial Sequence
  Description of Artificial Sequence: Synthetic oligonucleotide
  Target: ATXN1; (-) strand; PAM type: NRG; PAM sequence: GAG
atctcttatttcaaggtatg

SEQ ID NO: 62908 - DNA, 20 bp, Artificial Sequence
  Description of Artificial Sequence: Synthetic oligonucleotide
  Target: ATXN1; (-) strand; PAM type: NRG; PAM sequence: TGG
tcatctcttatttcaaggta

SEQ ID NO: 62909 - DNA, 20 bp, Artificial Sequence
  Description of Artificial Sequence: Synthetic oligonucleotide
  Target: ATXN1; (-) strand; PAM type: NRG; PAM sequence: AGG
atgaatcatctcttatttca

SEQ ID NO: 62910 - DNA, 20 bp, Artificial Sequence
  Description of Artificial Sequence: Synthetic oligonucleotide
  Target: ATXN1; (-) strand; PAM type: NRG; PAM sequence: AAG
gatgaatcatctcttatttc

SEQ ID NO: 62911 - DNA, 20 bp, Artificial Sequence
  Description of Artificial Sequence: Synthetic oligonucleotide
  Target: ATXN1; (-) strand; PAM type: NRG; PAM sequence: AAG
ctgatggcctagcagtcaga

SEQ ID NO: 62912 - DNA, 20 bp, Artificial Sequence
  Description of Artificial Sequence: Synthetic oligonucleotide
  Target: ATXN1; (-) strand; PAM type: NRG; PAM sequence: CAG
tgctctgatggcctagcagt

SEQ ID NO: 62913 - DNA, 20 bp, Artificial Sequence
  Description of Artificial Sequence: Synthetic oligonucleotide
  Target: ATXN1; (-) strand; PAM type: NRG; PAM sequence: CAG
gtgttgctctgatggcctag

SEQ ID NO: 62914 - DNA, 20 bp, Artificial Sequence
  Description of Artificial Sequence: Synthetic oligonucleotide
  Target: ATXN1; (-) strand; PAM type: NRG; PAM sequence: TAG
tgtgtgttgctctgatggcc

SEQ ID NO: 62915 - DNA, 20 bp, Artificial Sequence
  Description of Artificial Sequence: Synthetic oligonucleotide
  Target: ATXN1; (-) strand; PAM type: NRG; PAM sequence: TGG
gaaggtgtgtgttgctctga

SEQ ID NO: 62916 - DNA, 20 bp, Artificial Sequence
  Description of Artificial Sequence: Synthetic oligonucleotide
  Target: ATXN1; (-) strand; PAM type: NRG; PAM sequence: AGG
accgaaattaatcacagaga

SEQ ID NO: 62917 - DNA, 20 bp, Artificial Sequence
  Description of Artificial Sequence: Synthetic oligonucleotide
  Target: ATXN1; (-) strand; PAM type: NRG; PAM sequence: AAG
caccgaaattaatcacagag

SEQ ID NO: 62918 - DNA, 20 bp, Artificial Sequence
  Description of Artificial Sequence: Synthetic oligonucleotide
  Target: ATXN1; (-) strand; PAM type: NRG; PAM sequence: GAG
tctcaccgaaattaatcaca

SEQ ID NO: 62919 - DNA, 20 bp, Artificial Sequence
  Description of Artificial Sequence: Synthetic oligonucleotide
  Target: ATXN1; (-) strand; PAM type: NRG; PAM sequence: CAG
cctctcaccgaaattaatca

SEQ ID NO: 62920 - DNA, 20 bp, Artificial Sequence
  Description of Artificial Sequence: Synthetic oligonucleotide
  Target: ATXN1; (-) strand; PAM type: NRG; PAM sequence: GGG
aagaataatacctgcatcag

SEQ ID NO: 62921 - DNA, 20 bp, Artificial Sequence
  Description of Artificial Sequence: Synthetic oligonucleotide
  Target: ATXN1; (-) strand; PAM type: NRG; PAM sequence: GGG
caagaataatacctgcatca

SEQ ID NO: 62922 - DNA, 20 bp, Artificial Sequence
  Description of Artificial Sequence: Synthetic oligonucleotide
  Target: ATXN1; (-) strand; PAM type: NRG; PAM sequence: AGG
tcaagaataatacctgcatc

SEQ ID NO: 62923 - DNA, 20 bp, Artificial Sequence
  Description of Artificial Sequence: Synthetic oligonucleotide
  Target: ATXN1; (-) strand; PAM type: NRG; PAM sequence: CAG
atcaagaataatacctgcat

SEQ ID NO: 62924 - DNA, 20 bp, Artificial Sequence
  Description of Artificial Sequence: Synthetic oligonucleotide
  Target: ATXN1; (-) strand; PAM type: NRG; PAM sequence: AAG
tcattatttgctgtcacatc

SEQ ID NO: 62925 - DNA, 20 bp, Artificial Sequence
  Description of Artificial Sequence: Synthetic oligonucleotide
  Target: ATXN1; (-) strand; PAM type: NRG; PAM sequence: GGG
ttggggtgcattagagagca

SEQ ID NO: 62926 - DNA, 20 bp, Artificial Sequence
  Description of Artificial Sequence: Synthetic oligonucleotide
  Target: ATXN1; (-) strand; PAM type: NRG; PAM sequence: AGG
cttggggtgcattagagagc

SEQ ID NO: 62927 - DNA, 20 bp, Artificial Sequence
  Description of Artificial Sequence: Synthetic oligonucleotide
  Target: ATXN1; (-) strand; PAM type: NRG; PAM sequence: CAG
acttggggtgcattagagag

SEQ ID NO: 62928 - DNA, 20 bp, Artificial Sequence
  Description of Artificial Sequence: Synthetic oligonucleotide
  Target: ATXN1; (-) strand; PAM type: NRG; PAM sequence: GAG
gtgacttggggtgcattaga

SEQ ID NO: 62929 - DNA, 20 bp, Artificial Sequence
  Description of Artificial Sequence: Synthetic oligonucleotide
  Target: ATXN1; (-) strand; PAM type: NRG; PAM sequence: GAG
gagtgacttggggtgcatta

SEQ ID NO: 62930 - DNA, 20 bp, Artificial Sequence
  Description of Artificial Sequence: Synthetic oligonucleotide
  Target: ATXN1; (-) strand; PAM type: NRG; PAM sequence: TAG
cggagtgacttggggtgcat

SEQ ID NO: 62931 - DNA, 20 bp, Artificial Sequence
  Description of Artificial Sequence: Synthetic oligonucleotide
  Target: ATXN1; (-) strand; PAM type: NRG; PAM sequence: GGG
tgtgataacggagtgacttg

SEQ ID NO: 62932 - DNA, 20 bp, Artificial Sequence
  Description of Artificial Sequence: Synthetic oligonucleotide
  Target: ATXN1; (-) strand; PAM type: NRG; PAM sequence: GGG
ctgtgataacggagtgactt

SEQ ID NO: 62933 - DNA, 20 bp, Artificial Sequence
  Description of Artificial Sequence: Synthetic oligonucleotide
  Target: ATXN1; (-) strand; PAM type: NRG; PAM sequence: TGG
actgtgataacggagtgact

SEQ ID NO: 62934 - DNA, 20 bp, Artificial Sequence
  Description of Artificial Sequence: Synthetic oligonucleotide
  Target: ATXN1; (-) strand; PAM type: NRG; PAM sequence: GAG
tttacttcactgtgataacg

SEQ ID NO: 62935 - DNA, 20 bp, Artificial Sequence
  Description of Artificial Sequence: Synthetic oligonucleotide
  Target: ATXN1; (-) strand; PAM type: NRG; PAM sequence: CGG
cttttacttcactgtgataa

SEQ ID NO: 62936 - DNA, 20 bp, Artificial Sequence
  Description of Artificial Sequence: Synthetic oligonucleotide
  Target: ATXN1; (-) strand; PAM type: NRG; PAM sequence: GAG
gcatgcaggtgtcaacaaga

SEQ ID NO: 62937 - DNA, 20 bp, Artificial Sequence
  Description of Artificial Sequence: Synthetic oligonucleotide
  Target: ATXN1; (-) strand; PAM type: NRG; PAM sequence: GAG
tggcatgcaggtgtcaacaa

SEQ ID NO: 62938 - DNA, 20 bp, Artificial Sequence
  Description of Artificial Sequence: Synthetic oligonucleotide
  Target: ATXN1; (-) strand; PAM type: NRG; PAM sequence: AAG
tgtggcatgcaggtgtcaac

SEQ ID NO: 62939 - DNA, 20 bp, Artificial Sequence
  Description of Artificial Sequence: Synthetic oligonucleotide
  Target: ATXN1; (-) strand; PAM type: NRG; PAM sequence: AGG
taacttcagctgtggcatgc

SEQ ID NO: 62940 - DNA, 20 bp, Artificial Sequence
  Description of Artificial Sequence: Synthetic oligonucleotide
  Target: ATXN1; (-) strand; PAM type: NRG; PAM sequence: CAG
ttaacttcagctgtggcatg

SEQ ID NO: 62941 - DNA, 20 bp, Artificial Sequence
  Description of Artificial Sequence: Synthetic oligonucleotide
  Target: ATXN1; (-) strand; PAM type: NRG; PAM sequence: TGG
ggttttcttaacttcagctg

SEQ ID NO: 62942 - DNA, 20 bp, Artificial Sequence
  Description of Artificial Sequence: Synthetic oligonucleotide
  Target: ATXN1; (-) strand; PAM type: NRG; PAM sequence: CAG
ggggagggttttcttaactt

SEQ ID NO: 62943 - DNA, 20 bp, Artificial Sequence
  Description of Artificial Sequence: Synthetic oligonucleotide
  Target: ATXN1; (-) strand; PAM type: NRG; PAM sequence: GGG
tttcagtcctttttggggga

SEQ ID NO: 62944 - DNA, 20 bp, Artificial Sequence
  Description of Artificial Sequence: Synthetic oligonucleotide
  Target: ATXN1; (-) strand; PAM type: NRG; PAM sequence: AGG
ttttcagtcctttttggggg

SEQ ID NO: 62945 - DNA, 20 bp, Artificial Sequence
  Description of Artificial Sequence: Synthetic oligonucleotide
  Target: ATXN1; (-) strand; PAM type: NRG; PAM sequence: GAG
gttttcagtcctttttgggg

SEQ ID NO: 62946 - DNA, 20 bp, Artificial Sequence
  Description of Artificial Sequence: Synthetic oligonucleotide
  Target: ATXN1; (-) strand; PAM type: NRG; PAM sequence: GGG
ctgttttcagtcctttttgg

SEQ ID NO: 62947 - DNA, 20 bp, Artificial Sequence
  Description of Artificial Sequence: Synthetic oligonucleotide
  Target: ATXN1; (-) strand; PAM type: NRG; PAM sequence: GGG
tctgttttcagtcctttttg

SEQ ID NO: 62948 - DNA, 20 bp, Artificial Sequence
  Description of Artificial Sequence: Synthetic oligonucleotide
  Target: ATXN1; (-) strand; PAM type: NRG; PAM sequence: GGG
atctgttttcagtccttttt

SEQ ID NO: 62949 - DNA, 20 bp, Artificial Sequence
  Description of Artificial Sequence: Synthetic oligonucleotide
  Target: ATXN1; (-) strand; PAM type: NRG; PAM sequence: TGG
gatctgttttcagtcctttt

SEQ ID NO: 62950 - DNA, 20 bp, Artificial Sequence
  Description of Artificial Sequence: Synthetic oligonucleotide
  Target: ATXN1; (-) strand; PAM type: NRG; PAM sequence: CAG
caagtaatgtgatctgtttt

SEQ ID NO: 62951 - DNA, 20 bp, Artificial Sequence
  Description of Artificial Sequence: Synthetic oligonucleotide
  Target: ATXN1; (-) strand; PAM type: NRG; PAM sequence: AAG
gatgtttttcagaagtctac

SEQ ID NO: 62952 - DNA, 20 bp, Artificial Sequence
  Description of Artificial Sequence: Synthetic oligonucleotide
  Target: ATXN1; (-) strand; PAM type: NRG; PAM sequence: AAG
gtcctaaagatgtttttcag

SEQ ID NO: 62953 - DNA, 20 bp, Artificial Sequence
  Description of Artificial Sequence: Synthetic oligonucleotide
  Target: ATXN1; (-) strand; PAM type: NRG; PAM sequence: CAG
aaggtcctaaagatgttttt

SEQ ID NO: 62954 - DNA, 20 bp, Artificial Sequence
  Description of Artificial Sequence: Synthetic oligonucleotide
  Target: ATXN1; (-) strand; PAM type: NRG; PAM sequence: AAG
gtacctgatccaaggtccta

SEQ ID NO: 62955 - DNA, 20 bp, Artificial Sequence
  Description of Artificial Sequence: Synthetic oligonucleotide
  Target: ATXN1; (-) strand; PAM type: NRG; PAM sequence: AGG
gaaatctggtacctgatcca

SEQ ID NO: 62956 - DNA, 20 bp, Artificial Sequence
  Description of Artificial Sequence: Synthetic oligonucleotide
  Target: ATXN1; (-) strand; PAM type: NRG; PAM sequence: AAG
agaaatctggtacctgatcc

SEQ ID NO: 62957 - DNA, 20 bp, Artificial Sequence
  Description of Artificial Sequence: Synthetic oligonucleotide
  Target: ATXN1; (-) strand; PAM type: NRG; PAM sequence: TGG
tcaaggggaagccagaaatc

SEQ ID NO: 62958 - DNA, 20 bp, Artificial Sequence
  Description of Artificial Sequence: Synthetic oligonucleotide
  Target: ATXN1; (-) strand; PAM type: NRG; PAM sequence: CAG
cgtaatcatcaaggggaagc

SEQ ID NO: 62959 - DNA, 20 bp, Artificial Sequence
  Description of Artificial Sequence: Synthetic oligonucleotide
  Target: ATXN1; (-) strand; PAM type: NRG; PAM sequence: AAG
ataccgtaatcatcaagggg

SEQ ID NO: 62960 - DNA, 20 bp, Artificial Sequence
  Description of Artificial Sequence: Synthetic oligonucleotide
  Target: ATXN1; (-) strand; PAM type: NRG; PAM sequence: GGG
aaaataccgtaatcatcaag

SEQ ID NO: 62961 - DNA, 20 bp, Artificial Sequence
  Description of Artificial Sequence: Synthetic oligonucleotide
  Target: ATXN1; (-) strand; PAM type: NRG; PAM sequence: GGG
aaaaataccgtaatcatcaa

SEQ ID NO: 62962 - DNA, 20 bp, Artificial Sequence
  Description of Artificial Sequence: Synthetic oligonucleotide
  Target: ATXN1; (-) strand; PAM type: NRG; PAM sequence: AGG
taaaaataccgtaatcatca

SEQ ID NO: 62963 - DNA, 20 bp, Artificial Sequence
  Description of Artificial Sequence: Synthetic oligonucleotide
  Target: ATXN1; (-) strand; PAM type: NRG; PAM sequence: AAG
gtaaaaataccgtaatcatc

SEQ ID NO: 62964 - DNA, 20 bp, Artificial Sequence
  Description of Artificial Sequence: Synthetic oligonucleotide
  Target: ATXN1; (-) strand; PAM type: NRG; PAM sequence: TAG
gtttaagtccaagagagaaa

SEQ ID NO: 62965 - DNA, 20 bp, Artificial Sequence
  Description of Artificial Sequence: Synthetic oligonucleotide
  Target: ATXN1; (-) strand; PAM type: NRG; PAM sequence: GAG
aaagctgtttaagtccaaga

SEQ ID NO: 62966 - DNA, 20 bp, Artificial Sequence
  Description of Artificial Sequence: Synthetic oligonucleotide
  Target: ATXN1; (-) strand; PAM type: NRG; PAM sequence: GAG
taaaagctgtttaagtccaa

SEQ ID NO: 62967 - DNA, 20 bp, Artificial Sequence
  Description of Artificial Sequence: Synthetic oligonucleotide
  Target: ATXN1; (-) strand; PAM type: NRG; PAM sequence: AAG
cataaaagctgtttaagtcc

SEQ ID NO: 62968 - DNA, 20 bp, Artificial Sequence
  Description of Artificial Sequence: Synthetic oligonucleotide
  Target: ATXN1; (-) strand; PAM type: NRG; PAM sequence: AAG
ggtgggcataaaagctgttt

SEQ ID NO: 62969 - DNA, 20 bp, Artificial Sequence
  Description of Artificial Sequence: Synthetic oligonucleotide
  Target: ATXN1; (-) strand; PAM type: NRG; PAM sequence: AAG
actgttaacggtgggcataa

SEQ ID NO: 62970 - DNA, 20 bp, Artificial Sequence
  Description of Artificial Sequence: Synthetic oligonucleotide
  Target: ATXN1; (-) strand; PAM type: NRG; PAM sequence: GGG
gacggaacactgttaacggt

SEQ ID NO: 62971 - DNA, 20 bp, Artificial Sequence
  Description of Artificial Sequence: Synthetic oligonucleotide
  Target: ATXN1; (-) strand; PAM type: NRG; PAM sequence: TGG
tgacggaacactgttaacgg

SEQ ID NO: 62972 - DNA, 20 bp, Artificial Sequence
  Description of Artificial Sequence: Synthetic oligonucleotide
  Target: ATXN1; (-) strand; PAM type: NRG; PAM sequence: CGG
ggttgacggaacactgttaa

SEQ ID NO: 62973 - DNA, 20 bp, Artificial Sequence
  Description of Artificial Sequence: Synthetic oligonucleotide
  Target: ATXN1; (-) strand; PAM type: NRG; PAM sequence: CGG
gaaccaagagagaaggttga

SEQ ID NO: 62974 - DNA, 20 bp, Artificial Sequence
  Description of Artificial Sequence: Synthetic oligonucleotide
  Target: ATXN1; (-) strand; PAM type: NRG; PAM sequence: AGG
gaaccaagaaccaagagaga

SEQ ID NO: 62975 - DNA, 20 bp, Artificial Sequence
  Description of Artificial Sequence: Synthetic oligonucleotide
  Target: ATXN1; (-) strand; PAM type: NRG; PAM sequence: AAG
tgaaccaagaaccaagagag

SEQ ID NO: 62976 - DNA, 20 bp, Artificial Sequence
  Description of Artificial Sequence: Synthetic oligonucleotide
  Target: ATXN1; (-) strand; PAM type: NRG; PAM sequence: GAG
cactgaaccaagaaccaaga

SEQ ID NO: 62977 - DNA, 20 bp, Artificial Sequence
  Description of Artificial Sequence: Synthetic oligonucleotide
  Target: ATXN1; (-) strand; PAM type: NRG; PAM sequence: GAG
accactgaaccaagaaccaa

SEQ ID NO: 62978 - DNA, 20 bp, Artificial Sequence
  Description of Artificial Sequence: Synthetic oligonucleotide
  Target: ATXN1; (-) strand; PAM type: NRG; PAM sequence: AAG
agaccactgaaccaagaacc

SEQ ID NO: 62979 - DNA, 20 bp, Artificial Sequence
  Description of Artificial Sequence: Synthetic oligonucleotide
  Target: ATXN1; (-) strand; PAM type: NRG; PAM sequence: AAG
agtaaacagaccactgaacc

SEQ ID NO: 62980 - DNA, 20 bp, Artificial Sequence
  Description of Artificial Sequence: Synthetic oligonucleotide
  Target: ATXN1; (-) strand; PAM type: NRG; PAM sequence: CAG
ggctcatgtgggtaagtaaa

SEQ ID NO: 62981 - DNA, 20 bp, Artificial Sequence
  Description of Artificial Sequence: Synthetic oligonucleotide
  Target: ATXN1; (-) strand; PAM type: NRG; PAM sequence: AAG
tgcttgcggctcatgtgggt

SEQ ID NO: 62982 - DNA, 20 bp, Artificial Sequence
  Description of Artificial Sequence: Synthetic oligonucleotide
  Target: ATXN1; (-) strand; PAM type: NRG; PAM sequence: GGG
accttgcttgcggctcatgt

SEQ ID NO: 62983 - DNA, 20 bp, Artificial Sequence
  Description of Artificial Sequence: Synthetic oligonucleotide
  Target: ATXN1; (-) strand; PAM type: NRG; PAM sequence: TGG
caccttgcttgcggctcatg

SEQ ID NO: 62984 - DNA, 20 bp, Artificial Sequence
  Description of Artificial Sequence: Synthetic oligonucleotide
  Target: ATXN1; (-) strand; PAM type: NRG; PAM sequence: CGG
atttctttgcaccttgcttg

SEQ ID NO: 62985 - DNA, 20 bp, Artificial Sequence
  Description of Artificial Sequence: Synthetic oligonucleotide
  Target: ATXN1; (-) strand; PAM type: NRG; PAM sequence: CAG
tagggaagaagaaaacactt

SEQ ID NO: 62986 - DNA, 20 bp, Artificial Sequence
  Description of Artificial Sequence: Synthetic oligonucleotide
  Target: ATXN1; (-) strand; PAM type: NRG; PAM sequence: AAG
gatgtgggatgatagggaag

SEQ ID NO: 62987 - DNA, 20 bp, Artificial Sequence
  Description of Artificial Sequence: Synthetic oligonucleotide
  Target: ATXN1; (-) strand; PAM type: NRG; PAM sequence: AAG
ccagatgtgggatgataggg

SEQ ID NO: 62988 - DNA, 20 bp, Artificial Sequence
  Description of Artificial Sequence: Synthetic oligonucleotide
  Target: ATXN1; (-) strand; PAM type: NRG; PAM sequence: GGG
gagccagatgtgggatgata

SEQ ID NO: 62989 - DNA, 20 bp, Artificial Sequence
  Description of Artificial Sequence: Synthetic oligonucleotide
  Target: ATXN1; (-) strand; PAM type: NRG; PAM sequence: AGG
tgagccagatgtgggatgat

SEQ ID NO: 62990 - DNA, 20 bp, Artificial Sequence
  Description of Artificial Sequence: Synthetic oligonucleotide
  Target: ATXN1; (-) strand; PAM type: NRG; PAM sequence: TAG
ttgagccagatgtgggatga

SEQ ID NO: 62991 - DNA, 20 bp, Artificial Sequence
  Description of Artificial Sequence: Synthetic oligonucleotide
  Target: ATXN1; (-) strand; PAM type: NRG; PAM sequence: GGG
aattaagttgagccagatgt

SEQ ID NO: 62992 - DNA, 20 bp, Artificial Sequence
  Description of Artificial Sequence: Synthetic oligonucleotide
  Target: ATXN1; (-) strand; PAM type: NRG; PAM sequence: TGG
gaattaagttgagccagatg

SEQ ID NO: 62993 - DNA, 20 bp, Artificial Sequence
  Description of Artificial Sequence: Synthetic oligonucleotide
  Target: ATXN1; (-) strand; PAM type: NRG; PAM sequence: CAG
gtggaagaattaagttgagc

SEQ ID NO: 62994 - DNA, 20 bp, Artificial Sequence
  Description of Artificial Sequence: Synthetic oligonucleotide
  Target: ATXN1; (-) strand; PAM type: NRG; PAM sequence: GAG
cttagtggaagaattaagtt

SEQ ID NO: 62995 - DNA, 20 bp, Artificial Sequence
  Description of Artificial Sequence: Synthetic oligonucleotide
  Target: ATXN1; (-) strand; PAM type: NRG; PAM sequence: AAG
ttttccttagtggaagaatt

SEQ ID NO: 62996 - DNA, 20 bp, Artificial Sequence
  Description of Artificial Sequence: Synthetic oligonucleotide
  Target: ATXN1; (-) strand; PAM type: NRG; PAM sequence: AAG
ctactgattttccttagtgg

SEQ ID NO: 62997 - DNA, 20 bp, Artificial Sequence
  Description of Artificial Sequence: Synthetic oligonucleotide
  Target: ATXN1; (-) strand; PAM type: NRG; PAM sequence: TGG
aaactactgattttccttag

SEQ ID NO: 62998 - DNA, 20 bp, Artificial Sequence
  Description of Artificial Sequence: Synthetic oligonucleotide
  Target: ATXN1; (-) strand; PAM type: NRG; PAM sequence: TAG
agcaaactactgattttcct

SEQ ID NO: 62999 - DNA, 20 bp, Artificial Sequence
  Description of Artificial Sequence: Synthetic oligonucleotide
  Target: ATXN1; (-) strand; PAM type: NRG; PAM sequence: AAG
ttaatgttgtaggatgaaga

SEQ ID NO: 63000 - DNA, 20 bp, Artificial Sequence
  Description of Artificial Sequence: Synthetic oligonucleotide
  Target: ATXN1; (-) strand; PAM type: NRG; PAM sequence: AAG
tgctttaatgttgtaggatg

SEQ ID NO: 63001 - DNA, 20 bp, Artificial Sequence
  Description of Artificial Sequence: Synthetic oligonucleotide
  Target: ATXN1; (-) strand; PAM type: NRG; PAM sequence: AGG
ggatgatgctttaatgttgt

SEQ ID NO: 63002 - DNA, 20 bp, Artificial Sequence
  Description of Artificial Sequence: Synthetic oligonucleotide
  Target: ATXN1; (-) strand; PAM type: NRG; PAM sequence: TAG
tggatgatgctttaatgttg

SEQ ID NO: 63003 - DNA, 20 bp, Artificial Sequence
  Description of Artificial Sequence: Synthetic oligonucleotide
  Target: ATXN1; (-) strand; PAM type: NRG; PAM sequence: TGG
gagaacatgaatgagcctgt

SEQ ID NO: 63004 - DNA, 20 bp, Artificial Sequence
  Description of Artificial Sequence: Synthetic oligonucleotide
  Target: ATXN1; (-) strand; PAM type: NRG; PAM sequence: GAG
ttcatggggagaacatgaat

SEQ ID NO: 63005 - DNA, 20 bp, Artificial Sequence
  Description of Artificial Sequence: Synthetic oligonucleotide
  Target: ATXN1; (-) strand; PAM type: NRG; PAM sequence: GAG
agacttactccattcatggg

SEQ ID NO: 63006 - DNA, 20 bp, Artificial Sequence
  Description of Artificial Sequence: Synthetic oligonucleotide
  Target: ATXN1; (-) strand; PAM type: NRG; PAM sequence: GGG
tcagacttactccattcatg

SEQ ID NO: 63007 - DNA, 20 bp, Artificial Sequence
  Description of Artificial Sequence: Synthetic oligonucleotide
  Target: ATXN1; (-) strand; PAM type: NRG; PAM sequence: GGG
ttcagacttactccattcat

SEQ ID NO: 63008 - DNA, 20 bp, Artificial Sequence
  Description of Artificial Sequence: Synthetic oligonucleotide
  Target: ATXN1; (-) strand; PAM type: NRG; PAM sequence: TGG
tttcagacttactccattca

SEQ ID NO: 63009 - DNA, 20 bp, Artificial Sequence
  Description of Artificial Sequence: Synthetic oligonucleotide
  Target: ATXN1; (-) strand; PAM type: NRG; PAM sequence: CAG
atttgtttcagacaggcttt

SEQ ID NO: 63010 - DNA, 20 bp, Artificial Sequence
  Description of Artificial Sequence: Synthetic oligonucleotide
  Target: ATXN1; (-) strand; PAM type: NRG; PAM sequence: AGG
ttggcatatttgtttcagac

SEQ ID NO: 63011 - DNA, 20 bp, Artificial Sequence
  Description of Artificial Sequence: Synthetic oligonucleotide
  Target: ATXN1; (-) strand; PAM type: NRG; PAM sequence: CAG
tttggcatatttgtttcaga

SEQ ID NO: 63012 - DNA, 20 bp, Artificial Sequence
  Description of Artificial Sequence: Synthetic oligonucleotide
  Target: ATXN1; (-) strand; PAM type: NRG; PAM sequence: CAG
gaagtttggcatatttgttt

SEQ ID NO: 63013 - DNA, 20 bp, Artificial Sequence
  Description of Artificial Sequence: Synthetic oligonucleotide
  Target: ATXN1; (-) strand; PAM type: NRG; PAM sequence: TGG
aagagactcaaatagaagtt

SEQ ID NO: 63014 - DNA, 20 bp, Artificial Sequence
  Description of Artificial Sequence: Synthetic oligonucleotide
  Target: ATXN1; (-) strand; PAM type: NRG; PAM sequence: AAG
atggaaagagactcaaatag

SEQ ID NO: 63015 - DNA, 20 bp, Artificial Sequence
  Description of Artificial Sequence: Synthetic oligonucleotide
  Target: ATXN1; (-) strand; PAM type: NRG; PAM sequence: TAG
taaatggaaagagactcaaa

SEQ ID NO: 63016 - DNA, 20 bp, Artificial Sequence
  Description of Artificial Sequence: Synthetic oligonucleotide
  Target: ATXN1; (-) strand; PAM type: NRG; PAM sequence: GAG
ttggacattttaaatggaaa

SEQ ID NO: 63017 - DNA, 20 bp, Artificial Sequence
  Description of Artificial Sequence: Synthetic oligonucleotide
  Target: ATXN1; (-) strand; PAM type: NRG; PAM sequence: AAG
tcttggacattttaaatgga

SEQ ID NO: 63018 - DNA, 20 bp, Artificial Sequence
  Description of Artificial Sequence: Synthetic oligonucleotide
  Target: ATXN1; (-) strand; PAM type: NRG; PAM sequence: TGG
tttatcttggacattttaaa

SEQ ID NO: 63019 - DNA, 20 bp, Artificial Sequence
  Description of Artificial Sequence: Synthetic oligonucleotide
  Target: ATXN1; (-) strand; PAM type: NRG; PAM sequence: TGG
ggataaattacattttatct

SEQ ID NO: 63020 - DNA, 20 bp, Artificial Sequence
  Description of Artificial Sequence: Synthetic oligonucleotide
  Target: ATXN1; (-) strand; PAM type: NRG; PAM sequence: AGG
tgtttgtataagaagcttgt

SEQ ID NO: 63021 - DNA, 20 bp, Artificial Sequence
  Description of Artificial Sequence: Synthetic oligonucleotide
  Target: ATXN1; (-) strand; PAM type: NRG; PAM sequence: TAG
ttgtttgtataagaagcttg

SEQ ID NO: 63022 - DNA, 20 bp, Artificial Sequence
  Description of Artificial Sequence: Synthetic oligonucleotide
  Target: ATXN1; (-) strand; PAM type: NRG; PAM sequence: AAG
aatatttttgtttgtataag

SEQ ID NO: 63023 - DNA, 20 bp, Artificial Sequence
  Description of Artificial Sequence: Synthetic oligonucleotide
  Target: ATXN1; (-) strand; PAM type: NRG; PAM sequence: AAG
gttaatatttttgtttgtat

SEQ ID NO: 63024 - DNA, 20 bp, Artificial Sequence
  Description of Artificial Sequence: Synthetic oligonucleotide
  Target: ATXN1; (-) strand; PAM type: NRG; PAM sequence: TGG
atactctgagactttgaatg

SEQ ID NO: 63025 - DNA, 20 bp, Artificial Sequence
  Description of Artificial Sequence: Synthetic oligonucleotide
  Target: ATXN1; (-) strand; PAM type: NRG; PAM sequence: GAG
aaagtgaaggtttatactct

SEQ ID NO: 63026 - DNA, 20 bp, Artificial Sequence
  Description of Artificial Sequence: Synthetic oligonucleotide
  Target: ATXN1; (-) strand; PAM type: NRG; PAM sequence: AGG
aagttgccaggtcaaagtga

SEQ ID NO: 63027 - DNA, 20 bp, Artificial Sequence
  Description of Artificial Sequence: Synthetic oligonucleotide
  Target: ATXN1; (-) strand; PAM type: NRG; PAM sequence: AAG
aaagttgccaggtcaaagtg

SEQ ID NO: 63028 - DNA, 20 bp, Artificial Sequence
  Description of Artificial Sequence: Synthetic oligonucleotide
  Target: ATXN1; (-) strand; PAM type: NRG; PAM sequence: AAG
gtgtcaaagttgccaggtca

SEQ ID NO: 63029 - DNA, 20 bp, Artificial Sequence
  Description of Artificial Sequence: Synthetic oligonucleotide
  Target: ATXN1; (-) strand; PAM type: NRG; PAM sequence: AGG
ctgagtgtgtcaaagttgcc

SEQ ID NO: 63030 - DNA, 20 bp, Artificial Sequence
  Description of Artificial Sequence: Synthetic oligonucleotide
  Target: ATXN1; (-) strand; PAM type: NRG; PAM sequence: CAG
tctgagtgtgtcaaagttgc

SEQ ID NO: 63031 - DNA, 20 bp, Artificial Sequence
  Description of Artificial Sequence: Synthetic oligonucleotide
  Target: ATXN1; (-) strand; PAM type: NRG; PAM sequence: AAG
tctcctttctgagtgtgtca

SEQ ID NO: 63032 - DNA, 20 bp, Artificial Sequence
  Description of Artificial Sequence: Synthetic oligonucleotide
  Target: ATXN1; (-) strand; PAM type: NRG; PAM sequence: GAG
ttgttctctctctcctttct

SEQ ID NO: 63033 - DNA, 20 bp, Artificial Sequence
  Description of Artificial Sequence: Synthetic oligonucleotide
  Target: ATXN1; (-) strand; PAM type: NRG; PAM sequence: AAG
ttggacaccttggcttcagg

SEQ ID NO: 63034 - DNA, 20 bp, Artificial Sequence
  Description of Artificial Sequence: Synthetic oligonucleotide
  Target: ATXN1; (-) strand; PAM type: NRG; PAM sequence: AGG
atattggacaccttggcttc

SEQ ID NO: 63035 - DNA, 20 bp, Artificial Sequence
  Description of Artificial Sequence: Synthetic oligonucleotide
  Target: ATXN1; (-) strand; PAM type: NRG; PAM sequence: CAG
gatattggacaccttggctt

SEQ ID NO: 63036 - DNA, 20 bp, Artificial Sequence
  Description of Artificial Sequence: Synthetic oligonucleotide
  Target: ATXN1; (-) strand; PAM type: NRG; PAM sequence: TGG
tggcaagatattggacacct

SEQ ID NO: 63037 - DNA, 20 bp, Artificial Sequence
  Description of Artificial Sequence: Synthetic oligonucleotide
  Target: ATXN1; (-) strand; PAM type: NRG; PAM sequence: TGG
caggtccgatggcaagatat

SEQ ID NO: 63038 - DNA, 20 bp, Artificial Sequence
  Description of Artificial Sequence: Synthetic oligonucleotide
  Target: ATXN1; (-) strand; PAM type: NRG; PAM sequence: AAG
aatttcccaggtccgatggc

SEQ ID NO: 63039 - DNA, 20 bp, Artificial Sequence
  Description of Artificial Sequence: Synthetic oligonucleotide
  Target: ATXN1; (-) strand; PAM type: NRG; PAM sequence: TGG
gcgtaatttcccaggtccga

SEQ ID NO: 63040 - DNA, 20 bp, Artificial Sequence
  Description of Artificial Sequence: Synthetic oligonucleotide
  Target: ATXN1; (-) strand; PAM type: NRG; PAM sequence: AGG
acagcctggcgtaatttccc

SEQ ID NO: 63041 - DNA, 20 bp, Artificial Sequence
  Description of Artificial Sequence: Synthetic oligonucleotide
  Target: ATXN1; (-) strand; PAM type: NRG; PAM sequence: CAG
gacagcctggcgtaatttcc

SEQ ID NO: 63042 - DNA, 20 bp, Artificial Sequence
  Description of Artificial Sequence: Synthetic oligonucleotide
  Target: ATXN1; (-) strand; PAM type: NRG; PAM sequence: TGG
agaggatgaaactgacagcc

SEQ ID NO: 63043 - DNA, 20 bp, Artificial Sequence
  Description of Artificial Sequence: Synthetic oligonucleotide
  Target: ATXN1; (-) strand; PAM type: NRG; PAM sequence: CAG
taggcagaggatgaaactga

SEQ ID NO: 63044 - DNA, 20 bp, Artificial Sequence
  Description of Artificial Sequence: Synthetic oligonucleotide
  Target: ATXN1; (-) strand; PAM type: NRG; PAM sequence: AGG
tcattttctcctctaggcag

SEQ ID NO: 63045 - DNA, 20 bp, Artificial Sequence
  Description of Artificial Sequence: Synthetic oligonucleotide
  Target: ATXN1; (-) strand; PAM type: NRG; PAM sequence: GAG
gtcattttctcctctaggca

SEQ ID NO: 63046 - DNA, 20 bp, Artificial Sequence
  Description of Artificial Sequence: Synthetic oligonucleotide
  Target: ATXN1; (-) strand; PAM type: NRG; PAM sequence: CAG
gtgtcattttctcctctagg

SEQ ID NO: 63047 - DNA, 20 bp, Artificial Sequence
  Description of Artificial Sequence: Synthetic oligonucleotide
  Target: ATXN1; (-) strand; PAM type: NRG; PAM sequence: AGG
attgtgtcattttctcctct

SEQ ID NO: 63048 - DNA, 20 bp, Artificial Sequence
  Description of Artificial Sequence: Synthetic oligonucleotide
  Target: ATXN1; (-) strand; PAM type: NRG; PAM sequence: TAG
cattgtgtcattttctcctc

SEQ ID NO: 63049 - DNA, 20 bp, Artificial Sequence
  Description of Artificial Sequence: Synthetic oligonucleotide
  Target: ATXN1; (-) strand; PAM type: NRG; PAM sequence: TGG
cagtcaggggaaggagaaat

SEQ ID NO: 63050 - DNA, 20 bp, Artificial Sequence
  Description of Artificial Sequence: Synthetic oligonucleotide
  Target: ATXN1; (-) strand; PAM type: NRG; PAM sequence: GAG
ctgtgggcagtcaggggaag

SEQ ID NO: 63051 - DNA, 20 bp, Artificial Sequence
  Description of Artificial Sequence: Synthetic oligonucleotide
  Target: ATXN1; (-) strand; PAM type: NRG; PAM sequence: AGG
tgctgtgggcagtcagggga

SEQ ID NO: 63052 - DNA, 20 bp, Artificial Sequence
  Description of Artificial Sequence: Synthetic oligonucleotide
  Target: ATXN1; (-) strand; PAM type: NRG; PAM sequence: AAG
gtgctgtgggcagtcagggg

SEQ ID NO: 63053 - DNA, 20 bp, Artificial Sequence
  Description of Artificial Sequence: Synthetic oligonucleotide
  Target: ATXN1; (-) strand; PAM type: NRG; PAM sequence: GGG
taagtgctgtgggcagtcag

SEQ ID NO: 63054 - DNA, 20 bp, Artificial Sequence
  Description of Artificial Sequence: Synthetic oligonucleotide
  Target: ATXN1; (-) strand; PAM type: NRG; PAM sequence: GGG
gtaagtgctgtgggcagtca

SEQ ID NO: 63055 - DNA, 20 bp, Artificial Sequence
  Description of Artificial Sequence: Synthetic oligonucleotide
  Target: ATXN1; (-) strand; PAM type: NRG; PAM sequence: AGG
tgtaagtgctgtgggcagtc

SEQ ID NO: 63056 - DNA, 20 bp, Artificial Sequence
  Description of Artificial Sequence: Synthetic oligonucleotide
  Target: ATXN1; (-) strand; PAM type: NRG; PAM sequence: CAG
ctgtaagtgctgtgggcagt

SEQ ID NO: 63057 - DNA, 20 bp, Artificial Sequence
  Description of Artificial Sequence: Synthetic oligonucleotide
  Target: ATXN1; (-) strand; PAM type: NRG; PAM sequence: CAG
gagactgtaagtgctgtggg

SEQ ID NO: 63058 - DNA, 20 bp, Artificial Sequence
  Description of Artificial Sequence: Synthetic oligonucleotide
  Target: ATXN1; (-) strand; PAM type: NRG; PAM sequence: GGG
gtagagactgtaagtgctgt

SEQ ID NO: 63059 - DNA, 20 bp, Artificial Sequence
  Description of Artificial Sequence: Synthetic oligonucleotide
  Target: ATXN1; (-) strand; PAM type: NRG; PAM sequence: TGG
ggtagagactgtaagtgctg

SEQ ID NO: 63060 - DNA, 20 bp, Artificial Sequence
  Description of Artificial Sequence: Synthetic oligonucleotide
  Target: ATXN1; (-) strand; PAM type: NRG; PAM sequence: AAG
gaatgtgtggtagagactgt

SEQ ID NO: 63061 - DNA, 20 bp, Artificial Sequence
  Description of Artificial Sequence: Synthetic oligonucleotide
  Target: ATXN1; (-) strand; PAM type: NRG; PAM sequence: GAG
ttgggtcagaatgtgtggta

SEQ ID NO: 63062 - DNA, 20 bp, Artificial Sequence
  Description of Artificial Sequence: Synthetic oligonucleotide
  Target: ATXN1; (-) strand; PAM type: NRG; PAM sequence: TAG
ccttgggtcagaatgtgtgg

SEQ ID NO: 63063 - DNA, 20 bp, Artificial Sequence
  Description of Artificial Sequence: Synthetic oligonucleotide
  Target: ATXN1; (-) strand; PAM type: NRG; PAM sequence: TGG
ggaccttgggtcagaatgtg

SEQ ID NO: 63064 - DNA, 20 bp, Artificial Sequence
  Description of Artificial Sequence: Synthetic oligonucleotide
  Target: ATXN1; (-) strand; PAM type: NRG; PAM sequence: CAG
aactgaaaaggaccttgggt

SEQ ID NO: 63065 - DNA, 20 bp, Artificial Sequence
  Description of Artificial Sequence: Synthetic oligonucleotide
  Target: ATXN1; (-) strand; PAM type: NRG; PAM sequence: GGG
gctgaactgaaaaggacctt

SEQ ID NO: 63066 - DNA, 20 bp, Artificial Sequence
  Description of Artificial Sequence: Synthetic oligonucleotide
  Target: ATXN1; (-) strand; PAM type: NRG; PAM sequence: TGG
tgctgaactgaaaaggacct

SEQ ID NO: 63067 - DNA, 20 bp, Artificial Sequence
  Description of Artificial Sequence: Synthetic oligonucleotide
  Target: ATXN1; (-) strand; PAM type: NRG; PAM sequence: AGG
aacaaagtgctgaactgaaa

SEQ ID NO: 63068 - DNA, 20 bp, Artificial Sequence
  Description of Artificial Sequence: Synthetic oligonucleotide
  Target: ATXN1; (-) strand; PAM type: NRG; PAM sequence: AAG
taacaaagtgctgaactgaa

SEQ ID NO: 63069 - DNA, 20 bp, Artificial Sequence
  Description of Artificial Sequence: Synthetic oligonucleotide
  Target: ATXN1; (-) strand; PAM type: NRG; PAM sequence: AAG
tataaaaagacagtataaca

SEQ ID NO: 63070 - DNA, 20 bp, Artificial Sequence
  Description of Artificial Sequence: Synthetic oligonucleotide
  Target: ATXN1; (-) strand; PAM type: NRG; PAM sequence: CAG
tccagtggagtataaaaaga

SEQ ID NO: 63071 - DNA, 20 bp, Artificial Sequence
  Description of Artificial Sequence: Synthetic oligonucleotide
  Target: ATXN1; (-) strand; PAM type: NRG; PAM sequence: AAG
taaatccagtggagtataaa

SEQ ID NO: 63072 - DNA, 20 bp, Artificial Sequence
  Description of Artificial Sequence: Synthetic oligonucleotide
  Target: ATXN1; (-) strand; PAM type: NRG; PAM sequence: GAG
agacttaaataaatccagtg

SEQ ID NO: 63073 - DNA, 20 bp, Artificial Sequence
  Description of Artificial Sequence: Synthetic oligonucleotide
  Target: ATXN1; (-) strand; PAM type: NRG; PAM sequence: TGG
caagacttaaataaatccag

SEQ ID NO: 63074 - DNA, 20 bp, Artificial Sequence
  Description of Artificial Sequence: Synthetic oligonucleotide
  Target: ATXN1; (-) strand; PAM type: NRG; PAM sequence: CAG
cttcaagacttaaataaatc

SEQ ID NO: 63075 - DNA, 20 bp, Artificial Sequence
  Description of Artificial Sequence: Synthetic oligonucleotide
  Target: ATXN1; (-) strand; PAM type: NRG; PAM sequence: AAG
tagaaactttttgagccttc

SEQ ID NO: 63076 - DNA, 20 bp, Artificial Sequence
  Description of Artificial Sequence: Synthetic oligonucleotide
  Target: ATXN1; (-) strand; PAM type: NRG; PAM sequence: GAG
agagagcttagaaacttttt

SEQ ID NO: 63077 - DNA, 20 bp, Artificial Sequence
  Description of Artificial Sequence: Synthetic oligonucleotide
  Target: ATXN1; (-) strand; PAM type: NRG; PAM sequence: TAG
gtttctttcatcagagagct

SEQ ID NO: 63078 - DNA, 20 bp, Artificial Sequence
  Description of Artificial Sequence: Synthetic oligonucleotide
  Target: ATXN1; (-) strand; PAM type: NRG; PAM sequence: GAG
gcaaggtttctttcatcaga

SEQ ID NO: 63079 - DNA, 20 bp, Artificial Sequence
  Description of Artificial Sequence: Synthetic oligonucleotide
  Target: ATXN1; (-) strand; PAM type: NRG; PAM sequence: GAG
tggcaaggtttctttcatca

SEQ ID NO: 63080 - DNA, 20 bp, Artificial Sequence
  Description of Artificial Sequence: Synthetic oligonucleotide
  Target: ATXN1; (-) strand; PAM type: NRG; PAM sequence: CAG
catggcaaggtttctttcat

SEQ ID NO: 63081 - DNA, 20 bp, Artificial Sequence
  Description of Artificial Sequence: Synthetic oligonucleotide
  Target: ATXN1; (-) strand; PAM type: NRG; PAM sequence: AGG
tgcaaaagaagggcatggca

SEQ ID NO: 63082 - DNA, 20 bp, Artificial Sequence
  Description of Artificial Sequence: Synthetic oligonucleotide
  Target: ATXN1; (-) strand; PAM type: NRG; PAM sequence: AAG
ttgcaaaagaagggcatggc

SEQ ID NO: 63083 - DNA, 20 bp, Artificial Sequence
  Description of Artificial Sequence: Synthetic oligonucleotide
  Target: ATXN1; (-) strand; PAM type: NRG; PAM sequence: TGG
gaggttgcaaaagaagggca

SEQ ID NO: 63084 - DNA, 20 bp, Artificial Sequence
  Description of Artificial Sequence: Synthetic oligonucleotide
  Target: ATXN1; (-) strand; PAM type: NRG; PAM sequence: GGG
gttaggaggttgcaaaagaa

SEQ ID NO: 63085 - DNA, 20 bp, Artificial Sequence
  Description of Artificial Sequence: Synthetic oligonucleotide
  Target: ATXN1; (-) strand; PAM type: NRG; PAM sequence: AGG
tgttaggaggttgcaaaaga

SEQ ID NO: 63086 - DNA, 20 bp, Artificial Sequence
  Description of Artificial Sequence: Synthetic oligonucleotide
  Target: ATXN1; (-) strand; PAM type: NRG; PAM sequence: AAG
ctgttaggaggttgcaaaag

SEQ ID NO: 63087 - DNA, 20 bp, Artificial Sequence
  Description of Artificial Sequence: Synthetic oligonucleotide
  Target: ATXN1; (-) strand; PAM type: NRG; PAM sequence: AAG
atgctgttaggaggttgcaa

SEQ ID NO: 63088 - DNA, 20 bp, Artificial Sequence
  Description of Artificial Sequence: Synthetic oligonucleotide
  Target: ATXN1; (-) strand; PAM type: NRG; PAM sequence: AGG
ttccactagatgctgttagg

SEQ ID NO: 63089 - DNA, 20 bp, Artificial Sequence
  Description of Artificial Sequence: Synthetic oligonucleotide
  Target: ATXN1; (-) strand; PAM type: NRG; PAM sequence: GAG
cttccactagatgctgttag

SEQ ID NO: 63090 - DNA, 20 bp, Artificial Sequence
  Description of Artificial Sequence: Synthetic oligonucleotide
  Target: ATXN1; (-) strand; PAM type: NRG; PAM sequence: AGG
ctcttccactagatgctgtt

SEQ ID NO: 63091 - DNA, 20 bp, Artificial Sequence
  Description of Artificial Sequence: Synthetic oligonucleotide
  Target: ATXN1; (-) strand; PAM type: NRG; PAM sequence: TAG
gctcttccactagatgctgt

SEQ ID NO: 63092 - DNA, 20 bp, Artificial Sequence
  Description of Artificial Sequence: Synthetic oligonucleotide
  Target: ATXN1; (-) strand; PAM type: NRG; PAM sequence: TAG
ttaaatccaggctcttccac

SEQ ID NO: 63093 - DNA, 20 bp, Artificial Sequence
  Description of Artificial Sequence: Synthetic oligonucleotide
  Target: ATXN1; (-) strand; PAM type: NRG; PAM sequence: AGG
ggatcatttaagttaaatcc

SEQ ID NO: 63094 - DNA, 20 bp, Artificial Sequence
  Description of Artificial Sequence: Synthetic oligonucleotide
  Target: ATXN1; (-) strand; PAM type: NRG; PAM sequence: CAG
tggatcatttaagttaaatc

SEQ ID NO: 63095 - DNA, 20 bp, Artificial Sequence
  Description of Artificial Sequence: Synthetic oligonucleotide
  Target: ATXN1; (-) strand; PAM type: NRG; PAM sequence: AAG
gttttggatatggatcattt

SEQ ID NO: 63096 - DNA, 20 bp, Artificial Sequence
  Description of Artificial Sequence: Synthetic oligonucleotide
  Target: ATXN1; (-) strand; PAM type: NRG; PAM sequence: TGG
cctagaacaggttttggata

SEQ ID NO: 63097 - DNA, 20 bp, Artificial Sequence
  Description of Artificial Sequence: Synthetic oligonucleotide
  Target: ATXN1; (-) strand; PAM type: NRG; PAM sequence: TGG
ttaagtcctagaacaggttt

SEQ ID NO: 63098 - DNA, 20 bp, Artificial Sequence
  Description of Artificial Sequence: Synthetic oligonucleotide
  Target: ATXN1; (-) strand; PAM type: NRG; PAM sequence: AGG
taagggttaagtcctagaac

SEQ ID NO: 63099 - DNA, 20 bp, Artificial Sequence
  Description of Artificial Sequence: Synthetic oligonucleotide
  Target: ATXN1; (-) strand; PAM type: NRG; PAM sequence: CAG
gtaagggttaagtcctagaa

SEQ ID NO: 63100 - DNA, 20 bp, Artificial Sequence
  Description of Artificial Sequence: Synthetic oligonucleotide
  Target: ATXN1; (-) strand; PAM type: NRG; PAM sequence: TAG
ttggagtaagggttaagtcc

SEQ ID NO: 63101 - DNA, 20 bp, Artificial Sequence
  Description of Artificial Sequence: Synthetic oligonucleotide
  Target: ATXN1; (-) strand; PAM type: NRG; PAM sequence: AAG
attcttttggagtaagggtt

SEQ ID NO: 63102 - DNA, 20 bp, Artificial Sequence
  Description of Artificial Sequence: Synthetic oligonucleotide
  Target: ATXN1; (-) strand; PAM type: NRG; PAM sequence: GGG
tggtgattcttttggagtaa

SEQ ID NO: 63103 - DNA, 20 bp, Artificial Sequence
  Description of Artificial Sequence: Synthetic oligonucleotide
  Target: ATXN1; (-) strand; PAM type: NRG; PAM sequence: AGG
ctggtgattcttttggagta

SEQ ID NO: 63104 - DNA, 20 bp, Artificial Sequence
  Description of Artificial Sequence: Synthetic oligonucleotide
  Target: ATXN1; (-) strand; PAM type: NRG; PAM sequence: AAG
actggtgattcttttggagt

SEQ ID NO: 63105 - DNA, 20 bp, Artificial Sequence
  Description of Artificial Sequence: Synthetic oligonucleotide
  Target: ATXN1; (-) strand; PAM type: NRG; PAM sequence: GAG
gtagactggtgattcttttg

SEQ ID NO: 63106 - DNA, 20 bp, Artificial Sequence
  Description of Artificial Sequence: Synthetic oligonucleotide
  Target: ATXN1; (-) strand; PAM type: NRG; PAM sequence: TGG
ctgtagactggtgattcttt

SEQ ID NO: 63107 - DNA, 20 bp, Artificial Sequence
  Description of Artificial Sequence: Synthetic oligonucleotide
  Target: ATXN1; (-) strand; PAM type: NRG; PAM sequence: TGG
cttaaagcatagctgtagac

SEQ ID NO: 63108 - DNA, 20 bp, Artificial Sequence
  Description of Artificial Sequence: Synthetic oligonucleotide
  Target: ATXN1; (-) strand; PAM type: NRG; PAM sequence: TAG
atgggcttaaagcatagctg

SEQ ID NO: 63109 - DNA, 20 bp, Artificial Sequence
  Description of Artificial Sequence: Synthetic oligonucleotide
  Target: ATXN1; (-) strand; PAM type: NRG; PAM sequence: TAG
ggtgaaatgggcttaaagca

SEQ ID NO: 63110 - DNA, 20 bp, Artificial Sequence
  Description of Artificial Sequence: Synthetic oligonucleotide
  Target: ATXN1; (-) strand; PAM type: NRG; PAM sequence: AAG
agaaaggtgaaatgggctta

SEQ ID NO: 63111 - DNA, 20 bp, Artificial Sequence
  Description of Artificial Sequence: Synthetic oligonucleotide
  Target: ATXN1; (-) strand; PAM type: NRG; PAM sequence: GGG
aagacagagaaaggtgaaat

SEQ ID NO: 63112 - DNA, 20 bp, Artificial Sequence
  Description of Artificial Sequence: Synthetic oligonucleotide
  Target: ATXN1; (-) strand; PAM type: NRG; PAM sequence: TGG
gaagacagagaaaggtgaaa

SEQ ID NO: 63113 - DNA, 20 bp, Artificial Sequence
  Description of Artificial Sequence: Synthetic oligonucleotide
  Target: ATXN1; (-) strand; PAM type: NRG; PAM sequence: AGG
agtccctggaagacagagaa

SEQ ID NO: 63114 - DNA, 20 bp, Artificial Sequence
  Description of Artificial Sequence: Synthetic oligonucleotide
  Target: ATXN1; (-) strand; PAM type: NRG; PAM sequence: AAG
aagtccctggaagacagaga

SEQ ID NO: 63115 - DNA, 20 bp, Artificial Sequence
  Description of Artificial Sequence: Synthetic oligonucleotide
  Target: ATXN1; (-) strand; PAM type: NRG; PAM sequence: GAG
tttcaagtccctggaagaca

SEQ ID NO: 63116 - DNA, 20 bp, Artificial Sequence
  Description of Artificial Sequence: Synthetic oligonucleotide
  Target: ATXN1; (-) strand; PAM type: NRG; PAM sequence: CAG
actttcaagtccctggaaga

SEQ ID NO: 63117 - DNA, 20 bp, Artificial Sequence
  Description of Artificial Sequence: Synthetic oligonucleotide
  Target: ATXN1; (-) strand; PAM type: NRG; PAM sequence: AAG
tcagactttcaagtccctgg

SEQ ID NO: 63118 - DNA, 20 bp, Artificial Sequence
  Description of Artificial Sequence: Synthetic oligonucleotide
  Target: ATXN1; (-) strand; PAM type: NRG; PAM sequence: TGG
tcatcagactttcaagtccc

SEQ ID NO: 63119 - DNA, 20 bp, Artificial Sequence
  Description of Artificial Sequence: Synthetic oligonucleotide
  Target: ATXN1; (-) strand; PAM type: NRG; PAM sequence: AAG
ataggcatcatcagactttc

SEQ ID NO: 63120 - DNA, 20 bp, Artificial Sequence
  Description of Artificial Sequence: Synthetic oligonucleotide
  Target: ATXN1; (-) strand; PAM type: NRG; PAM sequence: CAG
atgatgatgataggcatcat

SEQ ID NO: 63121 - DNA, 20 bp, Artificial Sequence
  Description of Artificial Sequence: Synthetic oligonucleotide
  Target: ATXN1; (-) strand; PAM type: NRG; PAM sequence: AGG
ggctgacacatgatgatgat

SEQ ID NO: 63122 - DNA, 20 bp, Artificial Sequence
  Description of Artificial Sequence: Synthetic oligonucleotide
  Target: ATXN1; (-) strand; PAM type: NRG; PAM sequence: TAG
gggctgacacatgatgatga

SEQ ID NO: 63123 - DNA, 20 bp, Artificial Sequence
  Description of Artificial Sequence: Synthetic oligonucleotide
  Target: ATXN1; (-) strand; PAM type: NRG; PAM sequence: GGG
attttttttgagtttgtgga

SEQ ID NO: 63124 - DNA, 20 bp, Artificial Sequence
  Description of Artificial Sequence: Synthetic oligonucleotide
  Target: ATXN1; (-) strand; PAM type: NRG; PAM sequence: AGG
aattttttttgagtttgtgg

SEQ ID NO: 63125 - DNA, 20 bp, Artificial Sequence
  Description of Artificial Sequence: Synthetic oligonucleotide
  Target: ATXN1; (-) strand; PAM type: NRG; PAM sequence: GAG
taattttttttgagtttgtg

SEQ ID NO: 63126 - DNA, 20 bp, Artificial Sequence
  Description of Artificial Sequence: Synthetic oligonucleotide
  Target: ATXN1; (-) strand; PAM type: NRG; PAM sequence: TGG
tttaattttttttgagtttg

SEQ ID NO: 63127 - DNA, 20 bp, Artificial Sequence
  Description of Artificial Sequence: Synthetic oligonucleotide
  Target: ATXN1; (-) strand; PAM type: NRG; PAM sequence: GAG
gttgtaatttaatttttttt

SEQ ID NO: 63128 - DNA, 20 bp, Artificial Sequence
  Description of Artificial Sequence: Synthetic oligonucleotide
  Target: ATXN1; (-) strand; PAM type: NRG; PAM sequence: AAG
aagaacagaatagaaaggct

SEQ ID NO: 63129 - DNA, 20 bp, Artificial Sequence
  Description of Artificial Sequence: Synthetic oligonucleotide
  Target: ATXN1; (-) strand; PAM type: NRG; PAM sequence: AGG
attggaagaacagaatagaa

SEQ ID NO: 63130 - DNA, 20 bp, Artificial Sequence
  Description of Artificial Sequence: Synthetic oligonucleotide
  Target: ATXN1; (-) strand; PAM type: NRG; PAM sequence: AAG
gattggaagaacagaataga

SEQ ID NO: 63131 - DNA, 20 bp, Artificial Sequence
  Description of Artificial Sequence: Synthetic oligonucleotide
  Target: ATXN1; (-) strand; PAM type: NRG; PAM sequence: TAG
aatggattggaagaacagaa

SEQ ID NO: 63132 - DNA, 20 bp, Artificial Sequence
  Description of Artificial Sequence: Synthetic oligonucleotide
  Target: ATXN1; (-) strand; PAM type: NRG; PAM sequence: CAG
gatgtaatggattggaagaa

SEQ ID NO: 63133 - DNA, 20 bp, Artificial Sequence
  Description of Artificial Sequence: Synthetic oligonucleotide
  Target: ATXN1; (-) strand; PAM type: NRG; PAM sequence: AAG
cttaagatgtaatggattgg

SEQ ID NO: 63134 - DNA, 20 bp, Artificial Sequence
  Description of Artificial Sequence: Synthetic oligonucleotide
  Target: ATXN1; (-) strand; PAM type: NRG; PAM sequence: TGG
tgacttaagatgtaatggat

SEQ ID NO: 63135 - DNA, 20 bp, Artificial Sequence
  Description of Artificial Sequence: Synthetic oligonucleotide
  Target: ATXN1; (-) strand; PAM type: NRG; PAM sequence: TGG
actaatgacttaagatgtaa

SEQ ID NO: 63136 - DNA, 20 bp, Artificial Sequence
  Description of Artificial Sequence: Synthetic oligonucleotide
  Target: ATXN1; (-) strand; PAM type: NRG; PAM sequence: AAG
tcaaattccactaatgactt

SEQ ID NO: 63137 - DNA, 20 bp, Artificial Sequence
  Description of Artificial Sequence: Synthetic oligonucleotide
  Target: ATXN1; (-) strand; PAM type: NRG; PAM sequence: GAG
gagtttgtaaatcttgaaag

SEQ ID NO: 63138 - DNA, 20 bp, Artificial Sequence
  Description of Artificial Sequence: Synthetic oligonucleotide
  Target: ATXN1; (-) strand; PAM type: NRG; PAM sequence: AGG
gggagtttgtaaatcttgaa

SEQ ID NO: 63139 - DNA, 20 bp, Artificial Sequence
  Description of Artificial Sequence: Synthetic oligonucleotide
  Target: ATXN1; (-) strand; PAM type: NRG; PAM sequence: AAG
ggggagtttgtaaatcttga

SEQ ID NO: 63140 - DNA, 20 bp, Artificial Sequence
  Description of Artificial Sequence: Synthetic oligonucleotide
  Target: ATXN1; (-) strand; PAM type: NRG; PAM sequence: GAG
ctggtgatgaggaaatgggg

SEQ ID NO: 63141 - DNA, 20 bp, Artificial Sequence
  Description of Artificial Sequence: Synthetic oligonucleotide
  Target: ATXN1; (-) strand; PAM type: NRG; PAM sequence: GGG
tgctggtgatgaggaaatgg

SEQ ID NO: 63142 - DNA, 20 bp, Artificial Sequence
  Description of Artificial Sequence: Synthetic oligonucleotide
  Target: ATXN1; (-) strand; PAM type: NRG; PAM sequence: GGG
ctgctggtgatgaggaaatg

SEQ ID NO: 63143 - DNA, 20 bp, Artificial Sequence
  Description of Artificial Sequence: Synthetic oligonucleotide
  Target: ATXN1; (-) strand; PAM type: NRG; PAM sequence: GGG
gctgctggtgatgaggaaat

SEQ ID NO: 63144 - DNA, 20 bp, Artificial Sequence
  Description of Artificial Sequence: Synthetic oligonucleotide
  Target: ATXN1; (-) strand; PAM type: NRG; PAM sequence: TGG
agctgctggtgatgaggaaa

SEQ ID NO: 63145 - DNA, 20 bp, Artificial Sequence
  Description of Artificial Sequence: Synthetic oligonucleotide
  Target: ATXN1; (-) strand; PAM type: NRG; PAM sequence: AGG
gatgtaagctgctggtgatg

SEQ ID NO: 63146 - DNA, 20 bp, Artificial Sequence
  Description of Artificial Sequence: Synthetic oligonucleotide
  Target: ATXN1; (-) strand; PAM type: NRG; PAM sequence: GAG
tgatgtaagctgctggtgat

SEQ ID NO: 63147 - DNA, 20 bp, Artificial Sequence
  Description of Artificial Sequence: Synthetic oligonucleotide
  Target: ATXN1; (-) strand; PAM type: NRG; PAM sequence: TGG
gagctagtgatgtaagctgc

SEQ ID NO: 63148 - DNA, 20 bp, Artificial Sequence
  Description of Artificial Sequence: Synthetic oligonucleotide
  Target: ATXN1; (-) strand; PAM type: NRG; PAM sequence: AAG
gctatgagagctagtgatgt

SEQ ID NO: 63149 - DNA, 20 bp, Artificial Sequence
  Description of Artificial Sequence: Synthetic oligonucleotide
  Target: ATXN1; (-) strand; PAM type: NRG; PAM sequence: TAG
ctttgagaagctatgagagc

SEQ ID NO: 63150 - DNA, 20 bp, Artificial Sequence
  Description of Artificial Sequence: Synthetic oligonucleotide
  Target: ATXN1; (-) strand; PAM type: NRG; PAM sequence: GAG
gtggctttgagaagctatga

SEQ ID NO: 63151 - DNA, 20 bp, Artificial Sequence
  Description of Artificial Sequence: Synthetic oligonucleotide
  Target: ATXN1; (-) strand; PAM type: NRG; PAM sequence: GAG
tagtggctttgagaagctat

SEQ ID NO: 63152 - DNA, 20 bp, Artificial Sequence
  Description of Artificial Sequence: Synthetic oligonucleotide
  Target: ATXN1; (-) strand; PAM type: NRG; PAM sequence: AAG
tccttaatagtggctttgag

SEQ ID NO: 63153 - DNA, 20 bp, Artificial Sequence
  Description of Artificial Sequence: Synthetic oligonucleotide
  Target: ATXN1; (-) strand; PAM type: NRG; PAM sequence: GAG
gtttccttaatagtggcttt

SEQ ID NO: 63154 - DNA, 20 bp, Artificial Sequence
  Description of Artificial Sequence: Synthetic oligonucleotide
  Target: ATXN1; (-) strand; PAM type: NRG; PAM sequence: TGG
catgaaggtttccttaatag

SEQ ID NO: 63155 - DNA, 20 bp, Artificial Sequence
  Description of Artificial Sequence: Synthetic oligonucleotide
  Target: ATXN1; (-) strand; PAM type: NRG; PAM sequence: TAG
tgccatgaaggtttccttaa

SEQ ID NO: 63156 - DNA, 20 bp, Artificial Sequence
  Description of Artificial Sequence: Synthetic oligonucleotide
  Target: ATXN1; (-) strand; PAM type: NRG; PAM sequence: AGG
ctcccctccacatgccatga

SEQ ID NO: 63157 - DNA, 20 bp, Artificial Sequence
  Description of Artificial Sequence: Synthetic oligonucleotide
  Target: ATXN1; (-) strand; PAM type: NRG; PAM sequence: AAG
tctcccctccacatgccatg

SEQ ID NO: 63158 - DNA, 20 bp, Artificial Sequence
  Description of Artificial Sequence: Synthetic oligonucleotide
  Target: ATXN1; (-) strand; PAM type: NRG; PAM sequence: AGG
tttgaatatcactgcctcag

SEQ ID NO: 63159 - DNA, 20 bp, Artificial Sequence
  Description of Artificial Sequence: Synthetic oligonucleotide
  Target: ATXN1; (-) strand; PAM type: NRG; PAM sequence: GAG
gtttgaatatcactgcctca

SEQ ID NO: 63160 - DNA, 20 bp, Artificial Sequence
  Description of Artificial Sequence: Synthetic oligonucleotide
  Target: ATXN1; (-) strand; PAM type: NRG; PAM sequence: CAG
aagtttgaatatcactgcct

SEQ ID NO: 63161 - DNA, 20 bp, Artificial Sequence
  Description of Artificial Sequence: Synthetic oligonucleotide
  Target: ATXN1; (-) strand; PAM type: NRG; PAM sequence: AAG
gccatttctgatgctgcttc

SEQ ID NO: 63162 - DNA, 20 bp, Artificial Sequence
  Description of Artificial Sequence: Synthetic oligonucleotide
  Target: ATXN1; (-) strand; PAM type: NRG; PAM sequence: CAG
ccactgcacctggccttctc

SEQ ID NO: 63163 - DNA, 20 bp, Artificial Sequence
  Description of Artificial Sequence: Synthetic oligonucleotide
  Target: ATXN1; (-) strand; PAM type: NRG; PAM sequence: TGG
caggtgtgagccactgcacc

SEQ ID NO: 63164 - DNA, 20 bp, Artificial Sequence
  Description of Artificial Sequence: Synthetic oligonucleotide
  Target: ATXN1; (-) strand; PAM type: NRG; PAM sequence: GAG
agtgctgggattacaggtgt

SEQ ID NO: 63165 - DNA, 20 bp, Artificial Sequence
  Description of Artificial Sequence: Synthetic oligonucleotide
  Target: ATXN1; (-) strand; PAM type: NRG; PAM sequence: AGG
tcccaaagtgctgggattac

SEQ ID NO: 63166 - DNA, 20 bp, Artificial Sequence
  Description of Artificial Sequence: Synthetic oligonucleotide
  Target: ATXN1; (-) strand; PAM type: NRG; PAM sequence: CAG
ctcccaaagtgctgggatta

SEQ ID NO: 63167 - DNA, 20 bp, Artificial Sequence
  Description of Artificial Sequence: Synthetic oligonucleotide
  Target: ATXN1; (-) strand; PAM type: NRG; PAM sequence: GGG
cctcagcctcccaaagtgct

SEQ ID NO: 63168 - DNA, 20 bp, Artificial Sequence
  Description of Artificial Sequence: Synthetic oligonucleotide
  Target: ATXN1; (-) strand; PAM type: NRG; PAM sequence: TGG
gcctcagcctcccaaagtgc

SEQ ID NO: 63169 - DNA, 20 bp, Artificial Sequence
  Description of Artificial Sequence: Synthetic oligonucleotide
  Target: ATXN1; (-) strand; PAM type: NRG; PAM sequence: AAG
cttcctgcctcagcctccca

SEQ ID NO: 63170 - DNA, 20 bp, Artificial Sequence
  Description of Artificial Sequence: Synthetic oligonucleotide
  Target: ATXN1; (-) strand; PAM type: NRG; PAM sequence: CAG
ctcaagccaccttcctgcct

SEQ ID NO: 63171 - DNA, 20 bp, Artificial Sequence
  Description of Artificial Sequence: Synthetic oligonucleotide
  Target: ATXN1; (-) strand; PAM type: NRG; PAM sequence: AAG
agccttgaactcctgagctc

SEQ ID NO: 63172 - DNA, 20 bp, Artificial Sequence
  Description of Artificial Sequence: Synthetic oligonucleotide
  Target: ATXN1; (-) strand; PAM type: NRG; PAM sequence: GAG
cattgcagccttgaactcct

SEQ ID NO: 63173 - DNA, 20 bp, Artificial Sequence
  Description of Artificial Sequence: Synthetic oligonucleotide
  Target: ATXN1; (-) strand; PAM type: NRG; PAM sequence: CAG
ggcgtgatcatagtgcattg

SEQ ID NO: 63174 - DNA, 20 bp, Artificial Sequence
  Description of Artificial Sequence: Synthetic oligonucleotide
  Target: ATXN1; (-) strand; PAM type: NRG; PAM sequence: TAG
ggggtacagtggcgtgatca

SEQ ID NO: 63175 - DNA, 20 bp, Artificial Sequence
  Description of Artificial Sequence: Synthetic oligonucleotide
  Target: ATXN1; (-) strand; PAM type: NRG; PAM sequence: TGG
tcgcccaggctggggtacag

SEQ ID NO: 63176 - DNA, 20 bp, Artificial Sequence
  Description of Artificial Sequence: Synthetic oligonucleotide
  Target: ATXN1; (-) strand; PAM type: NRG; PAM sequence: CAG
ctttcgcccaggctggggta

SEQ ID NO: 63177 - DNA, 20 bp, Artificial Sequence
  Description of Artificial Sequence: Synthetic oligonucleotide
  Target: ATXN1; (-) strand; PAM type: NRG; PAM sequence: GGG
ttgttctttcgcccaggctg

SEQ ID NO: 63178 - DNA, 20 bp, Artificial Sequence
  Description of Artificial Sequence: Synthetic oligonucleotide
  Target: ATXN1; (-) strand; PAM type: NRG; PAM sequence: GGG
cttgttctttcgcccaggct

SEQ ID NO: 63179 - DNA, 20 bp, Artificial Sequence
  Description of Artificial Sequence: Synthetic oligonucleotide
  Target: ATXN1; (-) strand; PAM type: NRG; PAM sequence: TGG
tcttgttctttcgcccaggc

SEQ ID NO: 63180 - DNA, 20 bp, Artificial Sequence
  Description of Artificial Sequence: Synthetic oligonucleotide
  Target: ATXN1; (-) strand; PAM type: NRG; PAM sequence: AGG
ggagtcttgttctttcgccc

SEQ ID NO: 63181 - DNA, 20 bp, Artificial Sequence
  Description of Artificial Sequence: Synthetic oligonucleotide
  Target: ATXN1; (-) strand; PAM type: NRG; PAM sequence: CAG
cggagtcttgttctttcgcc

SEQ ID NO: 63182 - DNA, 20 bp, Artificial Sequence
  Description of Artificial Sequence: Synthetic oligonucleotide
  Target: ATXN1; (-) strand; PAM type: NRG; PAM sequence: GAG
tctttcctttttttgagtcg

SEQ ID NO: 63183 - DNA, 20 bp, Artificial Sequence
  Description of Artificial Sequence: Synthetic oligonucleotide
  Target: ATXN1; (-) strand; PAM type: NRG; PAM sequence: CGG
tttctttcctttttttgagt

SEQ ID NO: 63184 - DNA, 20 bp, Artificial Sequence
  Description of Artificial Sequence: Synthetic oligonucleotide
  Target: ATXN1; (-) strand; PAM type: NRG; PAM sequence: GAG
ttcgtttctttccttttttt

SEQ ID NO: 63185 - DNA, 20 bp, Artificial Sequence
  Description of Artificial Sequence: Synthetic oligonucleotide
  Target: ATXN1; (-) strand; PAM type: NRG; PAM sequence: TAG
tctgatttaacaagaccctc

SEQ ID NO: 63186 - DNA, 20 bp, Artificial Sequence
  Description of Artificial Sequence: Synthetic oligonucleotide
  Target: ATXN1; (-) strand; PAM type: NRG; PAM sequence: AAG
ttagcattctctgatttaac

SEQ ID NO: 63187 - DNA, 20 bp, Artificial Sequence
  Description of Artificial Sequence: Synthetic oligonucleotide
  Target: ATXN1; (-) strand; PAM type: NRG; PAM sequence: TAG
gaaattctacagatgggtct

SEQ ID NO: 63188 - DNA, 20 bp, Artificial Sequence
  Description of Artificial Sequence: Synthetic oligonucleotide
  Target: ATXN1; (-) strand; PAM type: NRG; PAM sequence: GGG
gaatcagaaattctacagat

SEQ ID NO: 63189 - DNA, 20 bp, Artificial Sequence
  Description of Artificial Sequence: Synthetic oligonucleotide
  Target: ATXN1; (-) strand; PAM type: NRG; PAM sequence: TGG
tgaatcagaaattctacaga

SEQ ID NO: 63190 - DNA, 20 bp, Artificial Sequence
  Description of Artificial Sequence: Synthetic oligonucleotide
  Target: ATXN1; (-) strand; PAM type: NRG; PAM sequence: CAG
ctactgaatcagaaattcta

SEQ ID NO: 63191 - DNA, 20 bp, Artificial Sequence
  Description of Artificial Sequence: Synthetic oligonucleotide
  Target: ATXN1; (-) strand; PAM type: NRG; PAM sequence: CAG
ccaccccaagcctactgaat

SEQ ID NO: 63192 - DNA, 20 bp, Artificial Sequence
  Description of Artificial Sequence: Synthetic oligonucleotide
  Target: ATXN1; (-) strand; PAM type: NRG; PAM sequence: AAG
aaattatctgaccccacccc

SEQ ID NO: 63193 - DNA, 20 bp, Artificial Sequence
  Description of Artificial Sequence: Synthetic oligonucleotide
  Target: ATXN1; (-) strand; PAM type: NRG; PAM sequence: CAG
agcatcacctgggaacttgt

SEQ ID NO: 63194 - DNA, 20 bp, Artificial Sequence
  Description of Artificial Sequence: Synthetic oligonucleotide
  Target: ATXN1; (-) strand; PAM type: NRG; PAM sequence: GGG
cagcagtatcagcatcacct

SEQ ID NO: 63195 - DNA, 20 bp, Artificial Sequence
  Description of Artificial Sequence: Synthetic oligonucleotide
  Target: ATXN1; (-) strand; PAM type: NRG; PAM sequence: TGG
ccagcagtatcagcatcacc

SEQ ID NO: 63196 - DNA, 20 bp, Artificial Sequence
  Description of Artificial Sequence: Synthetic oligonucleotide
  Target: ATXN1; (-) strand; PAM type: NRG; PAM sequence: CAG
ggtccctggaccagcagtat

SEQ ID NO: 63197 - DNA, 20 bp, Artificial Sequence
  Description of Artificial Sequence: Synthetic oligonucleotide
  Target: ATXN1; (-) strand; PAM type: NRG; PAM sequence: CAG
aagtctggtccctggaccag

SEQ ID NO: 63198 - DNA, 20 bp, Artificial Sequence
  Description of Artificial Sequence: Synthetic oligonucleotide
  Target: ATXN1; (-) strand; PAM type: NRG; PAM sequence: CAG
tcaaagtctggtccctggac

SEQ ID NO: 63199 - DNA, 20 bp, Artificial Sequence
  Description of Artificial Sequence: Synthetic oligonucleotide
  Target: ATXN1; (-) strand; PAM type: NRG; PAM sequence: TGG
ggttctcaaagtctggtccc

SEQ ID NO: 63200 - DNA, 20 bp, Artificial Sequence
  Description of Artificial Sequence: Synthetic oligonucleotide
  Target: ATXN1; (-) strand; PAM type: NRG; PAM sequence: TGG
gagaagtggttctcaaagtc

SEQ ID NO: 63201 - DNA, 20 bp, Artificial Sequence
  Description of Artificial Sequence: Synthetic oligonucleotide
  Target: ATXN1; (-) strand; PAM type: NRG; PAM sequence: AAG
ccttagagaagtggttctca

SEQ ID NO: 63202 - DNA, 20 bp, Artificial Sequence
  Description of Artificial Sequence: Synthetic oligonucleotide
  Target: ATXN1; (-) strand; PAM type: NRG; PAM sequence: TGG
aacatttaaccttagagaag

SEQ ID NO: 63203 - DNA, 20 bp, Artificial Sequence
  Description of Artificial Sequence: Synthetic oligonucleotide
  Target: ATXN1; (-) strand; PAM type: NRG; PAM sequence: AAG
agaaacatttaaccttagag

SEQ ID NO: 63204 - DNA, 20 bp, Artificial Sequence
  Description of Artificial Sequence: Synthetic oligonucleotide
  Target: ATXN1; (-) strand; PAM type: NRG; PAM sequence: GAG
gacagaaacatttaacctta

SEQ ID NO: 63205 - DNA, 20 bp, Artificial Sequence
  Description of Artificial Sequence: Synthetic oligonucleotide
  Target: ATXN1; (-) strand; PAM type: NRG; PAM sequence: TAG
ttgacagaaacatttaacct

SEQ ID NO: 63206 - DNA, 20 bp, Artificial Sequence
  Description of Artificial Sequence: Synthetic oligonucleotide
  Target: ATXN1; (-) strand; PAM type: NRG; PAM sequence: CAG
ctctctggccctgtaattga

SEQ ID NO: 63207 - DNA, 20 bp, Artificial Sequence
  Description of Artificial Sequence: Synthetic oligonucleotide
  Target: ATXN1; (-) strand; PAM type: NRG; PAM sequence: TGG
aaagatcctcagcatctctc

SEQ ID NO: 63208 - DNA, 20 bp, Artificial Sequence
  Description of Artificial Sequence: Synthetic oligonucleotide
  Target: ATXN1; (-) strand; PAM type: NRG; PAM sequence: CAG
aaatgtactcaaaagatcct

SEQ ID NO: 63209 - DNA, 20 bp, Artificial Sequence
  Description of Artificial Sequence: Synthetic oligonucleotide
  Target: ATXN1; (-) strand; PAM type: NRG; PAM sequence: AAG
tggtgattaaatgtactcaa

SEQ ID NO: 63210 - DNA, 20 bp, Artificial Sequence
  Description of Artificial Sequence: Synthetic oligonucleotide
  Target: ATXN1; (-) strand; PAM type: NRG; PAM sequence: TGG
ctttcaatgtagctatcaaa

SEQ ID NO: 63211 - DNA, 20 bp, Artificial Sequence
  Description of Artificial Sequence: Synthetic oligonucleotide
  Target: ATXN1; (-) strand; PAM type: NRG; PAM sequence: TAG
aggtatcattgctttcaatg

SEQ ID NO: 63212 - DNA, 20 bp, Artificial Sequence
  Description of Artificial Sequence: Synthetic oligonucleotide
  Target: ATXN1; (-) strand; PAM type: NRG; PAM sequence: AGG
gtcgcttctttgaaatagac

SEQ ID NO: 63213 - DNA, 20 bp, Artificial Sequence
  Description of Artificial Sequence: Synthetic oligonucleotide
  Target: ATXN1; (-) strand; PAM type: NRG; PAM sequence: CAG
tgtcgcttctttgaaataga

SEQ ID NO: 63214 - DNA, 20 bp, Artificial Sequence
  Description of Artificial Sequence: Synthetic oligonucleotide
  Target: ATXN1; (-) strand; PAM type: NRG; PAM sequence: TAG
catttgtcgcttctttgaaa

SEQ ID NO: 63215 - DNA, 20 bp, Artificial Sequence
  Description of Artificial Sequence: Synthetic oligonucleotide
  Target: ATXN1; (-) strand; PAM type: NRG; PAM sequence: TGG
ttggtttttttttttttttt

SEQ ID NO: 63216 - DNA, 20 bp, Artificial Sequence
  Description of Artificial Sequence: Synthetic oligonucleotide
  Target: ATXN1; (-) strand; PAM type: NRG; PAM sequence: TGG
gttttttgttgtttggtttt

SEQ ID NO: 63217 - DNA, 20 bp, Artificial Sequence
  Description of Artificial Sequence: Synthetic oligonucleotide
  Target: ATXN1; (-) strand; PAM type: NRG; PAM sequence: TGG
gtgtgaagttttttgttgtt

SEQ ID NO: 63218 - DNA, 20 bp, Artificial Sequence
  Description of Artificial Sequence: Synthetic oligonucleotide
  Target: ATXN1; (-) strand; PAM type: NRG; PAM sequence: AAG
cctgggtaatatagtgtgtg

SEQ ID NO: 63219 - DNA, 20 bp, Artificial Sequence
  Description of Artificial Sequence: Synthetic oligonucleotide
  Target: ATXN1; (-) strand; PAM type: NRG; PAM sequence: TAG
gtgtaataacctgggtaata

SEQ ID NO: 63220 - DNA, 20 bp, Artificial Sequence
  Description of Artificial Sequence: Synthetic oligonucleotide
  Target: ATXN1; (-) strand; PAM type: NRG; PAM sequence: GGG
cacacacagtgtaataacct

SEQ ID NO: 63221 - DNA, 20 bp, Artificial Sequence
  Description of Artificial Sequence: Synthetic oligonucleotide
  Target: ATXN1; (-) strand; PAM type: NRG; PAM sequence: TGG
ccacacacagtgtaataacc

SEQ ID NO: 63222 - DNA, 20 bp, Artificial Sequence
  Description of Artificial Sequence: Synthetic oligonucleotide
  Target: ATXN1; (-) strand; PAM type: NRG; PAM sequence: CAG
ccaagtagagaggccacaca

SEQ ID NO: 63223 - DNA, 20 bp, Artificial Sequence
  Description of Artificial Sequence: Synthetic oligonucleotide
  Target: ATXN1; (-) strand; PAM type: NRG; PAM sequence: AGG
gattcagactccaagtagag

SEQ ID NO: 63224 - DNA, 20 bp, Artificial Sequence
  Description of Artificial Sequence: Synthetic oligonucleotide
  Target: ATXN1; (-) strand; PAM type: NRG; PAM sequence: GAG
ggattcagactccaagtaga

SEQ ID NO: 63225 - DNA, 20 bp, Artificial Sequence
  Description of Artificial Sequence: Synthetic oligonucleotide
  Target: ATXN1; (-) strand; PAM type: NRG; PAM sequence: GAG
atggattcagactccaagta

SEQ ID NO: 63226 - DNA, 20 bp, Artificial Sequence
  Description of Artificial Sequence: Synthetic oligonucleotide
  Target: ATXN1; (-) strand; PAM type: NRG; PAM sequence: TAG
gaatggattcagactccaag

SEQ ID NO: 63227 - DNA, 20 bp, Artificial Sequence
  Description of Artificial Sequence: Synthetic oligonucleotide
  Target: ATXN1; (-) strand; PAM type: NRG; PAM sequence: AAG
ggagaatggattcagactcc

SEQ ID NO: 63228 - DNA, 20 bp, Artificial Sequence
  Description of Artificial Sequence: Synthetic oligonucleotide
  Target: ATXN1; (-) strand; PAM type: NRG; PAM sequence: CAG
cagtaggaggagaatggatt

SEQ ID NO: 63229 - DNA, 20 bp, Artificial Sequence
  Description of Artificial Sequence: Synthetic oligonucleotide
  Target: ATXN1; (-) strand; PAM type: NRG; PAM sequence: TGG
tggaaccagtaggaggagaa

SEQ ID NO: 63230 - DNA, 20 bp, Artificial Sequence
  Description of Artificial Sequence: Synthetic oligonucleotide
  Target: ATXN1; (-) strand; PAM type: NRG; PAM sequence: GAG
ggatctggaaccagtaggag

SEQ ID NO: 63231 - DNA, 20 bp, Artificial Sequence
  Description of Artificial Sequence: Synthetic oligonucleotide
  Target: ATXN1; (-) strand; PAM type: NRG; PAM sequence: AGG
caggatctggaaccagtagg

SEQ ID NO: 63232 - DNA, 20 bp, Artificial Sequence
  Description of Artificial Sequence: Synthetic oligonucleotide
  Target: ATXN1; (-) strand; PAM type: NRG; PAM sequence: GAG
gcaggatctggaaccagtag

SEQ ID NO: 63233 - DNA, 20 bp, Artificial Sequence
  Description of Artificial Sequence: Synthetic oligonucleotide
  Target: ATXN1; (-) strand; PAM type: NRG; PAM sequence: AGG
cagcaggatctggaaccagt

SEQ ID NO: 63234 - DNA, 20 bp, Artificial Sequence
  Description of Artificial Sequence: Synthetic oligonucleotide
  Target: ATXN1; (-) strand; PAM type: NRG; PAM sequence: TAG
ccagcaggatctggaaccag

SEQ ID NO: 63235 - DNA, 20 bp, Artificial Sequence
  Description of Artificial Sequence: Synthetic oligonucleotide
  Target: ATXN1; (-) strand; PAM type: NRG; PAM sequence: CAG
accccagcaggatctggaac

SEQ ID NO: 63236 - DNA, 20 bp, Artificial Sequence
  Description of Artificial Sequence: Synthetic oligonucleotide
  Target: ATXN1; (-) strand; PAM type: NRG; PAM sequence: TGG
gagttgaccccagcaggatc

SEQ ID NO: 63237 - DNA, 20 bp, Artificial Sequence
  Description of Artificial Sequence: Synthetic oligonucleotide
  Target: ATXN1; (-) strand; PAM type: NRG; PAM sequence: AGG
ggagcagagttgaccccagc

SEQ ID NO: 63238 - DNA, 20 bp, Artificial Sequence
  Description of Artificial Sequence: Synthetic oligonucleotide
  Target: ATXN1; (-) strand; PAM type: NRG; PAM sequence: CAG
gggagcagagttgaccccag

SEQ ID NO: 63239 - DNA, 20 bp, Artificial Sequence
  Description of Artificial Sequence: Synthetic oligonucleotide
  Target: ATXN1; (-) strand; PAM type: NRG; PAM sequence: CAG
gttgggagcagagttgaccc

SEQ ID NO: 63240 - DNA, 20 bp, Artificial Sequence
  Description of Artificial Sequence: Synthetic oligonucleotide
  Target: ATXN1; (-) strand; PAM type: NRG; PAM sequence: GAG
ctgaagggaagttgggagca

SEQ ID NO: 63241 - DNA, 20 bp, Artificial Sequence
  Description of Artificial Sequence: Synthetic oligonucleotide
  Target: ATXN1; (-) strand; PAM type: NRG; PAM sequence: CAG
gactgaagggaagttgggag

SEQ ID NO: 63242 - DNA, 20 bp, Artificial Sequence
  Description of Artificial Sequence: Synthetic oligonucleotide
  Target: ATXN1; (-) strand; PAM type: NRG; PAM sequence: GAG
aaagactgaagggaagttgg

SEQ ID NO: 63243 - DNA, 20 bp, Artificial Sequence
  Description of Artificial Sequence: Synthetic oligonucleotide
  Target: ATXN1; (-) strand; PAM type: NRG; PAM sequence: GGG
aaaaagactgaagggaagtt

SEQ ID NO: 63244 - DNA, 20 bp, Artificial Sequence
  Description of Artificial Sequence: Synthetic oligonucleotide
  Target: ATXN1; (-) strand; PAM type: NRG; PAM sequence: TGG
gaaaaagactgaagggaagt

SEQ ID NO: 63245 - DNA, 20 bp, Artificial Sequence
  Description of Artificial Sequence: Synthetic oligonucleotide
  Target: ATXN1; (-) strand; PAM type: NRG; PAM sequence: AAG
agaggaaaaagactgaaggg

SEQ ID NO: 63246 - DNA, 20 bp, Artificial Sequence
  Description of Artificial Sequence: Synthetic oligonucleotide
  Target: ATXN1; (-) strand; PAM type: NRG; PAM sequence: GGG
tagagaggaaaaagactgaa

SEQ ID NO: 63247 - DNA, 20 bp, Artificial Sequence
  Description of Artificial Sequence: Synthetic oligonucleotide
  Target: ATXN1; (-) strand; PAM type: NRG; PAM sequence: AGG
gtagagaggaaaaagactga

SEQ ID NO: 63248 - DNA, 20 bp, Artificial Sequence
  Description of Artificial Sequence: Synthetic oligonucleotide
  Target: ATXN1; (-) strand; PAM type: NRG; PAM sequence: AAG
agtagagaggaaaaagactg

SEQ ID NO: 63249 - DNA, 20 bp, Artificial Sequence
  Description of Artificial Sequence: Synthetic oligonucleotide
  Target: ATXN1; (-) strand; PAM type: NRG; PAM sequence: AAG
aatttccagtagagaggaaa

SEQ ID NO: 63250 - DNA, 20 bp, Artificial Sequence
  Description of Artificial Sequence: Synthetic oligonucleotide
  Target: ATXN1; (-) strand; PAM type: NRG; PAM sequence: AGG
gtgagaaatttccagtagag

SEQ ID NO: 63251 - DNA, 20 bp, Artificial Sequence
  Description of Artificial Sequence: Synthetic oligonucleotide
  Target: ATXN1; (-) strand; PAM type: NRG; PAM sequence: GAG
tgtgagaaatttccagtaga

SEQ ID NO: 63252 - DNA, 20 bp, Artificial Sequence
  Description of Artificial Sequence: Synthetic oligonucleotide
  Target: ATXN1; (-) strand; PAM type: NRG; PAM sequence: GAG
agtgtgagaaatttccagta

SEQ ID NO: 63253 - DNA, 20 bp, Artificial Sequence
  Description of Artificial Sequence: Synthetic oligonucleotide
  Target: ATXN1; (-) strand; PAM type: NRG; PAM sequence: TAG
ggagtgtgagaaatttccag

SEQ ID NO: 63254 - DNA, 20 bp, Artificial Sequence
  Description of Artificial Sequence: Synthetic oligonucleotide
  Target: ATXN1; (-) strand; PAM type: NRG; PAM sequence: CAG
cttggagtgtgagaaatttc

SEQ ID NO: 63255 - DNA, 20 bp, Artificial Sequence
  Description of Artificial Sequence: Synthetic oligonucleotide
  Target: ATXN1; (-) strand; PAM type: NRG; PAM sequence: GAG
actgagtatgcttggagtgt

SEQ ID NO: 63256 - DNA, 20 bp, Artificial Sequence
  Description of Artificial Sequence: Synthetic oligonucleotide
  Target: ATXN1; (-) strand; PAM type: NRG; PAM sequence: GAG
gcagtgactgagtatgcttg

SEQ ID NO: 63257 - DNA, 20 bp, Artificial Sequence
  Description of Artificial Sequence: Synthetic oligonucleotide
  Target: ATXN1; (-) strand; PAM type: NRG; PAM sequence: TGG
tagcagtgactgagtatgct

SEQ ID NO: 63258 - DNA, 20 bp, Artificial Sequence
  Description of Artificial Sequence: Synthetic oligonucleotide
  Target: ATXN1; (-) strand; PAM type: NRG; PAM sequence: GAG
ttttaggaatagcagtgact

SEQ ID NO: 63259 - DNA, 20 bp, Artificial Sequence
  Description of Artificial Sequence: Synthetic oligonucleotide
  Target: ATXN1; (-) strand; PAM type: NRG; PAM sequence: CAG
ataaattcttttaggaatag

SEQ ID NO: 63260 - DNA, 20 bp, Artificial Sequence
  Description of Artificial Sequence: Synthetic oligonucleotide
  Target: ATXN1; (-) strand; PAM type: NRG; PAM sequence: TAG
tggataaattcttttaggaa

SEQ ID NO: 63261 - DNA, 20 bp, Artificial Sequence
  Description of Artificial Sequence: Synthetic oligonucleotide
  Target: ATXN1; (-) strand; PAM type: NRG; PAM sequence: AGG
gggtatggataaattctttt

SEQ ID NO: 63262 - DNA, 20 bp, Artificial Sequence
  Description of Artificial Sequence: Synthetic oligonucleotide
  Target: ATXN1; (-) strand; PAM type: NRG; PAM sequence: TAG
agggtatggataaattcttt

SEQ ID NO: 63263 - DNA, 20 bp, Artificial Sequence
  Description of Artificial Sequence: Synthetic oligonucleotide
  Target: ATXN1; (-) strand; PAM type: NRG; PAM sequence: TGG
tttgggactgtattagggta

SEQ ID NO: 63264 - DNA, 20 bp, Artificial Sequence
  Description of Artificial Sequence: Synthetic oligonucleotide
  Target: ATXN1; (-) strand; PAM type: NRG; PAM sequence: GGG
agccatttgggactgtatta

SEQ ID NO: 63265 - DNA, 20 bp, Artificial Sequence
  Description of Artificial Sequence: Synthetic oligonucleotide
  Target: ATXN1; (-) strand; PAM type: NRG; PAM sequence: AGG
cagccatttgggactgtatt

SEQ ID NO: 63266 - DNA, 20 bp, Artificial Sequence
  Description of Artificial Sequence: Synthetic oligonucleotide
  Target: ATXN1; (-) strand; PAM type: NRG; PAM sequence: TAG
acagccatttgggactgtat

SEQ ID NO: 63267 - DNA, 20 bp, Artificial Sequence
  Description of Artificial Sequence: Synthetic oligonucleotide
  Target: ATXN1; (-) strand; PAM type: NRG; PAM sequence: GGG
aagagagaggacagccattt

SEQ ID NO: 63268 - DNA, 20 bp, Artificial Sequence
  Description of Artificial Sequence: Synthetic oligonucleotide
  Target: ATXN1; (-) strand; PAM type: NRG; PAM sequence: TGG
gaagagagaggacagccatt

SEQ ID NO: 63269 - DNA, 20 bp, Artificial Sequence
  Description of Artificial Sequence: Synthetic oligonucleotide
  Target: ATXN1; (-) strand; PAM type: NRG; PAM sequence: CAG
ggtaaacagaagagagagga

SEQ ID NO: 63270 - DNA, 20 bp, Artificial Sequence
  Description of Artificial Sequence: Synthetic oligonucleotide
  Target: ATXN1; (-) strand; PAM type: NRG; PAM sequence: AGG
tgttggtaaacagaagagag

SEQ ID NO: 63271 - DNA, 20 bp, Artificial Sequence
  Description of Artificial Sequence: Synthetic oligonucleotide
  Target: ATXN1; (-) strand; PAM type: NRG; PAM sequence: GAG
ttgttggtaaacagaagaga

SEQ ID NO: 63272 - DNA, 20 bp, Artificial Sequence
  Description of Artificial Sequence: Synthetic oligonucleotide
  Target: ATXN1; (-) strand; PAM type: NRG; PAM sequence: GAG
gtttgttggtaaacagaaga

SEQ ID NO: 63273 - DNA, 20 bp, Artificial Sequence
  Description of Artificial Sequence: Synthetic oligonucleotide
  Target: ATXN1; (-) strand; PAM type: NRG; PAM sequence: GAG
ctgtttgttggtaaacagaa

SEQ ID NO: 63274 - DNA, 20 bp, Artificial Sequence
  Description of Artificial Sequence: Synthetic oligonucleotide
  Target: ATXN1; (-) strand; PAM type: NRG; PAM sequence: AAG
aactgtttgttggtaaacag

SEQ ID NO: 63275 - DNA, 20 bp, Artificial Sequence
  Description of Artificial Sequence: Synthetic oligonucleotide
  Target: ATXN1; (-) strand; PAM type: NRG; PAM sequence: CAG
tacaactgtttgttggtaaa

SEQ ID NO: 63276 - DNA, 20 bp, Artificial Sequence
  Description of Artificial Sequence: Synthetic oligonucleotide
  Target: ATXN1; (-) strand; PAM type: NRG; PAM sequence: TGG
tgtatagtacaactgtttgt

SEQ ID NO: 63277 - DNA, 20 bp, Artificial Sequence
  Description of Artificial Sequence: Synthetic oligonucleotide
  Target: ATXN1; (-) strand; PAM type: NRG; PAM sequence: TAG
aaatactggcattgaatgta

SEQ ID NO: 63278 - DNA, 20 bp, Artificial Sequence
  Description of Artificial Sequence: Synthetic oligonucleotide
  Target: ATXN1; (-) strand; PAM type: NRG; PAM sequence: TGG
agatgtaggcggtgaaatac

SEQ ID NO: 63279 - DNA, 20 bp, Artificial Sequence
  Description of Artificial Sequence: Synthetic oligonucleotide
  Target: ATXN1; (-) strand; PAM type: NRG; PAM sequence: CGG
ccagagttttaagatgtagg

SEQ ID NO: 63280 - DNA, 20 bp, Artificial Sequence
  Description of Artificial Sequence: Synthetic oligonucleotide
  Target: ATXN1; (-) strand; PAM type: NRG; PAM sequence: AGG
gctccagagttttaagatgt

SEQ ID NO: 63281 - DNA, 20 bp, Artificial Sequence
  Description of Artificial Sequence: Synthetic oligonucleotide
  Target: ATXN1; (-) strand; PAM type: NRG; PAM sequence: TAG
agctccagagttttaagatg

SEQ ID NO: 63282 - DNA, 20 bp, Artificial Sequence
  Description of Artificial Sequence: Synthetic oligonucleotide
  Target: ATXN1; (-) strand; PAM type: NRG; PAM sequence: AAG
aaatcaagctccagagtttt

SEQ ID NO: 63283 - DNA, 20 bp, Artificial Sequence
  Description of Artificial Sequence: Synthetic oligonucleotide
  Target: ATXN1; (-) strand; PAM type: NRG; PAM sequence: GAG
gtggtggaaatcaagctcca

SEQ ID NO: 63284 - DNA, 20 bp, Artificial Sequence
  Description of Artificial Sequence: Synthetic oligonucleotide
  Target: ATXN1; (-) strand; PAM type: NRG; PAM sequence: CAG
aagtggtggaaatcaagctc

SEQ ID NO: 63285 - DNA, 20 bp, Artificial Sequence
  Description of Artificial Sequence: Synthetic oligonucleotide
  Target: ATXN1; (-) strand; PAM type: NRG; PAM sequence: AAG
agagaaaagtggtggaaatc

SEQ ID NO: 63286 - DNA, 20 bp, Artificial Sequence
  Description of Artificial Sequence: Synthetic oligonucleotide
  Target: ATXN1; (-) strand; PAM type: NRG; PAM sequence: TGG
actaacacagagaaaagtgg

SEQ ID NO: 63287 - DNA, 20 bp, Artificial Sequence
  Description of Artificial Sequence: Synthetic oligonucleotide
  Target: ATXN1; (-) strand; PAM type: NRG; PAM sequence: TGG
gttactaacacagagaaaag

SEQ ID NO: 63288 - DNA, 20 bp, Artificial Sequence
  Description of Artificial Sequence: Synthetic oligonucleotide
  Target: ATXN1; (-) strand; PAM type: NRG; PAM sequence: AAG
aaggttactaacacagagaa

SEQ ID NO: 63289 - DNA, 20 bp, Artificial Sequence
  Description of Artificial Sequence: Synthetic oligonucleotide
  Target: ATXN1; (-) strand; PAM type: NRG; PAM sequence: GAG
gaaggaaggttactaacaca

SEQ ID NO: 63290 - DNA, 20 bp, Artificial Sequence
  Description of Artificial Sequence: Synthetic oligonucleotide
  Target: ATXN1; (-) strand; PAM type: NRG; PAM sequence: CAG
gagaaggaaggttactaaca

SEQ ID NO: 63291 - DNA, 20 bp, Artificial Sequence
  Description of Artificial Sequence: Synthetic oligonucleotide
  Target: ATXN1; (-) strand; PAM type: NRG; PAM sequence: AGG
tgacctttggaggagaagga

SEQ ID NO: 63292 - DNA, 20 bp, Artificial Sequence
  Description of Artificial Sequence: Synthetic oligonucleotide
  Target: ATXN1; (-) strand; PAM type: NRG; PAM sequence: AAG
ttgacctttggaggagaagg

SEQ ID NO: 63293 - DNA, 20 bp, Artificial Sequence
  Description of Artificial Sequence: Synthetic oligonucleotide
  Target: ATXN1; (-) strand; PAM type: NRG; PAM sequence: AGG
ttcttgacctttggaggaga

SEQ ID NO: 63294 - DNA, 20 bp, Artificial Sequence
  Description of Artificial Sequence: Synthetic oligonucleotide
  Target: ATXN1; (-) strand; PAM type: NRG; PAM sequence: AAG
attcttgacctttggaggag

SEQ ID NO: 63295 - DNA, 20 bp, Artificial Sequence
  Description of Artificial Sequence: Synthetic oligonucleotide
  Target: ATXN1; (-) strand; PAM type: NRG; PAM sequence: GAG
accattcttgacctttggag

SEQ ID NO: 63296 - DNA, 20 bp, Artificial Sequence
  Description of Artificial Sequence: Synthetic oligonucleotide
  Target: ATXN1; (-) strand; PAM type: NRG; PAM sequence: AGG
aaaccattcttgacctttgg

SEQ ID NO: 63297 - DNA, 20 bp, Artificial Sequence
  Description of Artificial Sequence: Synthetic oligonucleotide
  Target: ATXN1; (-) strand; PAM type: NRG; PAM sequence: GAG
gaaaccattcttgacctttg

SEQ ID NO: 63298 - DNA, 20 bp, Artificial Sequence
  Description of Artificial Sequence: Synthetic oligonucleotide
  Target: ATXN1; (-) strand; PAM type: NRG; PAM sequence: TGG
aggaaaccattcttgacctt

SEQ ID NO: 63299 - DNA, 20 bp, Artificial Sequence
  Description of Artificial Sequence: Synthetic oligonucleotide
  Target: ATXN1; (-) strand; PAM type: NRG; PAM sequence: AGG
ggtcactgcatttagaaggc

SEQ ID NO: 63300 - DNA, 20 bp, Artificial Sequence
  Description of Artificial Sequence: Synthetic oligonucleotide
  Target: ATXN1; (-) strand; PAM type: NRG; PAM sequence: CAG
aggtcactgcatttagaagg

SEQ ID NO: 63301 - DNA, 20 bp, Artificial Sequence
  Description of Artificial Sequence: Synthetic oligonucleotide
  Target: ATXN1; (-) strand; PAM type: NRG; PAM sequence: AGG
caaaggtcactgcatttaga

SEQ ID NO: 63302 - DNA, 20 bp, Artificial Sequence
  Description of Artificial Sequence: Synthetic oligonucleotide
  Target: ATXN1; (-) strand; PAM type: NRG; PAM sequence: AAG
gcaaaggtcactgcatttag

SEQ ID NO: 63303 - DNA, 20 bp, Artificial Sequence
  Description of Artificial Sequence: Synthetic oligonucleotide
  Target: ATXN1; (-) strand; PAM type: NRG; PAM sequence: TAG
tcagcaaaggtcactgcatt

SEQ ID NO: 63304 - DNA, 20 bp, Artificial Sequence
  Description of Artificial Sequence: Synthetic oligonucleotide
  Target: ATXN1; (-) strand; PAM type: NRG; PAM sequence: AGG
ttaagaggaggactcagcaa

SEQ ID NO: 63305 - DNA, 20 bp, Artificial Sequence
  Description of Artificial Sequence: Synthetic oligonucleotide
  Target: ATXN1; (-) strand; PAM type: NRG; PAM sequence: AAG
gttaagaggaggactcagca

SEQ ID NO: 63306 - DNA, 20 bp, Artificial Sequence
  Description of Artificial Sequence: Synthetic oligonucleotide
  Target: ATXN1; (-) strand; PAM type: NRG; PAM sequence: CAG
gagaagttaagaggaggact

SEQ ID NO: 63307 - DNA, 20 bp, Artificial Sequence
  Description of Artificial Sequence: Synthetic oligonucleotide
  Target: ATXN1; (-) strand; PAM type: NRG; PAM sequence: AGG
ttgttagagaagttaagagg

SEQ ID NO: 63308 - DNA, 20 bp, Artificial Sequence
  Description of Artificial Sequence: Synthetic oligonucleotide
  Target: ATXN1; (-) strand; PAM type: NRG; PAM sequence: GAG
attgttagagaagttaagag

SEQ ID NO: 63309 - DNA, 20 bp, Artificial Sequence
  Description of Artificial Sequence: Synthetic oligonucleotide
  Target: ATXN1; (-) strand; PAM type: NRG; PAM sequence: AGG
acattgttagagaagttaag

SEQ ID NO: 63310 - DNA, 20 bp, Artificial Sequence
  Description of Artificial Sequence: Synthetic oligonucleotide
  Target: ATXN1; (-) strand; PAM type: NRG; PAM sequence: GAG
gacattgttagagaagttaa

SEQ ID NO: 63311 - DNA, 20 bp, Artificial Sequence
  Description of Artificial Sequence: Synthetic oligonucleotide
  Target: ATXN1; (-) strand; PAM type: NRG; PAM sequence: AAG
cagacattgttagagaagtt

SEQ ID NO: 63312 - DNA, 20 bp, Artificial Sequence
  Description of Artificial Sequence: Synthetic oligonucleotide
  Target: ATXN1; (-) strand; PAM type: NRG; PAM sequence: AAG
tgtatcagacattgttagag

SEQ ID NO: 63313 - DNA, 20 bp, Artificial Sequence
  Description of Artificial Sequence: Synthetic oligonucleotide
  Target: ATXN1; (-) strand; PAM type: NRG; PAM sequence: GAG
aactgtatcagacattgtta

SEQ ID NO: 63314 - DNA, 20 bp, Artificial Sequence
  Description of Artificial Sequence: Synthetic oligonucleotide
  Target: ATXN1; (-) strand; PAM type: NRG; PAM sequence: TAG
tgaactgtatcagacattgt

SEQ ID NO: 63315 - DNA, 20 bp, Artificial Sequence
  Description of Artificial Sequence: Synthetic oligonucleotide
  Target: ATXN1; (-) strand; PAM type: NRG; PAM sequence: CAG
ctattactagtgaactgtat

SEQ ID NO: 63316 - DNA, 20 bp, Artificial Sequence
  Description of Artificial Sequence: Synthetic oligonucleotide
  Target: ATXN1; (-) strand; PAM type: NRG; PAM sequence: TAG
aaaatggaaggaactattac

SEQ ID NO: 63317 - DNA, 20 bp, Artificial Sequence
  Description of Artificial Sequence: Synthetic oligonucleotide
  Target: ATXN1; (-) strand; PAM type: NRG; PAM sequence: AGG
taaaaggaaaagaaaatgga

SEQ ID NO: 63318 - DNA, 20 bp, Artificial Sequence
  Description of Artificial Sequence: Synthetic oligonucleotide
  Target: ATXN1; (-) strand; PAM type: NRG; PAM sequence: AAG
ataaaaggaaaagaaaatgg

SEQ ID NO: 63319 - DNA, 20 bp, Artificial Sequence
  Description of Artificial Sequence: Synthetic oligonucleotide
  Target: ATXN1; (-) strand; PAM type: NRG; PAM sequence: TGG
taaataaaaggaaaagaaaa

SEQ ID NO: 63320 - DNA, 20 bp, Artificial Sequence
  Description of Artificial Sequence: Synthetic oligonucleotide
  Target: ATXN1; (-) strand; PAM type: NRG; PAM sequence: AAG
agtctactaaataaaaggaa

SEQ ID NO: 63321 - DNA, 20 bp, Artificial Sequence
  Description of Artificial Sequence: Synthetic oligonucleotide
  Target: ATXN1; (-) strand; PAM type: NRG; PAM sequence: AGG
atgctagtctactaaataaa

SEQ ID NO: 63322 - DNA, 20 bp, Artificial Sequence
  Description of Artificial Sequence: Synthetic oligonucleotide
  Target: ATXN1; (-) strand; PAM type: NRG; PAM sequence: AAG
aatgctagtctactaaataa

SEQ ID NO: 63323 - DNA, 20 bp, Artificial Sequence
  Description of Artificial Sequence: Synthetic oligonucleotide
  Target: ATXN1; (-) strand; PAM type: NRG; PAM sequence: TAG
tgctgttcaggcaaaaatgc

SEQ ID NO: 63324 - DNA, 20 bp, Artificial Sequence
  Description of Artificial Sequence: Synthetic oligonucleotide
  Target: ATXN1; (-) strand; PAM type: NRG; PAM sequence: AGG
ttccagaaaagatgctgttc

SEQ ID NO: 63325 - DNA, 20 bp, Artificial Sequence
  Description of Artificial Sequence: Synthetic oligonucleotide
  Target: ATXN1; (-) strand; PAM type: NRG; PAM sequence: CAG
attccagaaaagatgctgtt

SEQ ID NO: 63326 - DNA, 20 bp, Artificial Sequence
  Description of Artificial Sequence: Synthetic oligonucleotide
  Target: ATXN1; (-) strand; PAM type: NRG; PAM sequence: AAG
ggggagagatcattccagaa

SEQ ID NO: 63327 - DNA, 20 bp, Artificial Sequence
  Description of Artificial Sequence: Synthetic oligonucleotide
  Target: ATXN1; (-) strand; PAM type: NRG; PAM sequence: CAG
gccaaggggagagatcattc

SEQ ID NO: 63328 - DNA, 20 bp, Artificial Sequence
  Description of Artificial Sequence: Synthetic oligonucleotide
  Target: ATXN1; (-) strand; PAM type: NRG; PAM sequence: GAG
ccagataacagccaagggga

SEQ ID NO: 63329 - DNA, 20 bp, Artificial Sequence
  Description of Artificial Sequence: Synthetic oligonucleotide
  Target: ATXN1; (-) strand; PAM type: NRG; PAM sequence: GAG
gcccagataacagccaaggg

SEQ ID NO: 63330 - DNA, 20 bp, Artificial Sequence
  Description of Artificial Sequence: Synthetic oligonucleotide
  Target: ATXN1; (-) strand; PAM type: NRG; PAM sequence: GGG
cagcccagataacagccaag

SEQ ID NO: 63331 - DNA, 20 bp, Artificial Sequence
  Description of Artificial Sequence: Synthetic oligonucleotide
  Target: ATXN1; (-) strand; PAM type: NRG; PAM sequence: GGG
ccagcccagataacagccaa

SEQ ID NO: 63332 - DNA, 20 bp, Artificial Sequence
  Description of Artificial Sequence: Synthetic oligonucleotide
  Target: ATXN1; (-) strand; PAM type: NRG; PAM sequence: AGG
cccagcccagataacagcca

SEQ ID NO: 63333 - DNA, 20 bp, Artificial Sequence
  Description of Artificial Sequence: Synthetic oligonucleotide
  Target: ATXN1; (-) strand; PAM type: NRG; PAM sequence: AAG
tcccagcccagataacagcc

SEQ ID NO: 63334 - DNA, 20 bp, Artificial Sequence
  Description of Artificial Sequence: Synthetic oligonucleotide
  Target: ATXN1; (-) strand; PAM type: NRG; PAM sequence: CAG
agtcatcccagcccagataa

SEQ ID NO: 63335 - DNA, 20 bp, Artificial Sequence
  Description of Artificial Sequence: Synthetic oligonucleotide
  Target: ATXN1; (-) strand; PAM type: NRG; PAM sequence: CAG
tgtgtgaagtcatcccagcc

SEQ ID NO: 63336 - DNA, 20 bp, Artificial Sequence
  Description of Artificial Sequence: Synthetic oligonucleotide
  Target: ATXN1; (-) strand; PAM type: NRG; PAM sequence: CAG
gccaatgtgtgaagtcatcc

SEQ ID NO: 63337 - DNA, 20 bp, Artificial Sequence
  Description of Artificial Sequence: Synthetic oligonucleotide
  Target: ATXN1; (-) strand; PAM type: NRG; PAM sequence: AAG
atcttccaggccaatgtgtg

SEQ ID NO: 63338 - DNA, 20 bp, Artificial Sequence
  Description of Artificial Sequence: Synthetic oligonucleotide
  Target: ATXN1; (-) strand; PAM type: NRG; PAM sequence: AGG
gggtcatatgtccatcttcc

SEQ ID NO: 63339 - DNA, 20 bp, Artificial Sequence
  Description of Artificial Sequence: Synthetic oligonucleotide
  Target: ATXN1; (-) strand; PAM type: NRG; PAM sequence: CAG
tgggtcatatgtccatcttc

SEQ ID NO: 63340 - DNA, 20 bp, Artificial Sequence
  Description of Artificial Sequence: Synthetic oligonucleotide
  Target: ATXN1; (-) strand; PAM type: NRG; PAM sequence: GGG
tattacgattgcccagacct

SEQ ID NO: 63341 - DNA, 20 bp, Artificial Sequence
  Description of Artificial Sequence: Synthetic oligonucleotide
  Target: ATXN1; (-) strand; PAM type: NRG; PAM sequence: TGG
gtattacgattgcccagacc

SEQ ID NO: 63342 - DNA, 20 bp, Artificial Sequence
  Description of Artificial Sequence: Synthetic oligonucleotide
  Target: ATXN1; (-) strand; PAM type: NRG; PAM sequence: CAG
gttgttgtattacgattgcc

SEQ ID NO: 63343 - DNA, 20 bp, Artificial Sequence
  Description of Artificial Sequence: Synthetic oligonucleotide
  Target: ATXN1; (-) strand; PAM type: NRG; PAM sequence: GGG
ggccagtcactgtggctgga

SEQ ID NO: 63344 - DNA, 20 bp, Artificial Sequence
  Description of Artificial Sequence: Synthetic oligonucleotide
  Target: ATXN1; (-) strand; PAM type: NRG; PAM sequence: AGG
aggccagtcactgtggctgg

SEQ ID NO: 63345 - DNA, 20 bp, Artificial Sequence
  Description of Artificial Sequence: Synthetic oligonucleotide
  Target: ATXN1; (-) strand; PAM type: NRG; PAM sequence: GAG
taggccagtcactgtggctg

SEQ ID NO: 63346 - DNA, 20 bp, Artificial Sequence
  Description of Artificial Sequence: Synthetic oligonucleotide
  Target: ATXN1; (-) strand; PAM type: NRG; PAM sequence: TGG
cctaggccagtcactgtggc

SEQ ID NO: 63347 - DNA, 20 bp, Artificial Sequence
  Description of Artificial Sequence: Synthetic oligonucleotide
  Target: ATXN1; (-) strand; PAM type: NRG; PAM sequence: TGG
tacccctaggccagtcactg

SEQ ID NO: 63348 - DNA, 20 bp, Artificial Sequence
  Description of Artificial Sequence: Synthetic oligonucleotide
  Target: ATXN1; (-) strand; PAM type: NRG; PAM sequence: CAG
gtacatgcctacccctaggc

SEQ ID NO: 63349 - DNA, 20 bp, Artificial Sequence
  Description of Artificial Sequence: Synthetic oligonucleotide
  Target: ATXN1; (-) strand; PAM type: NRG; PAM sequence: AGG
ttgggtacatgcctacccct

SEQ ID NO: 63350 - DNA, 20 bp, Artificial Sequence
  Description of Artificial Sequence: Synthetic oligonucleotide
  Target: ATXN1; (-) strand; PAM type: NRG; PAM sequence: TAG
cttgggtacatgcctacccc

SEQ ID NO: 63351 - DNA, 20 bp, Artificial Sequence
  Description of Artificial Sequence: Synthetic oligonucleotide
  Target: ATXN1; (-) strand; PAM type: NRG; PAM sequence: GGG
gcctttgattggcttgcctt

SEQ ID NO: 63352 - DNA, 20 bp, Artificial Sequence
  Description of Artificial Sequence: Synthetic oligonucleotide
  Target: ATXN1; (-) strand; PAM type: NRG; PAM sequence: TGG
ggcctttgattggcttgcct

SEQ ID NO: 63353 - DNA, 20 bp, Artificial Sequence
  Description of Artificial Sequence: Synthetic oligonucleotide
  Target: ATXN1; (-) strand; PAM type: NRG; PAM sequence: TGG
gtctgagagaggcctttgat

SEQ ID NO: 63354 - DNA, 20 bp, Artificial Sequence
  Description of Artificial Sequence: Synthetic oligonucleotide
  Target: ATXN1; (-) strand; PAM type: NRG; PAM sequence: AGG
agttccaggtagtctgagag

SEQ ID NO: 63355 - DNA, 20 bp, Artificial Sequence
  Description of Artificial Sequence: Synthetic oligonucleotide
  Target: ATXN1; (-) strand; PAM type: NRG; PAM sequence: GAG
tagttccaggtagtctgaga

SEQ ID NO: 63356 - DNA, 20 bp, Artificial Sequence
  Description of Artificial Sequence: Synthetic oligonucleotide
  Target: ATXN1; (-) strand; PAM type: NRG; PAM sequence: GAG
cttagttccaggtagtctga

SEQ ID NO: 63357 - DNA, 20 bp, Artificial Sequence
  Description of Artificial Sequence: Synthetic oligonucleotide
  Target: ATXN1; (-) strand; PAM type: NRG; PAM sequence: GAG
ctcttagttccaggtagtct

SEQ ID NO: 63358 - DNA, 20 bp, Artificial Sequence
  Description of Artificial Sequence: Synthetic oligonucleotide
  Target: ATXN1; (-) strand; PAM type: NRG; PAM sequence: TAG
ttgctcctcttagttccagg

SEQ ID NO: 63359 - DNA, 20 bp, Artificial Sequence
  Description of Artificial Sequence: Synthetic oligonucleotide
  Target: ATXN1; (-) strand; PAM type: NRG; PAM sequence: AGG
gtgttgctcctcttagttcc

SEQ ID NO: 63360 - DNA, 20 bp, Artificial Sequence
  Description of Artificial Sequence: Synthetic oligonucleotide
  Target: ATXN1; (-) strand; PAM type: NRG; PAM sequence: CAG
tgtgttgctcctcttagttc

SEQ ID NO: 63361 - DNA, 20 bp, Artificial Sequence
  Description of Artificial Sequence: Synthetic oligonucleotide
  Target: ATXN1; (-) strand; PAM type: NRG; PAM sequence: TAG
aaagagtgtgttgctcctct

SEQ ID NO: 63362 - DNA, 20 bp, Artificial Sequence
  Description of Artificial Sequence: Synthetic oligonucleotide
  Target: ATXN1; (-) strand; PAM type: NRG; PAM sequence: GAG
cccgtggtctcactaggaaa

SEQ ID NO: 63363 - DNA, 20 bp, Artificial Sequence
  Description of Artificial Sequence: Synthetic oligonucleotide
  Target: ATXN1; (-) strand; PAM type: NRG; PAM sequence: AAG
ctcccgtggtctcactagga

SEQ ID NO: 63364 - DNA, 20 bp, Artificial Sequence
  Description of Artificial Sequence: Synthetic oligonucleotide
  Target: ATXN1; (-) strand; PAM type: NRG; PAM sequence: AGG
catgctcccgtggtctcact

SEQ ID NO: 63365 - DNA, 20 bp, Artificial Sequence
  Description of Artificial Sequence: Synthetic oligonucleotide
  Target: ATXN1; (-) strand; PAM type: NRG; PAM sequence: TAG
tcatgctcccgtggtctcac

SEQ ID NO: 63366 - DNA, 20 bp, Artificial Sequence
  Description of Artificial Sequence: Synthetic oligonucleotide
  Target: ATXN1; (-) strand; PAM type: NRG; PAM sequence: TGG
ttagtagcatcatgctcccg

SEQ ID NO: 63367 - DNA, 20 bp, Artificial Sequence
  Description of Artificial Sequence: Synthetic oligonucleotide
  Target: ATXN1; (-) strand; PAM type: NRG; PAM sequence: TAG
ctaaagaaaccagctgttag

SEQ ID NO: 63368 - DNA, 20 bp, Artificial Sequence
  Description of Artificial Sequence: Synthetic oligonucleotide
  Target: ATXN1; (-) strand; PAM type: NRG; PAM sequence: TAG
tggctaaagaaaccagctgt

SEQ ID NO: 63369 - DNA, 20 bp, Artificial Sequence
  Description of Artificial Sequence: Synthetic oligonucleotide
  Target: ATXN1; (-) strand; PAM type: NRG; PAM sequence: CAG
taagaggtggctaaagaaac

SEQ ID NO: 63370 - DNA, 20 bp, Artificial Sequence
  Description of Artificial Sequence: Synthetic oligonucleotide
  Target: ATXN1; (-) strand; PAM type: NRG; PAM sequence: AAG
ctttctgtaagaggtggcta

SEQ ID NO: 63371 - DNA, 20 bp, Artificial Sequence
  Description of Artificial Sequence: Synthetic oligonucleotide
  Target: ATXN1; (-) strand; PAM type: NRG; PAM sequence: TGG
agtgggctttctgtaagagg

SEQ ID NO: 63372 - DNA, 20 bp, Artificial Sequence
  Description of Artificial Sequence: Synthetic oligonucleotide
  Target: ATXN1; (-) strand; PAM type: NRG; PAM sequence: AGG
tccagtgggctttctgtaag

SEQ ID NO: 63373 - DNA, 20 bp, Artificial Sequence
  Description of Artificial Sequence: Synthetic oligonucleotide
  Target: ATXN1; (-) strand; PAM type: NRG; PAM sequence: GAG
ctccagtgggctttctgtaa

SEQ ID NO: 63374 - DNA, 20 bp, Artificial Sequence
  Description of Artificial Sequence: Synthetic oligonucleotide
  Target: ATXN1; (-) strand; PAM type: NRG; PAM sequence: AAG
ttctccagtgggctttctgt

SEQ ID NO: 63375 - DNA, 20 bp, Artificial Sequence
  Description of Artificial Sequence: Synthetic oligonucleotide
  Target: ATXN1; (-) strand; PAM type: NRG; PAM sequence: GGG
gggaagcttccttctccagt

SEQ ID NO: 63376 - DNA, 20 bp, Artificial Sequence
  Description of Artificial Sequence: Synthetic oligonucleotide
  Target: ATXN1; (-) strand; PAM type: NRG; PAM sequence: TGG
tgggaagcttccttctccag

SEQ ID NO: 63377 - DNA, 20 bp, Artificial Sequence
  Description of Artificial Sequence: Synthetic oligonucleotide
  Target: ATXN1; (-) strand; PAM type: NRG; PAM sequence: CAG
tactgggaagcttccttctc

SEQ ID NO: 63378 - DNA, 20 bp, Artificial Sequence
  Description of Artificial Sequence: Synthetic oligonucleotide
  Target: ATXN1; (-) strand; PAM type: NRG; PAM sequence: AAG
cagcttttctctgtactggg

SEQ ID NO: 63379 - DNA, 20 bp, Artificial Sequence
  Description of Artificial Sequence: Synthetic oligonucleotide
  Target: ATXN1; (-) strand; PAM type: NRG; PAM sequence: GGG
tttcagcttttctctgtact

SEQ ID NO: 63380 - DNA, 20 bp, Artificial Sequence
  Description of Artificial Sequence: Synthetic oligonucleotide
  Target: ATXN1; (-) strand; PAM type: NRG; PAM sequence: TGG
ctttcagcttttctctgtac

SEQ ID NO: 63381 - DNA, 20 bp, Artificial Sequence
  Description of Artificial Sequence: Synthetic oligonucleotide
  Target: ATXN1; (-) strand; PAM type: NRG; PAM sequence: CAG
gactcagattttctgtcttt

SEQ ID NO: 63382 - DNA, 20 bp, Artificial Sequence
  Description of Artificial Sequence: Synthetic oligonucleotide
  Target: ATXN1; (-) strand; PAM type: NRG; PAM sequence: CAG
actttactgtcatcaggact

SEQ ID NO: 63383 - DNA, 20 bp, Artificial Sequence
  Description of Artificial Sequence: Synthetic oligonucleotide
  Target: ATXN1; (-) strand; PAM type: NRG; PAM sequence: AGG
caagggactttactgtcatc

SEQ ID NO: 63384 - DNA, 20 bp, Artificial Sequence
  Description of Artificial Sequence: Synthetic oligonucleotide
  Target: ATXN1; (-) strand; PAM type: NRG; PAM sequence: CAG
ccaagggactttactgtcat

SEQ ID NO: 63385 - DNA, 20 bp, Artificial Sequence
  Description of Artificial Sequence: Synthetic oligonucleotide
  Target: ATXN1; (-) strand; PAM type: NRG; PAM sequence: GGG
tctggcatggctaaatccaa

SEQ ID NO: 63386 - DNA, 20 bp, Artificial Sequence
  Description of Artificial Sequence: Synthetic oligonucleotide
  Target: ATXN1; (-) strand; PAM type: NRG; PAM sequence: AGG
ttctggcatggctaaatcca

SEQ ID NO: 63387 - DNA, 20 bp, Artificial Sequence
  Description of Artificial Sequence: Synthetic oligonucleotide
  Target: ATXN1; (-) strand; PAM type: NRG; PAM sequence: AAG
cttctggcatggctaaatcc

SEQ ID NO: 63388 - DNA, 20 bp, Artificial Sequence
  Description of Artificial Sequence: Synthetic oligonucleotide
  Target: ATXN1; (-) strand; PAM type: NRG; PAM sequence: TGG
gatccgtctaacttctggca

SEQ ID NO: 63389 - DNA, 20 bp, Artificial Sequence
  Description of Artificial Sequence: Synthetic oligonucleotide
  Target: ATXN1; (-) strand; PAM type: NRG; PAM sequence: TGG
ccagggatccgtctaacttc

SEQ ID NO: 63390 - DNA, 20 bp, Artificial Sequence
  Description of Artificial Sequence: Synthetic oligonucleotide
  Target: ATXN1; (-) strand; PAM type: NRG; PAM sequence: GGG
aaaaaaaaaaaaaaaatcca

SEQ ID NO: 63391 - DNA, 20 bp, Artificial Sequence
  Description of Artificial Sequence: Synthetic oligonucleotide
  Target: ATXN1; (-) strand; PAM type: NRG; PAM sequence: AGG
aaaaaaaaaaaaaaaaatcc

SEQ ID NO: 63392 - DNA, 20 bp, Artificial Sequence
  Description of Artificial Sequence: Synthetic oligonucleotide
  Target: ATXN1; (-) strand; PAM type: NRG; PAM sequence: CAG
aaaaaaaaaaaaaaaaaatc

SEQ ID NO: 63393 - DNA, 20 bp, Artificial Sequence
  Description of Artificial Sequence: Synthetic oligonucleotide
  Target: ATXN1; (-) strand; PAM type: NRG; PAM sequence: AAG
ctctgtctgggtgatggagc

SEQ ID NO: 63394 - DNA, 20 bp, Artificial Sequence
  Description of Artificial Sequence: Synthetic oligonucleotide
  Target: ATXN1; (-) strand; PAM type: NRG; PAM sequence: GAG
actgctctgtctgggtgatg

SEQ ID NO: 63395 - DNA, 20 bp, Artificial Sequence
  Description of Artificial Sequence: Synthetic oligonucleotide
  Target: ATXN1; (-) strand; PAM type: NRG; PAM sequence: TGG
ccactgctctgtctgggtga

SEQ ID NO: 63396 - DNA, 20 bp, Artificial Sequence
  Description of Artificial Sequence: Synthetic oligonucleotide
  Target: ATXN1; (-) strand; PAM type: NRG; PAM sequence: GGG
accgtgccactgctctgtct

SEQ ID NO: 63397 - DNA, 20 bp, Artificial Sequence
  Description of Artificial Sequence: Synthetic oligonucleotide
  Target: ATXN1; (-) strand; PAM type: NRG; PAM sequence: TGG
gaccgtgccactgctctgtc

SEQ ID NO: 63398 - DNA, 20 bp, Artificial Sequence
  Description of Artificial Sequence: Synthetic oligonucleotide
  Target: ATXN1; (-) strand; PAM type: NRG; PAM sequence: GAG
agtcagaggttgcagtgagt

SEQ ID NO: 63399 - DNA, 20 bp, Artificial Sequence
  Description of Artificial Sequence: Synthetic oligonucleotide
  Target: ATXN1; (-) strand; PAM type: NRG; PAM sequence: GAG
tcggagtcagaggttgcagt

SEQ ID NO: 63400 - DNA, 20 bp, Artificial Sequence
  Description of Artificial Sequence: Synthetic oligonucleotide
  Target: ATXN1; (-) strand; PAM type: NRG; PAM sequence: CAG
gaactcggagtcagaggttg

SEQ ID NO: 63401 - DNA, 20 bp, Artificial Sequence
  Description of Artificial Sequence: Synthetic oligonucleotide
  Target: ATXN1; (-) strand; PAM type: NRG; PAM sequence: AGG
ttgcttgaactcggagtcag

SEQ ID NO: 63402 - DNA, 20 bp, Artificial Sequence
  Description of Artificial Sequence: Synthetic oligonucleotide
  Target: ATXN1; (-) strand; PAM type: NRG; PAM sequence: GAG
attgcttgaactcggagtca

SEQ ID NO: 63403 - DNA, 20 bp, Artificial Sequence
  Description of Artificial Sequence: Synthetic oligonucleotide
  Target: ATXN1; (-) strand; PAM type: NRG; PAM sequence: CAG
gtattgcttgaactcggagt

SEQ ID NO: 63404 - DNA, 20 bp, Artificial Sequence
  Description of Artificial Sequence: Synthetic oligonucleotide
  Target: ATXN1; (-) strand; PAM type: NRG; PAM sequence: GAG
aggagtattgcttgaactcg

SEQ ID NO: 63405 - DNA, 20 bp, Artificial Sequence
  Description of Artificial Sequence: Synthetic oligonucleotide
  Target: ATXN1; (-) strand; PAM type: NRG; PAM sequence: CGG
tcaggagtattgcttgaact

SEQ ID NO: 63406 - DNA, 20 bp, Artificial Sequence
  Description of Artificial Sequence: Synthetic oligonucleotide
  Target: ATXN1; (-) strand; PAM type: NRG; PAM sequence: GAG
tactcgggaggctgagtcag

SEQ ID NO: 63407 - DNA, 20 bp, Artificial Sequence
  Description of Artificial Sequence: Synthetic oligonucleotide
  Target: ATXN1; (-) strand; PAM type: NRG; PAM sequence: AGG
gctactcgggaggctgagtc

SEQ ID NO: 63408 - DNA, 20 bp, Artificial Sequence
  Description of Artificial Sequence: Synthetic oligonucleotide
  Target: ATXN1; (-) strand; PAM type: NRG; PAM sequence: CAG
agctactcgggaggctgagt

SEQ ID NO: 63409 - DNA, 20 bp, Artificial Sequence
  Description of Artificial Sequence: Synthetic oligonucleotide
  Target: ATXN1; (-) strand; PAM type: NRG; PAM sequence: GAG
tcccagctactcgggaggct

SEQ ID NO: 63410 - DNA, 20 bp, Artificial Sequence
  Description of Artificial Sequence: Synthetic oligonucleotide
  Target: ATXN1; (-) strand; PAM type: NRG; PAM sequence: AGG
tataatcccagctactcggg

SEQ ID NO: 63411 - DNA, 20 bp, Artificial Sequence
  Description of Artificial Sequence: Synthetic oligonucleotide
  Target: ATXN1; (-) strand; PAM type: NRG; PAM sequence: GAG
ctataatcccagctactcgg

SEQ ID NO: 63412 - DNA, 20 bp, Artificial Sequence
  Description of Artificial Sequence: Synthetic oligonucleotide
  Target: ATXN1; (-) strand; PAM type: NRG; PAM sequence: GGG
gcctataatcccagctactc

SEQ ID NO: 63413 - DNA, 20 bp, Artificial Sequence
  Description of Artificial Sequence: Synthetic oligonucleotide
  Target: ATXN1; (-) strand; PAM type: NRG; PAM sequence: CGG
tgcctataatcccagctact

SEQ ID NO: 63414 - DNA, 20 bp, Artificial Sequence
  Description of Artificial Sequence: Synthetic oligonucleotide
  Target: ATXN1; (-) strand; PAM type: NRG; PAM sequence: CAG
gtggcatatgcctataatcc

SEQ ID NO: 63415 - DNA, 20 bp, Artificial Sequence
  Description of Artificial Sequence: Synthetic oligonucleotide
  Target: ATXN1; (-) strand; PAM type: NRG; PAM sequence: TGG
taataattagccaggtgtgg

SEQ ID NO: 63416 - DNA, 20 bp, Artificial Sequence
  Description of Artificial Sequence: Synthetic oligonucleotide
  Target: ATXN1; (-) strand; PAM type: NRG; PAM sequence: TGG
taataataattagccaggtg

SEQ ID NO: 63417 - DNA, 20 bp, Artificial Sequence
  Description of Artificial Sequence: Synthetic oligonucleotide
  Target: ATXN1; (-) strand; PAM type: NRG; PAM sequence: AGG
aataataataataattagcc

SEQ ID NO: 63418 - DNA, 20 bp, Artificial Sequence
  Description of Artificial Sequence: Synthetic oligonucleotide
  Target: ATXN1; (-) strand; PAM type: NRG; PAM sequence: CAG
taataataataataattagc

SEQ ID NO: 63419 - DNA, 20 bp, Artificial Sequence
  Description of Artificial Sequence: Synthetic oligonucleotide
  Target: ATXN1; (-) strand; PAM type: NRG; PAM sequence: TAG
ataataataataataataat

SEQ ID NO: 63420 - DNA, 20 bp, Artificial Sequence
  Description of Artificial Sequence: Synthetic oligonucleotide
  Target: ATXN1; (-) strand; PAM type: NRG; PAM sequence: GAG
cactccagcctgggcaacaa

SEQ ID NO: 63421 - DNA, 20 bp, Artificial Sequence
  Description of Artificial Sequence: Synthetic oligonucleotide
  Target: ATXN1; (-) strand; PAM type: NRG; PAM sequence: AAG
tgcactccagcctgggcaac

SEQ ID NO: 63422 - DNA, 20 bp, Artificial Sequence
  Description of Artificial Sequence: Synthetic oligonucleotide
  Target: ATXN1; (-) strand; PAM type: NRG; PAM sequence: GGG
gcgccattgcactccagcct

SEQ ID NO: 63423 - DNA, 20 bp, Artificial Sequence
  Description of Artificial Sequence: Synthetic oligonucleotide
  Target: ATXN1; (-) strand; PAM type: NRG; PAM sequence: TGG
tgcgccattgcactccagcc

SEQ ID NO: 63424 - DNA, 20 bp, Artificial Sequence
  Description of Artificial Sequence: Synthetic oligonucleotide
  Target: ATXN1; (-) strand; PAM type: NRG; PAM sequence: CAG
gagattgcgccattgcactc

SEQ ID NO: 63425 - DNA, 20 bp, Artificial Sequence
  Description of Artificial Sequence: Synthetic oligonucleotide
  Target: ATXN1; (-) strand; PAM type: NRG; PAM sequence: GAG
ggcagaggttgcagtgagct

SEQ ID NO: 63426 - DNA, 20 bp, Artificial Sequence
  Description of Artificial Sequence: Synthetic oligonucleotide
  Target: ATXN1; (-) strand; PAM type: NRG; PAM sequence: GAG
tgggaggcagaggttgcagt

SEQ ID NO: 63427 - DNA, 20 bp, Artificial Sequence
  Description of Artificial Sequence: Synthetic oligonucleotide
  Target: ATXN1; (-) strand; PAM type: NRG; PAM sequence: CAG
aacctgggaggcagaggttg

SEQ ID NO: 63428 - DNA, 20 bp, Artificial Sequence
  Description of Artificial Sequence: Synthetic oligonucleotide
  Target: ATXN1; (-) strand; PAM type: NRG; PAM sequence: AGG
tgcttgaacctgggaggcag

SEQ ID NO: 63429 - DNA, 20 bp, Artificial Sequence
  Description of Artificial Sequence: Synthetic oligonucleotide
  Target: ATXN1; (-) strand; PAM type: NRG; PAM sequence: GAG
ttgcttgaacctgggaggca

SEQ ID NO: 63430 - DNA, 20 bp, Artificial Sequence
  Description of Artificial Sequence: Synthetic oligonucleotide
  Target: ATXN1; (-) strand; PAM type: NRG; PAM sequence: CAG
aattgcttgaacctgggagg

SEQ ID NO: 63431 - DNA, 20 bp, Artificial Sequence
  Description of Artificial Sequence: Synthetic oligonucleotide
  Target: ATXN1; (-) strand; PAM type: NRG; PAM sequence: AGG
gagaattgcttgaacctggg

SEQ ID NO: 63432 - DNA, 20 bp, Artificial Sequence
  Description of Artificial Sequence: Synthetic oligonucleotide
  Target: ATXN1; (-) strand; PAM type: NRG; PAM sequence: GAG
ggagaattgcttgaacctgg

SEQ ID NO: 63433 - DNA, 20 bp, Artificial Sequence
  Description of Artificial Sequence: Synthetic oligonucleotide
  Target: ATXN1; (-) strand; PAM type: NRG; PAM sequence: GGG
caggagaattgcttgaacct

SEQ ID NO: 63434 - DNA, 20 bp, Artificial Sequence
  Description of Artificial Sequence: Synthetic oligonucleotide
  Target: ATXN1; (-) strand; PAM type: NRG; PAM sequence: TGG
acaggagaattgcttgaacc

SEQ ID NO: 63435 - DNA, 20 bp, Artificial Sequence
  Description of Artificial Sequence: Synthetic oligonucleotide
  Target: ATXN1; (-) strand; PAM type: NRG; PAM sequence: GAG
tactcaggaggctgagacag

SEQ ID NO: 63436 - DNA, 20 bp, Artificial Sequence
  Description of Artificial Sequence: Synthetic oligonucleotide
  Target: ATXN1; (-) strand; PAM type: NRG; PAM sequence: AGG
gctactcaggaggctgagac

SEQ ID NO: 63437 - DNA, 20 bp, Artificial Sequence
  Description of Artificial Sequence: Synthetic oligonucleotide
  Target: ATXN1; (-) strand; PAM type: NRG; PAM sequence: CAG
agctactcaggaggctgaga

SEQ ID NO: 63438 - DNA, 20 bp, Artificial Sequence
  Description of Artificial Sequence: Synthetic oligonucleotide
  Target: ATXN1; (-) strand; PAM type: NRG; PAM sequence: GAG
tcccagctactcaggaggct

SEQ ID NO: 63439 - DNA, 20 bp, Artificial Sequence
  Description of Artificial Sequence: Synthetic oligonucleotide
  Target: ATXN1; (-) strand; PAM type: NRG; PAM sequence: AGG
tgcagtcccagctactcagg

SEQ ID NO: 63440 - DNA, 20 bp, Artificial Sequence
  Description of Artificial Sequence: Synthetic oligonucleotide
  Target: ATXN1; (-) strand; PAM type: NRG; PAM sequence: GAG
ctgcagtcccagctactcag

SEQ ID NO: 63441 - DNA, 20 bp, Artificial Sequence
  Description of Artificial Sequence: Synthetic oligonucleotide
  Target: ATXN1; (-) strand; PAM type: NRG; PAM sequence: AGG
gcctgcagtcccagctactc

SEQ ID NO: 63442 - DNA, 20 bp, Artificial Sequence
  Description of Artificial Sequence: Synthetic oligonucleotide
  Target: ATXN1; (-) strand; PAM type: NRG; PAM sequence: CAG
tgcctgcagtcccagctact

SEQ ID NO: 63443 - DNA, 20 bp, Artificial Sequence
  Description of Artificial Sequence: Synthetic oligonucleotide
  Target: ATXN1; (-) strand; PAM type: NRG; PAM sequence: CAG
gtggctggtgcctgcagtcc

SEQ ID NO: 63444 - DNA, 20 bp, Artificial Sequence
  Description of Artificial Sequence: Synthetic oligonucleotide
  Target: ATXN1; (-) strand; PAM type: NRG; PAM sequence: CAG
ggcgtagtggctggtgcctg

SEQ ID NO: 63445 - DNA, 20 bp, Artificial Sequence
  Description of Artificial Sequence: Synthetic oligonucleotide
  Target: ATXN1; (-) strand; PAM type: NRG; PAM sequence: TGG
aattagccgggcgtagtggc

SEQ ID NO: 63446 - DNA, 20 bp, Artificial Sequence
  Description of Artificial Sequence: Synthetic oligonucleotide
  Target: ATXN1; (-) strand; PAM type: NRG; PAM sequence: TGG
caaaaattagccgggcgtag

SEQ ID NO: 63447 - DNA, 20 bp, Artificial Sequence
  Description of Artificial Sequence: Synthetic oligonucleotide
  Target: ATXN1; (-) strand; PAM type: NRG; PAM sequence: TAG
taccaaaaattagccgggcg

SEQ ID NO: 63448 - DNA, 20 bp, Artificial Sequence
  Description of Artificial Sequence: Synthetic oligonucleotide
  Target: ATXN1; (-) strand; PAM type: NRG; PAM sequence: GGG
aaaaataccaaaaattagcc

SEQ ID NO: 63449 - DNA, 20 bp, Artificial Sequence
  Description of Artificial Sequence: Synthetic oligonucleotide
  Target: ATXN1; (-) strand; PAM type: NRG; PAM sequence: CGG
taaaaataccaaaaattagc

SEQ ID NO: 63450 - DNA, 20 bp, Artificial Sequence
  Description of Artificial Sequence: Synthetic oligonucleotide
  Target: ATXN1; (-) strand; PAM type: NRG; PAM sequence: TAG
ctactaaaaataccaaaaat

SEQ ID NO: 63451 - DNA, 20 bp, Artificial Sequence
  Description of Artificial Sequence: Synthetic oligonucleotide
  Target: ATXN1; (-) strand; PAM type: NRG; PAM sequence: TGG
tgtcttgaacatggccaaca

SEQ ID NO: 63452 - DNA, 20 bp, Artificial Sequence
  Description of Artificial Sequence: Synthetic oligonucleotide
  Target: ATXN1; (-) strand; PAM type: NRG; PAM sequence: TGG
agaccagcctgtcttgaaca

SEQ ID NO: 63453 - DNA, 20 bp, Artificial Sequence
  Description of Artificial Sequence: Synthetic oligonucleotide
  Target: ATXN1; (-) strand; PAM type: NRG; PAM sequence: CAG
tgaggccaggagttcaagac

SEQ ID NO: 63454 - DNA, 20 bp, Artificial Sequence
  Description of Artificial Sequence: Synthetic oligonucleotide
  Target: ATXN1; (-) strand; PAM type: NRG; PAM sequence: AAG
tcacttgaggccaggagttc

SEQ ID NO: 63455 - DNA, 20 bp, Artificial Sequence
  Description of Artificial Sequence: Synthetic oligonucleotide
  Target: ATXN1; (-) strand; PAM type: NRG; PAM sequence: GAG
ggtggatcacttgaggccag

SEQ ID NO: 63456 - DNA, 20 bp, Artificial Sequence
  Description of Artificial Sequence: Synthetic oligonucleotide
  Target: ATXN1; (-) strand; PAM type: NRG; PAM sequence: AGG
caggtggatcacttgaggcc

SEQ ID NO: 63457 - DNA, 20 bp, Artificial Sequence
  Description of Artificial Sequence: Synthetic oligonucleotide
  Target: ATXN1; (-) strand; PAM type: NRG; PAM sequence: CAG
gcaggtggatcacttgaggc

SEQ ID NO: 63458 - DNA, 20 bp, Artificial Sequence
  Description of Artificial Sequence: Synthetic oligonucleotide
  Target: ATXN1; (-) strand; PAM type: NRG; PAM sequence: AGG
tgaggcaggtggatcacttg

SEQ ID NO: 63459 - DNA, 20 bp, Artificial Sequence
  Description of Artificial Sequence: Synthetic oligonucleotide
  Target: ATXN1; (-) strand; PAM type: NRG; PAM sequence: GAG
ctgaggcaggtggatcactt

SEQ ID NO: 63460 - DNA, 20 bp, Artificial Sequence
  Description of Artificial Sequence: Synthetic oligonucleotide
  Target: ATXN1; (-) strand; PAM type: NRG; PAM sequence: TGG
ctttgggaggctgaggcagg

SEQ ID NO: 63461 - DNA, 20 bp, Artificial Sequence
  Description of Artificial Sequence: Synthetic oligonucleotide
  Target: ATXN1; (-) strand; PAM type: NRG; PAM sequence: AGG
gcactttgggaggctgaggc

SEQ ID NO: 63462 - DNA, 20 bp, Artificial Sequence
  Description of Artificial Sequence: Synthetic oligonucleotide
  Target: ATXN1; (-) strand; PAM type: NRG; PAM sequence: CAG
ggcactttgggaggctgagg

SEQ ID NO: 63463 - DNA, 20 bp, Artificial Sequence
  Description of Artificial Sequence: Synthetic oligonucleotide
  Target: ATXN1; (-) strand; PAM type: NRG; PAM sequence: AGG
cccggcactttgggaggctg

SEQ ID NO: 63464 - DNA, 20 bp, Artificial Sequence
  Description of Artificial Sequence: Synthetic oligonucleotide
  Target: ATXN1; (-) strand; PAM type: NRG; PAM sequence: GAG
tcccggcactttgggaggct

SEQ ID NO: 63465 - DNA, 20 bp, Artificial Sequence
  Description of Artificial Sequence: Synthetic oligonucleotide
  Target: ATXN1; (-) strand; PAM type: NRG; PAM sequence: AGG
tgtaatcccggcactttggg

SEQ ID NO: 63466 - DNA, 20 bp, Artificial Sequence
  Description of Artificial Sequence: Synthetic oligonucleotide
  Target: ATXN1; (-) strand; PAM type: NRG; PAM sequence: GAG
ctgtaatcccggcactttgg

SEQ ID NO: 63467 - DNA, 20 bp, Artificial Sequence
  Description of Artificial Sequence: Synthetic oligonucleotide
  Target: ATXN1; (-) strand; PAM type: NRG; PAM sequence: GGG
acctgtaatcccggcacttt

SEQ ID NO: 63468 - DNA, 20 bp, Artificial Sequence
  Description of Artificial Sequence: Synthetic oligonucleotide
  Target: ATXN1; (-) strand; PAM type: NRG; PAM sequence: TGG
cacctgtaatcccggcactt

SEQ ID NO: 63469 - DNA, 20 bp, Artificial Sequence
  Description of Artificial Sequence: Synthetic oligonucleotide
  Target: ATXN1; (-) strand; PAM type: NRG; PAM sequence: CGG
atggctcacacctgtaatcc

SEQ ID NO: 63470 - DNA, 20 bp, Artificial Sequence
  Description of Artificial Sequence: Synthetic oligonucleotide
  Target: ATXN1; (-) strand; PAM type: NRG; PAM sequence: TGG
agggatcaggccgggcgcca

SEQ ID NO: 63471 - DNA, 20 bp, Artificial Sequence
  Description of Artificial Sequence: Synthetic oligonucleotide
  Target: ATXN1; (-) strand; PAM type: NRG; PAM sequence: GGG
aaaattccagggatcaggcc

SEQ ID NO: 63472 - DNA, 20 bp, Artificial Sequence
  Description of Artificial Sequence: Synthetic oligonucleotide
  Target: ATXN1; (-) strand; PAM type: NRG; PAM sequence: CGG
aaaaattccagggatcaggc

SEQ ID NO: 63473 - DNA, 20 bp, Artificial Sequence
  Description of Artificial Sequence: Synthetic oligonucleotide
  Target: ATXN1; (-) strand; PAM type: NRG; PAM sequence: AGG
aactaaaaattccagggatc

SEQ ID NO: 63474 - DNA, 20 bp, Artificial Sequence
  Description of Artificial Sequence: Synthetic oligonucleotide
  Target: ATXN1; (-) strand; PAM type: NRG; PAM sequence: CAG
taactaaaaattccagggat

SEQ ID NO: 63475 - DNA, 20 bp, Artificial Sequence
  Description of Artificial Sequence: Synthetic oligonucleotide
  Target: ATXN1; (-) strand; PAM type: NRG; PAM sequence: GGG
taatataactaaaaattcca

SEQ ID NO: 63476 - DNA, 20 bp, Artificial Sequence
  Description of Artificial Sequence: Synthetic oligonucleotide
  Target: ATXN1; (-) strand; PAM type: NRG; PAM sequence: AGG
ataatataactaaaaattcc

SEQ ID NO: 63477 - DNA, 20 bp, Artificial Sequence
  Description of Artificial Sequence: Synthetic oligonucleotide
  Target: ATXN1; (-) strand; PAM type: NRG; PAM sequence: CAG
cataatataactaaaaattc

SEQ ID NO: 63478 - DNA, 20 bp, Artificial Sequence
  Description of Artificial Sequence: Synthetic oligonucleotide
  Target: ATXN1; (-) strand; PAM type: NRG; PAM sequence: TGG
ttgtgggctacgttagaatt

SEQ ID NO: 63479 - DNA, 20 bp, Artificial Sequence
  Description of Artificial Sequence: Synthetic oligonucleotide
  Target: ATXN1; (-) strand; PAM type: NRG; PAM sequence: TAG
ggcaatcttgtgggctacgt

SEQ ID NO: 63480 - DNA, 20 bp, Artificial Sequence
  Description of Artificial Sequence: Synthetic oligonucleotide
  Target: ATXN1; (-) strand; PAM type: NRG; PAM sequence: GGG
aggggacatggcaatcttgt

SEQ ID NO: 63481 - DNA, 20 bp, Artificial Sequence
  Description of Artificial Sequence: Synthetic oligonucleotide
  Target: ATXN1; (-) strand; PAM type: NRG; PAM sequence: TGG
caggggacatggcaatcttg

SEQ ID NO: 63482 - DNA, 20 bp, Artificial Sequence
  Description of Artificial Sequence: Synthetic oligonucleotide
  Target: ATXN1; (-) strand; PAM type: NRG; PAM sequence: TGG
tgtgtgtctggcaggggaca

SEQ ID NO: 63483 - DNA, 20 bp, Artificial Sequence
  Description of Artificial Sequence: Synthetic oligonucleotide
  Target: ATXN1; (-) strand; PAM type: NRG; PAM sequence: GGG
aagaggtgtgtgtctggcag

SEQ ID NO: 63484 - DNA, 20 bp, Artificial Sequence
  Description of Artificial Sequence: Synthetic oligonucleotide
  Target: ATXN1; (-) strand; PAM type: NRG; PAM sequence: GGG
gaagaggtgtgtgtctggca

SEQ ID NO: 63485 - DNA, 20 bp, Artificial Sequence
  Description of Artificial Sequence: Synthetic oligonucleotide
  Target: ATXN1; (-) strand; PAM type: NRG; PAM sequence: AGG
ggaagaggtgtgtgtctggc

SEQ ID NO: 63486 - DNA, 20 bp, Artificial Sequence
  Description of Artificial Sequence: Synthetic oligonucleotide
  Target: ATXN1; (-) strand; PAM type: NRG; PAM sequence: CAG
gggaagaggtgtgtgtctgg

SEQ ID NO: 63487 - DNA, 20 bp, Artificial Sequence
  Description of Artificial Sequence: Synthetic oligonucleotide
  Target: ATXN1; (-) strand; PAM type: NRG; PAM sequence: TGG
actgggaagaggtgtgtgtc

SEQ ID NO: 63488 - DNA, 20 bp, Artificial Sequence
  Description of Artificial Sequence: Synthetic oligonucleotide
  Target: ATXN1; (-) strand; PAM type: NRG; PAM sequence: AGG
cccactgactaactgggaag

SEQ ID NO: 63489 - DNA, 20 bp, Artificial Sequence
  Description of Artificial Sequence: Synthetic oligonucleotide
  Target: ATXN1; (-) strand; PAM type: NRG; PAM sequence: GAG
tcccactgactaactgggaa

SEQ ID NO: 63490 - DNA, 20 bp, Artificial Sequence
  Description of Artificial Sequence: Synthetic oligonucleotide
  Target: ATXN1; (-) strand; PAM type: NRG; PAM sequence: AAG
tgtcccactgactaactggg

SEQ ID NO: 63491 - DNA, 20 bp, Artificial Sequence
  Description of Artificial Sequence: Synthetic oligonucleotide
  Target: ATXN1; (-) strand; PAM type: NRG; PAM sequence: GGG
tactgtcccactgactaact

SEQ ID NO: 63492 - DNA, 20 bp, Artificial Sequence
  Description of Artificial Sequence: Synthetic oligonucleotide
  Target: ATXN1; (-) strand; PAM type: NRG; PAM sequence: TGG
ttactgtcccactgactaac

SEQ ID NO: 63493 - DNA, 20 bp, Artificial Sequence
  Description of Artificial Sequence: Synthetic oligonucleotide
  Target: ATXN1; (-) strand; PAM type: NRG; PAM sequence: CAG
gcaaaatcccttcacaacag

SEQ ID NO: 63494 - DNA, 20 bp, Artificial Sequence
  Description of Artificial Sequence: Synthetic oligonucleotide
  Target: ATXN1; (-) strand; PAM type: NRG; PAM sequence: CAG
tttgcaaaatcccttcacaa

SEQ ID NO: 63495 - DNA, 20 bp, Artificial Sequence
  Description of Artificial Sequence: Synthetic oligonucleotide
  Target: ATXN1; (-) strand; PAM type: NRG; PAM sequence: TGG
attttaaggttggttgactt

SEQ ID NO: 63496 - DNA, 20 bp, Artificial Sequence
  Description of Artificial Sequence: Synthetic oligonucleotide
  Target: ATXN1; (-) strand; PAM type: NRG; PAM sequence: TGG
taatctctctattttaaggt

SEQ ID NO: 63497 - DNA, 20 bp, Artificial Sequence
  Description of Artificial Sequence: Synthetic oligonucleotide
  Target: ATXN1; (-) strand; PAM type: NRG; PAM sequence: AGG
aagataatctctctatttta

SEQ ID NO: 63498 - DNA, 20 bp, Artificial Sequence
  Description of Artificial Sequence: Synthetic oligonucleotide
  Target: ATXN1; (-) strand; PAM type: NRG; PAM sequence: AAG
caagataatctctctatttt

SEQ ID NO: 63499 - DNA, 20 bp, Artificial Sequence
  Description of Artificial Sequence: Synthetic oligonucleotide
  Target: ATXN1; (-) strand; PAM type: NRG; PAM sequence: AAG
ttaattagatcaggctcacc

SEQ ID NO: 63500 - DNA, 20 bp, Artificial Sequence
  Description of Artificial Sequence: Synthetic oligonucleotide
  Target: ATXN1; (-) strand; PAM type: NRG; PAM sequence: AGG
agggttctcttaattagatc

SEQ ID NO: 63501 - DNA, 20 bp, Artificial Sequence
  Description of Artificial Sequence: Synthetic oligonucleotide
  Target: ATXN1; (-) strand; PAM type: NRG; PAM sequence: CAG
tagggttctcttaattagat

SEQ ID NO: 63502 - DNA, 20 bp, Artificial Sequence
  Description of Artificial Sequence: Synthetic oligonucleotide
  Target: ATXN1; (-) strand; PAM type: NRG; PAM sequence: TAG
ccttttagggttctcttaat

SEQ ID NO: 63503 - DNA, 20 bp, Artificial Sequence
  Description of Artificial Sequence: Synthetic oligonucleotide
  Target: ATXN1; (-) strand; PAM type: NRG; PAM sequence: GGG
gtaaagccccatccctttta

SEQ ID NO: 63504 - DNA, 20 bp, Artificial Sequence
  Description of Artificial Sequence: Synthetic oligonucleotide
  Target: ATXN1; (-) strand; PAM type: NRG; PAM sequence: AGG
ggtaaagccccatccctttt

SEQ ID NO: 63505 - DNA, 20 bp, Artificial Sequence
  Description of Artificial Sequence: Synthetic oligonucleotide
  Target: ATXN1; (-) strand; PAM type: NRG; PAM sequence: TAG
tggtaaagccccatcccttt

SEQ ID NO: 63506 - DNA, 20 bp, Artificial Sequence
  Description of Artificial Sequence: Synthetic oligonucleotide
  Target: ATXN1; (-) strand; PAM type: NRG; PAM sequence: AAG
tttgaatctcattcctggta

SEQ ID NO: 63507 - DNA, 20 bp, Artificial Sequence
  Description of Artificial Sequence: Synthetic oligonucleotide
  Target: ATXN1; (-) strand; PAM type: NRG; PAM sequence: TGG
ctcactttgaatctcattcc

SEQ ID NO: 63508 - DNA, 20 bp, Artificial Sequence
  Description of Artificial Sequence: Synthetic oligonucleotide
  Target: ATXN1; (-) strand; PAM type: NRG; PAM sequence: CAG
caggtcctggcattcacctt

SEQ ID NO: 63509 - DNA, 20 bp, Artificial Sequence
  Description of Artificial Sequence: Synthetic oligonucleotide
  Target: ATXN1; (-) strand; PAM type: NRG; PAM sequence: TGG
tgggggccactctcaggtcc

SEQ ID NO: 63510 - DNA, 20 bp, Artificial Sequence
  Description of Artificial Sequence: Synthetic oligonucleotide
  Target: ATXN1; (-) strand; PAM type: NRG; PAM sequence: AGG
gtgagctgggggccactctc

SEQ ID NO: 63511 - DNA, 20 bp, Artificial Sequence
  Description of Artificial Sequence: Synthetic oligonucleotide
  Target: ATXN1; (-) strand; PAM type: NRG; PAM sequence: CAG
tgtgagctgggggccactct

SEQ ID NO: 63512 - DNA, 20 bp, Artificial Sequence
  Description of Artificial Sequence: Synthetic oligonucleotide
  Target: ATXN1; (-) strand; PAM type: NRG; PAM sequence: GGG
cattgctggctgtgagctgg

SEQ ID NO: 63513 - DNA, 20 bp, Artificial Sequence
  Description of Artificial Sequence: Synthetic oligonucleotide
  Target: ATXN1; (-) strand; PAM type: NRG; PAM sequence: GGG
ccattgctggctgtgagctg

SEQ ID NO: 63514 - DNA, 20 bp, Artificial Sequence
  Description of Artificial Sequence: Synthetic oligonucleotide
  Target: ATXN1; (-) strand; PAM type: NRG; PAM sequence: GGG
tccattgctggctgtgagct

SEQ ID NO: 63515 - DNA, 20 bp, Artificial Sequence
  Description of Artificial Sequence: Synthetic oligonucleotide
  Target: ATXN1; (-) strand; PAM type: NRG; PAM sequence: TGG
ttccattgctggctgtgagc

SEQ ID NO: 63516 - DNA, 20 bp, Artificial Sequence
  Description of Artificial Sequence: Synthetic oligonucleotide
  Target: ATXN1; (-) strand; PAM type: NRG; PAM sequence: GAG
cccgttccattgctggctgt

SEQ ID NO: 63517 - DNA, 20 bp, Artificial Sequence
  Description of Artificial Sequence: Synthetic oligonucleotide
  Target: ATXN1; (-) strand; PAM type: NRG; PAM sequence: TGG
ccaaggtcccgttccattgc

SEQ ID NO: 63518 - DNA, 20 bp, Artificial Sequence
  Description of Artificial Sequence: Synthetic oligonucleotide
  Target: ATXN1; (-) strand; PAM type: NRG; PAM sequence: AGG
ttcttgtggtcgtaggacca

SEQ ID NO: 63519 - DNA, 20 bp, Artificial Sequence
  Description of Artificial Sequence: Synthetic oligonucleotide
  Target: ATXN1; (-) strand; PAM type: NRG; PAM sequence: AAG
tttcttgtggtcgtaggacc

SEQ ID NO: 63520 - DNA, 20 bp, Artificial Sequence
  Description of Artificial Sequence: Synthetic oligonucleotide
  Target: ATXN1; (-) strand; PAM type: NRG; PAM sequence: AGG
atttagtttcttgtggtcgt

SEQ ID NO: 63521 - DNA, 20 bp, Artificial Sequence
  Description of Artificial Sequence: Synthetic oligonucleotide
  Target: ATXN1; (-) strand; PAM type: NRG; PAM sequence: TAG
tatttagtttcttgtggtcg

SEQ ID NO: 63522 - DNA, 20 bp, Artificial Sequence
  Description of Artificial Sequence: Synthetic oligonucleotide
  Target: ATXN1; (-) strand; PAM type: NRG; PAM sequence: TGG
tttttgtatttagtttcttg

SEQ ID NO: 63523 - DNA, 20 bp, Artificial Sequence
  Description of Artificial Sequence: Synthetic oligonucleotide
  Target: ATXN1; (-) strand; PAM type: NRG; PAM sequence: TAG
ctcacatggttttttgtatt

SEQ ID NO: 63524 - DNA, 20 bp, Artificial Sequence
  Description of Artificial Sequence: Synthetic oligonucleotide
  Target: ATXN1; (-) strand; PAM type: NRG; PAM sequence: TGG
ggtcctttttcaagctcaca

SEQ ID NO: 63525 - DNA, 20 bp, Artificial Sequence
  Description of Artificial Sequence: Synthetic oligonucleotide
  Target: ATXN1; (-) strand; PAM type: NRG; PAM sequence: AAG
ggagctcatggtcctttttc

SEQ ID NO: 63526 - DNA, 20 bp, Artificial Sequence
  Description of Artificial Sequence: Synthetic oligonucleotide
  Target: ATXN1; (-) strand; PAM type: NRG; PAM sequence: TGG
gccttattatctggagctca

SEQ ID NO: 63527 - DNA, 20 bp, Artificial Sequence
  Description of Artificial Sequence: Synthetic oligonucleotide
  Target: ATXN1; (-) strand; PAM type: NRG; PAM sequence: GAG
cagggctgccttattatctg

SEQ ID NO: 63528 - DNA, 20 bp, Artificial Sequence
  Description of Artificial Sequence: Synthetic oligonucleotide
  Target: ATXN1; (-) strand; PAM type: NRG; PAM sequence: TGG
aacagggctgccttattatc

SEQ ID NO: 63529 - DNA, 20 bp, Artificial Sequence
  Description of Artificial Sequence: Synthetic oligonucleotide
  Target: ATXN1; (-) strand; PAM type: NRG; PAM sequence: GGG
ctgaaattgaggtgtcaaca

SEQ ID NO: 63530 - DNA, 20 bp, Artificial Sequence
  Description of Artificial Sequence: Synthetic oligonucleotide
  Target: ATXN1; (-) strand; PAM type: NRG; PAM sequence: AGG
actgaaattgaggtgtcaac

SEQ ID NO: 63531 - DNA, 20 bp, Artificial Sequence
  Description of Artificial Sequence: Synthetic oligonucleotide
  Target: ATXN1; (-) strand; PAM type: NRG; PAM sequence: CAG
gactgaaattgaggtgtcaa

SEQ ID NO: 63532 - DNA, 20 bp, Artificial Sequence
  Description of Artificial Sequence: Synthetic oligonucleotide
  Target: ATXN1; (-) strand; PAM type: NRG; PAM sequence: AGG
gtttcataagactgaaattg

SEQ ID NO: 63533 - DNA, 20 bp, Artificial Sequence
  Description of Artificial Sequence: Synthetic oligonucleotide
  Target: ATXN1; (-) strand; PAM type: NRG; PAM sequence: GAG
ggtttcataagactgaaatt

SEQ ID NO: 63534 - DNA, 20 bp, Artificial Sequence
  Description of Artificial Sequence: Synthetic oligonucleotide
  Target: ATXN1; (-) strand; PAM type: NRG; PAM sequence: AAG
ttatctgttcagggtttcat

SEQ ID NO: 63535 - DNA, 20 bp, Artificial Sequence
  Description of Artificial Sequence: Synthetic oligonucleotide
  Target: ATXN1; (-) strand; PAM type: NRG; PAM sequence: GGG
ttagctgaattatctgttca

SEQ ID NO: 63536 - DNA, 20 bp, Artificial Sequence
  Description of Artificial Sequence: Synthetic oligonucleotide
  Target: ATXN1; (-) strand; PAM type: NRG; PAM sequence: AGG
cttagctgaattatctgttc

SEQ ID NO: 63537 - DNA, 20 bp, Artificial Sequence
  Description of Artificial Sequence: Synthetic oligonucleotide
  Target: ATXN1; (-) strand; PAM type: NRG; PAM sequence: CAG
gcttagctgaattatctgtt

SEQ ID NO: 63538 - DNA, 20 bp, Artificial Sequence
  Description of Artificial Sequence: Synthetic oligonucleotide
  Target: ATXN1; (-) strand; PAM type: NRG; PAM sequence: TAG
tccgaagtccaggcatggct

SEQ ID NO: 63539 - DNA, 20 bp, Artificial Sequence
  Description of Artificial Sequence: Synthetic oligonucleotide
  Target: ATXN1; (-) strand; PAM type: NRG; PAM sequence: TGG
ggaggtccgaagtccaggca

SEQ ID NO: 63540 - DNA, 20 bp, Artificial Sequence
  Description of Artificial Sequence: Synthetic oligonucleotide
  Target: ATXN1; (-) strand; PAM type: NRG; PAM sequence: AGG
ctgttggaggtccgaagtcc

SEQ ID NO: 63541 - DNA, 20 bp, Artificial Sequence
  Description of Artificial Sequence: Synthetic oligonucleotide
  Target: ATXN1; (-) strand; PAM type: NRG; PAM sequence: CAG
tctgttggaggtccgaagtc

SEQ ID NO: 63542 - DNA, 20 bp, Artificial Sequence
  Description of Artificial Sequence: Synthetic oligonucleotide
  Target: ATXN1; (-) strand; PAM type: NRG; PAM sequence: AAG
aattatctgttggaggtccg

SEQ ID NO: 63543 - DNA, 20 bp, Artificial Sequence
  Description of Artificial Sequence: Synthetic oligonucleotide
  Target: ATXN1; (-) strand; PAM type: NRG; PAM sequence: AGG
ttagttgaattatctgttgg

SEQ ID NO: 63544 - DNA, 20 bp, Artificial Sequence
  Description of Artificial Sequence: Synthetic oligonucleotide
  Target: ATXN1; (-) strand; PAM type: NRG; PAM sequence: GAG
cttagttgaattatctgttg

SEQ ID NO: 63545 - DNA, 20 bp, Artificial Sequence
  Description of Artificial Sequence: Synthetic oligonucleotide
  Target: ATXN1; (-) strand; PAM type: NRG; PAM sequence: TGG
ggcttagttgaattatctgt

SEQ ID NO: 63546 - DNA, 20 bp, Artificial Sequence
  Description of Artificial Sequence: Synthetic oligonucleotide
  Target: ATXN1; (-) strand; PAM type: NRG; PAM sequence: TAG
tgcgaagtccaggcatggct

SEQ ID NO: 63547 - DNA, 20 bp, Artificial Sequence
  Description of Artificial Sequence: Synthetic oligonucleotide
  Target: ATXN1; (-) strand; PAM type: NRG; PAM sequence: TGG
ggaggtgcgaagtccaggca

SEQ ID NO: 63548 - DNA, 20 bp, Artificial Sequence
  Description of Artificial Sequence: Synthetic oligonucleotide
  Target: ATXN1; (-) strand; PAM type: NRG; PAM sequence: AGG
tttctggaggtgcgaagtcc

SEQ ID NO: 63549 - DNA, 20 bp, Artificial Sequence
  Description of Artificial Sequence: Synthetic oligonucleotide
  Target: ATXN1; (-) strand; PAM type: NRG; PAM sequence: CAG
gtttctggaggtgcgaagtc

SEQ ID NO: 63550 - DNA, 20 bp, Artificial Sequence
  Description of Artificial Sequence: Synthetic oligonucleotide
  Target: ATXN1; (-) strand; PAM type: NRG; PAM sequence: AAG
tcacagtttctggaggtgcg

SEQ ID NO: 63551 - DNA, 20 bp, Artificial Sequence
  Description of Artificial Sequence: Synthetic oligonucleotide
  Target: ATXN1; (-) strand; PAM type: NRG; PAM sequence: AGG
tattatctcacagtttctgg

SEQ ID NO: 63552 - DNA, 20 bp, Artificial Sequence
  Description of Artificial Sequence: Synthetic oligonucleotide
  Target: ATXN1; (-) strand; PAM type: NRG; PAM sequence: GAG
ttattatctcacagtttctg

SEQ ID NO: 63553 - DNA, 20 bp, Artificial Sequence
  Description of Artificial Sequence: Synthetic oligonucleotide
  Target: ATXN1; (-) strand; PAM type: NRG; PAM sequence: TGG
atttattatctcacagtttc

SEQ ID NO: 63554 - DNA, 20 bp, Artificial Sequence
  Description of Artificial Sequence: Synthetic oligonucleotide
  Target: ATXN1; (-) strand; PAM type: NRG; PAM sequence: CAG
aatacctatttattatctca

SEQ ID NO: 63555 - DNA, 20 bp, Artificial Sequence
  Description of Artificial Sequence: Synthetic oligonucleotide
  Target: ATXN1; (-) strand; PAM type: NRG; PAM sequence: GAG
ccaccccactacagtcccca

SEQ ID NO: 63556 - DNA, 20 bp, Artificial Sequence
  Description of Artificial Sequence: Synthetic oligonucleotide
  Target: ATXN1; (-) strand; PAM type: NRG; PAM sequence: CAG
ccccaccccactacagtccc

SEQ ID NO: 63557 - DNA, 20 bp, Artificial Sequence
  Description of Artificial Sequence: Synthetic oligonucleotide
  Target: ATXN1; (-) strand; PAM type: NRG; PAM sequence: CAG
ccgctccccccaccccacta

SEQ ID NO: 63558 - DNA, 20 bp, Artificial Sequence
  Description of Artificial Sequence: Synthetic oligonucleotide
  Target: ATXN1; (-) strand; PAM type: NRG; PAM sequence: AGG
ttaactcgtcatctagcatt

SEQ ID NO: 63559 - DNA, 20 bp, Artificial Sequence
  Description of Artificial Sequence: Synthetic oligonucleotide
  Target: ATXN1; (-) strand; PAM type: NRG; PAM sequence: TAG
attaactcgtcatctagcat

SEQ ID NO: 63560 - DNA, 20 bp, Artificial Sequence
  Description of Artificial Sequence: Synthetic oligonucleotide
  Target: ATXN1; (-) strand; PAM type: NRG; PAM sequence: TAG
gcacccattaactcgtcatc

SEQ ID NO: 63561 - DNA, 20 bp, Artificial Sequence
  Description of Artificial Sequence: Synthetic oligonucleotide
  Target: ATXN1; (-) strand; PAM type: NRG; PAM sequence: TGG
tatgtatacatgtgccatgc

SEQ ID NO: 63562 - DNA, 20 bp, Artificial Sequence
  Description of Artificial Sequence: Synthetic oligonucleotide
  Target: ATXN1; (-) strand; PAM type: NRG; PAM sequence: TAG
catgtgcacaatgtgcaggt

SEQ ID NO: 63563 - DNA, 20 bp, Artificial Sequence
  Description of Artificial Sequence: Synthetic oligonucleotide
  Target: ATXN1; (-) strand; PAM type: NRG; PAM sequence: AGG
ggtacatgtgcacaatgtgc

SEQ ID NO: 63564 - DNA, 20 bp, Artificial Sequence
  Description of Artificial Sequence: Synthetic oligonucleotide
  Target: ATXN1; (-) strand; PAM type: NRG; PAM sequence: CAG
gggtacatgtgcacaatgtg

SEQ ID NO: 63565 - DNA, 20 bp, Artificial Sequence
  Description of Artificial Sequence: Synthetic oligonucleotide
  Target: ATXN1; (-) strand; PAM type: NRG; PAM sequence: GGG
ttattatactttaggtttta

SEQ ID NO: 63566 - DNA, 20 bp, Artificial Sequence
  Description of Artificial Sequence: Synthetic oligonucleotide
  Target: ATXN1; (-) strand; PAM type: NRG; PAM sequence: AGG
attattatactttaggtttt

SEQ ID NO: 63567 - DNA, 20 bp, Artificial Sequence
  Description of Artificial Sequence: Synthetic oligonucleotide
  Target: ATXN1; (-) strand; PAM type: NRG; PAM sequence: TAG
tattattatactttaggttt

SEQ ID NO: 63568 - DNA, 20 bp, Artificial Sequence
  Description of Artificial Sequence: Synthetic oligonucleotide
  Target: ATXN1; (-) strand; PAM type: NRG; PAM sequence: AGG
tgttattattattatacttt

SEQ ID NO: 63569 - DNA, 20 bp, Artificial Sequence
  Description of Artificial Sequence: Synthetic oligonucleotide
  Target: ATXN1; (-) strand; PAM type: NRG; PAM sequence: TAG
atgttattattattatactt

SEQ ID NO: 63570 - DNA, 20 bp, Artificial Sequence
  Description of Artificial Sequence: Synthetic oligonucleotide
  Target: ATXN1; (-) strand; PAM type: NRG; PAM sequence: TAG
tgtatgacaaactacaaata

SEQ ID NO: 63571 - DNA, 20 bp, Artificial Sequence
  Description of Artificial Sequence: Synthetic oligonucleotide
  Target: ATXN1; (-) strand; PAM type: NRG; PAM sequence: TGG
gtattgtattatatgtggat

SEQ ID NO: 63572 - DNA, 20 bp, Artificial Sequence
  Description of Artificial Sequence: Synthetic oligonucleotide
  Target: ATXN1; (-) strand; PAM type: NRG; PAM sequence: TGG
gaaatgtattgtattatatg

SEQ ID NO: 63573 - DNA, 20 bp, Artificial Sequence
  Description of Artificial Sequence: Synthetic oligonucleotide
  Target: ATXN1; (-) strand; PAM type: NRG; PAM sequence: AAG
gtgattcaagcaaaaaaaaa

SEQ ID NO: 63574 - DNA, 20 bp, Artificial Sequence
  Description of Artificial Sequence: Synthetic oligonucleotide
  Target: ATXN1; (-) strand; PAM type: NRG; PAM sequence: AAG
aattaaactcaaagtgattc

SEQ ID NO: 63575 - DNA, 20 bp, Artificial Sequence
  Description of Artificial Sequence: Synthetic oligonucleotide
  Target: ATXN1; (-) strand; PAM type: NRG; PAM sequence: AAG
caatagacaaattaaactca

SEQ ID NO: 63576 - DNA, 20 bp, Artificial Sequence
  Description of Artificial Sequence: Synthetic oligonucleotide
  Target: ATXN1; (-) strand; PAM type: NRG; PAM sequence: TAG
tttgtttattttggttacaa

SEQ ID NO: 63577 - DNA, 20 bp, Artificial Sequence
  Description of Artificial Sequence: Synthetic oligonucleotide
  Target: ATXN1; (-) strand; PAM type: NRG; PAM sequence: TGG
ttaagaatatttgtttattt

SEQ ID NO: 63578 - DNA, 20 bp, Artificial Sequence
  Description of Artificial Sequence: Synthetic oligonucleotide
  Target: ATXN1; (-) strand; PAM type: NRG; PAM sequence: AAG
agtaccatctcagagaaatt

SEQ ID NO: 63579 - DNA, 20 bp, Artificial Sequence
  Description of Artificial Sequence: Synthetic oligonucleotide
  Target: ATXN1; (-) strand; PAM type: NRG; PAM sequence: GAG
cccaagaaagtaccatctca

SEQ ID NO: 63580 - DNA, 20 bp, Artificial Sequence
  Description of Artificial Sequence: Synthetic oligonucleotide
  Target: ATXN1; (-) strand; PAM type: NRG; PAM sequence: CAG
aacccaagaaagtaccatct

SEQ ID NO: 63581 - DNA, 20 bp, Artificial Sequence
  Description of Artificial Sequence: Synthetic oligonucleotide
  Target: ATXN1; (-) strand; PAM type: NRG; PAM sequence: AAG
gtaatataaggaacccaaga

SEQ ID NO: 63582 - DNA, 20 bp, Artificial Sequence
  Description of Artificial Sequence: Synthetic oligonucleotide
  Target: ATXN1; (-) strand; PAM type: NRG; PAM sequence: AAG
aggagtaatataaggaaccc

SEQ ID NO: 63583 - DNA, 20 bp, Artificial Sequence
  Description of Artificial Sequence: Synthetic oligonucleotide
  Target: ATXN1; (-) strand; PAM type: NRG; PAM sequence: AGG
gggccataaggagtaatata

SEQ ID NO: 63584 - DNA, 20 bp, Artificial Sequence
  Description of Artificial Sequence: Synthetic oligonucleotide
  Target: ATXN1; (-) strand; PAM type: NRG; PAM sequence: AAG
ggggccataaggagtaatat

SEQ ID NO: 63585 - DNA, 20 bp, Artificial Sequence
  Description of Artificial Sequence: Synthetic oligonucleotide
  Target: ATXN1; (-) strand; PAM type: NRG; PAM sequence: GAG
aactgcagaggggccataag

SEQ ID NO: 63586 - DNA, 20 bp, Artificial Sequence
  Description of Artificial Sequence: Synthetic oligonucleotide
  Target: ATXN1; (-) strand; PAM type: NRG; PAM sequence: AGG
aaaactgcagaggggccata

SEQ ID NO: 63587 - DNA, 20 bp, Artificial Sequence
  Description of Artificial Sequence: Synthetic oligonucleotide
  Target: ATXN1; (-) strand; PAM type: NRG; PAM sequence: AAG
aaaaactgcagaggggccat

SEQ ID NO: 63588 - DNA, 20 bp, Artificial Sequence
  Description of Artificial Sequence: Synthetic oligonucleotide
  Target: ATXN1; (-) strand; PAM type: NRG; PAM sequence: GGG
gagagcaaaaaactgcagag

SEQ ID NO: 63589 - DNA, 20 bp, Artificial Sequence
  Description of Artificial Sequence: Synthetic oligonucleotide
  Target: ATXN1; (-) strand; PAM type: NRG; PAM sequence: GGG
agagagcaaaaaactgcaga

SEQ ID NO: 63590 - DNA, 20 bp, Artificial Sequence
  Description of Artificial Sequence: Synthetic oligonucleotide
  Target: ATXN1; (-) strand; PAM type: NRG; PAM sequence: AGG
gagagagcaaaaaactgcag

SEQ ID NO: 63591 - DNA, 20 bp, Artificial Sequence
  Description of Artificial Sequence: Synthetic oligonucleotide
  Target: ATXN1; (-) strand; PAM type: NRG; PAM sequence: GAG
agagagagcaaaaaactgca

SEQ ID NO: 63592 - DNA, 20 bp, Artificial Sequence
  Description of Artificial Sequence: Synthetic oligonucleotide
  Target: ATXN1; (-) strand; PAM type: NRG; PAM sequence: CAG
acagagagagcaaaaaactg

SEQ ID NO: 63593 - DNA, 20 bp, Artificial Sequence
  Description of Artificial Sequence: Synthetic oligonucleotide
  Target: ATXN1; (-) strand; PAM type: NRG; PAM sequence: GAG
agagttagaaagaacagaga

SEQ ID NO: 63594 - DNA, 20 bp, Artificial Sequence
  Description of Artificial Sequence: Synthetic oligonucleotide
  Target: ATXN1; (-) strand; PAM type: NRG; PAM sequence: GAG
ctagagttagaaagaacaga

SEQ ID NO: 63595 - DNA, 20 bp, Artificial Sequence
  Description of Artificial Sequence: Synthetic oligonucleotide
  Target: ATXN1; (-) strand; PAM type: NRG; PAM sequence: GAG
ccctagagttagaaagaaca

SEQ ID NO: 63596 - DNA, 20 bp, Artificial Sequence
  Description of Artificial Sequence: Synthetic oligonucleotide
  Target: ATXN1; (-) strand; PAM type: NRG; PAM sequence: CAG
tcccctagagttagaaagaa

SEQ ID NO: 63597 - DNA, 20 bp, Artificial Sequence
  Description of Artificial Sequence: Synthetic oligonucleotide
  Target: ATXN1; (-) strand; PAM type: NRG; PAM sequence: AAG
atctgtcccctagagttaga

SEQ ID NO: 63598 - DNA, 20 bp, Artificial Sequence
  Description of Artificial Sequence: Synthetic oligonucleotide
  Target: ATXN1; (-) strand; PAM type: NRG; PAM sequence: TAG
ggaaatctgtcccctagagt

SEQ ID NO: 63599 - DNA, 20 bp, Artificial Sequence
  Description of Artificial Sequence: Synthetic oligonucleotide
  Target: ATXN1; (-) strand; PAM type: NRG; PAM sequence: GAG
cttaggaaatctgtccccta

SEQ ID NO: 63600 - DNA, 20 bp, Artificial Sequence
  Description of Artificial Sequence: Synthetic oligonucleotide
  Target: ATXN1; (-) strand; PAM type: NRG; PAM sequence: TAG
gccttaggaaatctgtcccc

SEQ ID NO: 63601 - DNA, 20 bp, Artificial Sequence
  Description of Artificial Sequence: Synthetic oligonucleotide
  Target: ATXN1; (-) strand; PAM type: NRG; PAM sequence: AGG
agaactgagcagatagcctt

SEQ ID NO: 63602 - DNA, 20 bp, Artificial Sequence
  Description of Artificial Sequence: Synthetic oligonucleotide
  Target: ATXN1; (-) strand; PAM type: NRG; PAM sequence: TAG
tagaactgagcagatagcct

SEQ ID NO: 63603 - DNA, 20 bp, Artificial Sequence
  Description of Artificial Sequence: Synthetic oligonucleotide
  Target: ATXN1; (-) strand; PAM type: NRG; PAM sequence: TAG
agtgaatagaactgagcaga

SEQ ID NO: 63604 - DNA, 20 bp, Artificial Sequence
  Description of Artificial Sequence: Synthetic oligonucleotide
  Target: ATXN1; (-) strand; PAM type: NRG; PAM sequence: CAG
agaaagtgaatagaactgag

SEQ ID NO: 63605 - DNA, 20 bp, Artificial Sequence
  Description of Artificial Sequence: Synthetic oligonucleotide
  Target: ATXN1; (-) strand; PAM type: NRG; PAM sequence: GAG
tatagaaagtgaatagaact

SEQ ID NO: 63606 - DNA, 20 bp, Artificial Sequence
  Description of Artificial Sequence: Synthetic oligonucleotide
  Target: ATXN1; (-) strand; PAM type: NRG; PAM sequence: TAG
aaatcattatagaaagtgaa

SEQ ID NO: 63607 - DNA, 20 bp, Artificial Sequence
  Description of Artificial Sequence: Synthetic oligonucleotide
  Target: ATXN1; (-) strand; PAM type: NRG; PAM sequence: AAG
tagaaggaaatcattataga

SEQ ID NO: 63608 - DNA, 20 bp, Artificial Sequence
  Description of Artificial Sequence: Synthetic oligonucleotide
  Target: ATXN1; (-) strand; PAM type: NRG; PAM sequence: TAG
acagtagaaggaaatcatta

SEQ ID NO: 63609 - DNA, 20 bp, Artificial Sequence
  Description of Artificial Sequence: Synthetic oligonucleotide
  Target: ATXN1; (-) strand; PAM type: NRG; PAM sequence: AGG
taagaacgataaacagtaga

SEQ ID NO: 63610 - DNA, 20 bp, Artificial Sequence
  Description of Artificial Sequence: Synthetic oligonucleotide
  Target: ATXN1; (-) strand; PAM type: NRG; PAM sequence: AAG
ttaagaacgataaacagtag

SEQ ID NO: 63611 - DNA, 20 bp, Artificial Sequence
  Description of Artificial Sequence: Synthetic oligonucleotide
  Target: ATXN1; (-) strand; PAM type: NRG; PAM sequence: TAG
gatttaagaacgataaacag

SEQ ID NO: 63612 - DNA, 20 bp, Artificial Sequence
  Description of Artificial Sequence: Synthetic oligonucleotide
  Target: ATXN1; (-) strand; PAM type: NRG; PAM sequence: CAG
acagatttaagaacgataaa

SEQ ID NO: 63613 - DNA, 20 bp, Artificial Sequence
  Description of Artificial Sequence: Synthetic oligonucleotide
  Target: ATXN1; (-) strand; PAM type: NRG; PAM sequence: AAG
agggaccaggatacagattt

SEQ ID NO: 63614 - DNA, 20 bp, Artificial Sequence
  Description of Artificial Sequence: Synthetic oligonucleotide
  Target: ATXN1; (-) strand; PAM type: NRG; PAM sequence: CAG
agataccagggaccaggata

SEQ ID NO: 63615 - DNA, 20 bp, Artificial Sequence
  Description of Artificial Sequence: Synthetic oligonucleotide
  Target: ATXN1; (-) strand; PAM type: NRG; PAM sequence: AGG
agggggagataccagggacc

SEQ ID NO: 63616 - DNA, 20 bp, Artificial Sequence
  Description of Artificial Sequence: Synthetic oligonucleotide
  Target: ATXN1; (-) strand; PAM type: NRG; PAM sequence: CAG
tagggggagataccagggac

SEQ ID NO: 63617 - DNA, 20 bp, Artificial Sequence
  Description of Artificial Sequence: Synthetic oligonucleotide
  Target: ATXN1; (-) strand; PAM type: NRG; PAM sequence: GGG
gtttgtagggggagatacca

SEQ ID NO: 63618 - DNA, 20 bp, Artificial Sequence
  Description of Artificial Sequence: Synthetic oligonucleotide
  Target: ATXN1; (-) strand; PAM type: NRG; PAM sequence: AGG
agtttgtagggggagatacc

SEQ ID NO: 63619 - DNA, 20 bp, Artificial Sequence
  Description of Artificial Sequence: Synthetic oligonucleotide
  Target: ATXN1; (-) strand; PAM type: NRG; PAM sequence: CAG
gagtttgtagggggagatac

SEQ ID NO: 63620 - DNA, 20 bp, Artificial Sequence
  Description of Artificial Sequence: Synthetic oligonucleotide
  Target: ATXN1; (-) strand; PAM type: NRG; PAM sequence: GAG
tatccaggagtttgtagggg

SEQ ID NO: 63621 - DNA, 20 bp, Artificial Sequence
  Description of Artificial Sequence: Synthetic oligonucleotide
  Target: ATXN1; (-) strand; PAM type: NRG; PAM sequence: GGG
tatatccaggagtttgtagg

SEQ ID NO: 63622 - DNA, 20 bp, Artificial Sequence
  Description of Artificial Sequence: Synthetic oligonucleotide
  Target: ATXN1; (-) strand; PAM type: NRG; PAM sequence: GGG
atatatccaggagtttgtag

SEQ ID NO: 63623 - DNA, 20 bp, Artificial Sequence
  Description of Artificial Sequence: Synthetic oligonucleotide
  Target: ATXN1; (-) strand; PAM type: NRG; PAM sequence: GGG
catatatccaggagtttgta

SEQ ID NO: 63624 - DNA, 20 bp, Artificial Sequence
  Description of Artificial Sequence: Synthetic oligonucleotide
  Target: ATXN1; (-) strand; PAM type: NRG; PAM sequence: AGG
gcatatatccaggagtttgt

SEQ ID NO: 63625 - DNA, 20 bp, Artificial Sequence
  Description of Artificial Sequence: Synthetic oligonucleotide
  Target: ATXN1; (-) strand; PAM type: NRG; PAM sequence: TAG
tgcatatatccaggagtttg

SEQ ID NO: 63626 - DNA, 20 bp, Artificial Sequence
  Description of Artificial Sequence: Synthetic oligonucleotide
  Target: ATXN1; (-) strand; PAM type: NRG; PAM sequence: GAG
tttccactgcatatatccag

SEQ ID NO: 63627 - DNA, 20 bp, Artificial Sequence
  Description of Artificial Sequence: Synthetic oligonucleotide
  Target: ATXN1; (-) strand; PAM type: NRG; PAM sequence: AGG
tgtttccactgcatatatcc

SEQ ID NO: 63628 - DNA, 20 bp, Artificial Sequence
  Description of Artificial Sequence: Synthetic oligonucleotide
  Target: ATXN1; (-) strand; PAM type: NRG; PAM sequence: CAG
ttgtttccactgcatatatc

SEQ ID NO: 63629 - DNA, 20 bp, Artificial Sequence
  Description of Artificial Sequence: Synthetic oligonucleotide
  Target: ATXN1; (-) strand; PAM type: NRG; PAM sequence: AAG
tttggagcaagggactggga

SEQ ID NO: 63630 - DNA, 20 bp, Artificial Sequence
  Description of Artificial Sequence: Synthetic oligonucleotide
  Target: ATXN1; (-) strand; PAM type: NRG; PAM sequence: GGG
tgggtttggagcaagggact

SEQ ID NO: 63631 - DNA, 20 bp, Artificial Sequence
  Description of Artificial Sequence: Synthetic oligonucleotide
  Target: ATXN1; (-) strand; PAM type: NRG; PAM sequence: TGG
ctgggtttggagcaagggac

SEQ ID NO: 63632 - DNA, 20 bp, Artificial Sequence
  Description of Artificial Sequence: Synthetic oligonucleotide
  Target: ATXN1; (-) strand; PAM type: NRG; PAM sequence: GGG
aggagctgggtttggagcaa

SEQ ID NO: 63633 - DNA, 20 bp, Artificial Sequence
  Description of Artificial Sequence: Synthetic oligonucleotide
  Target: ATXN1; (-) strand; PAM type: NRG; PAM sequence: AGG
gaggagctgggtttggagca

SEQ ID NO: 63634 - DNA, 20 bp, Artificial Sequence
  Description of Artificial Sequence: Synthetic oligonucleotide
  Target: ATXN1; (-) strand; PAM type: NRG; PAM sequence: AAG
ggaggagctgggtttggagc

SEQ ID NO: 63635 - DNA, 20 bp, Artificial Sequence
  Description of Artificial Sequence: Synthetic oligonucleotide
  Target: ATXN1; (-) strand; PAM type: NRG; PAM sequence: GAG
aagaggaggagctgggtttg

SEQ ID NO: 63636 - DNA, 20 bp, Artificial Sequence
  Description of Artificial Sequence: Synthetic oligonucleotide
  Target: ATXN1; (-) strand; PAM type: NRG; PAM sequence: TGG
taaagaggaggagctgggtt

SEQ ID NO: 63637 - DNA, 20 bp, Artificial Sequence
  Description of Artificial Sequence: Synthetic oligonucleotide
  Target: ATXN1; (-) strand; PAM type: NRG; PAM sequence: GGG
gaaattaaagaggaggagct

SEQ ID NO: 63638 - DNA, 20 bp, Artificial Sequence
  Description of Artificial Sequence: Synthetic oligonucleotide
  Target: ATXN1; (-) strand; PAM type: NRG; PAM sequence: TGG
agaaattaaagaggaggagc

SEQ ID NO: 63639 - DNA, 20 bp, Artificial Sequence
  Description of Artificial Sequence: Synthetic oligonucleotide
  Target: ATXN1; (-) strand; PAM type: NRG; PAM sequence: GAG
catcagaaattaaagaggag

SEQ ID NO: 63640 - DNA, 20 bp, Artificial Sequence
  Description of Artificial Sequence: Synthetic oligonucleotide
  Target: ATXN1; (-) strand; PAM type: NRG; PAM sequence: AGG
tccatcagaaattaaagagg

SEQ ID NO: 63641 - DNA, 20 bp, Artificial Sequence
  Description of Artificial Sequence: Synthetic oligonucleotide
  Target: ATXN1; (-) strand; PAM type: NRG; PAM sequence: GAG
ttccatcagaaattaaagag

SEQ ID NO: 63642 - DNA, 20 bp, Artificial Sequence
  Description of Artificial Sequence: Synthetic oligonucleotide
  Target: ATXN1; (-) strand; PAM type: NRG; PAM sequence: AGG
gcttccatcagaaattaaag

SEQ ID NO: 63643 - DNA, 20 bp, Artificial Sequence
  Description of Artificial Sequence: Synthetic oligonucleotide
  Target: ATXN1; (-) strand; PAM type: NRG; PAM sequence: GAG
agcttccatcagaaattaaa

SEQ ID NO: 63644 - DNA, 20 bp, Artificial Sequence
  Description of Artificial Sequence: Synthetic oligonucleotide
  Target: ATXN1; (-) strand; PAM type: NRG; PAM sequence: AAG
tcagcttccatcagaaatta

SEQ ID NO: 63645 - DNA, 20 bp, Artificial Sequence
  Description of Artificial Sequence: Synthetic oligonucleotide
  Target: ATXN1; (-) strand; PAM type: NRG; PAM sequence: CAG
atgatgctgtcagcttccat

SEQ ID NO: 63646 - DNA, 20 bp, Artificial Sequence
  Description of Artificial Sequence: Synthetic oligonucleotide
  Target: ATXN1; (-) strand; PAM type: NRG; PAM sequence: CAG
gtagaagatgatgatgctgt

SEQ ID NO: 63647 - DNA, 20 bp, Artificial Sequence
  Description of Artificial Sequence: Synthetic oligonucleotide
  Target: ATXN1; (-) strand; PAM type: NRG; PAM sequence: AAG
gaatgtgggagaaagagtag

SEQ ID NO: 63648 - DNA, 20 bp, Artificial Sequence
  Description of Artificial Sequence: Synthetic oligonucleotide
  Target: ATXN1; (-) strand; PAM type: NRG; PAM sequence: TAG
atggaatgtgggagaaagag

SEQ ID NO: 63649 - DNA, 20 bp, Artificial Sequence
  Description of Artificial Sequence: Synthetic oligonucleotide
  Target: ATXN1; (-) strand; PAM type: NRG; PAM sequence: GAG
ccgatggaatgtgggagaaa

SEQ ID NO: 63650 - DNA, 20 bp, Artificial Sequence
  Description of Artificial Sequence: Synthetic oligonucleotide
  Target: ATXN1; (-) strand; PAM type: NRG; PAM sequence: AAG
aaccgatggaatgtgggaga

SEQ ID NO: 63651 - DNA, 20 bp, Artificial Sequence
  Description of Artificial Sequence: Synthetic oligonucleotide
  Target: ATXN1; (-) strand; PAM type: NRG; PAM sequence: GAG
tggaaaccgatggaatgtgg

SEQ ID NO: 63652 - DNA, 20 bp, Artificial Sequence
  Description of Artificial Sequence: Synthetic oligonucleotide
  Target: ATXN1; (-) strand; PAM type: NRG; PAM sequence: GGG
cttggaaaccgatggaatgt

SEQ ID NO: 63653 - DNA, 20 bp, Artificial Sequence
  Description of Artificial Sequence: Synthetic oligonucleotide
  Target: ATXN1; (-) strand; PAM type: NRG; PAM sequence: TGG
acttggaaaccgatggaatg

SEQ ID NO: 63654 - DNA, 20 bp, Artificial Sequence
  Description of Artificial Sequence: Synthetic oligonucleotide
  Target: ATXN1; (-) strand; PAM type: NRG; PAM sequence: TGG
tggtaggacttggaaaccga

SEQ ID NO: 63655 - DNA, 20 bp, Artificial Sequence
  Description of Artificial Sequence: Synthetic oligonucleotide
  Target: ATXN1; (-) strand; PAM type: NRG; PAM sequence: TGG
ggtgcagaattggtaggact

SEQ ID NO: 63656 - DNA, 20 bp, Artificial Sequence
  Description of Artificial Sequence: Synthetic oligonucleotide
  Target: ATXN1; (-) strand; PAM type: NRG; PAM sequence: AGG
agaaagggtgcagaattggt

SEQ ID NO: 63657 - DNA, 20 bp, Artificial Sequence
  Description of Artificial Sequence: Synthetic oligonucleotide
  Target: ATXN1; (-) strand; PAM type: NRG; PAM sequence: TAG
tagaaagggtgcagaattgg

SEQ ID NO: 63658 - DNA, 20 bp, Artificial Sequence
  Description of Artificial Sequence: Synthetic oligonucleotide
  Target: ATXN1; (-) strand; PAM type: NRG; PAM sequence: TGG
agatagaaagggtgcagaat

SEQ ID NO: 63659 - DNA, 20 bp, Artificial Sequence
  Description of Artificial Sequence: Synthetic oligonucleotide
  Target: ATXN1; (-) strand; PAM type: NRG; PAM sequence: CAG
cggtgaagatagaaagggtg

SEQ ID NO: 63660 - DNA, 20 bp, Artificial Sequence
  Description of Artificial Sequence: Synthetic oligonucleotide
  Target: ATXN1; (-) strand; PAM type: NRG; PAM sequence: GGG
tggggcggtgaagatagaaa

SEQ ID NO: 63661 - DNA, 20 bp, Artificial Sequence
  Description of Artificial Sequence: Synthetic oligonucleotide
  Target: ATXN1; (-) strand; PAM type: NRG; PAM sequence: AGG
atggggcggtgaagatagaa

SEQ ID NO: 63662 - DNA, 20 bp, Artificial Sequence
  Description of Artificial Sequence: Synthetic oligonucleotide
  Target: ATXN1; (-) strand; PAM type: NRG; PAM sequence: AAG
catggggcggtgaagataga

SEQ ID NO: 63663 - DNA, 20 bp, Artificial Sequence
  Description of Artificial Sequence: Synthetic oligonucleotide
  Target: ATXN1; (-) strand; PAM type: NRG; PAM sequence: TAG
ctagcatggggcggtgaaga

SEQ ID NO: 63664 - DNA, 20 bp, Artificial Sequence
  Description of Artificial Sequence: Synthetic oligonucleotide
  Target: ATXN1; (-) strand; PAM type: NRG; PAM sequence: AAG
tgagctagcatggggcggtg

SEQ ID NO: 63665 - DNA, 20 bp, Artificial Sequence
  Description of Artificial Sequence: Synthetic oligonucleotide
  Target: ATXN1; (-) strand; PAM type: NRG; PAM sequence: CGG
cagtctgagctagcatgggg

SEQ ID NO: 63666 - DNA, 20 bp, Artificial Sequence
  Description of Artificial Sequence: Synthetic oligonucleotide
  Target: ATXN1; (-) strand; PAM type: NRG; PAM sequence: GGG
attcagtctgagctagcatg

SEQ ID NO: 63667 - DNA, 20 bp, Artificial Sequence
  Description of Artificial Sequence: Synthetic oligonucleotide
  Target: ATXN1; (-) strand; PAM type: NRG; PAM sequence: GGG
aattcagtctgagctagcat

SEQ ID NO: 63668 - DNA, 20 bp, Artificial Sequence
  Description of Artificial Sequence: Synthetic oligonucleotide
  Target: ATXN1; (-) strand; PAM type: NRG; PAM sequence: TGG
gaattcagtctgagctagca

SEQ ID NO: 63669 - DNA, 20 bp, Artificial Sequence
  Description of Artificial Sequence: Synthetic oligonucleotide
  Target: ATXN1; (-) strand; PAM type: NRG; PAM sequence: TAG
gagaggaattcagtctgagc

SEQ ID NO: 63670 - DNA, 20 bp, Artificial Sequence
  Description of Artificial Sequence: Synthetic oligonucleotide
  Target: ATXN1; (-) strand; PAM type: NRG; PAM sequence: GAG
ctgtgagaggaattcagtct

SEQ ID NO: 63671 - DNA, 20 bp, Artificial Sequence
  Description of Artificial Sequence: Synthetic oligonucleotide
  Target: ATXN1; (-) strand; PAM type: NRG; PAM sequence: CAG
aggctgctgtgagaggaatt

SEQ ID NO: 63672 - DNA, 20 bp, Artificial Sequence
  Description of Artificial Sequence: Synthetic oligonucleotide
  Target: ATXN1; (-) strand; PAM type: NRG; PAM sequence: AGG
aatgagcaggctgctgtgag

SEQ ID NO: 63673 - DNA, 20 bp, Artificial Sequence
  Description of Artificial Sequence: Synthetic oligonucleotide
  Target: ATXN1; (-) strand; PAM type: NRG; PAM sequence: GAG
caatgagcaggctgctgtga

SEQ ID NO: 63674 - DNA, 20 bp, Artificial Sequence
  Description of Artificial Sequence: Synthetic oligonucleotide
  Target: ATXN1; (-) strand; PAM type: NRG; PAM sequence: GAG
accaatgagcaggctgctgt

SEQ ID NO: 63675 - DNA, 20 bp, Artificial Sequence
  Description of Artificial Sequence: Synthetic oligonucleotide
  Target: ATXN1; (-) strand; PAM type: NRG; PAM sequence: AGG
tgacaagaagaccaatgagc

SEQ ID NO: 63676 - DNA, 20 bp, Artificial Sequence
  Description of Artificial Sequence: Synthetic oligonucleotide
  Target: ATXN1; (-) strand; PAM type: NRG; PAM sequence: CAG
ttgacaagaagaccaatgag

SEQ ID NO: 63677 - DNA, 20 bp, Artificial Sequence
  Description of Artificial Sequence: Synthetic oligonucleotide
  Target: ATXN1; (-) strand; PAM type: NRG; PAM sequence: GAG
gcattgacaagaagaccaat

SEQ ID NO: 63678 - DNA, 20 bp, Artificial Sequence
  Description of Artificial Sequence: Synthetic oligonucleotide
  Target: ATXN1; (-) strand; PAM type: NRG; PAM sequence: AAG
agagagaaagcattgacaag

SEQ ID NO: 63679 - DNA, 20 bp, Artificial Sequence
  Description of Artificial Sequence: Synthetic oligonucleotide
  Target: ATXN1; (-) strand; PAM type: NRG; PAM sequence: AAG
tagagagagaaagcattgac

SEQ ID NO: 63680 - DNA, 20 bp, Artificial Sequence
  Description of Artificial Sequence: Synthetic oligonucleotide
  Target: ATXN1; (-) strand; PAM type: NRG; PAM sequence: AAG
tcaaatggtttagagagaga

SEQ ID NO: 63681 - DNA, 20 bp, Artificial Sequence
  Description of Artificial Sequence: Synthetic oligonucleotide
  Target: ATXN1; (-) strand; PAM type: NRG; PAM sequence: GAG
tgactcaaatggtttagaga

SEQ ID NO: 63682 - DNA, 20 bp, Artificial Sequence
  Description of Artificial Sequence: Synthetic oligonucleotide
  Target: ATXN1; (-) strand; PAM type: NRG; PAM sequence: GAG
gatgactcaaatggtttaga

SEQ ID NO: 63683 - DNA, 20 bp, Artificial Sequence
  Description of Artificial Sequence: Synthetic oligonucleotide
  Target: ATXN1; (-) strand; PAM type: NRG; PAM sequence: GAG
gggatgactcaaatggttta

SEQ ID NO: 63684 - DNA, 20 bp, Artificial Sequence
  Description of Artificial Sequence: Synthetic oligonucleotide
  Target: ATXN1; (-) strand; PAM type: NRG; PAM sequence: TAG
cagggatgactcaaatggtt

SEQ ID NO: 63685 - DNA, 20 bp, Artificial Sequence
  Description of Artificial Sequence: Synthetic oligonucleotide
  Target: ATXN1; (-) strand; PAM type: NRG; PAM sequence: TGG
tccaacagggatgactcaaa

SEQ ID NO: 63686 - DNA, 20 bp, Artificial Sequence
  Description of Artificial Sequence: Synthetic oligonucleotide
  Target: ATXN1; (-) strand; PAM type: NRG; PAM sequence: GGG
ttaggaagttcgatccaaca

SEQ ID NO: 63687 - DNA, 20 bp, Artificial Sequence
  Description of Artificial Sequence: Synthetic oligonucleotide
  Target: ATXN1; (-) strand; PAM type: NRG; PAM sequence: AGG
tttaggaagttcgatccaac

SEQ ID NO: 63688 - DNA, 20 bp, Artificial Sequence
  Description of Artificial Sequence: Synthetic oligonucleotide
  Target: ATXN1; (-) strand; PAM type: NRG; PAM sequence: CAG
ctttaggaagttcgatccaa

SEQ ID NO: 63689 - DNA, 20 bp, Artificial Sequence
  Description of Artificial Sequence: Synthetic oligonucleotide
  Target: ATXN1; (-) strand; PAM type: NRG; PAM sequence: AAG
tgtgttatatctactttagg

SEQ ID NO: 63690 - DNA, 20 bp, Artificial Sequence
  Description of Artificial Sequence: Synthetic oligonucleotide
  Target: ATXN1; (-) strand; PAM type: NRG; PAM sequence: AGG
agttgtgttatatctacttt

SEQ ID NO: 63691 - DNA, 20 bp, Artificial Sequence
  Description of Artificial Sequence: Synthetic oligonucleotide
  Target: ATXN1; (-) strand; PAM type: NRG; PAM sequence: TAG
aagttgtgttatatctactt

SEQ ID NO: 63692 - DNA, 20 bp, Artificial Sequence
  Description of Artificial Sequence: Synthetic oligonucleotide
  Target: ATXN1; (-) strand; PAM type: NRG; PAM sequence: AAG
aaggtatggatggcacgggg

SEQ ID NO: 63693 - DNA, 20 bp, Artificial Sequence
  Description of Artificial Sequence: Synthetic oligonucleotide
  Target: ATXN1; (-) strand; PAM type: NRG; PAM sequence: GGG
atgaaggtatggatggcacg

SEQ ID NO: 63694 - DNA, 20 bp, Artificial Sequence
  Description of Artificial Sequence: Synthetic oligonucleotide
  Target: ATXN1; (-) strand; PAM type: NRG; PAM sequence: GGG
aatgaaggtatggatggcac

SEQ ID NO: 63695 - DNA, 20 bp, Artificial Sequence
  Description of Artificial Sequence: Synthetic oligonucleotide
  Target: ATXN1; (-) strand; PAM type: NRG; PAM sequence: CGG
caatgaaggtatggatggca

SEQ ID NO: 63696 - DNA, 20 bp, Artificial Sequence
  Description of Artificial Sequence: Synthetic oligonucleotide
  Target: ATXN1; (-) strand; PAM type: NRG; PAM sequence: TGG
ggaaccaatgaaggtatgga

SEQ ID NO: 63697 - DNA, 20 bp, Artificial Sequence
  Description of Artificial Sequence: Synthetic oligonucleotide
  Target: ATXN1; (-) strand; PAM type: NRG; PAM sequence: TGG
tgtaggaaccaatgaaggta

SEQ ID NO: 63698 - DNA, 20 bp, Artificial Sequence
  Description of Artificial Sequence: Synthetic oligonucleotide
  Target: ATXN1; (-) strand; PAM type: NRG; PAM sequence: AGG
taagctgtaggaaccaatga

SEQ ID NO: 63699 - DNA, 20 bp, Artificial Sequence
  Description of Artificial Sequence: Synthetic oligonucleotide
  Target: ATXN1; (-) strand; PAM type: NRG; PAM sequence: AAG
gtaagctgtaggaaccaatg

SEQ ID NO: 63700 - DNA, 20 bp, Artificial Sequence
  Description of Artificial Sequence: Synthetic oligonucleotide
  Target: ATXN1; (-) strand; PAM type: NRG; PAM sequence: AGG
gaagatgttcagtaagctgt

SEQ ID NO: 63701 - DNA, 20 bp, Artificial Sequence
  Description of Artificial Sequence: Synthetic oligonucleotide
  Target: ATXN1; (-) strand; PAM type: NRG; PAM sequence: TAG
cgaagatgttcagtaagctg

SEQ ID NO: 63702 - DNA, 20 bp, Artificial Sequence
  Description of Artificial Sequence: Synthetic oligonucleotide
  Target: ATXN1; (-) strand; PAM type: NRG; PAM sequence: AAG
gaatttcgaagatgttcagt

SEQ ID NO: 63703 - DNA, 20 bp, Artificial Sequence
  Description of Artificial Sequence: Synthetic oligonucleotide
  Target: ATXN1; (-) strand; PAM type: NRG; PAM sequence: CAG
taaagaatttcgaagatgtt

SEQ ID NO: 63704 - DNA, 20 bp, Artificial Sequence
  Description of Artificial Sequence: Synthetic oligonucleotide
  Target: ATXN1; (-) strand; PAM type: NRG; PAM sequence: AAG
gcatcaaataaagaatttcg

SEQ ID NO: 63705 - DNA, 20 bp, Artificial Sequence
  Description of Artificial Sequence: Synthetic oligonucleotide
  Target: ATXN1; (-) strand; PAM type: NRG; PAM sequence: AAG
aagatcttcagcatcaaata

SEQ ID NO: 63706 - DNA, 20 bp, Artificial Sequence
  Description of Artificial Sequence: Synthetic oligonucleotide
  Target: ATXN1; (-) strand; PAM type: NRG; PAM sequence: CAG
ggccagattgtgaagatctt

SEQ ID NO: 63707 - DNA, 20 bp, Artificial Sequence
  Description of Artificial Sequence: Synthetic oligonucleotide
  Target: ATXN1; (-) strand; PAM type: NRG; PAM sequence: AAG
catgctggggccagattgtg

SEQ ID NO: 63708 - DNA, 20 bp, Artificial Sequence
  Description of Artificial Sequence: Synthetic oligonucleotide
  Target: ATXN1; (-) strand; PAM type: NRG; PAM sequence: CAG
ttggaaaagcatgctggggc

SEQ ID NO: 63709 - DNA, 20 bp, Artificial Sequence
  Description of Artificial Sequence: Synthetic oligonucleotide
  Target: ATXN1; (-) strand; PAM type: NRG; PAM sequence: GGG
gaagttggaaaagcatgctg

SEQ ID NO: 63710 - DNA, 20 bp, Artificial Sequence
  Description of Artificial Sequence: Synthetic oligonucleotide
  Target: ATXN1; (-) strand; PAM type: NRG; PAM sequence: GGG
tgaagttggaaaagcatgct

SEQ ID NO: 63711 - DNA, 20 bp, Artificial Sequence
  Description of Artificial Sequence: Synthetic oligonucleotide
  Target: ATXN1; (-) strand; PAM type: NRG; PAM sequence: TGG
atgaagttggaaaagcatgc

SEQ ID NO: 63712 - DNA, 20 bp, Artificial Sequence
  Description of Artificial Sequence: Synthetic oligonucleotide
  Target: ATXN1; (-) strand; PAM type: NRG; PAM sequence: AAG
aagtagaaatgaagttggaa

SEQ ID NO: 63713 - DNA, 20 bp, Artificial Sequence
  Description of Artificial Sequence: Synthetic oligonucleotide
  Target: ATXN1; (-) strand; PAM type: NRG; PAM sequence: TGG
gggagaagtagaaatgaagt

SEQ ID NO: 63714 - DNA, 20 bp, Artificial Sequence
  Description of Artificial Sequence: Synthetic oligonucleotide
  Target: ATXN1; (-) strand; PAM type: NRG; PAM sequence: AAG
tgaggggagaagtagaaatg

SEQ ID NO: 63715 - DNA, 20 bp, Artificial Sequence
  Description of Artificial Sequence: Synthetic oligonucleotide
  Target: ATXN1; (-) strand; PAM type: NRG; PAM sequence: TAG
agtgtgcatgaggggagaag

SEQ ID NO: 63716 - DNA, 20 bp, Artificial Sequence
  Description of Artificial Sequence: Synthetic oligonucleotide
  Target: ATXN1; (-) strand; PAM type: NRG; PAM sequence: AAG
ttcagtgtgcatgaggggag

SEQ ID NO: 63717 - DNA, 20 bp, Artificial Sequence
  Description of Artificial Sequence: Synthetic oligonucleotide
  Target: ATXN1; (-) strand; PAM type: NRG; PAM sequence: GAG
tgcttcagtgtgcatgaggg

SEQ ID NO: 63718 - DNA, 20 bp, Artificial Sequence
  Description of Artificial Sequence: Synthetic oligonucleotide
  Target: ATXN1; (-) strand; PAM type: NRG; PAM sequence: GGG
gctgcttcagtgtgcatgag

SEQ ID NO: 63719 - DNA, 20 bp, Artificial Sequence
  Description of Artificial Sequence: Synthetic oligonucleotide
  Target: ATXN1; (-) strand; PAM type: NRG; PAM sequence: GGG
ggctgcttcagtgtgcatga

SEQ ID NO: 63720 - DNA, 20 bp, Artificial Sequence
  Description of Artificial Sequence: Synthetic oligonucleotide
  Target: ATXN1; (-) strand; PAM type: NRG; PAM sequence: AGG
tggctgcttcagtgtgcatg

SEQ ID NO: 63721 - DNA, 20 bp, Artificial Sequence
  Description of Artificial Sequence: Synthetic oligonucleotide
  Target: ATXN1; (-) strand; PAM type: NRG; PAM sequence: GAG
gtggctgcttcagtgtgcat

SEQ ID NO: 63722 - DNA, 20 bp, Artificial Sequence
  Description of Artificial Sequence: Synthetic oligonucleotide
  Target: ATXN1; (-) strand; PAM type: NRG; PAM sequence: CAG
gaagctcactgtggctgctt

SEQ ID NO: 63723 - DNA, 20 bp, Artificial Sequence
  Description of Artificial Sequence: Synthetic oligonucleotide
  Target: ATXN1; (-) strand; PAM type: NRG; PAM sequence: TGG
aggaagtgagaagctcactg

SEQ ID NO: 63724 - DNA, 20 bp, Artificial Sequence
  Description of Artificial Sequence: Synthetic oligonucleotide
  Target: ATXN1; (-) strand; PAM type: NRG; PAM sequence: AAG
gctctcagagaggaagtgag

SEQ ID NO: 63725 - DNA, 20 bp, Artificial Sequence
  Description of Artificial Sequence: Synthetic oligonucleotide
  Target: ATXN1; (-) strand; PAM type: NRG; PAM sequence: GAG
cgggctctcagagaggaagt

SEQ ID NO: 63726 - DNA, 20 bp, Artificial Sequence
  Description of Artificial Sequence: Synthetic oligonucleotide
  Target: ATXN1; (-) strand; PAM type: NRG; PAM sequence: AAG
aatgcgggctctcagagagg

SEQ ID NO: 63727 - DNA, 20 bp, Artificial Sequence
  Description of Artificial Sequence: Synthetic oligonucleotide
  Target: ATXN1; (-) strand; PAM type: NRG; PAM sequence: AGG
agaaatgcgggctctcagag

SEQ ID NO: 63728 - DNA, 20 bp, Artificial Sequence
  Description of Artificial Sequence: Synthetic oligonucleotide
  Target: ATXN1; (-) strand; PAM type: NRG; PAM sequence: GAG
tagaaatgcgggctctcaga

SEQ ID NO: 63729 - DNA, 20 bp, Artificial Sequence
  Description of Artificial Sequence: Synthetic oligonucleotide
  Target: ATXN1; (-) strand; PAM type: NRG; PAM sequence: GAG
agtagaaatgcgggctctca

SEQ ID NO: 63730 - DNA, 20 bp, Artificial Sequence
  Description of Artificial Sequence: Synthetic oligonucleotide
  Target: ATXN1; (-) strand; PAM type: NRG; PAM sequence: CAG
ggagtagaaatgcgggctct

SEQ ID NO: 63731 - DNA, 20 bp, Artificial Sequence
  Description of Artificial Sequence: Synthetic oligonucleotide
  Target: ATXN1; (-) strand; PAM type: NRG; PAM sequence: GGG
gacacgtggagtagaaatgc

SEQ ID NO: 63732 - DNA, 20 bp, Artificial Sequence
  Description of Artificial Sequence: Synthetic oligonucleotide
  Target: ATXN1; (-) strand; PAM type: NRG; PAM sequence: CGG
tgacacgtggagtagaaatg

SEQ ID NO: 63733 - DNA, 20 bp, Artificial Sequence
  Description of Artificial Sequence: Synthetic oligonucleotide
  Target: ATXN1; (-) strand; PAM type: NRG; PAM sequence: TAG
ttacattttgacacgtggag

SEQ ID NO: 63734 - DNA, 20 bp, Artificial Sequence
  Description of Artificial Sequence: Synthetic oligonucleotide
  Target: ATXN1; (-) strand; PAM type: NRG; PAM sequence: GAG
ggcttacattttgacacgtg

SEQ ID NO: 63735 - DNA, 20 bp, Artificial Sequence
  Description of Artificial Sequence: Synthetic oligonucleotide
  Target: ATXN1; (-) strand; PAM type: NRG; PAM sequence: TGG
ctggcttacattttgacacg

SEQ ID NO: 63736 - DNA, 20 bp, Artificial Sequence
  Description of Artificial Sequence: Synthetic oligonucleotide
  Target: ATXN1; (-) strand; PAM type: NRG; PAM sequence: TGG
tgagctggtcttgggaggtc

SEQ ID NO: 63737 - DNA, 20 bp, Artificial Sequence
  Description of Artificial Sequence: Synthetic oligonucleotide
  Target: ATXN1; (-) strand; PAM type: NRG; PAM sequence: AGG
ggatttgagctggtcttggg

SEQ ID NO: 63738 - DNA, 20 bp, Artificial Sequence
  Description of Artificial Sequence: Synthetic oligonucleotide
  Target: ATXN1; (-) strand; PAM type: NRG; PAM sequence: GAG
gggatttgagctggtcttgg

SEQ ID NO: 63739 - DNA, 20 bp, Artificial Sequence
  Description of Artificial Sequence: Synthetic oligonucleotide
  Target: ATXN1; (-) strand; PAM type: NRG; PAM sequence: GGG
gtgggatttgagctggtctt

SEQ ID NO: 63740 - DNA, 20 bp, Artificial Sequence
  Description of Artificial Sequence: Synthetic oligonucleotide
  Target: ATXN1; (-) strand; PAM type: NRG; PAM sequence: TGG
agtgggatttgagctggtct

SEQ ID NO: 63741 - DNA, 20 bp, Artificial Sequence
  Description of Artificial Sequence: Synthetic oligonucleotide
  Target: ATXN1; (-) strand; PAM type: NRG; PAM sequence: TGG
agaaaaagtgggatttgagc

SEQ ID NO: 63742 - DNA, 20 bp, Artificial Sequence
  Description of Artificial Sequence: Synthetic oligonucleotide
  Target: ATXN1; (-) strand; PAM type: NRG; PAM sequence: GAG
ttgtagaaaaagtgggattt

SEQ ID NO: 63743 - DNA, 20 bp, Artificial Sequence
  Description of Artificial Sequence: Synthetic oligonucleotide
  Target: ATXN1; (-) strand; PAM type: NRG; PAM sequence: GGG
aaaagagttgtagaaaaagt

SEQ ID NO: 63744 - DNA, 20 bp, Artificial Sequence
  Description of Artificial Sequence: Synthetic oligonucleotide
  Target: ATXN1; (-) strand; PAM type: NRG; PAM sequence: TGG
taaaagagttgtagaaaaag

SEQ ID NO: 63745 - DNA, 20 bp, Artificial Sequence
  Description of Artificial Sequence: Synthetic oligonucleotide
  Target: ATXN1; (-) strand; PAM type: NRG; PAM sequence: AAG
ggataaaagagttgtagaaa

SEQ ID NO: 63746 - DNA, 20 bp, Artificial Sequence
  Description of Artificial Sequence: Synthetic oligonucleotide
  Target: ATXN1; (-) strand; PAM type: NRG; PAM sequence: TAG
ataagaggataaaagagttg

SEQ ID NO: 63747 - DNA, 20 bp, Artificial Sequence
  Description of Artificial Sequence: Synthetic oligonucleotide
  Target: ATXN1; (-) strand; PAM type: NRG; PAM sequence: GAG
tgtagaataagaggataaaa

SEQ ID NO: 63748 - DNA, 20 bp, Artificial Sequence
  Description of Artificial Sequence: Synthetic oligonucleotide
  Target: ATXN1; (-) strand; PAM type: NRG; PAM sequence: AAG
gttgtagaataagaggataa

SEQ ID NO: 63749 - DNA, 20 bp, Artificial Sequence
  Description of Artificial Sequence: Synthetic oligonucleotide
  Target: ATXN1; (-) strand; PAM type: NRG; PAM sequence: AGG
tgagaaagttgtagaataag

SEQ ID NO: 63750 - DNA, 20 bp, Artificial Sequence
  Description of Artificial Sequence: Synthetic oligonucleotide
  Target: ATXN1; (-) strand; PAM type: NRG; PAM sequence: GAG
ttgagaaagttgtagaataa

SEQ ID NO: 63751 - DNA, 20 bp, Artificial Sequence
  Description of Artificial Sequence: Synthetic oligonucleotide
  Target: ATXN1; (-) strand; PAM type: NRG; PAM sequence: AAG
gattgagaaagttgtagaat

SEQ ID NO: 63752 - DNA, 20 bp, Artificial Sequence
  Description of Artificial Sequence: Synthetic oligonucleotide
  Target: ATXN1; (-) strand; PAM type: NRG; PAM sequence: TAG
acttctgattgagaaagttg

SEQ ID NO: 63753 - DNA, 20 bp, Artificial Sequence
  Description of Artificial Sequence: Synthetic oligonucleotide
  Target: ATXN1; (-) strand; PAM type: NRG; PAM sequence: AAG
aaaaaaacttctgattgaga

SEQ ID NO: 63754 - DNA, 20 bp, Artificial Sequence
  Description of Artificial Sequence: Synthetic oligonucleotide
  Target: ATXN1; (-) strand; PAM type: NRG; PAM sequence: GAG
aaaaaaaaaaacttctgatt

SEQ ID NO: 63755 - DNA, 20 bp, Artificial Sequence
  Description of Artificial Sequence: Synthetic oligonucleotide
  Target: ATXN1; (-) strand; PAM type: NRG; PAM sequence: AGG
aaaatgaattttaaaaccat

SEQ ID NO: 63756 - DNA, 20 bp, Artificial Sequence
  Description of Artificial Sequence: Synthetic oligonucleotide
  Target: ATXN1; (-) strand; PAM type: NRG; PAM sequence: TAG
gaaaatgaattttaaaacca

SEQ ID NO: 63757 - DNA, 20 bp, Artificial Sequence
  Description of Artificial Sequence: Synthetic oligonucleotide
  Target: ATXN1; (-) strand; PAM type: NRG; PAM sequence: AGG
ataaaatggttagtaacata

SEQ ID NO: 63758 - DNA, 20 bp, Artificial Sequence
  Description of Artificial Sequence: Synthetic oligonucleotide
  Target: ATXN1; (-) strand; PAM type: NRG; PAM sequence: AAG
aataaaatggttagtaacat

SEQ ID NO: 63759 - DNA, 20 bp, Artificial Sequence
  Description of Artificial Sequence: Synthetic oligonucleotide
  Target: ATXN1; (-) strand; PAM type: NRG; PAM sequence: TAG
aggataaggaataaaatggt

SEQ ID NO: 63760 - DNA, 20 bp, Artificial Sequence
  Description of Artificial Sequence: Synthetic oligonucleotide
  Target: ATXN1; (-) strand; PAM type: NRG; PAM sequence: TGG
ttgtaggataaggaataaaa

SEQ ID NO: 63761 - DNA, 20 bp, Artificial Sequence
  Description of Artificial Sequence: Synthetic oligonucleotide
  Target: ATXN1; (-) strand; PAM type: NRG; PAM sequence: AGG
atgacacctattgtaggata

SEQ ID NO: 63762 - DNA, 20 bp, Artificial Sequence
  Description of Artificial Sequence: Synthetic oligonucleotide
  Target: ATXN1; (-) strand; PAM type: NRG; PAM sequence: AAG
gatgacacctattgtaggat

SEQ ID NO: 63763 - DNA, 20 bp, Artificial Sequence
  Description of Artificial Sequence: Synthetic oligonucleotide
  Target: ATXN1; (-) strand; PAM type: NRG; PAM sequence: AGG
ggggagatgacacctattgt

SEQ ID NO: 63764 - DNA, 20 bp, Artificial Sequence
  Description of Artificial Sequence: Synthetic oligonucleotide
  Target: ATXN1; (-) strand; PAM type: NRG; PAM sequence: TAG
tggggagatgacacctattg

SEQ ID NO: 63765 - DNA, 20 bp, Artificial Sequence
  Description of Artificial Sequence: Synthetic oligonucleotide
  Target: ATXN1; (-) strand; PAM type: NRG; PAM sequence: GAG
gttaccacattccacttggg

SEQ ID NO: 63766 - DNA, 20 bp, Artificial Sequence
  Description of Artificial Sequence: Synthetic oligonucleotide
  Target: ATXN1; (-) strand; PAM type: NRG; PAM sequence: GGG
aagttaccacattccacttg

SEQ ID NO: 63767 - DNA, 20 bp, Artificial Sequence
  Description of Artificial Sequence: Synthetic oligonucleotide
  Target: ATXN1; (-) strand; PAM type: NRG; PAM sequence: GGG
gaagttaccacattccactt

SEQ ID NO: 63768 - DNA, 20 bp, Artificial Sequence
  Description of Artificial Sequence: Synthetic oligonucleotide
  Target: ATXN1; (-) strand; PAM type: NRG; PAM sequence: TGG
ggaagttaccacattccact

SEQ ID NO: 63769 - DNA, 20 bp, Artificial Sequence
  Description of Artificial Sequence: Synthetic oligonucleotide
  Target: ATXN1; (-) strand; PAM type: NRG; PAM sequence: AAG
cataaaccctacctttacgg

SEQ ID NO: 63770 - DNA, 20 bp, Artificial Sequence
  Description of Artificial Sequence: Synthetic oligonucleotide
  Target: ATXN1; (-) strand; PAM type: NRG; PAM sequence: CGG
agacataaaccctaccttta

SEQ ID NO: 63771 - DNA, 20 bp, Artificial Sequence
  Description of Artificial Sequence: Synthetic oligonucleotide
  Target: ATXN1; (-) strand; PAM type: NRG; PAM sequence: CAG
tgaagcttacaaaaagaaga

SEQ ID NO: 63772 - DNA, 20 bp, Artificial Sequence
  Description of Artificial Sequence: Synthetic oligonucleotide
  Target: ATXN1; (-) strand; PAM type: NRG; PAM sequence: AAG
cccgtgaagcttacaaaaag

SEQ ID NO: 63773 - DNA, 20 bp, Artificial Sequence
  Description of Artificial Sequence: Synthetic oligonucleotide
  Target: ATXN1; (-) strand; PAM type: NRG; PAM sequence: AAG
agccccgtgaagcttacaaa

SEQ ID NO: 63774 - DNA, 20 bp, Artificial Sequence
  Description of Artificial Sequence: Synthetic oligonucleotide
  Target: ATXN1; (-) strand; PAM type: NRG; PAM sequence: AAG
tcatttgcgaaagccccgtg

SEQ ID NO: 63775 - DNA, 20 bp, Artificial Sequence
  Description of Artificial Sequence: Synthetic oligonucleotide
  Target: ATXN1; (-) strand; PAM type: NRG; PAM sequence: AAG
caaagagttatcatttgcga

SEQ ID NO: 63776 - DNA, 20 bp, Artificial Sequence
  Description of Artificial Sequence: Synthetic oligonucleotide
  Target: ATXN1; (-) strand; PAM type: NRG; PAM sequence: GAG
atcaacaaatattgatcaaa

SEQ ID NO: 63777 - DNA, 20 bp, Artificial Sequence
  Description of Artificial Sequence: Synthetic oligonucleotide
  Target: ATXN1; (-) strand; PAM type: NRG; PAM sequence: AAG
taatcaacaaatattgatca

SEQ ID NO: 63778 - DNA, 20 bp, Artificial Sequence
  Description of Artificial Sequence: Synthetic oligonucleotide
  Target: ATXN1; (-) strand; PAM type: NRG; PAM sequence: CAG
tataataccatgttatcaat

SEQ ID NO: 63779 - DNA, 20 bp, Artificial Sequence
  Description of Artificial Sequence: Synthetic oligonucleotide
  Target: ATXN1; (-) strand; PAM type: NRG; PAM sequence: AAG
caaagacatataacgtcttc

SEQ ID NO: 63780 - DNA, 20 bp, Artificial Sequence
  Description of Artificial Sequence: Synthetic oligonucleotide
  Target: ATXN1; (-) strand; PAM type: NRG; PAM sequence: AAG
ccatggaggacagagactca

SEQ ID NO: 63781 - DNA, 20 bp, Artificial Sequence
  Description of Artificial Sequence: Synthetic oligonucleotide
  Target: ATXN1; (-) strand; PAM type: NRG; PAM sequence: GAG
gtcctcttccatggaggaca

SEQ ID NO: 63782 - DNA, 20 bp, Artificial Sequence
  Description of Artificial Sequence: Synthetic oligonucleotide
  Target: ATXN1; (-) strand; PAM type: NRG; PAM sequence: CAG
ctgtcctcttccatggagga

SEQ ID NO: 63783 - DNA, 20 bp, Artificial Sequence
  Description of Artificial Sequence: Synthetic oligonucleotide
  Target: ATXN1; (-) strand; PAM type: NRG; PAM sequence: AGG
acacctgtcctcttccatgg

SEQ ID NO: 63784 - DNA, 20 bp, Artificial Sequence
  Description of Artificial Sequence: Synthetic oligonucleotide
  Target: ATXN1; (-) strand; PAM type: NRG; PAM sequence: GAG
aacacctgtcctcttccatg

SEQ ID NO: 63785 - DNA, 20 bp, Artificial Sequence
  Description of Artificial Sequence: Synthetic oligonucleotide
  Target: ATXN1; (-) strand; PAM type: NRG; PAM sequence: TGG
tgaacacctgtcctcttcca

SEQ ID NO: 63786 - DNA, 20 bp, Artificial Sequence
  Description of Artificial Sequence: Synthetic oligonucleotide
  Target: ATXN1; (-) strand; PAM type: NRG; PAM sequence: GGG
tttctccaagtcacccaaaa

SEQ ID NO: 63787 - DNA, 20 bp, Artificial Sequence
  Description of Artificial Sequence: Synthetic oligonucleotide
  Target: ATXN1; (-) strand; PAM type: NRG; PAM sequence: AGG
ttttctccaagtcacccaaa

SEQ ID NO: 63788 - DNA, 20 bp, Artificial Sequence
  Description of Artificial Sequence: Synthetic oligonucleotide
  Target: ATXN1; (-) strand; PAM type: NRG; PAM sequence: AAG
tttttctccaagtcacccaa

SEQ ID NO: 63789 - DNA, 20 bp, Artificial Sequence
  Description of Artificial Sequence: Synthetic oligonucleotide
  Target: ATXN1; (-) strand; PAM type: NRG; PAM sequence: AAG
ttatgtgatgatttttctcc

SEQ ID NO: 63790 - DNA, 20 bp, Artificial Sequence
  Description of Artificial Sequence: Synthetic oligonucleotide
  Target: ATXN1; (-) strand; PAM type: NRG; PAM sequence: GAG
gggactgcacagtttcctta

SEQ ID NO: 63791 - DNA, 20 bp, Artificial Sequence
  Description of Artificial Sequence: Synthetic oligonucleotide
  Target: ATXN1; (-) strand; PAM type: NRG; PAM sequence: TAG
gagggactgcacagtttcct

SEQ ID NO: 63792 - DNA, 20 bp, Artificial Sequence
  Description of Artificial Sequence: Synthetic oligonucleotide
  Target: ATXN1; (-) strand; PAM type: NRG; PAM sequence: CAG
catttcattgagggactgca

SEQ ID NO: 63793 - DNA, 20 bp, Artificial Sequence
  Description of Artificial Sequence: Synthetic oligonucleotide
  Target: ATXN1; (-) strand; PAM type: NRG; PAM sequence: GGG
gttgtggaacatttcattga

SEQ ID NO: 63794 - DNA, 20 bp, Artificial Sequence
  Description of Artificial Sequence: Synthetic oligonucleotide
  Target: ATXN1; (-) strand; PAM type: NRG; PAM sequence: AGG
tgttgtggaacatttcattg

SEQ ID NO: 63795 - DNA, 20 bp, Artificial Sequence
  Description of Artificial Sequence: Synthetic oligonucleotide
  Target: ATXN1; (-) strand; PAM type: NRG; PAM sequence: GAG
ctgttgtggaacatttcatt

SEQ ID NO: 63796 - DNA, 20 bp, Artificial Sequence
  Description of Artificial Sequence: Synthetic oligonucleotide
  Target: ATXN1; (-) strand; PAM type: NRG; PAM sequence: TGG
gttggaaaaagaggctgttg

SEQ ID NO: 63797 - DNA, 20 bp, Artificial Sequence
  Description of Artificial Sequence: Synthetic oligonucleotide
  Target: ATXN1; (-) strand; PAM type: NRG; PAM sequence: AGG
tagttctgagttggaaaaag

SEQ ID NO: 63798 - DNA, 20 bp, Artificial Sequence
  Description of Artificial Sequence: Synthetic oligonucleotide
  Target: ATXN1; (-) strand; PAM type: NRG; PAM sequence: GAG
ttagttctgagttggaaaaa

SEQ ID NO: 63799 - DNA, 20 bp, Artificial Sequence
  Description of Artificial Sequence: Synthetic oligonucleotide
  Target: ATXN1; (-) strand; PAM type: NRG; PAM sequence: AAG
ctttagttctgagttggaaa

SEQ ID NO: 63800 - DNA, 20 bp, Artificial Sequence
  Description of Artificial Sequence: Synthetic oligonucleotide
  Target: ATXN1; (-) strand; PAM type: NRG; PAM sequence: TGG
agttacctttagttctgagt

SEQ ID NO: 63801 - DNA, 20 bp, Artificial Sequence
  Description of Artificial Sequence: Synthetic oligonucleotide
  Target: ATXN1; (-) strand; PAM type: NRG; PAM sequence: GAG
aaagagttacctttagttct

SEQ ID NO: 63802 - DNA, 20 bp, Artificial Sequence
  Description of Artificial Sequence: Synthetic oligonucleotide
  Target: ATXN1; (-) strand; PAM type: NRG; PAM sequence: TAG
gaaatacaaagagttacctt

SEQ ID NO: 63803 - DNA, 20 bp, Artificial Sequence
  Description of Artificial Sequence: Synthetic oligonucleotide
  Target: ATXN1; (-) strand; PAM type: NRG; PAM sequence: GAG
cctcagaaaggaaatacaaa

SEQ ID NO: 63804 - DNA, 20 bp, Artificial Sequence
  Description of Artificial Sequence: Synthetic oligonucleotide
  Target: ATXN1; (-) strand; PAM type: NRG; PAM sequence: AAG
ttcctcagaaaggaaataca

SEQ ID NO: 63805 - DNA, 20 bp, Artificial Sequence
  Description of Artificial Sequence: Synthetic oligonucleotide
  Target: ATXN1; (-) strand; PAM type: NRG; PAM sequence: AGG
cttctctttattcctcagaa

SEQ ID NO: 63806 - DNA, 20 bp, Artificial Sequence
  Description of Artificial Sequence: Synthetic oligonucleotide
  Target: ATXN1; (-) strand; PAM type: NRG; PAM sequence: AAG
gcttctctttattcctcaga

SEQ ID NO: 63807 - DNA, 20 bp, Artificial Sequence
  Description of Artificial Sequence: Synthetic oligonucleotide
  Target: ATXN1; (-) strand; PAM type: NRG; PAM sequence: CAG
ggcagcttctctttattcct

SEQ ID NO: 63808 - DNA, 20 bp, Artificial Sequence
  Description of Artificial Sequence: Synthetic oligonucleotide
  Target: ATXN1; (-) strand; PAM type: NRG; PAM sequence: CAG
gcaattgccagcagccctgg

SEQ ID NO: 63809 - DNA, 20 bp, Artificial Sequence
  Description of Artificial Sequence: Synthetic oligonucleotide
  Target: ATXN1; (-) strand; PAM type: NRG; PAM sequence: TGG
tctgcaattgccagcagccc

SEQ ID NO: 63810 - DNA, 20 bp, Artificial Sequence
  Description of Artificial Sequence: Synthetic oligonucleotide
  Target: ATXN1; (-) strand; PAM type: NRG; PAM sequence: CAG
ctgaactctgcaattgccag

SEQ ID NO: 63811 - DNA, 20 bp, Artificial Sequence
  Description of Artificial Sequence: Synthetic oligonucleotide
  Target: ATXN1; (-) strand; PAM type: NRG; PAM sequence: CAG
tttctgaactctgcaattgc

SEQ ID NO: 63812 - DNA, 20 bp, Artificial Sequence
  Description of Artificial Sequence: Synthetic oligonucleotide
  Target: ATXN1; (-) strand; PAM type: NRG; PAM sequence: AAG
tgagtgtgctcattcagagg

SEQ ID NO: 63813 - DNA, 20 bp, Artificial Sequence
  Description of Artificial Sequence: Synthetic oligonucleotide
  Target: ATXN1; (-) strand; PAM type: NRG; PAM sequence: AGG
ggctgagtgtgctcattcag

SEQ ID NO: 63814 - DNA, 20 bp, Artificial Sequence
  Description of Artificial Sequence: Synthetic oligonucleotide
  Target: ATXN1; (-) strand; PAM type: NRG; PAM sequence: GAG
gggctgagtgtgctcattca

SEQ ID NO: 63815 - DNA, 20 bp, Artificial Sequence
  Description of Artificial Sequence: Synthetic oligonucleotide
  Target: ATXN1; (-) strand; PAM type: NRG; PAM sequence: CAG
ctgggctgagtgtgctcatt

SEQ ID NO: 63816 - DNA, 20 bp, Artificial Sequence
  Description of Artificial Sequence: Synthetic oligonucleotide
  Target: ATXN1; (-) strand; PAM type: NRG; PAM sequence: GAG
gctctgcaccctgctgggct

SEQ ID NO: 63817 - DNA, 20 bp, Artificial Sequence
  Description of Artificial Sequence: Synthetic oligonucleotide
  Target: ATXN1; (-) strand; PAM type: NRG; PAM sequence: GGG
acagggctctgcaccctgct

SEQ ID NO: 63818 - DNA, 20 bp, Artificial Sequence
  Description of Artificial Sequence: Synthetic oligonucleotide
  Target: ATXN1; (-) strand; PAM type: NRG; PAM sequence: TGG
gacagggctctgcaccctgc

SEQ ID NO: 63819 - DNA, 20 bp, Artificial Sequence
  Description of Artificial Sequence: Synthetic oligonucleotide
  Target: ATXN1; (-) strand; PAM type: NRG; PAM sequence: GGG
tggtgggcagggtggagaca

SEQ ID NO: 63820 - DNA, 20 bp, Artificial Sequence
  Description of Artificial Sequence: Synthetic oligonucleotide
  Target: ATXN1; (-) strand; PAM type: NRG; PAM sequence: AGG
ttggtgggcagggtggagac

SEQ ID NO: 63821 - DNA, 20 bp, Artificial Sequence
  Description of Artificial Sequence: Synthetic oligonucleotide
  Target: ATXN1; (-) strand; PAM type: NRG; PAM sequence: CAG
cttggtgggcagggtggaga

SEQ ID NO: 63822 - DNA, 20 bp, Artificial Sequence
  Description of Artificial Sequence: Synthetic oligonucleotide
  Target: ATXN1; (-) strand; PAM type: NRG; PAM sequence: GAG
gctccttggtgggcagggtg

SEQ ID NO: 63823 - DNA, 20 bp, Artificial Sequence
  Description of Artificial Sequence: Synthetic oligonucleotide
  Target: ATXN1; (-) strand; PAM type: NRG; PAM sequence: TGG
aagctccttggtgggcaggg

SEQ ID NO: 63824 - DNA, 20 bp, Artificial Sequence
  Description of Artificial Sequence: Synthetic oligonucleotide
  Target: ATXN1; (-) strand; PAM type: NRG; PAM sequence: GGG
cttaagctccttggtgggca

SEQ ID NO: 63825 - DNA, 20 bp, Artificial Sequence
  Description of Artificial Sequence: Synthetic oligonucleotide
  Target: ATXN1; (-) strand; PAM type: NRG; PAM sequence: AGG
acttaagctccttggtgggc

SEQ ID NO: 63826 - DNA, 20 bp, Artificial Sequence
  Description of Artificial Sequence: Synthetic oligonucleotide
  Target: ATXN1; (-) strand; PAM type: NRG; PAM sequence: CAG
cacttaagctccttggtggg

SEQ ID NO: 63827 - DNA, 20 bp, Artificial Sequence
  Description of Artificial Sequence: Synthetic oligonucleotide
  Target: ATXN1; (-) strand; PAM type: NRG; PAM sequence: GGG
tgccacttaagctccttggt

SEQ ID NO: 63828 - DNA, 20 bp, Artificial Sequence
  Description of Artificial Sequence: Synthetic oligonucleotide
  Target: ATXN1; (-) strand; PAM type: NRG; PAM sequence: TGG
ctgccacttaagctccttgg

SEQ ID NO: 63829 - DNA, 20 bp, Artificial Sequence
  Description of Artificial Sequence: Synthetic oligonucleotide
  Target: ATXN1; (-) strand; PAM type: NRG; PAM sequence: TGG
tgcctgccacttaagctcct

SEQ ID NO: 63830 - DNA, 20 bp, Artificial Sequence
  Description of Artificial Sequence: Synthetic oligonucleotide
  Target: ATXN1; (-) strand; PAM type: NRG; PAM sequence: AAG
gcccagtttgcctgccactt

SEQ ID NO: 63831 - DNA, 20 bp, Artificial Sequence
  Description of Artificial Sequence: Synthetic oligonucleotide
  Target: ATXN1; (-) strand; PAM type: NRG; PAM sequence: CAG
ggaaaggggtgtttttggcc

SEQ ID NO: 63832 - DNA, 20 bp, Artificial Sequence
  Description of Artificial Sequence: Synthetic oligonucleotide
  Target: ATXN1; (-) strand; PAM type: NRG; PAM sequence: TGG
ccatgggaaaggggtgtttt

SEQ ID NO: 63833 - DNA, 20 bp, Artificial Sequence
  Description of Artificial Sequence: Synthetic oligonucleotide
  Target: ATXN1; (-) strand; PAM type: NRG; PAM sequence: GGG
gatgcctctccatgggaaag

SEQ ID NO: 63834 - DNA, 20 bp, Artificial Sequence
  Description of Artificial Sequence: Synthetic oligonucleotide
  Target: ATXN1; (-) strand; PAM type: NRG; PAM sequence: GGG
agatgcctctccatgggaaa

SEQ ID NO: 63835 - DNA, 20 bp, Artificial Sequence
  Description of Artificial Sequence: Synthetic oligonucleotide
  Target: ATXN1; (-) strand; PAM type: NRG; PAM sequence: AGG
gagatgcctctccatgggaa

SEQ ID NO: 63836 - DNA, 20 bp, Artificial Sequence
  Description of Artificial Sequence: Synthetic oligonucleotide
  Target: ATXN1; (-) strand; PAM type: NRG; PAM sequence: AAG
ggagatgcctctccatggga

SEQ ID NO: 63837 - DNA, 20 bp, Artificial Sequence
  Description of Artificial Sequence: Synthetic oligonucleotide
  Target: ATXN1; (-) strand; PAM type: NRG; PAM sequence: GGG
cactggagatgcctctccat

SEQ ID NO: 63838 - DNA, 20 bp, Artificial Sequence
  Description of Artificial Sequence: Synthetic oligonucleotide
  Target: ATXN1; (-) strand; PAM type: NRG; PAM sequence: TGG
gcactggagatgcctctcca

SEQ ID NO: 63839 - DNA, 20 bp, Artificial Sequence
  Description of Artificial Sequence: Synthetic oligonucleotide
  Target: ATXN1; (-) strand; PAM type: NRG; PAM sequence: GAG
ctcagtccagccctgcactg

SEQ ID NO: 63840 - DNA, 20 bp, Artificial Sequence
  Description of Artificial Sequence: Synthetic oligonucleotide
  Target: ATXN1; (-) strand; PAM type: NRG; PAM sequence: TGG
ctctcagtccagccctgcac

SEQ ID NO: 63841 - DNA, 20 bp, Artificial Sequence
  Description of Artificial Sequence: Synthetic oligonucleotide
  Target: ATXN1; (-) strand; PAM type: NRG; PAM sequence: CAG
actggagatgcctctcagtc

SEQ ID NO: 63842 - DNA, 20 bp, Artificial Sequence
  Description of Artificial Sequence: Synthetic oligonucleotide
  Target: ATXN1; (-) strand; PAM type: NRG; PAM sequence: CAG
cctgcactggagatgcctct

SEQ ID NO: 63843 - DNA, 20 bp, Artificial Sequence
  Description of Artificial Sequence: Synthetic oligonucleotide
  Target: ATXN1; (-) strand; PAM type: NRG; PAM sequence: GAG
ctcagtccagccctgcactg

SEQ ID NO: 63844 - DNA, 20 bp, Artificial Sequence
  Description of Artificial Sequence: Synthetic oligonucleotide
  Target: ATXN1; (-) strand; PAM type: NRG; PAM sequence: TGG
ctctcagtccagccctgcac

SEQ ID NO: 63845 - DNA, 20 bp, Artificial Sequence
  Description of Artificial Sequence: Synthetic oligonucleotide
  Target: ATXN1; (-) strand; PAM type: NRG; PAM sequence: CAG
actggagatgcctctcagtc

SEQ ID NO: 63846 - DNA, 20 bp, Artificial Sequence
  Description of Artificial Sequence: Synthetic oligonucleotide
  Target: ATXN1; (-) strand; PAM type: NRG; PAM sequence: CAG
cctgcactggagatgcctct

SEQ ID NO: 63847 - DNA, 20 bp, Artificial Sequence
  Description of Artificial Sequence: Synthetic oligonucleotide
  Target: ATXN1; (-) strand; PAM type: NRG; PAM sequence: GAG
ctcagtccagccctgcactg

SEQ ID NO: 63848 - DNA, 20 bp, Artificial Sequence
  Description of Artificial Sequence: Synthetic oligonucleotide
  Target: ATXN1; (-) strand; PAM type: NRG; PAM sequence: TGG
ctctcagtccagccctgcac

SEQ ID NO: 63849 - DNA, 20 bp, Artificial Sequence
  Description of Artificial Sequence: Synthetic oligonucleotide
  Target: ATXN1; (-) strand; PAM type: NRG; PAM sequence: CAG
gtctaactggactctcagtc

SEQ ID NO: 63850 - DNA, 20 bp, Artificial Sequence
  Description of Artificial Sequence: Synthetic oligonucleotide
  Target: ATXN1; (-) strand; PAM type: NRG; PAM sequence: CAG
ttgaggtctaactggactct

SEQ ID NO: 63851 - DNA, 20 bp, Artificial Sequence
  Description of Artificial Sequence: Synthetic oligonucleotide
  Target: ATXN1; (-) strand; PAM type: NRG; PAM sequence: TGG
aactcttcttgaggtctaac

SEQ ID NO: 63852 - DNA, 20 bp, Artificial Sequence
  Description of Artificial Sequence: Synthetic oligonucleotide
  Target: ATXN1; (-) strand; PAM type: NRG; PAM sequence: AGG
cctccctccaactcttcttg

SEQ ID NO: 63853 - DNA, 20 bp, Artificial Sequence
  Description of Artificial Sequence: Synthetic oligonucleotide
  Target: ATXN1; (-) strand; PAM type: NRG; PAM sequence: GAG
acctccctccaactcttctt

SEQ ID NO: 63854 - DNA, 20 bp, Artificial Sequence
  Description of Artificial Sequence: Synthetic oligonucleotide
  Target: ATXN1; (-) strand; PAM type: NRG; PAM sequence: TGG
cttcagaataccttgagttt

SEQ ID NO: 63855 - DNA, 20 bp, Artificial Sequence
  Description of Artificial Sequence: Synthetic oligonucleotide
  Target: ATXN1; (-) strand; PAM type: NRG; PAM sequence: GAG
catattcttcagaatacctt

SEQ ID NO: 63856 - DNA, 20 bp, Artificial Sequence
  Description of Artificial Sequence: Synthetic oligonucleotide
  Target: ATXN1; (-) strand; PAM type: NRG; PAM sequence: CAG
tgtgaataaatcatattctt

SEQ ID NO: 63857 - DNA, 20 bp, Artificial Sequence
  Description of Artificial Sequence: Synthetic oligonucleotide
  Target: ATXN1; (-) strand; PAM type: NRG; PAM sequence: GGG
gatcaaatgttgactgaaca

SEQ ID NO: 63858 - DNA, 20 bp, Artificial Sequence
  Description of Artificial Sequence: Synthetic oligonucleotide
  Target: ATXN1; (-) strand; PAM type: NRG; PAM sequence: AGG
tgatcaaatgttgactgaac

SEQ ID NO: 63859 - DNA, 20 bp, Artificial Sequence
  Description of Artificial Sequence: Synthetic oligonucleotide
  Target: ATXN1; (-) strand; PAM type: NRG; PAM sequence: CAG
atgatcaaatgttgactgaa

SEQ ID NO: 63860 - DNA, 20 bp, Artificial Sequence
  Description of Artificial Sequence: Synthetic oligonucleotide
  Target: ATXN1; (-) strand; PAM type: NRG; PAM sequence: TGG
gtttgtaagaaattttacaa

SEQ ID NO: 63861 - DNA, 20 bp, Artificial Sequence
  Description of Artificial Sequence: Synthetic oligonucleotide
  Target: ATXN1; (-) strand; PAM type: NRG; PAM sequence: AAG
tccaaggactgccagtttgt

SEQ ID NO: 63862 - DNA, 20 bp, Artificial Sequence
  Description of Artificial Sequence: Synthetic oligonucleotide
  Target: ATXN1; (-) strand; PAM type: NRG; PAM sequence: CAG
gctaggtatccaaggactgc

SEQ ID NO: 63863 - DNA, 20 bp, Artificial Sequence
  Description of Artificial Sequence: Synthetic oligonucleotide
  Target: ATXN1; (-) strand; PAM type: NRG; PAM sequence: AGG
gagtgcatgctaggtatcca

SEQ ID NO: 63864 - DNA, 20 bp, Artificial Sequence
  Description of Artificial Sequence: Synthetic oligonucleotide
  Target: ATXN1; (-) strand; PAM type: NRG; PAM sequence: AAG
tgagtgcatgctaggtatcc

SEQ ID NO: 63865 - DNA, 20 bp, Artificial Sequence
  Description of Artificial Sequence: Synthetic oligonucleotide
  Target: ATXN1; (-) strand; PAM type: NRG; PAM sequence: AGG
gaatattctgagtgcatgct

SEQ ID NO: 63866 - DNA, 20 bp, Artificial Sequence
  Description of Artificial Sequence: Synthetic oligonucleotide
  Target: ATXN1; (-) strand; PAM type: NRG; PAM sequence: TAG
agaatattctgagtgcatgc

SEQ ID NO: 63867 - DNA, 20 bp, Artificial Sequence
  Description of Artificial Sequence: Synthetic oligonucleotide
  Target: ATXN1; (-) strand; PAM type: NRG; PAM sequence: GAG
atatacacagagaatattct

SEQ ID NO: 63868 - DNA, 20 bp, Artificial Sequence
  Description of Artificial Sequence: Synthetic oligonucleotide
  Target: ATXN1; (-) strand; PAM type: NRG; PAM sequence: GAG
caaaccagttaatatacaca

SEQ ID NO: 63869 - DNA, 20 bp, Artificial Sequence
  Description of Artificial Sequence: Synthetic oligonucleotide
  Target: ATXN1; (-) strand; PAM type: NRG; PAM sequence: CAG
cacaaaccagttaatataca

SEQ ID NO: 63870 - DNA, 20 bp, Artificial Sequence
  Description of Artificial Sequence: Synthetic oligonucleotide
  Target: ATXN1; (-) strand; PAM type: NRG; PAM sequence: CAG
tttattccttgaacacaaac

SEQ ID NO: 63871 - DNA, 20 bp, Artificial Sequence
  Description of Artificial Sequence: Synthetic oligonucleotide
  Target: ATXN1; (-) strand; PAM type: NRG; PAM sequence: TGG
ctttaggccggtactaattt

SEQ ID NO: 63872 - DNA, 20 bp, Artificial Sequence
  Description of Artificial Sequence: Synthetic oligonucleotide
  Target: ATXN1; (-) strand; PAM type: NRG; PAM sequence: CGG
tgataatgtgttctttaggc

SEQ ID NO: 63873 - DNA, 20 bp, Artificial Sequence
  Description of Artificial Sequence: Synthetic oligonucleotide
  Target: ATXN1; (-) strand; PAM type: NRG; PAM sequence: AGG
tctctgataatgtgttcttt

SEQ ID NO: 63874 - DNA, 20 bp, Artificial Sequence
  Description of Artificial Sequence: Synthetic oligonucleotide
  Target: ATXN1; (-) strand; PAM type: NRG; PAM sequence: TAG
atctctgataatgtgttctt

SEQ ID NO: 63875 - DNA, 20 bp, Artificial Sequence
  Description of Artificial Sequence: Synthetic oligonucleotide
  Target: ATXN1; (-) strand; PAM type: NRG; PAM sequence: CAG
tttgaggatagacatttttc

SEQ ID NO: 63876 - DNA, 20 bp, Artificial Sequence
  Description of Artificial Sequence: Synthetic oligonucleotide
  Target: ATXN1; (-) strand; PAM type: NRG; PAM sequence: TAG
ttttaaaaaacctttgagga

SEQ ID NO: 63877 - DNA, 20 bp, Artificial Sequence
  Description of Artificial Sequence: Synthetic oligonucleotide
  Target: ATXN1; (-) strand; PAM type: NRG; PAM sequence: AGG
atttttttaaaaaacctttg

SEQ ID NO: 63878 - DNA, 20 bp, Artificial Sequence
  Description of Artificial Sequence: Synthetic oligonucleotide
  Target: ATXN1; (-) strand; PAM type: NRG; PAM sequence: GAG
aatttttttaaaaaaccttt

SEQ ID NO: 63879 - DNA, 20 bp, Artificial Sequence
  Description of Artificial Sequence: Synthetic oligonucleotide
  Target: ATXN1; (-) strand; PAM type: NRG; PAM sequence: TGG
aatgataagaagcagtgaca

SEQ ID NO: 63880 - DNA, 20 bp, Artificial Sequence
  Description of Artificial Sequence: Synthetic oligonucleotide
  Target: ATXN1; (-) strand; PAM type: NRG; PAM sequence: CAG
gccatgctaatgataagaag

SEQ ID NO: 63881 - DNA, 20 bp, Artificial Sequence
  Description of Artificial Sequence: Synthetic oligonucleotide
  Target: ATXN1; (-) strand; PAM type: NRG; PAM sequence: AAG
taagccatgctaatgataag

SEQ ID NO: 63882 - DNA, 20 bp, Artificial Sequence
  Description of Artificial Sequence: Synthetic oligonucleotide
  Target: ATXN1; (-) strand; PAM type: NRG; PAM sequence: AAG
tgataagccatgctaatgat

SEQ ID NO: 63883 - DNA, 20 bp, Artificial Sequence
  Description of Artificial Sequence: Synthetic oligonucleotide
  Target: ATXN1; (-) strand; PAM type: NRG; PAM sequence: AAG
aatccttacctttatgtgat

SEQ ID NO: 63884 - DNA, 20 bp, Artificial Sequence
  Description of Artificial Sequence: Synthetic oligonucleotide
  Target: ATXN1; (-) strand; PAM type: NRG; PAM sequence: CAG
catacaaatacacacagcag

SEQ ID NO: 63885 - DNA, 20 bp, Artificial Sequence
  Description of Artificial Sequence: Synthetic oligonucleotide
  Target: ATXN1; (-) strand; PAM type: NRG; PAM sequence: CAG
ctgcatacaaatacacacag

SEQ ID NO: 63886 - DNA, 20 bp, Artificial Sequence
  Description of Artificial Sequence: Synthetic oligonucleotide
  Target: ATXN1; (-) strand; PAM type: NRG; PAM sequence: CAG
aacctgcatacaaatacaca

SEQ ID NO: 63887 - DNA, 20 bp, Artificial Sequence
  Description of Artificial Sequence: Synthetic oligonucleotide
  Target: ATXN1; (-) strand; PAM type: NRG; PAM sequence: GAG
ctttgcactacgtccataag

SEQ ID NO: 63888 - DNA, 20 bp, Artificial Sequence
  Description of Artificial Sequence: Synthetic oligonucleotide
  Target: ATXN1; (-) strand; PAM type: NRG; PAM sequence: AGG
aactttgcactacgtccata

SEQ ID NO: 63889 - DNA, 20 bp, Artificial Sequence
  Description of Artificial Sequence: Synthetic oligonucleotide
  Target: ATXN1; (-) strand; PAM type: NRG; PAM sequence: AAG
aaactttgcactacgtccat

SEQ ID NO: 63890 - DNA, 20 bp, Artificial Sequence
  Description of Artificial Sequence: Synthetic oligonucleotide
  Target: ATXN1; (-) strand; PAM type: NRG; PAM sequence: TAG
caatgtataattatatttca

SEQ ID NO: 63891 - DNA, 20 bp, Artificial Sequence
  Description of Artificial Sequence: Synthetic oligonucleotide
  Target: ATXN1; (-) strand; PAM type: NRG; PAM sequence: CAG
ttcattttattcttgatatg

SEQ ID NO: 63892 - DNA, 20 bp, Artificial Sequence
  Description of Artificial Sequence: Synthetic oligonucleotide
  Target: ATXN1; (-) strand; PAM type: NRG; PAM sequence: GGG
acagctgctcagcacagatt

SEQ ID NO: 63893 - DNA, 20 bp, Artificial Sequence
  Description of Artificial Sequence: Synthetic oligonucleotide
  Target: ATXN1; (-) strand; PAM type: NRG; PAM sequence: TGG
tacagctgctcagcacagat

SEQ ID NO: 63894 - DNA, 20 bp, Artificial Sequence
  Description of Artificial Sequence: Synthetic oligonucleotide
  Target: ATXN1; (-) strand; PAM type: NRG; PAM sequence: CAG
cgttctacagctgctcagca

SEQ ID NO: 63895 - DNA, 20 bp, Artificial Sequence
  Description of Artificial Sequence: Synthetic oligonucleotide
  Target: ATXN1; (-) strand; PAM type: NRG; PAM sequence: CAG
gacgtcgttctacagctgct

SEQ ID NO: 63896 - DNA, 20 bp, Artificial Sequence
  Description of Artificial Sequence: Synthetic oligonucleotide
  Target: ATXN1; (-) strand; PAM type: NRG; PAM sequence: CAG
tttcctgagacgtcgttcta

SEQ ID NO: 63897 - DNA, 20 bp, Artificial Sequence
  Description of Artificial Sequence: Synthetic oligonucleotide
  Target: ATXN1; (-) strand; PAM type: NRG; PAM sequence: GAG
ctttaaaatactaatttcct

SEQ ID NO: 63898 - DNA, 20 bp, Artificial Sequence
  Description of Artificial Sequence: Synthetic oligonucleotide
  Target: ATXN1; (-) strand; PAM type: NRG; PAM sequence: GAG
caggaataagttgtcaatag

SEQ ID NO: 63899 - DNA, 20 bp, Artificial Sequence
  Description of Artificial Sequence: Synthetic oligonucleotide
  Target: ATXN1; (-) strand; PAM type: NRG; PAM sequence: AGG
gccaggaataagttgtcaat

SEQ ID NO: 63900 - DNA, 20 bp, Artificial Sequence
  Description of Artificial Sequence: Synthetic oligonucleotide
  Target: ATXN1; (-) strand; PAM type: NRG; PAM sequence: TAG
ggccaggaataagttgtcaa

SEQ ID NO: 63901 - DNA, 20 bp, Artificial Sequence
  Description of Artificial Sequence: Synthetic oligonucleotide
  Target: ATXN1; (-) strand; PAM type: NRG; PAM sequence: AAG
gaacaaataaggccaggaat

SEQ ID NO: 63902 - DNA, 20 bp, Artificial Sequence
  Description of Artificial Sequence: Synthetic oligonucleotide
  Target: ATXN1; (-) strand; PAM type: NRG; PAM sequence: AGG
cgtgttgaacaaataaggcc

SEQ ID NO: 63903 - DNA, 20 bp, Artificial Sequence
  Description of Artificial Sequence: Synthetic oligonucleotide
  Target: ATXN1; (-) strand; PAM type: NRG; PAM sequence: CAG
gcgtgttgaacaaataaggc

SEQ ID NO: 63904 - DNA, 20 bp, Artificial Sequence
  Description of Artificial Sequence: Synthetic oligonucleotide
  Target: ATXN1; (-) strand; PAM type: NRG; PAM sequence: AGG
acctgcgtgttgaacaaata

SEQ ID NO: 63905 - DNA, 20 bp, Artificial Sequence
  Description of Artificial Sequence: Synthetic oligonucleotide
  Target: ATXN1; (-) strand; PAM type: NRG; PAM sequence: AAG
gacctgcgtgttgaacaaat

SEQ ID NO: 63906 - DNA, 20 bp, Artificial Sequence
  Description of Artificial Sequence: Synthetic oligonucleotide
  Target: ATXN1; (-) strand; PAM type: NRG; PAM sequence: AGG
tgtgctacagcaatacctga

SEQ ID NO: 63907 - DNA, 20 bp, Artificial Sequence
  Description of Artificial Sequence: Synthetic oligonucleotide
  Target: ATXN1; (-) strand; PAM type: NRG; PAM sequence: AAG
ttgtgctacagcaatacctg

SEQ ID NO: 63908 - DNA, 20 bp, Artificial Sequence
  Description of Artificial Sequence: Synthetic oligonucleotide
  Target: ATXN1; (-) strand; PAM type: NRG; PAM sequence: CAG
ctgttctttctgttgtgcta

SEQ ID NO: 63909 - DNA, 20 bp, Artificial Sequence
  Description of Artificial Sequence: Synthetic oligonucleotide
  Target: ATXN1; (-) strand; PAM type: NRG; PAM sequence: TGG
acccagacctccctgtcttc

SEQ ID NO: 63910 - DNA, 20 bp, Artificial Sequence
  Description of Artificial Sequence: Synthetic oligonucleotide
  Target: ATXN1; (-) strand; PAM type: NRG; PAM sequence: CAG
agtctctgggcttctagacc

SEQ ID NO: 63911 - DNA, 20 bp, Artificial Sequence
  Description of Artificial Sequence: Synthetic oligonucleotide
  Target: ATXN1; (-) strand; PAM type: NRG; PAM sequence: TAG
atgtggagtctctgggcttc

SEQ ID NO: 63912 - DNA, 20 bp, Artificial Sequence
  Description of Artificial Sequence: Synthetic oligonucleotide
  Target: ATXN1; (-) strand; PAM type: NRG; PAM sequence: GGG
actcgggatgtggagtctct

SEQ ID NO: 63913 - DNA, 20 bp, Artificial Sequence
  Description of Artificial Sequence: Synthetic oligonucleotide
  Target: ATXN1; (-) strand; PAM type: NRG; PAM sequence: TGG
aactcgggatgtggagtctc

SEQ ID NO: 63914 - DNA, 20 bp, Artificial Sequence
  Description of Artificial Sequence: Synthetic oligonucleotide
  Target: ATXN1; (-) strand; PAM type: NRG; PAM sequence: GAG
gatgtgtaactcgggatgtg

SEQ ID NO: 63915 - DNA, 20 bp, Artificial Sequence
  Description of Artificial Sequence: Synthetic oligonucleotide
  Target: ATXN1; (-) strand; PAM type: NRG; PAM sequence: TGG
gggatgtgtaactcgggatg

SEQ ID NO: 63916 - DNA, 20 bp, Artificial Sequence
  Description of Artificial Sequence: Synthetic oligonucleotide
  Target: ATXN1; (-) strand; PAM type: NRG; PAM sequence: GGG
agaaaggggatgtgtaactc

SEQ ID NO: 63917 - DNA, 20 bp, Artificial Sequence
  Description of Artificial Sequence: Synthetic oligonucleotide
  Target: ATXN1; (-) strand; PAM type: NRG; PAM sequence: CGG
cagaaaggggatgtgtaact

SEQ ID NO: 63918 - DNA, 20 bp, Artificial Sequence
  Description of Artificial Sequence: Synthetic oligonucleotide
  Target: ATXN1; (-) strand; PAM type: NRG; PAM sequence: GGG
gactcatggcaaccagaaag

SEQ ID NO: 63919 - DNA, 20 bp, Artificial Sequence
  Description of Artificial Sequence: Synthetic oligonucleotide
  Target: ATXN1; (-) strand; PAM type: NRG; PAM sequence: GGG
tgactcatggcaaccagaaa

SEQ ID NO: 63920 - DNA, 20 bp, Artificial Sequence
  Description of Artificial Sequence: Synthetic oligonucleotide
  Target: ATXN1; (-) strand; PAM type: NRG; PAM sequence: AGG
atgactcatggcaaccagaa

SEQ ID NO: 63921 - DNA, 20 bp, Artificial Sequence
  Description of Artificial Sequence: Synthetic oligonucleotide
  Target: ATXN1; (-) strand; PAM type: NRG; PAM sequence: AAG
gatgactcatggcaaccaga

SEQ ID NO: 63922 - DNA, 20 bp, Artificial Sequence
  Description of Artificial Sequence: Synthetic oligonucleotide
  Target: ATXN1; (-) strand; PAM type: NRG; PAM sequence: CAG
gcgtgatgactcatggcaac

SEQ ID NO: 63923 - DNA, 20 bp, Artificial Sequence
  Description of Artificial Sequence: Synthetic oligonucleotide
  Target: ATXN1; (-) strand; PAM type: NRG; PAM sequence: TGG
agaaggtgcgtgatgactca

SEQ ID NO: 63924 - DNA, 20 bp, Artificial Sequence
  Description of Artificial Sequence: Synthetic oligonucleotide
  Target: ATXN1; (-) strand; PAM type: NRG; PAM sequence: AGG
aaaactctcctctgggcaga

SEQ ID NO: 63925 - DNA, 20 bp, Artificial Sequence
  Description of Artificial Sequence: Synthetic oligonucleotide
  Target: ATXN1; (-) strand; PAM type: NRG; PAM sequence: AAG
taaaactctcctctgggcag

SEQ ID NO: 63926 - DNA, 20 bp, Artificial Sequence
  Description of Artificial Sequence: Synthetic oligonucleotide
  Target: ATXN1; (-) strand; PAM type: NRG; PAM sequence: CAG
gaataaaactctcctctggg

SEQ ID NO: 63927 - DNA, 20 bp, Artificial Sequence
  Description of Artificial Sequence: Synthetic oligonucleotide
  Target: ATXN1; (-) strand; PAM type: NRG; PAM sequence: GGG
catgaataaaactctcctct

SEQ ID NO: 63928 - DNA, 20 bp, Artificial Sequence
  Description of Artificial Sequence: Synthetic oligonucleotide
  Target: ATXN1; (-) strand; PAM type: NRG; PAM sequence: TGG
gcatgaataaaactctcctc

SEQ ID NO: 63929 - DNA, 20 bp, Artificial Sequence
  Description of Artificial Sequence: Synthetic oligonucleotide
  Target: ATXN1; (-) strand; PAM type: NRG; PAM sequence: AGG
aaacactgaccttttcaagc

SEQ ID NO: 63930 - DNA, 20 bp, Artificial Sequence
  Description of Artificial Sequence: Synthetic oligonucleotide
  Target: ATXN1; (-) strand; PAM type: NRG; PAM sequence: CAG
taaacactgaccttttcaag

SEQ ID NO: 63931 - DNA, 20 bp, Artificial Sequence
  Description of Artificial Sequence: Synthetic oligonucleotide
  Target: ATXN1; (-) strand; PAM type: NRG; PAM sequence: AAG
acctaaacactgaccttttc

SEQ ID NO: 63932 - DNA, 20 bp, Artificial Sequence
  Description of Artificial Sequence: Synthetic oligonucleotide
  Target: ATXN1; (-) strand; PAM type: NRG; PAM sequence: AAG
cagccttccccattttcacc

SEQ ID NO: 63933 - DNA, 20 bp, Artificial Sequence
  Description of Artificial Sequence: Synthetic oligonucleotide
  Target: ATXN1; (-) strand; PAM type: NRG; PAM sequence: CAG
atgaggcacaggctgtgttt

SEQ ID NO: 63934 - DNA, 20 bp, Artificial Sequence
  Description of Artificial Sequence: Synthetic oligonucleotide
  Target: ATXN1; (-) strand; PAM type: NRG; PAM sequence: AGG
attatcaaagcatgaggcac

SEQ ID NO: 63935 - DNA, 20 bp, Artificial Sequence
  Description of Artificial Sequence: Synthetic oligonucleotide
  Target: ATXN1; (-) strand; PAM type: NRG; PAM sequence: CAG
aattatcaaagcatgaggca

SEQ ID NO: 63936 - DNA, 20 bp, Artificial Sequence
  Description of Artificial Sequence: Synthetic oligonucleotide
  Target: ATXN1; (-) strand; PAM type: NRG; PAM sequence: AGG
tcagaaattatcaaagcatg

SEQ ID NO: 63937 - DNA, 20 bp, Artificial Sequence
  Description of Artificial Sequence: Synthetic oligonucleotide
  Target: ATXN1; (-) strand; PAM type: NRG; PAM sequence: GAG
ttcagaaattatcaaagcat

SEQ ID NO: 63938 - DNA, 20 bp, Artificial Sequence
  Description of Artificial Sequence: Synthetic oligonucleotide
  Target: ATXN1; (-) strand; PAM type: NRG; PAM sequence: AAG
aaatgcttcagaaattatca

SEQ ID NO: 63939 - DNA, 20 bp, Artificial Sequence
  Description of Artificial Sequence: Synthetic oligonucleotide
  Target: ATXN1; (-) strand; PAM type: NRG; PAM sequence: CAG
ctcatgatttataaatgctt

SEQ ID NO: 63940 - DNA, 20 bp, Artificial Sequence
  Description of Artificial Sequence: Synthetic oligonucleotide
  Target: ATXN1; (-) strand; PAM type: NRG; PAM sequence: TAG
cattagcatcttgcagacct

SEQ ID NO: 63941 - DNA, 20 bp, Artificial Sequence
  Description of Artificial Sequence: Synthetic oligonucleotide
  Target: ATXN1; (-) strand; PAM type: NRG; PAM sequence: CAG
ctgcacacattagcatcttg

SEQ ID NO: 63942 - DNA, 20 bp, Artificial Sequence
  Description of Artificial Sequence: Synthetic oligonucleotide
  Target: ATXN1; (-) strand; PAM type: NRG; PAM sequence: TAG
gaggactggactgcacacat

SEQ ID NO: 63943 - DNA, 20 bp, Artificial Sequence
  Description of Artificial Sequence: Synthetic oligonucleotide
  Target: ATXN1; (-) strand; PAM type: NRG; PAM sequence: TGG
cagacttaaagtcagaggac

SEQ ID NO: 63944 - DNA, 20 bp, Artificial Sequence
  Description of Artificial Sequence: Synthetic oligonucleotide
  Target: ATXN1; (-) strand; PAM type: NRG; PAM sequence: AGG
tgaaacagacttaaagtcag

SEQ ID NO: 63945 - DNA, 20 bp, Artificial Sequence
  Description of Artificial Sequence: Synthetic oligonucleotide
  Target: ATXN1; (-) strand; PAM type: NRG; PAM sequence: GAG
ctgaaacagacttaaagtca

SEQ ID NO: 63946 - DNA, 20 bp, Artificial Sequence
  Description of Artificial Sequence: Synthetic oligonucleotide
  Target: ATXN1; (-) strand; PAM type: NRG; PAM sequence: CAG
aactgaaacagacttaaagt

SEQ ID NO: 63947 - DNA, 20 bp, Artificial Sequence
  Description of Artificial Sequence: Synthetic oligonucleotide
  Target: ATXN1; (-) strand; PAM type: NRG; PAM sequence: AAG
caggaactgaaacagactta

SEQ ID NO: 63948 - DNA, 20 bp, Artificial Sequence
  Description of Artificial Sequence: Synthetic oligonucleotide
  Target: ATXN1; (-) strand; PAM type: NRG; PAM sequence: CAG
aaatagagcaggaactgaaa

SEQ ID NO: 63949 - DNA, 20 bp, Artificial Sequence
  Description of Artificial Sequence: Synthetic oligonucleotide
  Target: ATXN1; (-) strand; PAM type: NRG; PAM sequence: AGG
taaaaaggagcaaatagagc

SEQ ID NO: 63950 - DNA, 20 bp, Artificial Sequence
  Description of Artificial Sequence: Synthetic oligonucleotide
  Target: ATXN1; (-) strand; PAM type: NRG; PAM sequence: CAG
ttaaaaaggagcaaatagag

SEQ ID NO: 63951 - DNA, 20 bp, Artificial Sequence
  Description of Artificial Sequence: Synthetic oligonucleotide
  Target: ATXN1; (-) strand; PAM type: NRG; PAM sequence: GAG
ttattaaaaaggagcaaata

SEQ ID NO: 63952 - DNA, 20 bp, Artificial Sequence
  Description of Artificial Sequence: Synthetic oligonucleotide
  Target: ATXN1; (-) strand; PAM type: NRG; PAM sequence: TAG
tgttattaaaaaggagcaaa

SEQ ID NO: 63953 - DNA, 20 bp, Artificial Sequence
  Description of Artificial Sequence: Synthetic oligonucleotide
  Target: ATXN1; (-) strand; PAM type: NRG; PAM sequence: GAG
ctaattgtgttattaaaaag

SEQ ID NO: 63954 - DNA, 20 bp, Artificial Sequence
  Description of Artificial Sequence: Synthetic oligonucleotide
  Target: ATXN1; (-) strand; PAM type: NRG; PAM sequence: AGG
tactaattgtgttattaaaa

SEQ ID NO: 63955 - DNA, 20 bp, Artificial Sequence
  Description of Artificial Sequence: Synthetic oligonucleotide
  Target: ATXN1; (-) strand; PAM type: NRG; PAM sequence: AAG
ttactaattgtgttattaaa

SEQ ID NO: 63956 - DNA, 20 bp, Artificial Sequence
  Description of Artificial Sequence: Synthetic oligonucleotide
  Target: ATXN1; (-) strand; PAM type: NRG; PAM sequence: AGG
tatttagctatttctttttt

SEQ ID NO: 63957 - DNA, 20 bp, Artificial Sequence
  Description of Artificial Sequence: Synthetic oligonucleotide
  Target: ATXN1; (-) strand; PAM type: NRG; PAM sequence: TAG
atatttagctatttcttttt

SEQ ID NO: 63958 - DNA, 20 bp, Artificial Sequence
  Description of Artificial Sequence: Synthetic oligonucleotide
  Target: ATXN1; (-) strand; PAM type: NRG; PAM sequence: TAG
gagaatgagaggaaaatatt

SEQ ID NO: 63959 - DNA, 20 bp, Artificial Sequence
  Description of Artificial Sequence: Synthetic oligonucleotide
  Target: ATXN1; (-) strand; PAM type: NRG; PAM sequence: AGG
tatggcaaaaagagaatgag

SEQ ID NO: 63960 - DNA, 20 bp, Artificial Sequence
  Description of Artificial Sequence: Synthetic oligonucleotide
  Target: ATXN1; (-) strand; PAM type: NRG; PAM sequence: GAG
ttatggcaaaaagagaatga

SEQ ID NO: 63961 - DNA, 20 bp, Artificial Sequence
  Description of Artificial Sequence: Synthetic oligonucleotide
  Target: ATXN1; (-) strand; PAM type: NRG; PAM sequence: GAG
tattatggcaaaaagagaat

SEQ ID NO: 63962 - DNA, 20 bp, Artificial Sequence
  Description of Artificial Sequence: Synthetic oligonucleotide
  Target: ATXN1; (-) strand; PAM type: NRG; PAM sequence: GAG
tctcaatattatggcaaaaa

SEQ ID NO: 63963 - DNA, 20 bp, Artificial Sequence
  Description of Artificial Sequence: Synthetic oligonucleotide
  Target: ATXN1; (-) strand; PAM type: NRG; PAM sequence: AAG
actctcaatattatggcaaa

SEQ ID NO: 63964 - DNA, 20 bp, Artificial Sequence
  Description of Artificial Sequence: Synthetic oligonucleotide
  Target: ATXN1; (-) strand; PAM type: NRG; PAM sequence: TGG
tcatataactctcaatatta

SEQ ID NO: 63965 - DNA, 20 bp, Artificial Sequence
  Description of Artificial Sequence: Synthetic oligonucleotide
  Target: ATXN1; (-) strand; PAM type: NRG; PAM sequence: AAG
caggccaaataaaatagttg

SEQ ID NO: 63966 - DNA, 20 bp, Artificial Sequence
  Description of Artificial Sequence: Synthetic oligonucleotide
  Target: ATXN1; (-) strand; PAM type: NRG; PAM sequence: TAG
tgaagtcaggccaaataaaa

SEQ ID NO: 63967 - DNA, 20 bp, Artificial Sequence
  Description of Artificial Sequence: Synthetic oligonucleotide
  Target: ATXN1; (-) strand; PAM type: NRG; PAM sequence: AGG
gtttggtactttgtgaagtc

SEQ ID NO: 63968 - DNA, 20 bp, Artificial Sequence
  Description of Artificial Sequence: Synthetic oligonucleotide
  Target: ATXN1; (-) strand; PAM type: NRG; PAM sequence: CAG
cgtttggtactttgtgaagt

SEQ ID NO: 63969 - DNA, 20 bp, Artificial Sequence
  Description of Artificial Sequence: Synthetic oligonucleotide
  Target: ATXN1; (-) strand; PAM type: NRG; PAM sequence: AAG
tccccgtttggtactttgtg

SEQ ID NO: 63970 - DNA, 20 bp, Artificial Sequence
  Description of Artificial Sequence: Synthetic oligonucleotide
  Target: ATXN1; (-) strand; PAM type: NRG; PAM sequence: TGG
ttttatcttcactccccgtt

SEQ ID NO: 63971 - DNA, 20 bp, Artificial Sequence
  Description of Artificial Sequence: Synthetic oligonucleotide
  Target: ATXN1; (-) strand; PAM type: NRG; PAM sequence: TGG
gaggttgggagatgcatatg

SEQ ID NO: 63972 - DNA, 20 bp, Artificial Sequence
  Description of Artificial Sequence: Synthetic oligonucleotide
  Target: ATXN1; (-) strand; PAM type: NRG; PAM sequence: GAG
ttcaaaaggacagaggttgg

SEQ ID NO: 63973 - DNA, 20 bp, Artificial Sequence
  Description of Artificial Sequence: Synthetic oligonucleotide
  Target: ATXN1; (-) strand; PAM type: NRG; PAM sequence: GGG
tgttcaaaaggacagaggtt

SEQ ID NO: 63974 - DNA, 20 bp, Artificial Sequence
  Description of Artificial Sequence: Synthetic oligonucleotide
  Target: ATXN1; (-) strand; PAM type: NRG; PAM sequence: TGG
ctgttcaaaaggacagaggt

SEQ ID NO: 63975 - DNA, 20 bp, Artificial Sequence
  Description of Artificial Sequence: Synthetic oligonucleotide
  Target: ATXN1; (-) strand; PAM type: NRG; PAM sequence: AGG
gtgtctgttcaaaaggacag

SEQ ID NO: 63976 - DNA, 20 bp, Artificial Sequence
  Description of Artificial Sequence: Synthetic oligonucleotide
  Target: ATXN1; (-) strand; PAM type: NRG; PAM sequence: GAG
tgtgtctgttcaaaaggaca

SEQ ID NO: 63977 - DNA, 20 bp, Artificial Sequence
  Description of Artificial Sequence: Synthetic oligonucleotide
  Target: ATXN1; (-) strand; PAM type: NRG; PAM sequence: CAG
cttgtgtctgttcaaaagga

SEQ ID NO: 63978 - DNA, 20 bp, Artificial Sequence
  Description of Artificial Sequence: Synthetic oligonucleotide
  Target: ATXN1; (-) strand; PAM type: NRG; PAM sequence: AGG
gttacttgtgtctgttcaaa

SEQ ID NO: 63979 - DNA, 20 bp, Artificial Sequence
  Description of Artificial Sequence: Synthetic oligonucleotide
  Target: ATXN1; (-) strand; PAM type: NRG; PAM sequence: AAG
tgttacttgtgtctgttcaa

SEQ ID NO: 63980 - DNA, 20 bp, Artificial Sequence
  Description of Artificial Sequence: Synthetic oligonucleotide
  Target: ATXN1; (-) strand; PAM type: NRG; PAM sequence: TGG
ggtcgtgtttttaatacttt

SEQ ID NO: 63981 - DNA, 20 bp, Artificial Sequence
  Description of Artificial Sequence: Synthetic oligonucleotide
  Target: ATXN1; (-) strand; PAM type: NRG; PAM sequence: AGG
gctttgataggatgcttcca

SEQ ID NO: 63982 - DNA, 20 bp, Artificial Sequence
  Description of Artificial Sequence: Synthetic oligonucleotide
  Target: ATXN1; (-) strand; PAM type: NRG; PAM sequence: AAG
ggctttgataggatgcttcc

SEQ ID NO: 63983 - DNA, 20 bp, Artificial Sequence
  Description of Artificial Sequence: Synthetic oligonucleotide
  Target: ATXN1; (-) strand; PAM type: NRG; PAM sequence: AGG
aaggaagttgtggctttgat

SEQ ID NO: 63984 - DNA, 20 bp, Artificial Sequence
  Description of Artificial Sequence: Synthetic oligonucleotide
  Target: ATXN1; (-) strand; PAM type: NRG; PAM sequence: TAG
aaaggaagttgtggctttga

SEQ ID NO: 63985 - DNA, 20 bp, Artificial Sequence
  Description of Artificial Sequence: Synthetic oligonucleotide
  Target: ATXN1; (-) strand; PAM type: NRG; PAM sequence: TGG
ataaaaagaaaaggaagttg

SEQ ID NO: 63986 - DNA, 20 bp, Artificial Sequence
  Description of Artificial Sequence: Synthetic oligonucleotide
  Target: ATXN1; (-) strand; PAM type: NRG; PAM sequence: AAG
tagttcataaaaagaaaagg

SEQ ID NO: 63987 - DNA, 20 bp, Artificial Sequence
  Description of Artificial Sequence: Synthetic oligonucleotide
  Target: ATXN1; (-) strand; PAM type: NRG; PAM sequence: AGG
tagtagttcataaaaagaaa

SEQ ID NO: 63988 - DNA, 20 bp, Artificial Sequence
  Description of Artificial Sequence: Synthetic oligonucleotide
  Target: ATXN1; (-) strand; PAM type: NRG; PAM sequence: AAG
gtagtagttcataaaaagaa

SEQ ID NO: 63989 - DNA, 20 bp, Artificial Sequence
  Description of Artificial Sequence: Synthetic oligonucleotide
  Target: ATXN1; (-) strand; PAM type: NRG; PAM sequence: AAG
gcatggtagtagttcataaa

SEQ ID NO: 63990 - DNA, 20 bp, Artificial Sequence
  Description of Artificial Sequence: Synthetic oligonucleotide
  Target: ATXN1; (-) strand; PAM type: NRG; PAM sequence: TAG
catgcaattttgcatggtag

SEQ ID NO: 63991 - DNA, 20 bp, Artificial Sequence
  Description of Artificial Sequence: Synthetic oligonucleotide
  Target: ATXN1; (-) strand; PAM type: NRG; PAM sequence: TAG
agccatgcaattttgcatgg

SEQ ID NO: 63992 - DNA, 20 bp, Artificial Sequence
  Description of Artificial Sequence: Synthetic oligonucleotide
  Target: ATXN1; (-) strand; PAM type: NRG; PAM sequence: TGG
tgtagccatgcaattttgca

SEQ ID NO: 63993 - DNA, 20 bp, Artificial Sequence
  Description of Artificial Sequence: Synthetic oligonucleotide
  Target: ATXN1; (-) strand; PAM type: NRG; PAM sequence: TAG
atgatttgatgtcccagctg

SEQ ID NO: 63994 - DNA, 20 bp, Artificial Sequence
  Description of Artificial Sequence: Synthetic oligonucleotide
  Target: ATXN1; (-) strand; PAM type: NRG; PAM sequence: CAG
taaagcatgatttgatgtcc

SEQ ID NO: 63995 - DNA, 20 bp, Artificial Sequence
  Description of Artificial Sequence: Synthetic oligonucleotide
  Target: ATXN1; (-) strand; PAM type: NRG; PAM sequence: AAG
gccccaatactaatttttta

SEQ ID NO: 63996 - DNA, 20 bp, Artificial Sequence
  Description of Artificial Sequence: Synthetic oligonucleotide
  Target: ATXN1; (-) strand; PAM type: NRG; PAM sequence: TAG
taggcgtaagccaccacgcc

SEQ ID NO: 63997 - DNA, 20 bp, Artificial Sequence
  Description of Artificial Sequence: Synthetic oligonucleotide
  Target: ATXN1; (-) strand; PAM type: NRG; PAM sequence: AAG
agtacagggattataggcgt

SEQ ID NO: 63998 - DNA, 20 bp, Artificial Sequence
  Description of Artificial Sequence: Synthetic oligonucleotide
  Target: ATXN1; (-) strand; PAM type: NRG; PAM sequence: AGG
tcccaaagtacagggattat

SEQ ID NO: 63999 - DNA, 20 bp, Artificial Sequence
  Description of Artificial Sequence: Synthetic oligonucleotide
  Target: ATXN1; (-) strand; PAM type: NRG; PAM sequence: TAG
ctcccaaagtacagggatta

SEQ ID NO: 64000 - DNA, 20 bp, Artificial Sequence
  Description of Artificial Sequence: Synthetic oligonucleotide
  Target: ATXN1; (-) strand; PAM type: NRG; PAM sequence: GGG
ccttggcctcccaaagtaca

SEQ ID NO: 64001 - DNA, 20 bp, Artificial Sequence
  Description of Artificial Sequence: Synthetic oligonucleotide
  Target: ATXN1; (-) strand; PAM type: NRG; PAM sequence: AGG
gccttggcctcccaaagtac

SEQ ID NO: 64002 - DNA, 20 bp, Artificial Sequence
  Description of Artificial Sequence: Synthetic oligonucleotide
  Target: ATXN1; (-) strand; PAM type: NRG; PAM sequence: CAG
tgccttggcctcccaaagta

SEQ ID NO: 64003 - DNA, 20 bp, Artificial Sequence
  Description of Artificial Sequence: Synthetic oligonucleotide
  Target: ATXN1; (-) strand; PAM type: NRG; PAM sequence: AAG
ccacctgccttggcctccca

SEQ ID NO: 64004 - DNA, 20 bp, Artificial Sequence
  Description of Artificial Sequence: Synthetic oligonucleotide
  Target: ATXN1; (-) strand; PAM type: NRG; PAM sequence: TGG
ctcaaatgatccacctgcct

SEQ ID NO: 64005 - DNA, 20 bp, Artificial Sequence
  Description of Artificial Sequence: Synthetic oligonucleotide
  Target: ATXN1; (-) strand; PAM type: NRG; PAM sequence: TGG
tttcaccatgttggccaggc

SEQ ID NO: 64006 - DNA, 20 bp, Artificial Sequence
  Description of Artificial Sequence: Synthetic oligonucleotide
  Target: ATXN1; (-) strand; PAM type: NRG; PAM sequence: AGG
agggtttcaccatgttggcc

SEQ ID NO: 64007 - DNA, 20 bp, Artificial Sequence
  Description of Artificial Sequence: Synthetic oligonucleotide
  Target: ATXN1; (-) strand; PAM type: NRG; PAM sequence: CAG
cagggtttcaccatgttggc

SEQ ID NO: 64008 - DNA, 20 bp, Artificial Sequence
  Description of Artificial Sequence: Synthetic oligonucleotide
  Target: ATXN1; (-) strand; PAM type: NRG; PAM sequence: TGG
gagacagggtttcaccatgt

SEQ ID NO: 64009 - DNA, 20 bp, Artificial Sequence
  Description of Artificial Sequence: Synthetic oligonucleotide
  Target: ATXN1; (-) strand; PAM type: NRG; PAM sequence: GGG
ttgtatttttagtagagaca

SEQ ID NO: 64010 - DNA, 20 bp, Artificial Sequence
  Description of Artificial Sequence: Synthetic oligonucleotide
  Target: ATXN1; (-) strand; PAM type: NRG; PAM sequence: AGG
tttgtatttttagtagagac

SEQ ID NO: 64011 - DNA, 20 bp, Artificial Sequence
  Description of Artificial Sequence: Synthetic oligonucleotide
  Target: ATXN1; (-) strand; PAM type: NRG; PAM sequence: CAG
ttttgtatttttagtagaga

SEQ ID NO: 64012 - DNA, 20 bp, Artificial Sequence
  Description of Artificial Sequence: Synthetic oligonucleotide
  Target: ATXN1; (-) strand; PAM type: NRG; PAM sequence: GAG
tcatttttgtatttttagta

SEQ ID NO: 64013 - DNA, 20 bp, Artificial Sequence
  Description of Artificial Sequence: Synthetic oligonucleotide
  Target: ATXN1; (-) strand; PAM type: NRG; PAM sequence: TAG
gctcatttttgtatttttag

SEQ ID NO: 64014 - DNA, 20 bp, Artificial Sequence
  Description of Artificial Sequence: Synthetic oligonucleotide
  Target: ATXN1; (-) strand; PAM type: NRG; PAM sequence: TAG
ctggctcatttttgtatttt

SEQ ID NO: 64015 - DNA, 20 bp, Artificial Sequence
  Description of Artificial Sequence: Synthetic oligonucleotide
  Target: ATXN1; (-) strand; PAM type: NRG; PAM sequence: TGG
caggcgcctgccaccatacc

SEQ ID NO: 64016 - DNA, 20 bp, Artificial Sequence
  Description of Artificial Sequence: Synthetic oligonucleotide
  Target: ATXN1; (-) strand; PAM type: NRG; PAM sequence: AGG
tcgtgagtagctgggactac

SEQ ID NO: 64017 - DNA, 20 bp, Artificial Sequence
  Description of Artificial Sequence: Synthetic oligonucleotide
  Target: ATXN1; (-) strand; PAM type: NRG; PAM sequence: CAG
ctcgtgagtagctgggacta

SEQ ID NO: 64018 - DNA, 20 bp, Artificial Sequence
  Description of Artificial Sequence: Synthetic oligonucleotide
  Target: ATXN1; (-) strand; PAM type: NRG; PAM sequence: GGG
cctcagcctcgtgagtagct

SEQ ID NO: 64019 - DNA, 20 bp, Artificial Sequence
  Description of Artificial Sequence: Synthetic oligonucleotide
  Target: ATXN1; (-) strand; PAM type: NRG; PAM sequence: TGG
gcctcagcctcgtgagtagc

SEQ ID NO: 64020 - DNA, 20 bp, Artificial Sequence
  Description of Artificial Sequence: Synthetic oligonucleotide
  Target: ATXN1; (-) strand; PAM type: NRG; PAM sequence: TAG
tcctgcctcagcctcgtgag

SEQ ID NO: 64021 - DNA, 20 bp, Artificial Sequence
  Description of Artificial Sequence: Synthetic oligonucleotide
  Target: ATXN1; (-) strand; PAM type: NRG; PAM sequence: GAG
ttctcctgcctcagcctcgt

SEQ ID NO: 64022 - DNA, 20 bp, Artificial Sequence
  Description of Artificial Sequence: Synthetic oligonucleotide
  Target: ATXN1; (-) strand; PAM type: NRG; PAM sequence: CAG
ttcaagtgattctcctgcct

SEQ ID NO: 64023 - DNA, 20 bp, Artificial Sequence
  Description of Artificial Sequence: Synthetic oligonucleotide
  Target: ATXN1; (-) strand; PAM type: NRG; PAM sequence: AAG
aacctccgcttcctgggttc

SEQ ID NO: 64024 - DNA, 20 bp, Artificial Sequence
  Description of Artificial Sequence: Synthetic oligonucleotide
  Target: ATXN1; (-) strand; PAM type: NRG; PAM sequence: GGG
cactgcaacctccgcttcct

SEQ ID NO: 64025 - DNA, 20 bp, Artificial Sequence
  Description of Artificial Sequence: Synthetic oligonucleotide
  Target: ATXN1; (-) strand; PAM type: NRG; PAM sequence: TGG
tcactgcaacctccgcttcc

SEQ ID NO: 64026 - DNA, 20 bp, Artificial Sequence
  Description of Artificial Sequence: Synthetic oligonucleotide
  Target: ATXN1; (-) strand; PAM type: NRG; PAM sequence: CGG
agagtgcagtggcatgatct

SEQ ID NO: 64027 - DNA, 20 bp, Artificial Sequence
  Description of Artificial Sequence: Synthetic oligonucleotide
  Target: ATXN1; (-) strand; PAM type: NRG; PAM sequence: TGG
tcacccaggctagagtgcag

SEQ ID NO: 64028 - DNA, 20 bp, Artificial Sequence
  Description of Artificial Sequence: Synthetic oligonucleotide
  Target: ATXN1; (-) strand; PAM type: NRG; PAM sequence: CAG
ctgtcacccaggctagagtg

SEQ ID NO: 64029 - DNA, 20 bp, Artificial Sequence
  Description of Artificial Sequence: Synthetic oligonucleotide
  Target: ATXN1; (-) strand; PAM type: NRG; PAM sequence: GAG
tcactctgtcacccaggcta

SEQ ID NO: 64030 - DNA, 20 bp, Artificial Sequence
  Description of Artificial Sequence: Synthetic oligonucleotide
  Target: ATXN1; (-) strand; PAM type: NRG; PAM sequence: TAG
tctcactctgtcacccaggc

SEQ ID NO: 64031 - DNA, 20 bp, Artificial Sequence
  Description of Artificial Sequence: Synthetic oligonucleotide
  Target: ATXN1; (-) strand; PAM type: NRG; PAM sequence: AGG
agagtctcactctgtcaccc

SEQ ID NO: 64032 - DNA, 20 bp, Artificial Sequence
  Description of Artificial Sequence: Synthetic oligonucleotide
  Target: ATXN1; (-) strand; PAM type: NRG; PAM sequence: CAG
gagagtctcactctgtcacc

SEQ ID NO: 64033 - DNA, 20 bp, Artificial Sequence
  Description of Artificial Sequence: Synthetic oligonucleotide
  Target: ATXN1; (-) strand; PAM type: NRG; PAM sequence: GAG
ttttttgagagagagagaga

SEQ ID NO: 64034 - DNA, 20 bp, Artificial Sequence
  Description of Artificial Sequence: Synthetic oligonucleotide
  Target: ATXN1; (-) strand; PAM type: NRG; PAM sequence: GAG
ttttttttgagagagagaga

SEQ ID NO: 64035 - DNA, 20 bp, Artificial Sequence
  Description of Artificial Sequence: Synthetic oligonucleotide
  Target: ATXN1; (-) strand; PAM type: NRG; PAM sequence: GAG
ttttttttttgagagagaga

SEQ ID NO: 64036 - DNA, 20 bp, Artificial Sequence
  Description of Artificial Sequence: Synthetic oligonucleotide
  Target: ATXN1; (-) strand; PAM type: NRG; PAM sequence: GAG
ttttttttttttgagagaga

SEQ ID NO: 64037 - DNA, 20 bp, Artificial Sequence
  Description of Artificial Sequence: Synthetic oligonucleotide
  Target: ATXN1; (-) strand; PAM type: NRG; PAM sequence: GAG
ttttttttttttttgagaga

SEQ ID NO: 64038 - DNA, 20 bp, Artificial Sequence
  Description of Artificial Sequence: Synthetic oligonucleotide
  Target: ATXN1; (-) strand; PAM type: NRG; PAM sequence: GAG
ctttttttttttttttgaga

SEQ ID NO: 64039 - DNA, 20 bp, Artificial Sequence
  Description of Artificial Sequence: Synthetic oligonucleotide
  Target: ATXN1; (-) strand; PAM type: NRG; PAM sequence: GAG
aactttttttttttttttga

SEQ ID NO: 64040 - DNA, 20 bp, Artificial Sequence
  Description of Artificial Sequence: Synthetic oligonucleotide
  Target: ATXN1; (-) strand; PAM type: NRG; PAM sequence: GAG
ataacttttttttttttttt

SEQ ID NO: 64041 - DNA, 20 bp, Artificial Sequence
  Description of Artificial Sequence: Synthetic oligonucleotide
  Target: ATXN1; (-) strand; PAM type: NRG; PAM sequence: TGG
tgttgtttttgagctttgaa

SEQ ID NO: 64042 - DNA, 20 bp, Artificial Sequence
  Description of Artificial Sequence: Synthetic oligonucleotide
  Target: ATXN1; (-) strand; PAM type: NRG; PAM sequence: GAG
aaaataattctgttgttttt

SEQ ID NO: 64043 - DNA, 20 bp, Artificial Sequence
  Description of Artificial Sequence: Synthetic oligonucleotide
  Target: ATXN1; (-) strand; PAM type: NRG; PAM sequence: CAG
ctggcactgattttgaattt

SEQ ID NO: 64044 - DNA, 20 bp, Artificial Sequence
  Description of Artificial Sequence: Synthetic oligonucleotide
  Target: ATXN1; (-) strand; PAM type: NRG; PAM sequence: TGG
tatgcaaaagtagttaaatc

SEQ ID NO: 64045 - DNA, 20 bp, Artificial Sequence
  Description of Artificial Sequence: Synthetic oligonucleotide
  Target: ATXN1; (-) strand; PAM type: NRG; PAM sequence: TAG
gggcaaacattatgcaaaag

SEQ ID NO: 64046 - DNA, 20 bp, Artificial Sequence
  Description of Artificial Sequence: Synthetic oligonucleotide
  Target: ATXN1; (-) strand; PAM type: NRG; PAM sequence: AAG
tgggggcaaacattatgcaa

SEQ ID NO: 64047 - DNA, 20 bp, Artificial Sequence
  Description of Artificial Sequence: Synthetic oligonucleotide
  Target: ATXN1; (-) strand; PAM type: NRG; PAM sequence: GGG
tattatggaaagttctgtgg

SEQ ID NO: 64048 - DNA, 20 bp, Artificial Sequence
  Description of Artificial Sequence: Synthetic oligonucleotide
  Target: ATXN1; (-) strand; PAM type: NRG; PAM sequence: GGG
ttattatggaaagttctgtg

SEQ ID NO: 64049 - DNA, 20 bp, Artificial Sequence
  Description of Artificial Sequence: Synthetic oligonucleotide
  Target: ATXN1; (-) strand; PAM type: NRG; PAM sequence: GGG
attattatggaaagttctgt

SEQ ID NO: 64050 - DNA, 20 bp, Artificial Sequence
  Description of Artificial Sequence: Synthetic oligonucleotide
  Target: ATXN1; (-) strand; PAM type: NRG; PAM sequence: TGG
tattattatggaaagttctg

SEQ ID NO: 64051 - DNA, 20 bp, Artificial Sequence
  Description of Artificial Sequence: Synthetic oligonucleotide
  Target: ATXN1; (-) strand; PAM type: NRG; PAM sequence: AAG
tgacgtaatattattatgga

SEQ ID NO: 64052 - DNA, 20 bp, Artificial Sequence
  Description of Artificial Sequence: Synthetic oligonucleotide
  Target: ATXN1; (-) strand; PAM type: NRG; PAM sequence: TGG
ctgttgacgtaatattatta

SEQ ID NO: 64053 - DNA, 20 bp, Artificial Sequence
  Description of Artificial Sequence: Synthetic oligonucleotide
  Target: ATXN1; (-) strand; PAM type: NRG; PAM sequence: GAG
aagtagaccaaaaagaaaat

SEQ ID NO: 64054 - DNA, 20 bp, Artificial Sequence
  Description of Artificial Sequence: Synthetic oligonucleotide
  Target: ATXN1; (-) strand; PAM type: NRG; PAM sequence: AAG
agtaaaacaagtagaccaaa

SEQ ID NO: 64055 - DNA, 20 bp, Artificial Sequence
  Description of Artificial Sequence: Synthetic oligonucleotide
  Target: ATXN1; (-) strand; PAM type: NRG; PAM sequence: TAG
ttttaatttagtaaaacaag

SEQ ID NO: 64056 - DNA, 20 bp, Artificial Sequence
  Description of Artificial Sequence: Synthetic oligonucleotide
  Target: ATXN1; (-) strand; PAM type: NRG; PAM sequence: AAG
ggcttttaatttagtaaaac

SEQ ID NO: 64057 - DNA, 20 bp, Artificial Sequence
  Description of Artificial Sequence: Synthetic oligonucleotide
  Target: ATXN1; (-) strand; PAM type: NRG; PAM sequence: TAG
gtatctgttggcttttaatt

SEQ ID NO: 64058 - DNA, 20 bp, Artificial Sequence
  Description of Artificial Sequence: Synthetic oligonucleotide
  Target: ATXN1; (-) strand; PAM type: NRG; PAM sequence: TGG
tatggagttgttgtatctgt

SEQ ID NO: 64059 - DNA, 20 bp, Artificial Sequence
  Description of Artificial Sequence: Synthetic oligonucleotide
  Target: ATXN1; (-) strand; PAM type: NRG; PAM sequence: GAG
aaaaaggagtttaaagtatg

SEQ ID NO: 64060 - DNA, 20 bp, Artificial Sequence
  Description of Artificial Sequence: Synthetic oligonucleotide
  Target: ATXN1; (-) strand; PAM type: NRG; PAM sequence: TGG
taaaaaaggagtttaaagta

SEQ ID NO: 64061 - DNA, 20 bp, Artificial Sequence
  Description of Artificial Sequence: Synthetic oligonucleotide
  Target: ATXN1; (-) strand; PAM type: NRG; PAM sequence: AAG
agtattaaaaaaggagttta

SEQ ID NO: 64062 - DNA, 20 bp, Artificial Sequence
  Description of Artificial Sequence: Synthetic oligonucleotide
  Target: ATXN1; (-) strand; PAM type: NRG; PAM sequence: GAG
tcggaatagtattaaaaaag

SEQ ID NO: 64063 - DNA, 20 bp, Artificial Sequence
  Description of Artificial Sequence: Synthetic oligonucleotide
  Target: ATXN1; (-) strand; PAM type: NRG; PAM sequence: AGG
actcggaatagtattaaaaa

SEQ ID NO: 64064 - DNA, 20 bp, Artificial Sequence
  Description of Artificial Sequence: Synthetic oligonucleotide
  Target: ATXN1; (-) strand; PAM type: NRG; PAM sequence: AAG
tactcggaatagtattaaaa

SEQ ID NO: 64065 - DNA, 20 bp, Artificial Sequence
  Description of Artificial Sequence: Synthetic oligonucleotide
  Target: ATXN1; (-) strand; PAM type: NRG; PAM sequence: TAG
aaggaggcagttactcggaa

SEQ ID NO: 64066 - DNA, 20 bp, Artificial Sequence
  Description of Artificial Sequence: Synthetic oligonucleotide
  Target: ATXN1; (-) strand; PAM type: NRG; PAM sequence: CGG
taaacaaggaggcagttact

SEQ ID NO: 64067 - DNA, 20 bp, Artificial Sequence
  Description of Artificial Sequence: Synthetic oligonucleotide
  Target: ATXN1; (-) strand; PAM type: NRG; PAM sequence: CAG
gtaatatttaaacaaggagg

SEQ ID NO: 64068 - DNA, 20 bp, Artificial Sequence
  Description of Artificial Sequence: Synthetic oligonucleotide
  Target: ATXN1; (-) strand; PAM type: NRG; PAM sequence: AGG
attgtaatatttaaacaagg

SEQ ID NO: 64069 - DNA, 20 bp, Artificial Sequence
  Description of Artificial Sequence: Synthetic oligonucleotide
  Target: ATXN1; (-) strand; PAM type: NRG; PAM sequence: GAG
aattgtaatatttaaacaag

SEQ ID NO: 64070 - DNA, 20 bp, Artificial Sequence
  Description of Artificial Sequence: Synthetic oligonucleotide
  Target: ATXN1; (-) strand; PAM type: NRG; PAM sequence: AGG
aaaattgtaatatttaaaca

SEQ ID NO: 64071 - DNA, 20 bp, Artificial Sequence
  Description of Artificial Sequence: Synthetic oligonucleotide
  Target: ATXN1; (-) strand; PAM type: NRG; PAM sequence: AAG
gaaaattgtaatatttaaac

SEQ ID NO: 64072 - DNA, 20 bp, Artificial Sequence
  Description of Artificial Sequence: Synthetic oligonucleotide
  Target: ATXN1; (-) strand; PAM type: NRG; PAM sequence: CAG
atactttgttctgattgagt

SEQ ID NO: 64073 - DNA, 20 bp, Artificial Sequence
  Description of Artificial Sequence: Synthetic oligonucleotide
  Target: ATXN1; (-) strand; PAM type: NRG; PAM sequence: GAG
tgcaatactttgttctgatt

SEQ ID NO: 64074 - DNA, 20 bp, Artificial Sequence
  Description of Artificial Sequence: Synthetic oligonucleotide
  Target: ATXN1; (-) strand; PAM type: NRG; PAM sequence: TAG
aaaaaaagagaagttttcaa

SEQ ID NO: 64075 - DNA, 20 bp, Artificial Sequence
  Description of Artificial Sequence: Synthetic oligonucleotide
  Target: ATXN1; (-) strand; PAM type: NRG; PAM sequence: AAG
agcctcctccaaaaaaagag

SEQ ID NO: 64076 - DNA, 20 bp, Artificial Sequence
  Description of Artificial Sequence: Synthetic oligonucleotide
  Target: ATXN1; (-) strand; PAM type: NRG; PAM sequence: GAG
tgaagcctcctccaaaaaaa

SEQ ID NO: 64077 - DNA, 20 bp, Artificial Sequence
  Description of Artificial Sequence: Synthetic oligonucleotide
  Target: ATXN1; (-) strand; PAM type: NRG; PAM sequence: AAG
tatgaagcctcctccaaaaa

SEQ ID NO: 64078 - DNA, 20 bp, Artificial Sequence
  Description of Artificial Sequence: Synthetic oligonucleotide
  Target: ATXN1; (-) strand; PAM type: NRG; PAM sequence: AAG
taagctagaatgcttttatg

SEQ ID NO: 64079 - DNA, 20 bp, Artificial Sequence
  Description of Artificial Sequence: Synthetic oligonucleotide
  Target: ATXN1; (-) strand; PAM type: NRG; PAM sequence: TAG
ttgaaatcccagttttaagc

SEQ ID NO: 64080 - DNA, 20 bp, Artificial Sequence
  Description of Artificial Sequence: Synthetic oligonucleotide
  Target: ATXN1; (-) strand; PAM type: NRG; PAM sequence: AAG
accattgaaatcccagtttt

SEQ ID NO: 64081 - DNA, 20 bp, Artificial Sequence
  Description of Artificial Sequence: Synthetic oligonucleotide
  Target: ATXN1; (-) strand; PAM type: NRG; PAM sequence: CAG
agttaagaccattgaaatcc

SEQ ID NO: 64082 - DNA, 20 bp, Artificial Sequence
  Description of Artificial Sequence: Synthetic oligonucleotide
  Target: ATXN1; (-) strand; PAM type: NRG; PAM sequence: AAG
gctacatggtattcacagtt

SEQ ID NO: 64083 - DNA, 20 bp, Artificial Sequence
  Description of Artificial Sequence: Synthetic oligonucleotide
  Target: ATXN1; (-) strand; PAM type: NRG; PAM sequence: CAG
tttctgctacatggtattca

SEQ ID NO: 64084 - DNA, 20 bp, Artificial Sequence
  Description of Artificial Sequence: Synthetic oligonucleotide
  Target: ATXN1; (-) strand; PAM type: NRG; PAM sequence: TGG
caagtggcatttctgctaca

SEQ ID NO: 64085 - DNA, 20 bp, Artificial Sequence
  Description of Artificial Sequence: Synthetic oligonucleotide
  Target: ATXN1; (-) strand; PAM type: NRG; PAM sequence: TGG
tccctagatataatgccaag

SEQ ID NO: 64086 - DNA, 20 bp, Artificial Sequence
  Description of Artificial Sequence: Synthetic oligonucleotide
  Target: ATXN1; (-) strand; PAM type: NRG; PAM sequence: AAG
taatccctagatataatgcc

SEQ ID NO: 64087 - DNA, 20 bp, Artificial Sequence
  Description of Artificial Sequence: Synthetic oligonucleotide
  Target: ATXN1; (-) strand; PAM type: NRG; PAM sequence: TAG
gtgtttcaacaggtaatccc

SEQ ID NO: 64088 - DNA, 20 bp, Artificial Sequence
  Description of Artificial Sequence: Synthetic oligonucleotide
  Target: ATXN1; (-) strand; PAM type: NRG; PAM sequence: AGG
cctgtctttggtgtttcaac

SEQ ID NO: 64089 - DNA, 20 bp, Artificial Sequence
  Description of Artificial Sequence: Synthetic oligonucleotide
  Target: ATXN1; (-) strand; PAM type: NRG; PAM sequence: CAG
acctgtctttggtgtttcaa

SEQ ID NO: 64090 - DNA, 20 bp, Artificial Sequence
  Description of Artificial Sequence: Synthetic oligonucleotide
  Target: ATXN1; (-) strand; PAM type: NRG; PAM sequence: TGG
catcaaagtatacctgtctt

SEQ ID NO: 64091 - DNA, 20 bp, Artificial Sequence
  Description of Artificial Sequence: Synthetic oligonucleotide
  Target: ATXN1; (-) strand; PAM type: NRG; PAM sequence: AAG
gccctgcgtaacccacatca

SEQ ID NO: 64092 - DNA, 20 bp, Artificial Sequence
  Description of Artificial Sequence: Synthetic oligonucleotide
  Target: ATXN1; (-) strand; PAM type: NRG; PAM sequence: CGG
tgtatttcttgttacttacc

SEQ ID NO: 64093 - DNA, 20 bp, Artificial Sequence
  Description of Artificial Sequence: Synthetic oligonucleotide
  Target: ATXN1; (-) strand; PAM type: NRG; PAM sequence: AAG
gcgccacattcatagaaaga

SEQ ID NO: 64094 - DNA, 20 bp, Artificial Sequence
  Description of Artificial Sequence: Synthetic oligonucleotide
  Target: ATXN1; (-) strand; PAM type: NRG; PAM sequence: AAG
ttcagcgccacattcataga

SEQ ID NO: 64095 - DNA, 20 bp, Artificial Sequence
  Description of Artificial Sequence: Synthetic oligonucleotide
  Target: ATXN1; (-) strand; PAM type: NRG; PAM sequence: TAG
aatcttcagcgccacattca

SEQ ID NO: 64096 - DNA, 20 bp, Artificial Sequence
  Description of Artificial Sequence: Synthetic oligonucleotide
  Target: ATXN1; (-) strand; PAM type: NRG; PAM sequence: CAG
caaatatggtatcaaatctt

SEQ ID NO: 64097 - DNA, 20 bp, Artificial Sequence
  Description of Artificial Sequence: Synthetic oligonucleotide
  Target: ATXN1; (-) strand; PAM type: NRG; PAM sequence: TGG
atggatctgtgctccaaata

SEQ ID NO: 64098 - DNA, 20 bp, Artificial Sequence
  Description of Artificial Sequence: Synthetic oligonucleotide
  Target: ATXN1; (-) strand; PAM type: NRG; PAM sequence: TGG
ttccccatccctccacacga

SEQ ID NO: 64099 - DNA, 20 bp, Artificial Sequence
  Description of Artificial Sequence: Synthetic oligonucleotide
  Target: ATXN1; (-) strand; PAM type: NRG; PAM sequence: CAG
tgtggacatgtggtcacact

SEQ ID NO: 64100 - DNA, 20 bp, Artificial Sequence
  Description of Artificial Sequence: Synthetic oligonucleotide
  Target: ATXN1; (-) strand; PAM type: NRG; PAM sequence: TGG
cagacaggcctgtggacatg

SEQ ID NO: 64101 - DNA, 20 bp, Artificial Sequence
  Description of Artificial Sequence: Synthetic oligonucleotide
  Target: ATXN1; (-) strand; PAM type: NRG; PAM sequence: TGG
agcgagctcagacaggcctg

SEQ ID NO: 64102 - DNA, 20 bp, Artificial Sequence
  Description of Artificial Sequence: Synthetic oligonucleotide
  Target: ATXN1; (-) strand; PAM type: NRG; PAM sequence: AGG
gacctgtagcgagctcagac

SEQ ID NO: 64103 - DNA, 20 bp, Artificial Sequence
  Description of Artificial Sequence: Synthetic oligonucleotide
  Target: ATXN1; (-) strand; PAM type: NRG; PAM sequence: CAG
tgacctgtagcgagctcaga

SEQ ID NO: 64104 - DNA, 20 bp, Artificial Sequence
  Description of Artificial Sequence: Synthetic oligonucleotide
  Target: ATXN1; (-) strand; PAM type: NRG; PAM sequence: CAG
agtgtgacctgtagcgagct

SEQ ID NO: 64105 - DNA, 20 bp, Artificial Sequence
  Description of Artificial Sequence: Synthetic oligonucleotide
  Target: ATXN1; (-) strand; PAM type: NRG; PAM sequence: GAG
gatgcagtgtgacctgtagc

SEQ ID NO: 64106 - DNA, 20 bp, Artificial Sequence
  Description of Artificial Sequence: Synthetic oligonucleotide
  Target: ATXN1; (-) strand; PAM type: NRG; PAM sequence: TAG
tcatgatgcagtgtgacctg

SEQ ID NO: 64107 - DNA, 20 bp, Artificial Sequence
  Description of Artificial Sequence: Synthetic oligonucleotide
  Target: ATXN1; (-) strand; PAM type: NRG; PAM sequence: CAG
gtacagggtccttcatgatg

SEQ ID NO: 64108 - DNA, 20 bp, Artificial Sequence
  Description of Artificial Sequence: Synthetic oligonucleotide
  Target: ATXN1; (-) strand; PAM type: NRG; PAM sequence: GGG
attgcagcaagtggagtaca

SEQ ID NO: 64109 - DNA, 20 bp, Artificial Sequence
  Description of Artificial Sequence: Synthetic oligonucleotide
  Target: ATXN1; (-) strand; PAM type: NRG; PAM sequence: AGG
aattgcagcaagtggagtac

SEQ ID NO: 64110 - DNA, 20 bp, Artificial Sequence
  Description of Artificial Sequence: Synthetic oligonucleotide
  Target: ATXN1; (-) strand; PAM type: NRG; PAM sequence: CAG
aaattgcagcaagtggagta

SEQ ID NO: 64111 - DNA, 20 bp, Artificial Sequence
  Description of Artificial Sequence: Synthetic oligonucleotide
  Target: ATXN1; (-) strand; PAM type: NRG; PAM sequence: GAG
cattgaaattgcagcaagtg

SEQ ID NO: 64112 - DNA, 20 bp, Artificial Sequence
  Description of Artificial Sequence: Synthetic oligonucleotide
  Target: ATXN1; (-) strand; PAM type: NRG; PAM sequence: TGG
tgcattgaaattgcagcaag

SEQ ID NO: 64113 - DNA, 20 bp, Artificial Sequence
  Description of Artificial Sequence: Synthetic oligonucleotide
  Target: ATXN1; (-) strand; PAM type: NRG; PAM sequence: AAG
atttgcattgaaattgcagc

SEQ ID NO: 64114 - DNA, 20 bp, Artificial Sequence
  Description of Artificial Sequence: Synthetic oligonucleotide
  Target: ATXN1; (-) strand; PAM type: NRG; PAM sequence: CAG
ctttatttgcattgaaattg

SEQ ID NO: 64115 - DNA, 20 bp, Artificial Sequence
  Description of Artificial Sequence: Synthetic oligonucleotide
  Target: ATXN1; (-) strand; PAM type: NRG; PAM sequence: TAG
gtcctttactcataaaatag

SEQ ID NO: 64116 - DNA, 20 bp, Artificial Sequence
  Description of Artificial Sequence: Synthetic oligonucleotide
  Target: ATXN1; (-) strand; PAM type: NRG; PAM sequence: TAG
agcgtcctttactcataaaa

SEQ ID NO: 64117 - DNA, 20 bp, Artificial Sequence
  Description of Artificial Sequence: Synthetic oligonucleotide
  Target: ATXN1; (-) strand; PAM type: NRG; PAM sequence: CAG
aaaccacggctgcatcttgc

SEQ ID NO: 64118 - DNA, 20 bp, Artificial Sequence
  Description of Artificial Sequence: Synthetic oligonucleotide
  Target: ATXN1; (-) strand; PAM type: NRG; PAM sequence: CGG
aggactcttaagacaaacca

SEQ ID NO: 64119 - DNA, 20 bp, Artificial Sequence
  Description of Artificial Sequence: Synthetic oligonucleotide
  Target: ATXN1; (-) strand; PAM type: NRG; PAM sequence: AAG
aactgagtttcaggactctt

SEQ ID NO: 64120 - DNA, 20 bp, Artificial Sequence
  Description of Artificial Sequence: Synthetic oligonucleotide
  Target: ATXN1; (-) strand; PAM type: NRG; PAM sequence: AGG
aggtattttaactgagtttc

SEQ ID NO: 64121 - DNA, 20 bp, Artificial Sequence
  Description of Artificial Sequence: Synthetic oligonucleotide
  Target: ATXN1; (-) strand; PAM type: NRG; PAM sequence: CAG
caggtattttaactgagttt

SEQ ID NO: 64122 - DNA, 20 bp, Artificial Sequence
  Description of Artificial Sequence: Synthetic oligonucleotide
  Target: ATXN1; (-) strand; PAM type: NRG; PAM sequence: GAG
gatcatcaggtattttaact

SEQ ID NO: 64123 - DNA, 20 bp, Artificial Sequence
  Description of Artificial Sequence: Synthetic oligonucleotide
  Target: ATXN1; (-) strand; PAM type: NRG; PAM sequence: AGG
tttaatgaaacgcgatcatc

SEQ ID NO: 64124 - DNA, 20 bp, Artificial Sequence
  Description of Artificial Sequence: Synthetic oligonucleotide
  Target: ATXN1; (-) strand; PAM type: NRG; PAM sequence: CAG
ttttaatgaaacgcgatcat

SEQ ID NO: 64125 - DNA, 20 bp, Artificial Sequence
  Description of Artificial Sequence: Synthetic oligonucleotide
  Target: ATXN1; (-) strand; PAM type: NRG; PAM sequence: GGG
tggtgtaaagaaattccttg

SEQ ID NO: 64126 - DNA, 20 bp, Artificial Sequence
  Description of Artificial Sequence: Synthetic oligonucleotide
  Target: ATXN1; (-) strand; PAM type: NRG; PAM sequence: GGG
atggtgtaaagaaattcctt

SEQ ID NO: 64127 - DNA, 20 bp, Artificial Sequence
  Description of Artificial Sequence: Synthetic oligonucleotide
  Target: ATXN1; (-) strand; PAM type: NRG; PAM sequence: TGG
catggtgtaaagaaattcct

SEQ ID NO: 64128 - DNA, 20 bp, Artificial Sequence
  Description of Artificial Sequence: Synthetic oligonucleotide
  Target: ATXN1; (-) strand; PAM type: NRG; PAM sequence: AAG
tgtagaatgctcatggtgta

SEQ ID NO: 64129 - DNA, 20 bp, Artificial Sequence
  Description of Artificial Sequence: Synthetic oligonucleotide
  Target: ATXN1; (-) strand; PAM type: NRG; PAM sequence: TGG
ggaaacttgtagaatgctca

SEQ ID NO: 64130 - DNA, 20 bp, Artificial Sequence
  Description of Artificial Sequence: Synthetic oligonucleotide
  Target: ATXN1; (-) strand; PAM type: NRG; PAM sequence: TAG
aaagagaggtaggaaacttg

SEQ ID NO: 64131 - DNA, 20 bp, Artificial Sequence
  Description of Artificial Sequence: Synthetic oligonucleotide
  Target: ATXN1; (-) strand; PAM type: NRG; PAM sequence: AGG
atttagtcttaaagagaggt

SEQ ID NO: 64132 - DNA, 20 bp, Artificial Sequence
  Description of Artificial Sequence: Synthetic oligonucleotide
  Target: ATXN1; (-) strand; PAM type: NRG; PAM sequence: TAG
tatttagtcttaaagagagg

SEQ ID NO: 64133 - DNA, 20 bp, Artificial Sequence
  Description of Artificial Sequence: Synthetic oligonucleotide
  Target: ATXN1; (-) strand; PAM type: NRG; PAM sequence: AGG
aaatatttagtcttaaagag

SEQ ID NO: 64134 - DNA, 20 bp, Artificial Sequence
  Description of Artificial Sequence: Synthetic oligonucleotide
  Target: ATXN1; (-) strand; PAM type: NRG; PAM sequence: GAG
taaatatttagtcttaaaga

SEQ ID NO: 64135 - DNA, 20 bp, Artificial Sequence
  Description of Artificial Sequence: Synthetic oligonucleotide
  Target: ATXN1; (-) strand; PAM type: NRG; PAM sequence: GAG
tttaaatatttagtcttaaa

SEQ ID NO: 64136 - DNA, 20 bp, Artificial Sequence
  Description of Artificial Sequence: Synthetic oligonucleotide
  Target: ATXN1; (-) strand; PAM type: NRG; PAM sequence: AAG
gttttaaatatttagtctta

SEQ ID NO: 64137 - DNA, 20 bp, Artificial Sequence
  Description of Artificial Sequence: Synthetic oligonucleotide
  Target: ATXN1; (-) strand; PAM type: NRG; PAM sequence: TAG
tctaaagagttttaaatatt

SEQ ID NO: 64138 - DNA, 20 bp, Artificial Sequence
  Description of Artificial Sequence: Synthetic oligonucleotide
  Target: ATXN1; (-) strand; PAM type: NRG; PAM sequence: GAG
tagatgatgctaattctaaa

SEQ ID NO: 64139 - DNA, 20 bp, Artificial Sequence
  Description of Artificial Sequence: Synthetic oligonucleotide
  Target: ATXN1; (-) strand; PAM type: NRG; PAM sequence: AAG
catagatgatgctaattcta

SEQ ID NO: 64140 - DNA, 20 bp, Artificial Sequence
  Description of Artificial Sequence: Synthetic oligonucleotide
  Target: ATXN1; (-) strand; PAM type: NRG; PAM sequence: TAG
tcctagagccaagtgacaca

SEQ ID NO: 64141 - DNA, 20 bp, Artificial Sequence
  Description of Artificial Sequence: Synthetic oligonucleotide
  Target: ATXN1; (-) strand; PAM type: NRG; PAM sequence: AAG
agaatatgtgtcctagagcc

SEQ ID NO: 64142 - DNA, 20 bp, Artificial Sequence
  Description of Artificial Sequence: Synthetic oligonucleotide
  Target: ATXN1; (-) strand; PAM type: NRG; PAM sequence: GAG
ccccgagaatatgtgtccta

SEQ ID NO: 64143 - DNA, 20 bp, Artificial Sequence
  Description of Artificial Sequence: Synthetic oligonucleotide
  Target: ATXN1; (-) strand; PAM type: NRG; PAM sequence: TAG
ttccccgagaatatgtgtcc

SEQ ID NO: 64144 - DNA, 20 bp, Artificial Sequence
  Description of Artificial Sequence: Synthetic oligonucleotide
  Target: ATXN1; (-) strand; PAM type: NRG; PAM sequence: GAG
atggggatatgctcttcccc

SEQ ID NO: 64145 - DNA, 20 bp, Artificial Sequence
  Description of Artificial Sequence: Synthetic oligonucleotide
  Target: ATXN1; (-) strand; PAM type: NRG; PAM sequence: GGG
tctttctcctaatagaaatg

SEQ ID NO: 64146 - DNA, 20 bp, Artificial Sequence
  Description of Artificial Sequence: Synthetic oligonucleotide
  Target: ATXN1; (-) strand; PAM type: NRG; PAM sequence: GGG
ttctttctcctaatagaaat

SEQ ID NO: 64147 - DNA, 20 bp, Artificial Sequence
  Description of Artificial Sequence: Synthetic oligonucleotide
  Target: ATXN1; (-) strand; PAM type: NRG; PAM sequence: TGG
attctttctcctaatagaaa

SEQ ID NO: 64148 - DNA, 20 bp, Artificial Sequence
  Description of Artificial Sequence: Synthetic oligonucleotide
  Target: ATXN1; (-) strand; PAM type: NRG; PAM sequence: TAG
cctgttattctttctcctaa

SEQ ID NO: 64149 - DNA, 20 bp, Artificial Sequence
  Description of Artificial Sequence: Synthetic oligonucleotide
  Target: ATXN1; (-) strand; PAM type: NRG; PAM sequence: GAG
tgcaagatgaaggaggaggg

SEQ ID NO: 64150 - DNA, 20 bp, Artificial Sequence
  Description of Artificial Sequence: Synthetic oligonucleotide
  Target: ATXN1; (-) strand; PAM type: NRG; PAM sequence: GGG
tctgcaagatgaaggaggag

SEQ ID NO: 64151 - DNA, 20 bp, Artificial Sequence
  Description of Artificial Sequence: Synthetic oligonucleotide
  Target: ATXN1; (-) strand; PAM type: NRG; PAM sequence: GGG
atctgcaagatgaaggagga

SEQ ID NO: 64152 - DNA, 20 bp, Artificial Sequence
  Description of Artificial Sequence: Synthetic oligonucleotide
  Target: ATXN1; (-) strand; PAM type: NRG; PAM sequence: AGG
aatctgcaagatgaaggagg

SEQ ID NO: 64153 - DNA, 20 bp, Artificial Sequence
  Description of Artificial Sequence: Synthetic oligonucleotide
  Target: ATXN1; (-) strand; PAM type: NRG; PAM sequence: GAG
aaatctgcaagatgaaggag

SEQ ID NO: 64154 - DNA, 20 bp, Artificial Sequence
  Description of Artificial Sequence: Synthetic oligonucleotide
  Target: ATXN1; (-) strand; PAM type: NRG; PAM sequence: AGG
ctaaatctgcaagatgaagg

SEQ ID NO: 64155 - DNA, 20 bp, Artificial Sequence
  Description of Artificial Sequence: Synthetic oligonucleotide
  Target: ATXN1; (-) strand; PAM type: NRG; PAM sequence: GAG
cctaaatctgcaagatgaag

SEQ ID NO: 64156 - DNA, 20 bp, Artificial Sequence
  Description of Artificial Sequence: Synthetic oligonucleotide
  Target: ATXN1; (-) strand; PAM type: NRG; PAM sequence: AGG
cccctaaatctgcaagatga

SEQ ID NO: 64157 - DNA, 20 bp, Artificial Sequence
  Description of Artificial Sequence: Synthetic oligonucleotide
  Target: ATXN1; (-) strand; PAM type: NRG; PAM sequence: AAG
acccctaaatctgcaagatg

SEQ ID NO: 64158 - DNA, 20 bp, Artificial Sequence
  Description of Artificial Sequence: Synthetic oligonucleotide
  Target: ATXN1; (-) strand; PAM type: NRG; PAM sequence: AAG
ggataaacccctaaatctgc

SEQ ID NO: 64159 - DNA, 20 bp, Artificial Sequence
  Description of Artificial Sequence: Synthetic oligonucleotide
  Target: ATXN1; (-) strand; PAM type: NRG; PAM sequence: AGG
atcccctgagccatgatact

SEQ ID NO: 64160 - DNA, 20 bp, Artificial Sequence
  Description of Artificial Sequence: Synthetic oligonucleotide
  Target: ATXN1; (-) strand; PAM type: NRG; PAM sequence: TAG
aatcccctgagccatgatac

SEQ ID NO: 64161 - DNA, 20 bp, Artificial Sequence
  Description of Artificial Sequence: Synthetic oligonucleotide
  Target: ATXN1; (-) strand; PAM type: NRG; PAM sequence: GAG
tgtaagtgtgagaatcccct

SEQ ID NO: 64162 - DNA, 20 bp, Artificial Sequence
  Description of Artificial Sequence: Synthetic oligonucleotide
  Target: ATXN1; (-) strand; PAM type: NRG; PAM sequence: GAG
atattaggagttgtaagtgt

SEQ ID NO: 64163 - DNA, 20 bp, Artificial Sequence
  Description of Artificial Sequence: Synthetic oligonucleotide
  Target: ATXN1; (-) strand; PAM type: NRG; PAM sequence: AAG
tttgatatattaggagttgt

SEQ ID NO: 64164 - DNA, 20 bp, Artificial Sequence
  Description of Artificial Sequence: Synthetic oligonucleotide
  Target: ATXN1; (-) strand; PAM type: NRG; PAM sequence: GAG
ctccttttttgatatattag

SEQ ID NO: 64165 - DNA, 20 bp, Artificial Sequence
  Description of Artificial Sequence: Synthetic oligonucleotide
  Target: ATXN1; (-) strand; PAM type: NRG; PAM sequence: AGG
ttctccttttttgatatatt

SEQ ID NO: 64166 - DNA, 20 bp, Artificial Sequence
  Description of Artificial Sequence: Synthetic oligonucleotide
  Target: ATXN1; (-) strand; PAM type: NRG; PAM sequence: TAG
tttctccttttttgatatat

SEQ ID NO: 64167 - DNA, 20 bp, Artificial Sequence
  Description of Artificial Sequence: Synthetic oligonucleotide
  Target: ATXN1; (-) strand; PAM type: NRG; PAM sequence: GAG
aaacaattaagcagtgaaga

SEQ ID NO: 64168 - DNA, 20 bp, Artificial Sequence
  Description of Artificial Sequence: Synthetic oligonucleotide
  Target: ATXN1; (-) strand; PAM type: NRG; PAM sequence: GAG
caaaacaattaagcagtgaa

SEQ ID NO: 64169 - DNA, 20 bp, Artificial Sequence
  Description of Artificial Sequence: Synthetic oligonucleotide
  Target: ATXN1; (-) strand; PAM type: NRG; PAM sequence: AAG
gacaaaacaattaagcagtg

SEQ ID NO: 64170 - DNA, 20 bp, Artificial Sequence
  Description of Artificial Sequence: Synthetic oligonucleotide
  Target: ATXN1; (-) strand; PAM type: NRG; PAM sequence: CAG
tattcgacaaaacaattaag

SEQ ID NO: 64171 - DNA, 20 bp, Artificial Sequence
  Description of Artificial Sequence: Synthetic oligonucleotide
  Target: ATXN1; (-) strand; PAM type: NRG; PAM sequence: AAG
gcttattcgacaaaacaatt

SEQ ID NO: 64172 - DNA, 20 bp, Artificial Sequence
  Description of Artificial Sequence: Synthetic oligonucleotide
  Target: ATXN1; (-) strand; PAM type: NRG; PAM sequence: GAG
taacaaaaatgaacttttga

SEQ ID NO: 64173 - DNA, 20 bp, Artificial Sequence
  Description of Artificial Sequence: Synthetic oligonucleotide
  Target: ATXN1; (-) strand; PAM type: NRG; PAM sequence: GAG
ggtaacaaaaatgaactttt

SEQ ID NO: 64174 - DNA, 20 bp, Artificial Sequence
  Description of Artificial Sequence: Synthetic oligonucleotide
  Target: ATXN1; (-) strand; PAM type: NRG; PAM sequence: AGG
cctcttattttgcctgaaaa

SEQ ID NO: 64175 - DNA, 20 bp, Artificial Sequence
  Description of Artificial Sequence: Synthetic oligonucleotide
  Target: ATXN1; (-) strand; PAM type: NRG; PAM sequence: AAG
gcctcttattttgcctgaaa

SEQ ID NO: 64176 - DNA, 20 bp, Artificial Sequence
  Description of Artificial Sequence: Synthetic oligonucleotide
  Target: ATXN1; (-) strand; PAM type: NRG; PAM sequence: AGG
agcaatagaatttttgtaaa

SEQ ID NO: 64177 - DNA, 20 bp, Artificial Sequence
  Description of Artificial Sequence: Synthetic oligonucleotide
  Target: ATXN1; (-) strand; PAM type: NRG; PAM sequence: AAG
tagcaatagaatttttgtaa

SEQ ID NO: 64178 - DNA, 20 bp, Artificial Sequence
  Description of Artificial Sequence: Synthetic oligonucleotide
  Target: ATXN1; (-) strand; PAM type: NRG; PAM sequence: TAG
gaattccattgttttagcaa

SEQ ID NO: 64179 - DNA, 20 bp, Artificial Sequence
  Description of Artificial Sequence: Synthetic oligonucleotide
  Target: ATXN1; (-) strand; PAM type: NRG; PAM sequence: TAG
ccgggagaattccattgttt

SEQ ID NO: 64180 - DNA, 20 bp, Artificial Sequence
  Description of Artificial Sequence: Synthetic oligonucleotide
  Target: ATXN1; (-) strand; PAM type: NRG; PAM sequence: GAG
cataacgaagtcattcccgg

SEQ ID NO: 64181 - DNA, 20 bp, Artificial Sequence
  Description of Artificial Sequence: Synthetic oligonucleotide
  Target: ATXN1; (-) strand; PAM type: NRG; PAM sequence: GGG
tccataacgaagtcattccc

SEQ ID NO: 64182 - DNA, 20 bp, Artificial Sequence
  Description of Artificial Sequence: Synthetic oligonucleotide
  Target: ATXN1; (-) strand; PAM type: NRG; PAM sequence: CGG
ttccataacgaagtcattcc

SEQ ID NO: 64183 - DNA, 20 bp, Artificial Sequence
  Description of Artificial Sequence: Synthetic oligonucleotide
  Target: ATXN1; (-) strand; PAM type: NRG; PAM sequence: AAG
gtcacttcatttccataacg

SEQ ID NO: 64184 - DNA, 20 bp, Artificial Sequence
  Description of Artificial Sequence: Synthetic oligonucleotide
  Target: ATXN1; (-) strand; PAM type: NRG; PAM sequence: AAG
tctgcctggctagataaaag

SEQ ID NO: 64185 - DNA, 20 bp, Artificial Sequence
  Description of Artificial Sequence: Synthetic oligonucleotide
  Target: ATXN1; (-) strand; PAM type: NRG; PAM sequence: AAG
ctttctgcctggctagataa

SEQ ID NO: 64186 - DNA, 20 bp, Artificial Sequence
  Description of Artificial Sequence: Synthetic oligonucleotide
  Target: ATXN1; (-) strand; PAM type: NRG; PAM sequence: TAG
atgcagactttctgcctggc

SEQ ID NO: 64187 - DNA, 20 bp, Artificial Sequence
  Description of Artificial Sequence: Synthetic oligonucleotide
  Target: ATXN1; (-) strand; PAM type: NRG; PAM sequence: TGG
ataaatgcagactttctgcc

SEQ ID NO: 64188 - DNA, 20 bp, Artificial Sequence
  Description of Artificial Sequence: Synthetic oligonucleotide
  Target: ATXN1; (-) strand; PAM type: NRG; PAM sequence: CAG
ctgaatgccttttataaatg

SEQ ID NO: 64189 - DNA, 20 bp, Artificial Sequence
  Description of Artificial Sequence: Synthetic oligonucleotide
  Target: ATXN1; (-) strand; PAM type: NRG; PAM sequence: GAG
tcctcccacacacaacactt

SEQ ID NO: 64190 - DNA, 20 bp, Artificial Sequence
  Description of Artificial Sequence: Synthetic oligonucleotide
  Target: ATXN1; (-) strand; PAM type: NRG; PAM sequence: TAG
gctgcaatctgaattaaaaa

SEQ ID NO: 64191 - DNA, 20 bp, Artificial Sequence
  Description of Artificial Sequence: Synthetic oligonucleotide
  Target: ATXN1; (-) strand; PAM type: NRG; PAM sequence: AGG
tactgaaagacctggatggg

SEQ ID NO: 64192 - DNA, 20 bp, Artificial Sequence
  Description of Artificial Sequence: Synthetic oligonucleotide
  Target: ATXN1; (-) strand; PAM type: NRG; PAM sequence: GAG
atactgaaagacctggatgg

SEQ ID NO: 64193 - DNA, 20 bp, Artificial Sequence
  Description of Artificial Sequence: Synthetic oligonucleotide
  Target: ATXN1; (-) strand; PAM type: NRG; PAM sequence: GGG
ttatactgaaagacctggat

SEQ ID NO: 64194 - DNA, 20 bp, Artificial Sequence
  Description of Artificial Sequence: Synthetic oligonucleotide
  Target: ATXN1; (-) strand; PAM type: NRG; PAM sequence: TGG
attatactgaaagacctgga

SEQ ID NO: 64195 - DNA, 20 bp, Artificial Sequence
  Description of Artificial Sequence: Synthetic oligonucleotide
  Target: ATXN1; (-) strand; PAM type: NRG; PAM sequence: TGG
tatgattatactgaaagacc

SEQ ID NO: 64196 - DNA, 20 bp, Artificial Sequence
  Description of Artificial Sequence: Synthetic oligonucleotide
  Target: ATXN1; (-) strand; PAM type: NRG; PAM sequence: AAG
tatgattatgattatactga

SEQ ID NO: 64197 - DNA, 20 bp, Artificial Sequence
  Description of Artificial Sequence: Synthetic oligonucleotide
  Target: ATXN1; (-) strand; PAM type: NRG; PAM sequence: CAG
ttttttttttctttttacat

SEQ ID NO: 64198 - DNA, 20 bp, Artificial Sequence
  Description of Artificial Sequence: Synthetic oligonucleotide
  Target: ATXN1; (-) strand; PAM type: NRG; PAM sequence: GGG
ctgctggggtcagcaggaat

SEQ ID NO: 64199 - DNA, 20 bp, Artificial Sequence
  Description of Artificial Sequence: Synthetic oligonucleotide
  Target: ATXN1; (-) strand; PAM type: NRG; PAM sequence: TGG
tctgctggggtcagcaggaa

SEQ ID NO: 64200 - DNA, 20 bp, Artificial Sequence
  Description of Artificial Sequence: Synthetic oligonucleotide
  Target: ATXN1; (-) strand; PAM type: NRG; PAM sequence: AGG
ctttttctgctggggtcagc

SEQ ID NO: 64201 - DNA, 20 bp, Artificial Sequence
  Description of Artificial Sequence: Synthetic oligonucleotide
  Target: ATXN1; (-) strand; PAM type: NRG; PAM sequence: CAG
tctttttctgctggggtcag

SEQ ID NO: 64202 - DNA, 20 bp, Artificial Sequence
  Description of Artificial Sequence: Synthetic oligonucleotide
  Target: ATXN1; (-) strand; PAM type: NRG; PAM sequence: CAG
ctctctttttctgctggggt

SEQ ID NO: 64203 - DNA, 20 bp, Artificial Sequence
  Description of Artificial Sequence: Synthetic oligonucleotide
  Target: ATXN1; (-) strand; PAM type: NRG; PAM sequence: GGG
ctttctctctttttctgctg

SEQ ID NO: 64204 - DNA, 20 bp, Artificial Sequence
  Description of Artificial Sequence: Synthetic oligonucleotide
  Target: ATXN1; (-) strand; PAM type: NRG; PAM sequence: GGG
tctttctctctttttctgct

SEQ ID NO: 64205 - DNA, 20 bp, Artificial Sequence
  Description of Artificial Sequence: Synthetic oligonucleotide
  Target: ATXN1; (-) strand; PAM type: NRG; PAM sequence: TGG
ttctttctctctttttctgc

SEQ ID NO: 64206 - DNA, 20 bp, Artificial Sequence
  Description of Artificial Sequence: Synthetic oligonucleotide
  Target: ATXN1; (-) strand; PAM type: NRG; PAM sequence: AAG
aacggtctaaaagtggaagg

SEQ ID NO: 64207 - DNA, 20 bp, Artificial Sequence
  Description of Artificial Sequence: Synthetic oligonucleotide
  Target: ATXN1; (-) strand; PAM type: NRG; PAM sequence: AGG
cagaacggtctaaaagtgga

SEQ ID NO: 64208 - DNA, 20 bp, Artificial Sequence
  Description of Artificial Sequence: Synthetic oligonucleotide
  Target: ATXN1; (-) strand; PAM type: NRG; PAM sequence: AAG
acagaacggtctaaaagtgg

SEQ ID NO: 64209 - DNA, 20 bp, Artificial Sequence
  Description of Artificial Sequence: Synthetic oligonucleotide
  Target: ATXN1; (-) strand; PAM type: NRG; PAM sequence: TGG
cccacagaacggtctaaaag

SEQ ID NO: 64210 - DNA, 20 bp, Artificial Sequence
  Description of Artificial Sequence: Synthetic oligonucleotide
  Target: ATXN1; (-) strand; PAM type: NRG; PAM sequence: AAG
aagcccacagaacggtctaa

SEQ ID NO: 64211 - DNA, 20 bp, Artificial Sequence
  Description of Artificial Sequence: Synthetic oligonucleotide
  Target: ATXN1; (-) strand; PAM type: NRG; PAM sequence: CGG
ggatctccaagcccacagaa

SEQ ID NO: 64212 - DNA, 20 bp, Artificial Sequence
  Description of Artificial Sequence: Synthetic oligonucleotide
  Target: ATXN1; (-) strand; PAM type: NRG; PAM sequence: CAG
aaggtggatctccaagccca

SEQ ID NO: 64213 - DNA, 20 bp, Artificial Sequence
  Description of Artificial Sequence: Synthetic oligonucleotide
  Target: ATXN1; (-) strand; PAM type: NRG; PAM sequence: AAG
tgcctcgaaggtggatctcc

SEQ ID NO: 64214 - DNA, 20 bp, Artificial Sequence
  Description of Artificial Sequence: Synthetic oligonucleotide
  Target: ATXN1; (-) strand; PAM type: NRG; PAM sequence: TGG
tgctctgattgcctcgaagg

SEQ ID NO: 64215 - DNA, 20 bp, Artificial Sequence
  Description of Artificial Sequence: Synthetic oligonucleotide
  Target: ATXN1; (-) strand; PAM type: NRG; PAM sequence: AGG
gtctgctctgattgcctcga

SEQ ID NO: 64216 - DNA, 20 bp, Artificial Sequence
  Description of Artificial Sequence: Synthetic oligonucleotide
  Target: ATXN1; (-) strand; PAM type: NRG; PAM sequence: AAG
agtctgctctgattgcctcg

SEQ ID NO: 64217 - DNA, 20 bp, Artificial Sequence
  Description of Artificial Sequence: Synthetic oligonucleotide
  Target: ATXN1; (-) strand; PAM type: NRG; PAM sequence: TAG
ttttaactttggataatgga

SEQ ID NO: 64218 - DNA, 20 bp, Artificial Sequence
  Description of Artificial Sequence: Synthetic oligonucleotide
  Target: ATXN1; (-) strand; PAM type: NRG; PAM sequence: TGG
gtgcttttaactttggataa

SEQ ID NO: 64219 - DNA, 20 bp, Artificial Sequence
  Description of Artificial Sequence: Synthetic oligonucleotide
  Target: ATXN1; (-) strand; PAM type: NRG; PAM sequence: TGG
agttaaagtgcttttaactt

SEQ ID NO: 64220 - DNA, 20 bp, Artificial Sequence
  Description of Artificial Sequence: Synthetic oligonucleotide
  Target: ATXN1; (-) strand; PAM type: NRG; PAM sequence: AAG
tgctgttactagcagagtta

SEQ ID NO: 64221 - DNA, 20 bp, Artificial Sequence
  Description of Artificial Sequence: Synthetic oligonucleotide
  Target: ATXN1; (-) strand; PAM type: NRG; PAM sequence: GAG
acgtgatgctgttactagca

SEQ ID NO: 64222 - DNA, 20 bp, Artificial Sequence
  Description of Artificial Sequence: Synthetic oligonucleotide
  Target: ATXN1; (-) strand; PAM type: NRG; PAM sequence: CAG
agacgtgatgctgttactag

SEQ ID NO: 64223 - DNA, 20 bp, Artificial Sequence
  Description of Artificial Sequence: Synthetic oligonucleotide
  Target: ATXN1; (-) strand; PAM type: NRG; PAM sequence: TAG
agaagacgtgatgctgttac

SEQ ID NO: 64224 - DNA, 20 bp, Artificial Sequence
  Description of Artificial Sequence: Synthetic oligonucleotide
  Target: ATXN1; (-) strand; PAM type: NRG; PAM sequence: AAG
agaatgtaaatttgtgtgag

SEQ ID NO: 64225 - DNA, 20 bp, Artificial Sequence
  Description of Artificial Sequence: Synthetic oligonucleotide
  Target: ATXN1; (-) strand; PAM type: NRG; PAM sequence: GAG
acaagaatgtaaatttgtgt

SEQ ID NO: 64226 - DNA, 20 bp, Artificial Sequence
  Description of Artificial Sequence: Synthetic oligonucleotide
  Target: ATXN1; (-) strand; PAM type: NRG; PAM sequence: AAG
agagtgaaagtcacacgaac

SEQ ID NO: 64227 - DNA, 20 bp, Artificial Sequence
  Description of Artificial Sequence: Synthetic oligonucleotide
  Target: ATXN1; (-) strand; PAM type: NRG; PAM sequence: AAG
ctgcaaacttaggagagtga

SEQ ID NO: 64228 - DNA, 20 bp, Artificial Sequence
  Description of Artificial Sequence: Synthetic oligonucleotide
  Target: ATXN1; (-) strand; PAM type: NRG; PAM sequence: GAG
cgattcctgcaaacttagga

SEQ ID NO: 64229 - DNA, 20 bp, Artificial Sequence
  Description of Artificial Sequence: Synthetic oligonucleotide
  Target: ATXN1; (-) strand; PAM type: NRG; PAM sequence: GAG
ggcgattcctgcaaacttag

SEQ ID NO: 64230 - DNA, 20 bp, Artificial Sequence
  Description of Artificial Sequence: Synthetic oligonucleotide
  Target: ATXN1; (-) strand; PAM type: NRG; PAM sequence: AGG
caggcgattcctgcaaactt

SEQ ID NO: 64231 - DNA, 20 bp, Artificial Sequence
  Description of Artificial Sequence: Synthetic oligonucleotide
  Target: ATXN1; (-) strand; PAM type: NRG; PAM sequence: TAG
acaggcgattcctgcaaact

SEQ ID NO: 64232 - DNA, 20 bp, Artificial Sequence
  Description of Artificial Sequence: Synthetic oligonucleotide
  Target: ATXN1; (-) strand; PAM type: NRG; PAM sequence: AGG
cggcgtttcccagcaggcac

SEQ ID NO: 64233 - DNA, 20 bp, Artificial Sequence
  Description of Artificial Sequence: Synthetic oligonucleotide
  Target: ATXN1; (-) strand; PAM type: NRG; PAM sequence: CAG
acggcgtttcccagcaggca

SEQ ID NO: 64234 - DNA, 20 bp, Artificial Sequence
  Description of Artificial Sequence: Synthetic oligonucleotide
  Target: ATXN1; (-) strand; PAM type: NRG; PAM sequence: AGG
cttgcacggcgtttcccagc

SEQ ID NO: 64235 - DNA, 20 bp, Artificial Sequence
  Description of Artificial Sequence: Synthetic oligonucleotide
  Target: ATXN1; (-) strand; PAM type: NRG; PAM sequence: CAG
acttgcacggcgtttcccag

SEQ ID NO: 64236 - DNA, 20 bp, Artificial Sequence
  Description of Artificial Sequence: Synthetic oligonucleotide
  Target: ATXN1; (-) strand; PAM type: NRG; PAM sequence: CAG
ggaacttgcacggcgtttcc

SEQ ID NO: 64237 - DNA, 20 bp, Artificial Sequence
  Description of Artificial Sequence: Synthetic oligonucleotide
  Target: ATXN1; (-) strand; PAM type: NRG; PAM sequence: CGG
aacagatggaggaacttgca

SEQ ID NO: 64238 - DNA, 20 bp, Artificial Sequence
  Description of Artificial Sequence: Synthetic oligonucleotide
  Target: ATXN1; (-) strand; PAM type: NRG; PAM sequence: AGG
taagtcttggaaacagatgg

SEQ ID NO: 64239 - DNA, 20 bp, Artificial Sequence
  Description of Artificial Sequence: Synthetic oligonucleotide
  Target: ATXN1; (-) strand; PAM type: NRG; PAM sequence: GAG
ttaagtcttggaaacagatg

SEQ ID NO: 64240 - DNA, 20 bp, Artificial Sequence
  Description of Artificial Sequence: Synthetic oligonucleotide
  Target: ATXN1; (-) strand; PAM type: NRG; PAM sequence: TGG
tgttaagtcttggaaacaga

SEQ ID NO: 64241 - DNA, 20 bp, Artificial Sequence
  Description of Artificial Sequence: Synthetic oligonucleotide
  Target: ATXN1; (-) strand; PAM type: NRG; PAM sequence: CAG
ggaatgttaagtcttggaaa

SEQ ID NO: 64242 - DNA, 20 bp, Artificial Sequence
  Description of Artificial Sequence: Synthetic oligonucleotide
  Target: ATXN1; (-) strand; PAM type: NRG; PAM sequence: TGG
caccaaggaatgttaagtct

SEQ ID NO: 64243 - DNA, 20 bp, Artificial Sequence
  Description of Artificial Sequence: Synthetic oligonucleotide
  Target: ATXN1; (-) strand; PAM type: NRG; PAM sequence: AAG
cactgtcaccaaggaatgtt

SEQ ID NO: 64244 - DNA, 20 bp, Artificial Sequence
  Description of Artificial Sequence: Synthetic oligonucleotide
  Target: ATXN1; (-) strand; PAM type: NRG; PAM sequence: AGG
cgtccattgcactgtcacca

SEQ ID NO: 64245 - DNA, 20 bp, Artificial Sequence
  Description of Artificial Sequence: Synthetic oligonucleotide
  Target: ATXN1; (-) strand; PAM type: NRG; PAM sequence: AAG
tcgtccattgcactgtcacc

SEQ ID NO: 64246 - DNA, 20 bp, Artificial Sequence
  Description of Artificial Sequence: Synthetic oligonucleotide
  Target: ATXN1; (-) strand; PAM type: NRG; PAM sequence: TGG
gcatggccctgccaccaggc

SEQ ID NO: 64247 - DNA, 20 bp, Artificial Sequence
  Description of Artificial Sequence: Synthetic oligonucleotide
  Target: ATXN1; (-) strand; PAM type: NRG; PAM sequence: AGG
cccagcatggccctgccacc

SEQ ID NO: 64248 - DNA, 20 bp, Artificial Sequence
  Description of Artificial Sequence: Synthetic oligonucleotide
  Target: ATXN1; (-) strand; PAM type: NRG; PAM sequence: CAG
tcccagcatggccctgccac

SEQ ID NO: 64249 - DNA, 20 bp, Artificial Sequence
  Description of Artificial Sequence: Synthetic oligonucleotide
  Target: ATXN1; (-) strand; PAM type: NRG; PAM sequence: TGG
tagaaatcaagttcccagca

SEQ ID NO: 64250 - DNA, 20 bp, Artificial Sequence
  Description of Artificial Sequence: Synthetic oligonucleotide
  Target: ATXN1; (-) strand; PAM type: NRG; PAM sequence: CAG
gacattagaaatcaagttcc

SEQ ID NO: 64251 - DNA, 20 bp, Artificial Sequence
  Description of Artificial Sequence: Synthetic oligonucleotide
  Target: ATXN1; (-) strand; PAM type: NRG; PAM sequence: AAG
agtgattgacattagaaatc

SEQ ID NO: 64252 - DNA, 20 bp, Artificial Sequence
  Description of Artificial Sequence: Synthetic oligonucleotide
  Target: ATXN1; (-) strand; PAM type: NRG; PAM sequence: TAG
ggcattccagtgattgacat

SEQ ID NO: 64253 - DNA, 20 bp, Artificial Sequence
  Description of Artificial Sequence: Synthetic oligonucleotide
  Target: ATXN1; (-) strand; PAM type: NRG; PAM sequence: CAG
tccttactagaagggcattc

SEQ ID NO: 64254 - DNA, 20 bp, Artificial Sequence
  Description of Artificial Sequence: Synthetic oligonucleotide
  Target: ATXN1; (-) strand; PAM type: NRG; PAM sequence: GGG
gcacctcttccttactagaa

SEQ ID NO: 64255 - DNA, 20 bp, Artificial Sequence
  Description of Artificial Sequence: Synthetic oligonucleotide
  Target: ATXN1; (-) strand; PAM type: NRG; PAM sequence: AGG
ggcacctcttccttactaga

SEQ ID NO: 64256 - DNA, 20 bp, Artificial Sequence
  Description of Artificial Sequence: Synthetic oligonucleotide
  Target: ATXN1; (-) strand; PAM type: NRG; PAM sequence: AAG
gggcacctcttccttactag

SEQ ID NO: 64257 - DNA, 20 bp, Artificial Sequence
  Description of Artificial Sequence: Synthetic oligonucleotide
  Target: ATXN1; (-) strand; PAM type: NRG; PAM sequence: TAG
cttgggcacctcttccttac

SEQ ID NO: 64258 - DNA, 20 bp, Artificial Sequence
  Description of Artificial Sequence: Synthetic oligonucleotide
  Target: ATXN1; (-) strand; PAM type: NRG; PAM sequence: GGG
gttaactcaaacagaagctt

SEQ ID NO: 64259 - DNA, 20 bp, Artificial Sequence
  Description of Artificial Sequence: Synthetic oligonucleotide
  Target: ATXN1; (-) strand; PAM type: NRG; PAM sequence: TGG
tgttaactcaaacagaagct

SEQ ID NO: 64260 - DNA, 20 bp, Artificial Sequence
  Description of Artificial Sequence: Synthetic oligonucleotide
  Target: ATXN1; (-) strand; PAM type: NRG; PAM sequence: AAG
gtctgtgttaactcaaacag

SEQ ID NO: 64261 - DNA, 20 bp, Artificial Sequence
  Description of Artificial Sequence: Synthetic oligonucleotide
  Target: ATXN1; (-) strand; PAM type: NRG; PAM sequence: CAG
aaggtctgtgttaactcaaa

SEQ ID NO: 64262 - DNA, 20 bp, Artificial Sequence
  Description of Artificial Sequence: Synthetic oligonucleotide
  Target: ATXN1; (-) strand; PAM type: NRG; PAM sequence: AGG
attctacacctgacctggaa

SEQ ID NO: 64263 - DNA, 20 bp, Artificial Sequence
  Description of Artificial Sequence: Synthetic oligonucleotide
  Target: ATXN1; (-) strand; PAM type: NRG; PAM sequence: AAG
gattctacacctgacctgga

SEQ ID NO: 64264 - DNA, 20 bp, Artificial Sequence
  Description of Artificial Sequence: Synthetic oligonucleotide
  Target: ATXN1; (-) strand; PAM type: NRG; PAM sequence: TGG
tccagattctacacctgacc

SEQ ID NO: 64265 - DNA, 20 bp, Artificial Sequence
  Description of Artificial Sequence: Synthetic oligonucleotide
  Target: ATXN1; (-) strand; PAM type: NRG; PAM sequence: CAG
agcccttccattcatcactc

SEQ ID NO: 64266 - DNA, 20 bp, Artificial Sequence
  Description of Artificial Sequence: Synthetic oligonucleotide
  Target: ATXN1; (-) strand; PAM type: NRG; PAM sequence: CAG
actggtcttcatttcctttc

SEQ ID NO: 64267 - DNA, 20 bp, Artificial Sequence
  Description of Artificial Sequence: Synthetic oligonucleotide
  Target: ATXN1; (-) strand; PAM type: NRG; PAM sequence: TGG
ctgcaaagagacatctacac

SEQ ID NO: 64268 - DNA, 20 bp, Artificial Sequence
  Description of Artificial Sequence: Synthetic oligonucleotide
  Target: ATXN1; (-) strand; PAM type: NRG; PAM sequence: GAG
taatgttcaacttctgcaaa

SEQ ID NO: 64269 - DNA, 20 bp, Artificial Sequence
  Description of Artificial Sequence: Synthetic oligonucleotide
  Target: ATXN1; (-) strand; PAM type: NRG; PAM sequence: AAG
tctaatgttcaacttctgca

SEQ ID NO: 64270 - DNA, 20 bp, Artificial Sequence
  Description of Artificial Sequence: Synthetic oligonucleotide
  Target: ATXN1; (-) strand; PAM type: NRG; PAM sequence: CAG
ctgcacatatagccttaaac

SEQ ID NO: 64271 - DNA, 20 bp, Artificial Sequence
  Description of Artificial Sequence: Synthetic oligonucleotide
  Target: ATXN1; (-) strand; PAM type: NRG; PAM sequence: TAG
cttctctaatcctgcacata

SEQ ID NO: 64272 - DNA, 20 bp, Artificial Sequence
  Description of Artificial Sequence: Synthetic oligonucleotide
  Target: ATXN1; (-) strand; PAM type: NRG; PAM sequence: CAG
tgacttacacactttaaaaa

SEQ ID NO: 64273 - DNA, 20 bp, Artificial Sequence
  Description of Artificial Sequence: Synthetic oligonucleotide
  Target: ATXN1; (-) strand; PAM type: NRG; PAM sequence: AAG
tcaacatgtggatggagtaa

SEQ ID NO: 64274 - DNA, 20 bp, Artificial Sequence
  Description of Artificial Sequence: Synthetic oligonucleotide
  Target: ATXN1; (-) strand; PAM type: NRG; PAM sequence: GAG
ggttgttcaacatgtggatg

SEQ ID NO: 64275 - DNA, 20 bp, Artificial Sequence
  Description of Artificial Sequence: Synthetic oligonucleotide
  Target: ATXN1; (-) strand; PAM type: NRG; PAM sequence: TGG
atggttgttcaacatgtgga

SEQ ID NO: 64276 - DNA, 20 bp, Artificial Sequence
  Description of Artificial Sequence: Synthetic oligonucleotide
  Target: ATXN1; (-) strand; PAM type: NRG; PAM sequence: TGG
gatgatggttgttcaacatg

SEQ ID NO: 64277 - DNA, 20 bp, Artificial Sequence
  Description of Artificial Sequence: Synthetic oligonucleotide
  Target: ATXN1; (-) strand; PAM type: NRG; PAM sequence: TGG
ctggaattagatagtgatga

SEQ ID NO: 64278 - DNA, 20 bp, Artificial Sequence
  Description of Artificial Sequence: Synthetic oligonucleotide
  Target: ATXN1; (-) strand; PAM type: NRG; PAM sequence: TAG
gacaatcttctggaattaga

SEQ ID NO: 64279 - DNA, 20 bp, Artificial Sequence
  Description of Artificial Sequence: Synthetic oligonucleotide
  Target: ATXN1; (-) strand; PAM type: NRG; PAM sequence: TAG
tgatgacaatcttctggaat

SEQ ID NO: 64280 - DNA, 20 bp, Artificial Sequence
  Description of Artificial Sequence: Synthetic oligonucleotide
  Target: ATXN1; (-) strand; PAM type: NRG; PAM sequence: TGG
gggggatgatgacaatcttc

SEQ ID NO: 64281 - DNA, 20 bp, Artificial Sequence
  Description of Artificial Sequence: Synthetic oligonucleotide
  Target: ATXN1; (-) strand; PAM type: NRG; PAM sequence: GGG
tgactgtttcatggataagg

SEQ ID NO: 64282 - DNA, 20 bp, Artificial Sequence
  Description of Artificial Sequence: Synthetic oligonucleotide
  Target: ATXN1; (-) strand; PAM type: NRG; PAM sequence: GGG
gtgactgtttcatggataag

SEQ ID NO: 64283 - DNA, 20 bp, Artificial Sequence
  Description of Artificial Sequence: Synthetic oligonucleotide
  Target: ATXN1; (-) strand; PAM type: NRG; PAM sequence: GGG
agtgactgtttcatggataa

SEQ ID NO: 64284 - DNA, 20 bp, Artificial Sequence
  Description of Artificial Sequence: Synthetic oligonucleotide
  Target: ATXN1; (-) strand; PAM type: NRG; PAM sequence: AGG
gagtgactgtttcatggata

SEQ ID NO: 64285 - DNA, 20 bp, Artificial Sequence
  Description of Artificial Sequence: Synthetic oligonucleotide
  Target: ATXN1; (-) strand; PAM type: NRG; PAM sequence: AAG
ggagtgactgtttcatggat

SEQ ID NO: 64286 - DNA, 20 bp, Artificial Sequence
  Description of Artificial Sequence: Synthetic oligonucleotide
  Target: ATXN1; (-) strand; PAM type: NRG; PAM sequence: TGG
gacagggagtgactgtttca

SEQ ID NO: 64287 - DNA, 20 bp, Artificial Sequence
  Description of Artificial Sequence: Synthetic oligonucleotide
  Target: ATXN1; (-) strand; PAM type: NRG; PAM sequence: GAG
tgagaggagtgggggacagg

SEQ ID NO: 64288 - DNA, 20 bp, Artificial Sequence
  Description of Artificial Sequence: Synthetic oligonucleotide
  Target: ATXN1; (-) strand; PAM type: NRG; PAM sequence: GGG
gctgagaggagtgggggaca

SEQ ID NO: 64289 - DNA, 20 bp, Artificial Sequence
  Description of Artificial Sequence: Synthetic oligonucleotide
  Target: ATXN1; (-) strand; PAM type: NRG; PAM sequence: AGG
ggctgagaggagtgggggac

SEQ ID NO: 64290 - DNA, 20 bp, Artificial Sequence
  Description of Artificial Sequence: Synthetic oligonucleotide
  Target: ATXN1; (-) strand; PAM type: NRG; PAM sequence: CAG
gggctgagaggagtggggga

SEQ ID NO: 64291 - DNA, 20 bp, Artificial Sequence
  Description of Artificial Sequence: Synthetic oligonucleotide
  Target: ATXN1; (-) strand; PAM type: NRG; PAM sequence: GGG
ccaggggctgagaggagtgg

SEQ ID NO: 64292 - DNA, 20 bp, Artificial Sequence
  Description of Artificial Sequence: Synthetic oligonucleotide
  Target: ATXN1; (-) strand; PAM type: NRG; PAM sequence: GGG
gccaggggctgagaggagtg

SEQ ID NO: 64293 - DNA, 20 bp, Artificial Sequence
  Description of Artificial Sequence: Synthetic oligonucleotide
  Target: ATXN1; (-) strand; PAM type: NRG; PAM sequence: GGG
tgccaggggctgagaggagt

SEQ ID NO: 64294 - DNA, 20 bp, Artificial Sequence
  Description of Artificial Sequence: Synthetic oligonucleotide
  Target: ATXN1; (-) strand; PAM type: NRG; PAM sequence: TGG
ttgccaggggctgagaggag

SEQ ID NO: 64295 - DNA, 20 bp, Artificial Sequence
  Description of Artificial Sequence: Synthetic oligonucleotide
  Target: ATXN1; (-) strand; PAM type: NRG; PAM sequence: GAG
tctttgccaggggctgagag

SEQ ID NO: 64296 - DNA, 20 bp, Artificial Sequence
  Description of Artificial Sequence: Synthetic oligonucleotide
  Target: ATXN1; (-) strand; PAM type: NRG; PAM sequence: AGG
agtctttgccaggggctgag

SEQ ID NO: 64297 - DNA, 20 bp, Artificial Sequence
  Description of Artificial Sequence: Synthetic oligonucleotide
  Target: ATXN1; (-) strand; PAM type: NRG; PAM sequence: GAG
tagtctttgccaggggctga

SEQ ID NO: 64298 - DNA, 20 bp, Artificial Sequence
  Description of Artificial Sequence: Synthetic oligonucleotide
  Target: ATXN1; (-) strand; PAM type: NRG; PAM sequence: GAG
attagtctttgccaggggct

SEQ ID NO: 64299 - DNA, 20 bp, Artificial Sequence
  Description of Artificial Sequence: Synthetic oligonucleotide
  Target: ATXN1; (-) strand; PAM type: NRG; PAM sequence: GGG
agtagattagtctttgccag

SEQ ID NO: 64300 - DNA, 20 bp, Artificial Sequence
  Description of Artificial Sequence: Synthetic oligonucleotide
  Target: ATXN1; (-) strand; PAM type: NRG; PAM sequence: GGG
aagtagattagtctttgcca

SEQ ID NO: 64301 - DNA, 20 bp, Artificial Sequence
  Description of Artificial Sequence: Synthetic oligonucleotide
  Target: ATXN1; (-) strand; PAM type: NRG; PAM sequence: AGG
aaagtagattagtctttgcc

SEQ ID NO: 64302 - DNA, 20 bp, Artificial Sequence
  Description of Artificial Sequence: Synthetic oligonucleotide
  Target: ATXN1; (-) strand; PAM type: NRG; PAM sequence: CAG
gaaagtagattagtctttgc

SEQ ID NO: 64303 - DNA, 20 bp, Artificial Sequence
  Description of Artificial Sequence: Synthetic oligonucleotide
  Target: ATXN1; (-) strand; PAM type: NRG; PAM sequence: TAG
cttagagtcagaaagtagat

SEQ ID NO: 64304 - DNA, 20 bp, Artificial Sequence
  Description of Artificial Sequence: Synthetic oligonucleotide
  Target: ATXN1; (-) strand; PAM type: NRG; PAM sequence: TAG
aactccttagagtcagaaag

SEQ ID NO: 64305 - DNA, 20 bp, Artificial Sequence
  Description of Artificial Sequence: Synthetic oligonucleotide
  Target: ATXN1; (-) strand; PAM type: NRG; PAM sequence: AAG
gacaactccttagagtcaga

SEQ ID NO: 64306 - DNA, 20 bp, Artificial Sequence
  Description of Artificial Sequence: Synthetic oligonucleotide
  Target: ATXN1; (-) strand; PAM type: NRG; PAM sequence: CAG
aatagacaactccttagagt

SEQ ID NO: 64307 - DNA, 20 bp, Artificial Sequence
  Description of Artificial Sequence: Synthetic oligonucleotide
  Target: ATXN1; (-) strand; PAM type: NRG; PAM sequence: GAG
ccagaatagacaactcctta

SEQ ID NO: 64308 - DNA, 20 bp, Artificial Sequence
  Description of Artificial Sequence: Synthetic oligonucleotide
  Target: ATXN1; (-) strand; PAM type: NRG; PAM sequence: TAG
atccagaatagacaactcct

SEQ ID NO: 64309 - DNA, 20 bp, Artificial Sequence
  Description of Artificial Sequence: Synthetic oligonucleotide
  Target: ATXN1; (-) strand; PAM type: NRG; PAM sequence: TAG
tttatacacaacatccagaa

SEQ ID NO: 64310 - DNA, 20 bp, Artificial Sequence
  Description of Artificial Sequence: Synthetic oligonucleotide
  Target: ATXN1; (-) strand; PAM type: NRG; PAM sequence: CAG
ttcagtttatacacaacatc

SEQ ID NO: 64311 - DNA, 20 bp, Artificial Sequence
  Description of Artificial Sequence: Synthetic oligonucleotide
  Target: ATXN1; (-) strand; PAM type: NRG; PAM sequence: CAG
aggccacatattgtatgatt

SEQ ID NO: 64312 - DNA, 20 bp, Artificial Sequence
  Description of Artificial Sequence: Synthetic oligonucleotide
  Target: ATXN1; (-) strand; PAM type: NRG; PAM sequence: AGG
agaaagcagccagacacaaa

SEQ ID NO: 64313 - DNA, 20 bp, Artificial Sequence
  Description of Artificial Sequence: Synthetic oligonucleotide
  Target: ATXN1; (-) strand; PAM type: NRG; PAM sequence: AAG
gagaaagcagccagacacaa

SEQ ID NO: 64314 - DNA, 20 bp, Artificial Sequence
  Description of Artificial Sequence: Synthetic oligonucleotide
  Target: ATXN1; (-) strand; PAM type: NRG; PAM sequence: CAG
ttatgccaagagaaagcagc

SEQ ID NO: 64315 - DNA, 20 bp, Artificial Sequence
  Description of Artificial Sequence: Synthetic oligonucleotide
  Target: ATXN1; (-) strand; PAM type: NRG; PAM sequence: CAG
aacattatgccaagagaaag

SEQ ID NO: 64316 - DNA, 20 bp, Artificial Sequence
  Description of Artificial Sequence: Synthetic oligonucleotide
  Target: ATXN1; (-) strand; PAM type: NRG; PAM sequence: AAG
gaaaacattatgccaagaga

SEQ ID NO: 64317 - DNA, 20 bp, Artificial Sequence
  Description of Artificial Sequence: Synthetic oligonucleotide
  Target: ATXN1; (-) strand; PAM type: NRG; PAM sequence: GAG
ccttgaaaacattatgccaa

SEQ ID NO: 64318 - DNA, 20 bp, Artificial Sequence
  Description of Artificial Sequence: Synthetic oligonucleotide
  Target: ATXN1; (-) strand; PAM type: NRG; PAM sequence: AAG
agccttgaaaacattatgcc

SEQ ID NO: 64319 - DNA, 20 bp, Artificial Sequence
  Description of Artificial Sequence: Synthetic oligonucleotide
  Target: ATXN1; (-) strand; PAM type: NRG; PAM sequence: GAG
gtacatgttacaatatgaat

SEQ ID NO: 64320 - DNA, 20 bp, Artificial Sequence
  Description of Artificial Sequence: Synthetic oligonucleotide
  Target: ATXN1; (-) strand; PAM type: NRG; PAM sequence: TGG
ccaaaacaagaatgaagtac

SEQ ID NO: 64321 - DNA, 20 bp, Artificial Sequence
  Description of Artificial Sequence: Synthetic oligonucleotide
  Target: ATXN1; (-) strand; PAM type: NRG; PAM sequence: AAG
attgaaccaaaacaagaatg

SEQ ID NO: 64322 - DNA, 20 bp, Artificial Sequence
  Description of Artificial Sequence: Synthetic oligonucleotide
  Target: ATXN1; (-) strand; PAM type: NRG; PAM sequence: AAG
gagtattattgaaccaaaac

SEQ ID NO: 64323 - DNA, 20 bp, Artificial Sequence
  Description of Artificial Sequence: Synthetic oligonucleotide
  Target: ATXN1; (-) strand; PAM type: NRG; PAM sequence: GAG
atgtggtatagcctacaata

SEQ ID NO: 64324 - DNA, 20 bp, Artificial Sequence
  Description of Artificial Sequence: Synthetic oligonucleotide
  Target: ATXN1; (-) strand; PAM type: NRG; PAM sequence: TAG
aaatgtggtatagcctacaa

SEQ ID NO: 64325 - DNA, 20 bp, Artificial Sequence
  Description of Artificial Sequence: Synthetic oligonucleotide
  Target: ATXN1; (-) strand; PAM type: NRG; PAM sequence: TAG
ataaataacaaaatgtggta

SEQ ID NO: 64326 - DNA, 20 bp, Artificial Sequence
  Description of Artificial Sequence: Synthetic oligonucleotide
  Target: ATXN1; (-) strand; PAM type: NRG; PAM sequence: TGG
gacgaataaataacaaaatg

SEQ ID NO: 64327 - DNA, 20 bp, Artificial Sequence
  Description of Artificial Sequence: Synthetic oligonucleotide
  Target: ATXN1; (-) strand; PAM type: NRG; PAM sequence: TGG
gattcatagtagcccaaata

SEQ ID NO: 64328 - DNA, 20 bp, Artificial Sequence
  Description of Artificial Sequence: Synthetic oligonucleotide
  Target: ATXN1; (-) strand; PAM type: NRG; PAM sequence: TAG
catagcagcatgattcatag

SEQ ID NO: 64329 - DNA, 20 bp, Artificial Sequence
  Description of Artificial Sequence: Synthetic oligonucleotide
  Target: ATXN1; (-) strand; PAM type: NRG; PAM sequence: TAG
gttcatagcagcatgattca

SEQ ID NO: 64330 - DNA, 20 bp, Artificial Sequence
  Description of Artificial Sequence: Synthetic oligonucleotide
  Target: ATXN1; (-) strand; PAM type: NRG; PAM sequence: CAG
atgtacatgaatgttcatag

SEQ ID NO: 64331 - DNA, 20 bp, Artificial Sequence
  Description of Artificial Sequence: Synthetic oligonucleotide
  Target: ATXN1; (-) strand; PAM type: NRG; PAM sequence: TAG
aacatgtacatgaatgttca

SEQ ID NO: 64332 - DNA, 20 bp, Artificial Sequence
  Description of Artificial Sequence: Synthetic oligonucleotide
  Target: ATXN1; (-) strand; PAM type: NRG; PAM sequence: AGG
cactgaagagatttgcaaac

SEQ ID NO: 64333 - DNA, 20 bp, Artificial Sequence
  Description of Artificial Sequence: Synthetic oligonucleotide
  Target: ATXN1; (-) strand; PAM type: NRG; PAM sequence: CAG
acactgaagagatttgcaaa

SEQ ID NO: 64334 - DNA, 20 bp, Artificial Sequence
  Description of Artificial Sequence: Synthetic oligonucleotide
  Target: ATXN1; (-) strand; PAM type: NRG; PAM sequence: GAG
gctcttaggtatacactgaa

SEQ ID NO: 64335 - DNA, 20 bp, Artificial Sequence
  Description of Artificial Sequence: Synthetic oligonucleotide
  Target: ATXN1; (-) strand; PAM type: NRG; PAM sequence: AAG
ctgctcttaggtatacactg

SEQ ID NO: 64336 - DNA, 20 bp, Artificial Sequence
  Description of Artificial Sequence: Synthetic oligonucleotide
  Target: ATXN1; (-) strand; PAM type: NRG; PAM sequence: AGG
gactcagtagttctgctctt

SEQ ID NO: 64337 - DNA, 20 bp, Artificial Sequence
  Description of Artificial Sequence: Synthetic oligonucleotide
  Target: ATXN1; (-) strand; PAM type: NRG; PAM sequence: TAG
tgactcagtagttctgctct

SEQ ID NO: 64338 - DNA, 20 bp, Artificial Sequence
  Description of Artificial Sequence: Synthetic oligonucleotide
  Target: ATXN1; (-) strand; PAM type: NRG; PAM sequence: TAG
agaattaacatatgactcag

SEQ ID NO: 64339 - DNA, 20 bp, Artificial Sequence
  Description of Artificial Sequence: Synthetic oligonucleotide
  Target: ATXN1; (-) strand; PAM type: NRG; PAM sequence: CAG
tacagaattaacatatgact

SEQ ID NO: 64340 - DNA, 20 bp, Artificial Sequence
  Description of Artificial Sequence: Synthetic oligonucleotide
  Target: ATXN1; (-) strand; PAM type: NRG; PAM sequence: CAG
agtcctcaaatagctaaata

SEQ ID NO: 64341 - DNA, 20 bp, Artificial Sequence
  Description of Artificial Sequence: Synthetic oligonucleotide
  Target: ATXN1; (-) strand; PAM type: NRG; PAM sequence: TAG
caatttggcaagtcctcaaa

SEQ ID NO: 64342 - DNA, 20 bp, Artificial Sequence
  Description of Artificial Sequence: Synthetic oligonucleotide
  Target: ATXN1; (-) strand; PAM type: NRG; PAM sequence: AAG
actatagaaaacaatttggc

SEQ ID NO: 64343 - DNA, 20 bp, Artificial Sequence
  Description of Artificial Sequence: Synthetic oligonucleotide
  Target: ATXN1; (-) strand; PAM type: NRG; PAM sequence: TGG
aatcactatagaaaacaatt

SEQ ID NO: 64344 - DNA, 20 bp, Artificial Sequence
  Description of Artificial Sequence: Synthetic oligonucleotide
  Target: ATXN1; (-) strand; PAM type: NRG; PAM sequence: TAG
gtagtatggtgcaatcacta

SEQ ID NO: 64345 - DNA, 20 bp, Artificial Sequence
  Description of Artificial Sequence: Synthetic oligonucleotide
  Target: ATXN1; (-) strand; PAM type: NRG; PAM sequence: TGG
tggctggtgggaatgtagta

SEQ ID NO: 64346 - DNA, 20 bp, Artificial Sequence
  Description of Artificial Sequence: Synthetic oligonucleotide
  Target: ATXN1; (-) strand; PAM type: NRG; PAM sequence: TAG
ctacctggctggtgggaatg

SEQ ID NO: 64347 - DNA, 20 bp, Artificial Sequence
  Description of Artificial Sequence: Synthetic oligonucleotide
  Target: ATXN1; (-) strand; PAM type: NRG; PAM sequence: GGG
aatcttcctacctggctggt

SEQ ID NO: 64348 - DNA, 20 bp, Artificial Sequence
  Description of Artificial Sequence: Synthetic oligonucleotide
  Target: ATXN1; (-) strand; PAM type: NRG; PAM sequence: TGG
taatcttcctacctggctgg

SEQ ID NO: 64349 - DNA, 20 bp, Artificial Sequence
  Description of Artificial Sequence: Synthetic oligonucleotide
  Target: ATXN1; (-) strand; PAM type: NRG; PAM sequence: TGG
tggtaatcttcctacctggc

SEQ ID NO: 64350 - DNA, 20 bp, Artificial Sequence
  Description of Artificial Sequence: Synthetic oligonucleotide
  Target: ATXN1; (-) strand; PAM type: NRG; PAM sequence: TGG
aaaatggtaatcttcctacc

SEQ ID NO: 64351 - DNA, 20 bp, Artificial Sequence
  Description of Artificial Sequence: Synthetic oligonucleotide
  Target: ATXN1; (-) strand; PAM type: NRG; PAM sequence: TGG
tggcaagcttgtggaaaaaa

SEQ ID NO: 64352 - DNA, 20 bp, Artificial Sequence
  Description of Artificial Sequence: Synthetic oligonucleotide
  Target: ATXN1; (-) strand; PAM type: NRG; PAM sequence: TGG
aacaagtgttggcaagcttg

SEQ ID NO: 64353 - DNA, 20 bp, Artificial Sequence
  Description of Artificial Sequence: Synthetic oligonucleotide
  Target: ATXN1; (-) strand; PAM type: NRG; PAM sequence: AAG
ggaaaataacaagtgttggc

SEQ ID NO: 64354 - DNA, 20 bp, Artificial Sequence
  Description of Artificial Sequence: Synthetic oligonucleotide
  Target: ATXN1; (-) strand; PAM type: NRG; PAM sequence: TGG
aaaaggaaaataacaagtgt

SEQ ID NO: 64355 - DNA, 20 bp, Artificial Sequence
  Description of Artificial Sequence: Synthetic oligonucleotide
  Target: ATXN1; (-) strand; PAM type: NRG; PAM sequence: AAG
ttttaaaaaaggaaaataac

SEQ ID NO: 64356 - DNA, 20 bp, Artificial Sequence
  Description of Artificial Sequence: Synthetic oligonucleotide
  Target: ATXN1; (-) strand; PAM type: NRG; PAM sequence: AGG
ggccataatttttttaaaaa

SEQ ID NO: 64357 - DNA, 20 bp, Artificial Sequence
  Description of Artificial Sequence: Synthetic oligonucleotide
  Target: ATXN1; (-) strand; PAM type: NRG; PAM sequence: AAG
tggccataatttttttaaaa

SEQ ID NO: 64358 - DNA, 20 bp, Artificial Sequence
  Description of Artificial Sequence: Synthetic oligonucleotide
  Target: ATXN1; (-) strand; PAM type: NRG; PAM sequence: TGG
attatggtcacccattatga

SEQ ID NO: 64359 - DNA, 20 bp, Artificial Sequence
  Description of Artificial Sequence: Synthetic oligonucleotide
  Target: ATXN1; (-) strand; PAM type: NRG; PAM sequence: TGG
aatgagataccactttatta

SEQ ID NO: 64360 - DNA, 20 bp, Artificial Sequence
  Description of Artificial Sequence: Synthetic oligonucleotide
  Target: ATXN1; (-) strand; PAM type: NRG; PAM sequence: GAG
atgcaaatcaaaaccacaat

SEQ ID NO: 64361 - DNA, 20 bp, Artificial Sequence
  Description of Artificial Sequence: Synthetic oligonucleotide
  Target: ATXN1; (-) strand; PAM type: NRG; PAM sequence: GGG
ccaacatcattagtgtttag

SEQ ID NO: 64362 - DNA, 20 bp, Artificial Sequence
  Description of Artificial Sequence: Synthetic oligonucleotide
  Target: ATXN1; (-) strand; PAM type: NRG; PAM sequence: GGG
tccaacatcattagtgttta

SEQ ID NO: 64363 - DNA, 20 bp, Artificial Sequence
  Description of Artificial Sequence: Synthetic oligonucleotide
  Target: ATXN1; (-) strand; PAM type: NRG; PAM sequence: AGG
gtccaacatcattagtgttt

SEQ ID NO: 64364 - DNA, 20 bp, Artificial Sequence
  Description of Artificial Sequence: Synthetic oligonucleotide
  Target: ATXN1; (-) strand; PAM type: NRG; PAM sequence: TAG
tgtccaacatcattagtgtt

SEQ ID NO: 64365 - DNA, 20 bp, Artificial Sequence
  Description of Artificial Sequence: Synthetic oligonucleotide
  Target: ATXN1; (-) strand; PAM type: NRG; PAM sequence: TAG
gaaaagatgtccaacatcat

SEQ ID NO: 64366 - DNA, 20 bp, Artificial Sequence
  Description of Artificial Sequence: Synthetic oligonucleotide
  Target: ATXN1; (-) strand; PAM type: NRG; PAM sequence: AAG
atagccaataagcttatgaa

SEQ ID NO: 64367 - DNA, 20 bp, Artificial Sequence
  Description of Artificial Sequence: Synthetic oligonucleotide
  Target: ATXN1; (-) strand; PAM type: NRG; PAM sequence: AAG
aagatatataaatagccaat

SEQ ID NO: 64368 - DNA, 20 bp, Artificial Sequence
  Description of Artificial Sequence: Synthetic oligonucleotide
  Target: ATXN1; (-) strand; PAM type: NRG; PAM sequence: TAG
ctccaaagaagatatataaa

SEQ ID NO: 64369 - DNA, 20 bp, Artificial Sequence
  Description of Artificial Sequence: Synthetic oligonucleotide
  Target: ATXN1; (-) strand; PAM type: NRG; PAM sequence: AAG
ggatagagatttctccaaag

SEQ ID NO: 64370 - DNA, 20 bp, Artificial Sequence
  Description of Artificial Sequence: Synthetic oligonucleotide
  Target: ATXN1; (-) strand; PAM type: NRG; PAM sequence: AAG
attggatagagatttctcca

SEQ ID NO: 64371 - DNA, 20 bp, Artificial Sequence
  Description of Artificial Sequence: Synthetic oligonucleotide
  Target: ATXN1; (-) strand; PAM type: NRG; PAM sequence: GAG
atggacaaaggcattggata

SEQ ID NO: 64372 - DNA, 20 bp, Artificial Sequence
  Description of Artificial Sequence: Synthetic oligonucleotide
  Target: ATXN1; (-) strand; PAM type: NRG; PAM sequence: TAG
agatggacaaaggcattgga

SEQ ID NO: 64373 - DNA, 20 bp, Artificial Sequence
  Description of Artificial Sequence: Synthetic oligonucleotide
  Target: ATXN1; (-) strand; PAM type: NRG; PAM sequence: TGG
ttaaagatggacaaaggcat

SEQ ID NO: 64374 - DNA, 20 bp, Artificial Sequence
  Description of Artificial Sequence: Synthetic oligonucleotide
  Target: ATXN1; (-) strand; PAM type: NRG; PAM sequence: AGG
cccagtttaaagatggacaa

SEQ ID NO: 64375 - DNA, 20 bp, Artificial Sequence
  Description of Artificial Sequence: Synthetic oligonucleotide
  Target: ATXN1; (-) strand; PAM type: NRG; PAM sequence: AAG
acccagtttaaagatggaca

SEQ ID NO: 64376 - DNA, 20 bp, Artificial Sequence
  Description of Artificial Sequence: Synthetic oligonucleotide
  Target: ATXN1; (-) strand; PAM type: NRG; PAM sequence: TGG
ctaacaacccagtttaaaga

SEQ ID NO: 64377 - DNA, 20 bp, Artificial Sequence
  Description of Artificial Sequence: Synthetic oligonucleotide
  Target: ATXN1; (-) strand; PAM type: NRG; PAM sequence: AAG
aagactaacaacccagttta

SEQ ID NO: 64378 - DNA, 20 bp, Artificial Sequence
  Description of Artificial Sequence: Synthetic oligonucleotide
  Target: ATXN1; (-) strand; PAM type: NRG; PAM sequence: CAG
agagaaaaagactaacaacc

SEQ ID NO: 64379 - DNA, 20 bp, Artificial Sequence
  Description of Artificial Sequence: Synthetic oligonucleotide
  Target: ATXN1; (-) strand; PAM type: NRG; PAM sequence: AAG
tcttacaattcaaagagaaa

SEQ ID NO: 64380 - DNA, 20 bp, Artificial Sequence
  Description of Artificial Sequence: Synthetic oligonucleotide
  Target: ATXN1; (-) strand; PAM type: NRG; PAM sequence: GAG
aagaactcttacaattcaaa

SEQ ID NO: 64381 - DNA, 20 bp, Artificial Sequence
  Description of Artificial Sequence: Synthetic oligonucleotide
  Target: ATXN1; (-) strand; PAM type: NRG; PAM sequence: AAG
taaagaactcttacaattca

SEQ ID NO: 64382 - DNA, 20 bp, Artificial Sequence
  Description of Artificial Sequence: Synthetic oligonucleotide
  Target: ATXN1; (-) strand; PAM type: NRG; PAM sequence: AAG
tctagtttctggaatatata

SEQ ID NO: 64383 - DNA, 20 bp, Artificial Sequence
  Description of Artificial Sequence: Synthetic oligonucleotide
  Target: ATXN1; (-) strand; PAM type: NRG; PAM sequence: TGG
tctcataagggtctagtttc

SEQ ID NO: 64384 - DNA, 20 bp, Artificial Sequence
  Description of Artificial Sequence: Synthetic oligonucleotide
  Target: ATXN1; (-) strand; PAM type: NRG; PAM sequence: TAG
gtcagtatctcataagggtc

SEQ ID NO: 64385 - DNA, 20 bp, Artificial Sequence
  Description of Artificial Sequence: Synthetic oligonucleotide
  Target: ATXN1; (-) strand; PAM type: NRG; PAM sequence: GGG
tgcaagtcagtatctcataa

SEQ ID NO: 64386 - DNA, 20 bp, Artificial Sequence
  Description of Artificial Sequence: Synthetic oligonucleotide
  Target: ATXN1; (-) strand; PAM type: NRG; PAM sequence: AGG
ttgcaagtcagtatctcata

SEQ ID NO: 64387 - DNA, 20 bp, Artificial Sequence
  Description of Artificial Sequence: Synthetic oligonucleotide
  Target: ATXN1; (-) strand; PAM type: NRG; PAM sequence: AAG
tttgcaagtcagtatctcat

SEQ ID NO: 64388 - DNA, 20 bp, Artificial Sequence
  Description of Artificial Sequence: Synthetic oligonucleotide
  Target: ATXN1; (-) strand; PAM type: NRG; PAM sequence: CAG
gggagaaaatatttgcaagt

SEQ ID NO: 64389 - DNA, 20 bp, Artificial Sequence
  Description of Artificial Sequence: Synthetic oligonucleotide
  Target: ATXN1; (-) strand; PAM type: NRG; PAM sequence: AAG
gaatgggagaaaatatttgc

SEQ ID NO: 64390 - DNA, 20 bp, Artificial Sequence
  Description of Artificial Sequence: Synthetic oligonucleotide
  Target: ATXN1; (-) strand; PAM type: NRG; PAM sequence: GAG
aaagacagcccacagaatgg

SEQ ID NO: 64391 - DNA, 20 bp, Artificial Sequence
  Description of Artificial Sequence: Synthetic oligonucleotide
  Target: ATXN1; (-) strand; PAM type: NRG; PAM sequence: GGG
caaaagacagcccacagaat

SEQ ID NO: 64392 - DNA, 20 bp, Artificial Sequence
  Description of Artificial Sequence: Synthetic oligonucleotide
  Target: ATXN1; (-) strand; PAM type: NRG; PAM sequence: TGG
tcaaaagacagcccacagaa

SEQ ID NO: 64393 - DNA, 20 bp, Artificial Sequence
  Description of Artificial Sequence: Synthetic oligonucleotide
  Target: ATXN1; (-) strand; PAM type: NRG; PAM sequence: CAG
gaaagtcaaaagacagccca

SEQ ID NO: 64394 - DNA, 20 bp, Artificial Sequence
  Description of Artificial Sequence: Synthetic oligonucleotide
  Target: ATXN1; (-) strand; PAM type: NRG; PAM sequence: CAG
ctgtcaagaaagtcaaaaga

SEQ ID NO: 64395 - DNA, 20 bp, Artificial Sequence
  Description of Artificial Sequence: Synthetic oligonucleotide
  Target: ATXN1; (-) strand; PAM type: NRG; PAM sequence: AAG
ggcactgtcaagaaagtcaa

SEQ ID NO: 64396 - DNA, 20 bp, Artificial Sequence
  Description of Artificial Sequence: Synthetic oligonucleotide
  Target: ATXN1; (-) strand; PAM type: NRG; PAM sequence: AAG
accaaagggcactgtcaaga

SEQ ID NO: 64397 - DNA, 20 bp, Artificial Sequence
  Description of Artificial Sequence: Synthetic oligonucleotide
  Target: ATXN1; (-) strand; PAM type: NRG; PAM sequence: AAG
gtgaaccaaagggcactgtc

SEQ ID NO: 64398 - DNA, 20 bp, Artificial Sequence
  Description of Artificial Sequence: Synthetic oligonucleotide
  Target: ATXN1; (-) strand; PAM type: NRG; PAM sequence: GGG
caaagcctttgtgaaccaaa

SEQ ID NO: 64399 - DNA, 20 bp, Artificial Sequence
  Description of Artificial Sequence: Synthetic oligonucleotide
  Target: ATXN1; (-) strand; PAM type: NRG; PAM sequence: AGG
tcaaagcctttgtgaaccaa

SEQ ID NO: 64400 - DNA, 20 bp, Artificial Sequence
  Description of Artificial Sequence: Synthetic oligonucleotide
  Target: ATXN1; (-) strand; PAM type: NRG; PAM sequence: AAG
atcaaagcctttgtgaacca

SEQ ID NO: 64401 - DNA, 20 bp, Artificial Sequence
  Description of Artificial Sequence: Synthetic oligonucleotide
  Target: ATXN1; (-) strand; PAM type: NRG; PAM sequence: AAG
attggacttcatcagtatca

SEQ ID NO: 64402 - DNA, 20 bp, Artificial Sequence
  Description of Artificial Sequence: Synthetic oligonucleotide
  Target: ATXN1; (-) strand; PAM type: NRG; PAM sequence: CAG
atagatgcattggacttcat

SEQ ID NO: 64403 - DNA, 20 bp, Artificial Sequence
  Description of Artificial Sequence: Synthetic oligonucleotide
  Target: ATXN1; (-) strand; PAM type: NRG; PAM sequence: TGG
aaagaaaaaaatagatgcat

SEQ ID NO: 64404 - DNA, 20 bp, Artificial Sequence
  Description of Artificial Sequence: Synthetic oligonucleotide
  Target: ATXN1; (-) strand; PAM type: NRG; PAM sequence: TAG
caaacaacaaaagaaaaaaa

SEQ ID NO: 64405 - DNA, 20 bp, Artificial Sequence
  Description of Artificial Sequence: Synthetic oligonucleotide
  Target: ATXN1; (-) strand; PAM type: NRG; PAM sequence: AAG
accaaaagcacaaacaacaa

SEQ ID NO: 64406 - DNA, 20 bp, Artificial Sequence
  Description of Artificial Sequence: Synthetic oligonucleotide
  Target: ATXN1; (-) strand; PAM type: NRG; PAM sequence: AAG
attcttagatgtgacaccaa

SEQ ID NO: 64407 - DNA, 20 bp, Artificial Sequence
  Description of Artificial Sequence: Synthetic oligonucleotide
  Target: ATXN1; (-) strand; PAM type: NRG; PAM sequence: TAG
tggatttggcaatagattct

SEQ ID NO: 64408 - DNA, 20 bp, Artificial Sequence
  Description of Artificial Sequence: Synthetic oligonucleotide
  Target: ATXN1; (-) strand; PAM type: NRG; PAM sequence: TAG
catgaccatggatttggcaa

SEQ ID NO: 64409 - DNA, 20 bp, Artificial Sequence
  Description of Artificial Sequence: Synthetic oligonucleotide
  Target: ATXN1; (-) strand; PAM type: NRG; PAM sequence: TGG
aatcttcatgaccatggatt

SEQ ID NO: 64410 - DNA, 20 bp, Artificial Sequence
  Description of Artificial Sequence: Synthetic oligonucleotide
  Target: ATXN1; (-) strand; PAM type: NRG; PAM sequence: TGG
ggagtaaatcttcatgacca

SEQ ID NO: 64411 - DNA, 20 bp, Artificial Sequence
  Description of Artificial Sequence: Synthetic oligonucleotide
  Target: ATXN1; (-) strand; PAM type: NRG; PAM sequence: GAG
aaacttttaaatgaaaacag

SEQ ID NO: 64412 - DNA, 20 bp, Artificial Sequence
  Description of Artificial Sequence: Synthetic oligonucleotide
  Target: ATXN1; (-) strand; PAM type: NRG; PAM sequence: AGG
taaaacttttaaatgaaaac

SEQ ID NO: 64413 - DNA, 20 bp, Artificial Sequence
  Description of Artificial Sequence: Synthetic oligonucleotide
  Target: ATXN1; (-) strand; PAM type: NRG; PAM sequence: CAG
ataaaacttttaaatgaaaa

SEQ ID NO: 64414 - DNA, 20 bp, Artificial Sequence
  Description of Artificial Sequence: Synthetic oligonucleotide
  Target: ATXN1; (-) strand; PAM type: NRG; PAM sequence: AGG
tggatcaataccctaaatgt

SEQ ID NO: 64415 - DNA, 20 bp, Artificial Sequence
  Description of Artificial Sequence: Synthetic oligonucleotide
  Target: ATXN1; (-) strand; PAM type: NRG; PAM sequence: TAG
atggatcaataccctaaatg

SEQ ID NO: 64416 - DNA, 20 bp, Artificial Sequence
  Description of Artificial Sequence: Synthetic oligonucleotide
  Target: ATXN1; (-) strand; PAM type: NRG; PAM sequence: TGG
atacaaaaatgaactaaaaa

SEQ ID NO: 64417 - DNA, 20 bp, Artificial Sequence
  Description of Artificial Sequence: Synthetic oligonucleotide
  Target: ATXN1; (-) strand; PAM type: NRG; PAM sequence: AAG
gggacacatgccagagaaag

SEQ ID NO: 64418 - DNA, 20 bp, Artificial Sequence
  Description of Artificial Sequence: Synthetic oligonucleotide
  Target: ATXN1; (-) strand; PAM type: NRG; PAM sequence: AAG
cctgggacacatgccagaga

SEQ ID NO: 64419 - DNA, 20 bp, Artificial Sequence
  Description of Artificial Sequence: Synthetic oligonucleotide
  Target: ATXN1; (-) strand; PAM type: NRG; PAM sequence: GAG
gtcacctgggacacatgcca

SEQ ID NO: 64420 - DNA, 20 bp, Artificial Sequence
  Description of Artificial Sequence: Synthetic oligonucleotide
  Target: ATXN1; (-) strand; PAM type: NRG; PAM sequence: CAG
aagtcacctgggacacatgc

SEQ ID NO: 64421 - DNA, 20 bp, Artificial Sequence
  Description of Artificial Sequence: Synthetic oligonucleotide
  Target: ATXN1; (-) strand; PAM type: NRG; PAM sequence: GGG
gacaatggaaaaagtcacct

SEQ ID NO: 64422 - DNA, 20 bp, Artificial Sequence
  Description of Artificial Sequence: Synthetic oligonucleotide
  Target: ATXN1; (-) strand; PAM type: NRG; PAM sequence: TGG
agacaatggaaaaagtcacc

SEQ ID NO: 64423 - DNA, 20 bp, Artificial Sequence
  Description of Artificial Sequence: Synthetic oligonucleotide
  Target: ATXN1; (-) strand; PAM type: NRG; PAM sequence: AAG
tggtgctgagacaatggaaa

SEQ ID NO: 64424 - DNA, 20 bp, Artificial Sequence
  Description of Artificial Sequence: Synthetic oligonucleotide
  Target: ATXN1; (-) strand; PAM type: NRG; PAM sequence: TGG
aacaattggtgctgagacaa

SEQ ID NO: 64425 - DNA, 20 bp, Artificial Sequence
  Description of Artificial Sequence: Synthetic oligonucleotide
  Target: ATXN1; (-) strand; PAM type: NRG; PAM sequence: GAG
tcttttcaacaattggtgct

SEQ ID NO: 64426 - DNA, 20 bp, Artificial Sequence
  Description of Artificial Sequence: Synthetic oligonucleotide
  Target: ATXN1; (-) strand; PAM type: NRG; PAM sequence: TGG
tcttacctcttttcaacaat

SEQ ID NO: 64427 - DNA, 20 bp, Artificial Sequence
  Description of Artificial Sequence: Synthetic oligonucleotide
  Target: ATXN1; (-) strand; PAM type: NRG; PAM sequence: AAG
gttttgttttttcaagagaa

SEQ ID NO: 64428 - DNA, 20 bp, Artificial Sequence
  Description of Artificial Sequence: Synthetic oligonucleotide
  Target: ATXN1; (-) strand; PAM type: NRG; PAM sequence: GAG
ttaaagttttgttttttcaa

SEQ ID NO: 64429 - DNA, 20 bp, Artificial Sequence
  Description of Artificial Sequence: Synthetic oligonucleotide
  Target: ATXN1; (-) strand; PAM type: NRG; PAM sequence: AAG
ttttaaagttttgttttttc

SEQ ID NO: 64430 - DNA, 20 bp, Artificial Sequence
  Description of Artificial Sequence: Synthetic oligonucleotide
  Target: ATXN1; (-) strand; PAM type: NRG; PAM sequence: AAG
taaaataatgtatattttta

SEQ ID NO: 64431 - DNA, 20 bp, Artificial Sequence
  Description of Artificial Sequence: Synthetic oligonucleotide
  Target: ATXN1; (-) strand; PAM type: NRG; PAM sequence: CAG
gtcatagtgtaaccaaaagc

SEQ ID NO: 64432 - DNA, 20 bp, Artificial Sequence
  Description of Artificial Sequence: Synthetic oligonucleotide
  Target: ATXN1; (-) strand; PAM type: NRG; PAM sequence: AAG
tacagtcatagtgtaaccaa

SEQ ID NO: 64433 - DNA, 20 bp, Artificial Sequence
  Description of Artificial Sequence: Synthetic oligonucleotide
  Target: ATXN1; (-) strand; PAM type: NRG; PAM sequence: TAG
atagtggctgaatacagtca

SEQ ID NO: 64434 - DNA, 20 bp, Artificial Sequence
  Description of Artificial Sequence: Synthetic oligonucleotide
  Target: ATXN1; (-) strand; PAM type: NRG; PAM sequence: CAG
atttaaatagtggctgaata

SEQ ID NO: 64435 - DNA, 20 bp, Artificial Sequence
  Description of Artificial Sequence: Synthetic oligonucleotide
  Target: ATXN1; (-) strand; PAM type: NRG; PAM sequence: TGG
gaggaaaaacatttaaatag

SEQ ID NO: 64436 - DNA, 20 bp, Artificial Sequence
  Description of Artificial Sequence: Synthetic oligonucleotide
  Target: ATXN1; (-) strand; PAM type: NRG; PAM sequence: TAG
gatgaggaaaaacatttaaa

SEQ ID NO: 64437 - DNA, 20 bp, Artificial Sequence
  Description of Artificial Sequence: Synthetic oligonucleotide
  Target: ATXN1; (-) strand; PAM type: NRG; PAM sequence: AGG
catctttaaaatgtgggatg

SEQ ID NO: 64438 - DNA, 20 bp, Artificial Sequence
  Description of Artificial Sequence: Synthetic oligonucleotide
  Target: ATXN1; (-) strand; PAM type: NRG; PAM sequence: GAG
gcatctttaaaatgtgggat

SEQ ID NO: 64439 - DNA, 20 bp, Artificial Sequence
  Description of Artificial Sequence: Synthetic oligonucleotide
  Target: ATXN1; (-) strand; PAM type: NRG; PAM sequence: GGG
ttgctgcatctttaaaatgt

SEQ ID NO: 64440 - DNA, 20 bp, Artificial Sequence
  Description of Artificial Sequence: Synthetic oligonucleotide
  Target: ATXN1; (-) strand; PAM type: NRG; PAM sequence: TGG
cttgctgcatctttaaaatg

SEQ ID NO: 64441 - DNA, 20 bp, Artificial Sequence
  Description of Artificial Sequence: Synthetic oligonucleotide
  Target: ATXN1; (-) strand; PAM type: NRG; PAM sequence: GGG
ctcagcatcatggctctggt

SEQ ID NO: 64442 - DNA, 20 bp, Artificial Sequence
  Description of Artificial Sequence: Synthetic oligonucleotide
  Target: ATXN1; (-) strand; PAM type: NRG; PAM sequence: TGG
gctcagcatcatggctctgg

SEQ ID NO: 64443 - DNA, 20 bp, Artificial Sequence
  Description of Artificial Sequence: Synthetic oligonucleotide
  Target: ATXN1; (-) strand; PAM type: NRG; PAM sequence: TGG
aaagctcagcatcatggctc

SEQ ID NO: 64444 - DNA, 20 bp, Artificial Sequence
  Description of Artificial Sequence: Synthetic oligonucleotide
  Target: ATXN1; (-) strand; PAM type: NRG; PAM sequence: TGG
tccctgaaagctcagcatca

SEQ ID NO: 64445 - DNA, 20 bp, Artificial Sequence
  Description of Artificial Sequence: Synthetic oligonucleotide
  Target: ATXN1; (-) strand; PAM type: NRG; PAM sequence: CAG
ggttggcttccctgaaagct

SEQ ID NO: 64446 - DNA, 20 bp, Artificial Sequence
  Description of Artificial Sequence: Synthetic oligonucleotide
  Target: ATXN1; (-) strand; PAM type: NRG; PAM sequence: AAG
gaggtggttggcttccctga

SEQ ID NO: 64447 - DNA, 20 bp, Artificial Sequence
  Description of Artificial Sequence: Synthetic oligonucleotide
  Target: ATXN1; (-) strand; PAM type: NRG; PAM sequence: TGG
gcaccacctcaagaggtggt

SEQ ID NO: 64448 - DNA, 20 bp, Artificial Sequence
  Description of Artificial Sequence: Synthetic oligonucleotide
  Target: ATXN1; (-) strand; PAM type: NRG; PAM sequence: TGG
aaaagcaccacctcaagagg

SEQ ID NO: 64449 - DNA, 20 bp, Artificial Sequence
  Description of Artificial Sequence: Synthetic oligonucleotide
  Target: ATXN1; (-) strand; PAM type: NRG; PAM sequence: AGG
tgcaaaagcaccacctcaag

SEQ ID NO: 64450 - DNA, 20 bp, Artificial Sequence
  Description of Artificial Sequence: Synthetic oligonucleotide
  Target: ATXN1; (-) strand; PAM type: NRG; PAM sequence: GAG
ttgcaaaagcaccacctcaa

SEQ ID NO: 64451 - DNA, 20 bp, Artificial Sequence
  Description of Artificial Sequence: Synthetic oligonucleotide
  Target: ATXN1; (-) strand; PAM type: NRG; PAM sequence: AAG
tcttgcaaaagcaccacctc

SEQ ID NO: 64452 - DNA, 20 bp, Artificial Sequence
  Description of Artificial Sequence: Synthetic oligonucleotide
  Target: ATXN1; (-) strand; PAM type: NRG; PAM sequence: AAG
ttgaaaattagttcttgcaa

SEQ ID NO: 64453 - DNA, 20 bp, Artificial Sequence
  Description of Artificial Sequence: Synthetic oligonucleotide
  Target: ATXN1; (-) strand; PAM type: NRG; PAM sequence: TAG
ctactgttgcttttgaaaat

SEQ ID NO: 64454 - DNA, 20 bp, Artificial Sequence
  Description of Artificial Sequence: Synthetic oligonucleotide
  Target: ATXN1; (-) strand; PAM type: NRG; PAM sequence: AAG
aacccaaagtcagcaatttc

SEQ ID NO: 64455 - DNA, 20 bp, Artificial Sequence
  Description of Artificial Sequence: Synthetic oligonucleotide
  Target: ATXN1; (-) strand; PAM type: NRG; PAM sequence: CAG
aggcaaatgcaacccaaagt

SEQ ID NO: 64456 - DNA, 20 bp, Artificial Sequence
  Description of Artificial Sequence: Synthetic oligonucleotide
  Target: ATXN1; (-) strand; PAM type: NRG; PAM sequence: AAG
acagaggcaaatgcaaccca

SEQ ID NO: 64457 - DNA, 20 bp, Artificial Sequence
  Description of Artificial Sequence: Synthetic oligonucleotide
  Target: ATXN1; (-) strand; PAM type: NRG; PAM sequence: AGG
ctagaggggcacaaacacag

SEQ ID NO: 64458 - DNA, 20 bp, Artificial Sequence
  Description of Artificial Sequence: Synthetic oligonucleotide
  Target: ATXN1; (-) strand; PAM type: NRG; PAM sequence: GAG
actagaggggcacaaacaca

SEQ ID NO: 64459 - DNA, 20 bp, Artificial Sequence
  Description of Artificial Sequence: Synthetic oligonucleotide
  Target: ATXN1; (-) strand; PAM type: NRG; PAM sequence: CAG
tcactagaggggcacaaaca

SEQ ID NO: 64460 - DNA, 20 bp, Artificial Sequence
  Description of Artificial Sequence: Synthetic oligonucleotide
  Target: ATXN1; (-) strand; PAM type: NRG; PAM sequence: GGG
acaggggctgttcactagag

SEQ ID NO: 64461 - DNA, 20 bp, Artificial Sequence
  Description of Artificial Sequence: Synthetic oligonucleotide
  Target: ATXN1; (-) strand; PAM type: NRG; PAM sequence: GGG
gacaggggctgttcactaga

SEQ ID NO: 64462 - DNA, 20 bp, Artificial Sequence
  Description of Artificial Sequence: Synthetic oligonucleotide
  Target: ATXN1; (-) strand; PAM type: NRG; PAM sequence: AGG
agacaggggctgttcactag

SEQ ID NO: 64463 - DNA, 20 bp, Artificial Sequence
  Description of Artificial Sequence: Synthetic oligonucleotide
  Target: ATXN1; (-) strand; PAM type: NRG; PAM sequence: GAG
aagacaggggctgttcacta

SEQ ID NO: 64464 - DNA, 20 bp, Artificial Sequence
  Description of Artificial Sequence: Synthetic oligonucleotide
  Target: ATXN1; (-) strand; PAM type: NRG; PAM sequence: TAG
tgaagacaggggctgttcac

SEQ ID NO: 64465 - DNA, 20 bp, Artificial Sequence
  Description of Artificial Sequence: Synthetic oligonucleotide
  Target: ATXN1; (-) strand; PAM type: NRG; PAM sequence: GGG
ctgtggatatctgaagacag

SEQ ID NO: 64466 - DNA, 20 bp, Artificial Sequence
  Description of Artificial Sequence: Synthetic oligonucleotide
  Target: ATXN1; (-) strand; PAM type: NRG; PAM sequence: GGG
tctgtggatatctgaagaca

SEQ ID NO: 64467 - DNA, 20 bp, Artificial Sequence
  Description of Artificial Sequence: Synthetic oligonucleotide
  Target: ATXN1; (-) strand; PAM type: NRG; PAM sequence: AGG
gtctgtggatatctgaagac

SEQ ID NO: 64468 - DNA, 20 bp, Artificial Sequence
  Description of Artificial Sequence: Synthetic oligonucleotide
  Target: ATXN1; (-) strand; PAM type: NRG; PAM sequence: CAG
ggtctgtggatatctgaaga

SEQ ID NO: 64469 - DNA, 20 bp, Artificial Sequence
  Description of Artificial Sequence: Synthetic oligonucleotide
  Target: ATXN1; (-) strand; PAM type: NRG; PAM sequence: AAG
cagaggtctgtggatatctg

SEQ ID NO: 64470 - DNA, 20 bp, Artificial Sequence
  Description of Artificial Sequence: Synthetic oligonucleotide
  Target: ATXN1; (-) strand; PAM type: NRG; PAM sequence: TGG
ggaaagagaacagaggtctg

SEQ ID NO: 64471 - DNA, 20 bp, Artificial Sequence
  Description of Artificial Sequence: Synthetic oligonucleotide
  Target: ATXN1; (-) strand; PAM type: NRG; PAM sequence: AGG
cgggcttggaaagagaacag

SEQ ID NO: 64472 - DNA, 20 bp, Artificial Sequence
  Description of Artificial Sequence: Synthetic oligonucleotide
  Target: ATXN1; (-) strand; PAM type: NRG; PAM sequence: GAG
tcgggcttggaaagagaaca

SEQ ID NO: 64473 - DNA, 20 bp, Artificial Sequence
  Description of Artificial Sequence: Synthetic oligonucleotide
  Target: ATXN1; (-) strand; PAM type: NRG; PAM sequence: CAG
tgtcgggcttggaaagagaa

SEQ ID NO: 64474 - DNA, 20 bp, Artificial Sequence
  Description of Artificial Sequence: Synthetic oligonucleotide
  Target: ATXN1; (-) strand; PAM type: NRG; PAM sequence: GAG
gtgggtgtcgggcttggaaa

SEQ ID NO: 64475 - DNA, 20 bp, Artificial Sequence
  Description of Artificial Sequence: Synthetic oligonucleotide
  Target: ATXN1; (-) strand; PAM type: NRG; PAM sequence: AAG
gggtgggtgtcgggcttgga

SEQ ID NO: 64476 - DNA, 20 bp, Artificial Sequence
  Description of Artificial Sequence: Synthetic oligonucleotide
  Target: ATXN1; (-) strand; PAM type: NRG; PAM sequence: TGG
taatgggtgggtgtcgggct

SEQ ID NO: 64477 - DNA, 20 bp, Artificial Sequence
  Description of Artificial Sequence: Synthetic oligonucleotide
  Target: ATXN1; (-) strand; PAM type: NRG; PAM sequence: GGG
aatcttaatgggtgggtgtc

SEQ ID NO: 64478 - DNA, 20 bp, Artificial Sequence
  Description of Artificial Sequence: Synthetic oligonucleotide
  Target: ATXN1; (-) strand; PAM type: NRG; PAM sequence: CGG
caatcttaatgggtgggtgt

SEQ ID NO: 64479 - DNA, 20 bp, Artificial Sequence
  Description of Artificial Sequence: Synthetic oligonucleotide
  Target: ATXN1; (-) strand; PAM type: NRG; PAM sequence: GGG
aagagccaatcttaatgggt

SEQ ID NO: 64480 - DNA, 20 bp, Artificial Sequence
  Description of Artificial Sequence: Synthetic oligonucleotide
  Target: ATXN1; (-) strand; PAM type: NRG; PAM sequence: TGG
aaagagccaatcttaatggg

SEQ ID NO: 64481 - DNA, 20 bp, Artificial Sequence
  Description of Artificial Sequence: Synthetic oligonucleotide
  Target: ATXN1; (-) strand; PAM type: NRG; PAM sequence: GGG
tccaaagagccaatcttaat

SEQ ID NO: 64482 - DNA, 20 bp, Artificial Sequence
  Description of Artificial Sequence: Synthetic oligonucleotide
  Target: ATXN1; (-) strand; PAM type: NRG; PAM sequence: TGG
ctccaaagagccaatcttaa

SEQ ID NO: 64483 - DNA, 20 bp, Artificial Sequence
  Description of Artificial Sequence: Synthetic oligonucleotide
  Target: ATXN1; (-) strand; PAM type: NRG; PAM sequence: GAG
tttattaagttttctccaaa

SEQ ID NO: 64484 - DNA, 20 bp, Artificial Sequence
  Description of Artificial Sequence: Synthetic oligonucleotide
  Target: ATXN1; (-) strand; PAM type: NRG; PAM sequence: AAG
agtttattaagttttctcca

SEQ ID NO: 64485 - DNA, 20 bp, Artificial Sequence
  Description of Artificial Sequence: Synthetic oligonucleotide
  Target: ATXN1; (-) strand; PAM type: NRG; PAM sequence: AAG
ttggcatgaattagtttatt

SEQ ID NO: 64486 - DNA, 20 bp, Artificial Sequence
  Description of Artificial Sequence: Synthetic oligonucleotide
  Target: ATXN1; (-) strand; PAM type: NRG; PAM sequence: TAG
atacacgatttggcatgaat

SEQ ID NO: 64487 - DNA, 20 bp, Artificial Sequence
  Description of Artificial Sequence: Synthetic oligonucleotide
  Target: ATXN1; (-) strand; PAM type: NRG; PAM sequence: TGG
tctcttggttatacacgatt

SEQ ID NO: 64488 - DNA, 20 bp, Artificial Sequence
  Description of Artificial Sequence: Synthetic oligonucleotide
  Target: ATXN1; (-) strand; PAM type: NRG; PAM sequence: TGG
caaaagtctattatttctct

SEQ ID NO: 64489 - DNA, 20 bp, Artificial Sequence
  Description of Artificial Sequence: Synthetic oligonucleotide
  Target: ATXN1; (-) strand; PAM type: NRG; PAM sequence: AAG
agtcttaggtatcatgccaa

SEQ ID NO: 64490 - DNA, 20 bp, Artificial Sequence
  Description of Artificial Sequence: Synthetic oligonucleotide
  Target: ATXN1; (-) strand; PAM type: NRG; PAM sequence: AGG
cttaagataaacagagtctt

SEQ ID NO: 64491 - DNA, 20 bp, Artificial Sequence
  Description of Artificial Sequence: Synthetic oligonucleotide
  Target: ATXN1; (-) strand; PAM type: NRG; PAM sequence: TAG
gcttaagataaacagagtct

SEQ ID NO: 64492 - DNA, 20 bp, Artificial Sequence
  Description of Artificial Sequence: Synthetic oligonucleotide
  Target: ATXN1; (-) strand; PAM type: NRG; PAM sequence: GAG
ctttttgcttaagataaaca

SEQ ID NO: 64493 - DNA, 20 bp, Artificial Sequence
  Description of Artificial Sequence: Synthetic oligonucleotide
  Target: ATXN1; (-) strand; PAM type: NRG; PAM sequence: CAG
ttctttttgcttaagataaa

SEQ ID NO: 64494 - DNA, 20 bp, Artificial Sequence
  Description of Artificial Sequence: Synthetic oligonucleotide
  Target: ATXN1; (-) strand; PAM type: NRG; PAM sequence: AAG
acactgtattctttttgctt

SEQ ID NO: 64495 - DNA, 20 bp, Artificial Sequence
  Description of Artificial Sequence: Synthetic oligonucleotide
  Target: ATXN1; (-) strand; PAM type: NRG; PAM sequence: CAG
ttggctgaattgatgatagc

SEQ ID NO: 64496 - DNA, 20 bp, Artificial Sequence
  Description of Artificial Sequence: Synthetic oligonucleotide
  Target: ATXN1; (-) strand; PAM type: NRG; PAM sequence: TAG
tgcattggctgaattgatga

SEQ ID NO: 64497 - DNA, 20 bp, Artificial Sequence
  Description of Artificial Sequence: Synthetic oligonucleotide
  Target: ATXN1; (-) strand; PAM type: NRG; PAM sequence: TGG
aaagtcttcactccttgcat

SEQ ID NO: 64498 - DNA, 20 bp, Artificial Sequence
  Description of Artificial Sequence: Synthetic oligonucleotide
  Target: ATXN1; (-) strand; PAM type: NRG; PAM sequence: AAG
gatgctttagggggatttaa

SEQ ID NO: 64499 - DNA, 20 bp, Artificial Sequence
  Description of Artificial Sequence: Synthetic oligonucleotide
  Target: ATXN1; (-) strand; PAM type: NRG; PAM sequence: GGG
tggagaactgatgctttagg

SEQ ID NO: 64500 - DNA, 20 bp, Artificial Sequence
  Description of Artificial Sequence: Synthetic oligonucleotide
  Target: ATXN1; (-) strand; PAM type: NRG; PAM sequence: GGG
ttggagaactgatgctttag

SEQ ID NO: 64501 - DNA, 20 bp, Artificial Sequence
  Description of Artificial Sequence: Synthetic oligonucleotide
  Target: ATXN1; (-) strand; PAM type: NRG; PAM sequence: GGG
gttggagaactgatgcttta

SEQ ID NO: 64502 - DNA, 20 bp, Artificial Sequence
  Description of Artificial Sequence: Synthetic oligonucleotide
  Target: ATXN1; (-) strand; PAM type: NRG; PAM sequence: AGG
agttggagaactgatgcttt

SEQ ID NO: 64503 - DNA, 20 bp, Artificial Sequence
  Description of Artificial Sequence: Synthetic oligonucleotide
  Target: ATXN1; (-) strand; PAM type: NRG; PAM sequence: TAG
aagttggagaactgatgctt

SEQ ID NO: 64504 - DNA, 20 bp, Artificial Sequence
  Description of Artificial Sequence: Synthetic oligonucleotide
  Target: ATXN1; (-) strand; PAM type: NRG; PAM sequence: GAG
cacaatgtgtagccaagttg

SEQ ID NO: 64505 - DNA, 20 bp, Artificial Sequence
  Description of Artificial Sequence: Synthetic oligonucleotide
  Target: ATXN1; (-) strand; PAM type: NRG; PAM sequence: TGG
gtcacaatgtgtagccaagt

SEQ ID NO: 64506 - DNA, 20 bp, Artificial Sequence
  Description of Artificial Sequence: Synthetic oligonucleotide
  Target: ATXN1; (-) strand; PAM type: NRG; PAM sequence: AAG
ggtggtcacaatgtgtagcc

SEQ ID NO: 64507 - DNA, 20 bp, Artificial Sequence
  Description of Artificial Sequence: Synthetic oligonucleotide
  Target: ATXN1; (-) strand; PAM type: NRG; PAM sequence: TAG
ctctgggtggtcacaatgtg

SEQ ID NO: 64508 - DNA, 20 bp, Artificial Sequence
  Description of Artificial Sequence: Synthetic oligonucleotide
  Target: ATXN1; (-) strand; PAM type: NRG; PAM sequence: TGG
actttctaaatctctctggg

SEQ ID NO: 64509 - DNA, 20 bp, Artificial Sequence
  Description of Artificial Sequence: Synthetic oligonucleotide
  Target: ATXN1; (-) strand; PAM type: NRG; PAM sequence: GGG
agtactttctaaatctctct

SEQ ID NO: 64510 - DNA, 20 bp, Artificial Sequence
  Description of Artificial Sequence: Synthetic oligonucleotide
  Target: ATXN1; (-) strand; PAM type: NRG; PAM sequence: TGG
tagtactttctaaatctctc

SEQ ID NO: 64511 - DNA, 20 bp, Artificial Sequence
  Description of Artificial Sequence: Synthetic oligonucleotide
  Target: ATXN1; (-) strand; PAM type: NRG; PAM sequence: TAG
tgtgggtggaacccagacat

SEQ ID NO: 64512 - DNA, 20 bp, Artificial Sequence
  Description of Artificial Sequence: Synthetic oligonucleotide
  Target: ATXN1; (-) strand; PAM type: NRG; PAM sequence: CAG
ggatctctgtgggtggaacc

SEQ ID NO: 64513 - DNA, 20 bp, Artificial Sequence
  Description of Artificial Sequence: Synthetic oligonucleotide
  Target: ATXN1; (-) strand; PAM type: NRG; PAM sequence: TGG
taagtaaggatctctgtggg

SEQ ID NO: 64514 - DNA, 20 bp, Artificial Sequence
  Description of Artificial Sequence: Synthetic oligonucleotide
  Target: ATXN1; (-) strand; PAM type: NRG; PAM sequence: GGG
agttaagtaaggatctctgt

SEQ ID NO: 64515 - DNA, 20 bp, Artificial Sequence
  Description of Artificial Sequence: Synthetic oligonucleotide
  Target: ATXN1; (-) strand; PAM type: NRG; PAM sequence: TGG
cagttaagtaaggatctctg

SEQ ID NO: 64516 - DNA, 20 bp, Artificial Sequence
  Description of Artificial Sequence: Synthetic oligonucleotide
  Target: ATXN1; (-) strand; PAM type: NRG; PAM sequence: AGG
taccccagaccagttaagta

SEQ ID NO: 64517 - DNA, 20 bp, Artificial Sequence
  Description of Artificial Sequence: Synthetic oligonucleotide
  Target: ATXN1; (-) strand; PAM type: NRG; PAM sequence: AAG
ataccccagaccagttaagt

SEQ ID NO: 64518 - DNA, 20 bp, Artificial Sequence
  Description of Artificial Sequence: Synthetic oligonucleotide
  Target: ATXN1; (-) strand; PAM type: NRG; PAM sequence: AAG
agccataccccagaccagtt

SEQ ID NO: 64519 - DNA, 20 bp, Artificial Sequence
  Description of Artificial Sequence: Synthetic oligonucleotide
  Target: ATXN1; (-) strand; PAM type: NRG; PAM sequence: CAG
gcctgagccataccccagac

SEQ ID NO: 64520 - DNA, 20 bp, Artificial Sequence
  Description of Artificial Sequence: Synthetic oligonucleotide
  Target: ATXN1; (-) strand; PAM type: NRG; PAM sequence: CAG
ctattgcctgagccataccc

SEQ ID NO: 64521 - DNA, 20 bp, Artificial Sequence
  Description of Artificial Sequence: Synthetic oligonucleotide
  Target: ATXN1; (-) strand; PAM type: NRG; PAM sequence: GAG
tttccaaaattctattgcct

SEQ ID NO: 64522 - DNA, 20 bp, Artificial Sequence
  Description of Artificial Sequence: Synthetic oligonucleotide
  Target: ATXN1; (-) strand; PAM type: NRG; PAM sequence: GAG
gcatagtagaatcacttggg

SEQ ID NO: 64523 - DNA, 20 bp, Artificial Sequence
  Description of Artificial Sequence: Synthetic oligonucleotide
  Target: ATXN1; (-) strand; PAM type: NRG; PAM sequence: GGG
ctgcatagtagaatcacttg

SEQ ID NO: 64524 - DNA, 20 bp, Artificial Sequence
  Description of Artificial Sequence: Synthetic oligonucleotide
  Target: ATXN1; (-) strand; PAM type: NRG; PAM sequence: GGG
gctgcatagtagaatcactt

SEQ ID NO: 64525 - DNA, 20 bp, Artificial Sequence
  Description of Artificial Sequence: Synthetic oligonucleotide
  Target: ATXN1; (-) strand; PAM type: NRG; PAM sequence: TGG
ggctgcatagtagaatcact

SEQ ID NO: 64526 - DNA, 20 bp, Artificial Sequence
  Description of Artificial Sequence: Synthetic oligonucleotide
  Target: ATXN1; (-) strand; PAM type: NRG; PAM sequence: TAG
tctccaccttggctgcatag

SEQ ID NO: 64527 - DNA, 20 bp, Artificial Sequence
  Description of Artificial Sequence: Synthetic oligonucleotide
  Target: ATXN1; (-) strand; PAM type: NRG; PAM sequence: TAG
gactctccaccttggctgca

SEQ ID NO: 64528 - DNA, 20 bp, Artificial Sequence
  Description of Artificial Sequence: Synthetic oligonucleotide
  Target: ATXN1; (-) strand; PAM type: NRG; PAM sequence: TGG
aggacagtgactctccacct

SEQ ID NO: 64529 - DNA, 20 bp, Artificial Sequence
  Description of Artificial Sequence: Synthetic oligonucleotide
  Target: ATXN1; (-) strand; PAM type: NRG; PAM sequence: CAG
aacctctgatgacttcagga

SEQ ID NO: 64530 - DNA, 20 bp, Artificial Sequence
  Description of Artificial Sequence: Synthetic oligonucleotide
  Target: ATXN1; (-) strand; PAM type: NRG; PAM sequence: AGG
tggcaacctctgatgacttc

SEQ ID NO: 64531 - DNA, 20 bp, Artificial Sequence
  Description of Artificial Sequence: Synthetic oligonucleotide
  Target: ATXN1; (-) strand; PAM type: NRG; PAM sequence: CAG
gtggcaacctctgatgactt

SEQ ID NO: 64532 - DNA, 20 bp, Artificial Sequence
  Description of Artificial Sequence: Synthetic oligonucleotide
  Target: ATXN1; (-) strand; PAM type: NRG; PAM sequence: TGG
acctttgtgggaggagtagg

SEQ ID NO: 64533 - DNA, 20 bp, Artificial Sequence
  Description of Artificial Sequence: Synthetic oligonucleotide
  Target: ATXN1; (-) strand; PAM type: NRG; PAM sequence: AGG
gccacctttgtgggaggagt

SEQ ID NO: 64534 - DNA, 20 bp, Artificial Sequence
  Description of Artificial Sequence: Synthetic oligonucleotide
  Target: ATXN1; (-) strand; PAM type: NRG; PAM sequence: TAG
agccacctttgtgggaggag

SEQ ID NO: 64535 - DNA, 20 bp, Artificial Sequence
  Description of Artificial Sequence: Synthetic oligonucleotide
  Target: ATXN1; (-) strand; PAM type: NRG; PAM sequence: GAG
aggagccacctttgtgggag

SEQ ID NO: 64536 - DNA, 20 bp, Artificial Sequence
  Description of Artificial Sequence: Synthetic oligonucleotide
  Target: ATXN1; (-) strand; PAM type: NRG; PAM sequence: AGG
agaggagccacctttgtggg

SEQ ID NO: 64537 - DNA, 20 bp, Artificial Sequence
  Description of Artificial Sequence: Synthetic oligonucleotide
  Target: ATXN1; (-) strand; PAM type: NRG; PAM sequence: GAG
aagaggagccacctttgtgg

SEQ ID NO: 64538 - DNA, 20 bp, Artificial Sequence
  Description of Artificial Sequence: Synthetic oligonucleotide
  Target: ATXN1; (-) strand; PAM type: NRG; PAM sequence: GGG
acaagaggagccacctttgt

SEQ ID NO: 64539 - DNA, 20 bp, Artificial Sequence
  Description of Artificial Sequence: Synthetic oligonucleotide
  Target: ATXN1; (-) strand; PAM type: NRG; PAM sequence: TGG
gacaagaggagccacctttg

SEQ ID NO: 64540 - DNA, 20 bp, Artificial Sequence
  Description of Artificial Sequence: Synthetic oligonucleotide
  Target: ATXN1; (-) strand; PAM type: NRG; PAM sequence: GAG
gtggtgcaaggtgacaagag

SEQ ID NO: 64541 - DNA, 20 bp, Artificial Sequence
  Description of Artificial Sequence: Synthetic oligonucleotide
  Target: ATXN1; (-) strand; PAM type: NRG; PAM sequence: AGG
aagtggtgcaaggtgacaag

SEQ ID NO: 64542 - DNA, 20 bp, Artificial Sequence
  Description of Artificial Sequence: Synthetic oligonucleotide
  Target: ATXN1; (-) strand; PAM type: NRG; PAM sequence: GAG
caagtggtgcaaggtgacaa

SEQ ID NO: 64543 - DNA, 20 bp, Artificial Sequence
  Description of Artificial Sequence: Synthetic oligonucleotide
  Target: ATXN1; (-) strand; PAM type: NRG; PAM sequence: AAG
tgcaagtggtgcaaggtgac

SEQ ID NO: 64544 - DNA, 20 bp, Artificial Sequence
  Description of Artificial Sequence: Synthetic oligonucleotide
  Target: ATXN1; (-) strand; PAM type: NRG; PAM sequence: AGG
aattgcttgcaagtggtgca

SEQ ID NO: 64545 - DNA, 20 bp, Artificial Sequence
  Description of Artificial Sequence: Synthetic oligonucleotide
  Target: ATXN1; (-) strand; PAM type: NRG; PAM sequence: AAG
taattgcttgcaagtggtgc

SEQ ID NO: 64546 - DNA, 20 bp, Artificial Sequence
  Description of Artificial Sequence: Synthetic oligonucleotide
  Target: ATXN1; (-) strand; PAM type: NRG; PAM sequence: TGG
catccctaattgcttgcaag

SEQ ID NO: 64547 - DNA, 20 bp, Artificial Sequence
  Description of Artificial Sequence: Synthetic oligonucleotide
  Target: ATXN1; (-) strand; PAM type: NRG; PAM sequence: AAG
gtacatccctaattgcttgc

SEQ ID NO: 64548 - DNA, 20 bp, Artificial Sequence
  Description of Artificial Sequence: Synthetic oligonucleotide
  Target: ATXN1; (-) strand; PAM type: NRG; PAM sequence: AAG
tagttttaatcggacatcat

SEQ ID NO: 64549 - DNA, 20 bp, Artificial Sequence
  Description of Artificial Sequence: Synthetic oligonucleotide
  Target: ATXN1; (-) strand; PAM type: NRG; PAM sequence: CGG
caagttttgttagttttaat

SEQ ID NO: 64550 - DNA, 20 bp, Artificial Sequence
  Description of Artificial Sequence: Synthetic oligonucleotide
  Target: ATXN1; (-) strand; PAM type: NRG; PAM sequence: TAG
acaagaaattcaagttttgt

SEQ ID NO: 64551 - DNA, 20 bp, Artificial Sequence
  Description of Artificial Sequence: Synthetic oligonucleotide
  Target: ATXN1; (-) strand; PAM type: NRG; PAM sequence: AAG
ataactgatacaagaaattc

SEQ ID NO: 64552 - DNA, 20 bp, Artificial Sequence
  Description of Artificial Sequence: Synthetic oligonucleotide
  Target: ATXN1; (-) strand; PAM type: NRG; PAM sequence: AAG
gagtgaatgataactgatac

SEQ ID NO: 64553 - DNA, 20 bp, Artificial Sequence
  Description of Artificial Sequence: Synthetic oligonucleotide
  Target: ATXN1; (-) strand; PAM type: NRG; PAM sequence: GAG
tttcacacggttgttgagaa

SEQ ID NO: 64554 - DNA, 20 bp, Artificial Sequence
  Description of Artificial Sequence: Synthetic oligonucleotide
  Target: ATXN1; (-) strand; PAM type: NRG; PAM sequence: AAG
actttcacacggttgttgag

SEQ ID NO: 64555 - DNA, 20 bp, Artificial Sequence
  Description of Artificial Sequence: Synthetic oligonucleotide
  Target: ATXN1; (-) strand; PAM type: NRG; PAM sequence: GAG
cttactttcacacggttgtt

SEQ ID NO: 64556 - DNA, 20 bp, Artificial Sequence
  Description of Artificial Sequence: Synthetic oligonucleotide
  Target: ATXN1; (-) strand; PAM type: NRG; PAM sequence: CGG
acaataaacttactttcaca

SEQ ID NO: 64557 - DNA, 20 bp, Artificial Sequence
  Description of Artificial Sequence: Synthetic oligonucleotide
  Target: ATXN1; (-) strand; PAM type: NRG; PAM sequence: GGG
tgtttcctcgtgtgtcatat

SEQ ID NO: 64558 - DNA, 20 bp, Artificial Sequence
  Description of Artificial Sequence: Synthetic oligonucleotide
  Target: ATXN1; (-) strand; PAM type: NRG; PAM sequence: TGG
ttgtttcctcgtgtgtcata

SEQ ID NO: 64559 - DNA, 20 bp, Artificial Sequence
  Description of Artificial Sequence: Synthetic oligonucleotide
  Target: ATXN1; (-) strand; PAM type: NRG; PAM sequence: GAG
gtcgcttaattaatctctca

SEQ ID NO: 64560 - DNA, 20 bp, Artificial Sequence
  Description of Artificial Sequence: Synthetic oligonucleotide
  Target: ATXN1; (-) strand; PAM type: NRG; PAM sequence: CAG
ctgtcgcttaattaatctct

SEQ ID NO: 64561 - DNA, 20 bp, Artificial Sequence
  Description of Artificial Sequence: Synthetic oligonucleotide
  Target: ATXN1; (-) strand; PAM type: NRG; PAM sequence: GGG
cttccaagttctgtgatcta

SEQ ID NO: 64562 - DNA, 20 bp, Artificial Sequence
  Description of Artificial Sequence: Synthetic oligonucleotide
  Target: ATXN1; (-) strand; PAM type: NRG; PAM sequence: AGG
acttccaagttctgtgatct

SEQ ID NO: 64563 - DNA, 20 bp, Artificial Sequence
  Description of Artificial Sequence: Synthetic oligonucleotide
  Target: ATXN1; (-) strand; PAM type: NRG; PAM sequence: TAG
cacttccaagttctgtgatc

SEQ ID NO: 64564 - DNA, 20 bp, Artificial Sequence
  Description of Artificial Sequence: Synthetic oligonucleotide
  Target: ATXN1; (-) strand; PAM type: NRG; PAM sequence: AAG
atcaattttctgccacttcc

SEQ ID NO: 64565 - DNA, 20 bp, Artificial Sequence
  Description of Artificial Sequence: Synthetic oligonucleotide
  Target: ATXN1; (-) strand; PAM type: NRG; PAM sequence: GGG
ttataatgatacagactgtg

SEQ ID NO: 64566 - DNA, 20 bp, Artificial Sequence
  Description of Artificial Sequence: Synthetic oligonucleotide
  Target: ATXN1; (-) strand; PAM type: NRG; PAM sequence: GGG
attataatgatacagactgt

SEQ ID NO: 64567 - DNA, 20 bp, Artificial Sequence
  Description of Artificial Sequence: Synthetic oligonucleotide
  Target: ATXN1; (-) strand; PAM type: NRG; PAM sequence: TGG
gattataatgatacagactg

SEQ ID NO: 64568 - DNA, 20 bp, Artificial Sequence
  Description of Artificial Sequence: Synthetic oligonucleotide
  Target: ATXN1; (-) strand; PAM type: NRG; PAM sequence: CAG
actgggagattataatgata

SEQ ID NO: 64569 - DNA, 20 bp, Artificial Sequence
  Description of Artificial Sequence: Synthetic oligonucleotide
  Target: ATXN1; (-) strand; PAM type: NRG; PAM sequence: GAG
ggcccttttgaaattactgg

SEQ ID NO: 64570 - DNA, 20 bp, Artificial Sequence
  Description of Artificial Sequence: Synthetic oligonucleotide
  Target: ATXN1; (-) strand; PAM type: NRG; PAM sequence: GGG
ttggcccttttgaaattact

SEQ ID NO: 64571 - DNA, 20 bp, Artificial Sequence
  Description of Artificial Sequence: Synthetic oligonucleotide
  Target: ATXN1; (-) strand; PAM type: NRG; PAM sequence: TGG
gttggcccttttgaaattac

SEQ ID NO: 64572 - DNA, 20 bp, Artificial Sequence
  Description of Artificial Sequence: Synthetic oligonucleotide
  Target: ATXN1; (-) strand; PAM type: NRG; PAM sequence: TGG
atgcccacactcacagtggt

SEQ ID NO: 64573 - DNA, 20 bp, Artificial Sequence
  Description of Artificial Sequence: Synthetic oligonucleotide
  Target: ATXN1; (-) strand; PAM type: NRG; PAM sequence: TGG
ttacatgcccacactcacag

SEQ ID NO: 64574 - DNA, 20 bp, Artificial Sequence
  Description of Artificial Sequence: Synthetic oligonucleotide
  Target: ATXN1; (-) strand; PAM type: NRG; PAM sequence: CAG
aaattacatgcccacactca

SEQ ID NO: 64575 - DNA, 20 bp, Artificial Sequence
  Description of Artificial Sequence: Synthetic oligonucleotide
  Target: ATXN1; (-) strand; PAM type: NRG; PAM sequence: AAG
acaagatgggtgccacattg

SEQ ID NO: 64576 - DNA, 20 bp, Artificial Sequence
  Description of Artificial Sequence: Synthetic oligonucleotide
  Target: ATXN1; (-) strand; PAM type: NRG; PAM sequence: GGG
ctcgtcccattccacaagat

SEQ ID NO: 64577 - DNA, 20 bp, Artificial Sequence
  Description of Artificial Sequence: Synthetic oligonucleotide
  Target: ATXN1; (-) strand; PAM type: NRG; PAM sequence: TGG
cctcgtcccattccacaaga

SEQ ID NO: 64578 - DNA, 20 bp, Artificial Sequence
  Description of Artificial Sequence: Synthetic oligonucleotide
  Target: ATXN1; (-) strand; PAM type: NRG; PAM sequence: AAG
atcccctcgtcccattccac

SEQ ID NO: 64579 - DNA, 20 bp, Artificial Sequence
  Description of Artificial Sequence: Synthetic oligonucleotide
  Target: ATXN1; (-) strand; PAM type: NRG; PAM sequence: GAG
tgcctgctattctcttcagc

SEQ ID NO: 64580 - DNA, 20 bp, Artificial Sequence
  Description of Artificial Sequence: Synthetic oligonucleotide
  Target: ATXN1; (-) strand; PAM type: NRG; PAM sequence: CAG
gtagtgcctgctattctctt

SEQ ID NO: 64581 - DNA, 20 bp, Artificial Sequence
  Description of Artificial Sequence: Synthetic oligonucleotide
  Target: ATXN1; (-) strand; PAM type: NRG; PAM sequence: TAG
taaatagtaaccgacagagg

SEQ ID NO: 64582 - DNA, 20 bp, Artificial Sequence
  Description of Artificial Sequence: Synthetic oligonucleotide
  Target: ATXN1; (-) strand; PAM type: NRG; PAM sequence: AGG
aggtaaatagtaaccgacag

SEQ ID NO: 64583 - DNA, 20 bp, Artificial Sequence
  Description of Artificial Sequence: Synthetic oligonucleotide
  Target: ATXN1; (-) strand; PAM type: NRG; PAM sequence: GAG
aaggtaaatagtaaccgaca

SEQ ID NO: 64584 - DNA, 20 bp, Artificial Sequence
  Description of Artificial Sequence: Synthetic oligonucleotide
  Target: ATXN1; (-) strand; PAM type: NRG; PAM sequence: CAG
gaaaggtaaatagtaaccga

SEQ ID NO: 64585 - DNA, 20 bp, Artificial Sequence
  Description of Artificial Sequence: Synthetic oligonucleotide
  Target: ATXN1; (-) strand; PAM type: NRG; PAM sequence: TAG
tatagagaaagaaaggtaaa

SEQ ID NO: 64586 - DNA, 20 bp, Artificial Sequence
  Description of Artificial Sequence: Synthetic oligonucleotide
  Target: ATXN1; (-) strand; PAM type: NRG; PAM sequence: AGG
catacaatatagagaaagaa

SEQ ID NO: 64587 - DNA, 20 bp, Artificial Sequence
  Description of Artificial Sequence: Synthetic oligonucleotide
  Target: ATXN1; (-) strand; PAM type: NRG; PAM sequence: AAG
gcatacaatatagagaaaga

SEQ ID NO: 64588 - DNA, 20 bp, Artificial Sequence
  Description of Artificial Sequence: Synthetic oligonucleotide
  Target: ATXN1; (-) strand; PAM type: NRG; PAM sequence: AAG
acatgcatacaatatagaga

SEQ ID NO: 64589 - DNA, 20 bp, Artificial Sequence
  Description of Artificial Sequence: Synthetic oligonucleotide
  Target: ATXN1; (-) strand; PAM type: NRG; PAM sequence: GAG
acccacatgcatacaatata

SEQ ID NO: 64590 - DNA, 20 bp, Artificial Sequence
  Description of Artificial Sequence: Synthetic oligonucleotide
  Target: ATXN1; (-) strand; PAM type: NRG; PAM sequence: TAG
acacccacatgcatacaata

SEQ ID NO: 64591 - DNA, 20 bp, Artificial Sequence
  Description of Artificial Sequence: Synthetic oligonucleotide
  Target: ATXN1; (-) strand; PAM type: NRG; PAM sequence: TGG
tgaggtccactttccttagg

SEQ ID NO: 64592 - DNA, 20 bp, Artificial Sequence
  Description of Artificial Sequence: Synthetic oligonucleotide
  Target: ATXN1; (-) strand; PAM type: NRG; PAM sequence: AGG
ccttgaggtccactttcctt

SEQ ID NO: 64593 - DNA, 20 bp, Artificial Sequence
  Description of Artificial Sequence: Synthetic oligonucleotide
  Target: ATXN1; (-) strand; PAM type: NRG; PAM sequence: TAG
cccttgaggtccactttcct

SEQ ID NO: 64594 - DNA, 20 bp, Artificial Sequence
  Description of Artificial Sequence: Synthetic oligonucleotide
  Target: ATXN1; (-) strand; PAM type: NRG; PAM sequence: AGG
tcaattcagatatacccttg

SEQ ID NO: 64595 - DNA, 20 bp, Artificial Sequence
  Description of Artificial Sequence: Synthetic oligonucleotide
  Target: ATXN1; (-) strand; PAM type: NRG; PAM sequence: GAG
ctcaattcagatataccctt

SEQ ID NO: 64596 - DNA, 20 bp, Artificial Sequence
  Description of Artificial Sequence: Synthetic oligonucleotide
  Target: ATXN1; (-) strand; PAM type: NRG; PAM sequence: CAG
gggccatatgtttctcaatt

SEQ ID NO: 64597 - DNA, 20 bp, Artificial Sequence
  Description of Artificial Sequence: Synthetic oligonucleotide
  Target: ATXN1; (-) strand; PAM type: NRG; PAM sequence: GGG
ccaggtaccttcttgtagtt

SEQ ID NO: 64598 - DNA, 20 bp, Artificial Sequence
  Description of Artificial Sequence: Synthetic oligonucleotide
  Target: ATXN1; (-) strand; PAM type: NRG; PAM sequence: TGG
cccaggtaccttcttgtagt

SEQ ID NO: 64599 - DNA, 20 bp, Artificial Sequence
  Description of Artificial Sequence: Synthetic oligonucleotide
  Target: ATXN1; (-) strand; PAM type: NRG; PAM sequence: TAG
cctacccaggtaccttcttg

SEQ ID NO: 64600 - DNA, 20 bp, Artificial Sequence
  Description of Artificial Sequence: Synthetic oligonucleotide
  Target: ATXN1; (-) strand; PAM type: NRG; PAM sequence: AGG
catctctgaaaaccctaccc

SEQ ID NO: 64601 - DNA, 20 bp, Artificial Sequence
  Description of Artificial Sequence: Synthetic oligonucleotide
  Target: ATXN1; (-) strand; PAM type: NRG; PAM sequence: CAG
acatctctgaaaaccctacc

SEQ ID NO: 64602 - DNA, 20 bp, Artificial Sequence
  Description of Artificial Sequence: Synthetic oligonucleotide
  Target: ATXN1; (-) strand; PAM type: NRG; PAM sequence: AAG
cagtcttatcacatcttgga

SEQ ID NO: 64603 - DNA, 20 bp, Artificial Sequence
  Description of Artificial Sequence: Synthetic oligonucleotide
  Target: ATXN1; (-) strand; PAM type: NRG; PAM sequence: TGG
ttaccagtcttatcacatct

SEQ ID NO: 64604 - DNA, 20 bp, Artificial Sequence
  Description of Artificial Sequence: Synthetic oligonucleotide
  Target: ATXN1; (-) strand; PAM type: NRG; PAM sequence: CAG
gatatttcatgaccttttac

SEQ ID NO: 64605 - DNA, 20 bp, Artificial Sequence
  Description of Artificial Sequence: Synthetic oligonucleotide
  Target: ATXN1; (-) strand; PAM type: NRG; PAM sequence: AAG
tttttttttttatcataatg

SEQ ID NO: 64606 - DNA, 20 bp, Artificial Sequence
  Description of Artificial Sequence: Synthetic oligonucleotide
  Target: ATXN1; (-) strand; PAM type: NRG; PAM sequence: TAG
tccataaatgaatgaattgg

SEQ ID NO: 64607 - DNA, 20 bp, Artificial Sequence
  Description of Artificial Sequence: Synthetic oligonucleotide
  Target: ATXN1; (-) strand; PAM type: NRG; PAM sequence: TGG
gaatccataaatgaatgaat

SEQ ID NO: 64608 - DNA, 20 bp, Artificial Sequence
  Description of Artificial Sequence: Synthetic oligonucleotide
  Target: ATXN1; (-) strand; PAM type: NRG; PAM sequence: TAG
tgtaatctatatatgggcat

SEQ ID NO: 64609 - DNA, 20 bp, Artificial Sequence
  Description of Artificial Sequence: Synthetic oligonucleotide
  Target: ATXN1; (-) strand; PAM type: NRG; PAM sequence: GGG
aagctttgtaatctatatat

SEQ ID NO: 64610 - DNA, 20 bp, Artificial Sequence
  Description of Artificial Sequence: Synthetic oligonucleotide
  Target: ATXN1; (-) strand; PAM type: NRG; PAM sequence: TGG
taagctttgtaatctatata

SEQ ID NO: 64611 - DNA, 20 bp, Artificial Sequence
  Description of Artificial Sequence: Synthetic oligonucleotide
  Target: ATXN1; (-) strand; PAM type: NRG; PAM sequence: AAG
cttgtcactcactactgatt

SEQ ID NO: 64612 - DNA, 20 bp, Artificial Sequence
  Description of Artificial Sequence: Synthetic oligonucleotide
  Target: ATXN1; (-) strand; PAM type: NRG; PAM sequence: CAG
gatttttgcctgatattctt

SEQ ID NO: 64613 - DNA, 20 bp, Artificial Sequence
  Description of Artificial Sequence: Synthetic oligonucleotide
  Target: ATXN1; (-) strand; PAM type: NRG; PAM sequence: GAG
acctgaatatttaagtatgg

SEQ ID NO: 64614 - DNA, 20 bp, Artificial Sequence
  Description of Artificial Sequence: Synthetic oligonucleotide
  Target: ATXN1; (-) strand; PAM type: NRG; PAM sequence: GGG
gaacctgaatatttaagtat

SEQ ID NO: 64615 - DNA, 20 bp, Artificial Sequence
  Description of Artificial Sequence: Synthetic oligonucleotide
  Target: ATXN1; (-) strand; PAM type: NRG; PAM sequence: TGG
agaacctgaatatttaagta

SEQ ID NO: 64616 - DNA, 20 bp, Artificial Sequence
  Description of Artificial Sequence: Synthetic oligonucleotide
  Target: ATXN1; (-) strand; PAM type: NRG; PAM sequence: AAG
ttataagaacctgaatattt

SEQ ID NO: 64617 - DNA, 20 bp, Artificial Sequence
  Description of Artificial Sequence: Synthetic oligonucleotide
  Target: ATXN1; (-) strand; PAM type: NRG; PAM sequence: AAG
aattgtgtcttgtctattat

SEQ ID NO: 64618 - DNA, 20 bp, Artificial Sequence
  Description of Artificial Sequence: Synthetic oligonucleotide
  Target: ATXN1; (-) strand; PAM type: NRG; PAM sequence: TGG
gcagacaagatgatattatg

SEQ ID NO: 64619 - DNA, 20 bp, Artificial Sequence
  Description of Artificial Sequence: Synthetic oligonucleotide
  Target: ATXN1; (-) strand; PAM type: NRG; PAM sequence: AAG
tgccccatgcattggcagac

SEQ ID NO: 64620 - DNA, 20 bp, Artificial Sequence
  Description of Artificial Sequence: Synthetic oligonucleotide
  Target: ATXN1; (-) strand; PAM type: NRG; PAM sequence: CAG
taatgtgccccatgcattgg

SEQ ID NO: 64621 - DNA, 20 bp, Artificial Sequence
  Description of Artificial Sequence: Synthetic oligonucleotide
  Target: ATXN1; (-) strand; PAM type: NRG; PAM sequence: TGG
agttaatgtgccccatgcat

SEQ ID NO: 64622 - DNA, 20 bp, Artificial Sequence
  Description of Artificial Sequence: Synthetic oligonucleotide
  Target: ATXN1; (-) strand; PAM type: NRG; PAM sequence: TAG
ttctactattgtgtcaaggc

SEQ ID NO: 64623 - DNA, 20 bp, Artificial Sequence
  Description of Artificial Sequence: Synthetic oligonucleotide
  Target: ATXN1; (-) strand; PAM type: NRG; PAM sequence: AGG
tttgttctactattgtgtca

SEQ ID NO: 64624 - DNA, 20 bp, Artificial Sequence
  Description of Artificial Sequence: Synthetic oligonucleotide
  Target: ATXN1; (-) strand; PAM type: NRG; PAM sequence: AAG
atttgttctactattgtgtc

SEQ ID NO: 64625 - DNA, 20 bp, Artificial Sequence
  Description of Artificial Sequence: Synthetic oligonucleotide
  Target: ATXN1; (-) strand; PAM type: NRG; PAM sequence: AAG
cagtttaaaataagagaaaa

SEQ ID NO: 64626 - DNA, 20 bp, Artificial Sequence
  Description of Artificial Sequence: Synthetic oligonucleotide
  Target: ATXN1; (-) strand; PAM type: NRG; PAM sequence: GAG
agtgcaccagtttaaaataa

SEQ ID NO: 64627 - DNA, 20 bp, Artificial Sequence
  Description of Artificial Sequence: Synthetic oligonucleotide
  Target: ATXN1; (-) strand; PAM type: NRG; PAM sequence: AAG
tgagtgcaccagtttaaaat

SEQ ID NO: 64628 - DNA, 20 bp, Artificial Sequence
  Description of Artificial Sequence: Synthetic oligonucleotide
  Target: ATXN1; (-) strand; PAM type: NRG; PAM sequence: CAG
acctacacatttgagtgcac

SEQ ID NO: 64629 - DNA, 20 bp, Artificial Sequence
  Description of Artificial Sequence: Synthetic oligonucleotide
  Target: ATXN1; (-) strand; PAM type: NRG; PAM sequence: GAG
atgcacaaacctacacattt

SEQ ID NO: 64630 - DNA, 20 bp, Artificial Sequence
  Description of Artificial Sequence: Synthetic oligonucleotide
  Target: ATXN1; (-) strand; PAM type: NRG; PAM sequence: AAG
ctgaaatggagtcttcactc

SEQ ID NO: 64631 - DNA, 20 bp, Artificial Sequence
  Description of Artificial Sequence: Synthetic oligonucleotide
  Target: ATXN1; (-) strand; PAM type: NRG; PAM sequence: GAG
acaatggcagaactgaaatg

SEQ ID NO: 64632 - DNA, 20 bp, Artificial Sequence
  Description of Artificial Sequence: Synthetic oligonucleotide
  Target: ATXN1; (-) strand; PAM type: NRG; PAM sequence: TGG
gaacaatggcagaactgaaa

SEQ ID NO: 64633 - DNA, 20 bp, Artificial Sequence
  Description of Artificial Sequence: Synthetic oligonucleotide
  Target: ATXN1; (-) strand; PAM type: NRG; PAM sequence: CAG
gttaggcctgtgaacaatgg

SEQ ID NO: 64634 - DNA, 20 bp, Artificial Sequence
  Description of Artificial Sequence: Synthetic oligonucleotide
  Target: ATXN1; (-) strand; PAM type: NRG; PAM sequence: TGG
gttgttaggcctgtgaacaa

SEQ ID NO: 64635 - DNA, 20 bp, Artificial Sequence
  Description of Artificial Sequence: Synthetic oligonucleotide
  Target: ATXN1; (-) strand; PAM type: NRG; PAM sequence: AGG
ttaaggaaaagtaagttgtt

SEQ ID NO: 64636 - DNA, 20 bp, Artificial Sequence
  Description of Artificial Sequence: Synthetic oligonucleotide
  Target: ATXN1; (-) strand; PAM type: NRG; PAM sequence: TAG
tttaaggaaaagtaagttgt

SEQ ID NO: 64637 - DNA, 20 bp, Artificial Sequence
  Description of Artificial Sequence: Synthetic oligonucleotide
  Target: ATXN1; (-) strand; PAM type: NRG; PAM sequence: AAG
tccttgttttaaggaaaagt

SEQ ID NO: 64638 - DNA, 20 bp, Artificial Sequence
  Description of Artificial Sequence: Synthetic oligonucleotide
  Target: ATXN1; (-) strand; PAM type: NRG; PAM sequence: AAG
cctttccttgttttaaggaa

SEQ ID NO: 64639 - DNA, 20 bp, Artificial Sequence
  Description of Artificial Sequence: Synthetic oligonucleotide
  Target: ATXN1; (-) strand; PAM type: NRG; PAM sequence: AGG
accctcctttccttgtttta

SEQ ID NO: 64640 - DNA, 20 bp, Artificial Sequence
  Description of Artificial Sequence: Synthetic oligonucleotide
  Target: ATXN1; (-) strand; PAM type: NRG; PAM sequence: AAG
aaccctcctttccttgtttt

SEQ ID NO: 64641 - DNA, 20 bp, Artificial Sequence
  Description of Artificial Sequence: Synthetic oligonucleotide
  Target: ATXN1; (-) strand; PAM type: NRG; PAM sequence: CAG
ttatggcataataatggaaa

SEQ ID NO: 64642 - DNA, 20 bp, Artificial Sequence
  Description of Artificial Sequence: Synthetic oligonucleotide
  Target: ATXN1; (-) strand; PAM type: NRG; PAM sequence: TGG
gtttccttatggcataataa

SEQ ID NO: 64643 - DNA, 20 bp, Artificial Sequence
  Description of Artificial Sequence: Synthetic oligonucleotide
  Target: ATXN1; (-) strand; PAM type: NRG; PAM sequence: TGG
gaattcttccagtttcctta

SEQ ID NO: 64644 - DNA, 20 bp, Artificial Sequence
  Description of Artificial Sequence: Synthetic oligonucleotide
  Target: ATXN1; (-) strand; PAM type: NRG; PAM sequence: CAG
ttaaaaataaagaattcttc

SEQ ID NO: 64645 - DNA, 20 bp, Artificial Sequence
  Description of Artificial Sequence: Synthetic oligonucleotide
  Target: ATXN1; (-) strand; PAM type: NRG; PAM sequence: AAG
ttaaaaatattttaaaaata

SEQ ID NO: 64646 - DNA, 20 bp, Artificial Sequence
  Description of Artificial Sequence: Synthetic oligonucleotide
  Target: ATXN1; (-) strand; PAM type: NRG; PAM sequence: AAG
cacatgtatcccagaactta

SEQ ID NO: 64647 - DNA, 20 bp, Artificial Sequence
  Description of Artificial Sequence: Synthetic oligonucleotide
  Target: ATXN1; (-) strand; PAM type: NRG; PAM sequence: CAG
catgttctgcacatgtatcc

SEQ ID NO: 64648 - DNA, 20 bp, Artificial Sequence
  Description of Artificial Sequence: Synthetic oligonucleotide
  Target: ATXN1; (-) strand; PAM type: NRG; PAM sequence: TGG
ataggtgcagcaaaccacca

SEQ ID NO: 64649 - DNA, 20 bp, Artificial Sequence
  Description of Artificial Sequence: Synthetic oligonucleotide
  Target: ATXN1; (-) strand; PAM type: NRG; PAM sequence: CAG
agatgatgggttgataggtg

SEQ ID NO: 64650 - DNA, 20 bp, Artificial Sequence
  Description of Artificial Sequence: Synthetic oligonucleotide
  Target: ATXN1; (-) strand; PAM type: NRG; PAM sequence: AGG
aacctagatgatgggttgat

SEQ ID NO: 64651 - DNA, 20 bp, Artificial Sequence
  Description of Artificial Sequence: Synthetic oligonucleotide
  Target: ATXN1; (-) strand; PAM type: NRG; PAM sequence: TAG
aaacctagatgatgggttga

SEQ ID NO: 64652 - DNA, 20 bp, Artificial Sequence
  Description of Artificial Sequence: Synthetic oligonucleotide
  Target: ATXN1; (-) strand; PAM type: NRG; PAM sequence: GGG
gggcttaaaacctagatgat

SEQ ID NO: 64653 - DNA, 20 bp, Artificial Sequence
  Description of Artificial Sequence: Synthetic oligonucleotide
  Target: ATXN1; (-) strand; PAM type: NRG; PAM sequence: TGG
ggggcttaaaacctagatga

SEQ ID NO: 64654 - DNA, 20 bp, Artificial Sequence
  Description of Artificial Sequence: Synthetic oligonucleotide
  Target: ATXN1; (-) strand; PAM type: NRG; PAM sequence: TAG
tgcatgaggggcttaaaacc

SEQ ID NO: 64655 - DNA, 20 bp, Artificial Sequence
  Description of Artificial Sequence: Synthetic oligonucleotide
  Target: ATXN1; (-) strand; PAM type: NRG; PAM sequence: GGG
acaaatacctaatgcatgag

SEQ ID NO: 64656 - DNA, 20 bp, Artificial Sequence
  Description of Artificial Sequence: Synthetic oligonucleotide
  Target: ATXN1; (-) strand; PAM type: NRG; PAM sequence: GGG
gacaaatacctaatgcatga

SEQ ID NO: 64657 - DNA, 20 bp, Artificial Sequence
  Description of Artificial Sequence: Synthetic oligonucleotide
  Target: ATXN1; (-) strand; PAM type: NRG; PAM sequence: AGG
ggacaaatacctaatgcatg

SEQ ID NO: 64658 - DNA, 20 bp, Artificial Sequence
  Description of Artificial Sequence: Synthetic oligonucleotide
  Target: ATXN1; (-) strand; PAM type: NRG; PAM sequence: GAG
aggacaaatacctaatgcat

SEQ ID NO: 64659 - DNA, 20 bp, Artificial Sequence
  Description of Artificial Sequence: Synthetic oligonucleotide
  Target: ATXN1; (-) strand; PAM type: NRG; PAM sequence: AGG
gcaaggggagggagagaatt

SEQ ID NO: 64660 - DNA, 20 bp, Artificial Sequence
  Description of Artificial Sequence: Synthetic oligonucleotide
  Target: ATXN1; (-) strand; PAM type: NRG; PAM sequence: TAG
ggcaaggggagggagagaat

SEQ ID NO: 64661 - DNA, 20 bp, Artificial Sequence
  Description of Artificial Sequence: Synthetic oligonucleotide
  Target: ATXN1; (-) strand; PAM type: NRG; PAM sequence: GAG
gtggggggcaaggggaggga

SEQ ID NO: 64662 - DNA, 20 bp, Artificial Sequence
  Description of Artificial Sequence: Synthetic oligonucleotide
  Target: ATXN1; (-) strand; PAM type: NRG; PAM sequence: GAG
gagtggggggcaaggggagg

SEQ ID NO: 64663 - DNA, 20 bp, Artificial Sequence
  Description of Artificial Sequence: Synthetic oligonucleotide
  Target: ATXN1; (-) strand; PAM type: NRG; PAM sequence: GGG
gtgagtggggggcaagggga

SEQ ID NO: 64664 - DNA, 20 bp, Artificial Sequence
  Description of Artificial Sequence: Synthetic oligonucleotide
  Target: ATXN1; (-) strand; PAM type: NRG; PAM sequence: AGG
ggtgagtggggggcaagggg

SEQ ID NO: 64665 - DNA, 20 bp, Artificial Sequence
  Description of Artificial Sequence: Synthetic oligonucleotide
  Target: ATXN1; (-) strand; PAM type: NRG; PAM sequence: GAG
cggtgagtggggggcaaggg

SEQ ID NO: 64666 - DNA, 20 bp, Artificial Sequence
  Description of Artificial Sequence: Synthetic oligonucleotide
  Target: ATXN1; (-) strand; PAM type: NRG; PAM sequence: GGG
atcggtgagtggggggcaag

SEQ ID NO: 64667 - DNA, 20 bp, Artificial Sequence
  Description of Artificial Sequence: Synthetic oligonucleotide
  Target: ATXN1; (-) strand; PAM type: NRG; PAM sequence: GGG
tatcggtgagtggggggcaa

SEQ ID NO: 64668 - DNA, 20 bp, Artificial Sequence
  Description of Artificial Sequence: Synthetic oligonucleotide
  Target: ATXN1; (-) strand; PAM type: NRG; PAM sequence: AGG
ctatcggtgagtggggggca

SEQ ID NO: 64669 - DNA, 20 bp, Artificial Sequence
  Description of Artificial Sequence: Synthetic oligonucleotide
  Target: ATXN1; (-) strand; PAM type: NRG; PAM sequence: AAG
cctatcggtgagtggggggc

SEQ ID NO: 64670 - DNA, 20 bp, Artificial Sequence
  Description of Artificial Sequence: Synthetic oligonucleotide
  Target: ATXN1; (-) strand; PAM type: NRG; PAM sequence: GGG
agggcctatcggtgagtggg

SEQ ID NO: 64671 - DNA, 20 bp, Artificial Sequence
  Description of Artificial Sequence: Synthetic oligonucleotide
  Target: ATXN1; (-) strand; PAM type: NRG; PAM sequence: GGG
cagggcctatcggtgagtgg

SEQ ID NO: 64672 - DNA, 20 bp, Artificial Sequence
  Description of Artificial Sequence: Synthetic oligonucleotide
  Target: ATXN1; (-) strand; PAM type: NRG; PAM sequence: GGG
ccagggcctatcggtgagtg

SEQ ID NO: 64673 - DNA, 20 bp, Artificial Sequence
  Description of Artificial Sequence: Synthetic oligonucleotide
  Target: ATXN1; (-) strand; PAM type: NRG; PAM sequence: GGG
accagggcctatcggtgagt

SEQ ID NO: 64674 - DNA, 20 bp, Artificial Sequence
  Description of Artificial Sequence: Synthetic oligonucleotide
  Target: ATXN1; (-) strand; PAM type: NRG; PAM sequence: TGG
caccagggcctatcggtgag

SEQ ID NO: 64675 - DNA, 20 bp, Artificial Sequence
  Description of Artificial Sequence: Synthetic oligonucleotide
  Target: ATXN1; (-) strand; PAM type: NRG; PAM sequence: GAG
acacaccagggcctatcggt

SEQ ID NO: 64676 - DNA, 20 bp, Artificial Sequence
  Description of Artificial Sequence: Synthetic oligonucleotide
  Target: ATXN1; (-) strand; PAM type: NRG; PAM sequence: CGG
catcacacaccagggcctat

SEQ ID NO: 64677 - DNA, 20 bp, Artificial Sequence
  Description of Artificial Sequence: Synthetic oligonucleotide
  Target: ATXN1; (-) strand; PAM type: NRG; PAM sequence: GGG
gaggggaacatcacacacca

SEQ ID NO: 64678 - DNA, 20 bp, Artificial Sequence
  Description of Artificial Sequence: Synthetic oligonucleotide
  Target: ATXN1; (-) strand; PAM type: NRG; PAM sequence: AGG
ggaggggaacatcacacacc

SEQ ID NO: 64679 - DNA, 20 bp, Artificial Sequence
  Description of Artificial Sequence: Synthetic oligonucleotide
  Target: ATXN1; (-) strand; PAM type: NRG; PAM sequence: CAG
gggaggggaacatcacacac

SEQ ID NO: 64680 - DNA, 20 bp, Artificial Sequence
  Description of Artificial Sequence: Synthetic oligonucleotide
  Target: ATXN1; (-) strand; PAM type: NRG; PAM sequence: GGG
gaacacatggacacagggag

SEQ ID NO: 64681 - DNA, 20 bp, Artificial Sequence
  Description of Artificial Sequence: Synthetic oligonucleotide
  Target: ATXN1; (-) strand; PAM type: NRG; PAM sequence: GGG
agaacacatggacacaggga

SEQ ID NO: 64682 - DNA, 20 bp, Artificial Sequence
  Description of Artificial Sequence: Synthetic oligonucleotide
  Target: ATXN1; (-) strand; PAM type: NRG; PAM sequence: AGG
gagaacacatggacacaggg

SEQ ID NO: 64683 - DNA, 20 bp, Artificial Sequence
  Description of Artificial Sequence: Synthetic oligonucleotide
  Target: ATXN1; (-) strand; PAM type: NRG; PAM sequence: GAG
tgagaacacatggacacagg

SEQ ID NO: 64684 - DNA, 20 bp, Artificial Sequence
  Description of Artificial Sequence: Synthetic oligonucleotide
  Target: ATXN1; (-) strand; PAM type: NRG; PAM sequence: GGG
aatgagaacacatggacaca

SEQ ID NO: 64685 - DNA, 20 bp, Artificial Sequence
  Description of Artificial Sequence: Synthetic oligonucleotide
  Target: ATXN1; (-) strand; PAM type: NRG; PAM sequence: AGG
taatgagaacacatggacac

SEQ ID NO: 64686 - DNA, 20 bp, Artificial Sequence
  Description of Artificial Sequence: Synthetic oligonucleotide
  Target: ATXN1; (-) strand; PAM type: NRG; PAM sequence: CAG
ataatgagaacacatggaca

SEQ ID NO: 64687 - DNA, 20 bp, Artificial Sequence
  Description of Artificial Sequence: Synthetic oligonucleotide
  Target: ATXN1; (-) strand; PAM type: NRG; PAM sequence: TGG
agttgaataatgagaacaca

SEQ ID NO: 64688 - DNA, 20 bp, Artificial Sequence
  Description of Artificial Sequence: Synthetic oligonucleotide
  Target: ATXN1; (-) strand; PAM type: NRG; PAM sequence: GAG
catagtaggagttgaataat

SEQ ID NO: 64689 - DNA, 20 bp, Artificial Sequence
  Description of Artificial Sequence: Synthetic oligonucleotide
  Target: ATXN1; (-) strand; PAM type: NRG; PAM sequence: GAG
catgttctcactcatagtag

SEQ ID NO: 64690 - DNA, 20 bp, Artificial Sequence
  Description of Artificial Sequence: Synthetic oligonucleotide
  Target: ATXN1; (-) strand; PAM type: NRG; PAM sequence: AGG
cgcatgttctcactcatagt

SEQ ID NO: 64691 - DNA, 20 bp, Artificial Sequence
  Description of Artificial Sequence: Synthetic oligonucleotide
  Target: ATXN1; (-) strand; PAM type: NRG; PAM sequence: TAG
ccgcatgttctcactcatag

SEQ ID NO: 64692 - DNA, 20 bp, Artificial Sequence
  Description of Artificial Sequence: Synthetic oligonucleotide
  Target: ATXN1; (-) strand; PAM type: NRG; PAM sequence: TAG
acaccgcatgttctcactca

SEQ ID NO: 64693 - DNA, 20 bp, Artificial Sequence
  Description of Artificial Sequence: Synthetic oligonucleotide
  Target: ATXN1; (-) strand; PAM type: NRG; PAM sequence: CAG
tcagcaaactaacacaggaa

SEQ ID NO: 64694 - DNA, 20 bp, Artificial Sequence
  Description of Artificial Sequence: Synthetic oligonucleotide
  Target: ATXN1; (-) strand; PAM type: NRG; PAM sequence: AGG
cattctcagcaaactaacac

SEQ ID NO: 64695 - DNA, 20 bp, Artificial Sequence
  Description of Artificial Sequence: Synthetic oligonucleotide
  Target: ATXN1; (-) strand; PAM type: NRG; PAM sequence: CAG
tcattctcagcaaactaaca

SEQ ID NO: 64696 - DNA, 20 bp, Artificial Sequence
  Description of Artificial Sequence: Synthetic oligonucleotide
  Target: ATXN1; (-) strand; PAM type: NRG; PAM sequence: CAG
gaagctggaagcctcattct

SEQ ID NO: 64697 - DNA, 20 bp, Artificial Sequence
  Description of Artificial Sequence: Synthetic oligonucleotide
  Target: ATXN1; (-) strand; PAM type: NRG; PAM sequence: AAG
agggacatggatgaagctgg

SEQ ID NO: 64698 - DNA, 20 bp, Artificial Sequence
  Description of Artificial Sequence: Synthetic oligonucleotide
  Target: ATXN1; (-) strand; PAM type: NRG; PAM sequence: TGG
tacagggacatggatgaagc

SEQ ID NO: 64699 - DNA, 20 bp, Artificial Sequence
  Description of Artificial Sequence: Synthetic oligonucleotide
  Target: ATXN1; (-) strand; PAM type: NRG; PAM sequence: AAG
cctttacagggacatggatg

SEQ ID NO: 64700 - DNA, 20 bp, Artificial Sequence
  Description of Artificial Sequence: Synthetic oligonucleotide
  Target: ATXN1; (-) strand; PAM type: NRG; PAM sequence: TGG
tcatgtcctttacagggaca

SEQ ID NO: 64701 - DNA, 20 bp, Artificial Sequence
  Description of Artificial Sequence: Synthetic oligonucleotide
  Target: ATXN1; (-) strand; PAM type: NRG; PAM sequence: GGG
atgagctcatgtcctttaca

SEQ ID NO: 64702 - DNA, 20 bp, Artificial Sequence
  Description of Artificial Sequence: Synthetic oligonucleotide
  Target: ATXN1; (-) strand; PAM type: NRG; PAM sequence: AGG
aatgagctcatgtcctttac

SEQ ID NO: 64703 - DNA, 20 bp, Artificial Sequence
  Description of Artificial Sequence: Synthetic oligonucleotide
  Target: ATXN1; (-) strand; PAM type: NRG; PAM sequence: CAG
gaatgagctcatgtccttta

SEQ ID NO: 64704 - DNA, 20 bp, Artificial Sequence
  Description of Artificial Sequence: Synthetic oligonucleotide
  Target: ATXN1; (-) strand; PAM type: NRG; PAM sequence: GAG
atgcagccataaaaaagaat

SEQ ID NO: 64705 - DNA, 20 bp, Artificial Sequence
  Description of Artificial Sequence: Synthetic oligonucleotide
  Target: ATXN1; (-) strand; PAM type: NRG; PAM sequence: AAG
aatactatgcagccataaaa

SEQ ID NO: 64706 - DNA, 20 bp, Artificial Sequence
  Description of Artificial Sequence: Synthetic oligonucleotide
  Target: ATXN1; (-) strand; PAM type: NRG; PAM sequence: CAG
atacaccatggaatactatg

SEQ ID NO: 64707 - DNA, 20 bp, Artificial Sequence
  Description of Artificial Sequence: Synthetic oligonucleotide
  Target: ATXN1; (-) strand; PAM type: NRG; PAM sequence: TGG
aatgtggtaaatatacacca

SEQ ID NO: 64708 - DNA, 20 bp, Artificial Sequence
  Description of Artificial Sequence: Synthetic oligonucleotide
  Target: ATXN1; (-) strand; PAM type: NRG; PAM sequence: TGG
tagactggataaagaaaatg

SEQ ID NO: 64709 - DNA, 20 bp, Artificial Sequence
  Description of Artificial Sequence: Synthetic oligonucleotide
  Target: ATXN1; (-) strand; PAM type: NRG; PAM sequence: AAG
catcaatgatagactggata

SEQ ID NO: 64710 - DNA, 20 bp, Artificial Sequence
  Description of Artificial Sequence: Synthetic oligonucleotide
  Target: ATXN1; (-) strand; PAM type: NRG; PAM sequence: TGG
aatgcccatcaatgatagac

SEQ ID NO: 64711 - DNA, 20 bp, Artificial Sequence
  Description of Artificial Sequence: Synthetic oligonucleotide
  Target: ATXN1; (-) strand; PAM type: NRG; PAM sequence: TAG
acccaaatgcccatcaatga

SEQ ID NO: 64712 - DNA, 20 bp, Artificial Sequence
  Description of Artificial Sequence: Synthetic oligonucleotide
  Target: ATXN1; (-) strand; PAM type: NRG; PAM sequence: TGG
gtatttacaatagtaaagac

SEQ ID NO: 64713 - DNA, 20 bp, Artificial Sequence
  Description of Artificial Sequence: Synthetic oligonucleotide
  Target: ATXN1; (-) strand; PAM type: NRG; PAM sequence: AAG
cagcagtatttacaatagta

SEQ ID NO: 64714 - DNA, 20 bp, Artificial Sequence
  Description of Artificial Sequence: Synthetic oligonucleotide
  Target: ATXN1; (-) strand; PAM type: NRG; PAM sequence: TAG
tactgcagcagtatttacaa

SEQ ID NO: 64715 - DNA, 20 bp, Artificial Sequence
  Description of Artificial Sequence: Synthetic oligonucleotide
  Target: ATXN1; (-) strand; PAM type: NRG; PAM sequence: CAG
cacacatatgtttactgcag

SEQ ID NO: 64716 - DNA, 20 bp, Artificial Sequence
  Description of Artificial Sequence: Synthetic oligonucleotide
  Target: ATXN1; (-) strand; PAM type: NRG; PAM sequence: CAG
atgcacacatatgtttactg

SEQ ID NO: 64717 - DNA, 20 bp, Artificial Sequence
  Description of Artificial Sequence: Synthetic oligonucleotide
  Target: ATXN1; (-) strand; PAM type: NRG; PAM sequence: AAG
ttataaatcattctgttata

SEQ ID NO: 64718 - DNA, 20 bp, Artificial Sequence
  Description of Artificial Sequence: Synthetic oligonucleotide
  Target: ATXN1; (-) strand; PAM type: NRG; PAM sequence: AGG
gttactggttatatacccaa

SEQ ID NO: 64719 - DNA, 20 bp, Artificial Sequence
  Description of Artificial Sequence: Synthetic oligonucleotide
  Target: ATXN1; (-) strand; PAM type: NRG; PAM sequence: AAG
cgttactggttatataccca

SEQ ID NO: 64720 - DNA, 20 bp, Artificial Sequence
  Description of Artificial Sequence: Synthetic oligonucleotide
  Target: ATXN1; (-) strand; PAM type: NRG; PAM sequence: TGG
tgacccagcaatcccgttac

SEQ ID NO: 64721 - DNA, 20 bp, Artificial Sequence
  Description of Artificial Sequence: Synthetic oligonucleotide
  Target: ATXN1; (-) strand; PAM type: NRG; PAM sequence: CAG
accagaaataccatttgacc

SEQ ID NO: 64722 - DNA, 20 bp, Artificial Sequence
  Description of Artificial Sequence: Synthetic oligonucleotide
  Target: ATXN1; (-) strand; PAM type: NRG; PAM sequence: CAG
attcctcaaggatctagaac

SEQ ID NO: 64723 - DNA, 20 bp, Artificial Sequence
  Description of Artificial Sequence: Synthetic oligonucleotide
  Target: ATXN1; (-) strand; PAM type: NRG; PAM sequence: TAG
gtggcgattcctcaaggatc

SEQ ID NO: 64724 - DNA, 20 bp, Artificial Sequence
  Description of Artificial Sequence: Synthetic oligonucleotide
  Target: ATXN1; (-) strand; PAM type: NRG; PAM sequence: AGG
gacagtgtggcgattcctca

SEQ ID NO: 64725 - DNA, 20 bp, Artificial Sequence
  Description of Artificial Sequence: Synthetic oligonucleotide
  Target: ATXN1; (-) strand; PAM type: NRG; PAM sequence: AAG
agacagtgtggcgattcctc

SEQ ID NO: 64726 - DNA, 20 bp, Artificial Sequence
  Description of Artificial Sequence: Synthetic oligonucleotide
  Target: ATXN1; (-) strand; PAM type: NRG; PAM sequence: TGG
aaccattgtggaagacagtg

SEQ ID NO: 64727 - DNA, 20 bp, Artificial Sequence
  Description of Artificial Sequence: Synthetic oligonucleotide
  Target: ATXN1; (-) strand; PAM type: NRG; PAM sequence: CAG
agttcaaccattgtggaaga

SEQ ID NO: 64728 - DNA, 20 bp, Artificial Sequence
  Description of Artificial Sequence: Synthetic oligonucleotide
  Target: ATXN1; (-) strand; PAM type: NRG; PAM sequence: AAG
aattagttcaaccattgtgg

SEQ ID NO: 64729 - DNA, 20 bp, Artificial Sequence
  Description of Artificial Sequence: Synthetic oligonucleotide
  Target: ATXN1; (-) strand; PAM type: NRG; PAM sequence: TGG
gtaaattagttcaaccattg

SEQ ID NO: 64730 - DNA, 20 bp, Artificial Sequence
  Description of Artificial Sequence: Synthetic oligonucleotide
  Target: ATXN1; (-) strand; PAM type: NRG; PAM sequence: TAG
gctgttgggggactgtaaat

SEQ ID NO: 64731 - DNA, 20 bp, Artificial Sequence
  Description of Artificial Sequence: Synthetic oligonucleotide
  Target: ATXN1; (-) strand; PAM type: NRG; PAM sequence: GGG
gaatgcttttatgctgttgg

SEQ ID NO: 64732 - DNA, 20 bp, Artificial Sequence
  Description of Artificial Sequence: Synthetic oligonucleotide
  Target: ATXN1; (-) strand; PAM type: NRG; PAM sequence: GGG
ggaatgcttttatgctgttg

SEQ ID NO: 64733 - DNA, 20 bp, Artificial Sequence
  Description of Artificial Sequence: Synthetic oligonucleotide
  Target: ATXN1; (-) strand; PAM type: NRG; PAM sequence: GGG
aggaatgcttttatgctgtt

SEQ ID NO: 64734 - DNA, 20 bp, Artificial Sequence
  Description of Artificial Sequence: Synthetic oligonucleotide
  Target: ATXN1; (-) strand; PAM type: NRG; PAM sequence: TGG
taggaatgcttttatgctgt

SEQ ID NO: 64735 - DNA, 20 bp, Artificial Sequence
  Description of Artificial Sequence: Synthetic oligonucleotide
  Target: ATXN1; (-) strand; PAM type: NRG; PAM sequence: AGG
tggcgaggctgtggagaaat

SEQ ID NO: 64736 - DNA, 20 bp, Artificial Sequence
  Description of Artificial Sequence: Synthetic oligonucleotide
  Target: ATXN1; (-) strand; PAM type: NRG; PAM sequence: TAG
ctggcgaggctgtggagaaa

SEQ ID NO: 64737 - DNA, 20 bp, Artificial Sequence
  Description of Artificial Sequence: Synthetic oligonucleotide
  Target: ATXN1; (-) strand; PAM type: NRG; PAM sequence: GAG
tagatgctggcgaggctgtg

SEQ ID NO: 64738 - DNA, 20 bp, Artificial Sequence
  Description of Artificial Sequence: Synthetic oligonucleotide
  Target: ATXN1; (-) strand; PAM type: NRG; PAM sequence: TGG
aatagatgctggcgaggctg

SEQ ID NO: 64739 - DNA, 20 bp, Artificial Sequence
  Description of Artificial Sequence: Synthetic oligonucleotide
  Target: ATXN1; (-) strand; PAM type: NRG; PAM sequence: AGG
tttcctaatagatgctggcg

SEQ ID NO: 64740 - DNA, 20 bp, Artificial Sequence
  Description of Artificial Sequence: Synthetic oligonucleotide
  Target: ATXN1; (-) strand; PAM type: NRG; PAM sequence: GAG
gtttcctaatagatgctggc

SEQ ID NO: 64741 - DNA, 20 bp, Artificial Sequence
  Description of Artificial Sequence: Synthetic oligonucleotide
  Target: ATXN1; (-) strand; PAM type: NRG; PAM sequence: TGG
tccagtttcctaatagatgc

SEQ ID NO: 64742 - DNA, 20 bp, Artificial Sequence
  Description of Artificial Sequence: Synthetic oligonucleotide
  Target: ATXN1; (-) strand; PAM type: NRG; PAM sequence: TAG
gaattcttccagtttcctaa

SEQ ID NO: 64743 - DNA, 20 bp, Artificial Sequence
  Description of Artificial Sequence: Synthetic oligonucleotide
  Target: ATXN1; (-) strand; PAM type: NRG; PAM sequence: CAG
tctattgtatagaattcttc

SEQ ID NO: 64744 - DNA, 20 bp, Artificial Sequence
  Description of Artificial Sequence: Synthetic oligonucleotide
  Target: ATXN1; (-) strand; PAM type: NRG; PAM sequence: TAG
cagctcctaaatctattgta

SEQ ID NO: 64745 - DNA, 20 bp, Artificial Sequence
  Description of Artificial Sequence: Synthetic oligonucleotide
  Target: ATXN1; (-) strand; PAM type: NRG; PAM sequence: CAG
agcaaatccttactcctttg

SEQ ID NO: 64746 - DNA, 20 bp, Artificial Sequence
  Description of Artificial Sequence: Synthetic oligonucleotide
  Target: ATXN1; (-) strand; PAM type: NRG; PAM sequence: CAG
tacttgcctaagaaaatctt

SEQ ID NO: 64747 - DNA, 20 bp, Artificial Sequence
  Description of Artificial Sequence: Synthetic oligonucleotide
  Target: ATXN1; (-) strand; PAM type: NRG; PAM sequence: AAG
ccaacttctaatacttgcct

SEQ ID NO: 64748 - DNA, 20 bp, Artificial Sequence
  Description of Artificial Sequence: Synthetic oligonucleotide
  Target: ATXN1; (-) strand; PAM type: NRG; PAM sequence: AGG
actacaattaggagacaagg

SEQ ID NO: 64749 - DNA, 20 bp, Artificial Sequence
  Description of Artificial Sequence: Synthetic oligonucleotide
  Target: ATXN1; (-) strand; PAM type: NRG; PAM sequence: GAG
cactacaattaggagacaag

SEQ ID NO: 64750 - DNA, 20 bp, Artificial Sequence
  Description of Artificial Sequence: Synthetic oligonucleotide
  Target: ATXN1; (-) strand; PAM type: NRG; PAM sequence: AGG
ttcactacaattaggagaca

SEQ ID NO: 64751 - DNA, 20 bp, Artificial Sequence
  Description of Artificial Sequence: Synthetic oligonucleotide
  Target: ATXN1; (-) strand; PAM type: NRG; PAM sequence: AAG
attcactacaattaggagac

SEQ ID NO: 64752 - DNA, 20 bp, Artificial Sequence
  Description of Artificial Sequence: Synthetic oligonucleotide
  Target: ATXN1; (-) strand; PAM type: NRG; PAM sequence: GAG
gacagattcactacaattag

SEQ ID NO: 64753 - DNA, 20 bp, Artificial Sequence
  Description of Artificial Sequence: Synthetic oligonucleotide
  Target: ATXN1; (-) strand; PAM type: NRG; PAM sequence: AGG
ttgacagattcactacaatt

SEQ ID NO: 64754 - DNA, 20 bp, Artificial Sequence
  Description of Artificial Sequence: Synthetic oligonucleotide
  Target: ATXN1; (-) strand; PAM type: NRG; PAM sequence: TAG
gttgacagattcactacaat

SEQ ID NO: 64755 - DNA, 20 bp, Artificial Sequence
  Description of Artificial Sequence: Synthetic oligonucleotide
  Target: ATXN1; (-) strand; PAM type: NRG; PAM sequence: CAG
tacactgaaaagaaagttga

SEQ ID NO: 64756 - DNA, 20 bp, Artificial Sequence
  Description of Artificial Sequence: Synthetic oligonucleotide
  Target: ATXN1; (-) strand; PAM type: NRG; PAM sequence: AAG
gtcttgatacactgaaaaga

SEQ ID NO: 64757 - DNA, 20 bp, Artificial Sequence
  Description of Artificial Sequence: Synthetic oligonucleotide
  Target: ATXN1; (-) strand; PAM type: NRG; PAM sequence: AAG
taaagtcttgatacactgaa

SEQ ID NO: 64758 - DNA, 20 bp, Artificial Sequence
  Description of Artificial Sequence: Synthetic oligonucleotide
  Target: ATXN1; (-) strand; PAM type: NRG; PAM sequence: AAG
gagaatgattttgaagagta

SEQ ID NO: 64759 - DNA, 20 bp, Artificial Sequence
  Description of Artificial Sequence: Synthetic oligonucleotide
  Target: ATXN1; (-) strand; PAM type: NRG; PAM sequence: GAG
atactgagaatgattttgaa

SEQ ID NO: 64760 - DNA, 20 bp, Artificial Sequence
  Description of Artificial Sequence: Synthetic oligonucleotide
  Target: ATXN1; (-) strand; PAM type: NRG; PAM sequence: AAG
gcatactgagaatgattttg

SEQ ID NO: 64761 - DNA, 20 bp, Artificial Sequence
  Description of Artificial Sequence: Synthetic oligonucleotide
  Target: ATXN1; (-) strand; PAM type: NRG; PAM sequence: GAG
atagcaattcagagcatact

SEQ ID NO: 64762 - DNA, 20 bp, Artificial Sequence
  Description of Artificial Sequence: Synthetic oligonucleotide
  Target: ATXN1; (-) strand; PAM type: NRG; PAM sequence: GAG
cttaaaagtatagcaattca

SEQ ID NO: 64763 - DNA, 20 bp, Artificial Sequence
  Description of Artificial Sequence: Synthetic oligonucleotide
  Target: ATXN1; (-) strand; PAM type: NRG; PAM sequence: CAG
aacttaaaagtatagcaatt

SEQ ID NO: 64764 - DNA, 20 bp, Artificial Sequence
  Description of Artificial Sequence: Synthetic oligonucleotide
  Target: ATXN1; (-) strand; PAM type: NRG; PAM sequence: TAG
aagtagttaacttaaaagta

SEQ ID NO: 64765 - DNA, 20 bp, Artificial Sequence
  Description of Artificial Sequence: Synthetic oligonucleotide
  Target: ATXN1; (-) strand; PAM type: NRG; PAM sequence: AAG
ttgagaagtagttaacttaa

SEQ ID NO: 64766 - DNA, 20 bp, Artificial Sequence
  Description of Artificial Sequence: Synthetic oligonucleotide
  Target: ATXN1; (-) strand; PAM type: NRG; PAM sequence: TAG
ttaaacagcactttgagaag

SEQ ID NO: 64767 - DNA, 20 bp, Artificial Sequence
  Description of Artificial Sequence: Synthetic oligonucleotide
  Target: ATXN1; (-) strand; PAM type: NRG; PAM sequence: AAG
tttttaaacagcactttgag

SEQ ID NO: 64768 - DNA, 20 bp, Artificial Sequence
  Description of Artificial Sequence: Synthetic oligonucleotide
  Target: ATXN1; (-) strand; PAM type: NRG; PAM sequence: GAG
cagtttttaaacagcacttt

SEQ ID NO: 64769 - DNA, 20 bp, Artificial Sequence
  Description of Artificial Sequence: Synthetic oligonucleotide
  Target: ATXN1; (-) strand; PAM type: NRG; PAM sequence: CAG
tgaagatgtcagtttttaaa

SEQ ID NO: 64770 - DNA, 20 bp, Artificial Sequence
  Description of Artificial Sequence: Synthetic oligonucleotide
  Target: ATXN1; (-) strand; PAM type: NRG; PAM sequence: CAG
tgaaatgtggttgaagatgt

SEQ ID NO: 64771 - DNA, 20 bp, Artificial Sequence
  Description of Artificial Sequence: Synthetic oligonucleotide
  Target: ATXN1; (-) strand; PAM type: NRG; PAM sequence: AAG
ctaagcctgaaatgtggttg

SEQ ID NO: 64772 - DNA, 20 bp, Artificial Sequence
  Description of Artificial Sequence: Synthetic oligonucleotide
  Target: ATXN1; (-) strand; PAM type: NRG; PAM sequence: TGG
tagattctaagcctgaaatg

SEQ ID NO: 64773 - DNA, 20 bp, Artificial Sequence
  Description of Artificial Sequence: Synthetic oligonucleotide
  Target: ATXN1; (-) strand; PAM type: NRG; PAM sequence: AAG
tgcaaatttagatagattct

SEQ ID NO: 64774 - DNA, 20 bp, Artificial Sequence
  Description of Artificial Sequence: Synthetic oligonucleotide
  Target: ATXN1; (-) strand; PAM type: NRG; PAM sequence: TAG
tgaaactttgcaaatttaga

SEQ ID NO: 64775 - DNA, 20 bp, Artificial Sequence
  Description of Artificial Sequence: Synthetic oligonucleotide
  Target: ATXN1; (-) strand; PAM type: NRG; PAM sequence: TAG
ccaatgaaactttgcaaatt

SEQ ID NO: 64776 - DNA, 20 bp, Artificial Sequence
  Description of Artificial Sequence: Synthetic oligonucleotide
  Target: ATXN1; (-) strand; PAM type: NRG; PAM sequence: AAG
tttttaagtagcactttcat

SEQ ID NO: 64777 - DNA, 20 bp, Artificial Sequence
  Description of Artificial Sequence: Synthetic oligonucleotide
  Target: ATXN1; (-) strand; PAM type: NRG; PAM sequence: TAG
gtcaagtgtatttttttaag

SEQ ID NO: 64778 - DNA, 20 bp, Artificial Sequence
  Description of Artificial Sequence: Synthetic oligonucleotide
  Target: ATXN1; (-) strand; PAM type: NRG; PAM sequence: AAG
gctgtcaagtgtattttttt

SEQ ID NO: 64779 - DNA, 20 bp, Artificial Sequence
  Description of Artificial Sequence: Synthetic oligonucleotide
  Target: ATXN1; (-) strand; PAM type: NRG; PAM sequence: AAG
ttttcaagagattggctgtc

SEQ ID NO: 64780 - DNA, 20 bp, Artificial Sequence
  Description of Artificial Sequence: Synthetic oligonucleotide
  Target: ATXN1; (-) strand; PAM type: NRG; PAM sequence: TGG
acaaatcattttcaagagat

SEQ ID NO: 64781 - DNA, 20 bp, Artificial Sequence
  Description of Artificial Sequence: Synthetic oligonucleotide
  Target: ATXN1; (-) strand; PAM type: NRG; PAM sequence: GAG
tctgcacaaatcattttcaa

SEQ ID NO: 64782 - DNA, 20 bp, Artificial Sequence
  Description of Artificial Sequence: Synthetic oligonucleotide
  Target: ATXN1; (-) strand; PAM type: NRG; PAM sequence: AAG
tttctgcacaaatcattttc

SEQ ID NO: 64783 - DNA, 20 bp, Artificial Sequence
  Description of Artificial Sequence: Synthetic oligonucleotide
  Target: ATXN1; (-) strand; PAM type: NRG; PAM sequence: AAG
ctcttaaatgtcttgatata

SEQ ID NO: 64784 - DNA, 20 bp, Artificial Sequence
  Description of Artificial Sequence: Synthetic oligonucleotide
  Target: ATXN1; (-) strand; PAM type: NRG; PAM sequence: AAG
attatttttagcctattaca

SEQ ID NO: 64785 - DNA, 20 bp, Artificial Sequence
  Description of Artificial Sequence: Synthetic oligonucleotide
  Target: ATXN1; (-) strand; PAM type: NRG; PAM sequence: TAG
ataaaggatatcattatttt

SEQ ID NO: 64786 - DNA, 20 bp, Artificial Sequence
  Description of Artificial Sequence: Synthetic oligonucleotide
  Target: ATXN1; (-) strand; PAM type: NRG; PAM sequence: AGG
acatgttcagttgaagataa

SEQ ID NO: 64787 - DNA, 20 bp, Artificial Sequence
  Description of Artificial Sequence: Synthetic oligonucleotide
  Target: ATXN1; (-) strand; PAM type: NRG; PAM sequence: AAG
tacatgttcagttgaagata

SEQ ID NO: 64788 - DNA, 20 bp, Artificial Sequence
  Description of Artificial Sequence: Synthetic oligonucleotide
  Target: ATXN1; (-) strand; PAM type: NRG; PAM sequence: AAG
catatgtacatgttcagttg

SEQ ID NO: 64789 - DNA, 20 bp, Artificial Sequence
  Description of Artificial Sequence: Synthetic oligonucleotide
  Target: ATXN1; (-) strand; PAM type: NRG; PAM sequence: CAG
atacagcatatgtacatgtt

SEQ ID NO: 64790 - DNA, 20 bp, Artificial Sequence
  Description of Artificial Sequence: Synthetic oligonucleotide
  Target: ATXN1; (-) strand; PAM type: NRG; PAM sequence: CAG
tttaaatgcaacagcttata

SEQ ID NO: 64791 - DNA, 20 bp, Artificial Sequence
  Description of Artificial Sequence: Synthetic oligonucleotide
  Target: ATXN1; (-) strand; PAM type: NRG; PAM sequence: CAG
ttcaatttgtttaaatgcaa

SEQ ID NO: 64792 - DNA, 20 bp, Artificial Sequence
  Description of Artificial Sequence: Synthetic oligonucleotide
  Target: ATXN1; (-) strand; PAM type: NRG; PAM sequence: CAG
gtttctttacggtctatagc

SEQ ID NO: 64793 - DNA, 20 bp, Artificial Sequence
  Description of Artificial Sequence: Synthetic oligonucleotide
  Target: ATXN1; (-) strand; PAM type: NRG; PAM sequence: TAG
ttttgtttctttacggtcta

SEQ ID NO: 64794 - DNA, 20 bp, Artificial Sequence
  Description of Artificial Sequence: Synthetic oligonucleotide
  Target: ATXN1; (-) strand; PAM type: NRG; PAM sequence: CGG
gggcaagttttgtttcttta

SEQ ID NO: 64795 - DNA, 20 bp, Artificial Sequence
  Description of Artificial Sequence: Synthetic oligonucleotide
  Target: ATXN1; (-) strand; PAM type: NRG; PAM sequence: AAG
cttaaaatgatattctgggc

SEQ ID NO: 64796 - DNA, 20 bp, Artificial Sequence
  Description of Artificial Sequence: Synthetic oligonucleotide
  Target: ATXN1; (-) strand; PAM type: NRG; PAM sequence: GGG
aatgcttaaaatgatattct

SEQ ID NO: 64797 - DNA, 20 bp, Artificial Sequence
  Description of Artificial Sequence: Synthetic oligonucleotide
  Target: ATXN1; (-) strand; PAM type: NRG; PAM sequence: TGG
taatgcttaaaatgatattc

SEQ ID NO: 64798 - DNA, 20 bp, Artificial Sequence
  Description of Artificial Sequence: Synthetic oligonucleotide
  Target: ATXN1; (-) strand; PAM type: NRG; PAM sequence: CAG
ttgaactttgtgggaaatag

SEQ ID NO: 64799 - DNA, 20 bp, Artificial Sequence
  Description of Artificial Sequence: Synthetic oligonucleotide
  Target: ATXN1; (-) strand; PAM type: NRG; PAM sequence: TAG
ggattgaactttgtgggaaa

SEQ ID NO: 64800 - DNA, 20 bp, Artificial Sequence
  Description of Artificial Sequence: Synthetic oligonucleotide
  Target: ATXN1; (-) strand; PAM type: NRG; PAM sequence: GGG
tatgtaggattgaactttgt

SEQ ID NO: 64801 - DNA, 20 bp, Artificial Sequence
  Description of Artificial Sequence: Synthetic oligonucleotide
  Target: ATXN1; (-) strand; PAM type: NRG; PAM sequence: TGG
gtatgtaggattgaactttg

SEQ ID NO: 64802 - DNA, 20 bp, Artificial Sequence
  Description of Artificial Sequence: Synthetic oligonucleotide
  Target: ATXN1; (-) strand; PAM type: NRG; PAM sequence: AGG
acaattccgattctgtatgt

SEQ ID NO: 64803 - DNA, 20 bp, Artificial Sequence
  Description of Artificial Sequence: Synthetic oligonucleotide
  Target: ATXN1; (-) strand; PAM type: NRG; PAM sequence: TAG
gacaattccgattctgtatg

SEQ ID NO: 64804 - DNA, 20 bp, Artificial Sequence
  Description of Artificial Sequence: Synthetic oligonucleotide
  Target: ATXN1; (-) strand; PAM type: NRG; PAM sequence: TGG
ataatttgatgctttggacc

SEQ ID NO: 64805 - DNA, 20 bp, Artificial Sequence
  Description of Artificial Sequence: Synthetic oligonucleotide
  Target: ATXN1; (-) strand; PAM type: NRG; PAM sequence: TGG
ggttttataatttgatgctt

SEQ ID NO: 64806 - DNA, 20 bp, Artificial Sequence
  Description of Artificial Sequence: Synthetic oligonucleotide
  Target: ATXN1; (-) strand; PAM type: NRG; PAM sequence: AGG
ttgtctatttctgagacatc

SEQ ID NO: 64807 - DNA, 20 bp, Artificial Sequence
  Description of Artificial Sequence: Synthetic oligonucleotide
  Target: ATXN1; (-) strand; PAM type: NRG; PAM sequence: CAG
cttgtctatttctgagacat

SEQ ID NO: 64808 - DNA, 20 bp, Artificial Sequence
  Description of Artificial Sequence: Synthetic oligonucleotide
  Target: ATXN1; (-) strand; PAM type: NRG; PAM sequence: GAG
gagttttcttgtctatttct

SEQ ID NO: 64809 - DNA, 20 bp, Artificial Sequence
  Description of Artificial Sequence: Synthetic oligonucleotide
  Target: ATXN1; (-) strand; PAM type: NRG; PAM sequence: GAG
ctgtaataattattttttct

SEQ ID NO: 64810 - DNA, 20 bp, Artificial Sequence
  Description of Artificial Sequence: Synthetic oligonucleotide
  Target: ATXN1; (-) strand; PAM type: NRG; PAM sequence: TGG
cacttttctttgtgtgcgat

SEQ ID NO: 64811 - DNA, 20 bp, Artificial Sequence
  Description of Artificial Sequence: Synthetic oligonucleotide
  Target: ATXN1; (-) strand; PAM type: NRG; PAM sequence: TAG
agtaactcaaaaggaatttg

SEQ ID NO: 64812 - DNA, 20 bp, Artificial Sequence
  Description of Artificial Sequence: Synthetic oligonucleotide
  Target: ATXN1; (-) strand; PAM type: NRG; PAM sequence: AGG
atgttgcccagtaactcaaa

SEQ ID NO: 64813 - DNA, 20 bp, Artificial Sequence
  Description of Artificial Sequence: Synthetic oligonucleotide
  Target: ATXN1; (-) strand; PAM type: NRG; PAM sequence: AAG
aatgttgcccagtaactcaa

SEQ ID NO: 64814 - DNA, 20 bp, Artificial Sequence
  Description of Artificial Sequence: Synthetic oligonucleotide
  Target: ATXN1; (-) strand; PAM type: NRG; PAM sequence: CAG
cacttaaatagaatgttgcc

SEQ ID NO: 64815 - DNA, 20 bp, Artificial Sequence
  Description of Artificial Sequence: Synthetic oligonucleotide
  Target: ATXN1; (-) strand; PAM type: NRG; PAM sequence: TAG
gtcataagggtccacttaaa

SEQ ID NO: 64816 - DNA, 20 bp, Artificial Sequence
  Description of Artificial Sequence: Synthetic oligonucleotide
  Target: ATXN1; (-) strand; PAM type: NRG; PAM sequence: GGG
tcattatactactgtcataa

SEQ ID NO: 64817 - DNA, 20 bp, Artificial Sequence
  Description of Artificial Sequence: Synthetic oligonucleotide
  Target: ATXN1; (-) strand; PAM type: NRG; PAM sequence: AGG
ttcattatactactgtcata

SEQ ID NO: 64818 - DNA, 20 bp, Artificial Sequence
  Description of Artificial Sequence: Synthetic oligonucleotide
  Target: ATXN1; (-) strand; PAM type: NRG; PAM sequence: AAG
tttcattatactactgtcat

SEQ ID NO: 64819 - DNA, 20 bp, Artificial Sequence
  Description of Artificial Sequence: Synthetic oligonucleotide
  Target: ATXN1; (-) strand; PAM type: NRG; PAM sequence: GGG
tgttttagggctatgactta

SEQ ID NO: 64820 - DNA, 20 bp, Artificial Sequence
  Description of Artificial Sequence: Synthetic oligonucleotide
  Target: ATXN1; (-) strand; PAM type: NRG; PAM sequence: AGG
ttgttttagggctatgactt

SEQ ID NO: 64821 - DNA, 20 bp, Artificial Sequence
  Description of Artificial Sequence: Synthetic oligonucleotide
  Target: ATXN1; (-) strand; PAM type: NRG; PAM sequence: TAG
attgttttagggctatgact

SEQ ID NO: 64822 - DNA, 20 bp, Artificial Sequence
  Description of Artificial Sequence: Synthetic oligonucleotide
  Target: ATXN1; (-) strand; PAM type: NRG; PAM sequence: GGG
gttcagtgggaattgtttta

SEQ ID NO: 64823 - DNA, 20 bp, Artificial Sequence
  Description of Artificial Sequence: Synthetic oligonucleotide
  Target: ATXN1; (-) strand; PAM type: NRG; PAM sequence: AGG
tgttcagtgggaattgtttt

SEQ ID NO: 64824 - DNA, 20 bp, Artificial Sequence
  Description of Artificial Sequence: Synthetic oligonucleotide
  Target: ATXN1; (-) strand; PAM type: NRG; PAM sequence: TAG
atgttcagtgggaattgttt

SEQ ID NO: 64825 - DNA, 20 bp, Artificial Sequence
  Description of Artificial Sequence: Synthetic oligonucleotide
  Target: ATXN1; (-) strand; PAM type: NRG; PAM sequence: GGG
cattcaatgaaatgttcagt

SEQ ID NO: 64826 - DNA, 20 bp, Artificial Sequence
  Description of Artificial Sequence: Synthetic oligonucleotide
  Target: ATXN1; (-) strand; PAM type: NRG; PAM sequence: TGG
gcattcaatgaaatgttcag

SEQ ID NO: 64827 - DNA, 20 bp, Artificial Sequence
  Description of Artificial Sequence: Synthetic oligonucleotide
  Target: ATXN1; (-) strand; PAM type: NRG; PAM sequence: CAG
taagcattcaatgaaatgtt

SEQ ID NO: 64828 - DNA, 20 bp, Artificial Sequence
  Description of Artificial Sequence: Synthetic oligonucleotide
  Target: ATXN1; (-) strand; PAM type: NRG; PAM sequence: AAG
cacagtactttgcacatact

SEQ ID NO: 64829 - DNA, 20 bp, Artificial Sequence
  Description of Artificial Sequence: Synthetic oligonucleotide
  Target: ATXN1; (-) strand; PAM type: NRG; PAM sequence: CAG
catttctgaacctcacctca

SEQ ID NO: 64830 - DNA, 20 bp, Artificial Sequence
  Description of Artificial Sequence: Synthetic oligonucleotide
  Target: ATXN1; (-) strand; PAM type: NRG; PAM sequence: AAG
aaatcaatattctgcattca

SEQ ID NO: 64831 - DNA, 20 bp, Artificial Sequence
  Description of Artificial Sequence: Synthetic oligonucleotide
  Target: ATXN1; (-) strand; PAM type: NRG; PAM sequence: TAG
atagttggtgacgattagct

SEQ ID NO: 64832 - DNA, 20 bp, Artificial Sequence
  Description of Artificial Sequence: Synthetic oligonucleotide
  Target: ATXN1; (-) strand; PAM type: NRG; PAM sequence: TAG
ttattatagttggtgacgat

SEQ ID NO: 64833 - DNA, 20 bp, Artificial Sequence
  Description of Artificial Sequence: Synthetic oligonucleotide
  Target: ATXN1; (-) strand; PAM type: NRG; PAM sequence: TGG
tcataaaaaattattatagt

SEQ ID NO: 64834 - DNA, 20 bp, Artificial Sequence
  Description of Artificial Sequence: Synthetic oligonucleotide
  Target: ATXN1; (-) strand; PAM type: NRG; PAM sequence: TAG
ggaatcataaaaaattatta

SEQ ID NO: 64835 - DNA, 20 bp, Artificial Sequence
  Description of Artificial Sequence: Synthetic oligonucleotide
  Target: ATXN1; (-) strand; PAM type: NRG; PAM sequence: AGG
aatcattgctgttggcaatg

SEQ ID NO: 64836 - DNA, 20 bp, Artificial Sequence
  Description of Artificial Sequence: Synthetic oligonucleotide
  Target: ATXN1; (-) strand; PAM type: NRG; PAM sequence: GAG
aaatcattgctgttggcaat

SEQ ID NO: 64837 - DNA, 20 bp, Artificial Sequence
  Description of Artificial Sequence: Synthetic oligonucleotide
  Target: ATXN1; (-) strand; PAM type: NRG; PAM sequence: TGG
catttgaaaatcattgctgt

SEQ ID NO: 64838 - DNA, 20 bp, Artificial Sequence
  Description of Artificial Sequence: Synthetic oligonucleotide
  Target: ATXN1; (-) strand; PAM type: NRG; PAM sequence: TGG
tttgtttgaaggcagagttc

SEQ ID NO: 64839 - DNA, 20 bp, Artificial Sequence
  Description of Artificial Sequence: Synthetic oligonucleotide
  Target: ATXN1; (-) strand; PAM type: NRG; PAM sequence: GAG
taagattttgtttgaaggca

SEQ ID NO: 64840 - DNA, 20 bp, Artificial Sequence
  Description of Artificial Sequence: Synthetic oligonucleotide
  Target: ATXN1; (-) strand; PAM type: NRG; PAM sequence: CAG
tataagattttgtttgaagg

SEQ ID NO: 64841 - DNA, 20 bp, Artificial Sequence
  Description of Artificial Sequence: Synthetic oligonucleotide
  Target: ATXN1; (-) strand; PAM type: NRG; PAM sequence: AGG
ctatataagattttgtttga

SEQ ID NO: 64842 - DNA, 20 bp, Artificial Sequence
  Description of Artificial Sequence: Synthetic oligonucleotide
  Target: ATXN1; (-) strand; PAM type: NRG; PAM sequence: AAG
tctatataagattttgtttg

SEQ ID NO: 64843 - DNA, 20 bp, Artificial Sequence
  Description of Artificial Sequence: Synthetic oligonucleotide
  Target: ATXN1; (-) strand; PAM type: NRG; PAM sequence: AAG
tgtgtattagatttctatat

SEQ ID NO: 64844 - DNA, 20 bp, Artificial Sequence
  Description of Artificial Sequence: Synthetic oligonucleotide
  Target: ATXN1; (-) strand; PAM type: NRG; PAM sequence: TAG
attttatttatcttgtgtat

SEQ ID NO: 64845 - DNA, 20 bp, Artificial Sequence
  Description of Artificial Sequence: Synthetic oligonucleotide
  Target: ATXN1; (-) strand; PAM type: NRG; PAM sequence: TAG
ataaaactagatagtgtaag

SEQ ID NO: 64846 - DNA, 20 bp, Artificial Sequence
  Description of Artificial Sequence: Synthetic oligonucleotide
  Target: ATXN1; (-) strand; PAM type: NRG; PAM sequence: AAG
ccgataaaactagatagtgt

SEQ ID NO: 64847 - DNA, 20 bp, Artificial Sequence
  Description of Artificial Sequence: Synthetic oligonucleotide
  Target: ATXN1; (-) strand; PAM type: NRG; PAM sequence: TAG
gaggaaccgataaaactaga

SEQ ID NO: 64848 - DNA, 20 bp, Artificial Sequence
  Description of Artificial Sequence: Synthetic oligonucleotide
  Target: ATXN1; (-) strand; PAM type: NRG; PAM sequence: TAG
gtaggaggaaccgataaaac

SEQ ID NO: 64849 - DNA, 20 bp, Artificial Sequence
  Description of Artificial Sequence: Synthetic oligonucleotide
  Target: ATXN1; (-) strand; PAM type: NRG; PAM sequence: AGG
ggtgatggatgaggagtagg

SEQ ID NO: 64850 - DNA, 20 bp, Artificial Sequence
  Description of Artificial Sequence: Synthetic oligonucleotide
  Target: ATXN1; (-) strand; PAM type: NRG; PAM sequence: GAG
tggtgatggatgaggagtag

SEQ ID NO: 64851 - DNA, 20 bp, Artificial Sequence
  Description of Artificial Sequence: Synthetic oligonucleotide
  Target: ATXN1; (-) strand; PAM type: NRG; PAM sequence: AGG
ggtggtgatggatgaggagt

SEQ ID NO: 64852 - DNA, 20 bp, Artificial Sequence
  Description of Artificial Sequence: Synthetic oligonucleotide
  Target: ATXN1; (-) strand; PAM type: NRG; PAM sequence: TAG
tggtggtgatggatgaggag

SEQ ID NO: 64853 - DNA, 20 bp, Artificial Sequence
  Description of Artificial Sequence: Synthetic oligonucleotide
  Target: ATXN1; (-) strand; PAM type: NRG; PAM sequence: GAG
acttggtggtgatggatgag

SEQ ID NO: 64854 - DNA, 20 bp, Artificial Sequence
  Description of Artificial Sequence: Synthetic oligonucleotide
  Target: ATXN1; (-) strand; PAM type: NRG; PAM sequence: AGG
gtacttggtggtgatggatg

SEQ ID NO: 64855 - DNA, 20 bp, Artificial Sequence
  Description of Artificial Sequence: Synthetic oligonucleotide
  Target: ATXN1; (-) strand; PAM type: NRG; PAM sequence: GAG
agtacttggtggtgatggat

SEQ ID NO: 64856 - DNA, 20 bp, Artificial Sequence
  Description of Artificial Sequence: Synthetic oligonucleotide
  Target: ATXN1; (-) strand; PAM type: NRG; PAM sequence: TGG
tcagaagtacttggtggtga

SEQ ID NO: 64857 - DNA, 20 bp, Artificial Sequence
  Description of Artificial Sequence: Synthetic oligonucleotide
  Target: ATXN1; (-) strand; PAM type: NRG; PAM sequence: TGG
ctgccttcagaagtacttgg

SEQ ID NO: 64858 - DNA, 20 bp, Artificial Sequence
  Description of Artificial Sequence: Synthetic oligonucleotide
  Target: ATXN1; (-) strand; PAM type: NRG; PAM sequence: TGG
gggctgccttcagaagtact

SEQ ID NO: 64859 - DNA, 20 bp, Artificial Sequence
  Description of Artificial Sequence: Synthetic oligonucleotide
  Target: ATXN1; (-) strand; PAM type: NRG; PAM sequence: AAG
ctctgtggggctgccttcag

SEQ ID NO: 64860 - DNA, 20 bp, Artificial Sequence
  Description of Artificial Sequence: Synthetic oligonucleotide
  Target: ATXN1; (-) strand; PAM type: NRG; PAM sequence: CAG
aacctctgtggggctgcctt

SEQ ID NO: 64861 - DNA, 20 bp, Artificial Sequence
  Description of Artificial Sequence: Synthetic oligonucleotide
  Target: ATXN1; (-) strand; PAM type: NRG; PAM sequence: GGG
ctgccctgtgaacctctgtg

SEQ ID NO: 64862 - DNA, 20 bp, Artificial Sequence
  Description of Artificial Sequence: Synthetic oligonucleotide
  Target: ATXN1; (-) strand; PAM type: NRG; PAM sequence: GGG
tctgccctgtgaacctctgt

SEQ ID NO: 64863 - DNA, 20 bp, Artificial Sequence
  Description of Artificial Sequence: Synthetic oligonucleotide
  Target: ATXN1; (-) strand; PAM type: NRG; PAM sequence: TGG
ctctgccctgtgaacctctg

SEQ ID NO: 64864 - DNA, 20 bp, Artificial Sequence
  Description of Artificial Sequence: Synthetic oligonucleotide
  Target: ATXN1; (-) strand; PAM type: NRG; PAM sequence: CAG
ccagtagcctgaggatttct

SEQ ID NO: 64865 - DNA, 20 bp, Artificial Sequence
  Description of Artificial Sequence: Synthetic oligonucleotide
  Target: ATXN1; (-) strand; PAM type: NRG; PAM sequence: AGG
ccacattctccagtagcctg

SEQ ID NO: 64866 - DNA, 20 bp, Artificial Sequence
  Description of Artificial Sequence: Synthetic oligonucleotide
  Target: ATXN1; (-) strand; PAM type: NRG; PAM sequence: GAG
accacattctccagtagcct

SEQ ID NO: 64867 - DNA, 20 bp, Artificial Sequence
  Description of Artificial Sequence: Synthetic oligonucleotide
  Target: ATXN1; (-) strand; PAM type: NRG; PAM sequence: TAG
ggtcagaccacattctccag

SEQ ID NO: 64868 - DNA, 20 bp, Artificial Sequence
  Description of Artificial Sequence: Synthetic oligonucleotide
  Target: ATXN1; (-) strand; PAM type: NRG; PAM sequence: CAG
ggaggtcagaccacattctc

SEQ ID NO: 64869 - DNA, 20 bp, Artificial Sequence
  Description of Artificial Sequence: Synthetic oligonucleotide
  Target: ATXN1; (-) strand; PAM type: NRG; PAM sequence: CAG
ctcctcagctcggtggaggt

SEQ ID NO: 64870 - DNA, 20 bp, Artificial Sequence
  Description of Artificial Sequence: Synthetic oligonucleotide
  Target: ATXN1; (-) strand; PAM type: NRG; PAM sequence: AGG
cagactcctcagctcggtgg

SEQ ID NO: 64871 - DNA, 20 bp, Artificial Sequence
  Description of Artificial Sequence: Synthetic oligonucleotide
  Target: ATXN1; (-) strand; PAM type: NRG; PAM sequence: GAG
acagactcctcagctcggtg

SEQ ID NO: 64872 - DNA, 20 bp, Artificial Sequence
  Description of Artificial Sequence: Synthetic oligonucleotide
  Target: ATXN1; (-) strand; PAM type: NRG; PAM sequence: TGG
gtacagactcctcagctcgg

SEQ ID NO: 64873 - DNA, 20 bp, Artificial Sequence
  Description of Artificial Sequence: Synthetic oligonucleotide
  Target: ATXN1; (-) strand; PAM type: NRG; PAM sequence: CGG
ggagtacagactcctcagct

SEQ ID NO: 64874 - DNA, 20 bp, Artificial Sequence
  Description of Artificial Sequence: Synthetic oligonucleotide
  Target: ATXN1; (-) strand; PAM type: NRG; PAM sequence: CAG
gttaaggagtacagactcct

SEQ ID NO: 64875 - DNA, 20 bp, Artificial Sequence
  Description of Artificial Sequence: Synthetic oligonucleotide
  Target: ATXN1; (-) strand; PAM type: NRG; PAM sequence: CAG
ataggccatgttaaggagta

SEQ ID NO: 64876 - DNA, 20 bp, Artificial Sequence
  Description of Artificial Sequence: Synthetic oligonucleotide
  Target: ATXN1; (-) strand; PAM type: NRG; PAM sequence: GAG
gtctcataggccatgttaag

SEQ ID NO: 64877 - DNA, 20 bp, Artificial Sequence
  Description of Artificial Sequence: Synthetic oligonucleotide
  Target: ATXN1; (-) strand; PAM type: NRG; PAM sequence: AGG
gggtctcataggccatgtta

SEQ ID NO: 64878 - DNA, 20 bp, Artificial Sequence
  Description of Artificial Sequence: Synthetic oligonucleotide
  Target: ATXN1; (-) strand; PAM type: NRG; PAM sequence: AAG
agggtctcataggccatgtt

SEQ ID NO: 64879 - DNA, 20 bp, Artificial Sequence
  Description of Artificial Sequence: Synthetic oligonucleotide
  Target: ATXN1; (-) strand; PAM type: NRG; PAM sequence: AGG
caaaccatagagggtctcat

SEQ ID NO: 64880 - DNA, 20 bp, Artificial Sequence
  Description of Artificial Sequence: Synthetic oligonucleotide
  Target: ATXN1; (-) strand; PAM type: NRG; PAM sequence: TAG
gcaaaccatagagggtctca

SEQ ID NO: 64881 - DNA, 20 bp, Artificial Sequence
  Description of Artificial Sequence: Synthetic oligonucleotide
  Target: ATXN1; (-) strand; PAM type: NRG; PAM sequence: GGG
ggccaggagcaaaccataga

SEQ ID NO: 64882 - DNA, 20 bp, Artificial Sequence
  Description of Artificial Sequence: Synthetic oligonucleotide
  Target: ATXN1; (-) strand; PAM type: NRG; PAM sequence: AGG
aggccaggagcaaaccatag

SEQ ID NO: 64883 - DNA, 20 bp, Artificial Sequence
  Description of Artificial Sequence: Synthetic oligonucleotide
  Target: ATXN1; (-) strand; PAM type: NRG; PAM sequence: GAG
gaggccaggagcaaaccata

SEQ ID NO: 64884 - DNA, 20 bp, Artificial Sequence
  Description of Artificial Sequence: Synthetic oligonucleotide
  Target: ATXN1; (-) strand; PAM type: NRG; PAM sequence: TAG
atgaggccaggagcaaacca

SEQ ID NO: 64885 - DNA, 20 bp, Artificial Sequence
  Description of Artificial Sequence: Synthetic oligonucleotide
  Target: ATXN1; (-) strand; PAM type: NRG; PAM sequence: GAG
gtaacttgtcatgaggccag

SEQ ID NO: 64886 - DNA, 20 bp, Artificial Sequence
  Description of Artificial Sequence: Synthetic oligonucleotide
  Target: ATXN1; (-) strand; PAM type: NRG; PAM sequence: AGG
tggtaacttgtcatgaggcc

SEQ ID NO: 64887 - DNA, 20 bp, Artificial Sequence
  Description of Artificial Sequence: Synthetic oligonucleotide
  Target: ATXN1; (-) strand; PAM type: NRG; PAM sequence: CAG
gtggtaacttgtcatgaggc

SEQ ID NO: 64888 - DNA, 20 bp, Artificial Sequence
  Description of Artificial Sequence: Synthetic oligonucleotide
  Target: ATXN1; (-) strand; PAM type: NRG; PAM sequence: AGG
attggtggtaacttgtcatg

SEQ ID NO: 64889 - DNA, 20 bp, Artificial Sequence
  Description of Artificial Sequence: Synthetic oligonucleotide
  Target: ATXN1; (-) strand; PAM type: NRG; PAM sequence: GAG
cattggtggtaacttgtcat

SEQ ID NO: 64890 - DNA, 20 bp, Artificial Sequence
  Description of Artificial Sequence: Synthetic oligonucleotide
  Target: ATXN1; (-) strand; PAM type: NRG; PAM sequence: TGG
aacagtcagtactccattgg

SEQ ID NO: 64891 - DNA, 20 bp, Artificial Sequence
  Description of Artificial Sequence: Synthetic oligonucleotide
  Target: ATXN1; (-) strand; PAM type: NRG; PAM sequence: TGG
gggaacagtcagtactccat

SEQ ID NO: 64892 - DNA, 20 bp, Artificial Sequence
  Description of Artificial Sequence: Synthetic oligonucleotide
  Target: ATXN1; (-) strand; PAM type: NRG; PAM sequence: CAG
cagtgtgtgcagggaacagt

SEQ ID NO: 64893 - DNA, 20 bp, Artificial Sequence
  Description of Artificial Sequence: Synthetic oligonucleotide
  Target: ATXN1; (-) strand; PAM type: NRG; PAM sequence: CAG
ggtgcagtgtgtgcagggaa

SEQ ID NO: 64894 - DNA, 20 bp, Artificial Sequence
  Description of Artificial Sequence: Synthetic oligonucleotide
  Target: ATXN1; (-) strand; PAM type: NRG; PAM sequence: GGG
agcatggtgcagtgtgtgca

SEQ ID NO: 64895 - DNA, 20 bp, Artificial Sequence
  Description of Artificial Sequence: Synthetic oligonucleotide
  Target: ATXN1; (-) strand; PAM type: NRG; PAM sequence: AGG
cagcatggtgcagtgtgtgc

SEQ ID NO: 64896 - DNA, 20 bp, Artificial Sequence
  Description of Artificial Sequence: Synthetic oligonucleotide
  Target: ATXN1; (-) strand; PAM type: NRG; PAM sequence: CAG
acagcatggtgcagtgtgtg

SEQ ID NO: 64897 - DNA, 20 bp, Artificial Sequence
  Description of Artificial Sequence: Synthetic oligonucleotide
  Target: ATXN1; (-) strand; PAM type: NRG; PAM sequence: CAG
agggaacaaacagcatggtg

SEQ ID NO: 64898 - DNA, 20 bp, Artificial Sequence
  Description of Artificial Sequence: Synthetic oligonucleotide
  Target: ATXN1; (-) strand; PAM type: NRG; PAM sequence: TGG
agcacagggaacaaacagca

SEQ ID NO: 64899 - DNA, 20 bp, Artificial Sequence
  Description of Artificial Sequence: Synthetic oligonucleotide
  Target: ATXN1; (-) strand; PAM type: NRG; PAM sequence: CAG
gacaaagcacagggaacaaa

SEQ ID NO: 64900 - DNA, 20 bp, Artificial Sequence
  Description of Artificial Sequence: Synthetic oligonucleotide
  Target: ATXN1; (-) strand; PAM type: NRG; PAM sequence: GGG
gacagcatggacaaagcaca

SEQ ID NO: 64901 - DNA, 20 bp, Artificial Sequence
  Description of Artificial Sequence: Synthetic oligonucleotide
  Target: ATXN1; (-) strand; PAM type: NRG; PAM sequence: AGG
ggacagcatggacaaagcac

SEQ ID NO: 64902 - DNA, 20 bp, Artificial Sequence
  Description of Artificial Sequence: Synthetic oligonucleotide
  Target: ATXN1; (-) strand; PAM type: NRG; PAM sequence: CAG
gggacagcatggacaaagca

SEQ ID NO: 64903 - DNA, 20 bp, Artificial Sequence
  Description of Artificial Sequence: Synthetic oligonucleotide
  Target: ATXN1; (-) strand; PAM type: NRG; PAM sequence: AAG
gccaagggacagcatggaca

SEQ ID NO: 64904 - DNA, 20 bp, Artificial Sequence
  Description of Artificial Sequence: Synthetic oligonucleotide
  Target: ATXN1; (-) strand; PAM type: NRG; PAM sequence: TGG
tcacctgccaagggacagca

SEQ ID NO: 64905 - DNA, 20 bp, Artificial Sequence
  Description of Artificial Sequence: Synthetic oligonucleotide
  Target: ATXN1; (-) strand; PAM type: NRG; PAM sequence: CAG
agagatcacctgccaaggga

SEQ ID NO: 64906 - DNA, 20 bp, Artificial Sequence
  Description of Artificial Sequence: Synthetic oligonucleotide
  Target: ATXN1; (-) strand; PAM type: NRG; PAM sequence: GGG
ataaagagatcacctgccaa

SEQ ID NO: 64907 - DNA, 20 bp, Artificial Sequence
  Description of Artificial Sequence: Synthetic oligonucleotide
  Target: ATXN1; (-) strand; PAM type: NRG; PAM sequence: AGG
cataaagagatcacctgcca

SEQ ID NO: 64908 - DNA, 20 bp, Artificial Sequence
  Description of Artificial Sequence: Synthetic oligonucleotide
  Target: ATXN1; (-) strand; PAM type: NRG; PAM sequence: AAG
acataaagagatcacctgcc

SEQ ID NO: 64909 - DNA, 20 bp, Artificial Sequence
  Description of Artificial Sequence: Synthetic oligonucleotide
  Target: ATXN1; (-) strand; PAM type: NRG; PAM sequence: GAG
aaagagaagatggacataaa

SEQ ID NO: 64910 - DNA, 20 bp, Artificial Sequence
  Description of Artificial Sequence: Synthetic oligonucleotide
  Target: ATXN1; (-) strand; PAM type: NRG; PAM sequence: AAG
tcaaagagaagatggacata

SEQ ID NO: 64911 - DNA, 20 bp, Artificial Sequence
  Description of Artificial Sequence: Synthetic oligonucleotide
  Target: ATXN1; (-) strand; PAM type: NRG; PAM sequence: TGG
ggcatctgtcaaagagaaga

SEQ ID NO: 64912 - DNA, 20 bp, Artificial Sequence
  Description of Artificial Sequence: Synthetic oligonucleotide
  Target: ATXN1; (-) strand; PAM type: NRG; PAM sequence: AAG
tcttggcatctgtcaaagag

SEQ ID NO: 64913 - DNA, 20 bp, Artificial Sequence
  Description of Artificial Sequence: Synthetic oligonucleotide
  Target: ATXN1; (-) strand; PAM type: NRG; PAM sequence: GAG
gtgtcttggcatctgtcaaa

SEQ ID NO: 64914 - DNA, 20 bp, Artificial Sequence
  Description of Artificial Sequence: Synthetic oligonucleotide
  Target: ATXN1; (-) strand; PAM type: NRG; PAM sequence: AAG
gggtgtcttggcatctgtca

SEQ ID NO: 64915 - DNA, 20 bp, Artificial Sequence
  Description of Artificial Sequence: Synthetic oligonucleotide
  Target: ATXN1; (-) strand; PAM type: NRG; PAM sequence: TGG
tgcagagttgtggggtgtct

SEQ ID NO: 64916 - DNA, 20 bp, Artificial Sequence
  Description of Artificial Sequence: Synthetic oligonucleotide
  Target: ATXN1; (-) strand; PAM type: NRG; PAM sequence: GGG
tccagctgtgcagagttgtg

SEQ ID NO: 64917 - DNA, 20 bp, Artificial Sequence
  Description of Artificial Sequence: Synthetic oligonucleotide
  Target: ATXN1; (-) strand; PAM type: NRG; PAM sequence: GGG
gtccagctgtgcagagttgt

SEQ ID NO: 64918 - DNA, 20 bp, Artificial Sequence
  Description of Artificial Sequence: Synthetic oligonucleotide
  Target: ATXN1; (-) strand; PAM type: NRG; PAM sequence: TGG
tgtccagctgtgcagagttg

SEQ ID NO: 64919 - DNA, 20 bp, Artificial Sequence
  Description of Artificial Sequence: Synthetic oligonucleotide
  Target: ATXN1; (-) strand; PAM type: NRG; PAM sequence: GAG
agactgtgtccagctgtgca

SEQ ID NO: 64920 - DNA, 20 bp, Artificial Sequence
  Description of Artificial Sequence: Synthetic oligonucleotide
  Target: ATXN1; (-) strand; PAM type: NRG; PAM sequence: CAG
taagactgtgtccagctgtg

SEQ ID NO: 64921 - DNA, 20 bp, Artificial Sequence
  Description of Artificial Sequence: Synthetic oligonucleotide
  Target: ATXN1; (-) strand; PAM type: NRG; PAM sequence: CAG
tgtggagttaagactgtgtc

SEQ ID NO: 64922 - DNA, 20 bp, Artificial Sequence
  Description of Artificial Sequence: Synthetic oligonucleotide
  Target: ATXN1; (-) strand; PAM type: NRG; PAM sequence: AAG
atgaatgtgtatgtggagtt

SEQ ID NO: 64923 - DNA, 20 bp, Artificial Sequence
  Description of Artificial Sequence: Synthetic oligonucleotide
  Target: ATXN1; (-) strand; PAM type: NRG; PAM sequence: GAG
caaaaatgaatgtgtatgtg

SEQ ID NO: 64924 - DNA, 20 bp, Artificial Sequence
  Description of Artificial Sequence: Synthetic oligonucleotide
  Target: ATXN1; (-) strand; PAM type: NRG; PAM sequence: TGG
gccaaaaatgaatgtgtatg

SEQ ID NO: 64925 - DNA, 20 bp, Artificial Sequence
  Description of Artificial Sequence: Synthetic oligonucleotide
  Target: ATXN1; (-) strand; PAM type: NRG; PAM sequence: GAG
taattaccagccagcgtggt

SEQ ID NO: 64926 - DNA, 20 bp, Artificial Sequence
  Description of Artificial Sequence: Synthetic oligonucleotide
  Target: ATXN1; (-) strand; PAM type: NRG; PAM sequence: TGG
acaataattaccagccagcg

SEQ ID NO: 64927 - DNA, 20 bp, Artificial Sequence
  Description of Artificial Sequence: Synthetic oligonucleotide
  Target: ATXN1; (-) strand; PAM type: NRG; PAM sequence: CAG
tatgaacaataattaccagc

SEQ ID NO: 64928 - DNA, 20 bp, Artificial Sequence
  Description of Artificial Sequence: Synthetic oligonucleotide
  Target: ATXN1; (-) strand; PAM type: NRG; PAM sequence: CAG
gccatatgaacaataattac

SEQ ID NO: 64929 - DNA, 20 bp, Artificial Sequence
  Description of Artificial Sequence: Synthetic oligonucleotide
  Target: ATXN1; (-) strand; PAM type: NRG; PAM sequence: AAG
tctgaggttagtttaagtga

SEQ ID NO: 64930 - DNA, 20 bp, Artificial Sequence
  Description of Artificial Sequence: Synthetic oligonucleotide
  Target: ATXN1; (-) strand; PAM type: NRG; PAM sequence: AAG
tgttactctgaggttagttt

SEQ ID NO: 64931 - DNA, 20 bp, Artificial Sequence
  Description of Artificial Sequence: Synthetic oligonucleotide
  Target: ATXN1; (-) strand; PAM type: NRG; PAM sequence: TAG
tgcttgtgttactctgaggt

SEQ ID NO: 64932 - DNA, 20 bp, Artificial Sequence
  Description of Artificial Sequence: Synthetic oligonucleotide
  Target: ATXN1; (-) strand; PAM type: NRG; PAM sequence: AGG
tctgtgcttgtgttactctg

SEQ ID NO: 64933 - DNA, 20 bp, Artificial Sequence
  Description of Artificial Sequence: Synthetic oligonucleotide
  Target: ATXN1; (-) strand; PAM type: NRG; PAM sequence: GAG
ttctgtgcttgtgttactct

SEQ ID NO: 64934 - DNA, 20 bp, Artificial Sequence
  Description of Artificial Sequence: Synthetic oligonucleotide
  Target: ATXN1; (-) strand; PAM type: NRG; PAM sequence: TGG
tcaacatctgtgttccaagc

SEQ ID NO: 64935 - DNA, 20 bp, Artificial Sequence
  Description of Artificial Sequence: Synthetic oligonucleotide
  Target: ATXN1; (-) strand; PAM type: NRG; PAM sequence: AAG
taggtcaacatctgtgttcc

SEQ ID NO: 64936 - DNA, 20 bp, Artificial Sequence
  Description of Artificial Sequence: Synthetic oligonucleotide
  Target: ATXN1; (-) strand; PAM type: NRG; PAM sequence: AGG
atatttatgaagccactgtt

SEQ ID NO: 64937 - DNA, 20 bp, Artificial Sequence
  Description of Artificial Sequence: Synthetic oligonucleotide
  Target: ATXN1; (-) strand; PAM type: NRG; PAM sequence: TAG
aatatttatgaagccactgt

SEQ ID NO: 64938 - DNA, 20 bp, Artificial Sequence
  Description of Artificial Sequence: Synthetic oligonucleotide
  Target: ATXN1; (-) strand; PAM type: NRG; PAM sequence: AAG
tcattcaacaaatatttatg

SEQ ID NO: 64939 - DNA, 20 bp, Artificial Sequence
  Description of Artificial Sequence: Synthetic oligonucleotide
  Target: ATXN1; (-) strand; PAM type: NRG; PAM sequence: AAG
atttttccctagtttgatga

SEQ ID NO: 64940 - DNA, 20 bp, Artificial Sequence
  Description of Artificial Sequence: Synthetic oligonucleotide
  Target: ATXN1; (-) strand; PAM type: NRG; PAM sequence: TAG
tttacataaatatttttccc

SEQ ID NO: 64941 - DNA, 20 bp, Artificial Sequence
  Description of Artificial Sequence: Synthetic oligonucleotide
  Target: ATXN1; (-) strand; PAM type: NRG; PAM sequence: AAG
tagtttaccacaatttttag

SEQ ID NO: 64942 - DNA, 20 bp, Artificial Sequence
  Description of Artificial Sequence: Synthetic oligonucleotide
  Target: ATXN1; (-) strand; PAM type: NRG; PAM sequence: TAG
gtgtagtttaccacaatttt

SEQ ID NO: 64943 - DNA, 20 bp, Artificial Sequence
  Description of Artificial Sequence: Synthetic oligonucleotide
  Target: ATXN1; (-) strand; PAM type: NRG; PAM sequence: TAG
tggtacattttatatttgtg

SEQ ID NO: 64944 - DNA, 20 bp, Artificial Sequence
  Description of Artificial Sequence: Synthetic oligonucleotide
  Target: ATXN1; (-) strand; PAM type: NRG; PAM sequence: TGG
atagttaaaaatgtttaaga

SEQ ID NO: 64945 - DNA, 20 bp, Artificial Sequence
  Description of Artificial Sequence: Synthetic oligonucleotide
  Target: ATXN1; (-) strand; PAM type: NRG; PAM sequence: AAG
ctgtatagttaaaaatgttt

SEQ ID NO: 64946 - DNA, 20 bp, Artificial Sequence
  Description of Artificial Sequence: Synthetic oligonucleotide
  Target: ATXN1; (-) strand; PAM type: NRG; PAM sequence: TAG
acttaatgccactgactgta

SEQ ID NO: 64947 - DNA, 20 bp, Artificial Sequence
  Description of Artificial Sequence: Synthetic oligonucleotide
  Target: ATXN1; (-) strand; PAM type: NRG; PAM sequence: TGG
tggggggtggatggtggtaa

SEQ ID NO: 64948 - DNA, 20 bp, Artificial Sequence
  Description of Artificial Sequence: Synthetic oligonucleotide
  Target: ATXN1; (-) strand; PAM type: NRG; PAM sequence: TGG
agagtttggggggtggatgg

SEQ ID NO: 64949 - DNA, 20 bp, Artificial Sequence
  Description of Artificial Sequence: Synthetic oligonucleotide
  Target: ATXN1; (-) strand; PAM type: NRG; PAM sequence: TGG
tgaagagtttggggggtgga

SEQ ID NO: 64950 - DNA, 20 bp, Artificial Sequence
  Description of Artificial Sequence: Synthetic oligonucleotide
  Target: ATXN1; (-) strand; PAM type: NRG; PAM sequence: TGG
aaaatgaagagtttgggggg

SEQ ID NO: 64951 - DNA, 20 bp, Artificial Sequence
  Description of Artificial Sequence: Synthetic oligonucleotide
  Target: ATXN1; (-) strand; PAM type: NRG; PAM sequence: GGG
tgcaaaatgaagagtttggg

SEQ ID NO: 64952 - DNA, 20 bp, Artificial Sequence
  Description of Artificial Sequence: Synthetic oligonucleotide
  Target: ATXN1; (-) strand; PAM type: NRG; PAM sequence: GGG
ttgcaaaatgaagagtttgg

SEQ ID NO: 64953 - DNA, 20 bp, Artificial Sequence
  Description of Artificial Sequence: Synthetic oligonucleotide
  Target: ATXN1; (-) strand; PAM type: NRG; PAM sequence: GGG
tttgcaaaatgaagagtttg

SEQ ID NO: 64954 - DNA, 20 bp, Artificial Sequence
  Description of Artificial Sequence: Synthetic oligonucleotide
  Target: ATXN1; (-) strand; PAM type: NRG; PAM sequence: GGG
ttttgcaaaatgaagagttt

SEQ ID NO: 64955 - DNA, 20 bp, Artificial Sequence
  Description of Artificial Sequence: Synthetic oligonucleotide
  Target: ATXN1; (-) strand; PAM type: NRG; PAM sequence: TGG
gttttgcaaaatgaagagtt

SEQ ID NO: 64956 - DNA, 20 bp, Artificial Sequence
  Description of Artificial Sequence: Synthetic oligonucleotide
  Target: ATXN1; (-) strand; PAM type: NRG; PAM sequence: GAG
tttcagttttgcaaaatgaa

SEQ ID NO: 64957 - DNA, 20 bp, Artificial Sequence
  Description of Artificial Sequence: Synthetic oligonucleotide
  Target: ATXN1; (-) strand; PAM type: NRG; PAM sequence: AAG
agtttcagttttgcaaaatg

SEQ ID NO: 64958 - DNA, 20 bp, Artificial Sequence
  Description of Artificial Sequence: Synthetic oligonucleotide
  Target: ATXN1; (-) strand; PAM type: NRG; PAM sequence: CAG
gtacgtatgttaaaaagttt

SEQ ID NO: 64959 - DNA, 20 bp, Artificial Sequence
  Description of Artificial Sequence: Synthetic oligonucleotide
  Target: ATXN1; (-) strand; PAM type: NRG; PAM sequence: AAG
ttaaatgtacgtatgttaaa

SEQ ID NO: 64960 - DNA, 20 bp, Artificial Sequence
  Description of Artificial Sequence: Synthetic oligonucleotide
  Target: ATXN1; (-) strand; PAM type: NRG; PAM sequence: AAG
gatcattcaattacattttt

SEQ ID NO: 64961 - DNA, 20 bp, Artificial Sequence
  Description of Artificial Sequence: Synthetic oligonucleotide
  Target: ATXN1; (-) strand; PAM type: NRG; PAM sequence: TAG
aacctgggtaccccacaccc

SEQ ID NO: 64962 - DNA, 20 bp, Artificial Sequence
  Description of Artificial Sequence: Synthetic oligonucleotide
  Target: ATXN1; (-) strand; PAM type: NRG; PAM sequence: GGG
aagggggaagtgaagaacct

SEQ ID NO: 64963 - DNA, 20 bp, Artificial Sequence
  Description of Artificial Sequence: Synthetic oligonucleotide
  Target: ATXN1; (-) strand; PAM type: NRG; PAM sequence: TGG
caagggggaagtgaagaacc

SEQ ID NO: 64964 - DNA, 20 bp, Artificial Sequence
  Description of Artificial Sequence: Synthetic oligonucleotide
  Target: ATXN1; (-) strand; PAM type: NRG; PAM sequence: AAG
gtgggggcaagggggaagtg

SEQ ID NO: 64965 - DNA, 20 bp, Artificial Sequence
  Description of Artificial Sequence: Synthetic oligonucleotide
  Target: ATXN1; (-) strand; PAM type: NRG; PAM sequence: AAG
agcaggtgggggcaaggggg

SEQ ID NO: 64966 - DNA, 20 bp, Artificial Sequence
  Description of Artificial Sequence: Synthetic oligonucleotide
  Target: ATXN1; (-) strand; PAM type: NRG; PAM sequence: GGG
tatagcaggtgggggcaagg

SEQ ID NO: 64967 - DNA, 20 bp, Artificial Sequence
  Description of Artificial Sequence: Synthetic oligonucleotide
  Target: ATXN1; (-) strand; PAM type: NRG; PAM sequence: GGG
atatagcaggtgggggcaag

SEQ ID NO: 64968 - DNA, 20 bp, Artificial Sequence
  Description of Artificial Sequence: Synthetic oligonucleotide
  Target: ATXN1; (-) strand; PAM type: NRG; PAM sequence: GGG
tatatagcaggtgggggcaa

SEQ ID NO: 64969 - DNA, 20 bp, Artificial Sequence
  Description of Artificial Sequence: Synthetic oligonucleotide
  Target: ATXN1; (-) strand; PAM type: NRG; PAM sequence: AGG
atatatagcaggtgggggca

SEQ ID NO: 64970 - DNA, 20 bp, Artificial Sequence
  Description of Artificial Sequence: Synthetic oligonucleotide
  Target: ATXN1; (-) strand; PAM type: NRG; PAM sequence: AAG
gatatatagcaggtgggggc

SEQ ID NO: 64971 - DNA, 20 bp, Artificial Sequence
  Description of Artificial Sequence: Synthetic oligonucleotide
  Target: ATXN1; (-) strand; PAM type: NRG; PAM sequence: GGG
acaagatatatagcaggtgg

SEQ ID NO: 64972 - DNA, 20 bp, Artificial Sequence
  Description of Artificial Sequence: Synthetic oligonucleotide
  Target: ATXN1; (-) strand; PAM type: NRG; PAM sequence: GGG
cacaagatatatagcaggtg

SEQ ID NO: 64973 - DNA, 20 bp, Artificial Sequence
  Description of Artificial Sequence: Synthetic oligonucleotide
  Target: ATXN1; (-) strand; PAM type: NRG; PAM sequence: GGG
gcacaagatatatagcaggt

SEQ ID NO: 64974 - DNA, 20 bp, Artificial Sequence
  Description of Artificial Sequence: Synthetic oligonucleotide
  Target: ATXN1; (-) strand; PAM type: NRG; PAM sequence: TGG
ggcacaagatatatagcagg

SEQ ID NO: 64975 - DNA, 20 bp, Artificial Sequence
  Description of Artificial Sequence: Synthetic oligonucleotide
  Target: ATXN1; (-) strand; PAM type: NRG; PAM sequence: AGG
aaaggcacaagatatatagc

SEQ ID NO: 64976 - DNA, 20 bp, Artificial Sequence
  Description of Artificial Sequence: Synthetic oligonucleotide
  Target: ATXN1; (-) strand; PAM type: NRG; PAM sequence: CAG
gaaaggcacaagatatatag

SEQ ID NO: 64977 - DNA, 20 bp, Artificial Sequence
  Description of Artificial Sequence: Synthetic oligonucleotide
  Target: ATXN1; (-) strand; PAM type: NRG; PAM sequence: TAG
gctgaaaggcacaagatata

SEQ ID NO: 64978 - DNA, 20 bp, Artificial Sequence
  Description of Artificial Sequence: Synthetic oligonucleotide
  Target: ATXN1; (-) strand; PAM type: NRG; PAM sequence: AAG
taagtggggctgaaaggcac

SEQ ID NO: 64979 - DNA, 20 bp, Artificial Sequence
  Description of Artificial Sequence: Synthetic oligonucleotide
  Target: ATXN1; (-) strand; PAM type: NRG; PAM sequence: AGG
atgccctaagtggggctgaa

SEQ ID NO: 64980 - DNA, 20 bp, Artificial Sequence
  Description of Artificial Sequence: Synthetic oligonucleotide
  Target: ATXN1; (-) strand; PAM type: NRG; PAM sequence: AAG
gatgccctaagtggggctga

SEQ ID NO: 64981 - DNA, 20 bp, Artificial Sequence
  Description of Artificial Sequence: Synthetic oligonucleotide
  Target: ATXN1; (-) strand; PAM type: NRG; PAM sequence: GGG
tgctaaagatgccctaagtg

SEQ ID NO: 64982 - DNA, 20 bp, Artificial Sequence
  Description of Artificial Sequence: Synthetic oligonucleotide
  Target: ATXN1; (-) strand; PAM type: NRG; PAM sequence: GGG
ttgctaaagatgccctaagt

SEQ ID NO: 64983 - DNA, 20 bp, Artificial Sequence
  Description of Artificial Sequence: Synthetic oligonucleotide
  Target: ATXN1; (-) strand; PAM type: NRG; PAM sequence: TGG
cttgctaaagatgccctaag

SEQ ID NO: 64984 - DNA, 20 bp, Artificial Sequence
  Description of Artificial Sequence: Synthetic oligonucleotide
  Target: ATXN1; (-) strand; PAM type: NRG; PAM sequence: AAG
tttcttgctaaagatgccct

SEQ ID NO: 64985 - DNA, 20 bp, Artificial Sequence
  Description of Artificial Sequence: Synthetic oligonucleotide
  Target: ATXN1; (-) strand; PAM type: NRG; PAM sequence: AAG
atttaccacatttcttgcta

SEQ ID NO: 64986 - DNA, 20 bp, Artificial Sequence
  Description of Artificial Sequence: Synthetic oligonucleotide
  Target: ATXN1; (-) strand; PAM type: NRG; PAM sequence: GAG
gtagctaagctagtaggcag

SEQ ID NO: 64987 - DNA, 20 bp, Artificial Sequence
  Description of Artificial Sequence: Synthetic oligonucleotide
  Target: ATXN1; (-) strand; PAM type: NRG; PAM sequence: AGG
tagtagctaagctagtaggc

SEQ ID NO: 64988 - DNA, 20 bp, Artificial Sequence
  Description of Artificial Sequence: Synthetic oligonucleotide
  Target: ATXN1; (-) strand; PAM type: NRG; PAM sequence: CAG
ctagtagctaagctagtagg

SEQ ID NO: 64989 - DNA, 20 bp, Artificial Sequence
  Description of Artificial Sequence: Synthetic oligonucleotide
  Target: ATXN1; (-) strand; PAM type: NRG; PAM sequence: AGG
tagctagtagctaagctagt

SEQ ID NO: 64990 - DNA, 20 bp, Artificial Sequence
  Description of Artificial Sequence: Synthetic oligonucleotide
  Target: ATXN1; (-) strand; PAM type: NRG; PAM sequence: TAG
ctagctagtagctaagctag

SEQ ID NO: 64991 - DNA, 20 bp, Artificial Sequence
  Description of Artificial Sequence: Synthetic oligonucleotide
  Target: ATXN1; (-) strand; PAM type: NRG; PAM sequence: TAG
ctgctagctagtagctaagc

SEQ ID NO: 64992 - DNA, 20 bp, Artificial Sequence
  Description of Artificial Sequence: Synthetic oligonucleotide
  Target: ATXN1; (-) strand; PAM type: NRG; PAM sequence: AAG
caaactgctagctagtagct

SEQ ID NO: 64993 - DNA, 20 bp, Artificial Sequence
  Description of Artificial Sequence: Synthetic oligonucleotide
  Target: ATXN1; (-) strand; PAM type: NRG; PAM sequence: TAG
cagcccaaactgctagctag

SEQ ID NO: 64994 - DNA, 20 bp, Artificial Sequence
  Description of Artificial Sequence: Synthetic oligonucleotide
  Target: ATXN1; (-) strand; PAM type: NRG; PAM sequence: TAG
gagcagcccaaactgctagc

SEQ ID NO: 64995 - DNA, 20 bp, Artificial Sequence
  Description of Artificial Sequence: Synthetic oligonucleotide
  Target: ATXN1; (-) strand; PAM type: NRG; PAM sequence: TAG
ttttgagcagcccaaactgc

SEQ ID NO: 64996 - DNA, 20 bp, Artificial Sequence
  Description of Artificial Sequence: Synthetic oligonucleotide
  Target: ATXN1; (-) strand; PAM type: NRG; PAM sequence: CAG
tccaggaaattcattttgag

SEQ ID NO: 64997 - DNA, 20 bp, Artificial Sequence
  Description of Artificial Sequence: Synthetic oligonucleotide
  Target: ATXN1; (-) strand; PAM type: NRG; PAM sequence: GAG
ttatccaggaaattcatttt

SEQ ID NO: 64998 - DNA, 20 bp, Artificial Sequence
  Description of Artificial Sequence: Synthetic oligonucleotide
  Target: ATXN1; (-) strand; PAM type: NRG; PAM sequence: AGG
agggcttaggaaaattatcc

SEQ ID NO: 64999 - DNA, 20 bp, Artificial Sequence
  Description of Artificial Sequence: Synthetic oligonucleotide
  Target: ATXN1; (-) strand; PAM type: NRG; PAM sequence: CAG
gagggcttaggaaaattatc

SEQ ID NO: 65000 - DNA, 20 bp, Artificial Sequence
  Description of Artificial Sequence: Synthetic oligonucleotide
  Target: ATXN1; (-) strand; PAM type: NRG; PAM sequence: AGG
gtaggagtcagtgagggctt

SEQ ID NO: 65001 - DNA, 20 bp, Artificial Sequence
  Description of Artificial Sequence: Synthetic oligonucleotide
  Target: ATXN1; (-) strand; PAM type: NRG; PAM sequence: TAG
agtaggagtcagtgagggct

SEQ ID NO: 65002 - DNA, 20 bp, Artificial Sequence
  Description of Artificial Sequence: Synthetic oligonucleotide
  Target: ATXN1; (-) strand; PAM type: NRG; PAM sequence: GGG
atgcgagtaggagtcagtga

SEQ ID NO: 65003 - DNA, 20 bp, Artificial Sequence
  Description of Artificial Sequence: Synthetic oligonucleotide
  Target: ATXN1; (-) strand; PAM type: NRG; PAM sequence: AGG
catgcgagtaggagtcagtg

SEQ ID NO: 65004 - DNA, 20 bp, Artificial Sequence
  Description of Artificial Sequence: Synthetic oligonucleotide
  Target: ATXN1; (-) strand; PAM type: NRG; PAM sequence: GAG
acatgcgagtaggagtcagt

SEQ ID NO: 65005 - DNA, 20 bp, Artificial Sequence
  Description of Artificial Sequence: Synthetic oligonucleotide
  Target: ATXN1; (-) strand; PAM type: NRG; PAM sequence: CAG
caatacatgcgagtaggagt

SEQ ID NO: 65006 - DNA, 20 bp, Artificial Sequence
  Description of Artificial Sequence: Synthetic oligonucleotide
  Target: ATXN1; (-) strand; PAM type: NRG; PAM sequence: GAG
ctagcaatacatgcgagtag

SEQ ID NO: 65007 - DNA, 20 bp, Artificial Sequence
  Description of Artificial Sequence: Synthetic oligonucleotide
  Target: ATXN1; (-) strand; PAM type: NRG; PAM sequence: AGG
tcctagcaatacatgcgagt

SEQ ID NO: 65008 - DNA, 20 bp, Artificial Sequence
  Description of Artificial Sequence: Synthetic oligonucleotide
  Target: ATXN1; (-) strand; PAM type: NRG; PAM sequence: TAG
ctcctagcaatacatgcgag

SEQ ID NO: 65009 - DNA, 20 bp, Artificial Sequence
  Description of Artificial Sequence: Synthetic oligonucleotide
  Target: ATXN1; (-) strand; PAM type: NRG; PAM sequence: GAG
tggctcctagcaatacatgc

SEQ ID NO: 65010 - DNA, 20 bp, Artificial Sequence
  Description of Artificial Sequence: Synthetic oligonucleotide
  Target: ATXN1; (-) strand; PAM type: NRG; PAM sequence: TAG
caggagtgaaagctggctcc

SEQ ID NO: 65011 - DNA, 20 bp, Artificial Sequence
  Description of Artificial Sequence: Synthetic oligonucleotide
  Target: ATXN1; (-) strand; PAM type: NRG; PAM sequence: TGG
ccagtcccaggagtgaaagc

SEQ ID NO: 65012 - DNA, 20 bp, Artificial Sequence
  Description of Artificial Sequence: Synthetic oligonucleotide
  Target: ATXN1; (-) strand; PAM type: NRG; PAM sequence: AAG
caaaccagtcccaggagtga

SEQ ID NO: 65013 - DNA, 20 bp, Artificial Sequence
  Description of Artificial Sequence: Synthetic oligonucleotide
  Target: ATXN1; (-) strand; PAM type: NRG; PAM sequence: GAG
gaagcccaaaccagtcccag

SEQ ID NO: 65014 - DNA, 20 bp, Artificial Sequence
  Description of Artificial Sequence: Synthetic oligonucleotide
  Target: ATXN1; (-) strand; PAM type: NRG; PAM sequence: AGG
tggaagcccaaaccagtccc

SEQ ID NO: 65015 - DNA, 20 bp, Artificial Sequence
  Description of Artificial Sequence: Synthetic oligonucleotide
  Target: ATXN1; (-) strand; PAM type: NRG; PAM sequence: CAG
ctggaagcccaaaccagtcc

SEQ ID NO: 65016 - DNA, 20 bp, Artificial Sequence
  Description of Artificial Sequence: Synthetic oligonucleotide
  Target: ATXN1; (-) strand; PAM type: NRG; PAM sequence: CAG
tgctttctggaagcccaaac

SEQ ID NO: 65017 - DNA, 20 bp, Artificial Sequence
  Description of Artificial Sequence: Synthetic oligonucleotide
  Target: ATXN1; (-) strand; PAM type: NRG; PAM sequence: AAG
ttacaaggcatgctttctgg

SEQ ID NO: 65018 - DNA, 20 bp, Artificial Sequence
  Description of Artificial Sequence: Synthetic oligonucleotide
  Target: ATXN1; (-) strand; PAM type: NRG; PAM sequence: TGG
tctttacaaggcatgctttc

SEQ ID NO: 65019 - DNA, 20 bp, Artificial Sequence
  Description of Artificial Sequence: Synthetic oligonucleotide
  Target: ATXN1; (-) strand; PAM type: NRG; PAM sequence: AGG
cacaggccctgttctttaca

SEQ ID NO: 65020 - DNA, 20 bp, Artificial Sequence
  Description of Artificial Sequence: Synthetic oligonucleotide
  Target: ATXN1; (-) strand; PAM type: NRG; PAM sequence: AAG
acacaggccctgttctttac

SEQ ID NO: 65021 - DNA, 20 bp, Artificial Sequence
  Description of Artificial Sequence: Synthetic oligonucleotide
  Target: ATXN1; (-) strand; PAM type: NRG; PAM sequence: AGG
atacaggctgtttgacacac

SEQ ID NO: 65022 - DNA, 20 bp, Artificial Sequence
  Description of Artificial Sequence: Synthetic oligonucleotide
  Target: ATXN1; (-) strand; PAM type: NRG; PAM sequence: CAG
tatacaggctgtttgacaca

SEQ ID NO: 65023 - DNA, 20 bp, Artificial Sequence
  Description of Artificial Sequence: Synthetic oligonucleotide
  Target: ATXN1; (-) strand; PAM type: NRG; PAM sequence: AGG
aagctatgtgtgttgtatac

SEQ ID NO: 65024 - DNA, 20 bp, Artificial Sequence
  Description of Artificial Sequence: Synthetic oligonucleotide
  Target: ATXN1; (-) strand; PAM type: NRG; PAM sequence: CAG
taagctatgtgtgttgtata

SEQ ID NO: 65025 - DNA, 20 bp, Artificial Sequence
  Description of Artificial Sequence: Synthetic oligonucleotide
  Target: ATXN1; (-) strand; PAM type: NRG; PAM sequence: AAG
atcacatggttgtcatatat

SEQ ID NO: 65026 - DNA, 20 bp, Artificial Sequence
  Description of Artificial Sequence: Synthetic oligonucleotide
  Target: ATXN1; (-) strand; PAM type: NRG; PAM sequence: TGG
ttaaaatgacaaaaatcaca

SEQ ID NO: 65027 - DNA, 20 bp, Artificial Sequence
  Description of Artificial Sequence: Synthetic oligonucleotide
  Target: ATXN1; (-) strand; PAM type: NRG; PAM sequence: CAG
tataaaataagtcctgagtt

SEQ ID NO: 65028 - DNA, 20 bp, Artificial Sequence
  Description of Artificial Sequence: Synthetic oligonucleotide
  Target: ATXN1; (-) strand; PAM type: NRG; PAM sequence: GAG
tcatatataaaataagtcct

SEQ ID NO: 65029 - DNA, 20 bp, Artificial Sequence
  Description of Artificial Sequence: Synthetic oligonucleotide
  Target: ATXN1; (-) strand; PAM type: NRG; PAM sequence: AAG
gtaccaatcatatataaaat

SEQ ID NO: 65030 - DNA, 20 bp, Artificial Sequence
  Description of Artificial Sequence: Synthetic oligonucleotide
  Target: ATXN1; (-) strand; PAM type: NRG; PAM sequence: GGG
tgattagtttctgggggtgg

SEQ ID NO: 65031 - DNA, 20 bp, Artificial Sequence
  Description of Artificial Sequence: Synthetic oligonucleotide
  Target: ATXN1; (-) strand; PAM type: NRG; PAM sequence: GGG
atgattagtttctgggggtg

SEQ ID NO: 65032 - DNA, 20 bp, Artificial Sequence
  Description of Artificial Sequence: Synthetic oligonucleotide
  Target: ATXN1; (-) strand; PAM type: NRG; PAM sequence: GGG
aatgattagtttctgggggt

SEQ ID NO: 65033 - DNA, 20 bp, Artificial Sequence
  Description of Artificial Sequence: Synthetic oligonucleotide
  Target: ATXN1; (-) strand; PAM type: NRG; PAM sequence: TGG
aaatgattagtttctggggg

SEQ ID NO: 65034 - DNA, 20 bp, Artificial Sequence
  Description of Artificial Sequence: Synthetic oligonucleotide
  Target: ATXN1; (-) strand; PAM type: NRG; PAM sequence: GGG
attaaatgattagtttctgg

SEQ ID NO: 65035 - DNA, 20 bp, Artificial Sequence
  Description of Artificial Sequence: Synthetic oligonucleotide
  Target: ATXN1; (-) strand; PAM type: NRG; PAM sequence: GGG
gattaaatgattagtttctg

SEQ ID NO: 65036 - DNA, 20 bp, Artificial Sequence
  Description of Artificial Sequence: Synthetic oligonucleotide
  Target: ATXN1; (-) strand; PAM type: NRG; PAM sequence: GGG
agattaaatgattagtttct

SEQ ID NO: 65037 - DNA, 20 bp, Artificial Sequence
  Description of Artificial Sequence: Synthetic oligonucleotide
  Target: ATXN1; (-) strand; PAM type: NRG; PAM sequence: TGG
tagattaaatgattagtttc

SEQ ID NO: 65038 - DNA, 20 bp, Artificial Sequence
  Description of Artificial Sequence: Synthetic oligonucleotide
  Target: ATXN1; (-) strand; PAM type: NRG; PAM sequence: TAG
tgcactgtagattaaatgat

SEQ ID NO: 65039 - DNA, 20 bp, Artificial Sequence
  Description of Artificial Sequence: Synthetic oligonucleotide
  Target: ATXN1; (-) strand; PAM type: NRG; PAM sequence: TAG
actgatgataatatgcactg

SEQ ID NO: 65040 - DNA, 20 bp, Artificial Sequence
  Description of Artificial Sequence: Synthetic oligonucleotide
  Target: ATXN1; (-) strand; PAM type: NRG; PAM sequence: TAG
ccagttttctttgatttctg

SEQ ID NO: 65041 - DNA, 20 bp, Artificial Sequence
  Description of Artificial Sequence: Synthetic oligonucleotide
  Target: ATXN1; (-) strand; PAM type: NRG; PAM sequence: CAG
tgcaaatatgaaatagatac

SEQ ID NO: 65042 - DNA, 20 bp, Artificial Sequence
  Description of Artificial Sequence: Synthetic oligonucleotide
  Target: ATXN1; (-) strand; PAM type: NRG; PAM sequence: TAG
gattctgtgcaaatatgaaa

SEQ ID NO: 65043 - DNA, 20 bp, Artificial Sequence
  Description of Artificial Sequence: Synthetic oligonucleotide
  Target: ATXN1; (-) strand; PAM type: NRG; PAM sequence: TGG
tgcttctccaagtgtgagat

SEQ ID NO: 65044 - DNA, 20 bp, Artificial Sequence
  Description of Artificial Sequence: Synthetic oligonucleotide
  Target: ATXN1; (-) strand; PAM type: NRG; PAM sequence: GAG
ctttttgcttctccaagtgt

SEQ ID NO: 65045 - DNA, 20 bp, Artificial Sequence
  Description of Artificial Sequence: Synthetic oligonucleotide
  Target: ATXN1; (-) strand; PAM type: NRG; PAM sequence: AAG
tctttgctttttgcttctcc

SEQ ID NO: 65046 - DNA, 20 bp, Artificial Sequence
  Description of Artificial Sequence: Synthetic oligonucleotide
  Target: ATXN1; (-) strand; PAM type: NRG; PAM sequence: AAG
agtgacttgtcacccttttc

SEQ ID NO: 65047 - DNA, 20 bp, Artificial Sequence
  Description of Artificial Sequence: Synthetic oligonucleotide
  Target: ATXN1; (-) strand; PAM type: NRG; PAM sequence: GAG
tggcctcatcccattcacct

SEQ ID NO: 65048 - DNA, 20 bp, Artificial Sequence
  Description of Artificial Sequence: Synthetic oligonucleotide
  Target: ATXN1; (-) strand; PAM type: NRG; PAM sequence: TGG
atccaggcctggtcacctcc

SEQ ID NO: 65049 - DNA, 20 bp, Artificial Sequence
  Description of Artificial Sequence: Synthetic oligonucleotide
  Target: ATXN1; (-) strand; PAM type: NRG; PAM sequence: TGG
gttcacgtcagatccaggcc

SEQ ID NO: 65050 - DNA, 20 bp, Artificial Sequence
  Description of Artificial Sequence: Synthetic oligonucleotide
  Target: ATXN1; (-) strand; PAM type: NRG; PAM sequence: AGG
gagcagttcacgtcagatcc

SEQ ID NO: 65051 - DNA, 20 bp, Artificial Sequence
  Description of Artificial Sequence: Synthetic oligonucleotide
  Target: ATXN1; (-) strand; PAM type: NRG; PAM sequence: CAG
ggagcagttcacgtcagatc

SEQ ID NO: 65052 - DNA, 20 bp, Artificial Sequence
  Description of Artificial Sequence: Synthetic oligonucleotide
  Target: ATXN1; (-) strand; PAM type: NRG; PAM sequence: CAG
ttgtggggagcagttcacgt

SEQ ID NO: 65053 - DNA, 20 bp, Artificial Sequence
  Description of Artificial Sequence: Synthetic oligonucleotide
  Target: ATXN1; (-) strand; PAM type: NRG; PAM sequence: CAG
ggagaggtctttgtggggag

SEQ ID NO: 65054 - DNA, 20 bp, Artificial Sequence
  Description of Artificial Sequence: Synthetic oligonucleotide
  Target: ATXN1; (-) strand; PAM type: NRG; PAM sequence: GAG
cgtggagaggtctttgtggg

SEQ ID NO: 65055 - DNA, 20 bp, Artificial Sequence
  Description of Artificial Sequence: Synthetic oligonucleotide
  Target: ATXN1; (-) strand; PAM type: NRG; PAM sequence: GGG
gccgtggagaggtctttgtg

SEQ ID NO: 65056 - DNA, 20 bp, Artificial Sequence
  Description of Artificial Sequence: Synthetic oligonucleotide
  Target: ATXN1; (-) strand; PAM type: NRG; PAM sequence: GGG
cgccgtggagaggtctttgt

SEQ ID NO: 65057 - DNA, 20 bp, Artificial Sequence
  Description of Artificial Sequence: Synthetic oligonucleotide
  Target: ATXN1; (-) strand; PAM type: NRG; PAM sequence: TGG
gcgccgtggagaggtctttg

SEQ ID NO: 65058 - DNA, 20 bp, Artificial Sequence
  Description of Artificial Sequence: Synthetic oligonucleotide
  Target: ATXN1; (-) strand; PAM type: NRG; PAM sequence: AGG
tgaggctgagcgccgtggag

SEQ ID NO: 65059 - DNA, 20 bp, Artificial Sequence
  Description of Artificial Sequence: Synthetic oligonucleotide
  Target: ATXN1; (-) strand; PAM type: NRG; PAM sequence: GAG
ctgaggctgagcgccgtgga

SEQ ID NO: 65060 - DNA, 20 bp, Artificial Sequence
  Description of Artificial Sequence: Synthetic oligonucleotide
  Target: ATXN1; (-) strand; PAM type: NRG; PAM sequence: GAG
gtctgaggctgagcgccgtg

SEQ ID NO: 65061 - DNA, 20 bp, Artificial Sequence
  Description of Artificial Sequence: Synthetic oligonucleotide
  Target: ATXN1; (-) strand; PAM type: NRG; PAM sequence: TGG
gagtctgaggctgagcgccg

SEQ ID NO: 65062 - DNA, 20 bp, Artificial Sequence
  Description of Artificial Sequence: Synthetic oligonucleotide
  Target: ATXN1; (-) strand; PAM type: NRG; PAM sequence: GAG
catgaggggagtctgaggct

SEQ ID NO: 65063 - DNA, 20 bp, Artificial Sequence
  Description of Artificial Sequence: Synthetic oligonucleotide
  Target: ATXN1; (-) strand; PAM type: NRG; PAM sequence: AGG
ttacacatgaggggagtctg

SEQ ID NO: 65064 - DNA, 20 bp, Artificial Sequence
  Description of Artificial Sequence: Synthetic oligonucleotide
  Target: ATXN1; (-) strand; PAM type: NRG; PAM sequence: GAG
tttacacatgaggggagtct

SEQ ID NO: 65065 - DNA, 20 bp, Artificial Sequence
  Description of Artificial Sequence: Synthetic oligonucleotide
  Target: ATXN1; (-) strand; PAM type: NRG; PAM sequence: GAG
tgttattttacacatgaggg

SEQ ID NO: 65066 - DNA, 20 bp, Artificial Sequence
  Description of Artificial Sequence: Synthetic oligonucleotide
  Target: ATXN1; (-) strand; PAM type: NRG; PAM sequence: GGG
tgtgttattttacacatgag

SEQ ID NO: 65067 - DNA, 20 bp, Artificial Sequence
  Description of Artificial Sequence: Synthetic oligonucleotide
  Target: ATXN1; (-) strand; PAM type: NRG; PAM sequence: GGG
ctgtgttattttacacatga

SEQ ID NO: 65068 - DNA, 20 bp, Artificial Sequence
  Description of Artificial Sequence: Synthetic oligonucleotide
  Target: ATXN1; (-) strand; PAM type: NRG; PAM sequence: AGG
cctgtgttattttacacatg

SEQ ID NO: 65069 - DNA, 20 bp, Artificial Sequence
  Description of Artificial Sequence: Synthetic oligonucleotide
  Target: ATXN1; (-) strand; PAM type: NRG; PAM sequence: GAG
ccctgtgttattttacacat

SEQ ID NO: 65070 - DNA, 20 bp, Artificial Sequence
  Description of Artificial Sequence: Synthetic oligonucleotide
  Target: ATXN1; (-) strand; PAM type: NRG; PAM sequence: TGG
cgtcaggaacagcttaacac

SEQ ID NO: 65071 - DNA, 20 bp, Artificial Sequence
  Description of Artificial Sequence: Synthetic oligonucleotide
  Target: ATXN1; (-) strand; PAM type: NRG; PAM sequence: CAG
tgcaggaagcacgtcaggaa

SEQ ID NO: 65072 - DNA, 20 bp, Artificial Sequence
  Description of Artificial Sequence: Synthetic oligonucleotide
  Target: ATXN1; (-) strand; PAM type: NRG; PAM sequence: AGG
gttggtgcaggaagcacgtc

SEQ ID NO: 65073 - DNA, 20 bp, Artificial Sequence
  Description of Artificial Sequence: Synthetic oligonucleotide
  Target: ATXN1; (-) strand; PAM type: NRG; PAM sequence: CAG
tgttggtgcaggaagcacgt

SEQ ID NO: 65074 - DNA, 20 bp, Artificial Sequence
  Description of Artificial Sequence: Synthetic oligonucleotide
  Target: ATXN1; (-) strand; PAM type: NRG; PAM sequence: AAG
tggttgaatgttggtgcagg

SEQ ID NO: 65075 - DNA, 20 bp, Artificial Sequence
  Description of Artificial Sequence: Synthetic oligonucleotide
  Target: ATXN1; (-) strand; PAM type: NRG; PAM sequence: AGG
agctggttgaatgttggtgc

SEQ ID NO: 65076 - DNA, 20 bp, Artificial Sequence
  Description of Artificial Sequence: Synthetic oligonucleotide
  Target: ATXN1; (-) strand; PAM type: NRG; PAM sequence: CAG
gagctggttgaatgttggtg

SEQ ID NO: 65077 - DNA, 20 bp, Artificial Sequence
  Description of Artificial Sequence: Synthetic oligonucleotide
  Target: ATXN1; (-) strand; PAM type: NRG; PAM sequence: TGG
tcagagagctggttgaatgt

SEQ ID NO: 65078 - DNA, 20 bp, Artificial Sequence
  Description of Artificial Sequence: Synthetic oligonucleotide
  Target: ATXN1; (-) strand; PAM type: NRG; PAM sequence: TGG
tcgtaagaaggtcagagagc

SEQ ID NO: 65079 - DNA, 20 bp, Artificial Sequence
  Description of Artificial Sequence: Synthetic oligonucleotide
  Target: ATXN1; (-) strand; PAM type: NRG; PAM sequence: GAG
agcctcgtaagaaggtcaga

SEQ ID NO: 65080 - DNA, 20 bp, Artificial Sequence
  Description of Artificial Sequence: Synthetic oligonucleotide
  Target: ATXN1; (-) strand; PAM type: NRG; PAM sequence: GAG
tgagcctcgtaagaaggtca

SEQ ID NO: 65081 - DNA, 20 bp, Artificial Sequence
  Description of Artificial Sequence: Synthetic oligonucleotide
  Target: ATXN1; (-) strand; PAM type: NRG; PAM sequence: CAG
cctgagcctcgtaagaaggt

SEQ ID NO: 65082 - DNA, 20 bp, Artificial Sequence
  Description of Artificial Sequence: Synthetic oligonucleotide
  Target: ATXN1; (-) strand; PAM type: NRG; PAM sequence: AGG
gactcctgagcctcgtaaga

SEQ ID NO: 65083 - DNA, 20 bp, Artificial Sequence
  Description of Artificial Sequence: Synthetic oligonucleotide
  Target: ATXN1; (-) strand; PAM type: NRG; PAM sequence: AAG
ggactcctgagcctcgtaag

SEQ ID NO: 65084 - DNA, 20 bp, Artificial Sequence
  Description of Artificial Sequence: Synthetic oligonucleotide
  Target: ATXN1; (-) strand; PAM type: NRG; PAM sequence: AAG
ggaggactcctgagcctcgt

SEQ ID NO: 65085 - DNA, 20 bp, Artificial Sequence
  Description of Artificial Sequence: Synthetic oligonucleotide
  Target: ATXN1; (-) strand; PAM type: NRG; PAM sequence: GAG
tttcccccaggaggactcct

SEQ ID NO: 65086 - DNA, 20 bp, Artificial Sequence
  Description of Artificial Sequence: Synthetic oligonucleotide
  Target: ATXN1; (-) strand; PAM type: NRG; PAM sequence: AGG
ttgcagctctttcccccagg

SEQ ID NO: 65087 - DNA, 20 bp, Artificial Sequence
  Description of Artificial Sequence: Synthetic oligonucleotide
  Target: ATXN1; (-) strand; PAM type: NRG; PAM sequence: GAG
gttgcagctctttcccccag

SEQ ID NO: 65088 - DNA, 20 bp, Artificial Sequence
  Description of Artificial Sequence: Synthetic oligonucleotide
  Target: ATXN1; (-) strand; PAM type: NRG; PAM sequence: AGG
gtgttgcagctctttccccc

SEQ ID NO: 65089 - DNA, 20 bp, Artificial Sequence
  Description of Artificial Sequence: Synthetic oligonucleotide
  Target: ATXN1; (-) strand; PAM type: NRG; PAM sequence: CAG
ggtgttgcagctctttcccc

SEQ ID NO: 65090 - DNA, 20 bp, Artificial Sequence
  Description of Artificial Sequence: Synthetic oligonucleotide
  Target: ATXN1; (-) strand; PAM type: NRG; PAM sequence: CAG
aagtagaatagcaggtgttg

SEQ ID NO: 65091 - DNA, 20 bp, Artificial Sequence
  Description of Artificial Sequence: Synthetic oligonucleotide
  Target: ATXN1; (-) strand; PAM type: NRG; PAM sequence: AGG
accatgcaaagtagaatagc

SEQ ID NO: 65092 - DNA, 20 bp, Artificial Sequence
  Description of Artificial Sequence: Synthetic oligonucleotide
  Target: ATXN1; (-) strand; PAM type: NRG; PAM sequence: CAG
aaccatgcaaagtagaatag

SEQ ID NO: 65093 - DNA, 20 bp, Artificial Sequence
  Description of Artificial Sequence: Synthetic oligonucleotide
  Target: ATXN1; (-) strand; PAM type: NRG; PAM sequence: TAG
accaaccatgcaaagtagaa

SEQ ID NO: 65094 - DNA, 20 bp, Artificial Sequence
  Description of Artificial Sequence: Synthetic oligonucleotide
  Target: ATXN1; (-) strand; PAM type: NRG; PAM sequence: TAG
cctgaaccaaccatgcaaag

SEQ ID NO: 65095 - DNA, 20 bp, Artificial Sequence
  Description of Artificial Sequence: Synthetic oligonucleotide
  Target: ATXN1; (-) strand; PAM type: NRG; PAM sequence: AAG
gagcctgaaccaaccatgca

SEQ ID NO: 65096 - DNA, 20 bp, Artificial Sequence
  Description of Artificial Sequence: Synthetic oligonucleotide
  Target: ATXN1; (-) strand; PAM type: NRG; PAM sequence: GAG
tgggctcttgctattttcta

SEQ ID NO: 65097 - DNA, 20 bp, Artificial Sequence
  Description of Artificial Sequence: Synthetic oligonucleotide
  Target: ATXN1; (-) strand; PAM type: NRG; PAM sequence: TAG
ggtgggctcttgctattttc

SEQ ID NO: 65098 - DNA, 20 bp, Artificial Sequence
  Description of Artificial Sequence: Synthetic oligonucleotide
  Target: ATXN1; (-) strand; PAM type: NRG; PAM sequence: GGG
ttgcaggaggaggaggaggt

SEQ ID NO: 65099 - DNA, 20 bp, Artificial Sequence
  Description of Artificial Sequence: Synthetic oligonucleotide
  Target: ATXN1; (-) strand; PAM type: NRG; PAM sequence: TGG
attgcaggaggaggaggagg

SEQ ID NO: 65100 - DNA, 20 bp, Artificial Sequence
  Description of Artificial Sequence: Synthetic oligonucleotide
  Target: ATXN1; (-) strand; PAM type: NRG; PAM sequence: AGG
ctgattgcaggaggaggagg

SEQ ID NO: 65101 - DNA, 20 bp, Artificial Sequence
  Description of Artificial Sequence: Synthetic oligonucleotide
  Target: ATXN1; (-) strand; PAM type: NRG; PAM sequence: GAG
gctgattgcaggaggaggag

SEQ ID NO: 65102 - DNA, 20 bp, Artificial Sequence
  Description of Artificial Sequence: Synthetic oligonucleotide
  Target: ATXN1; (-) strand; PAM type: NRG; PAM sequence: AGG
gagctgattgcaggaggagg

SEQ ID NO: 65103 - DNA, 20 bp, Artificial Sequence
  Description of Artificial Sequence: Synthetic oligonucleotide
  Target: ATXN1; (-) strand; PAM type: NRG; PAM sequence: GAG
agagctgattgcaggaggag

SEQ ID NO: 65104 - DNA, 20 bp, Artificial Sequence
  Description of Artificial Sequence: Synthetic oligonucleotide
  Target: ATXN1; (-) strand; PAM type: NRG; PAM sequence: AGG
ggagagctgattgcaggagg

SEQ ID NO: 65105 - DNA, 20 bp, Artificial Sequence
  Description of Artificial Sequence: Synthetic oligonucleotide
  Target: ATXN1; (-) strand; PAM type: NRG; PAM sequence: GAG
aggagagctgattgcaggag

SEQ ID NO: 65106 - DNA, 20 bp, Artificial Sequence
  Description of Artificial Sequence: Synthetic oligonucleotide
  Target: ATXN1; (-) strand; PAM type: NRG; PAM sequence: AGG
acaggagagctgattgcagg

SEQ ID NO: 65107 - DNA, 20 bp, Artificial Sequence
  Description of Artificial Sequence: Synthetic oligonucleotide
  Target: ATXN1; (-) strand; PAM type: NRG; PAM sequence: GAG
aacaggagagctgattgcag

SEQ ID NO: 65108 - DNA, 20 bp, Artificial Sequence
  Description of Artificial Sequence: Synthetic oligonucleotide
  Target: ATXN1; (-) strand; PAM type: NRG; PAM sequence: AGG
gaaacaggagagctgattgc

SEQ ID NO: 65109 - DNA, 20 bp, Artificial Sequence
  Description of Artificial Sequence: Synthetic oligonucleotide
  Target: ATXN1; (-) strand; PAM type: NRG; PAM sequence: CAG
ggaaacaggagagctgattg

SEQ ID NO: 65110 - DNA, 20 bp, Artificial Sequence
  Description of Artificial Sequence: Synthetic oligonucleotide
  Target: ATXN1; (-) strand; PAM type: NRG; PAM sequence: GAG
aaaaaaaaaaggaaacagga

SEQ ID NO: 65111 - DNA, 20 bp, Artificial Sequence
  Description of Artificial Sequence: Synthetic oligonucleotide
  Target: ATXN1; (-) strand; PAM type: NRG; PAM sequence: GAG
aaaaaaaaaaaaggaaacag

SEQ ID NO: 65112 - DNA, 20 bp, Artificial Sequence
  Description of Artificial Sequence: Synthetic oligonucleotide
  Target: ATXN1; (-) strand; PAM type: NRG; PAM sequence: AGG
aaaaaaaaaaaaaaggaaac

SEQ ID NO: 65113 - DNA, 20 bp, Artificial Sequence
  Description of Artificial Sequence: Synthetic oligonucleotide
  Target: ATXN1; (-) strand; PAM type: NRG; PAM sequence: CAG
aaaaaaaaaaaaaaaggaaa

SEQ ID NO: 65114 - DNA, 20 bp, Artificial Sequence
  Description of Artificial Sequence: Synthetic oligonucleotide
  Target: ATXN1; (-) strand; PAM type: NRG; PAM sequence: AGG
agctaaaaaaaaaaaaaaaa

SEQ ID NO: 65115 - DNA, 20 bp, Artificial Sequence
  Description of Artificial Sequence: Synthetic oligonucleotide
  Target: ATXN1; (-) strand; PAM type: NRG; PAM sequence: AAG
aagctaaaaaaaaaaaaaaa

SEQ ID NO: 65116 - DNA, 20 bp, Artificial Sequence
  Description of Artificial Sequence: Synthetic oligonucleotide
  Target: ATXN1; (-) strand; PAM type: NRG; PAM sequence: AAG
ggaaaatagaagtagagcta

SEQ ID NO: 65117 - DNA, 20 bp, Artificial Sequence
  Description of Artificial Sequence: Synthetic oligonucleotide
  Target: ATXN1; (-) strand; PAM type: NRG; PAM sequence: GAG
ccagttggaaaatagaagta

SEQ ID NO: 65118 - DNA, 20 bp, Artificial Sequence
  Description of Artificial Sequence: Synthetic oligonucleotide
  Target: ATXN1; (-) strand; PAM type: NRG; PAM sequence: TAG
tcccagttggaaaatagaag

SEQ ID NO: 65119 - DNA, 20 bp, Artificial Sequence
  Description of Artificial Sequence: Synthetic oligonucleotide
  Target: ATXN1; (-) strand; PAM type: NRG; PAM sequence: AAG
tgatcccagttggaaaatag

SEQ ID NO: 65120 - DNA, 20 bp, Artificial Sequence
  Description of Artificial Sequence: Synthetic oligonucleotide
  Target: ATXN1; (-) strand; PAM type: NRG; PAM sequence: TAG
ccatgatcccagttggaaaa

SEQ ID NO: 65121 - DNA, 20 bp, Artificial Sequence
  Description of Artificial Sequence: Synthetic oligonucleotide
  Target: ATXN1; (-) strand; PAM type: NRG; PAM sequence: TGG
gcagtagccatgatcccagt

SEQ ID NO: 65122 - DNA, 20 bp, Artificial Sequence
  Description of Artificial Sequence: Synthetic oligonucleotide
  Target: ATXN1; (-) strand; PAM type: NRG; PAM sequence: CAG
gaaggcagtagccatgatcc

SEQ ID NO: 65123 - DNA, 20 bp, Artificial Sequence
  Description of Artificial Sequence: Synthetic oligonucleotide
  Target: ATXN1; (-) strand; PAM type: NRG; PAM sequence: TAG
tgctgagtagtagaaggcag

SEQ ID NO: 65124 - DNA, 20 bp, Artificial Sequence
  Description of Artificial Sequence: Synthetic oligonucleotide
  Target: ATXN1; (-) strand; PAM type: NRG; PAM sequence: CAG
agctgctgagtagtagaagg

SEQ ID NO: 65125 - DNA, 20 bp, Artificial Sequence
  Description of Artificial Sequence: Synthetic oligonucleotide
  Target: ATXN1; (-) strand; PAM type: NRG; PAM sequence: AGG
attagctgctgagtagtaga

SEQ ID NO: 65126 - DNA, 20 bp, Artificial Sequence
  Description of Artificial Sequence: Synthetic oligonucleotide
  Target: ATXN1; (-) strand; PAM type: NRG; PAM sequence: AAG
aattagctgctgagtagtag

SEQ ID NO: 65127 - DNA, 20 bp, Artificial Sequence
  Description of Artificial Sequence: Synthetic oligonucleotide
  Target: ATXN1; (-) strand; PAM type: NRG; PAM sequence: TAG
tgtaattagctgctgagtag

SEQ ID NO: 65128 - DNA, 20 bp, Artificial Sequence
  Description of Artificial Sequence: Synthetic oligonucleotide
  Target: ATXN1; (-) strand; PAM type: NRG; PAM sequence: TAG
gtgtgtaattagctgctgag

SEQ ID NO: 65129 - DNA, 20 bp, Artificial Sequence
  Description of Artificial Sequence: Synthetic oligonucleotide
  Target: ATXN1; (-) strand; PAM type: NRG; PAM sequence: GAG
ggtgtgtgtaattagctgct

SEQ ID NO: 65130 - DNA, 20 bp, Artificial Sequence
  Description of Artificial Sequence: Synthetic oligonucleotide
  Target: ATXN1; (-) strand; PAM type: NRG; PAM sequence: TAG
cctcggagggtgtgtgtaat

SEQ ID NO: 65131 - DNA, 20 bp, Artificial Sequence
  Description of Artificial Sequence: Synthetic oligonucleotide
  Target: ATXN1; (-) strand; PAM type: NRG; PAM sequence: GGG
agtggcctacgttcctcgga

SEQ ID NO: 65132 - DNA, 20 bp, Artificial Sequence
  Description of Artificial Sequence: Synthetic oligonucleotide
  Target: ATXN1; (-) strand; PAM type: NRG; PAM sequence: AGG
cagtggcctacgttcctcgg

SEQ ID NO: 65133 - DNA, 20 bp, Artificial Sequence
  Description of Artificial Sequence: Synthetic oligonucleotide
  Target: ATXN1; (-) strand; PAM type: NRG; PAM sequence: GAG
tcagtggcctacgttcctcg

SEQ ID NO: 65134 - DNA, 20 bp, Artificial Sequence
  Description of Artificial Sequence: Synthetic oligonucleotide
  Target: ATXN1; (-) strand; PAM type: NRG; PAM sequence: CGG
actcagtggcctacgttcct

SEQ ID NO: 65135 - DNA, 20 bp, Artificial Sequence
  Description of Artificial Sequence: Synthetic oligonucleotide
  Target: ATXN1; (-) strand; PAM type: NRG; PAM sequence: TGG
agtttgggcccctcactcag

SEQ ID NO: 65136 - DNA, 20 bp, Artificial Sequence
  Description of Artificial Sequence: Synthetic oligonucleotide
  Target: ATXN1; (-) strand; PAM type: NRG; PAM sequence: CAG
ctgagtttgggcccctcact

SEQ ID NO: 65137 - DNA, 20 bp, Artificial Sequence
  Description of Artificial Sequence: Synthetic oligonucleotide
  Target: ATXN1; (-) strand; PAM type: NRG; PAM sequence: GGG
gattgtgtccagctgagttt

SEQ ID NO: 65138 - DNA, 20 bp, Artificial Sequence
  Description of Artificial Sequence: Synthetic oligonucleotide
  Target: ATXN1; (-) strand; PAM type: NRG; PAM sequence: TGG
ggattgtgtccagctgagtt

SEQ ID NO: 65139 - DNA, 20 bp, Artificial Sequence
  Description of Artificial Sequence: Synthetic oligonucleotide
  Target: ATXN1; (-) strand; PAM type: NRG; PAM sequence: GAG
agcagggattgtgtccagct

SEQ ID NO: 65140 - DNA, 20 bp, Artificial Sequence
  Description of Artificial Sequence: Synthetic oligonucleotide
  Target: ATXN1; (-) strand; PAM type: NRG; PAM sequence: CAG
ggataagcagggattgtgtc

SEQ ID NO: 65141 - DNA, 20 bp, Artificial Sequence
  Description of Artificial Sequence: Synthetic oligonucleotide
  Target: ATXN1; (-) strand; PAM type: NRG; PAM sequence: GGG
acagctgagagggataagca

SEQ ID NO: 65142 - DNA, 20 bp, Artificial Sequence
  Description of Artificial Sequence: Synthetic oligonucleotide
  Target: ATXN1; (-) strand; PAM type: NRG; PAM sequence: AGG
cacagctgagagggataagc

SEQ ID NO: 65143 - DNA, 20 bp, Artificial Sequence
  Description of Artificial Sequence: Synthetic oligonucleotide
  Target: ATXN1; (-) strand; PAM type: NRG; PAM sequence: CAG
ccacagctgagagggataag

SEQ ID NO: 65144 - DNA, 20 bp, Artificial Sequence
  Description of Artificial Sequence: Synthetic oligonucleotide
  Target: ATXN1; (-) strand; PAM type: NRG; PAM sequence: AAG
tgaccacagctgagagggat

SEQ ID NO: 65145 - DNA, 20 bp, Artificial Sequence
  Description of Artificial Sequence: Synthetic oligonucleotide
  Target: ATXN1; (-) strand; PAM type: NRG; PAM sequence: GGG
ccagctgaccacagctgaga

SEQ ID NO: 65146 - DNA, 20 bp, Artificial Sequence
  Description of Artificial Sequence: Synthetic oligonucleotide
  Target: ATXN1; (-) strand; PAM type: NRG; PAM sequence: AGG
tccagctgaccacagctgag

SEQ ID NO: 65147 - DNA, 20 bp, Artificial Sequence
  Description of Artificial Sequence: Synthetic oligonucleotide
  Target: ATXN1; (-) strand; PAM type: NRG; PAM sequence: GAG
gtccagctgaccacagctga

SEQ ID NO: 65148 - DNA, 20 bp, Artificial Sequence
  Description of Artificial Sequence: Synthetic oligonucleotide
  Target: ATXN1; (-) strand; PAM type: NRG; PAM sequence: GAG
gtgtccagctgaccacagct

SEQ ID NO: 65149 - DNA, 20 bp, Artificial Sequence
  Description of Artificial Sequence: Synthetic oligonucleotide
  Target: ATXN1; (-) strand; PAM type: NRG; PAM sequence: CAG
cctaggtgtccagctgacca

SEQ ID NO: 65150 - DNA, 20 bp, Artificial Sequence
  Description of Artificial Sequence: Synthetic oligonucleotide
  Target: ATXN1; (-) strand; PAM type: NRG; PAM sequence: CAG
cccatgtgtgcctaggtgtc

SEQ ID NO: 65151 - DNA, 20 bp, Artificial Sequence
  Description of Artificial Sequence: Synthetic oligonucleotide
  Target: ATXN1; (-) strand; PAM type: NRG; PAM sequence: AGG
tggcttccccatgtgtgcct

SEQ ID NO: 65152 - DNA, 20 bp, Artificial Sequence
  Description of Artificial Sequence: Synthetic oligonucleotide
  Target: ATXN1; (-) strand; PAM type: NRG; PAM sequence: TAG
gtggcttccccatgtgtgcc

SEQ ID NO: 65153 - DNA, 20 bp, Artificial Sequence
  Description of Artificial Sequence: Synthetic oligonucleotide
  Target: ATXN1; (-) strand; PAM type: NRG; PAM sequence: TGG
tctttcaggcaaggactgag

SEQ ID NO: 65154 - DNA, 20 bp, Artificial Sequence
  Description of Artificial Sequence: Synthetic oligonucleotide
  Target: ATXN1; (-) strand; PAM type: NRG; PAM sequence: GAG
tcttctttcaggcaaggact

SEQ ID NO: 65155 - DNA, 20 bp, Artificial Sequence
  Description of Artificial Sequence: Synthetic oligonucleotide
  Target: ATXN1; (-) strand; PAM type: NRG; PAM sequence: AGG
atgttttcttctttcaggca

SEQ ID NO: 65156 - DNA, 20 bp, Artificial Sequence
  Description of Artificial Sequence: Synthetic oligonucleotide
  Target: ATXN1; (-) strand; PAM type: NRG; PAM sequence: AAG
tatgttttcttctttcaggc

SEQ ID NO: 65157 - DNA, 20 bp, Artificial Sequence
  Description of Artificial Sequence: Synthetic oligonucleotide
  Target: ATXN1; (-) strand; PAM type: NRG; PAM sequence: AGG
ccggtatgttttcttctttc

SEQ ID NO: 65158 - DNA, 20 bp, Artificial Sequence
  Description of Artificial Sequence: Synthetic oligonucleotide
  Target: ATXN1; (-) strand; PAM type: NRG; PAM sequence: CAG
gccggtatgttttcttcttt

SEQ ID NO: 65159 - DNA, 20 bp, Artificial Sequence
  Description of Artificial Sequence: Synthetic oligonucleotide
  Target: ATXN1; (-) strand; PAM type: NRG; PAM sequence: CGG
aaggttgagatttgggctgc

SEQ ID NO: 65160 - DNA, 20 bp, Artificial Sequence
  Description of Artificial Sequence: Synthetic oligonucleotide
  Target: ATXN1; (-) strand; PAM type: NRG; PAM sequence: GGG
agtgaagaaggttgagattt

SEQ ID NO: 65161 - DNA, 20 bp, Artificial Sequence
  Description of Artificial Sequence: Synthetic oligonucleotide
  Target: ATXN1; (-) strand; PAM type: NRG; PAM sequence: TGG
tagtgaagaaggttgagatt

SEQ ID NO: 65162 - DNA, 20 bp, Artificial Sequence
  Description of Artificial Sequence: Synthetic oligonucleotide
  Target: ATXN1; (-) strand; PAM type: NRG; PAM sequence: GAG
gcctgttagtgaagaaggtt

SEQ ID NO: 65163 - DNA, 20 bp, Artificial Sequence
  Description of Artificial Sequence: Synthetic oligonucleotide
  Target: ATXN1; (-) strand; PAM type: NRG; PAM sequence: AGG
agcttgcctgttagtgaaga

SEQ ID NO: 65164 - DNA, 20 bp, Artificial Sequence
  Description of Artificial Sequence: Synthetic oligonucleotide
  Target: ATXN1; (-) strand; PAM type: NRG; PAM sequence: AAG
aagcttgcctgttagtgaag

SEQ ID NO: 65165 - DNA, 20 bp, Artificial Sequence
  Description of Artificial Sequence: Synthetic oligonucleotide
  Target: ATXN1; (-) strand; PAM type: NRG; PAM sequence: AAG
ggtaagcttgcctgttagtg

SEQ ID NO: 65166 - DNA, 20 bp, Artificial Sequence
  Description of Artificial Sequence: Synthetic oligonucleotide
  Target: ATXN1; (-) strand; PAM type: NRG; PAM sequence: TAG
cacatggtaagcttgcctgt

SEQ ID NO: 65167 - DNA, 20 bp, Artificial Sequence
  Description of Artificial Sequence: Synthetic oligonucleotide
  Target: ATXN1; (-) strand; PAM type: NRG; PAM sequence: AAG
ggttaaattcaacacatggt

SEQ ID NO: 65168 - DNA, 20 bp, Artificial Sequence
  Description of Artificial Sequence: Synthetic oligonucleotide
  Target: ATXN1; (-) strand; PAM type: NRG; PAM sequence: TGG
ggctggttaaattcaacaca

SEQ ID NO: 65169 - DNA, 20 bp, Artificial Sequence
  Description of Artificial Sequence: Synthetic oligonucleotide
  Target: ATXN1; (-) strand; PAM type: NRG; PAM sequence: TGG
tctgatggtttggtgctggc

SEQ ID NO: 65170 - DNA, 20 bp, Artificial Sequence
  Description of Artificial Sequence: Synthetic oligonucleotide
  Target: ATXN1; (-) strand; PAM type: NRG; PAM sequence: TGG
aaagtctgatggtttggtgc

SEQ ID NO: 65171 - DNA, 20 bp, Artificial Sequence
  Description of Artificial Sequence: Synthetic oligonucleotide
  Target: ATXN1; (-) strand; PAM type: NRG; PAM sequence: TGG
taacagaaagtctgatggtt

SEQ ID NO: 65172 - DNA, 20 bp, Artificial Sequence
  Description of Artificial Sequence: Synthetic oligonucleotide
  Target: ATXN1; (-) strand; PAM type: NRG; PAM sequence: TGG
ctgagtaacagaaagtctga

SEQ ID NO: 65173 - DNA, 20 bp, Artificial Sequence
  Description of Artificial Sequence: Synthetic oligonucleotide
  Target: ATXN1; (-) strand; PAM type: NRG; PAM sequence: AAG
acttatttctgagtaacaga

SEQ ID NO: 65174 - DNA, 20 bp, Artificial Sequence
  Description of Artificial Sequence: Synthetic oligonucleotide
  Target: ATXN1; (-) strand; PAM type: NRG; PAM sequence: CAG
gtttacttatttctgagtaa

SEQ ID NO: 65175 - DNA, 20 bp, Artificial Sequence
  Description of Artificial Sequence: Synthetic oligonucleotide
  Target: ATXN1; (-) strand; PAM type: NRG; PAM sequence: GAG
catactgtttacttatttct

SEQ ID NO: 65176 - DNA, 20 bp, Artificial Sequence
  Description of Artificial Sequence: Synthetic oligonucleotide
  Target: ATXN1; (-) strand; PAM type: NRG; PAM sequence: GGG
accctgagcccacctaataa

SEQ ID NO: 65177 - DNA, 20 bp, Artificial Sequence
  Description of Artificial Sequence: Synthetic oligonucleotide
  Target: ATXN1; (-) strand; PAM type: NRG; PAM sequence: AGG
caccctgagcccacctaata

SEQ ID NO: 65178 - DNA, 20 bp, Artificial Sequence
  Description of Artificial Sequence: Synthetic oligonucleotide
  Target: ATXN1; (-) strand; PAM type: NRG; PAM sequence: AAG
gcaccctgagcccacctaat

SEQ ID NO: 65179 - DNA, 20 bp, Artificial Sequence
  Description of Artificial Sequence: Synthetic oligonucleotide
  Target: ATXN1; (-) strand; PAM type: NRG; PAM sequence: GAG
agtcctgataccagcaccct

SEQ ID NO: 65180 - DNA, 20 bp, Artificial Sequence
  Description of Artificial Sequence: Synthetic oligonucleotide
  Target: ATXN1; (-) strand; PAM type: NRG; PAM sequence: CAG
tgcaaaaatagtcctgatac

SEQ ID NO: 65181 - DNA, 20 bp, Artificial Sequence
  Description of Artificial Sequence: Synthetic oligonucleotide
  Target: ATXN1; (-) strand; PAM type: NRG; PAM sequence: TAG
aatgatagaatatgcaaaaa

SEQ ID NO: 65182 - DNA, 20 bp, Artificial Sequence
  Description of Artificial Sequence: Synthetic oligonucleotide
  Target: ATXN1; (-) strand; PAM type: NRG; PAM sequence: TAG
atgtcagcctgacctaatga

SEQ ID NO: 65183 - DNA, 20 bp, Artificial Sequence
  Description of Artificial Sequence: Synthetic oligonucleotide
  Target: ATXN1; (-) strand; PAM type: NRG; PAM sequence: CAG
ctttttaaggtttgggatgt

SEQ ID NO: 65184 - DNA, 20 bp, Artificial Sequence
  Description of Artificial Sequence: Synthetic oligonucleotide
  Target: ATXN1; (-) strand; PAM type: NRG; PAM sequence: GGG
ttattaactttttaaggttt

SEQ ID NO: 65185 - DNA, 20 bp, Artificial Sequence
  Description of Artificial Sequence: Synthetic oligonucleotide
  Target: ATXN1; (-) strand; PAM type: NRG; PAM sequence: TGG
cttattaactttttaaggtt

SEQ ID NO: 65186 - DNA, 20 bp, Artificial Sequence
  Description of Artificial Sequence: Synthetic oligonucleotide
  Target: ATXN1; (-) strand; PAM type: NRG; PAM sequence: AGG
tttcccttattaacttttta

SEQ ID NO: 65187 - DNA, 20 bp, Artificial Sequence
  Description of Artificial Sequence: Synthetic oligonucleotide
  Target: ATXN1; (-) strand; PAM type: NRG; PAM sequence: AAG
ctttcccttattaacttttt

SEQ ID NO: 65188 - DNA, 20 bp, Artificial Sequence
  Description of Artificial Sequence: Synthetic oligonucleotide
  Target: ATXN1; (-) strand; PAM type: NRG; PAM sequence: AAG
tgcacttaaccttccatata

SEQ ID NO: 65189 - DNA, 20 bp, Artificial Sequence
  Description of Artificial Sequence: Synthetic oligonucleotide
  Target: ATXN1; (-) strand; PAM type: NRG; PAM sequence: CAG
tttctattttagtaggctgc

SEQ ID NO: 65190 - DNA, 20 bp, Artificial Sequence
  Description of Artificial Sequence: Synthetic oligonucleotide
  Target: ATXN1; (-) strand; PAM type: NRG; PAM sequence: AGG
atttaactttctattttagt

SEQ ID NO: 65191 - DNA, 20 bp, Artificial Sequence
  Description of Artificial Sequence: Synthetic oligonucleotide
  Target: ATXN1; (-) strand; PAM type: NRG; PAM sequence: TAG
tatttaactttctattttag

SEQ ID NO: 65192 - DNA, 20 bp, Artificial Sequence
  Description of Artificial Sequence: Synthetic oligonucleotide
  Target: ATXN1; (-) strand; PAM type: NRG; PAM sequence: TAG
ctgtatttaactttctattt

SEQ ID NO: 65193 - DNA, 20 bp, Artificial Sequence
  Description of Artificial Sequence: Synthetic oligonucleotide
  Target: ATXN1; (-) strand; PAM type: NRG; PAM sequence: GGG
cccttcttttttattgcaag

SEQ ID NO: 65194 - DNA, 20 bp, Artificial Sequence
  Description of Artificial Sequence: Synthetic oligonucleotide
  Target: ATXN1; (-) strand; PAM type: NRG; PAM sequence: GGG
ccccttcttttttattgcaa

SEQ ID NO: 65195 - DNA, 20 bp, Artificial Sequence
  Description of Artificial Sequence: Synthetic oligonucleotide
  Target: ATXN1; (-) strand; PAM type: NRG; PAM sequence: AGG
gccccttcttttttattgca

SEQ ID NO: 65196 - DNA, 20 bp, Artificial Sequence
  Description of Artificial Sequence: Synthetic oligonucleotide
  Target: ATXN1; (-) strand; PAM type: NRG; PAM sequence: AAG
ggccccttcttttttattgc

SEQ ID NO: 65197 - DNA, 20 bp, Artificial Sequence
  Description of Artificial Sequence: Synthetic oligonucleotide
  Target: ATXN1; (-) strand; PAM type: NRG; PAM sequence: AGG
cctggcttgtgttcctatta

SEQ ID NO: 65198 - DNA, 20 bp, Artificial Sequence
  Description of Artificial Sequence: Synthetic oligonucleotide
  Target: ATXN1; (-) strand; PAM type: NRG; PAM sequence: AAG
gcctggcttgtgttcctatt

SEQ ID NO: 65199 - DNA, 20 bp, Artificial Sequence
  Description of Artificial Sequence: Synthetic oligonucleotide
  Target: ATXN1; (-) strand; PAM type: NRG; PAM sequence: TGG
gactgcttttccagcaagcc

SEQ ID NO: 65200 - DNA, 20 bp, Artificial Sequence
  Description of Artificial Sequence: Synthetic oligonucleotide
  Target: ATXN1; (-) strand; PAM type: NRG; PAM sequence: AAG
acaaagactgcttttccagc

SEQ ID NO: 65201 - DNA, 20 bp, Artificial Sequence
  Description of Artificial Sequence: Synthetic oligonucleotide
  Target: ATXN1; (-) strand; PAM type: NRG; PAM sequence: CAG
aggaacaaagactgcttttc

SEQ ID NO: 65202 - DNA, 20 bp, Artificial Sequence
  Description of Artificial Sequence: Synthetic oligonucleotide
  Target: ATXN1; (-) strand; PAM type: NRG; PAM sequence: AAG
gcaggttgttttaaggaaca

SEQ ID NO: 65203 - DNA, 20 bp, Artificial Sequence
  Description of Artificial Sequence: Synthetic oligonucleotide
  Target: ATXN1; (-) strand; PAM type: NRG; PAM sequence: AGG
gtcaattgcaggttgtttta

SEQ ID NO: 65204 - DNA, 20 bp, Artificial Sequence
  Description of Artificial Sequence: Synthetic oligonucleotide
  Target: ATXN1; (-) strand; PAM type: NRG; PAM sequence: AAG
agtcaattgcaggttgtttt

SEQ ID NO: 65205 - DNA, 20 bp, Artificial Sequence
  Description of Artificial Sequence: Synthetic oligonucleotide
  Target: ATXN1; (-) strand; PAM type: NRG; PAM sequence: AGG
ctccataagtagtcaattgc

SEQ ID NO: 65206 - DNA, 20 bp, Artificial Sequence
  Description of Artificial Sequence: Synthetic oligonucleotide
  Target: ATXN1; (-) strand; PAM type: NRG; PAM sequence: CAG
cctccataagtagtcaattg

SEQ ID NO: 65207 - DNA, 20 bp, Artificial Sequence
  Description of Artificial Sequence: Synthetic oligonucleotide
  Target: ATXN1; (-) strand; PAM type: NRG; PAM sequence: TAG
aaatttaagtcctccataag

SEQ ID NO: 65208 - DNA, 20 bp, Artificial Sequence
  Description of Artificial Sequence: Synthetic oligonucleotide
  Target: ATXN1; (-) strand; PAM type: NRG; PAM sequence: AAG
cggaaatttaagtcctccat

SEQ ID NO: 65209 - DNA, 20 bp, Artificial Sequence
  Description of Artificial Sequence: Synthetic oligonucleotide
  Target: ATXN1; (-) strand; PAM type: NRG; PAM sequence: AAG
tacaatatttccggaaattt

SEQ ID NO: 65210 - DNA, 20 bp, Artificial Sequence
  Description of Artificial Sequence: Synthetic oligonucleotide
  Target: ATXN1; (-) strand; PAM type: NRG; PAM sequence: CGG
cagtgatggtacaatatttc

SEQ ID NO: 65211 - DNA, 20 bp, Artificial Sequence
  Description of Artificial Sequence: Synthetic oligonucleotide
  Target: ATXN1; (-) strand; PAM type: NRG; PAM sequence: TGG
ccgtgtacacgggtcagtga

SEQ ID NO: 65212 - DNA, 20 bp, Artificial Sequence
  Description of Artificial Sequence: Synthetic oligonucleotide
  Target: ATXN1; (-) strand; PAM type: NRG; PAM sequence: CAG
tcataaccgtgtacacgggt

SEQ ID NO: 65213 - DNA, 20 bp, Artificial Sequence
  Description of Artificial Sequence: Synthetic oligonucleotide
  Target: ATXN1; (-) strand; PAM type: NRG; PAM sequence: GGG
agcctcataaccgtgtacac

SEQ ID NO: 65214 - DNA, 20 bp, Artificial Sequence
  Description of Artificial Sequence: Synthetic oligonucleotide
  Target: ATXN1; (-) strand; PAM type: NRG; PAM sequence: CGG
gagcctcataaccgtgtaca

SEQ ID NO: 65215 - DNA, 20 bp, Artificial Sequence
  Description of Artificial Sequence: Synthetic oligonucleotide
  Target: ATXN1; (-) strand; PAM type: NRG; PAM sequence: GAG
tgagagtgctattgttatcg

SEQ ID NO: 65216 - DNA, 20 bp, Artificial Sequence
  Description of Artificial Sequence: Synthetic oligonucleotide
  Target: ATXN1; (-) strand; PAM type: NRG; PAM sequence: CGG
cctgagagtgctattgttat

SEQ ID NO: 65217 - DNA, 20 bp, Artificial Sequence
  Description of Artificial Sequence: Synthetic oligonucleotide
  Target: ATXN1; (-) strand; PAM type: NRG; PAM sequence: GAG
aaactgtcggttctccctga

SEQ ID NO: 65218 - DNA, 20 bp, Artificial Sequence
  Description of Artificial Sequence: Synthetic oligonucleotide
  Target: ATXN1; (-) strand; PAM type: NRG; PAM sequence: GAG
ttaaactgtcggttctccct

SEQ ID NO: 65219 - DNA, 20 bp, Artificial Sequence
  Description of Artificial Sequence: Synthetic oligonucleotide
  Target: ATXN1; (-) strand; PAM type: NRG; PAM sequence: CGG
atttgctttcgttaaactgt

SEQ ID NO: 65220 - DNA, 20 bp, Artificial Sequence
  Description of Artificial Sequence: Synthetic oligonucleotide
  Target: ATXN1; (-) strand; PAM type: NRG; PAM sequence: GAG
ttctcagtcatcttattact

SEQ ID NO: 65221 - DNA, 20 bp, Artificial Sequence
  Description of Artificial Sequence: Synthetic oligonucleotide
  Target: ATXN1; (-) strand; PAM type: NRG; PAM sequence: CAG
cgcatagtagtttatgttct

SEQ ID NO: 65222 - DNA, 20 bp, Artificial Sequence
  Description of Artificial Sequence: Synthetic oligonucleotide
  Target: ATXN1; (-) strand; PAM type: NRG; PAM sequence: TAG
tttaaaagatagacgcatag

SEQ ID NO: 65223 - DNA, 20 bp, Artificial Sequence
  Description of Artificial Sequence: Synthetic oligonucleotide
  Target: ATXN1; (-) strand; PAM type: NRG; PAM sequence: TAG
gtgtttaaaagatagacgca

SEQ ID NO: 65224 - DNA, 20 bp, Artificial Sequence
  Description of Artificial Sequence: Synthetic oligonucleotide
  Target: ATXN1; (-) strand; PAM type: NRG; PAM sequence: TAG
ttacttaagtgtttaaaaga

SEQ ID NO: 65225 - DNA, 20 bp, Artificial Sequence
  Description of Artificial Sequence: Synthetic oligonucleotide
  Target: ATXN1; (-) strand; PAM type: NRG; PAM sequence: AAG
aaaattacttaagtgtttaa

SEQ ID NO: 65226 - DNA, 20 bp, Artificial Sequence
  Description of Artificial Sequence: Synthetic oligonucleotide
  Target: ATXN1; (-) strand; PAM type: NRG; PAM sequence: AAG
aagcaacactaaaattactt

SEQ ID NO: 65227 - DNA, 20 bp, Artificial Sequence
  Description of Artificial Sequence: Synthetic oligonucleotide
  Target: ATXN1; (-) strand; PAM type: NRG; PAM sequence: AAG
ctcatttactctggcaagtg

SEQ ID NO: 65228 - DNA, 20 bp, Artificial Sequence
  Description of Artificial Sequence: Synthetic oligonucleotide
  Target: ATXN1; (-) strand; PAM type: NRG; PAM sequence: AAG
tataactcatttactctggc

SEQ ID NO: 65229 - DNA, 20 bp, Artificial Sequence
  Description of Artificial Sequence: Synthetic oligonucleotide
  Target: ATXN1; (-) strand; PAM type: NRG; PAM sequence: TGG
tttttataactcatttactc

SEQ ID NO: 65230 - DNA, 20 bp, Artificial Sequence
  Description of Artificial Sequence: Synthetic oligonucleotide
  Target: ATXN1; (-) strand; PAM type: NRG; PAM sequence: AGG
aggcttttatgagaaagcag

SEQ ID NO: 65231 - DNA, 20 bp, Artificial Sequence
  Description of Artificial Sequence: Synthetic oligonucleotide
  Target: ATXN1; (-) strand; PAM type: NRG; PAM sequence: GAG
gaggcttttatgagaaagca

SEQ ID NO: 65232 - DNA, 20 bp, Artificial Sequence
  Description of Artificial Sequence: Synthetic oligonucleotide
  Target: ATXN1; (-) strand; PAM type: NRG; PAM sequence: CAG
tggaggcttttatgagaaag

SEQ ID NO: 65233 - DNA, 20 bp, Artificial Sequence
  Description of Artificial Sequence: Synthetic oligonucleotide
  Target: ATXN1; (-) strand; PAM type: NRG; PAM sequence: AAG
atatggaggcttttatgaga

SEQ ID NO: 65234 - DNA, 20 bp, Artificial Sequence
  Description of Artificial Sequence: Synthetic oligonucleotide
  Target: ATXN1; (-) strand; PAM type: NRG; PAM sequence: GAG
gggtatatggaggcttttat

SEQ ID NO: 65235 - DNA, 20 bp, Artificial Sequence
  Description of Artificial Sequence: Synthetic oligonucleotide
  Target: ATXN1; (-) strand; PAM type: NRG; PAM sequence: AGG
gccattcgttgggtatatgg

SEQ ID NO: 65236 - DNA, 20 bp, Artificial Sequence
  Description of Artificial Sequence: Synthetic oligonucleotide
  Target: ATXN1; (-) strand; PAM type: NRG; PAM sequence: GAG
cgccattcgttgggtatatg

SEQ ID NO: 65237 - DNA, 20 bp, Artificial Sequence
  Description of Artificial Sequence: Synthetic oligonucleotide
  Target: ATXN1; (-) strand; PAM type: NRG; PAM sequence: TGG
ttcgccattcgttgggtata

SEQ ID NO: 65238 - DNA, 20 bp, Artificial Sequence
  Description of Artificial Sequence: Synthetic oligonucleotide
  Target: ATXN1; (-) strand; PAM type: NRG; PAM sequence: GGG
aacatcattcgccattcgtt

SEQ ID NO: 65239 - DNA, 20 bp, Artificial Sequence
  Description of Artificial Sequence: Synthetic oligonucleotide
  Target: ATXN1; (-) strand; PAM type: NRG; PAM sequence: TGG
taacatcattcgccattcgt

SEQ ID NO: 65240 - DNA, 20 bp, Artificial Sequence
  Description of Artificial Sequence: Synthetic oligonucleotide
  Target: ATXN1; (-) strand; PAM type: NRG; PAM sequence: GGG
tattccttatgggaggaaat

SEQ ID NO: 65241 - DNA, 20 bp, Artificial Sequence
  Description of Artificial Sequence: Synthetic oligonucleotide
  Target: ATXN1; (-) strand; PAM type: NRG; PAM sequence: TGG
ttattccttatgggaggaaa

SEQ ID NO: 65242 - DNA, 20 bp, Artificial Sequence
  Description of Artificial Sequence: Synthetic oligonucleotide
  Target: ATXN1; (-) strand; PAM type: NRG; PAM sequence: AGG
agaggattattccttatggg

SEQ ID NO: 65243 - DNA, 20 bp, Artificial Sequence
  Description of Artificial Sequence: Synthetic oligonucleotide
  Target: ATXN1; (-) strand; PAM type: NRG; PAM sequence: GAG
aagaggattattccttatgg

SEQ ID NO: 65244 - DNA, 20 bp, Artificial Sequence
  Description of Artificial Sequence: Synthetic oligonucleotide
  Target: ATXN1; (-) strand; PAM type: NRG; PAM sequence: GGG
aaaagaggattattccttat

SEQ ID NO: 65245 - DNA, 20 bp, Artificial Sequence
  Description of Artificial Sequence: Synthetic oligonucleotide
  Target: ATXN1; (-) strand; PAM type: NRG; PAM sequence: TGG
aaaaagaggattattcctta

SEQ ID NO: 65246 - DNA, 20 bp, Artificial Sequence
  Description of Artificial Sequence: Synthetic oligonucleotide
  Target: ATXN1; (-) strand; PAM type: NRG; PAM sequence: AGG
aaaaggagaatcacaaaaag

SEQ ID NO: 65247 - DNA, 20 bp, Artificial Sequence
  Description of Artificial Sequence: Synthetic oligonucleotide
  Target: ATXN1; (-) strand; PAM type: NRG; PAM sequence: GAG
gaaaaggagaatcacaaaaa

SEQ ID NO: 65248 - DNA, 20 bp, Artificial Sequence
  Description of Artificial Sequence: Synthetic oligonucleotide
  Target: ATXN1; (-) strand; PAM type: NRG; PAM sequence: AAG
gtgaaaaggagaatcacaaa

SEQ ID NO: 65249 - DNA, 20 bp, Artificial Sequence
  Description of Artificial Sequence: Synthetic oligonucleotide
  Target: ATXN1; (-) strand; PAM type: NRG; PAM sequence: GAG
cctccagatgaagtgaaaag

SEQ ID NO: 65250 - DNA, 20 bp, Artificial Sequence
  Description of Artificial Sequence: Synthetic oligonucleotide
  Target: ATXN1; (-) strand; PAM type: NRG; PAM sequence: AGG
gccctccagatgaagtgaaa

SEQ ID NO: 65251 - DNA, 20 bp, Artificial Sequence
  Description of Artificial Sequence: Synthetic oligonucleotide
  Target: ATXN1; (-) strand; PAM type: NRG; PAM sequence: AAG
tgccctccagatgaagtgaa

SEQ ID NO: 65252 - DNA, 20 bp, Artificial Sequence
  Description of Artificial Sequence: Synthetic oligonucleotide
  Target: ATXN1; (-) strand; PAM type: NRG; PAM sequence: AAG
aagacactgccctccagatg

SEQ ID NO: 65253 - DNA, 20 bp, Artificial Sequence
  Description of Artificial Sequence: Synthetic oligonucleotide
  Target: ATXN1; (-) strand; PAM type: NRG; PAM sequence: CAG
ggagggaagacactgccctc

SEQ ID NO: 65254 - DNA, 20 bp, Artificial Sequence
  Description of Artificial Sequence: Synthetic oligonucleotide
  Target: ATXN1; (-) strand; PAM type: NRG; PAM sequence: AAG
gggcctctcttctaggaggg

SEQ ID NO: 65255 - DNA, 20 bp, Artificial Sequence
  Description of Artificial Sequence: Synthetic oligonucleotide
  Target: ATXN1; (-) strand; PAM type: NRG; PAM sequence: GGG
cctgggcctctcttctagga

SEQ ID NO: 65256 - DNA, 20 bp, Artificial Sequence
  Description of Artificial Sequence: Synthetic oligonucleotide
  Target: ATXN1; (-) strand; PAM type: NRG; PAM sequence: AGG
gcctgggcctctcttctagg

SEQ ID NO: 65257 - DNA, 20 bp, Artificial Sequence
  Description of Artificial Sequence: Synthetic oligonucleotide
  Target: ATXN1; (-) strand; PAM type: NRG; PAM sequence: GAG
agcctgggcctctcttctag

SEQ ID NO: 65258 - DNA, 20 bp, Artificial Sequence
  Description of Artificial Sequence: Synthetic oligonucleotide
  Target: ATXN1; (-) strand; PAM type: NRG; PAM sequence: AGG
tcagcctgggcctctcttct

SEQ ID NO: 65259 - DNA, 20 bp, Artificial Sequence
  Description of Artificial Sequence: Synthetic oligonucleotide
  Target: ATXN1; (-) strand; PAM type: NRG; PAM sequence: TAG
ctcagcctgggcctctcttc

SEQ ID NO: 65260 - DNA, 20 bp, Artificial Sequence
  Description of Artificial Sequence: Synthetic oligonucleotide
  Target: ATXN1; (-) strand; PAM type: NRG; PAM sequence: GGG
aaccatgatgctctcagcct

SEQ ID NO: 65261 - DNA, 20 bp, Artificial Sequence
  Description of Artificial Sequence: Synthetic oligonucleotide
  Target: ATXN1; (-) strand; PAM type: NRG; PAM sequence: TGG
aaaccatgatgctctcagcc

SEQ ID NO: 65262 - DNA, 20 bp, Artificial Sequence
  Description of Artificial Sequence: Synthetic oligonucleotide
  Target: ATXN1; (-) strand; PAM type: NRG; PAM sequence: CAG
tgccaaaaccatgatgctct

SEQ ID NO: 65263 - DNA, 20 bp, Artificial Sequence
  Description of Artificial Sequence: Synthetic oligonucleotide
  Target: ATXN1; (-) strand; PAM type: NRG; PAM sequence: GAG
ccctgatgccaagattttct

SEQ ID NO: 65264 - DNA, 20 bp, Artificial Sequence
  Description of Artificial Sequence: Synthetic oligonucleotide
  Target: ATXN1; (-) strand; PAM type: NRG; PAM sequence: AAG
ttatagtaagccctgatgcc

SEQ ID NO: 65265 - DNA, 20 bp, Artificial Sequence
  Description of Artificial Sequence: Synthetic oligonucleotide
  Target: ATXN1; (-) strand; PAM type: NRG; PAM sequence: AAG
tgtttaactcagcttatagt

SEQ ID NO: 65266 - DNA, 20 bp, Artificial Sequence
  Description of Artificial Sequence: Synthetic oligonucleotide
  Target: ATXN1; (-) strand; PAM type: NRG; PAM sequence: TAG
ttcctgtttaactcagctta

SEQ ID NO: 65267 - DNA, 20 bp, Artificial Sequence
  Description of Artificial Sequence: Synthetic oligonucleotide
  Target: ATXN1; (-) strand; PAM type: NRG; PAM sequence: CAG
tcttccattcctgtttaact

SEQ ID NO: 65268 - DNA, 20 bp, Artificial Sequence
  Description of Artificial Sequence: Synthetic oligonucleotide
  Target: ATXN1; (-) strand; PAM type: NRG; PAM sequence: GGG
aaatattttctatttttcca

SEQ ID NO: 65269 - DNA, 20 bp, Artificial Sequence
  Description of Artificial Sequence: Synthetic oligonucleotide
  Target: ATXN1; (-) strand; PAM type: NRG; PAM sequence: AGG
gaaatattttctatttttcc

SEQ ID NO: 65270 - DNA, 20 bp, Artificial Sequence
  Description of Artificial Sequence: Synthetic oligonucleotide
  Target: ATXN1; (-) strand; PAM type: NRG; PAM sequence: CAG
agaaatattttctatttttc

SEQ ID NO: 65271 - DNA, 20 bp, Artificial Sequence
  Description of Artificial Sequence: Synthetic oligonucleotide
  Target: ATXN1; (-) strand; PAM type: NRG; PAM sequence: TAG
gccaaacttctgtgctaccc

SEQ ID NO: 65272 - DNA, 20 bp, Artificial Sequence
  Description of Artificial Sequence: Synthetic oligonucleotide
  Target: ATXN1; (-) strand; PAM type: NRG; PAM sequence: AGG
gaaataaatcaccagcgaaa

SEQ ID NO: 65273 - DNA, 20 bp, Artificial Sequence
  Description of Artificial Sequence: Synthetic oligonucleotide
  Target: ATXN1; (-) strand; PAM type: NRG; PAM sequence: AAG
ggaaataaatcaccagcgaa

SEQ ID NO: 65274 - DNA, 20 bp, Artificial Sequence
  Description of Artificial Sequence: Synthetic oligonucleotide
  Target: ATXN1; (-) strand; PAM type: NRG; PAM sequence: CAG
aacaaatggaaataaatcac

SEQ ID NO: 65275 - DNA, 20 bp, Artificial Sequence
  Description of Artificial Sequence: Synthetic oligonucleotide
  Target: ATXN1; (-) strand; PAM type: NRG; PAM sequence: TGG
agtcacatcatgtgaacaaa

SEQ ID NO: 65276 - DNA, 20 bp, Artificial Sequence
  Description of Artificial Sequence: Synthetic oligonucleotide
  Target: ATXN1; (-) strand; PAM type: NRG; PAM sequence: GAG
ctccatgtcacccaaatgat

SEQ ID NO: 65277 - DNA, 20 bp, Artificial Sequence
  Description of Artificial Sequence: Synthetic oligonucleotide
  Target: ATXN1; (-) strand; PAM type: NRG; PAM sequence: TAG
tcatactagagaaaaatcat

SEQ ID NO: 65278 - DNA, 20 bp, Artificial Sequence
  Description of Artificial Sequence: Synthetic oligonucleotide
  Target: ATXN1; (-) strand; PAM type: NRG; PAM sequence: GAG
tattaaataaaatcatacta

SEQ ID NO: 65279 - DNA, 20 bp, Artificial Sequence
  Description of Artificial Sequence: Synthetic oligonucleotide
  Target: ATXN1; (-) strand; PAM type: NRG; PAM sequence: TAG
actattaaataaaatcatac

SEQ ID NO: 65280 - DNA, 20 bp, Artificial Sequence
  Description of Artificial Sequence: Synthetic oligonucleotide
  Target: ATXN1; (-) strand; PAM type: NRG; PAM sequence: CAG
ggggaggtcagaggagacat

SEQ ID NO: 65281 - DNA, 20 bp, Artificial Sequence
  Description of Artificial Sequence: Synthetic oligonucleotide
  Target: ATXN1; (-) strand; PAM type: NRG; PAM sequence: GAG
ttaaaagggggaggtcagag

SEQ ID NO: 65282 - DNA, 20 bp, Artificial Sequence
  Description of Artificial Sequence: Synthetic oligonucleotide
  Target: ATXN1; (-) strand; PAM type: NRG; PAM sequence: AGG
ttttaaaagggggaggtcag

SEQ ID NO: 65283 - DNA, 20 bp, Artificial Sequence
  Description of Artificial Sequence: Synthetic oligonucleotide
  Target: ATXN1; (-) strand; PAM type: NRG; PAM sequence: GAG
attttaaaagggggaggtca

SEQ ID NO: 65284 - DNA, 20 bp, Artificial Sequence
  Description of Artificial Sequence: Synthetic oligonucleotide
  Target: ATXN1; (-) strand; PAM type: NRG; PAM sequence: CAG
aaattttaaaagggggaggt

SEQ ID NO: 65285 - DNA, 20 bp, Artificial Sequence
  Description of Artificial Sequence: Synthetic oligonucleotide
  Target: ATXN1; (-) strand; PAM type: NRG; PAM sequence: AGG
ctggaaattttaaaaggggg

SEQ ID NO: 65286 - DNA, 20 bp, Artificial Sequence
  Description of Artificial Sequence: Synthetic oligonucleotide
  Target: ATXN1; (-) strand; PAM type: NRG; PAM sequence: GAG
tctggaaattttaaaagggg

SEQ ID NO: 65287 - DNA, 20 bp, Artificial Sequence
  Description of Artificial Sequence: Synthetic oligonucleotide
  Target: ATXN1; (-) strand; PAM type: NRG; PAM sequence: GGG
tttctggaaattttaaaagg

SEQ ID NO: 65288 - DNA, 20 bp, Artificial Sequence
  Description of Artificial Sequence: Synthetic oligonucleotide
  Target: ATXN1; (-) strand; PAM type: NRG; PAM sequence: GGG
ttttctggaaattttaaaag

SEQ ID NO: 65289 - DNA, 20 bp, Artificial Sequence
  Description of Artificial Sequence: Synthetic oligonucleotide
  Target: ATXN1; (-) strand; PAM type: NRG; PAM sequence: GGG
attttctggaaattttaaaa

SEQ ID NO: 65290 - DNA, 20 bp, Artificial Sequence
  Description of Artificial Sequence: Synthetic oligonucleotide
  Target: ATXN1; (-) strand; PAM type: NRG; PAM sequence: AGG
tattttctggaaattttaaa

SEQ ID NO: 65291 - DNA, 20 bp, Artificial Sequence
  Description of Artificial Sequence: Synthetic oligonucleotide
  Target: ATXN1; (-) strand; PAM type: NRG; PAM sequence: AAG
ttattttctggaaattttaa

SEQ ID NO: 65292 - DNA, 20 bp, Artificial Sequence
  Description of Artificial Sequence: Synthetic oligonucleotide
  Target: ATXN1; (-) strand; PAM type: NRG; PAM sequence: TGG
catcagaatgtcttattttc

SEQ ID NO: 65293 - DNA, 20 bp, Artificial Sequence
  Description of Artificial Sequence: Synthetic oligonucleotide
  Target: ATXN1; (-) strand; PAM type: NRG; PAM sequence: CAG
tcttgtggcctgatctccat

SEQ ID NO: 65294 - DNA, 20 bp, Artificial Sequence
  Description of Artificial Sequence: Synthetic oligonucleotide
  Target: ATXN1; (-) strand; PAM type: NRG; PAM sequence: TGG
ttttctgaactactgtcttg

SEQ ID NO: 65295 - DNA, 20 bp, Artificial Sequence
  Description of Artificial Sequence: Synthetic oligonucleotide
  Target: ATXN1; (-) strand; PAM type: NRG; PAM sequence: GAG
ccaattacatagggagtgag

SEQ ID NO: 65296 - DNA, 20 bp, Artificial Sequence
  Description of Artificial Sequence: Synthetic oligonucleotide
  Target: ATXN1; (-) strand; PAM type: NRG; PAM sequence: AGG
caccaattacatagggagtg

SEQ ID NO: 65297 - DNA, 20 bp, Artificial Sequence
  Description of Artificial Sequence: Synthetic oligonucleotide
  Target: ATXN1; (-) strand; PAM type: NRG; PAM sequence: GAG
ccaccaattacatagggagt

SEQ ID NO: 65298 - DNA, 20 bp, Artificial Sequence
  Description of Artificial Sequence: Synthetic oligonucleotide
  Target: ATXN1; (-) strand; PAM type: NRG; PAM sequence: GAG
ctggccaccaattacatagg

SEQ ID NO: 65299 - DNA, 20 bp, Artificial Sequence
  Description of Artificial Sequence: Synthetic oligonucleotide
  Target: ATXN1; (-) strand; PAM type: NRG; PAM sequence: GGG
tcctggccaccaattacata

SEQ ID NO: 65300 - DNA, 20 bp, Artificial Sequence
  Description of Artificial Sequence: Synthetic oligonucleotide
  Target: ATXN1; (-) strand; PAM type: NRG; PAM sequence: AGG
atcctggccaccaattacat

SEQ ID NO: 65301 - DNA, 20 bp, Artificial Sequence
  Description of Artificial Sequence: Synthetic oligonucleotide
  Target: ATXN1; (-) strand; PAM type: NRG; PAM sequence: TAG
tatcctggccaccaattaca

SEQ ID NO: 65302 - DNA, 20 bp, Artificial Sequence
  Description of Artificial Sequence: Synthetic oligonucleotide
  Target: ATXN1; (-) strand; PAM type: NRG; PAM sequence: TGG
tccagagaatttcaatatcc

SEQ ID NO: 65303 - DNA, 20 bp, Artificial Sequence
  Description of Artificial Sequence: Synthetic oligonucleotide
  Target: ATXN1; (-) strand; PAM type: NRG; PAM sequence: GAG
aatggattctgtgttttcca

SEQ ID NO: 65304 - DNA, 20 bp, Artificial Sequence
  Description of Artificial Sequence: Synthetic oligonucleotide
  Target: ATXN1; (-) strand; PAM type: NRG; PAM sequence: CAG
taaatggattctgtgttttc

SEQ ID NO: 65305 - DNA, 20 bp, Artificial Sequence
  Description of Artificial Sequence: Synthetic oligonucleotide
  Target: ATXN1; (-) strand; PAM type: NRG; PAM sequence: TGG
cattgaattcatcatgtaaa

SEQ ID NO: 65306 - DNA, 20 bp, Artificial Sequence
  Description of Artificial Sequence: Synthetic oligonucleotide
  Target: ATXN1; (-) strand; PAM type: NRG; PAM sequence: AAG
ttctcctaacacttctgaac

SEQ ID NO: 65307 - DNA, 20 bp, Artificial Sequence
  Description of Artificial Sequence: Synthetic oligonucleotide
  Target: ATXN1; (-) strand; PAM type: NRG; PAM sequence: GAG
tctttgacctgggaattgca

SEQ ID NO: 65308 - DNA, 20 bp, Artificial Sequence
  Description of Artificial Sequence: Synthetic oligonucleotide
  Target: ATXN1; (-) strand; PAM type: NRG; PAM sequence: CAG
catctttgacctgggaattg

SEQ ID NO: 65309 - DNA, 20 bp, Artificial Sequence
  Description of Artificial Sequence: Synthetic oligonucleotide
  Target: ATXN1; (-) strand; PAM type: NRG; PAM sequence: GGG
tcatttcacatctttgacct

SEQ ID NO: 65310 - DNA, 20 bp, Artificial Sequence
  Description of Artificial Sequence: Synthetic oligonucleotide
  Target: ATXN1; (-) strand; PAM type: NRG; PAM sequence: TGG
ttcatttcacatctttgacc

SEQ ID NO: 65311 - DNA, 20 bp, Artificial Sequence
  Description of Artificial Sequence: Synthetic oligonucleotide
  Target: ATXN1; (-) strand; PAM type: NRG; PAM sequence: GAG
ctagaccacattttgccagt

SEQ ID NO: 65312 - DNA, 20 bp, Artificial Sequence
  Description of Artificial Sequence: Synthetic oligonucleotide
  Target: ATXN1; (-) strand; PAM type: NRG; PAM sequence: CAG
cccactagaccacattttgc

SEQ ID NO: 65313 - DNA, 20 bp, Artificial Sequence
  Description of Artificial Sequence: Synthetic oligonucleotide
  Target: ATXN1; (-) strand; PAM type: NRG; PAM sequence: TAG
tgtttcctaatcaggcccac

SEQ ID NO: 65314 - DNA, 20 bp, Artificial Sequence
  Description of Artificial Sequence: Synthetic oligonucleotide
  Target: ATXN1; (-) strand; PAM type: NRG; PAM sequence: AGG
taagcttttgtttcctaatc

SEQ ID NO: 65315 - DNA, 20 bp, Artificial Sequence
  Description of Artificial Sequence: Synthetic oligonucleotide
  Target: ATXN1; (-) strand; PAM type: NRG; PAM sequence: CAG
ataagcttttgtttcctaat

SEQ ID NO: 65316 - DNA, 20 bp, Artificial Sequence
  Description of Artificial Sequence: Synthetic oligonucleotide
  Target: ATXN1; (-) strand; PAM type: NRG; PAM sequence: AAG
ccctcttgctgcaaagttat

SEQ ID NO: 65317 - DNA, 20 bp, Artificial Sequence
  Description of Artificial Sequence: Synthetic oligonucleotide
  Target: ATXN1; (-) strand; PAM type: NRG; PAM sequence: AAG
tgttttcccctcttgctgca

SEQ ID NO: 65318 - DNA, 20 bp, Artificial Sequence
  Description of Artificial Sequence: Synthetic oligonucleotide
  Target: ATXN1; (-) strand; PAM type: NRG; PAM sequence: TAG
gaagagaattaggtaaaagg

SEQ ID NO: 65319 - DNA, 20 bp, Artificial Sequence
  Description of Artificial Sequence: Synthetic oligonucleotide
  Target: ATXN1; (-) strand; PAM type: NRG; PAM sequence: AGG
gtagaagagaattaggtaaa

SEQ ID NO: 65320 - DNA, 20 bp, Artificial Sequence
  Description of Artificial Sequence: Synthetic oligonucleotide
  Target: ATXN1; (-) strand; PAM type: NRG; PAM sequence: AAG
ggtagaagagaattaggtaa

SEQ ID NO: 65321 - DNA, 20 bp, Artificial Sequence
  Description of Artificial Sequence: Synthetic oligonucleotide
  Target: ATXN1; (-) strand; PAM type: NRG; PAM sequence: AGG
ccttagggtagaagagaatt

SEQ ID NO: 65322 - DNA, 20 bp, Artificial Sequence
  Description of Artificial Sequence: Synthetic oligonucleotide
  Target: ATXN1; (-) strand; PAM type: NRG; PAM sequence: TAG
cccttagggtagaagagaat

SEQ ID NO: 65323 - DNA, 20 bp, Artificial Sequence
  Description of Artificial Sequence: Synthetic oligonucleotide
  Target: ATXN1; (-) strand; PAM type: NRG; PAM sequence: GAG
tttactcccttagggtagaa

SEQ ID NO: 65324 - DNA, 20 bp, Artificial Sequence
  Description of Artificial Sequence: Synthetic oligonucleotide
  Target: ATXN1; (-) strand; PAM type: NRG; PAM sequence: AAG
cctttactcccttagggtag

SEQ ID NO: 65325 - DNA, 20 bp, Artificial Sequence
  Description of Artificial Sequence: Synthetic oligonucleotide
  Target: ATXN1; (-) strand; PAM type: NRG; PAM sequence: TAG
tgccctttactcccttaggg

SEQ ID NO: 65326 - DNA, 20 bp, Artificial Sequence
  Description of Artificial Sequence: Synthetic oligonucleotide
  Target: ATXN1; (-) strand; PAM type: NRG; PAM sequence: GGG
gcatgccctttactccctta

SEQ ID NO: 65327 - DNA, 20 bp, Artificial Sequence
  Description of Artificial Sequence: Synthetic oligonucleotide
  Target: ATXN1; (-) strand; PAM type: NRG; PAM sequence: AGG
ggcatgccctttactccctt

SEQ ID NO: 65328 - DNA, 20 bp, Artificial Sequence
  Description of Artificial Sequence: Synthetic oligonucleotide
  Target: ATXN1; (-) strand; PAM type: NRG; PAM sequence: TAG
tggcatgccctttactccct

SEQ ID NO: 65329 - DNA, 20 bp, Artificial Sequence
  Description of Artificial Sequence: Synthetic oligonucleotide
  Target: ATXN1; (-) strand; PAM type: NRG; PAM sequence: TGG
atgatgttatcaataatcat

SEQ ID NO: 65330 - DNA, 20 bp, Artificial Sequence
  Description of Artificial Sequence: Synthetic oligonucleotide
  Target: ATXN1; (-) strand; PAM type: NRG; PAM sequence: TGG
agtggtgtcaactcattaca

SEQ ID NO: 65331 - DNA, 20 bp, Artificial Sequence
  Description of Artificial Sequence: Synthetic oligonucleotide
  Target: ATXN1; (-) strand; PAM type: NRG; PAM sequence: TGG
catcctttggtttatttcag

SEQ ID NO: 65332 - DNA, 20 bp, Artificial Sequence
  Description of Artificial Sequence: Synthetic oligonucleotide
  Target: ATXN1; (-) strand; PAM type: NRG; PAM sequence: CAG
ctacatcctttggtttattt

SEQ ID NO: 65333 - DNA, 20 bp, Artificial Sequence
  Description of Artificial Sequence: Synthetic oligonucleotide
  Target: ATXN1; (-) strand; PAM type: NRG; PAM sequence: TGG
acatacatccctacatcctt

SEQ ID NO: 65334 - DNA, 20 bp, Artificial Sequence
  Description of Artificial Sequence: Synthetic oligonucleotide
  Target: ATXN1; (-) strand; PAM type: NRG; PAM sequence: CAG
catctgtccattcatccatc

SEQ ID NO: 65335 - DNA, 20 bp, Artificial Sequence
  Description of Artificial Sequence: Synthetic oligonucleotide
  Target: ATXN1; (-) strand; PAM type: NRG; PAM sequence: CGG
agtatatgtattttggtcac

SEQ ID NO: 65336 - DNA, 20 bp, Artificial Sequence
  Description of Artificial Sequence: Synthetic oligonucleotide
  Target: ATXN1; (-) strand; PAM type: NRG; PAM sequence: TGG
acggaggagtatatgtattt

SEQ ID NO: 65337 - DNA, 20 bp, Artificial Sequence
  Description of Artificial Sequence: Synthetic oligonucleotide
  Target: ATXN1; (-) strand; PAM type: NRG; PAM sequence: GAG
ccttaatatataacacggag

SEQ ID NO: 65338 - DNA, 20 bp, Artificial Sequence
  Description of Artificial Sequence: Synthetic oligonucleotide
  Target: ATXN1; (-) strand; PAM type: NRG; PAM sequence: AGG
agccttaatatataacacgg

SEQ ID NO: 65339 - DNA, 20 bp, Artificial Sequence
  Description of Artificial Sequence: Synthetic oligonucleotide
  Target: ATXN1; (-) strand; PAM type: NRG; PAM sequence: GAG
cagccttaatatataacacg

SEQ ID NO: 65340 - DNA, 20 bp, Artificial Sequence
  Description of Artificial Sequence: Synthetic oligonucleotide
  Target: ATXN1; (-) strand; PAM type: NRG; PAM sequence: CGG
agcagccttaatatataaca

SEQ ID NO: 65341 - DNA, 20 bp, Artificial Sequence
  Description of Artificial Sequence: Synthetic oligonucleotide
  Target: ATXN1; (-) strand; PAM type: NRG; PAM sequence: CAG
aggacagtgttctaaaaaag

SEQ ID NO: 65342 - DNA, 20 bp, Artificial Sequence
  Description of Artificial Sequence: Synthetic oligonucleotide
  Target: ATXN1; (-) strand; PAM type: NRG; PAM sequence: AAG
agaaggacagtgttctaaaa

SEQ ID NO: 65343 - DNA, 20 bp, Artificial Sequence
  Description of Artificial Sequence: Synthetic oligonucleotide
  Target: ATXN1; (-) strand; PAM type: NRG; PAM sequence: CAG
gataatttgggtaagaagga

SEQ ID NO: 65344 - DNA, 20 bp, Artificial Sequence
  Description of Artificial Sequence: Synthetic oligonucleotide
  Target: ATXN1; (-) strand; PAM type: NRG; PAM sequence: AGG
cagtgataatttgggtaaga

SEQ ID NO: 65345 - DNA, 20 bp, Artificial Sequence
  Description of Artificial Sequence: Synthetic oligonucleotide
  Target: ATXN1; (-) strand; PAM type: NRG; PAM sequence: AAG
acagtgataatttgggtaag

SEQ ID NO: 65346 - DNA, 20 bp, Artificial Sequence
  Description of Artificial Sequence: Synthetic oligonucleotide
  Target: ATXN1; (-) strand; PAM type: NRG; PAM sequence: AAG
tctacagtgataatttgggt

SEQ ID NO: 65347 - DNA, 20 bp, Artificial Sequence
  Description of Artificial Sequence: Synthetic oligonucleotide
  Target: ATXN1; (-) strand; PAM type: NRG; PAM sequence: GGG
tgcttctacagtgataattt

SEQ ID NO: 65348 - DNA, 20 bp, Artificial Sequence
  Description of Artificial Sequence: Synthetic oligonucleotide
  Target: ATXN1; (-) strand; PAM type: NRG; PAM sequence: TGG
ctgcttctacagtgataatt

SEQ ID NO: 65349 - DNA, 20 bp, Artificial Sequence
  Description of Artificial Sequence: Synthetic oligonucleotide
  Target: ATXN1; (-) strand; PAM type: NRG; PAM sequence: CAG
agcatgatgatctgcttcta

SEQ ID NO: 65350 - DNA, 20 bp, Artificial Sequence
  Description of Artificial Sequence: Synthetic oligonucleotide
  Target: ATXN1; (-) strand; PAM type: NRG; PAM sequence: AAG
ccatcatattctaaggctta

SEQ ID NO: 65351 - DNA, 20 bp, Artificial Sequence
  Description of Artificial Sequence: Synthetic oligonucleotide
  Target: ATXN1; (-) strand; PAM type: NRG; PAM sequence: AGG
ttgaaatccatcatattcta

SEQ ID NO: 65352 - DNA, 20 bp, Artificial Sequence
  Description of Artificial Sequence: Synthetic oligonucleotide
  Target: ATXN1; (-) strand; PAM type: NRG; PAM sequence: AAG
attgaaatccatcatattct

SEQ ID NO: 65353 - DNA, 20 bp, Artificial Sequence
  Description of Artificial Sequence: Synthetic oligonucleotide
  Target: ATXN1; (-) strand; PAM type: NRG; PAM sequence: CAG
aaaatctcacagatatgatg

SEQ ID NO: 65354 - DNA, 20 bp, Artificial Sequence
  Description of Artificial Sequence: Synthetic oligonucleotide
  Target: ATXN1; (-) strand; PAM type: NRG; PAM sequence: CAG
gttcctaaccaaaaatctca

SEQ ID NO: 65355 - DNA, 20 bp, Artificial Sequence
  Description of Artificial Sequence: Synthetic oligonucleotide
  Target: ATXN1; (-) strand; PAM type: NRG; PAM sequence: AAG
attggacaaattcatattaa

SEQ ID NO: 65356 - DNA, 20 bp, Artificial Sequence
  Description of Artificial Sequence: Synthetic oligonucleotide
  Target: ATXN1; (-) strand; PAM type: NRG; PAM sequence: TGG
ttttgcattactgaaaaaat

SEQ ID NO: 65357 - DNA, 20 bp, Artificial Sequence
  Description of Artificial Sequence: Synthetic oligonucleotide
  Target: ATXN1; (-) strand; PAM type: NRG; PAM sequence: AAG
acaacagatattaaaccaaa

SEQ ID NO: 65358 - DNA, 20 bp, Artificial Sequence
  Description of Artificial Sequence: Synthetic oligonucleotide
  Target: ATXN1; (-) strand; PAM type: NRG; PAM sequence: CAG
gacaagggtaggaataacaa

SEQ ID NO: 65359 - DNA, 20 bp, Artificial Sequence
  Description of Artificial Sequence: Synthetic oligonucleotide
  Target: ATXN1; (-) strand; PAM type: NRG; PAM sequence: AGG
tgagtttggctgacaagggt

SEQ ID NO: 65360 - DNA, 20 bp, Artificial Sequence
  Description of Artificial Sequence: Synthetic oligonucleotide
  Target: ATXN1; (-) strand; PAM type: NRG; PAM sequence: TAG
atgagtttggctgacaaggg

SEQ ID NO: 65361 - DNA, 20 bp, Artificial Sequence
  Description of Artificial Sequence: Synthetic oligonucleotide
  Target: ATXN1; (-) strand; PAM type: NRG; PAM sequence: GGG
tttatgagtttggctgacaa

SEQ ID NO: 65362 - DNA, 20 bp, Artificial Sequence
  Description of Artificial Sequence: Synthetic oligonucleotide
  Target: ATXN1; (-) strand; PAM type: NRG; PAM sequence: AGG
ttttatgagtttggctgaca

SEQ ID NO: 65363 - DNA, 20 bp, Artificial Sequence
  Description of Artificial Sequence: Synthetic oligonucleotide
  Target: ATXN1; (-) strand; PAM type: NRG; PAM sequence: AAG
attttatgagtttggctgac

SEQ ID NO: 65364 - DNA, 20 bp, Artificial Sequence
  Description of Artificial Sequence: Synthetic oligonucleotide
  Target: ATXN1; (-) strand; PAM type: NRG; PAM sequence: TGG
aaatctttattttatgagtt

SEQ ID NO: 65365 - DNA, 20 bp, Artificial Sequence
  Description of Artificial Sequence: Synthetic oligonucleotide
  Target: ATXN1; (-) strand; PAM type: NRG; PAM sequence: GAG
ttagaaaatctttattttat

SEQ ID NO: 65366 - DNA, 20 bp, Artificial Sequence
  Description of Artificial Sequence: Synthetic oligonucleotide
  Target: ATXN1; (-) strand; PAM type: NRG; PAM sequence: TAG
aatttctaaataccatatat

SEQ ID NO: 65367 - DNA, 20 bp, Artificial Sequence
  Description of Artificial Sequence: Synthetic oligonucleotide
  Target: ATXN1; (-) strand; PAM type: NRG; PAM sequence: GAG
caaacaccttctatagtgca

SEQ ID NO: 65368 - DNA, 20 bp, Artificial Sequence
  Description of Artificial Sequence: Synthetic oligonucleotide
  Target: ATXN1; (-) strand; PAM type: NRG; PAM sequence: CAG
ttcaaacaccttctatagtg

SEQ ID NO: 65369 - DNA, 20 bp, Artificial Sequence
  Description of Artificial Sequence: Synthetic oligonucleotide
  Target: ATXN1; (-) strand; PAM type: NRG; PAM sequence: TAG
ttaacttcaaacaccttcta

SEQ ID NO: 65370 - DNA, 20 bp, Artificial Sequence
  Description of Artificial Sequence: Synthetic oligonucleotide
  Target: ATXN1; (-) strand; PAM type: NRG; PAM sequence: TGG
ggacattgcagtgctgtggc

SEQ ID NO: 65371 - DNA, 20 bp, Artificial Sequence
  Description of Artificial Sequence: Synthetic oligonucleotide
  Target: ATXN1; (-) strand; PAM type: NRG; PAM sequence: TGG
cttcggacattgcagtgctg

SEQ ID NO: 65372 - DNA, 20 bp, Artificial Sequence
  Description of Artificial Sequence: Synthetic oligonucleotide
  Target: ATXN1; (-) strand; PAM type: NRG; PAM sequence: CAG
cagagttccttcggacattg

SEQ ID NO: 65373 - DNA, 20 bp, Artificial Sequence
  Description of Artificial Sequence: Synthetic oligonucleotide
  Target: ATXN1; (-) strand; PAM type: NRG; PAM sequence: CGG
ggaacgtttcagagttcctt

SEQ ID NO: 65374 - DNA, 20 bp, Artificial Sequence
  Description of Artificial Sequence: Synthetic oligonucleotide
  Target: ATXN1; (-) strand; PAM type: NRG; PAM sequence: GAG
gaggcatgaggaacgtttca

SEQ ID NO: 65375 - DNA, 20 bp, Artificial Sequence
  Description of Artificial Sequence: Synthetic oligonucleotide
  Target: ATXN1; (-) strand; PAM type: NRG; PAM sequence: CAG
tagaggcatgaggaacgttt

SEQ ID NO: 65376 - DNA, 20 bp, Artificial Sequence
  Description of Artificial Sequence: Synthetic oligonucleotide
  Target: ATXN1; (-) strand; PAM type: NRG; PAM sequence: AGG
cagtctttcctagaggcatg

SEQ ID NO: 65377 - DNA, 20 bp, Artificial Sequence
  Description of Artificial Sequence: Synthetic oligonucleotide
  Target: ATXN1; (-) strand; PAM type: NRG; PAM sequence: GAG
tcagtctttcctagaggcat

SEQ ID NO: 65378 - DNA, 20 bp, Artificial Sequence
  Description of Artificial Sequence: Synthetic oligonucleotide
  Target: ATXN1; (-) strand; PAM type: NRG; PAM sequence: AGG
caaaggtcagtctttcctag

SEQ ID NO: 65379 - DNA, 20 bp, Artificial Sequence
  Description of Artificial Sequence: Synthetic oligonucleotide
  Target: ATXN1; (-) strand; PAM type: NRG; PAM sequence: GAG
tcaaaggtcagtctttccta

SEQ ID NO: 65380 - DNA, 20 bp, Artificial Sequence
  Description of Artificial Sequence: Synthetic oligonucleotide
  Target: ATXN1; (-) strand; PAM type: NRG; PAM sequence: TAG
attcaaaggtcagtctttcc

SEQ ID NO: 65381 - DNA, 20 bp, Artificial Sequence
  Description of Artificial Sequence: Synthetic oligonucleotide
  Target: ATXN1; (-) strand; PAM type: NRG; PAM sequence: CAG
tgtctggcgtattcaaaggt

SEQ ID NO: 65382 - DNA, 20 bp, Artificial Sequence
  Description of Artificial Sequence: Synthetic oligonucleotide
  Target: ATXN1; (-) strand; PAM type: NRG; PAM sequence: AGG
tacttgtctggcgtattcaa

SEQ ID NO: 65383 - DNA, 20 bp, Artificial Sequence
  Description of Artificial Sequence: Synthetic oligonucleotide
  Target: ATXN1; (-) strand; PAM type: NRG; PAM sequence: AAG
atacttgtctggcgtattca

SEQ ID NO: 65384 - DNA, 20 bp, Artificial Sequence
  Description of Artificial Sequence: Synthetic oligonucleotide
  Target: ATXN1; (-) strand; PAM type: NRG; PAM sequence: TGG
tgctaagaaaaatacttgtc

SEQ ID NO: 65385 - DNA, 20 bp, Artificial Sequence
  Description of Artificial Sequence: Synthetic oligonucleotide
  Target: ATXN1; (-) strand; PAM type: NRG; PAM sequence: AAG
attgctcataaatgtttgct

SEQ ID NO: 65386 - DNA, 20 bp, Artificial Sequence
  Description of Artificial Sequence: Synthetic oligonucleotide
  Target: ATXN1; (-) strand; PAM type: NRG; PAM sequence: GAG
taaacactaatatagtgatt

SEQ ID NO: 65387 - DNA, 20 bp, Artificial Sequence
  Description of Artificial Sequence: Synthetic oligonucleotide
  Target: ATXN1; (-) strand; PAM type: NRG; PAM sequence: TAG
aaagcccttaaacactaata

SEQ ID NO: 65388 - DNA, 20 bp, Artificial Sequence
  Description of Artificial Sequence: Synthetic oligonucleotide
  Target: ATXN1; (-) strand; PAM type: NRG; PAM sequence: AAG
aaagagcttctatacaggaa

SEQ ID NO: 65389 - DNA, 20 bp, Artificial Sequence
  Description of Artificial Sequence: Synthetic oligonucleotide
  Target: ATXN1; (-) strand; PAM type: NRG; PAM sequence: AGG
caaagaaagagcttctatac

SEQ ID NO: 65390 - DNA, 20 bp, Artificial Sequence
  Description of Artificial Sequence: Synthetic oligonucleotide
  Target: ATXN1; (-) strand; PAM type: NRG; PAM sequence: CAG
tcaaagaaagagcttctata

SEQ ID NO: 65391 - DNA, 20 bp, Artificial Sequence
  Description of Artificial Sequence: Synthetic oligonucleotide
  Target: ATXN1; (-) strand; PAM type: NRG; PAM sequence: GAG
ggagacttcagtcaaagaaa

SEQ ID NO: 65392 - DNA, 20 bp, Artificial Sequence
  Description of Artificial Sequence: Synthetic oligonucleotide
  Target: ATXN1; (-) strand; PAM type: NRG; PAM sequence: AAG
ttggagacttcagtcaaaga

SEQ ID NO: 65393 - DNA, 20 bp, Artificial Sequence
  Description of Artificial Sequence: Synthetic oligonucleotide
  Target: ATXN1; (-) strand; PAM type: NRG; PAM sequence: AAG
ggctttggagacttcagtca

SEQ ID NO: 65394 - DNA, 20 bp, Artificial Sequence
  Description of Artificial Sequence: Synthetic oligonucleotide
  Target: ATXN1; (-) strand; PAM type: NRG; PAM sequence: CAG
aaatttggctttggagactt

SEQ ID NO: 65395 - DNA, 20 bp, Artificial Sequence
  Description of Artificial Sequence: Synthetic oligonucleotide
  Target: ATXN1; (-) strand; PAM type: NRG; PAM sequence: GAG
taattgtaaatttggctttg

SEQ ID NO: 65396 - DNA, 20 bp, Artificial Sequence
  Description of Artificial Sequence: Synthetic oligonucleotide
  Target: ATXN1; (-) strand; PAM type: NRG; PAM sequence: TGG
aataattgtaaatttggctt

SEQ ID NO: 65397 - DNA, 20 bp, Artificial Sequence
  Description of Artificial Sequence: Synthetic oligonucleotide
  Target: ATXN1; (-) strand; PAM type: NRG; PAM sequence: TGG
atacataataattgtaaatt

SEQ ID NO: 65398 - DNA, 20 bp, Artificial Sequence
  Description of Artificial Sequence: Synthetic oligonucleotide
  Target: ATXN1; (-) strand; PAM type: NRG; PAM sequence: AGG
tattatattaccttttattc

SEQ ID NO: 65399 - DNA, 20 bp, Artificial Sequence
  Description of Artificial Sequence: Synthetic oligonucleotide
  Target: ATXN1; (-) strand; PAM type: NRG; PAM sequence: CAG
atattatattaccttttatt

SEQ ID NO: 65400 - DNA, 20 bp, Artificial Sequence
  Description of Artificial Sequence: Synthetic oligonucleotide
  Target: ATXN1; (-) strand; PAM type: NRG; PAM sequence: GAG
ttttctgagggctttctttg

SEQ ID NO: 65401 - DNA, 20 bp, Artificial Sequence
  Description of Artificial Sequence: Synthetic oligonucleotide
  Target: ATXN1; (-) strand; PAM type: NRG; PAM sequence: TGG
gcttttctgagggctttctt

SEQ ID NO: 65402 - DNA, 20 bp, Artificial Sequence
  Description of Artificial Sequence: Synthetic oligonucleotide
  Target: ATXN1; (-) strand; PAM type: NRG; PAM sequence: GGG
gggtacttaggcttttctga

SEQ ID NO: 65403 - DNA, 20 bp, Artificial Sequence
  Description of Artificial Sequence: Synthetic oligonucleotide
  Target: ATXN1; (-) strand; PAM type: NRG; PAM sequence: AGG
agggtacttaggcttttctg

SEQ ID NO: 65404 - DNA, 20 bp, Artificial Sequence
  Description of Artificial Sequence: Synthetic oligonucleotide
  Target: ATXN1; (-) strand; PAM type: NRG; PAM sequence: GAG
aagggtacttaggcttttct

SEQ ID NO: 65405 - DNA, 20 bp, Artificial Sequence
  Description of Artificial Sequence: Synthetic oligonucleotide
  Target: ATXN1; (-) strand; PAM type: NRG; PAM sequence: AGG
ctcaaaaattaagggtactt

SEQ ID NO: 65406 - DNA, 20 bp, Artificial Sequence
  Description of Artificial Sequence: Synthetic oligonucleotide
  Target: ATXN1; (-) strand; PAM type: NRG; PAM sequence: TAG
actcaaaaattaagggtact

SEQ ID NO: 65407 - DNA, 20 bp, Artificial Sequence
  Description of Artificial Sequence: Synthetic oligonucleotide
  Target: ATXN1; (-) strand; PAM type: NRG; PAM sequence: GGG
tgtaagaactcaaaaattaa

SEQ ID NO: 65408 - DNA, 20 bp, Artificial Sequence
  Description of Artificial Sequence: Synthetic oligonucleotide
  Target: ATXN1; (-) strand; PAM type: NRG; PAM sequence: AGG
ttgtaagaactcaaaaatta

SEQ ID NO: 65409 - DNA, 20 bp, Artificial Sequence
  Description of Artificial Sequence: Synthetic oligonucleotide
  Target: ATXN1; (-) strand; PAM type: NRG; PAM sequence: AAG
tttgtaagaactcaaaaatt

SEQ ID NO: 65410 - DNA, 20 bp, Artificial Sequence
  Description of Artificial Sequence: Synthetic oligonucleotide
  Target: ATXN1; (-) strand; PAM type: NRG; PAM sequence: AAG
atagatacaataaactttgt

SEQ ID NO: 65411 - DNA, 20 bp, Artificial Sequence
  Description of Artificial Sequence: Synthetic oligonucleotide
  Target: ATXN1; (-) strand; PAM type: NRG; PAM sequence: TAG
tactttatttaagagaccaa

SEQ ID NO: 65412 - DNA, 20 bp, Artificial Sequence
  Description of Artificial Sequence: Synthetic oligonucleotide
  Target: ATXN1; (-) strand; PAM type: NRG; PAM sequence: GAG
ataaagactactttatttaa

SEQ ID NO: 65413 - DNA, 20 bp, Artificial Sequence
  Description of Artificial Sequence: Synthetic oligonucleotide
  Target: ATXN1; (-) strand; PAM type: NRG; PAM sequence: AAG
ccataaagactactttattt

SEQ ID NO: 65414 - DNA, 20 bp, Artificial Sequence
  Description of Artificial Sequence: Synthetic oligonucleotide
  Target: ATXN1; (-) strand; PAM type: NRG; PAM sequence: AAG
aaggtaatatgtcttccata

SEQ ID NO: 65415 - DNA, 20 bp, Artificial Sequence
  Description of Artificial Sequence: Synthetic oligonucleotide
  Target: ATXN1; (-) strand; PAM type: NRG; PAM sequence: AGG
catttatcaaggtagtttta

SEQ ID NO: 65416 - DNA, 20 bp, Artificial Sequence
  Description of Artificial Sequence: Synthetic oligonucleotide
  Target: ATXN1; (-) strand; PAM type: NRG; PAM sequence: AAG
gcatttatcaaggtagtttt

SEQ ID NO: 65417 - DNA, 20 bp, Artificial Sequence
  Description of Artificial Sequence: Synthetic oligonucleotide
  Target: ATXN1; (-) strand; PAM type: NRG; PAM sequence: TAG
caaactagcatttatcaagg

SEQ ID NO: 65418 - DNA, 20 bp, Artificial Sequence
  Description of Artificial Sequence: Synthetic oligonucleotide
  Target: ATXN1; (-) strand; PAM type: NRG; PAM sequence: AGG
tgccaaactagcatttatca

SEQ ID NO: 65419 - DNA, 20 bp, Artificial Sequence
  Description of Artificial Sequence: Synthetic oligonucleotide
  Target: ATXN1; (-) strand; PAM type: NRG; PAM sequence: AAG
atgccaaactagcatttatc

SEQ ID NO: 65420 - DNA, 20 bp, Artificial Sequence
  Description of Artificial Sequence: Synthetic oligonucleotide
  Target: ATXN1; (-) strand; PAM type: NRG; PAM sequence: TAG
gttatataaacatgccaaac

SEQ ID NO: 65421 - DNA, 20 bp, Artificial Sequence
  Description of Artificial Sequence: Synthetic oligonucleotide
  Target: ATXN1; (-) strand; PAM type: NRG; PAM sequence: TGG
ggaaaaacagttctgttagg

SEQ ID NO: 65422 - DNA, 20 bp, Artificial Sequence
  Description of Artificial Sequence: Synthetic oligonucleotide
  Target: ATXN1; (-) strand; PAM type: NRG; PAM sequence: AGG
aaaggaaaaacagttctgtt

SEQ ID NO: 65423 - DNA, 20 bp, Artificial Sequence
  Description of Artificial Sequence: Synthetic oligonucleotide
  Target: ATXN1; (-) strand; PAM type: NRG; PAM sequence: TAG
aaaaggaaaaacagttctgt

SEQ ID NO: 65424 - DNA, 20 bp, Artificial Sequence
  Description of Artificial Sequence: Synthetic oligonucleotide
  Target: ATXN1; (-) strand; PAM type: NRG; PAM sequence: CAG
ttaaaaaacaaaaggaaaaa

SEQ ID NO: 65425 - DNA, 20 bp, Artificial Sequence
  Description of Artificial Sequence: Synthetic oligonucleotide
  Target: ATXN1; (-) strand; PAM type: NRG; PAM sequence: AGG
ttcttccattaaaaaacaaa

SEQ ID NO: 65426 - DNA, 20 bp, Artificial Sequence
  Description of Artificial Sequence: Synthetic oligonucleotide
  Target: ATXN1; (-) strand; PAM type: NRG; PAM sequence: AAG
tttcttccattaaaaaacaa

SEQ ID NO: 65427 - DNA, 20 bp, Artificial Sequence
  Description of Artificial Sequence: Synthetic oligonucleotide
  Target: ATXN1; (-) strand; PAM type: NRG; PAM sequence: TAG
atacttccaagaataattac

SEQ ID NO: 65428 - DNA, 20 bp, Artificial Sequence
  Description of Artificial Sequence: Synthetic oligonucleotide
  Target: ATXN1; (-) strand; PAM type: NRG; PAM sequence: AAG
actaggaaagtcatacttcc

SEQ ID NO: 65429 - DNA, 20 bp, Artificial Sequence
  Description of Artificial Sequence: Synthetic oligonucleotide
  Target: ATXN1; (-) strand; PAM type: NRG; PAM sequence: AAG
tccagtgcttgcaactagga

SEQ ID NO: 65430 - DNA, 20 bp, Artificial Sequence
  Description of Artificial Sequence: Synthetic oligonucleotide
  Target: ATXN1; (-) strand; PAM type: NRG; PAM sequence: AGG
gacatccagtgcttgcaact

SEQ ID NO: 65431 - DNA, 20 bp, Artificial Sequence
  Description of Artificial Sequence: Synthetic oligonucleotide
  Target: ATXN1; (-) strand; PAM type: NRG; PAM sequence: TAG
tgacatccagtgcttgcaac

SEQ ID NO: 65432 - DNA, 20 bp, Artificial Sequence
  Description of Artificial Sequence: Synthetic oligonucleotide
  Target: ATXN1; (-) strand; PAM type: NRG; PAM sequence: CAG
tttttatttatagtgacatc

SEQ ID NO: 65433 - DNA, 20 bp, Artificial Sequence
  Description of Artificial Sequence: Synthetic oligonucleotide
  Target: ATXN1; (-) strand; PAM type: NRG; PAM sequence: TAG
ttaaaatgcttttttattta

SEQ ID NO: 65434 - DNA, 20 bp, Artificial Sequence
  Description of Artificial Sequence: Synthetic oligonucleotide
  Target: ATXN1; (-) strand; PAM type: NRG; PAM sequence: AAG
acttactgtgttgcttttaa

SEQ ID NO: 65435 - DNA, 20 bp, Artificial Sequence
  Description of Artificial Sequence: Synthetic oligonucleotide
  Target: ATXN1; (-) strand; PAM type: NRG; PAM sequence: GAG
tttttcttcattcttcctgt

SEQ ID NO: 65436 - DNA, 20 bp, Artificial Sequence
  Description of Artificial Sequence: Synthetic oligonucleotide
  Target: ATXN1; (-) strand; PAM type: NRG; PAM sequence: GAG
atcctaaaccatattattaa

SEQ ID NO: 65437 - DNA, 20 bp, Artificial Sequence
  Description of Artificial Sequence: Synthetic oligonucleotide
  Target: ATXN1; (-) strand; PAM type: NRG; PAM sequence: AAG
atatcctaaaccatattatt

SEQ ID NO: 65438 - DNA, 20 bp, Artificial Sequence
  Description of Artificial Sequence: Synthetic oligonucleotide
  Target: ATXN1; (-) strand; PAM type: NRG; PAM sequence: GGG
tagggaggcatcctacattg

SEQ ID NO: 65439 - DNA, 20 bp, Artificial Sequence
  Description of Artificial Sequence: Synthetic oligonucleotide
  Target: ATXN1; (-) strand; PAM type: NRG; PAM sequence: GGG
atagggaggcatcctacatt

SEQ ID NO: 65440 - DNA, 20 bp, Artificial Sequence
  Description of Artificial Sequence: Synthetic oligonucleotide
  Target: ATXN1; (-) strand; PAM type: NRG; PAM sequence: TGG
tatagggaggcatcctacat

SEQ ID NO: 65441 - DNA, 20 bp, Artificial Sequence
  Description of Artificial Sequence: Synthetic oligonucleotide
  Target: ATXN1; (-) strand; PAM type: NRG; PAM sequence: AGG
atgtgagcatggctataggg

SEQ ID NO: 65442 - DNA, 20 bp, Artificial Sequence
  Description of Artificial Sequence: Synthetic oligonucleotide
  Target: ATXN1; (-) strand; PAM type: NRG; PAM sequence: GAG
aatgtgagcatggctatagg

SEQ ID NO: 65443 - DNA, 20 bp, Artificial Sequence
  Description of Artificial Sequence: Synthetic oligonucleotide
  Target: ATXN1; (-) strand; PAM type: NRG; PAM sequence: GGG
ttaatgtgagcatggctata

SEQ ID NO: 65444 - DNA, 20 bp, Artificial Sequence
  Description of Artificial Sequence: Synthetic oligonucleotide
  Target: ATXN1; (-) strand; PAM type: NRG; PAM sequence: AGG
gttaatgtgagcatggctat

SEQ ID NO: 65445 - DNA, 20 bp, Artificial Sequence
  Description of Artificial Sequence: Synthetic oligonucleotide
  Target: ATXN1; (-) strand; PAM type: NRG; PAM sequence: TAG
agttaatgtgagcatggcta

SEQ ID NO: 65446 - DNA, 20 bp, Artificial Sequence
  Description of Artificial Sequence: Synthetic oligonucleotide
  Target: ATXN1; (-) strand; PAM type: NRG; PAM sequence: TGG
gcccacagttaatgtgagca

SEQ ID NO: 65447 - DNA, 20 bp, Artificial Sequence
  Description of Artificial Sequence: Synthetic oligonucleotide
  Target: ATXN1; (-) strand; PAM type: NRG; PAM sequence: GAG
gccaagcccacagttaatgt

SEQ ID NO: 65448 - DNA, 20 bp, Artificial Sequence
  Description of Artificial Sequence: Synthetic oligonucleotide
  Target: ATXN1; (-) strand; PAM type: NRG; PAM sequence: CAG
aagacatatagccaagccca

SEQ ID NO: 65449 - DNA, 20 bp, Artificial Sequence
  Description of Artificial Sequence: Synthetic oligonucleotide
  Target: ATXN1; (-) strand; PAM type: NRG; PAM sequence: AAG
ccaaaaaaagacatatagcc

SEQ ID NO: 65450 - DNA, 20 bp, Artificial Sequence
  Description of Artificial Sequence: Synthetic oligonucleotide
  Target: ATXN1; (-) strand; PAM type: NRG; PAM sequence: TAG
attggccaaaaaaagacata

SEQ ID NO: 65451 - DNA, 20 bp, Artificial Sequence
  Description of Artificial Sequence: Synthetic oligonucleotide
  Target: ATXN1; (-) strand; PAM type: NRG; PAM sequence: AAG
gagaccccattggccaaaaa

SEQ ID NO: 65452 - DNA, 20 bp, Artificial Sequence
  Description of Artificial Sequence: Synthetic oligonucleotide
  Target: ATXN1; (-) strand; PAM type: NRG; PAM sequence: TGG
tacatttgttgagaccccat

SEQ ID NO: 65453 - DNA, 20 bp, Artificial Sequence
  Description of Artificial Sequence: Synthetic oligonucleotide
  Target: ATXN1; (-) strand; PAM type: NRG; PAM sequence: GAG
attcgttggttacatttgtt

SEQ ID NO: 65454 - DNA, 20 bp, Artificial Sequence
  Description of Artificial Sequence: Synthetic oligonucleotide
  Target: ATXN1; (-) strand; PAM type: NRG; PAM sequence: TGG
gtgcccattcctatattcgt

SEQ ID NO: 65455 - DNA, 20 bp, Artificial Sequence
  Description of Artificial Sequence: Synthetic oligonucleotide
  Target: ATXN1; (-) strand; PAM type: NRG; PAM sequence: AAG
gaaatttcatcctaagccgc

SEQ ID NO: 65456 - DNA, 20 bp, Artificial Sequence
  Description of Artificial Sequence: Synthetic oligonucleotide
  Target: ATXN1; (-) strand; PAM type: NRG; PAM sequence: AAG
attaccagaaatttcatcct

SEQ ID NO: 65457 - DNA, 20 bp, Artificial Sequence
  Description of Artificial Sequence: Synthetic oligonucleotide
  Target: ATXN1; (-) strand; PAM type: NRG; PAM sequence: CAG
tctgtgtttgatgctattac

SEQ ID NO: 65458 - DNA, 20 bp, Artificial Sequence
  Description of Artificial Sequence: Synthetic oligonucleotide
  Target: ATXN1; (-) strand; PAM type: NRG; PAM sequence: AAG
tcatgtagtatcgttttcca

SEQ ID NO: 65459 - DNA, 20 bp, Artificial Sequence
  Description of Artificial Sequence: Synthetic oligonucleotide
  Target: ATXN1; (-) strand; PAM type: NRG; PAM sequence: TAG
gaactacatggcaggtcatg

SEQ ID NO: 65460 - DNA, 20 bp, Artificial Sequence
  Description of Artificial Sequence: Synthetic oligonucleotide
  Target: ATXN1; (-) strand; PAM type: NRG; PAM sequence: AGG
cacgttttgaactacatggc

SEQ ID NO: 65461 - DNA, 20 bp, Artificial Sequence
  Description of Artificial Sequence: Synthetic oligonucleotide
  Target: ATXN1; (-) strand; PAM type: NRG; PAM sequence: CAG
tcacgttttgaactacatgg

SEQ ID NO: 65462 - DNA, 20 bp, Artificial Sequence
  Description of Artificial Sequence: Synthetic oligonucleotide
  Target: ATXN1; (-) strand; PAM type: NRG; PAM sequence: TGG
tcctcacgttttgaactaca

SEQ ID NO: 65463 - DNA, 20 bp, Artificial Sequence
  Description of Artificial Sequence: Synthetic oligonucleotide
  Target: ATXN1; (-) strand; PAM type: NRG; PAM sequence: CAG
acaacttttatctactatat

SEQ ID NO: 65464 - DNA, 20 bp, Artificial Sequence
  Description of Artificial Sequence: Synthetic oligonucleotide
  Target: ATXN1; (-) strand; PAM type: NRG; PAM sequence: TAG
aaataatatatacattaatt

SEQ ID NO: 65465 - DNA, 20 bp, Artificial Sequence
  Description of Artificial Sequence: Synthetic oligonucleotide
  Target: ATXN1; (-) strand; PAM type: NRG; PAM sequence: AAG
gcttaaattatttaatctca

SEQ ID NO: 65466 - DNA, 20 bp, Artificial Sequence
  Description of Artificial Sequence: Synthetic oligonucleotide
  Target: ATXN1; (-) strand; PAM type: NRG; PAM sequence: CAG
agagatttctattaaaccat

SEQ ID NO: 65467 - DNA, 20 bp, Artificial Sequence
  Description of Artificial Sequence: Synthetic oligonucleotide
  Target: ATXN1; (-) strand; PAM type: NRG; PAM sequence: GAG
tataagcatttaaggattta

SEQ ID NO: 65468 - DNA, 20 bp, Artificial Sequence
  Description of Artificial Sequence: Synthetic oligonucleotide
  Target: ATXN1; (-) strand; PAM type: NRG; PAM sequence: TAG
tctataagcatttaaggatt

SEQ ID NO: 65469 - DNA, 20 bp, Artificial Sequence
  Description of Artificial Sequence: Synthetic oligonucleotide
  Target: ATXN1; (-) strand; PAM type: NRG; PAM sequence: AGG
agtttgtctataagcattta

SEQ ID NO: 65470 - DNA, 20 bp, Artificial Sequence
  Description of Artificial Sequence: Synthetic oligonucleotide
  Target: ATXN1; (-) strand; PAM type: NRG; PAM sequence: AAG
cagtttgtctataagcattt

SEQ ID NO: 65471 - DNA, 20 bp, Artificial Sequence
  Description of Artificial Sequence: Synthetic oligonucleotide
  Target: ATXN1; (-) strand; PAM type: NRG; PAM sequence: AAG
tttttggccagtttgtctat

SEQ ID NO: 65472 - DNA, 20 bp, Artificial Sequence
  Description of Artificial Sequence: Synthetic oligonucleotide
  Target: ATXN1; (-) strand; PAM type: NRG; PAM sequence: CAG
ctttcaatgaattttttggc

SEQ ID NO: 65473 - DNA, 20 bp, Artificial Sequence
  Description of Artificial Sequence: Synthetic oligonucleotide
  Target: ATXN1; (-) strand; PAM type: NRG; PAM sequence: TGG
tatcctttcaatgaattttt

SEQ ID NO: 65474 - DNA, 20 bp, Artificial Sequence
  Description of Artificial Sequence: Synthetic oligonucleotide
  Target: ATXN1; (-) strand; PAM type: NRG; PAM sequence: AAG
gggcctgcattataccatag

SEQ ID NO: 65475 - DNA, 20 bp, Artificial Sequence
  Description of Artificial Sequence: Synthetic oligonucleotide
  Target: ATXN1; (-) strand; PAM type: NRG; PAM sequence: TAG
tctgggcctgcattatacca

SEQ ID NO: 65476 - DNA, 20 bp, Artificial Sequence
  Description of Artificial Sequence: Synthetic oligonucleotide
  Target: ATXN1; (-) strand; PAM type: NRG; PAM sequence: GGG
gcctgcagctcaagaagtct

SEQ ID NO: 65477 - DNA, 20 bp, Artificial Sequence
  Description of Artificial Sequence: Synthetic oligonucleotide
  Target: ATXN1; (-) strand; PAM type: NRG; PAM sequence: TGG
ggcctgcagctcaagaagtc

SEQ ID NO: 65478 - DNA, 20 bp, Artificial Sequence
  Description of Artificial Sequence: Synthetic oligonucleotide
  Target: ATXN1; (-) strand; PAM type: NRG; PAM sequence: AAG
cttcaggcctgcagctcaag

SEQ ID NO: 65479 - DNA, 20 bp, Artificial Sequence
  Description of Artificial Sequence: Synthetic oligonucleotide
  Target: ATXN1; (-) strand; PAM type: NRG; PAM sequence: AAG
agtcttcaggcctgcagctc

SEQ ID NO: 65480 - DNA, 20 bp, Artificial Sequence
  Description of Artificial Sequence: Synthetic oligonucleotide
  Target: ATXN1; (-) strand; PAM type: NRG; PAM sequence: CAG
cagttgagtcttcaggcctg

SEQ ID NO: 65481 - DNA, 20 bp, Artificial Sequence
  Description of Artificial Sequence: Synthetic oligonucleotide
  Target: ATXN1; (-) strand; PAM type: NRG; PAM sequence: AGG
agatagacagttgagtcttc

SEQ ID NO: 65482 - DNA, 20 bp, Artificial Sequence
  Description of Artificial Sequence: Synthetic oligonucleotide
  Target: ATXN1; (-) strand; PAM type: NRG; PAM sequence: CAG
cagatagacagttgagtctt

SEQ ID NO: 65483 - DNA, 20 bp, Artificial Sequence
  Description of Artificial Sequence: Synthetic oligonucleotide
  Target: ATXN1; (-) strand; PAM type: NRG; PAM sequence: GAG
gatatttcagatagacagtt

SEQ ID NO: 65484 - DNA, 20 bp, Artificial Sequence
  Description of Artificial Sequence: Synthetic oligonucleotide
  Target: ATXN1; (-) strand; PAM type: NRG; PAM sequence: CAG
taggggatatttcagataga

SEQ ID NO: 65485 - DNA, 20 bp, Artificial Sequence
  Description of Artificial Sequence: Synthetic oligonucleotide
  Target: ATXN1; (-) strand; PAM type: NRG; PAM sequence: TAG
tttttaggggatatttcaga

SEQ ID NO: 65486 - DNA, 20 bp, Artificial Sequence
  Description of Artificial Sequence: Synthetic oligonucleotide
  Target: ATXN1; (-) strand; PAM type: NRG; PAM sequence: CAG
cctttttttaggggatattt

SEQ ID NO: 65487 - DNA, 20 bp, Artificial Sequence
  Description of Artificial Sequence: Synthetic oligonucleotide
  Target: ATXN1; (-) strand; PAM type: NRG; PAM sequence: GGG
ggtttgagacctttttttag

SEQ ID NO: 65488 - DNA, 20 bp, Artificial Sequence
  Description of Artificial Sequence: Synthetic oligonucleotide
  Target: ATXN1; (-) strand; PAM type: NRG; PAM sequence: GGG
aggtttgagaccttttttta

SEQ ID NO: 65489 - DNA, 20 bp, Artificial Sequence
  Description of Artificial Sequence: Synthetic oligonucleotide
  Target: ATXN1; (-) strand; PAM type: NRG; PAM sequence: AGG
gaggtttgagaccttttttt

SEQ ID NO: 65490 - DNA, 20 bp, Artificial Sequence
  Description of Artificial Sequence: Synthetic oligonucleotide
  Target: ATXN1; (-) strand; PAM type: NRG; PAM sequence: TAG
ggaggtttgagacctttttt

SEQ ID NO: 65491 - DNA, 20 bp, Artificial Sequence
  Description of Artificial Sequence: Synthetic oligonucleotide
  Target: ATXN1; (-) strand; PAM type: NRG; PAM sequence: GAG
tcctaataggttggaggttt

SEQ ID NO: 65492 - DNA, 20 bp, Artificial Sequence
  Description of Artificial Sequence: Synthetic oligonucleotide
  Target: ATXN1; (-) strand; PAM type: NRG; PAM sequence: AGG
tagccatcctaataggttgg

SEQ ID NO: 65493 - DNA, 20 bp, Artificial Sequence
  Description of Artificial Sequence: Synthetic oligonucleotide
  Target: ATXN1; (-) strand; PAM type: NRG; PAM sequence: GAG
gtagccatcctaataggttg

SEQ ID NO: 65494 - DNA, 20 bp, Artificial Sequence
  Description of Artificial Sequence: Synthetic oligonucleotide
  Target: ATXN1; (-) strand; PAM type: NRG; PAM sequence: TGG
tagtagccatcctaataggt

SEQ ID NO: 65495 - DNA, 20 bp, Artificial Sequence
  Description of Artificial Sequence: Synthetic oligonucleotide
  Target: ATXN1; (-) strand; PAM type: NRG; PAM sequence: AGG
ttgatagtagccatcctaat

SEQ ID NO: 65496 - DNA, 20 bp, Artificial Sequence
  Description of Artificial Sequence: Synthetic oligonucleotide
  Target: ATXN1; (-) strand; PAM type: NRG; PAM sequence: TAG
tttgatagtagccatcctaa

SEQ ID NO: 65497 - DNA, 20 bp, Artificial Sequence
  Description of Artificial Sequence: Synthetic oligonucleotide
  Target: ATXN1; (-) strand; PAM type: NRG; PAM sequence: TAG
taaaaaaatgtatttgatag

SEQ ID NO: 65498 - DNA, 20 bp, Artificial Sequence
  Description of Artificial Sequence: Synthetic oligonucleotide
  Target: ATXN1; (-) strand; PAM type: NRG; PAM sequence: TAG
ggttaaaaaaatgtatttga

SEQ ID NO: 65499 - DNA, 20 bp, Artificial Sequence
  Description of Artificial Sequence: Synthetic oligonucleotide
  Target: ATXN1; (-) strand; PAM type: NRG; PAM sequence: TGG
caccaacagttgttattttc

SEQ ID NO: 65500 - DNA, 20 bp, Artificial Sequence
  Description of Artificial Sequence: Synthetic oligonucleotide
  Target: ATXN1; (-) strand; PAM type: NRG; PAM sequence: CAG
tttctctatgtcctcaccaa

SEQ ID NO: 65501 - DNA, 20 bp, Artificial Sequence
  Description of Artificial Sequence: Synthetic oligonucleotide
  Target: ATXN1; (-) strand; PAM type: NRG; PAM sequence: CAG
ccaacagtgcacaagggttc

SEQ ID NO: 65502 - DNA, 20 bp, Artificial Sequence
  Description of Artificial Sequence: Synthetic oligonucleotide
  Target: ATXN1; (-) strand; PAM type: NRG; PAM sequence: GGG
tttctaccaacagtgcacaa

SEQ ID NO: 65503 - DNA, 20 bp, Artificial Sequence
  Description of Artificial Sequence: Synthetic oligonucleotide
  Target: ATXN1; (-) strand; PAM type: NRG; PAM sequence: AGG
atttctaccaacagtgcaca

SEQ ID NO: 65504 - DNA, 20 bp, Artificial Sequence
  Description of Artificial Sequence: Synthetic oligonucleotide
  Target: ATXN1; (-) strand; PAM type: NRG; PAM sequence: AAG
catttctaccaacagtgcac

SEQ ID NO: 65505 - DNA, 20 bp, Artificial Sequence
  Description of Artificial Sequence: Synthetic oligonucleotide
  Target: ATXN1; (-) strand; PAM type: NRG; PAM sequence: CAG
ccactttgcatttctaccaa

SEQ ID NO: 65506 - DNA, 20 bp, Artificial Sequence
  Description of Artificial Sequence: Synthetic oligonucleotide
  Target: ATXN1; (-) strand; PAM type: NRG; PAM sequence: TGG
tgctgtatcgttttccacag

SEQ ID NO: 65507 - DNA, 20 bp, Artificial Sequence
  Description of Artificial Sequence: Synthetic oligonucleotide
  Target: ATXN1; (-) strand; PAM type: NRG; PAM sequence: CAG
aactgctgtatcgttttcca

SEQ ID NO: 65508 - DNA, 20 bp, Artificial Sequence
  Description of Artificial Sequence: Synthetic oligonucleotide
  Target: ATXN1; (-) strand; PAM type: NRG; PAM sequence: TGG
aatggaattgctggatcacg

SEQ ID NO: 65509 - DNA, 20 bp, Artificial Sequence
  Description of Artificial Sequence: Synthetic oligonucleotide
  Target: ATXN1; (-) strand; PAM type: NRG; PAM sequence: TGG
atacctggaaatggaattgc

SEQ ID NO: 65510 - DNA, 20 bp, Artificial Sequence
  Description of Artificial Sequence: Synthetic oligonucleotide
  Target: ATXN1; (-) strand; PAM type: NRG; PAM sequence: TGG
tttgggtatatacctggaaa

SEQ ID NO: 65511 - DNA, 20 bp, Artificial Sequence
  Description of Artificial Sequence: Synthetic oligonucleotide
  Target: ATXN1; (-) strand; PAM type: NRG; PAM sequence: TGG
agttcttttgggtatatacc

SEQ ID NO: 65512 - DNA, 20 bp, Artificial Sequence
  Description of Artificial Sequence: Synthetic oligonucleotide
  Target: ATXN1; (-) strand; PAM type: NRG; PAM sequence: GGG
gttctcctttcagttctttt

SEQ ID NO: 65513 - DNA, 20 bp, Artificial Sequence
  Description of Artificial Sequence: Synthetic oligonucleotide
  Target: ATXN1; (-) strand; PAM type: NRG; PAM sequence: TGG
ggttctcctttcagttcttt

SEQ ID NO: 65514 - DNA, 20 bp, Artificial Sequence
  Description of Artificial Sequence: Synthetic oligonucleotide
  Target: ATXN1; (-) strand; PAM type: NRG; PAM sequence: CAG
caaatttgaggttctccttt

SEQ ID NO: 65515 - DNA, 20 bp, Artificial Sequence
  Description of Artificial Sequence: Synthetic oligonucleotide
  Target: ATXN1; (-) strand; PAM type: NRG; PAM sequence: AGG
aatgtgggtgtacaaatttg

SEQ ID NO: 65516 - DNA, 20 bp, Artificial Sequence
  Description of Artificial Sequence: Synthetic oligonucleotide
  Target: ATXN1; (-) strand; PAM type: NRG; PAM sequence: GAG
gaatgtgggtgtacaaattt

SEQ ID NO: 65517 - DNA, 20 bp, Artificial Sequence
  Description of Artificial Sequence: Synthetic oligonucleotide
  Target: ATXN1; (-) strand; PAM type: NRG; PAM sequence: GGG
aataatgctgctatgaatgt

SEQ ID NO: 65518 - DNA, 20 bp, Artificial Sequence
  Description of Artificial Sequence: Synthetic oligonucleotide
  Target: ATXN1; (-) strand; PAM type: NRG; PAM sequence: TGG
gaataatgctgctatgaatg

SEQ ID NO: 65519 - DNA, 20 bp, Artificial Sequence
  Description of Artificial Sequence: Synthetic oligonucleotide
  Target: ATXN1; (-) strand; PAM type: NRG; PAM sequence: TGG
cttgggttgtttccaccttt

SEQ ID NO: 65520 - DNA, 20 bp, Artificial Sequence
  Description of Artificial Sequence: Synthetic oligonucleotide
  Target: ATXN1; (-) strand; PAM type: NRG; PAM sequence: GGG
tcatctgtccataaacactt

SEQ ID NO: 65521 - DNA, 20 bp, Artificial Sequence
  Description of Artificial Sequence: Synthetic oligonucleotide
  Target: ATXN1; (-) strand; PAM type: NRG; PAM sequence: TGG
ttcatctgtccataaacact

SEQ ID NO: 65522 - DNA, 20 bp, Artificial Sequence
  Description of Artificial Sequence: Synthetic oligonucleotide
  Target: ATXN1; (-) strand; PAM type: NRG; PAM sequence: AGG
tgtcagaatttcttttttta

SEQ ID NO: 65523 - DNA, 20 bp, Artificial Sequence
  Description of Artificial Sequence: Synthetic oligonucleotide
  Target: ATXN1; (-) strand; PAM type: NRG; PAM sequence: AAG
gtgtcagaatttcttttttt

SEQ ID NO: 65524 - DNA, 20 bp, Artificial Sequence
  Description of Artificial Sequence: Synthetic oligonucleotide
  Target: ATXN1; (-) strand; PAM type: NRG; PAM sequence: CAG
atccatgttgtaacatgtgt

SEQ ID NO: 65525 - DNA, 20 bp, Artificial Sequence
  Description of Artificial Sequence: Synthetic oligonucleotide
  Target: ATXN1; (-) strand; PAM type: NRG; PAM sequence: AGG
tgtttagcataatgtcctca

SEQ ID NO: 65526 - DNA, 20 bp, Artificial Sequence
  Description of Artificial Sequence: Synthetic oligonucleotide
  Target: ATXN1; (-) strand; PAM type: NRG; PAM sequence: AAG
ttgtttagcataatgtcctc

SEQ ID NO: 65527 - DNA, 20 bp, Artificial Sequence
  Description of Artificial Sequence: Synthetic oligonucleotide
  Target: ATXN1; (-) strand; PAM type: NRG; PAM sequence: TAG
tccttttgtgactttttgtt

SEQ ID NO: 65528 - DNA, 20 bp, Artificial Sequence
  Description of Artificial Sequence: Synthetic oligonucleotide
  Target: ATXN1; (-) strand; PAM type: NRG; PAM sequence: GGG
cctatgagtagaatcacaca

SEQ ID NO: 65529 - DNA, 20 bp, Artificial Sequence
  Description of Artificial Sequence: Synthetic oligonucleotide
  Target: ATXN1; (-) strand; PAM type: NRG; PAM sequence: AGG
tcctatgagtagaatcacac

SEQ ID NO: 65530 - DNA, 20 bp, Artificial Sequence
  Description of Artificial Sequence: Synthetic oligonucleotide
  Target: ATXN1; (-) strand; PAM type: NRG; PAM sequence: CAG
ctcctatgagtagaatcaca

SEQ ID NO: 65531 - DNA, 20 bp, Artificial Sequence
  Description of Artificial Sequence: Synthetic oligonucleotide
  Target: ATXN1; (-) strand; PAM type: NRG; PAM sequence: TAG
ctctagggacctcctatgag

SEQ ID NO: 65532 - DNA, 20 bp, Artificial Sequence
  Description of Artificial Sequence: Synthetic oligonucleotide
  Target: ATXN1; (-) strand; PAM type: NRG; PAM sequence: GAG
ctgctctagggacctcctat

SEQ ID NO: 65533 - DNA, 20 bp, Artificial Sequence
  Description of Artificial Sequence: Synthetic oligonucleotide
  Target: ATXN1; (-) strand; PAM type: NRG; PAM sequence: GGG
ctatgaatttgactgctcta

SEQ ID NO: 65534 - DNA, 20 bp, Artificial Sequence
  Description of Artificial Sequence: Synthetic oligonucleotide
  Target: ATXN1; (-) strand; PAM type: NRG; PAM sequence: AGG
tctatgaatttgactgctct

SEQ ID NO: 65535 - DNA, 20 bp, Artificial Sequence
  Description of Artificial Sequence: Synthetic oligonucleotide
  Target: ATXN1; (-) strand; PAM type: NRG; PAM sequence: TAG
ctctatgaatttgactgctc

SEQ ID NO: 65536 - DNA, 20 bp, Artificial Sequence
  Description of Artificial Sequence: Synthetic oligonucleotide
  Target: ATXN1; (-) strand; PAM type: NRG; PAM sequence: TGG
tcccccttccccctccctcc

SEQ ID NO: 65537 - DNA, 20 bp, Artificial Sequence
  Description of Artificial Sequence: Synthetic oligonucleotide
  Target: ATXN1; (-) strand; PAM type: NRG; PAM sequence: TAG
ttgcaaaactctgtacccat

SEQ ID NO: 65538 - DNA, 20 bp, Artificial Sequence
  Description of Artificial Sequence: Synthetic oligonucleotide
  Target: ATXN1; (-) strand; PAM type: NRG; PAM sequence: CAG
tctcgttgtgcatccagtct

SEQ ID NO: 65539 - DNA, 20 bp, Artificial Sequence
  Description of Artificial Sequence: Synthetic oligonucleotide
  Target: ATXN1; (-) strand; PAM type: NRG; PAM sequence: CAG
gtatattctcgttgtgcatc

SEQ ID NO: 65540 - DNA, 20 bp, Artificial Sequence
  Description of Artificial Sequence: Synthetic oligonucleotide
  Target: ATXN1; (-) strand; PAM type: NRG; PAM sequence: CAG
agatacagcctgatagtatc

SEQ ID NO: 65541 - DNA, 20 bp, Artificial Sequence
  Description of Artificial Sequence: Synthetic oligonucleotide
  Target: ATXN1; (-) strand; PAM type: NRG; PAM sequence: TAG
gggttcaagatacagcctga

SEQ ID NO: 65542 - DNA, 20 bp, Artificial Sequence
  Description of Artificial Sequence: Synthetic oligonucleotide
  Target: ATXN1; (-) strand; PAM type: NRG; PAM sequence: CAG
aggtagctgggttcaagata

SEQ ID NO: 65543 - DNA, 20 bp, Artificial Sequence
  Description of Artificial Sequence: Synthetic oligonucleotide
  Target: ATXN1; (-) strand; PAM type: NRG; PAM sequence: AAG
agagagaggtagctgggttc

SEQ ID NO: 65544 - DNA, 20 bp, Artificial Sequence
  Description of Artificial Sequence: Synthetic oligonucleotide
  Target: ATXN1; (-) strand; PAM type: NRG; PAM sequence: GGG
ggcatcagagagaggtagct

SEQ ID NO: 65545 - DNA, 20 bp, Artificial Sequence
  Description of Artificial Sequence: Synthetic oligonucleotide
  Target: ATXN1; (-) strand; PAM type: NRG; PAM sequence: TGG
tggcatcagagagaggtagc

SEQ ID NO: 65546 - DNA, 20 bp, Artificial Sequence
  Description of Artificial Sequence: Synthetic oligonucleotide
  Target: ATXN1; (-) strand; PAM type: NRG; PAM sequence: TAG
gcagtggcatcagagagagg

SEQ ID NO: 65547 - DNA, 20 bp, Artificial Sequence
  Description of Artificial Sequence: Synthetic oligonucleotide
  Target: ATXN1; (-) strand; PAM type: NRG; PAM sequence: AGG
gtggcagtggcatcagagag

SEQ ID NO: 65548 - DNA, 20 bp, Artificial Sequence
  Description of Artificial Sequence: Synthetic oligonucleotide
  Target: ATXN1; (-) strand; PAM type: NRG; PAM sequence: GAG
ggtggcagtggcatcagaga

SEQ ID NO: 65549 - DNA, 20 bp, Artificial Sequence
  Description of Artificial Sequence: Synthetic oligonucleotide
  Target: ATXN1; (-) strand; PAM type: NRG; PAM sequence: GAG
atggtggcagtggcatcaga

SEQ ID NO: 65550 - DNA, 20 bp, Artificial Sequence
  Description of Artificial Sequence: Synthetic oligonucleotide
  Target: ATXN1; (-) strand; PAM type: NRG; PAM sequence: GAG
gaatggtggcagtggcatca

SEQ ID NO: 65551 - DNA, 20 bp, Artificial Sequence
  Description of Artificial Sequence: Synthetic oligonucleotide
  Target: ATXN1; (-) strand; PAM type: NRG; PAM sequence: CAG
ttgaatggtggcagtggcat

SEQ ID NO: 65552 - DNA, 20 bp, Artificial Sequence
  Description of Artificial Sequence: Synthetic oligonucleotide
  Target: ATXN1; (-) strand; PAM type: NRG; PAM sequence: TGG
ttgggcttgaatggtggcag

SEQ ID NO: 65553 - DNA, 20 bp, Artificial Sequence
  Description of Artificial Sequence: Synthetic oligonucleotide
  Target: ATXN1; (-) strand; PAM type: NRG; PAM sequence: CAG
ggcttgggcttgaatggtgg

SEQ ID NO: 65554 - DNA, 20 bp, Artificial Sequence
  Description of Artificial Sequence: Synthetic oligonucleotide
  Target: ATXN1; (-) strand; PAM type: NRG; PAM sequence: TGG
agtggcttgggcttgaatgg

SEQ ID NO: 65555 - DNA, 20 bp, Artificial Sequence
  Description of Artificial Sequence: Synthetic oligonucleotide
  Target: ATXN1; (-) strand; PAM type: NRG; PAM sequence: TGG
gacagtggcttgggcttgaa

SEQ ID NO: 65556 - DNA, 20 bp, Artificial Sequence
  Description of Artificial Sequence: Synthetic oligonucleotide
  Target: ATXN1; (-) strand; PAM type: NRG; PAM sequence: GGG
atagaaaatgacagtggctt

SEQ ID NO: 65557 - DNA, 20 bp, Artificial Sequence
  Description of Artificial Sequence: Synthetic oligonucleotide
  Target: ATXN1; (-) strand; PAM type: NRG; PAM sequence: TGG
gatagaaaatgacagtggct

SEQ ID NO: 65558 - DNA, 20 bp, Artificial Sequence
  Description of Artificial Sequence: Synthetic oligonucleotide
  Target: ATXN1; (-) strand; PAM type: NRG; PAM sequence: TGG
gacaggatagaaaatgacag

SEQ ID NO: 65559 - DNA, 20 bp, Artificial Sequence
  Description of Artificial Sequence: Synthetic oligonucleotide
  Target: ATXN1; (-) strand; PAM type: NRG; PAM sequence: CAG
gttgacaggatagaaaatga

SEQ ID NO: 65560 - DNA, 20 bp, Artificial Sequence
  Description of Artificial Sequence: Synthetic oligonucleotide
  Target: ATXN1; (-) strand; PAM type: NRG; PAM sequence: TAG
gaaacctgtagttgacagga

SEQ ID NO: 65561 - DNA, 20 bp, Artificial Sequence
  Description of Artificial Sequence: Synthetic oligonucleotide
  Target: ATXN1; (-) strand; PAM type: NRG; PAM sequence: AGG
gtaagaaacctgtagttgac

SEQ ID NO: 65562 - DNA, 20 bp, Artificial Sequence
  Description of Artificial Sequence: Synthetic oligonucleotide
  Target: ATXN1; (-) strand; PAM type: NRG; PAM sequence: CAG
ggtaagaaacctgtagttga

SEQ ID NO: 65563 - DNA, 20 bp, Artificial Sequence
  Description of Artificial Sequence: Synthetic oligonucleotide
  Target: ATXN1; (-) strand; PAM type: NRG; PAM sequence: TAG
gaggccaggtaagaaacctg

SEQ ID NO: 65564 - DNA, 20 bp, Artificial Sequence
  Description of Artificial Sequence: Synthetic oligonucleotide
  Target: ATXN1; (-) strand; PAM type: NRG; PAM sequence: AAG
gaaaaacagggaggccaggt

SEQ ID NO: 65565 - DNA, 20 bp, Artificial Sequence
  Description of Artificial Sequence: Synthetic oligonucleotide
  Target: ATXN1; (-) strand; PAM type: NRG; PAM sequence: AGG
gcaagaaaaacagggaggcc

SEQ ID NO: 65566 - DNA, 20 bp, Artificial Sequence
  Description of Artificial Sequence: Synthetic oligonucleotide
  Target: ATXN1; (-) strand; PAM type: NRG; PAM sequence: CAG
ggcaagaaaaacagggaggc

SEQ ID NO: 65567 - DNA, 20 bp, Artificial Sequence
  Description of Artificial Sequence: Synthetic oligonucleotide
  Target: ATXN1; (-) strand; PAM type: NRG; PAM sequence: AGG
ggatggcaagaaaaacaggg

SEQ ID NO: 65568 - DNA, 20 bp, Artificial Sequence
  Description of Artificial Sequence: Synthetic oligonucleotide
  Target: ATXN1; (-) strand; PAM type: NRG; PAM sequence: GAG
aggatggcaagaaaaacagg

SEQ ID NO: 65569 - DNA, 20 bp, Artificial Sequence
  Description of Artificial Sequence: Synthetic oligonucleotide
  Target: ATXN1; (-) strand; PAM type: NRG; PAM sequence: GGG
aaaggatggcaagaaaaaca

SEQ ID NO: 65570 - DNA, 20 bp, Artificial Sequence
  Description of Artificial Sequence: Synthetic oligonucleotide
  Target: ATXN1; (-) strand; PAM type: NRG; PAM sequence: AGG
aaaaggatggcaagaaaaac

SEQ ID NO: 65571 - DNA, 20 bp, Artificial Sequence
  Description of Artificial Sequence: Synthetic oligonucleotide
  Target: ATXN1; (-) strand; PAM type: NRG; PAM sequence: CAG
taaaaggatggcaagaaaaa

SEQ ID NO: 65572 - DNA, 20 bp, Artificial Sequence
  Description of Artificial Sequence: Synthetic oligonucleotide
  Target: ATXN1; (-) strand; PAM type: NRG; PAM sequence: AAG
tgtgacattaaaaggatggc

SEQ ID NO: 65573 - DNA, 20 bp, Artificial Sequence
  Description of Artificial Sequence: Synthetic oligonucleotide
  Target: ATXN1; (-) strand; PAM type: NRG; PAM sequence: TGG
ttactgtgacattaaaagga

SEQ ID NO: 65574 - DNA, 20 bp, Artificial Sequence
  Description of Artificial Sequence: Synthetic oligonucleotide
  Target: ATXN1; (-) strand; PAM type: NRG; PAM sequence: AGG
ctttttactgtgacattaaa

SEQ ID NO: 65575 - DNA, 20 bp, Artificial Sequence
  Description of Artificial Sequence: Synthetic oligonucleotide
  Target: ATXN1; (-) strand; PAM type: NRG; PAM sequence: AAG
actttttactgtgacattaa

SEQ ID NO: 65576 - DNA, 20 bp, Artificial Sequence
  Description of Artificial Sequence: Synthetic oligonucleotide
  Target: ATXN1; (-) strand; PAM type: NRG; PAM sequence: CGG
tcctatctaacatagtatgc

SEQ ID NO: 65577 - DNA, 20 bp, Artificial Sequence
  Description of Artificial Sequence: Synthetic oligonucleotide
  Target: ATXN1; (-) strand; PAM type: NRG; PAM sequence: TAG
cttgtccatcctatctaaca

SEQ ID NO: 65578 - DNA, 20 bp, Artificial Sequence
  Description of Artificial Sequence: Synthetic oligonucleotide
  Target: ATXN1; (-) strand; PAM type: NRG; PAM sequence: AGG
gcacaaatgtcacctccaag

SEQ ID NO: 65579 - DNA, 20 bp, Artificial Sequence
  Description of Artificial Sequence: Synthetic oligonucleotide
  Target: ATXN1; (-) strand; PAM type: NRG; PAM sequence: GAG
tgcacaaatgtcacctccaa

SEQ ID NO: 65580 - DNA, 20 bp, Artificial Sequence
  Description of Artificial Sequence: Synthetic oligonucleotide
  Target: ATXN1; (-) strand; PAM type: NRG; PAM sequence: AAG
agtgcacaaatgtcacctcc

SEQ ID NO: 65581 - DNA, 20 bp, Artificial Sequence
  Description of Artificial Sequence: Synthetic oligonucleotide
  Target: ATXN1; (-) strand; PAM type: NRG; PAM sequence: GAG
aatggaaaaatgacctgaat

SEQ ID NO: 65582 - DNA, 20 bp, Artificial Sequence
  Description of Artificial Sequence: Synthetic oligonucleotide
  Target: ATXN1; (-) strand; PAM type: NRG; PAM sequence: TGG
agctatcgaatgcttttgaa

SEQ ID NO: 65583 - DNA, 20 bp, Artificial Sequence
  Description of Artificial Sequence: Synthetic oligonucleotide
  Target: ATXN1; (-) strand; PAM type: NRG; PAM sequence: GAG
ataaataggacagtcagaat

SEQ ID NO: 65584 - DNA, 20 bp, Artificial Sequence
  Description of Artificial Sequence: Synthetic oligonucleotide
  Target: ATXN1; (-) strand; PAM type: NRG; PAM sequence: CAG
attaccataaataggacagt

SEQ ID NO: 65585 - DNA, 20 bp, Artificial Sequence
  Description of Artificial Sequence: Synthetic oligonucleotide
  Target: ATXN1; (-) strand; PAM type: NRG; PAM sequence: CAG
cagaattaccataaatagga

SEQ ID NO: 65586 - DNA, 20 bp, Artificial Sequence
  Description of Artificial Sequence: Synthetic oligonucleotide
  Target: ATXN1; (-) strand; PAM type: NRG; PAM sequence: AGG
gctacagaattaccataaat

SEQ ID NO: 65587 - DNA, 20 bp, Artificial Sequence
  Description of Artificial Sequence: Synthetic oligonucleotide
  Target: ATXN1; (-) strand; PAM type: NRG; PAM sequence: TAG
ggctacagaattaccataaa

SEQ ID NO: 65588 - DNA, 20 bp, Artificial Sequence
  Description of Artificial Sequence: Synthetic oligonucleotide
  Target: ATXN1; (-) strand; PAM type: NRG; PAM sequence: CAG
gtttcagtcctgaatggcta

SEQ ID NO: 65589 - DNA, 20 bp, Artificial Sequence
  Description of Artificial Sequence: Synthetic oligonucleotide
  Target: ATXN1; (-) strand; PAM type: NRG; PAM sequence: TGG
gtcagagtttcagtcctgaa

SEQ ID NO: 65590 - DNA, 20 bp, Artificial Sequence
  Description of Artificial Sequence: Synthetic oligonucleotide
  Target: ATXN1; (-) strand; PAM type: NRG; PAM sequence: CAG
tccaggggctgtcagagttt

SEQ ID NO: 65591 - DNA, 20 bp, Artificial Sequence
  Description of Artificial Sequence: Synthetic oligonucleotide
  Target: ATXN1; (-) strand; PAM type: NRG; PAM sequence: GAG
aaggtgtccaggggctgtca

SEQ ID NO: 65592 - DNA, 20 bp, Artificial Sequence
  Description of Artificial Sequence: Synthetic oligonucleotide
  Target: ATXN1; (-) strand; PAM type: NRG; PAM sequence: CAG
agaaggtgtccaggggctgt

SEQ ID NO: 65593 - DNA, 20 bp, Artificial Sequence
  Description of Artificial Sequence: Synthetic oligonucleotide
  Target: ATXN1; (-) strand; PAM type: NRG; PAM sequence: GGG
aaggatcagaaggtgtccag

SEQ ID NO: 65594 - DNA, 20 bp, Artificial Sequence
  Description of Artificial Sequence: Synthetic oligonucleotide
  Target: ATXN1; (-) strand; PAM type: NRG; PAM sequence: GGG
gaaggatcagaaggtgtcca

SEQ ID NO: 65595 - DNA, 20 bp, Artificial Sequence
  Description of Artificial Sequence: Synthetic oligonucleotide
  Target: ATXN1; (-) strand; PAM type: NRG; PAM sequence: AGG
agaaggatcagaaggtgtcc

SEQ ID NO: 65596 - DNA, 20 bp, Artificial Sequence
  Description of Artificial Sequence: Synthetic oligonucleotide
  Target: ATXN1; (-) strand; PAM type: NRG; PAM sequence: CAG
gagaaggatcagaaggtgtc

SEQ ID NO: 65597 - DNA, 20 bp, Artificial Sequence
  Description of Artificial Sequence: Synthetic oligonucleotide
  Target: ATXN1; (-) strand; PAM type: NRG; PAM sequence: AGG
acagagagagaaggatcaga

SEQ ID NO: 65598 - DNA, 20 bp, Artificial Sequence
  Description of Artificial Sequence: Synthetic oligonucleotide
  Target: ATXN1; (-) strand; PAM type: NRG; PAM sequence: AAG
tacagagagagaaggatcag

SEQ ID NO: 65599 - DNA, 20 bp, Artificial Sequence
  Description of Artificial Sequence: Synthetic oligonucleotide
  Target: ATXN1; (-) strand; PAM type: NRG; PAM sequence: CAG
cgatacagagagagaaggat

SEQ ID NO: 65600 - DNA, 20 bp, Artificial Sequence
  Description of Artificial Sequence: Synthetic oligonucleotide
  Target: ATXN1; (-) strand; PAM type: NRG; PAM sequence: AGG
agatgcgatacagagagaga

SEQ ID NO: 65601 - DNA, 20 bp, Artificial Sequence
  Description of Artificial Sequence: Synthetic oligonucleotide
  Target: ATXN1; (-) strand; PAM type: NRG; PAM sequence: AAG
tagatgcgatacagagagag

SEQ ID NO: 65602 - DNA, 20 bp, Artificial Sequence
  Description of Artificial Sequence: Synthetic oligonucleotide
  Target: ATXN1; (-) strand; PAM type: NRG; PAM sequence: GAG
gactagatgcgatacagaga

SEQ ID NO: 65603 - DNA, 20 bp, Artificial Sequence
  Description of Artificial Sequence: Synthetic oligonucleotide
  Target: ATXN1; (-) strand; PAM type: NRG; PAM sequence: GAG
gagactagatgcgatacaga

SEQ ID NO: 65604 - DNA, 20 bp, Artificial Sequence
  Description of Artificial Sequence: Synthetic oligonucleotide
  Target: ATXN1; (-) strand; PAM type: NRG; PAM sequence: GAG
tagagactagatgcgataca

SEQ ID NO: 65605 - DNA, 20 bp, Artificial Sequence
  Description of Artificial Sequence: Synthetic oligonucleotide
  Target: ATXN1; (-) strand; PAM type: NRG; PAM sequence: CAG
aatagagactagatgcgata

SEQ ID NO: 65606 - DNA, 20 bp, Artificial Sequence
  Description of Artificial Sequence: Synthetic oligonucleotide
  Target: ATXN1; (-) strand; PAM type: NRG; PAM sequence: TAG
gcaatggggaaaatagagac

SEQ ID NO: 65607 - DNA, 20 bp, Artificial Sequence
  Description of Artificial Sequence: Synthetic oligonucleotide
  Target: ATXN1; (-) strand; PAM type: NRG; PAM sequence: GAG
tcttagcaatggggaaaata

SEQ ID NO: 65608 - DNA, 20 bp, Artificial Sequence
  Description of Artificial Sequence: Synthetic oligonucleotide
  Target: ATXN1; (-) strand; PAM type: NRG; PAM sequence: TAG
actcttagcaatggggaaaa

SEQ ID NO: 65609 - DNA, 20 bp, Artificial Sequence
  Description of Artificial Sequence: Synthetic oligonucleotide
  Target: ATXN1; (-) strand; PAM type: NRG; PAM sequence: GGG
catgattactcttagcaatg

SEQ ID NO: 65610 - DNA, 20 bp, Artificial Sequence
  Description of Artificial Sequence: Synthetic oligonucleotide
  Target: ATXN1; (-) strand; PAM type: NRG; PAM sequence: GGG
gcatgattactcttagcaat

SEQ ID NO: 65611 - DNA, 20 bp, Artificial Sequence
  Description of Artificial Sequence: Synthetic oligonucleotide
  Target: ATXN1; (-) strand; PAM type: NRG; PAM sequence: TGG
agcatgattactcttagcaa

SEQ ID NO: 65612 - DNA, 20 bp, Artificial Sequence
  Description of Artificial Sequence: Synthetic oligonucleotide
  Target: ATXN1; (-) strand; PAM type: NRG; PAM sequence: TAG
acagatagcatgattactct

SEQ ID NO: 65613 - DNA, 20 bp, Artificial Sequence
  Description of Artificial Sequence: Synthetic oligonucleotide
  Target: ATXN1; (-) strand; PAM type: NRG; PAM sequence: TAG
ggagtagtagataggacaga

SEQ ID NO: 65614 - DNA, 20 bp, Artificial Sequence
  Description of Artificial Sequence: Synthetic oligonucleotide
  Target: ATXN1; (-) strand; PAM type: NRG; PAM sequence: CAG
agaaggagtagtagatagga

SEQ ID NO: 65615 - DNA, 20 bp, Artificial Sequence
  Description of Artificial Sequence: Synthetic oligonucleotide
  Target: ATXN1; (-) strand; PAM type: NRG; PAM sequence: AGG
caagagaaggagtagtagat

SEQ ID NO: 65616 - DNA, 20 bp, Artificial Sequence
  Description of Artificial Sequence: Synthetic oligonucleotide
  Target: ATXN1; (-) strand; PAM type: NRG; PAM sequence: TAG
ccaagagaaggagtagtaga

SEQ ID NO: 65617 - DNA, 20 bp, Artificial Sequence
  Description of Artificial Sequence: Synthetic oligonucleotide
  Target: ATXN1; (-) strand; PAM type: NRG; PAM sequence: TAG
cattccaagagaaggagtag

SEQ ID NO: 65618 - DNA, 20 bp, Artificial Sequence
  Description of Artificial Sequence: Synthetic oligonucleotide
  Target: ATXN1; (-) strand; PAM type: NRG; PAM sequence: TAG
gcccattccaagagaaggag

SEQ ID NO: 65619 - DNA, 20 bp, Artificial Sequence
  Description of Artificial Sequence: Synthetic oligonucleotide
  Target: ATXN1; (-) strand; PAM type: NRG; PAM sequence: GAG
acagcccattccaagagaag

SEQ ID NO: 65620 - DNA, 20 bp, Artificial Sequence
  Description of Artificial Sequence: Synthetic oligonucleotide
  Target: ATXN1; (-) strand; PAM type: NRG; PAM sequence: AGG
tgacagcccattccaagaga

SEQ ID NO: 65621 - DNA, 20 bp, Artificial Sequence
  Description of Artificial Sequence: Synthetic oligonucleotide
  Target: ATXN1; (-) strand; PAM type: NRG; PAM sequence: AAG
gtgacagcccattccaagag

SEQ ID NO: 65622 - DNA, 20 bp, Artificial Sequence
  Description of Artificial Sequence: Synthetic oligonucleotide
  Target: ATXN1; (-) strand; PAM type: NRG; PAM sequence: GAG
ggagtgacagcccattccaa

SEQ ID NO: 65623 - DNA, 20 bp, Artificial Sequence
  Description of Artificial Sequence: Synthetic oligonucleotide
  Target: ATXN1; (-) strand; PAM type: NRG; PAM sequence: AAG
ggggagtgacagcccattcc

SEQ ID NO: 65624 - DNA, 20 bp, Artificial Sequence
  Description of Artificial Sequence: Synthetic oligonucleotide
  Target: ATXN1; (-) strand; PAM type: NRG; PAM sequence: CAG
tagacgggagtggggagtga

SEQ ID NO: 65625 - DNA, 20 bp, Artificial Sequence
  Description of Artificial Sequence: Synthetic oligonucleotide
  Target: ATXN1; (-) strand; PAM type: NRG; PAM sequence: GAG
gtaggatagacgggagtggg

SEQ ID NO: 65626 - DNA, 20 bp, Artificial Sequence
  Description of Artificial Sequence: Synthetic oligonucleotide
  Target: ATXN1; (-) strand; PAM type: NRG; PAM sequence: GGG
atgtaggatagacgggagtg

SEQ ID NO: 65627 - DNA, 20 bp, Artificial Sequence
  Description of Artificial Sequence: Synthetic oligonucleotide
  Target: ATXN1; (-) strand; PAM type: NRG; PAM sequence: GGG
tatgtaggatagacgggagt

SEQ ID NO: 65628 - DNA, 20 bp, Artificial Sequence
  Description of Artificial Sequence: Synthetic oligonucleotide
  Target: ATXN1; (-) strand; PAM type: NRG; PAM sequence: TGG
atatgtaggatagacgggag

SEQ ID NO: 65629 - DNA, 20 bp, Artificial Sequence
  Description of Artificial Sequence: Synthetic oligonucleotide
  Target: ATXN1; (-) strand; PAM type: NRG; PAM sequence: GAG
tgtatatgtaggatagacgg

SEQ ID NO: 65630 - DNA, 20 bp, Artificial Sequence
  Description of Artificial Sequence: Synthetic oligonucleotide
  Target: ATXN1; (-) strand; PAM type: NRG; PAM sequence: GGG
catgtatatgtaggatagac

SEQ ID NO: 65631 - DNA, 20 bp, Artificial Sequence
  Description of Artificial Sequence: Synthetic oligonucleotide
  Target: ATXN1; (-) strand; PAM type: NRG; PAM sequence: CGG
gcatgtatatgtaggataga

SEQ ID NO: 65632 - DNA, 20 bp, Artificial Sequence
  Description of Artificial Sequence: Synthetic oligonucleotide
  Target: ATXN1; (-) strand; PAM type: NRG; PAM sequence: TAG
tctggcatgtatatgtagga

SEQ ID NO: 65633 - DNA, 20 bp, Artificial Sequence
  Description of Artificial Sequence: Synthetic oligonucleotide
  Target: ATXN1; (-) strand; PAM type: NRG; PAM sequence: AGG
ttcatctggcatgtatatgt

SEQ ID NO: 65634 - DNA, 20 bp, Artificial Sequence
  Description of Artificial Sequence: Synthetic oligonucleotide
  Target: ATXN1; (-) strand; PAM type: NRG; PAM sequence: TAG
attcatctggcatgtatatg

SEQ ID NO: 65635 - DNA, 20 bp, Artificial Sequence
  Description of Artificial Sequence: Synthetic oligonucleotide
  Target: ATXN1; (-) strand; PAM type: NRG; PAM sequence: TGG
gcagtttagaaagattcatc

SEQ ID NO: 65636 - DNA, 20 bp, Artificial Sequence
  Description of Artificial Sequence: Synthetic oligonucleotide
  Target: ATXN1; (-) strand; PAM type: NRG; PAM sequence: AAG
gattgaaactgcagtttaga

SEQ ID NO: 65637 - DNA, 20 bp, Artificial Sequence
  Description of Artificial Sequence: Synthetic oligonucleotide
  Target: ATXN1; (-) strand; PAM type: NRG; PAM sequence: TAG
agaagattgaaactgcagtt

SEQ ID NO: 65638 - DNA, 20 bp, Artificial Sequence
  Description of Artificial Sequence: Synthetic oligonucleotide
  Target: ATXN1; (-) strand; PAM type: NRG; PAM sequence: CAG
gagaaagaagattgaaactg

SEQ ID NO: 65639 - DNA, 20 bp, Artificial Sequence
  Description of Artificial Sequence: Synthetic oligonucleotide
  Target: ATXN1; (-) strand; PAM type: NRG; PAM sequence: AAG
gagattttgaaacgagaaag

SEQ ID NO: 65640 - DNA, 20 bp, Artificial Sequence
  Description of Artificial Sequence: Synthetic oligonucleotide
  Target: ATXN1; (-) strand; PAM type: NRG; PAM sequence: AAG
caagagattttgaaacgaga

SEQ ID NO: 65641 - DNA, 20 bp, Artificial Sequence
  Description of Artificial Sequence: Synthetic oligonucleotide
  Target: ATXN1; (-) strand; PAM type: NRG; PAM sequence: GAG
gcaacaagagattttgaaac

SEQ ID NO: 65642 - DNA, 20 bp, Artificial Sequence
  Description of Artificial Sequence: Synthetic oligonucleotide
  Target: ATXN1; (-) strand; PAM type: NRG; PAM sequence: GAG
cgaagaggaaccagcaacaa

SEQ ID NO: 65643 - DNA, 20 bp, Artificial Sequence
  Description of Artificial Sequence: Synthetic oligonucleotide
  Target: ATXN1; (-) strand; PAM type: NRG; PAM sequence: AAG
agcgaagaggaaccagcaac

SEQ ID NO: 65644 - DNA, 20 bp, Artificial Sequence
  Description of Artificial Sequence: Synthetic oligonucleotide
  Target: ATXN1; (-) strand; PAM type: NRG; PAM sequence: CAG
ttcaggaagcgaagaggaac

SEQ ID NO: 65645 - DNA, 20 bp, Artificial Sequence
  Description of Artificial Sequence: Synthetic oligonucleotide
  Target: ATXN1; (-) strand; PAM type: NRG; PAM sequence: AGG
acttaattcaggaagcgaag

SEQ ID NO: 65646 - DNA, 20 bp, Artificial Sequence
  Description of Artificial Sequence: Synthetic oligonucleotide
  Target: ATXN1; (-) strand; PAM type: NRG; PAM sequence: GAG
gacttaattcaggaagcgaa

SEQ ID NO: 65647 - DNA, 20 bp, Artificial Sequence
  Description of Artificial Sequence: Synthetic oligonucleotide
  Target: ATXN1; (-) strand; PAM type: NRG; PAM sequence: AAG
tggacttaattcaggaagcg

SEQ ID NO: 65648 - DNA, 20 bp, Artificial Sequence
  Description of Artificial Sequence: Synthetic oligonucleotide
  Target: ATXN1; (-) strand; PAM type: NRG; PAM sequence: AAG
aactctggacttaattcagg

SEQ ID NO: 65649 - DNA, 20 bp, Artificial Sequence
  Description of Artificial Sequence: Synthetic oligonucleotide
  Target: ATXN1; (-) strand; PAM type: NRG; PAM sequence: AGG
ggaaactctggacttaattc

SEQ ID NO: 65650 - DNA, 20 bp, Artificial Sequence
  Description of Artificial Sequence: Synthetic oligonucleotide
  Target: ATXN1; (-) strand; PAM type: NRG; PAM sequence: CAG
tggaaactctggacttaatt

SEQ ID NO: 65651 - DNA, 20 bp, Artificial Sequence
  Description of Artificial Sequence: Synthetic oligonucleotide
  Target: ATXN1; (-) strand; PAM type: NRG; PAM sequence: TGG
acagtctgggatggaaactc

SEQ ID NO: 65652 - DNA, 20 bp, Artificial Sequence
  Description of Artificial Sequence: Synthetic oligonucleotide
  Target: ATXN1; (-) strand; PAM type: NRG; PAM sequence: TGG
gactgtcagacagtctggga

SEQ ID NO: 65653 - DNA, 20 bp, Artificial Sequence
  Description of Artificial Sequence: Synthetic oligonucleotide
  Target: ATXN1; (-) strand; PAM type: NRG; PAM sequence: GGG
tgtagactgtcagacagtct

SEQ ID NO: 65654 - DNA, 20 bp, Artificial Sequence
  Description of Artificial Sequence: Synthetic oligonucleotide
  Target: ATXN1; (-) strand; PAM type: NRG; PAM sequence: TGG
ttgtagactgtcagacagtc

SEQ ID NO: 65655 - DNA, 20 bp, Artificial Sequence
  Description of Artificial Sequence: Synthetic oligonucleotide
  Target: ATXN1; (-) strand; PAM type: NRG; PAM sequence: CAG
ccatattgtagactgtcaga

SEQ ID NO: 65656 - DNA, 20 bp, Artificial Sequence
  Description of Artificial Sequence: Synthetic oligonucleotide
  Target: ATXN1; (-) strand; PAM type: NRG; PAM sequence: CAG
gaagccatattgtagactgt

SEQ ID NO: 65657 - DNA, 20 bp, Artificial Sequence
  Description of Artificial Sequence: Synthetic oligonucleotide
  Target: ATXN1; (-) strand; PAM type: NRG; PAM sequence: TAG
ggtaagtggaagccatattg

SEQ ID NO: 65658 - DNA, 20 bp, Artificial Sequence
  Description of Artificial Sequence: Synthetic oligonucleotide
  Target: ATXN1; (-) strand; PAM type: NRG; PAM sequence: AAG
acagttgggaaggtaagtgg

SEQ ID NO: 65659 - DNA, 20 bp, Artificial Sequence
  Description of Artificial Sequence: Synthetic oligonucleotide
  Target: ATXN1; (-) strand; PAM type: NRG; PAM sequence: TGG
ataacagttgggaaggtaag

SEQ ID NO: 65660 - DNA, 20 bp, Artificial Sequence
  Description of Artificial Sequence: Synthetic oligonucleotide
  Target: ATXN1; (-) strand; PAM type: NRG; PAM sequence: AAG
gagataacagttgggaaggt

SEQ ID NO: 65661 - DNA, 20 bp, Artificial Sequence
  Description of Artificial Sequence: Synthetic oligonucleotide
  Target: ATXN1; (-) strand; PAM type: NRG; PAM sequence: AGG
gtgggagataacagttggga

SEQ ID NO: 65662 - DNA, 20 bp, Artificial Sequence
  Description of Artificial Sequence: Synthetic oligonucleotide
  Target: ATXN1; (-) strand; PAM type: NRG; PAM sequence: AAG
agtgggagataacagttggg

SEQ ID NO: 65663 - DNA, 20 bp, Artificial Sequence
  Description of Artificial Sequence: Synthetic oligonucleotide
  Target: ATXN1; (-) strand; PAM type: NRG; PAM sequence: GGG
aaaagtgggagataacagtt

SEQ ID NO: 65664 - DNA, 20 bp, Artificial Sequence
  Description of Artificial Sequence: Synthetic oligonucleotide
  Target: ATXN1; (-) strand; PAM type: NRG; PAM sequence: TGG
gaaaagtgggagataacagt

SEQ ID NO: 65665 - DNA, 20 bp, Artificial Sequence
  Description of Artificial Sequence: Synthetic oligonucleotide
  Target: ATXN1; (-) strand; PAM type: NRG; PAM sequence: CAG
tggggaaaagtgggagataa

SEQ ID NO: 65666 - DNA, 20 bp, Artificial Sequence
  Description of Artificial Sequence: Synthetic oligonucleotide
  Target: ATXN1; (-) strand; PAM type: NRG; PAM sequence: GAG
cctgtgatggggaaaagtgg

SEQ ID NO: 65667 - DNA, 20 bp, Artificial Sequence
  Description of Artificial Sequence: Synthetic oligonucleotide
  Target: ATXN1; (-) strand; PAM type: NRG; PAM sequence: GGG
tgcctgtgatggggaaaagt

SEQ ID NO: 65668 - DNA, 20 bp, Artificial Sequence
  Description of Artificial Sequence: Synthetic oligonucleotide
  Target: ATXN1; (-) strand; PAM type: NRG; PAM sequence: TGG
atgcctgtgatggggaaaag

SEQ ID NO: 65669 - DNA, 20 bp, Artificial Sequence
  Description of Artificial Sequence: Synthetic oligonucleotide
  Target: ATXN1; (-) strand; PAM type: NRG; PAM sequence: AAG
cgtatgcctgtgatggggaa

SEQ ID NO: 65670 - DNA, 20 bp, Artificial Sequence
  Description of Artificial Sequence: Synthetic oligonucleotide
  Target: ATXN1; (-) strand; PAM type: NRG; PAM sequence: GGG
ccacccgtatgcctgtgatg

SEQ ID NO: 65671 - DNA, 20 bp, Artificial Sequence
  Description of Artificial Sequence: Synthetic oligonucleotide
  Target: ATXN1; (-) strand; PAM type: NRG; PAM sequence: GGG
gccacccgtatgcctgtgat

SEQ ID NO: 65672 - DNA, 20 bp, Artificial Sequence
  Description of Artificial Sequence: Synthetic oligonucleotide
  Target: ATXN1; (-) strand; PAM type: NRG; PAM sequence: TGG
ggccacccgtatgcctgtga

SEQ ID NO: 65673 - DNA, 20 bp, Artificial Sequence
  Description of Artificial Sequence: Synthetic oligonucleotide
  Target: ATXN1; (-) strand; PAM type: NRG; PAM sequence: GGG
agagtacgttctggaacaag

SEQ ID NO: 65674 - DNA, 20 bp, Artificial Sequence
  Description of Artificial Sequence: Synthetic oligonucleotide
  Target: ATXN1; (-) strand; PAM type: NRG; PAM sequence: GGG
aagagtacgttctggaacaa

SEQ ID NO: 65675 - DNA, 20 bp, Artificial Sequence
  Description of Artificial Sequence: Synthetic oligonucleotide
  Target: ATXN1; (-) strand; PAM type: NRG; PAM sequence: AGG
gaagagtacgttctggaaca

SEQ ID NO: 65676 - DNA, 20 bp, Artificial Sequence
  Description of Artificial Sequence: Synthetic oligonucleotide
  Target: ATXN1; (-) strand; PAM type: NRG; PAM sequence: AAG
tgaagagtacgttctggaac

SEQ ID NO: 65677 - DNA, 20 bp, Artificial Sequence
  Description of Artificial Sequence: Synthetic oligonucleotide
  Target: ATXN1; (-) strand; PAM type: NRG; PAM sequence: TGG
ggaaagtgaagagtacgttc

SEQ ID NO: 65678 - DNA, 20 bp, Artificial Sequence
  Description of Artificial Sequence: Synthetic oligonucleotide
  Target: ATXN1; (-) strand; PAM type: NRG; PAM sequence: GAG
cgcagattctggaaagtgaa

SEQ ID NO: 65679 - DNA, 20 bp, Artificial Sequence
  Description of Artificial Sequence: Synthetic oligonucleotide
  Target: ATXN1; (-) strand; PAM type: NRG; PAM sequence: AAG
gacgcagattctggaaagtg

SEQ ID NO: 65680 - DNA, 20 bp, Artificial Sequence
  Description of Artificial Sequence: Synthetic oligonucleotide
  Target: ATXN1; (-) strand; PAM type: NRG; PAM sequence: AAG
ccagagacgcagattctgga

SEQ ID NO: 65681 - DNA, 20 bp, Artificial Sequence
  Description of Artificial Sequence: Synthetic oligonucleotide
  Target: ATXN1; (-) strand; PAM type: NRG; PAM sequence: TGG
gagaccagagacgcagattc

SEQ ID NO: 65682 - DNA, 20 bp, Artificial Sequence
  Description of Artificial Sequence: Synthetic oligonucleotide
  Target: ATXN1; (-) strand; PAM type: NRG; PAM sequence: CAG
ggccattgagaccagagacg

SEQ ID NO: 65683 - DNA, 20 bp, Artificial Sequence
  Description of Artificial Sequence: Synthetic oligonucleotide
  Target: ATXN1; (-) strand; PAM type: NRG; PAM sequence: GAG
tgcgagggccattgagacca

SEQ ID NO: 65684 - DNA, 20 bp, Artificial Sequence
  Description of Artificial Sequence: Synthetic oligonucleotide
  Target: ATXN1; (-) strand; PAM type: NRG; PAM sequence: CAG
cgtgcgagggccattgagac

SEQ ID NO: 65685 - DNA, 20 bp, Artificial Sequence
  Description of Artificial Sequence: Synthetic oligonucleotide
  Target: ATXN1; (-) strand; PAM type: NRG; PAM sequence: GAG
ggaggcgtgcgagggccatt

SEQ ID NO: 65686 - DNA, 20 bp, Artificial Sequence
  Description of Artificial Sequence: Synthetic oligonucleotide
  Target: ATXN1; (-) strand; PAM type: NRG; PAM sequence: GGG
gattgcggggaggcgtgcga

SEQ ID NO: 65687 - DNA, 20 bp, Artificial Sequence
  Description of Artificial Sequence: Synthetic oligonucleotide
  Target: ATXN1; (-) strand; PAM type: NRG; PAM sequence: AGG
ggattgcggggaggcgtgcg

SEQ ID NO: 65688 - DNA, 20 bp, Artificial Sequence
  Description of Artificial Sequence: Synthetic oligonucleotide
  Target: ATXN1; (-) strand; PAM type: NRG; PAM sequence: GAG
gggattgcggggaggcgtgc

SEQ ID NO: 65689 - DNA, 20 bp, Artificial Sequence
  Description of Artificial Sequence: Synthetic oligonucleotide
  Target: ATXN1; (-) strand; PAM type: NRG; PAM sequence: AGG
ttgcaacagggattgcgggg

SEQ ID NO: 65690 - DNA, 20 bp, Artificial Sequence
  Description of Artificial Sequence: Synthetic oligonucleotide
  Target: ATXN1; (-) strand; PAM type: NRG; PAM sequence: GAG
tttgcaacagggattgcggg

SEQ ID NO: 65691 - DNA, 20 bp, Artificial Sequence
  Description of Artificial Sequence: Synthetic oligonucleotide
  Target: ATXN1; (-) strand; PAM type: NRG; PAM sequence: GGG
agtttgcaacagggattgcg

SEQ ID NO: 65692 - DNA, 20 bp, Artificial Sequence
  Description of Artificial Sequence: Synthetic oligonucleotide
  Target: ATXN1; (-) strand; PAM type: NRG; PAM sequence: GGG
tagtttgcaacagggattgc

SEQ ID NO: 65693 - DNA, 20 bp, Artificial Sequence
  Description of Artificial Sequence: Synthetic oligonucleotide
  Target: ATXN1; (-) strand; PAM type: NRG; PAM sequence: CGG
ttagtttgcaacagggattg

SEQ ID NO: 65694 - DNA, 20 bp, Artificial Sequence
  Description of Artificial Sequence: Synthetic oligonucleotide
  Target: ATXN1; (-) strand; PAM type: NRG; PAM sequence: GGG
tgggattttagtttgcaaca

SEQ ID NO: 65695 - DNA, 20 bp, Artificial Sequence
  Description of Artificial Sequence: Synthetic oligonucleotide
  Target: ATXN1; (-) strand; PAM type: NRG; PAM sequence: AGG
atgggattttagtttgcaac

SEQ ID NO: 65696 - DNA, 20 bp, Artificial Sequence
  Description of Artificial Sequence: Synthetic oligonucleotide
  Target: ATXN1; (-) strand; PAM type: NRG; PAM sequence: CAG
aatgggattttagtttgcaa

SEQ ID NO: 65697 - DNA, 20 bp, Artificial Sequence
  Description of Artificial Sequence: Synthetic oligonucleotide
  Target: ATXN1; (-) strand; PAM type: NRG; PAM sequence: TAG
gtgatttgggaatgggattt

SEQ ID NO: 65698 - DNA, 20 bp, Artificial Sequence
  Description of Artificial Sequence: Synthetic oligonucleotide
  Target: ATXN1; (-) strand; PAM type: NRG; PAM sequence: GGG
agagaaggtgatttgggaat

SEQ ID NO: 65699 - DNA, 20 bp, Artificial Sequence
  Description of Artificial Sequence: Synthetic oligonucleotide
  Target: ATXN1; (-) strand; PAM type: NRG; PAM sequence: TGG
cagagaaggtgatttgggaa

SEQ ID NO: 65700 - DNA, 20 bp, Artificial Sequence
  Description of Artificial Sequence: Synthetic oligonucleotide
  Target: ATXN1; (-) strand; PAM type: NRG; PAM sequence: GGG
ttccacagagaaggtgattt

SEQ ID NO: 65701 - DNA, 20 bp, Artificial Sequence
  Description of Artificial Sequence: Synthetic oligonucleotide
  Target: ATXN1; (-) strand; PAM type: NRG; PAM sequence: TGG
tttccacagagaaggtgatt

SEQ ID NO: 65702 - DNA, 20 bp, Artificial Sequence
  Description of Artificial Sequence: Synthetic oligonucleotide
  Target: ATXN1; (-) strand; PAM type: NRG; PAM sequence: AGG
caggccaatttccacagaga

SEQ ID NO: 65703 - DNA, 20 bp, Artificial Sequence
  Description of Artificial Sequence: Synthetic oligonucleotide
  Target: ATXN1; (-) strand; PAM type: NRG; PAM sequence: AAG
tcaggccaatttccacagag

SEQ ID NO: 65704 - DNA, 20 bp, Artificial Sequence
  Description of Artificial Sequence: Synthetic oligonucleotide
  Target: ATXN1; (-) strand; PAM type: NRG; PAM sequence: GAG
agatcaggccaatttccaca

SEQ ID NO: 65705 - DNA, 20 bp, Artificial Sequence
  Description of Artificial Sequence: Synthetic oligonucleotide
  Target: ATXN1; (-) strand; PAM type: NRG; PAM sequence: CAG
gaagatcaggccaatttcca

SEQ ID NO: 65706 - DNA, 20 bp, Artificial Sequence
  Description of Artificial Sequence: Synthetic oligonucleotide
  Target: ATXN1; (-) strand; PAM type: NRG; PAM sequence: AGG
cacttctgattgggaagatc

SEQ ID NO: 65707 - DNA, 20 bp, Artificial Sequence
  Description of Artificial Sequence: Synthetic oligonucleotide
  Target: ATXN1; (-) strand; PAM type: NRG; PAM sequence: CAG
tcacttctgattgggaagat

SEQ ID NO: 65708 - DNA, 20 bp, Artificial Sequence
  Description of Artificial Sequence: Synthetic oligonucleotide
  Target: ATXN1; (-) strand; PAM type: NRG; PAM sequence: AAG
agtgatcacttctgattggg

SEQ ID NO: 65709 - DNA, 20 bp, Artificial Sequence
  Description of Artificial Sequence: Synthetic oligonucleotide
  Target: ATXN1; (-) strand; PAM type: NRG; PAM sequence: GGG
agaagtgatcacttctgatt

SEQ ID NO: 65710 - DNA, 20 bp, Artificial Sequence
  Description of Artificial Sequence: Synthetic oligonucleotide
  Target: ATXN1; (-) strand; PAM type: NRG; PAM sequence: TGG
tagaagtgatcacttctgat

SEQ ID NO: 65711 - DNA, 20 bp, Artificial Sequence
  Description of Artificial Sequence: Synthetic oligonucleotide
  Target: ATXN1; (-) strand; PAM type: NRG; PAM sequence: AAG
cttcagagggttaaagatag

SEQ ID NO: 65712 - DNA, 20 bp, Artificial Sequence
  Description of Artificial Sequence: Synthetic oligonucleotide
  Target: ATXN1; (-) strand; PAM type: NRG; PAM sequence: TAG
acgcttcagagggttaaaga

SEQ ID NO: 65713 - DNA, 20 bp, Artificial Sequence
  Description of Artificial Sequence: Synthetic oligonucleotide
  Target: ATXN1; (-) strand; PAM type: NRG; PAM sequence: AAG
aaacacgcttcagagggtta

SEQ ID NO: 65714 - DNA, 20 bp, Artificial Sequence
  Description of Artificial Sequence: Synthetic oligonucleotide
  Target: ATXN1; (-) strand; PAM type: NRG; PAM sequence: GGG
aagtaaaaacacgcttcaga

SEQ ID NO: 65715 - DNA, 20 bp, Artificial Sequence
  Description of Artificial Sequence: Synthetic oligonucleotide
  Target: ATXN1; (-) strand; PAM type: NRG; PAM sequence: AGG
aaagtaaaaacacgcttcag

SEQ ID NO: 65716 - DNA, 20 bp, Artificial Sequence
  Description of Artificial Sequence: Synthetic oligonucleotide
  Target: ATXN1; (-) strand; PAM type: NRG; PAM sequence: GAG
aaaagtaaaaacacgcttca

SEQ ID NO: 65717 - DNA, 20 bp, Artificial Sequence
  Description of Artificial Sequence: Synthetic oligonucleotide
  Target: ATXN1; (-) strand; PAM type: NRG; PAM sequence: CAG
ataaaagtaaaaacacgctt

SEQ ID NO: 65718 - DNA, 20 bp, Artificial Sequence
  Description of Artificial Sequence: Synthetic oligonucleotide
  Target: ATXN1; (-) strand; PAM type: NRG; PAM sequence: AAG
aggtgataaactgtatataa

SEQ ID NO: 65719 - DNA, 20 bp, Artificial Sequence
  Description of Artificial Sequence: Synthetic oligonucleotide
  Target: ATXN1; (-) strand; PAM type: NRG; PAM sequence: AGG
taagtatggcataagacaga

SEQ ID NO: 65720 - DNA, 20 bp, Artificial Sequence
  Description of Artificial Sequence: Synthetic oligonucleotide
  Target: ATXN1; (-) strand; PAM type: NRG; PAM sequence: AAG
ataagtatggcataagacag

SEQ ID NO: 65721 - DNA, 20 bp, Artificial Sequence
  Description of Artificial Sequence: Synthetic oligonucleotide
  Target: ATXN1; (-) strand; PAM type: NRG; PAM sequence: CAG
caaataagtatggcataaga

SEQ ID NO: 65722 - DNA, 20 bp, Artificial Sequence
  Description of Artificial Sequence: Synthetic oligonucleotide
  Target: ATXN1; (-) strand; PAM type: NRG; PAM sequence: AAG
tatacaaataagtatggcat

SEQ ID NO: 65723 - DNA, 20 bp, Artificial Sequence
  Description of Artificial Sequence: Synthetic oligonucleotide
  Target: ATXN1; (-) strand; PAM type: NRG; PAM sequence: TGG
gagaagtatacaaataagta

SEQ ID NO: 65724 - DNA, 20 bp, Artificial Sequence
  Description of Artificial Sequence: Synthetic oligonucleotide
  Target: ATXN1; (-) strand; PAM type: NRG; PAM sequence: AAG
actaggagaagtatacaaat

SEQ ID NO: 65725 - DNA, 20 bp, Artificial Sequence
  Description of Artificial Sequence: Synthetic oligonucleotide
  Target: ATXN1; (-) strand; PAM type: NRG; PAM sequence: AAG
atctgaaaaggaactaggag

SEQ ID NO: 65726 - DNA, 20 bp, Artificial Sequence
  Description of Artificial Sequence: Synthetic oligonucleotide
  Target: ATXN1; (-) strand; PAM type: NRG; PAM sequence: GAG
atgatctgaaaaggaactag

SEQ ID NO: 65727 - DNA, 20 bp, Artificial Sequence
  Description of Artificial Sequence: Synthetic oligonucleotide
  Target: ATXN1; (-) strand; PAM type: NRG; PAM sequence: AGG
ctatgatctgaaaaggaact

SEQ ID NO: 65728 - DNA, 20 bp, Artificial Sequence
  Description of Artificial Sequence: Synthetic oligonucleotide
  Target: ATXN1; (-) strand; PAM type: NRG; PAM sequence: TAG
cctatgatctgaaaaggaac

SEQ ID NO: 65729 - DNA, 20 bp, Artificial Sequence
  Description of Artificial Sequence: Synthetic oligonucleotide
  Target: ATXN1; (-) strand; PAM type: NRG; PAM sequence: AGG
aaaaatcctatgatctgaaa

SEQ ID NO: 65730 - DNA, 20 bp, Artificial Sequence
  Description of Artificial Sequence: Synthetic oligonucleotide
  Target: ATXN1; (-) strand; PAM type: NRG; PAM sequence: AAG
caaaaatcctatgatctgaa

SEQ ID NO: 65731 - DNA, 20 bp, Artificial Sequence
  Description of Artificial Sequence: Synthetic oligonucleotide
  Target: ATXN1; (-) strand; PAM type: NRG; PAM sequence: AAG
ctaggtgatgcagaagacag

SEQ ID NO: 65732 - DNA, 20 bp, Artificial Sequence
  Description of Artificial Sequence: Synthetic oligonucleotide
  Target: ATXN1; (-) strand; PAM type: NRG; PAM sequence: CAG
ttgctaggtgatgcagaaga

SEQ ID NO: 65733 - DNA, 20 bp, Artificial Sequence
  Description of Artificial Sequence: Synthetic oligonucleotide
  Target: ATXN1; (-) strand; PAM type: NRG; PAM sequence: AAG
caagttgctaggtgatgcag

SEQ ID NO: 65734 - DNA, 20 bp, Artificial Sequence
  Description of Artificial Sequence: Synthetic oligonucleotide
  Target: ATXN1; (-) strand; PAM type: NRG; PAM sequence: CAG
gaacaagttgctaggtgatg

SEQ ID NO: 65735 - DNA, 20 bp, Artificial Sequence
  Description of Artificial Sequence: Synthetic oligonucleotide
  Target: ATXN1; (-) strand; PAM type: NRG; PAM sequence: AGG
actttgaggaacaagttgct

SEQ ID NO: 65736 - DNA, 20 bp, Artificial Sequence
  Description of Artificial Sequence: Synthetic oligonucleotide
  Target: ATXN1; (-) strand; PAM type: NRG; PAM sequence: TAG
cactttgaggaacaagttgc

SEQ ID NO: 65737 - DNA, 20 bp, Artificial Sequence
  Description of Artificial Sequence: Synthetic oligonucleotide
  Target: ATXN1; (-) strand; PAM type: NRG; PAM sequence: AAG
aggaagacactttgaggaac

SEQ ID NO: 65738 - DNA, 20 bp, Artificial Sequence
  Description of Artificial Sequence: Synthetic oligonucleotide
  Target: ATXN1; (-) strand; PAM type: NRG; PAM sequence: AGG
ggtcccaggaagacactttg

SEQ ID NO: 65739 - DNA, 20 bp, Artificial Sequence
  Description of Artificial Sequence: Synthetic oligonucleotide
  Target: ATXN1; (-) strand; PAM type: NRG; PAM sequence: GAG
tggtcccaggaagacacttt

SEQ ID NO: 65740 - DNA, 20 bp, Artificial Sequence
  Description of Artificial Sequence: Synthetic oligonucleotide
  Target: ATXN1; (-) strand; PAM type: NRG; PAM sequence: AAG
gagatgctgctggtcccagg

SEQ ID NO: 65741 - DNA, 20 bp, Artificial Sequence
  Description of Artificial Sequence: Synthetic oligonucleotide
  Target: ATXN1; (-) strand; PAM type: NRG; PAM sequence: AGG
cctgagatgctgctggtccc

SEQ ID NO: 65742 - DNA, 20 bp, Artificial Sequence
  Description of Artificial Sequence: Synthetic oligonucleotide
  Target: ATXN1; (-) strand; PAM type: NRG; PAM sequence: CAG
gcctgagatgctgctggtcc

SEQ ID NO: 65743 - DNA, 20 bp, Artificial Sequence
  Description of Artificial Sequence: Synthetic oligonucleotide
  Target: ATXN1; (-) strand; PAM type: NRG; PAM sequence: TGG
gatagggcctgagatgctgc

SEQ ID NO: 65744 - DNA, 20 bp, Artificial Sequence
  Description of Artificial Sequence: Synthetic oligonucleotide
  Target: ATXN1; (-) strand; PAM type: NRG; PAM sequence: GAG
gtcggtctgagatagggcct

SEQ ID NO: 65745 - DNA, 20 bp, Artificial Sequence
  Description of Artificial Sequence: Synthetic oligonucleotide
  Target: ATXN1; (-) strand; PAM type: NRG; PAM sequence: GGG
gatcctgtcggtctgagata

SEQ ID NO: 65746 - DNA, 20 bp, Artificial Sequence
  Description of Artificial Sequence: Synthetic oligonucleotide
  Target: ATXN1; (-) strand; PAM type: NRG; PAM sequence: AGG
tgatcctgtcggtctgagat

SEQ ID NO: 65747 - DNA, 20 bp, Artificial Sequence
  Description of Artificial Sequence: Synthetic oligonucleotide
  Target: ATXN1; (-) strand; PAM type: NRG; PAM sequence: TAG
ctgatcctgtcggtctgaga

SEQ ID NO: 65748 - DNA, 20 bp, Artificial Sequence
  Description of Artificial Sequence: Synthetic oligonucleotide
  Target: ATXN1; (-) strand; PAM type: NRG; PAM sequence: GAG
ggttctgatcctgtcggtct

SEQ ID NO: 65749 - DNA, 20 bp, Artificial Sequence
  Description of Artificial Sequence: Synthetic oligonucleotide
  Target: ATXN1; (-) strand; PAM type: NRG; PAM sequence: CGG
aatgcaggttctgatcctgt

SEQ ID NO: 65750 - DNA, 20 bp, Artificial Sequence
  Description of Artificial Sequence: Synthetic oligonucleotide
  Target: ATXN1; (-) strand; PAM type: NRG; PAM sequence: AGG
tgggaatattgttaaaatgc

SEQ ID NO: 65751 - DNA, 20 bp, Artificial Sequence
  Description of Artificial Sequence: Synthetic oligonucleotide
  Target: ATXN1; (-) strand; PAM type: NRG; PAM sequence: CAG
ctgggaatattgttaaaatg

SEQ ID NO: 65752 - DNA, 20 bp, Artificial Sequence
  Description of Artificial Sequence: Synthetic oligonucleotide
  Target: ATXN1; (-) strand; PAM type: NRG; PAM sequence: GGG
caagtgggtcggaatcccct

SEQ ID NO: 65753 - DNA, 20 bp, Artificial Sequence
  Description of Artificial Sequence: Synthetic oligonucleotide
  Target: ATXN1; (-) strand; PAM type: NRG; PAM sequence: TGG
tcaagtgggtcggaatcccc

SEQ ID NO: 65754 - DNA, 20 bp, Artificial Sequence
  Description of Artificial Sequence: Synthetic oligonucleotide
  Target: ATXN1; (-) strand; PAM type: NRG; PAM sequence: CGG
gtgagcttgatcaagtgggt

SEQ ID NO: 65755 - DNA, 20 bp, Artificial Sequence
  Description of Artificial Sequence: Synthetic oligonucleotide
  Target: ATXN1; (-) strand; PAM type: NRG; PAM sequence: GGG
tgctgtgagcttgatcaagt

SEQ ID NO: 65756 - DNA, 20 bp, Artificial Sequence
  Description of Artificial Sequence: Synthetic oligonucleotide
  Target: ATXN1; (-) strand; PAM type: NRG; PAM sequence: TGG
ctgctgtgagcttgatcaag

SEQ ID NO: 65757 - DNA, 20 bp, Artificial Sequence
  Description of Artificial Sequence: Synthetic oligonucleotide
  Target: ATXN1; (-) strand; PAM type: NRG; PAM sequence: AAG
tggctgctgtgagcttgatc

SEQ ID NO: 65758 - DNA, 20 bp, Artificial Sequence
  Description of Artificial Sequence: Synthetic oligonucleotide
  Target: ATXN1; (-) strand; PAM type: NRG; PAM sequence: GAG
atgagatgagtggctgctgt

SEQ ID NO: 65759 - DNA, 20 bp, Artificial Sequence
  Description of Artificial Sequence: Synthetic oligonucleotide
  Target: ATXN1; (-) strand; PAM type: NRG; PAM sequence: TGG
ccagtcaagtatgagatgag

SEQ ID NO: 65760 - DNA, 20 bp, Artificial Sequence
  Description of Artificial Sequence: Synthetic oligonucleotide
  Target: ATXN1; (-) strand; PAM type: NRG; PAM sequence: GAG
caaccagtcaagtatgagat

SEQ ID NO: 65761 - DNA, 20 bp, Artificial Sequence
  Description of Artificial Sequence: Synthetic oligonucleotide
  Target: ATXN1; (-) strand; PAM type: NRG; PAM sequence: GAG
cagttcaaccagtcaagtat

SEQ ID NO: 65762 - DNA, 20 bp, Artificial Sequence
  Description of Artificial Sequence: Synthetic oligonucleotide
  Target: ATXN1; (-) strand; PAM type: NRG; PAM sequence: AAG
cctagtcagttcaaccagtc

SEQ ID NO: 65763 - DNA, 20 bp, Artificial Sequence
  Description of Artificial Sequence: Synthetic oligonucleotide
  Target: ATXN1; (-) strand; PAM type: NRG; PAM sequence: CAG
gttttcctagtcagttcaac

SEQ ID NO: 65764 - DNA, 20 bp, Artificial Sequence
  Description of Artificial Sequence: Synthetic oligonucleotide
  Target: ATXN1; (-) strand; PAM type: NRG; PAM sequence: CAG
tcctactttgttttcctagt

SEQ ID NO: 65765 - DNA, 20 bp, Artificial Sequence
  Description of Artificial Sequence: Synthetic oligonucleotide
  Target: ATXN1; (-) strand; PAM type: NRG; PAM sequence: TAG
tttctcctactttgttttcc

SEQ ID NO: 65766 - DNA, 20 bp, Artificial Sequence
  Description of Artificial Sequence: Synthetic oligonucleotide
  Target: ATXN1; (-) strand; PAM type: NRG; PAM sequence: TGG
tgagttatgtaagttatgtt

SEQ ID NO: 65767 - DNA, 20 bp, Artificial Sequence
  Description of Artificial Sequence: Synthetic oligonucleotide
  Target: ATXN1; (-) strand; PAM type: NRG; PAM sequence: AAG
gatctttgaatgagttatgt

SEQ ID NO: 65768 - DNA, 20 bp, Artificial Sequence
  Description of Artificial Sequence: Synthetic oligonucleotide
  Target: ATXN1; (-) strand; PAM type: NRG; PAM sequence: GAG
actcacaatgatctttgaat

SEQ ID NO: 65769 - DNA, 20 bp, Artificial Sequence
  Description of Artificial Sequence: Synthetic oligonucleotide
  Target: ATXN1; (-) strand; PAM type: NRG; PAM sequence: TAG
gttttatataggtaaagcat

SEQ ID NO: 65770 - DNA, 20 bp, Artificial Sequence
  Description of Artificial Sequence: Synthetic oligonucleotide
  Target: ATXN1; (-) strand; PAM type: NRG; PAM sequence: AAG
gccctagttttatataggta

SEQ ID NO: 65771 - DNA, 20 bp, Artificial Sequence
  Description of Artificial Sequence: Synthetic oligonucleotide
  Target: ATXN1; (-) strand; PAM type: NRG; PAM sequence: AGG
gcctggccctagttttatat

SEQ ID NO: 65772 - DNA, 20 bp, Artificial Sequence
  Description of Artificial Sequence: Synthetic oligonucleotide
  Target: ATXN1; (-) strand; PAM type: NRG; PAM sequence: TAG
tgcctggccctagttttata

SEQ ID NO: 65773 - DNA, 20 bp, Artificial Sequence
  Description of Artificial Sequence: Synthetic oligonucleotide
  Target: ATXN1; (-) strand; PAM type: NRG; PAM sequence: TAG
taagccactgtgcctggccc

SEQ ID NO: 65774 - DNA, 20 bp, Artificial Sequence
  Description of Artificial Sequence: Synthetic oligonucleotide
  Target: ATXN1; (-) strand; PAM type: NRG; PAM sequence: TGG
taggtataagccactgtgcc

SEQ ID NO: 65775 - DNA, 20 bp, Artificial Sequence
  Description of Artificial Sequence: Synthetic oligonucleotide
  Target: ATXN1; (-) strand; PAM type: NRG; PAM sequence: AAG
cctcccacagtgctaggtat

SEQ ID NO: 65776 - DNA, 20 bp, Artificial Sequence
  Description of Artificial Sequence: Synthetic oligonucleotide
  Target: ATXN1; (-) strand; PAM type: NRG; PAM sequence: AGG
cctctgcctcccacagtgct

SEQ ID NO: 65777 - DNA, 20 bp, Artificial Sequence
  Description of Artificial Sequence: Synthetic oligonucleotide
  Target: ATXN1; (-) strand; PAM type: NRG; PAM sequence: TAG
acctctgcctcccacagtgc

SEQ ID NO: 65778 - DNA, 20 bp, Artificial Sequence
  Description of Artificial Sequence: Synthetic oligonucleotide
  Target: ATXN1; (-) strand; PAM type: NRG; PAM sequence: CAG
tctcccacctctgcctccca

SEQ ID NO: 65779 - DNA, 20 bp, Artificial Sequence
  Description of Artificial Sequence: Synthetic oligonucleotide
  Target: ATXN1; (-) strand; PAM type: NRG; PAM sequence: AAG
ggtcttgaactcctggactc

SEQ ID NO: 65780 - DNA, 20 bp, Artificial Sequence
  Description of Artificial Sequence: Synthetic oligonucleotide
  Target: ATXN1; (-) strand; PAM type: NRG; PAM sequence: TGG
tctggttggtcttgaactcc

SEQ ID NO: 65781 - DNA, 20 bp, Artificial Sequence
  Description of Artificial Sequence: Synthetic oligonucleotide
  Target: ATXN1; (-) strand; PAM type: NRG; PAM sequence: TGG
tttcactgtgctcctctggt

SEQ ID NO: 65782 - DNA, 20 bp, Artificial Sequence
  Description of Artificial Sequence: Synthetic oligonucleotide
  Target: ATXN1; (-) strand; PAM type: NRG; PAM sequence: TGG
ggggtttcactgtgctcctc

SEQ ID NO: 65783 - DNA, 20 bp, Artificial Sequence
  Description of Artificial Sequence: Synthetic oligonucleotide
  Target: ATXN1; (-) strand; PAM type: NRG; PAM sequence: GGG
ttgtatttttggtagagatg

SEQ ID NO: 65784 - DNA, 20 bp, Artificial Sequence
  Description of Artificial Sequence: Synthetic oligonucleotide
  Target: ATXN1; (-) strand; PAM type: NRG; PAM sequence: GGG
tttgtatttttggtagagat

SEQ ID NO: 65785 - DNA, 20 bp, Artificial Sequence
  Description of Artificial Sequence: Synthetic oligonucleotide
  Target: ATXN1; (-) strand; PAM type: NRG; PAM sequence: TGG
ttttgtatttttggtagaga

SEQ ID NO: 65786 - DNA, 20 bp, Artificial Sequence
  Description of Artificial Sequence: Synthetic oligonucleotide
  Target: ATXN1; (-) strand; PAM type: NRG; PAM sequence: GAG
taatttttgtatttttggta

SEQ ID NO: 65787 - DNA, 20 bp, Artificial Sequence
  Description of Artificial Sequence: Synthetic oligonucleotide
  Target: ATXN1; (-) strand; PAM type: NRG; PAM sequence: TAG
gctaatttttgtatttttgg

SEQ ID NO: 65788 - DNA, 20 bp, Artificial Sequence
  Description of Artificial Sequence: Synthetic oligonucleotide
  Target: ATXN1; (-) strand; PAM type: NRG; PAM sequence: TGG
ccagctaatttttgtatttt

SEQ ID NO: 65789 - DNA, 20 bp, Artificial Sequence
  Description of Artificial Sequence: Synthetic oligonucleotide
  Target: ATXN1; (-) strand; PAM type: NRG; PAM sequence: CAG
caggtgtgtgccaccatgcc

SEQ ID NO: 65790 - DNA, 20 bp, Artificial Sequence
  Description of Artificial Sequence: Synthetic oligonucleotide
  Target: ATXN1; (-) strand; PAM type: NRG; PAM sequence: AGG
cccaagtagcttgggactac

SEQ ID NO: 65791 - DNA, 20 bp, Artificial Sequence
  Description of Artificial Sequence: Synthetic oligonucleotide
  Target: ATXN1; (-) strand; PAM type: NRG; PAM sequence: CAG
tcccaagtagcttgggacta

SEQ ID NO: 65792 - DNA, 20 bp, Artificial Sequence
  Description of Artificial Sequence: Synthetic oligonucleotide
  Target: ATXN1; (-) strand; PAM type: NRG; PAM sequence: GGG
cttagcctcccaagtagctt

SEQ ID NO: 65793 - DNA, 20 bp, Artificial Sequence
  Description of Artificial Sequence: Synthetic oligonucleotide
  Target: ATXN1; (-) strand; PAM type: NRG; PAM sequence: TGG
ccttagcctcccaagtagct

SEQ ID NO: 65794 - DNA, 20 bp, Artificial Sequence
  Description of Artificial Sequence: Synthetic oligonucleotide
  Target: ATXN1; (-) strand; PAM type: NRG; PAM sequence: TAG
tcccaccttagcctcccaag

SEQ ID NO: 65795 - DNA, 20 bp, Artificial Sequence
  Description of Artificial Sequence: Synthetic oligonucleotide
  Target: ATXN1; (-) strand; PAM type: NRG; PAM sequence: AAG
tcctcccaccttagcctccc

SEQ ID NO: 65796 - DNA, 20 bp, Artificial Sequence
  Description of Artificial Sequence: Synthetic oligonucleotide
  Target: ATXN1; (-) strand; PAM type: NRG; PAM sequence: TAG
ttcaagcagtcctcccacct

SEQ ID NO: 65797 - DNA, 20 bp, Artificial Sequence
  Description of Artificial Sequence: Synthetic oligonucleotide
  Target: ATXN1; (-) strand; PAM type: NRG; PAM sequence: CAG
tcaacctcctggggttcaag

SEQ ID NO: 65798 - DNA, 20 bp, Artificial Sequence
  Description of Artificial Sequence: Synthetic oligonucleotide
  Target: ATXN1; (-) strand; PAM type: NRG; PAM sequence: AAG
gcctcaacctcctggggttc

SEQ ID NO: 65799 - DNA, 20 bp, Artificial Sequence
  Description of Artificial Sequence: Synthetic oligonucleotide
  Target: ATXN1; (-) strand; PAM type: NRG; PAM sequence: GGG
attgcagcctcaacctcctg

SEQ ID NO: 65800 - DNA, 20 bp, Artificial Sequence
  Description of Artificial Sequence: Synthetic oligonucleotide
  Target: ATXN1; (-) strand; PAM type: NRG; PAM sequence: GGG
cattgcagcctcaacctcct

SEQ ID NO: 65801 - DNA, 20 bp, Artificial Sequence
  Description of Artificial Sequence: Synthetic oligonucleotide
  Target: ATXN1; (-) strand; PAM type: NRG; PAM sequence: TGG
tcattgcagcctcaacctcc

SEQ ID NO: 65802 - DNA, 20 bp, Artificial Sequence
  Description of Artificial Sequence: Synthetic oligonucleotide
  Target: ATXN1; (-) strand; PAM type: NRG; PAM sequence: CAG
ggtgcactcacagctcattg

SEQ ID NO: 65803 - DNA, 20 bp, Artificial Sequence
  Description of Artificial Sequence: Synthetic oligonucleotide
  Target: ATXN1; (-) strand; PAM type: NRG; PAM sequence: CAG
ggagtgcagtggtgcactca

SEQ ID NO: 65804 - DNA, 20 bp, Artificial Sequence
  Description of Artificial Sequence: Synthetic oligonucleotide
  Target: ATXN1; (-) strand; PAM type: NRG; PAM sequence: TGG
tcacccaggctggagtgcag

SEQ ID NO: 65805 - DNA, 20 bp, Artificial Sequence
  Description of Artificial Sequence: Synthetic oligonucleotide
  Target: ATXN1; (-) strand; PAM type: NRG; PAM sequence: CAG
ctgtcacccaggctggagtg

SEQ ID NO: 65806 - DNA, 20 bp, Artificial Sequence
  Description of Artificial Sequence: Synthetic oligonucleotide
  Target: ATXN1; (-) strand; PAM type: NRG; PAM sequence: GAG
tcactctgtcacccaggctg

SEQ ID NO: 65807 - DNA, 20 bp, Artificial Sequence
  Description of Artificial Sequence: Synthetic oligonucleotide
  Target: ATXN1; (-) strand; PAM type: NRG; PAM sequence: TGG
cctcactctgtcacccaggc

SEQ ID NO: 65808 - DNA, 20 bp, Artificial Sequence
  Description of Artificial Sequence: Synthetic oligonucleotide
  Target: ATXN1; (-) strand; PAM type: NRG; PAM sequence: AGG
agggcctcactctgtcaccc

SEQ ID NO: 65809 - DNA, 20 bp, Artificial Sequence
  Description of Artificial Sequence: Synthetic oligonucleotide
  Target: ATXN1; (-) strand; PAM type: NRG; PAM sequence: CAG
cagggcctcactctgtcacc

SEQ ID NO: 65810 - DNA, 20 bp, Artificial Sequence
  Description of Artificial Sequence: Synthetic oligonucleotide
  Target: ATXN1; (-) strand; PAM type: NRG; PAM sequence: GGG
atttatttatttatgagaca

SEQ ID NO: 65811 - DNA, 20 bp, Artificial Sequence
  Description of Artificial Sequence: Synthetic oligonucleotide
  Target: ATXN1; (-) strand; PAM type: NRG; PAM sequence: AGG
tatttatttatttatgagac

SEQ ID NO: 65812 - DNA, 20 bp, Artificial Sequence
  Description of Artificial Sequence: Synthetic oligonucleotide
  Target: ATXN1; (-) strand; PAM type: NRG; PAM sequence: CAG
ttatttatttatttatgaga

SEQ ID NO: 65813 - DNA, 20 bp, Artificial Sequence
  Description of Artificial Sequence: Synthetic oligonucleotide
  Target: ATXN1; (-) strand; PAM type: NRG; PAM sequence: GAG
ctatttatttatttatttat

SEQ ID NO: 65814 - DNA, 20 bp, Artificial Sequence
  Description of Artificial Sequence: Synthetic oligonucleotide
  Target: ATXN1; (-) strand; PAM type: NRG; PAM sequence: TGG
gtcttcctccctcagaaggt

SEQ ID NO: 65815 - DNA, 20 bp, Artificial Sequence
  Description of Artificial Sequence: Synthetic oligonucleotide
  Target: ATXN1; (-) strand; PAM type: NRG; PAM sequence: AGG
atttgtcttcctccctcaga

SEQ ID NO: 65816 - DNA, 20 bp, Artificial Sequence
  Description of Artificial Sequence: Synthetic oligonucleotide
  Target: ATXN1; (-) strand; PAM type: NRG; PAM sequence: AAG
catttgtcttcctccctcag

SEQ ID NO: 65817 - DNA, 20 bp, Artificial Sequence
  Description of Artificial Sequence: Synthetic oligonucleotide
  Target: ATXN1; (-) strand; PAM type: NRG; PAM sequence: CAG
tgacatttgtcttcctccct

SEQ ID NO: 65818 - DNA, 20 bp, Artificial Sequence
  Description of Artificial Sequence: Synthetic oligonucleotide
  Target: ATXN1; (-) strand; PAM type: NRG; PAM sequence: AGG
cagatctatttggttggcca

SEQ ID NO: 65819 - DNA, 20 bp, Artificial Sequence
  Description of Artificial Sequence: Synthetic oligonucleotide
  Target: ATXN1; (-) strand; PAM type: NRG; PAM sequence: AAG
ccagatctatttggttggcc

SEQ ID NO: 65820 - DNA, 20 bp, Artificial Sequence
  Description of Artificial Sequence: Synthetic oligonucleotide
  Target: ATXN1; (-) strand; PAM type: NRG; PAM sequence: TGG
tcttcccagatctatttggt

SEQ ID NO: 65821 - DNA, 20 bp, Artificial Sequence
  Description of Artificial Sequence: Synthetic oligonucleotide
  Target: ATXN1; (-) strand; PAM type: NRG; PAM sequence: TGG
aaaatcttcccagatctatt

SEQ ID NO: 65822 - DNA, 20 bp, Artificial Sequence
  Description of Artificial Sequence: Synthetic oligonucleotide
  Target: ATXN1; (-) strand; PAM type: NRG; PAM sequence: CAG
ataaaaagacaaaatcttcc

SEQ ID NO: 65823 - DNA, 20 bp, Artificial Sequence
  Description of Artificial Sequence: Synthetic oligonucleotide
  Target: ATXN1; (-) strand; PAM type: NRG; PAM sequence: AAG
aaatagacaagctttataaa

SEQ ID NO: 65824 - DNA, 20 bp, Artificial Sequence
  Description of Artificial Sequence: Synthetic oligonucleotide
  Target: ATXN1; (-) strand; PAM type: NRG; PAM sequence: AAG
cttcccacccttaaatagac

SEQ ID NO: 65825 - DNA, 20 bp, Artificial Sequence
  Description of Artificial Sequence: Synthetic oligonucleotide
  Target: ATXN1; (-) strand; PAM type: NRG; PAM sequence: TAG
gctgacttcccacccttaaa

SEQ ID NO: 65826 - DNA, 20 bp, Artificial Sequence
  Description of Artificial Sequence: Synthetic oligonucleotide
  Target: ATXN1; (-) strand; PAM type: NRG; PAM sequence: CAG
agaagtgtactattggcaag

SEQ ID NO: 65827 - DNA, 20 bp, Artificial Sequence
  Description of Artificial Sequence: Synthetic oligonucleotide
  Target: ATXN1; (-) strand; PAM type: NRG; PAM sequence: AAG
gggagaagtgtactattggc

SEQ ID NO: 65828 - DNA, 20 bp, Artificial Sequence
  Description of Artificial Sequence: Synthetic oligonucleotide
  Target: ATXN1; (-) strand; PAM type: NRG; PAM sequence: TGG
aagtgggagaagtgtactat

SEQ ID NO: 65829 - DNA, 20 bp, Artificial Sequence
  Description of Artificial Sequence: Synthetic oligonucleotide
  Target: ATXN1; (-) strand; PAM type: NRG; PAM sequence: AAG
cgatttcattaaagtgggag

SEQ ID NO: 65830 - DNA, 20 bp, Artificial Sequence
  Description of Artificial Sequence: Synthetic oligonucleotide
  Target: ATXN1; (-) strand; PAM type: NRG; PAM sequence: GAG
aaccgatttcattaaagtgg

SEQ ID NO: 65831 - DNA, 20 bp, Artificial Sequence
  Description of Artificial Sequence: Synthetic oligonucleotide
  Target: ATXN1; (-) strand; PAM type: NRG; PAM sequence: GGG
ccaaccgatttcattaaagt

SEQ ID NO: 65832 - DNA, 20 bp, Artificial Sequence
  Description of Artificial Sequence: Synthetic oligonucleotide
  Target: ATXN1; (-) strand; PAM type: NRG; PAM sequence: TGG
gccaaccgatttcattaaag

SEQ ID NO: 65833 - DNA, 20 bp, Artificial Sequence
  Description of Artificial Sequence: Synthetic oligonucleotide
  Target: ATXN1; (-) strand; PAM type: NRG; PAM sequence: AAG
acagccaaccgatttcatta

SEQ ID NO: 65834 - DNA, 20 bp, Artificial Sequence
  Description of Artificial Sequence: Synthetic oligonucleotide
  Target: ATXN1; (-) strand; PAM type: NRG; PAM sequence: CAG
ctttgatgcacatattttca

SEQ ID NO: 65835 - DNA, 20 bp, Artificial Sequence
  Description of Artificial Sequence: Synthetic oligonucleotide
  Target: ATXN1; (-) strand; PAM type: NRG; PAM sequence: CAG
tataagtctactggatgtga

SEQ ID NO: 65836 - DNA, 20 bp, Artificial Sequence
  Description of Artificial Sequence: Synthetic oligonucleotide
  Target: ATXN1; (-) strand; PAM type: NRG; PAM sequence: TGG
aatctgtattataagtctac

SEQ ID NO: 65837 - DNA, 20 bp, Artificial Sequence
  Description of Artificial Sequence: Synthetic oligonucleotide
  Target: ATXN1; (-) strand; PAM type: NRG; PAM sequence: AAG
tctgtagcaatctgtattat

SEQ ID NO: 65838 - DNA, 20 bp, Artificial Sequence
  Description of Artificial Sequence: Synthetic oligonucleotide
  Target: ATXN1; (-) strand; PAM type: NRG; PAM sequence: TAG
gaggataaatcttccatctg

SEQ ID NO: 65839 - DNA, 20 bp, Artificial Sequence
  Description of Artificial Sequence: Synthetic oligonucleotide
  Target: ATXN1; (-) strand; PAM type: NRG; PAM sequence: AGG
tgctgttgctacatcaagtg

SEQ ID NO: 65840 - DNA, 20 bp, Artificial Sequence
  Description of Artificial Sequence: Synthetic oligonucleotide
  Target: ATXN1; (-) strand; PAM type: NRG; PAM sequence: GAG
gtgctgttgctacatcaagt

SEQ ID NO: 65841 - DNA, 20 bp, Artificial Sequence
  Description of Artificial Sequence: Synthetic oligonucleotide
  Target: ATXN1; (-) strand; PAM type: NRG; PAM sequence: AAG
cgtagtgctgttgctacatc

SEQ ID NO: 65842 - DNA, 20 bp, Artificial Sequence
  Description of Artificial Sequence: Synthetic oligonucleotide
  Target: ATXN1; (-) strand; PAM type: NRG; PAM sequence: TAG
ttgttacagttcaaagaacg

SEQ ID NO: 65843 - DNA, 20 bp, Artificial Sequence
  Description of Artificial Sequence: Synthetic oligonucleotide
  Target: ATXN1; (-) strand; PAM type: NRG; PAM sequence: AAG
aaaagctttgttacagttca

SEQ ID NO: 65844 - DNA, 20 bp, Artificial Sequence
  Description of Artificial Sequence: Synthetic oligonucleotide
  Target: ATXN1; (-) strand; PAM type: NRG; PAM sequence: CAG
aaaaatcaaaagctttgtta

SEQ ID NO: 65845 - DNA, 20 bp, Artificial Sequence
  Description of Artificial Sequence: Synthetic oligonucleotide
  Target: ATXN1; (-) strand; PAM type: NRG; PAM sequence: AAG
cgtgggaaaaaaaaaatcaa

SEQ ID NO: 65846 - DNA, 20 bp, Artificial Sequence
  Description of Artificial Sequence: Synthetic oligonucleotide
  Target: ATXN1; (-) strand; PAM type: NRG; PAM sequence: GGG
ctaagattcatctaccacgt

SEQ ID NO: 65847 - DNA, 20 bp, Artificial Sequence
  Description of Artificial Sequence: Synthetic oligonucleotide
  Target: ATXN1; (-) strand; PAM type: NRG; PAM sequence: TGG
actaagattcatctaccacg

SEQ ID NO: 65848 - DNA, 20 bp, Artificial Sequence
  Description of Artificial Sequence: Synthetic oligonucleotide
  Target: ATXN1; (-) strand; PAM type: NRG; PAM sequence: AAG
caagtctgtattttcttact

SEQ ID NO: 65849 - DNA, 20 bp, Artificial Sequence
  Description of Artificial Sequence: Synthetic oligonucleotide
  Target: ATXN1; (-) strand; PAM type: NRG; PAM sequence: AAG
agttgagtatgtgtcatatc

SEQ ID NO: 65850 - DNA, 20 bp, Artificial Sequence
  Description of Artificial Sequence: Synthetic oligonucleotide
  Target: ATXN1; (-) strand; PAM type: NRG; PAM sequence: GAG
gcacccactttacagtagtt

SEQ ID NO: 65851 - DNA, 20 bp, Artificial Sequence
  Description of Artificial Sequence: Synthetic oligonucleotide
  Target: ATXN1; (-) strand; PAM type: NRG; PAM sequence: TAG
attaagcacccactttacag

SEQ ID NO: 65852 - DNA, 20 bp, Artificial Sequence
  Description of Artificial Sequence: Synthetic oligonucleotide
  Target: ATXN1; (-) strand; PAM type: NRG; PAM sequence: CAG
taaattaagcacccacttta

SEQ ID NO: 65853 - DNA, 20 bp, Artificial Sequence
  Description of Artificial Sequence: Synthetic oligonucleotide
  Target: ATXN1; (-) strand; PAM type: NRG; PAM sequence: AAG
ttcctctccctaactaaatt

SEQ ID NO: 65854 - DNA, 20 bp, Artificial Sequence
  Description of Artificial Sequence: Synthetic oligonucleotide
  Target: ATXN1; (-) strand; PAM type: NRG; PAM sequence: CAG
cctctaagcaggactttccc

SEQ ID NO: 65855 - DNA, 20 bp, Artificial Sequence
  Description of Artificial Sequence: Synthetic oligonucleotide
  Target: ATXN1; (-) strand; PAM type: NRG; PAM sequence: AGG
tagtgaggtgccctctaagc

SEQ ID NO: 65856 - DNA, 20 bp, Artificial Sequence
  Description of Artificial Sequence: Synthetic oligonucleotide
  Target: ATXN1; (-) strand; PAM type: NRG; PAM sequence: CAG
ctagtgaggtgccctctaag

SEQ ID NO: 65857 - DNA, 20 bp, Artificial Sequence
  Description of Artificial Sequence: Synthetic oligonucleotide
  Target: ATXN1; (-) strand; PAM type: NRG; PAM sequence: AAG
tggctagtgaggtgccctct

SEQ ID NO: 65858 - DNA, 20 bp, Artificial Sequence
  Description of Artificial Sequence: Synthetic oligonucleotide
  Target: ATXN1; (-) strand; PAM type: NRG; PAM sequence: AGG
atgccctctagtggctagtg

SEQ ID NO: 65859 - DNA, 20 bp, Artificial Sequence
  Description of Artificial Sequence: Synthetic oligonucleotide
  Target: ATXN1; (-) strand; PAM type: NRG; PAM sequence: GAG
aatgccctctagtggctagt

SEQ ID NO: 65860 - DNA, 20 bp, Artificial Sequence
  Description of Artificial Sequence: Synthetic oligonucleotide
  Target: ATXN1; (-) strand; PAM type: NRG; PAM sequence: TAG
tgttaatgccctctagtggc

SEQ ID NO: 65861 - DNA, 20 bp, Artificial Sequence
  Description of Artificial Sequence: Synthetic oligonucleotide
  Target: ATXN1; (-) strand; PAM type: NRG; PAM sequence: TGG
cacatgttaatgccctctag

SEQ ID NO: 65862 - DNA, 20 bp, Artificial Sequence
  Description of Artificial Sequence: Synthetic oligonucleotide
  Target: ATXN1; (-) strand; PAM type: NRG; PAM sequence: TAG
attcacatgttaatgccctc

SEQ ID NO: 65863 - DNA, 20 bp, Artificial Sequence
  Description of Artificial Sequence: Synthetic oligonucleotide
  Target: ATXN1; (-) strand; PAM type: NRG; PAM sequence: AGG
ctgtttgaatcctggaaatc

SEQ ID NO: 65864 - DNA, 20 bp, Artificial Sequence
  Description of Artificial Sequence: Synthetic oligonucleotide
  Target: ATXN1; (-) strand; PAM type: NRG; PAM sequence: CAG
gctgtttgaatcctggaaat

SEQ ID NO: 65865 - DNA, 20 bp, Artificial Sequence
  Description of Artificial Sequence: Synthetic oligonucleotide
  Target: ATXN1; (-) strand; PAM type: NRG; PAM sequence: TGG
ggtgtctgctgtttgaatcc

SEQ ID NO: 65866 - DNA, 20 bp, Artificial Sequence
  Description of Artificial Sequence: Synthetic oligonucleotide
  Target: ATXN1; (-) strand; PAM type: NRG; PAM sequence: TGG
gccccattaattcccatgca

SEQ ID NO: 65867 - DNA, 20 bp, Artificial Sequence
  Description of Artificial Sequence: Synthetic oligonucleotide
  Target: ATXN1; (-) strand; PAM type: NRG; PAM sequence: GAG
gggaaaggaagagtgaagca

SEQ ID NO: 65868 - DNA, 20 bp, Artificial Sequence
  Description of Artificial Sequence: Synthetic oligonucleotide
  Target: ATXN1; (-) strand; PAM type: NRG; PAM sequence: CAG
aagggaaaggaagagtgaag

SEQ ID NO: 65869 - DNA, 20 bp, Artificial Sequence
  Description of Artificial Sequence: Synthetic oligonucleotide
  Target: ATXN1; (-) strand; PAM type: NRG; PAM sequence: AAG
ataaagggaaaggaagagtg

SEQ ID NO: 65870 - DNA, 20 bp, Artificial Sequence
  Description of Artificial Sequence: Synthetic oligonucleotide
  Target: ATXN1; (-) strand; PAM type: NRG; PAM sequence: GAG
catttataaagggaaaggaa

SEQ ID NO: 65871 - DNA, 20 bp, Artificial Sequence
  Description of Artificial Sequence: Synthetic oligonucleotide
  Target: ATXN1; (-) strand; PAM type: NRG; PAM sequence: AAG
gacatttataaagggaaagg

SEQ ID NO: 65872 - DNA, 20 bp, Artificial Sequence
  Description of Artificial Sequence: Synthetic oligonucleotide
  Target: ATXN1; (-) strand; PAM type: NRG; PAM sequence: AGG
ctggacatttataaagggaa

SEQ ID NO: 65873 - DNA, 20 bp, Artificial Sequence
  Description of Artificial Sequence: Synthetic oligonucleotide
  Target: ATXN1; (-) strand; PAM type: NRG; PAM sequence: AAG
tctggacatttataaaggga

SEQ ID NO: 65874 - DNA, 20 bp, Artificial Sequence
  Description of Artificial Sequence: Synthetic oligonucleotide
  Target: ATXN1; (-) strand; PAM type: NRG; PAM sequence: GGG
gctctctggacatttataaa

SEQ ID NO: 65875 - DNA, 20 bp, Artificial Sequence
  Description of Artificial Sequence: Synthetic oligonucleotide
  Target: ATXN1; (-) strand; PAM type: NRG; PAM sequence: AGG
agctctctggacatttataa

SEQ ID NO: 65876 - DNA, 20 bp, Artificial Sequence
  Description of Artificial Sequence: Synthetic oligonucleotide
  Target: ATXN1; (-) strand; PAM type: NRG; PAM sequence: AAG
tagctctctggacatttata

SEQ ID NO: 65877 - DNA, 20 bp, Artificial Sequence
  Description of Artificial Sequence: Synthetic oligonucleotide
  Target: ATXN1; (-) strand; PAM type: NRG; PAM sequence: TGG
ctttgcagttgttagctctc

SEQ ID NO: 65878 - DNA, 20 bp, Artificial Sequence
  Description of Artificial Sequence: Synthetic oligonucleotide
  Target: ATXN1; (-) strand; PAM type: NRG; PAM sequence: TAG
ttccacatctttgcagttgt

SEQ ID NO: 65879 - DNA, 20 bp, Artificial Sequence
  Description of Artificial Sequence: Synthetic oligonucleotide
  Target: ATXN1; (-) strand; PAM type: NRG; PAM sequence: CAG
gatatacttccacatctttg

SEQ ID NO: 65880 - DNA, 20 bp, Artificial Sequence
  Description of Artificial Sequence: Synthetic oligonucleotide
  Target: ATXN1; (-) strand; PAM type: NRG; PAM sequence: TAG
gttaaaacataaaaagagtt

SEQ ID NO: 65881 - DNA, 20 bp, Artificial Sequence
  Description of Artificial Sequence: Synthetic oligonucleotide
  Target: ATXN1; (-) strand; PAM type: NRG; PAM sequence: GAG
attgtgttaaaacataaaaa

SEQ ID NO: 65882 - DNA, 20 bp, Artificial Sequence
  Description of Artificial Sequence: Synthetic oligonucleotide
  Target: ATXN1; (-) strand; PAM type: NRG; PAM sequence: AAG
ctattgtgttaaaacataaa

SEQ ID NO: 65883 - DNA, 20 bp, Artificial Sequence
  Description of Artificial Sequence: Synthetic oligonucleotide
  Target: ATXN1; (-) strand; PAM type: NRG; PAM sequence: AAG
tcctggagctagcatggctc

SEQ ID NO: 65884 - DNA, 20 bp, Artificial Sequence
  Description of Artificial Sequence: Synthetic oligonucleotide
  Target: ATXN1; (-) strand; PAM type: NRG; PAM sequence: TGG
tcctagtcctggagctagca

SEQ ID NO: 65885 - DNA, 20 bp, Artificial Sequence
  Description of Artificial Sequence: Synthetic oligonucleotide
  Target: ATXN1; (-) strand; PAM type: NRG; PAM sequence: TAG
gtcaatcctagtcctggagc

SEQ ID NO: 65886 - DNA, 20 bp, Artificial Sequence
  Description of Artificial Sequence: Synthetic oligonucleotide
  Target: ATXN1; (-) strand; PAM type: NRG; PAM sequence: GAG
atatgtcaatcctagtcctg

SEQ ID NO: 65887 - DNA, 20 bp, Artificial Sequence
  Description of Artificial Sequence: Synthetic oligonucleotide
  Target: ATXN1; (-) strand; PAM type: NRG; PAM sequence: TGG
acatatgtcaatcctagtcc

SEQ ID NO: 65888 - DNA, 20 bp, Artificial Sequence
  Description of Artificial Sequence: Synthetic oligonucleotide
  Target: ATXN1; (-) strand; PAM type: NRG; PAM sequence: TAG
aaggaaacatatgtcaatcc

SEQ ID NO: 65889 - DNA, 20 bp, Artificial Sequence
  Description of Artificial Sequence: Synthetic oligonucleotide
  Target: ATXN1; (-) strand; PAM type: NRG; PAM sequence: AGG
atggaaatcgggcaccctga

SEQ ID NO: 65890 - DNA, 20 bp, Artificial Sequence
  Description of Artificial Sequence: Synthetic oligonucleotide
  Target: ATXN1; (-) strand; PAM type: NRG; PAM sequence: AAG
aatggaaatcgggcaccctg

SEQ ID NO: 65891 - DNA, 20 bp, Artificial Sequence
  Description of Artificial Sequence: Synthetic oligonucleotide
  Target: ATXN1; (-) strand; PAM type: NRG; PAM sequence: GGG
acttctgaagaatggaaatc

SEQ ID NO: 65892 - DNA, 20 bp, Artificial Sequence
  Description of Artificial Sequence: Synthetic oligonucleotide
  Target: ATXN1; (-) strand; PAM type: NRG; PAM sequence: CGG
gacttctgaagaatggaaat

SEQ ID NO: 65893 - DNA, 20 bp, Artificial Sequence
  Description of Artificial Sequence: Synthetic oligonucleotide
  Target: ATXN1; (-) strand; PAM type: NRG; PAM sequence: TGG
ggttgtggacttctgaagaa

SEQ ID NO: 65894 - DNA, 20 bp, Artificial Sequence
  Description of Artificial Sequence: Synthetic oligonucleotide
  Target: ATXN1; (-) strand; PAM type: NRG; PAM sequence: AAG
cagaaggttgtggacttctg

SEQ ID NO: 65895 - DNA, 20 bp, Artificial Sequence
  Description of Artificial Sequence: Synthetic oligonucleotide
  Target: ATXN1; (-) strand; PAM type: NRG; PAM sequence: TGG
ctctgttattcagaaggttg

SEQ ID NO: 65896 - DNA, 20 bp, Artificial Sequence
  Description of Artificial Sequence: Synthetic oligonucleotide
  Target: ATXN1; (-) strand; PAM type: NRG; PAM sequence: AGG
aaagacctctgttattcaga

SEQ ID NO: 65897 - DNA, 20 bp, Artificial Sequence
  Description of Artificial Sequence: Synthetic oligonucleotide
  Target: ATXN1; (-) strand; PAM type: NRG; PAM sequence: AAG
aaaagacctctgttattcag

SEQ ID NO: 65898 - DNA, 20 bp, Artificial Sequence
  Description of Artificial Sequence: Synthetic oligonucleotide
  Target: ATXN1; (-) strand; PAM type: NRG; PAM sequence: CAG
gagaaaagacctctgttatt

SEQ ID NO: 65899 - DNA, 20 bp, Artificial Sequence
  Description of Artificial Sequence: Synthetic oligonucleotide
  Target: ATXN1; (-) strand; PAM type: NRG; PAM sequence: AAG
aggttgattctgagggagaa

SEQ ID NO: 65900 - DNA, 20 bp, Artificial Sequence
  Description of Artificial Sequence: Synthetic oligonucleotide
  Target: ATXN1; (-) strand; PAM type: NRG; PAM sequence: GAG
ttgctaggttgattctgagg

SEQ ID NO: 65901 - DNA, 20 bp, Artificial Sequence
  Description of Artificial Sequence: Synthetic oligonucleotide
  Target: ATXN1; (-) strand; PAM type: NRG; PAM sequence: GGG
tgttgctaggttgattctga

SEQ ID NO: 65902 - DNA, 20 bp, Artificial Sequence
  Description of Artificial Sequence: Synthetic oligonucleotide
  Target: ATXN1; (-) strand; PAM type: NRG; PAM sequence: AGG
ttgttgctaggttgattctg

SEQ ID NO: 65903 - DNA, 20 bp, Artificial Sequence
  Description of Artificial Sequence: Synthetic oligonucleotide
  Target: ATXN1; (-) strand; PAM type: NRG; PAM sequence: GAG
cttgttgctaggttgattct

SEQ ID NO: 65904 - DNA, 20 bp, Artificial Sequence
  Description of Artificial Sequence: Synthetic oligonucleotide
  Target: ATXN1; (-) strand; PAM type: NRG; PAM sequence: AGG
gaggtttcggacttgttgct

SEQ ID NO: 65905 - DNA, 20 bp, Artificial Sequence
  Description of Artificial Sequence: Synthetic oligonucleotide
  Target: ATXN1; (-) strand; PAM type: NRG; PAM sequence: TAG
ggaggtttcggacttgttgc

SEQ ID NO: 65906 - DNA, 20 bp, Artificial Sequence
  Description of Artificial Sequence: Synthetic oligonucleotide
  Target: ATXN1; (-) strand; PAM type: NRG; PAM sequence: CGG
tgagaagtttttggaggttt

SEQ ID NO: 65907 - DNA, 20 bp, Artificial Sequence
  Description of Artificial Sequence: Synthetic oligonucleotide
  Target: ATXN1; (-) strand; PAM type: NRG; PAM sequence: AGG
caggtatgagaagtttttgg

SEQ ID NO: 65908 - DNA, 20 bp, Artificial Sequence
  Description of Artificial Sequence: Synthetic oligonucleotide
  Target: ATXN1; (-) strand; PAM type: NRG; PAM sequence: GAG
acaggtatgagaagtttttg

SEQ ID NO: 65909 - DNA, 20 bp, Artificial Sequence
  Description of Artificial Sequence: Synthetic oligonucleotide
  Target: ATXN1; (-) strand; PAM type: NRG; PAM sequence: TGG
ttacaggtatgagaagtttt

SEQ ID NO: 65910 - DNA, 20 bp, Artificial Sequence
  Description of Artificial Sequence: Synthetic oligonucleotide
  Target: ATXN1; (-) strand; PAM type: NRG; PAM sequence: AAG
gctaggattacaggtatgag

SEQ ID NO: 65911 - DNA, 20 bp, Artificial Sequence
  Description of Artificial Sequence: Synthetic oligonucleotide
  Target: ATXN1; (-) strand; PAM type: NRG; PAM sequence: GAG
agtgctaggattacaggtat

SEQ ID NO: 65912 - DNA, 20 bp, Artificial Sequence
  Description of Artificial Sequence: Synthetic oligonucleotide
  Target: ATXN1; (-) strand; PAM type: NRG; PAM sequence: AGG
tcccaaagtgctaggattac

SEQ ID NO: 65913 - DNA, 20 bp, Artificial Sequence
  Description of Artificial Sequence: Synthetic oligonucleotide
  Target: ATXN1; (-) strand; PAM type: NRG; PAM sequence: CAG
ttcccaaagtgctaggatta

SEQ ID NO: 65914 - DNA, 20 bp, Artificial Sequence
  Description of Artificial Sequence: Synthetic oligonucleotide
  Target: ATXN1; (-) strand; PAM type: NRG; PAM sequence: AGG
ctttggcttcccaaagtgct

SEQ ID NO: 65915 - DNA, 20 bp, Artificial Sequence
  Description of Artificial Sequence: Synthetic oligonucleotide
  Target: ATXN1; (-) strand; PAM type: NRG; PAM sequence: TAG
actttggcttcccaaagtgc

SEQ ID NO: 65916 - DNA, 20 bp, Artificial Sequence
  Description of Artificial Sequence: Synthetic oligonucleotide
  Target: ATXN1; (-) strand; PAM type: NRG; PAM sequence: AAG
cctctcactttggcttccca

SEQ ID NO: 65917 - DNA, 20 bp, Artificial Sequence
  Description of Artificial Sequence: Synthetic oligonucleotide
  Target: ATXN1; (-) strand; PAM type: NRG; PAM sequence: TGG
ctcaagcaatcctctcactt

SEQ ID NO: 65918 - DNA, 20 bp, Artificial Sequence
  Description of Artificial Sequence: Synthetic oligonucleotide
  Target: ATXN1; (-) strand; PAM type: NRG; PAM sequence: AAG
ggtcttgaattcctgggctc

SEQ ID NO: 65919 - DNA, 20 bp, Artificial Sequence
  Description of Artificial Sequence: Synthetic oligonucleotide
  Target: ATXN1; (-) strand; PAM type: NRG; PAM sequence: GGG
atggctggtcttgaattcct

SEQ ID NO: 65920 - DNA, 20 bp, Artificial Sequence
  Description of Artificial Sequence: Synthetic oligonucleotide
  Target: ATXN1; (-) strand; PAM type: NRG; PAM sequence: TGG
catggctggtcttgaattcc

SEQ ID NO: 65921 - DNA, 20 bp, Artificial Sequence
  Description of Artificial Sequence: Synthetic oligonucleotide
  Target: ATXN1; (-) strand; PAM type: NRG; PAM sequence: TGG
ggaagttttggagacatggc

SEQ ID NO: 65922 - DNA, 20 bp, Artificial Sequence
  Description of Artificial Sequence: Synthetic oligonucleotide
  Target: ATXN1; (-) strand; PAM type: NRG; PAM sequence: TGG
ttttggaagttttggagaca

SEQ ID NO: 65923 - DNA, 20 bp, Artificial Sequence
  Description of Artificial Sequence: Synthetic oligonucleotide
  Target: ATXN1; (-) strand; PAM type: NRG; PAM sequence: GAG
agaagtttttggaagttttg

SEQ ID NO: 65924 - DNA, 20 bp, Artificial Sequence
  Description of Artificial Sequence: Synthetic oligonucleotide
  Target: ATXN1; (-) strand; PAM type: NRG; PAM sequence: TGG
ggagaagtttttggaagttt

SEQ ID NO: 65925 - DNA, 20 bp, Artificial Sequence
  Description of Artificial Sequence: Synthetic oligonucleotide
  Target: ATXN1; (-) strand; PAM type: NRG; PAM sequence: AAG
caggctggagaagtttttgg

SEQ ID NO: 65926 - DNA, 20 bp, Artificial Sequence
  Description of Artificial Sequence: Synthetic oligonucleotide
  Target: ATXN1; (-) strand; PAM type: NRG; PAM sequence: TGG
aagcaggctggagaagtttt

SEQ ID NO: 65927 - DNA, 20 bp, Artificial Sequence
  Description of Artificial Sequence: Synthetic oligonucleotide
  Target: ATXN1; (-) strand; PAM type: NRG; PAM sequence: AAG
ttttagcaagcaggctggag

SEQ ID NO: 65928 - DNA, 20 bp, Artificial Sequence
  Description of Artificial Sequence: Synthetic oligonucleotide
  Target: ATXN1; (-) strand; PAM type: NRG; PAM sequence: GAG
aatttttagcaagcaggctg

SEQ ID NO: 65929 - DNA, 20 bp, Artificial Sequence
  Description of Artificial Sequence: Synthetic oligonucleotide
  Target: ATXN1; (-) strand; PAM type: NRG; PAM sequence: TGG
tgaatttttagcaagcaggc

SEQ ID NO: 65930 - DNA, 20 bp, Artificial Sequence
  Description of Artificial Sequence: Synthetic oligonucleotide
  Target: ATXN1; (-) strand; PAM type: NRG; PAM sequence: AGG
aacttgaatttttagcaagc

SEQ ID NO: 65931 - DNA, 20 bp, Artificial Sequence
  Description of Artificial Sequence: Synthetic oligonucleotide
  Target: ATXN1; (-) strand; PAM type: NRG; PAM sequence: CAG
caacttgaatttttagcaag

SEQ ID NO: 65932 - DNA, 20 bp, Artificial Sequence
  Description of Artificial Sequence: Synthetic oligonucleotide
  Target: ATXN1; (-) strand; PAM type: NRG; PAM sequence: AAG
tatcaacttgaatttttagc

SEQ ID NO: 65933 - DNA, 20 bp, Artificial Sequence
  Description of Artificial Sequence: Synthetic oligonucleotide
  Target: ATXN1; (-) strand; PAM type: NRG; PAM sequence: TAG
ggactatcaacttgaatttt

SEQ ID NO: 65934 - DNA, 20 bp, Artificial Sequence
  Description of Artificial Sequence: Synthetic oligonucleotide
  Target: ATXN1; (-) strand; PAM type: NRG; PAM sequence: TGG
aaatatccttttgcaatggg

SEQ ID NO: 65935 - DNA, 20 bp, Artificial Sequence
  Description of Artificial Sequence: Synthetic oligonucleotide
  Target: ATXN1; (-) strand; PAM type: NRG; PAM sequence: GGG
aggaaatatccttttgcaat

SEQ ID NO: 65936 - DNA, 20 bp, Artificial Sequence
  Description of Artificial Sequence: Synthetic oligonucleotide
  Target: ATXN1; (-) strand; PAM type: NRG; PAM sequence: TGG
aaggaaatatccttttgcaa

SEQ ID NO: 65937 - DNA, 20 bp, Artificial Sequence
  Description of Artificial Sequence: Synthetic oligonucleotide
  Target: ATXN1; (-) strand; PAM type: NRG; PAM sequence: AGG
atcttcctcctgcttcctga

SEQ ID NO: 65938 - DNA, 20 bp, Artificial Sequence
  Description of Artificial Sequence: Synthetic oligonucleotide
  Target: ATXN1; (-) strand; PAM type: NRG; PAM sequence: AAG
tatcttcctcctgcttcctg

SEQ ID NO: 65939 - DNA, 20 bp, Artificial Sequence
  Description of Artificial Sequence: Synthetic oligonucleotide
  Target: ATXN1; (-) strand; PAM type: NRG; PAM sequence: CAG
ctgttgtcttcagtcttccc

SEQ ID NO: 65940 - DNA, 20 bp, Artificial Sequence
  Description of Artificial Sequence: Synthetic oligonucleotide
  Target: ATXN1; (-) strand; PAM type: NRG; PAM sequence: CAG
gaactgaggactgttgtctt

SEQ ID NO: 65941 - DNA, 20 bp, Artificial Sequence
  Description of Artificial Sequence: Synthetic oligonucleotide
  Target: ATXN1; (-) strand; PAM type: NRG; PAM sequence: AGG
gctcattctcctcagaactg

SEQ ID NO: 65942 - DNA, 20 bp, Artificial Sequence
  Description of Artificial Sequence: Synthetic oligonucleotide
  Target: ATXN1; (-) strand; PAM type: NRG; PAM sequence: GAG
cgctcattctcctcagaact

SEQ ID NO: 65943 - DNA, 20 bp, Artificial Sequence
  Description of Artificial Sequence: Synthetic oligonucleotide
  Target: ATXN1; (-) strand; PAM type: NRG; PAM sequence: CAG
cacttcccgctcattctcct

SEQ ID NO: 65944 - DNA, 20 bp, Artificial Sequence
  Description of Artificial Sequence: Synthetic oligonucleotide
  Target: ATXN1; (-) strand; PAM type: NRG; PAM sequence: GGG
ctaaggcagggcggtggcct

SEQ ID NO: 65945 - DNA, 20 bp, Artificial Sequence
  Description of Artificial Sequence: Synthetic oligonucleotide
  Target: ATXN1; (-) strand; PAM type: NRG; PAM sequence: TGG
actaaggcagggcggtggcc

SEQ ID NO: 65946 - DNA, 20 bp, Artificial Sequence
  Description of Artificial Sequence: Synthetic oligonucleotide
  Target: ATXN1; (-) strand; PAM type: NRG; PAM sequence: TGG
cacccactaaggcagggcgg

SEQ ID NO: 65947 - DNA, 20 bp, Artificial Sequence
  Description of Artificial Sequence: Synthetic oligonucleotide
  Target: ATXN1; (-) strand; PAM type: NRG; PAM sequence: CGG
agacacccactaaggcaggg

SEQ ID NO: 65948 - DNA, 20 bp, Artificial Sequence
  Description of Artificial Sequence: Synthetic oligonucleotide
  Target: ATXN1; (-) strand; PAM type: NRG; PAM sequence: GGG
caaagacacccactaaggca

SEQ ID NO: 65949 - DNA, 20 bp, Artificial Sequence
  Description of Artificial Sequence: Synthetic oligonucleotide
  Target: ATXN1; (-) strand; PAM type: NRG; PAM sequence: AGG
gcaaagacacccactaaggc

SEQ ID NO: 65950 - DNA, 20 bp, Artificial Sequence
  Description of Artificial Sequence: Synthetic oligonucleotide
  Target: ATXN1; (-) strand; PAM type: NRG; PAM sequence: CAG
ggcaaagacacccactaagg

SEQ ID NO: 65951 - DNA, 20 bp, Artificial Sequence
  Description of Artificial Sequence: Synthetic oligonucleotide
  Target: ATXN1; (-) strand; PAM type: NRG; PAM sequence: AGG
cgtggcaaagacacccacta

SEQ ID NO: 65952 - DNA, 20 bp, Artificial Sequence
  Description of Artificial Sequence: Synthetic oligonucleotide
  Target: ATXN1; (-) strand; PAM type: NRG; PAM sequence: AAG
tcgtggcaaagacacccact

SEQ ID NO: 65953 - DNA, 20 bp, Artificial Sequence
  Description of Artificial Sequence: Synthetic oligonucleotide
  Target: ATXN1; (-) strand; PAM type: NRG; PAM sequence: AAG
tggaaggccacctcgtggca

SEQ ID NO: 65954 - DNA, 20 bp, Artificial Sequence
  Description of Artificial Sequence: Synthetic oligonucleotide
  Target: ATXN1; (-) strand; PAM type: NRG; PAM sequence: TGG
ctacctggaaggccacctcg

SEQ ID NO: 65955 - DNA, 20 bp, Artificial Sequence
  Description of Artificial Sequence: Synthetic oligonucleotide
  Target: ATXN1; (-) strand; PAM type: NRG; PAM sequence: AGG
aggaagccaagctacctgga

SEQ ID NO: 65956 - DNA, 20 bp, Artificial Sequence
  Description of Artificial Sequence: Synthetic oligonucleotide
  Target: ATXN1; (-) strand; PAM type: NRG; PAM sequence: AAG
aaggaagccaagctacctgg

SEQ ID NO: 65957 - DNA, 20 bp, Artificial Sequence
  Description of Artificial Sequence: Synthetic oligonucleotide
  Target: ATXN1; (-) strand; PAM type: NRG; PAM sequence: TGG
cagaaggaagccaagctacc

SEQ ID NO: 65958 - DNA, 20 bp, Artificial Sequence
  Description of Artificial Sequence: Synthetic oligonucleotide
  Target: ATXN1; (-) strand; PAM type: NRG; PAM sequence: AAG
cttaggtgcagaaggaagcc

SEQ ID NO: 65959 - DNA, 20 bp, Artificial Sequence
  Description of Artificial Sequence: Synthetic oligonucleotide
  Target: ATXN1; (-) strand; PAM type: NRG; PAM sequence: AAG
ataagcttaggtgcagaagg

SEQ ID NO: 65960 - DNA, 20 bp, Artificial Sequence
  Description of Artificial Sequence: Synthetic oligonucleotide
  Target: ATXN1; (-) strand; PAM type: NRG; PAM sequence: AGG
attataagcttaggtgcaga

SEQ ID NO: 65961 - DNA, 20 bp, Artificial Sequence
  Description of Artificial Sequence: Synthetic oligonucleotide
  Target: ATXN1; (-) strand; PAM type: NRG; PAM sequence: AAG
cattataagcttaggtgcag

SEQ ID NO: 65962 - DNA, 20 bp, Artificial Sequence
  Description of Artificial Sequence: Synthetic oligonucleotide
  Target: ATXN1; (-) strand; PAM type: NRG; PAM sequence: CAG
tgccattataagcttaggtg

SEQ ID NO: 65963 - DNA, 20 bp, Artificial Sequence
  Description of Artificial Sequence: Synthetic oligonucleotide
  Target: ATXN1; (-) strand; PAM type: NRG; PAM sequence: AGG
agtcttgccattataagctt

SEQ ID NO: 65964 - DNA, 20 bp, Artificial Sequence
  Description of Artificial Sequence: Synthetic oligonucleotide
  Target: ATXN1; (-) strand; PAM type: NRG; PAM sequence: TAG
tagtcttgccattataagct

SEQ ID NO: 65965 - DNA, 20 bp, Artificial Sequence
  Description of Artificial Sequence: Synthetic oligonucleotide
  Target: ATXN1; (-) strand; PAM type: NRG; PAM sequence: AAG
aaggttagtcttgccattat

SEQ ID NO: 65966 - DNA, 20 bp, Artificial Sequence
  Description of Artificial Sequence: Synthetic oligonucleotide
  Target: ATXN1; (-) strand; PAM type: NRG; PAM sequence: TAG
gggggctggagaggcaaggt

SEQ ID NO: 65967 - DNA, 20 bp, Artificial Sequence
  Description of Artificial Sequence: Synthetic oligonucleotide
  Target: ATXN1; (-) strand; PAM type: NRG; PAM sequence: AGG
agatgggggctggagaggca

SEQ ID NO: 65968 - DNA, 20 bp, Artificial Sequence
  Description of Artificial Sequence: Synthetic oligonucleotide
  Target: ATXN1; (-) strand; PAM type: NRG; PAM sequence: AAG
aagatgggggctggagaggc

SEQ ID NO: 65969 - DNA, 20 bp, Artificial Sequence
  Description of Artificial Sequence: Synthetic oligonucleotide
  Target: ATXN1; (-) strand; PAM type: NRG; PAM sequence: AGG
gagaaagatgggggctggag

SEQ ID NO: 65970 - DNA, 20 bp, Artificial Sequence
  Description of Artificial Sequence: Synthetic oligonucleotide
  Target: ATXN1; (-) strand; PAM type: NRG; PAM sequence: GAG
ggagaaagatgggggctgga

SEQ ID NO: 65971 - DNA, 20 bp, Artificial Sequence
  Description of Artificial Sequence: Synthetic oligonucleotide
  Target: ATXN1; (-) strand; PAM type: NRG; PAM sequence: GAG
gaggagaaagatgggggctg

SEQ ID NO: 65972 - DNA, 20 bp, Artificial Sequence
  Description of Artificial Sequence: Synthetic oligonucleotide
  Target: ATXN1; (-) strand; PAM type: NRG; PAM sequence: TGG
ttgaggagaaagatgggggc

SEQ ID NO: 65973 - DNA, 20 bp, Artificial Sequence
  Description of Artificial Sequence: Synthetic oligonucleotide
  Target: ATXN1; (-) strand; PAM type: NRG; PAM sequence: GGG
ccgtttgaggagaaagatgg

SEQ ID NO: 65974 - DNA, 20 bp, Artificial Sequence
  Description of Artificial Sequence: Synthetic oligonucleotide
  Target: ATXN1; (-) strand; PAM type: NRG; PAM sequence: GGG
accgtttgaggagaaagatg

SEQ ID NO: 65975 - DNA, 20 bp, Artificial Sequence
  Description of Artificial Sequence: Synthetic oligonucleotide
  Target: ATXN1; (-) strand; PAM type: NRG; PAM sequence: GGG
gaccgtttgaggagaaagat

SEQ ID NO: 65976 - DNA, 20 bp, Artificial Sequence
  Description of Artificial Sequence: Synthetic oligonucleotide
  Target: ATXN1; (-) strand; PAM type: NRG; PAM sequence: TGG
ggaccgtttgaggagaaaga

SEQ ID NO: 65977 - DNA, 20 bp, Artificial Sequence
  Description of Artificial Sequence: Synthetic oligonucleotide
  Target: ATXN1; (-) strand; PAM type: NRG; PAM sequence: AAG
agagggaccgtttgaggaga

SEQ ID NO: 65978 - DNA, 20 bp, Artificial Sequence
  Description of Artificial Sequence: Synthetic oligonucleotide
  Target: ATXN1; (-) strand; PAM type: NRG; PAM sequence: GAG
gattagagggaccgtttgag

SEQ ID NO: 65979 - DNA, 20 bp, Artificial Sequence
  Description of Artificial Sequence: Synthetic oligonucleotide
  Target: ATXN1; (-) strand; PAM type: NRG; PAM sequence: AGG
aagattagagggaccgtttg

SEQ ID NO: 65980 - DNA, 20 bp, Artificial Sequence
  Description of Artificial Sequence: Synthetic oligonucleotide
  Target: ATXN1; (-) strand; PAM type: NRG; PAM sequence: GAG
aaagattagagggaccgttt

SEQ ID NO: 65981 - DNA, 20 bp, Artificial Sequence
  Description of Artificial Sequence: Synthetic oligonucleotide
  Target: ATXN1; (-) strand; PAM type: NRG; PAM sequence: GGG
gagtatgtacaaagattaga

SEQ ID NO: 65982 - DNA, 20 bp, Artificial Sequence
  Description of Artificial Sequence: Synthetic oligonucleotide
  Target: ATXN1; (-) strand; PAM type: NRG; PAM sequence: AGG
tgagtatgtacaaagattag

SEQ ID NO: 65983 - DNA, 20 bp, Artificial Sequence
  Description of Artificial Sequence: Synthetic oligonucleotide
  Target: ATXN1; (-) strand; PAM type: NRG; PAM sequence: GAG
atgagtatgtacaaagatta

SEQ ID NO: 65984 - DNA, 20 bp, Artificial Sequence
  Description of Artificial Sequence: Synthetic oligonucleotide
  Target: ATXN1; (-) strand; PAM type: NRG; PAM sequence: TAG
ccatgagtatgtacaaagat

SEQ ID NO: 65985 - DNA, 20 bp, Artificial Sequence
  Description of Artificial Sequence: Synthetic oligonucleotide
  Target: ATXN1; (-) strand; PAM type: NRG; PAM sequence: AAG
tgaacccatgagtatgtaca

SEQ ID NO: 65986 - DNA, 20 bp, Artificial Sequence
  Description of Artificial Sequence: Synthetic oligonucleotide
  Target: ATXN1; (-) strand; PAM type: NRG; PAM sequence: GAG
tgcctggtaattgaacccat

SEQ ID NO: 65987 - DNA, 20 bp, Artificial Sequence
  Description of Artificial Sequence: Synthetic oligonucleotide
  Target: ATXN1; (-) strand; PAM type: NRG; PAM sequence: TGG
ctgcctcagggcatcctgcc

SEQ ID NO: 65988 - DNA, 20 bp, Artificial Sequence
  Description of Artificial Sequence: Synthetic oligonucleotide
  Target: ATXN1; (-) strand; PAM type: NRG; PAM sequence: GGG
actaacacctggctgcctca

SEQ ID NO: 65989 - DNA, 20 bp, Artificial Sequence
  Description of Artificial Sequence: Synthetic oligonucleotide
  Target: ATXN1; (-) strand; PAM type: NRG; PAM sequence: AGG
aactaacacctggctgcctc

SEQ ID NO: 65990 - DNA, 20 bp, Artificial Sequence
  Description of Artificial Sequence: Synthetic oligonucleotide
  Target: ATXN1; (-) strand; PAM type: NRG; PAM sequence: CAG
caactaacacctggctgcct

SEQ ID NO: 65991 - DNA, 20 bp, Artificial Sequence
  Description of Artificial Sequence: Synthetic oligonucleotide
  Target: ATXN1; (-) strand; PAM type: NRG; PAM sequence: TGG
ttctgttgccaactaacacc

SEQ ID NO: 65992 - DNA, 20 bp, Artificial Sequence
  Description of Artificial Sequence: Synthetic oligonucleotide
  Target: ATXN1; (-) strand; PAM type: NRG; PAM sequence: AGG
gacgctgaatggaggcgggg

SEQ ID NO: 65993 - DNA, 20 bp, Artificial Sequence
  Description of Artificial Sequence: Synthetic oligonucleotide
  Target: ATXN1; (-) strand; PAM type: NRG; PAM sequence: GAG
tgacgctgaatggaggcggg

SEQ ID NO: 65994 - DNA, 20 bp, Artificial Sequence
  Description of Artificial Sequence: Synthetic oligonucleotide
  Target: ATXN1; (-) strand; PAM type: NRG; PAM sequence: GGG
cctgacgctgaatggaggcg

SEQ ID NO: 65995 - DNA, 20 bp, Artificial Sequence
  Description of Artificial Sequence: Synthetic oligonucleotide
  Target: ATXN1; (-) strand; PAM type: NRG; PAM sequence: GGG
ccctgacgctgaatggaggc

SEQ ID NO: 65996 - DNA, 20 bp, Artificial Sequence
  Description of Artificial Sequence: Synthetic oligonucleotide
  Target: ATXN1; (-) strand; PAM type: NRG; PAM sequence: CGG
accctgacgctgaatggagg

SEQ ID NO: 65997 - DNA, 20 bp, Artificial Sequence
  Description of Artificial Sequence: Synthetic oligonucleotide
  Target: ATXN1; (-) strand; PAM type: NRG; PAM sequence: AGG
atcaccctgacgctgaatgg

SEQ ID NO: 65998 - DNA, 20 bp, Artificial Sequence
  Description of Artificial Sequence: Synthetic oligonucleotide
  Target: ATXN1; (-) strand; PAM type: NRG; PAM sequence: GAG
tatcaccctgacgctgaatg

SEQ ID NO: 65999 - DNA, 20 bp, Artificial Sequence
  Description of Artificial Sequence: Synthetic oligonucleotide
  Target: ATXN1; (-) strand; PAM type: NRG; PAM sequence: TGG
tttatcaccctgacgctgaa

SEQ ID NO: 66000 - DNA, 20 bp, Artificial Sequence
  Description of Artificial Sequence: Synthetic oligonucleotide
  Target: ATXN1; (-) strand; PAM type: NRG; PAM sequence: GGG
ttctgaggagctggctttga

SEQ ID NO: 66001 - DNA, 20 bp, Artificial Sequence
  Description of Artificial Sequence: Synthetic oligonucleotide
  Target: ATXN1; (-) strand; PAM type: NRG; PAM sequence: AGG
cttctgaggagctggctttg

SEQ ID NO: 66002 - DNA, 20 bp, Artificial Sequence
  Description of Artificial Sequence: Synthetic oligonucleotide
  Target: ATXN1; (-) strand; PAM type: NRG; PAM sequence: GAG
acttctgaggagctggcttt

SEQ ID NO: 66003 - DNA, 20 bp, Artificial Sequence
  Description of Artificial Sequence: Synthetic oligonucleotide
  Target: ATXN1; (-) strand; PAM type: NRG; PAM sequence: TGG
tggcagaacttctgaggagc

SEQ ID NO: 66004 - DNA, 20 bp, Artificial Sequence
  Description of Artificial Sequence: Synthetic oligonucleotide
  Target: ATXN1; (-) strand; PAM type: NRG; PAM sequence: GAG
gtggtggcagaacttctgag

SEQ ID NO: 66005 - DNA, 20 bp, Artificial Sequence
  Description of Artificial Sequence: Synthetic oligonucleotide
  Target: ATXN1; (-) strand; PAM type: NRG; PAM sequence: AGG
ccgtggtggcagaacttctg

SEQ ID NO: 66006 - DNA, 20 bp, Artificial Sequence
  Description of Artificial Sequence: Synthetic oligonucleotide
  Target: ATXN1; (-) strand; PAM type: NRG; PAM sequence: GAG
gccgtggtggcagaacttct

SEQ ID NO: 66007 - DNA, 20 bp, Artificial Sequence
  Description of Artificial Sequence: Synthetic oligonucleotide
  Target: ATXN1; (-) strand; PAM type: NRG; PAM sequence: CAG
tttcatatctgccgtggtgg

SEQ ID NO: 66008 - DNA, 20 bp, Artificial Sequence
  Description of Artificial Sequence: Synthetic oligonucleotide
  Target: ATXN1; (-) strand; PAM type: NRG; PAM sequence: TGG
gcctttcatatctgccgtgg

SEQ ID NO: 66009 - DNA, 20 bp, Artificial Sequence
  Description of Artificial Sequence: Synthetic oligonucleotide
  Target: ATXN1; (-) strand; PAM type: NRG; PAM sequence: TGG
aaagcctttcatatctgccg

SEQ ID NO: 66010 - DNA, 20 bp, Artificial Sequence
  Description of Artificial Sequence: Synthetic oligonucleotide
  Target: ATXN1; (-) strand; PAM type: NRG; PAM sequence: AAG
tgtatgaaaactatgtggta

SEQ ID NO: 66011 - DNA, 20 bp, Artificial Sequence
  Description of Artificial Sequence: Synthetic oligonucleotide
  Target: ATXN1; (-) strand; PAM type: NRG; PAM sequence: TGG
aactgtgtatgaaaactatg

SEQ ID NO: 66012 - DNA, 20 bp, Artificial Sequence
  Description of Artificial Sequence: Synthetic oligonucleotide
  Target: ATXN1; (-) strand; PAM type: NRG; PAM sequence: AAG
aatggtgctttctgaggaag

SEQ ID NO: 66013 - DNA, 20 bp, Artificial Sequence
  Description of Artificial Sequence: Synthetic oligonucleotide
  Target: ATXN1; (-) strand; PAM type: NRG; PAM sequence: AAG
acaaatggtgctttctgagg

SEQ ID NO: 66014 - DNA, 20 bp, Artificial Sequence
  Description of Artificial Sequence: Synthetic oligonucleotide
  Target: ATXN1; (-) strand; PAM type: NRG; PAM sequence: AGG
caaacaaatggtgctttctg

SEQ ID NO: 66015 - DNA, 20 bp, Artificial Sequence
  Description of Artificial Sequence: Synthetic oligonucleotide
  Target: ATXN1; (-) strand; PAM type: NRG; PAM sequence: GAG
tcaaacaaatggtgctttct

SEQ ID NO: 66016 - DNA, 20 bp, Artificial Sequence
  Description of Artificial Sequence: Synthetic oligonucleotide
  Target: ATXN1; (-) strand; PAM type: NRG; PAM sequence: TGG
tttacggatactcaaacaaa

SEQ ID NO: 66017 - DNA, 20 bp, Artificial Sequence
  Description of Artificial Sequence: Synthetic oligonucleotide
  Target: ATXN1; (-) strand; PAM type: NRG; PAM sequence: CGG
tcttctgtaggagttattta

SEQ ID NO: 66018 - DNA, 20 bp, Artificial Sequence
  Description of Artificial Sequence: Synthetic oligonucleotide
  Target: ATXN1; (-) strand; PAM type: NRG; PAM sequence: GAG
gcaaattgtgtcttctgtag

SEQ ID NO: 66019 - DNA, 20 bp, Artificial Sequence
  Description of Artificial Sequence: Synthetic oligonucleotide
  Target: ATXN1; (-) strand; PAM type: NRG; PAM sequence: AGG
gagcaaattgtgtcttctgt

SEQ ID NO: 66020 - DNA, 20 bp, Artificial Sequence
  Description of Artificial Sequence: Synthetic oligonucleotide
  Target: ATXN1; (-) strand; PAM type: NRG; PAM sequence: TAG
agagcaaattgtgtcttctg

SEQ ID NO: 66021 - DNA, 20 bp, Artificial Sequence
  Description of Artificial Sequence: Synthetic oligonucleotide
  Target: ATXN1; (-) strand; PAM type: NRG; PAM sequence: GAG
tccatagctccaaaacatta

SEQ ID NO: 66022 - DNA, 20 bp, Artificial Sequence
  Description of Artificial Sequence: Synthetic oligonucleotide
  Target: ATXN1; (-) strand; PAM type: NRG; PAM sequence: TAG
attccatagctccaaaacat

SEQ ID NO: 66023 - DNA, 20 bp, Artificial Sequence
  Description of Artificial Sequence: Synthetic oligonucleotide
  Target: ATXN1; (-) strand; PAM type: NRG; PAM sequence: TAG
tgtgatcataataaattcca

SEQ ID NO: 66024 - DNA, 20 bp, Artificial Sequence
  Description of Artificial Sequence: Synthetic oligonucleotide
  Target: ATXN1; (-) strand; PAM type: NRG; PAM sequence: TGG
tttcacattcagctatttcc

SEQ ID NO: 66025 - DNA, 20 bp, Artificial Sequence
  Description of Artificial Sequence: Synthetic oligonucleotide
  Target: ATXN1; (-) strand; PAM type: NRG; PAM sequence: CAG
gatgttcctgttttcacatt

SEQ ID NO: 66026 - DNA, 20 bp, Artificial Sequence
  Description of Artificial Sequence: Synthetic oligonucleotide
  Target: ATXN1; (-) strand; PAM type: NRG; PAM sequence: GAG
ttagagctgaggggtgattt

SEQ ID NO: 66027 - DNA, 20 bp, Artificial Sequence
  Description of Artificial Sequence: Synthetic oligonucleotide
  Target: ATXN1; (-) strand; PAM type: NRG; PAM sequence: GGG
ttactcttcttagagctgag

SEQ ID NO: 66028 - DNA, 20 bp, Artificial Sequence
  Description of Artificial Sequence: Synthetic oligonucleotide
  Target: ATXN1; (-) strand; PAM type: NRG; PAM sequence: GGG
gttactcttcttagagctga

SEQ ID NO: 66029 - DNA, 20 bp, Artificial Sequence
  Description of Artificial Sequence: Synthetic oligonucleotide
  Target: ATXN1; (-) strand; PAM type: NRG; PAM sequence: AGG
cgttactcttcttagagctg

SEQ ID NO: 66030 - DNA, 20 bp, Artificial Sequence
  Description of Artificial Sequence: Synthetic oligonucleotide
  Target: ATXN1; (-) strand; PAM type: NRG; PAM sequence: GAG
gcgttactcttcttagagct

SEQ ID NO: 66031 - DNA, 20 bp, Artificial Sequence
  Description of Artificial Sequence: Synthetic oligonucleotide
  Target: ATXN1; (-) strand; PAM type: NRG; PAM sequence: GAG
gaaatgcgttactcttctta

SEQ ID NO: 66032 - DNA, 20 bp, Artificial Sequence
  Description of Artificial Sequence: Synthetic oligonucleotide
  Target: ATXN1; (-) strand; PAM type: NRG; PAM sequence: TAG
ttgaaatgcgttactcttct

SEQ ID NO: 66033 - DNA, 20 bp, Artificial Sequence
  Description of Artificial Sequence: Synthetic oligonucleotide
  Target: ATXN1; (-) strand; PAM type: NRG; PAM sequence: CAG
ttgagagagaacagtaaaca

SEQ ID NO: 66034 - DNA, 20 bp, Artificial Sequence
  Description of Artificial Sequence: Synthetic oligonucleotide
  Target: ATXN1; (-) strand; PAM type: NRG; PAM sequence: CAG
ggcccctcattgagagagaa

SEQ ID NO: 66035 - DNA, 20 bp, Artificial Sequence
  Description of Artificial Sequence: Synthetic oligonucleotide
  Target: ATXN1; (-) strand; PAM type: NRG; PAM sequence: GAG
gtgcaggcccctcattgaga

SEQ ID NO: 66036 - DNA, 20 bp, Artificial Sequence
  Description of Artificial Sequence: Synthetic oligonucleotide
  Target: ATXN1; (-) strand; PAM type: NRG; PAM sequence: GAG
gagtgcaggcccctcattga

SEQ ID NO: 66037 - DNA, 20 bp, Artificial Sequence
  Description of Artificial Sequence: Synthetic oligonucleotide
  Target: ATXN1; (-) strand; PAM type: NRG; PAM sequence: GAG
gggagtgcaggcccctcatt

SEQ ID NO: 66038 - DNA, 20 bp, Artificial Sequence
  Description of Artificial Sequence: Synthetic oligonucleotide
  Target: ATXN1; (-) strand; PAM type: NRG; PAM sequence: AGG
tgacactgtcctgggagtgc

SEQ ID NO: 66039 - DNA, 20 bp, Artificial Sequence
  Description of Artificial Sequence: Synthetic oligonucleotide
  Target: ATXN1; (-) strand; PAM type: NRG; PAM sequence: CAG
ctgacactgtcctgggagtg

SEQ ID NO: 66040 - DNA, 20 bp, Artificial Sequence
  Description of Artificial Sequence: Synthetic oligonucleotide
  Target: ATXN1; (-) strand; PAM type: NRG; PAM sequence: GAG
gtatgctgacactgtcctgg

SEQ ID NO: 66041 - DNA, 20 bp, Artificial Sequence
  Description of Artificial Sequence: Synthetic oligonucleotide
  Target: ATXN1; (-) strand; PAM type: NRG; PAM sequence: GGG
aagtatgctgacactgtcct

SEQ ID NO: 66042 - DNA, 20 bp, Artificial Sequence
  Description of Artificial Sequence: Synthetic oligonucleotide
  Target: ATXN1; (-) strand; PAM type: NRG; PAM sequence: TGG
taagtatgctgacactgtcc

SEQ ID NO: 66043 - DNA, 20 bp, Artificial Sequence
  Description of Artificial Sequence: Synthetic oligonucleotide
  Target: ATXN1; (-) strand; PAM type: NRG; PAM sequence: AAG
tatttagtatttgaaaagct

SEQ ID NO: 66044 - DNA, 20 bp, Artificial Sequence
  Description of Artificial Sequence: Synthetic oligonucleotide
  Target: ATXN1; (-) strand; PAM type: NRG; PAM sequence: AAG
gtttttatttagtatttgaa

SEQ ID NO: 66045 - DNA, 20 bp, Artificial Sequence
  Description of Artificial Sequence: Synthetic oligonucleotide
  Target: ATXN1; (-) strand; PAM type: NRG; PAM sequence: TAG
gagatgctgttgtttttatt

SEQ ID NO: 66046 - DNA, 20 bp, Artificial Sequence
  Description of Artificial Sequence: Synthetic oligonucleotide
  Target: ATXN1; (-) strand; PAM type: NRG; PAM sequence: GAG
ttataaatgcttagaacttg

SEQ ID NO: 66047 - DNA, 20 bp, Artificial Sequence
  Description of Artificial Sequence: Synthetic oligonucleotide
  Target: ATXN1; (-) strand; PAM type: NRG; PAM sequence: TGG
ttttataaatgcttagaact

SEQ ID NO: 66048 - DNA, 20 bp, Artificial Sequence
  Description of Artificial Sequence: Synthetic oligonucleotide
  Target: ATXN1; (-) strand; PAM type: NRG; PAM sequence: TAG
gaataccttttataaatgct

SEQ ID NO: 66049 - DNA, 20 bp, Artificial Sequence
  Description of Artificial Sequence: Synthetic oligonucleotide
  Target: ATXN1; (-) strand; PAM type: NRG; PAM sequence: GAG
acttgtctttatctttaaaa

SEQ ID NO: 66050 - DNA, 20 bp, Artificial Sequence
  Description of Artificial Sequence: Synthetic oligonucleotide
  Target: ATXN1; (-) strand; PAM type: NRG; PAM sequence: AAG
aaacttgtctttatctttaa

SEQ ID NO: 66051 - DNA, 20 bp, Artificial Sequence
  Description of Artificial Sequence: Synthetic oligonucleotide
  Target: ATXN1; (-) strand; PAM type: NRG; PAM sequence: GGG
accgattgcgacaaaaaaag

SEQ ID NO: 66052 - DNA, 20 bp, Artificial Sequence
  Description of Artificial Sequence: Synthetic oligonucleotide
  Target: ATXN1; (-) strand; PAM type: NRG; PAM sequence: GGG
aaccgattgcgacaaaaaaa

SEQ ID NO: 66053 - DNA, 20 bp, Artificial Sequence
  Description of Artificial Sequence: Synthetic oligonucleotide
  Target: ATXN1; (-) strand; PAM type: NRG; PAM sequence: AGG
taaccgattgcgacaaaaaa

SEQ ID NO: 66054 - DNA, 20 bp, Artificial Sequence
  Description of Artificial Sequence: Synthetic oligonucleotide
  Target: ATXN1; (-) strand; PAM type: NRG; PAM sequence: AAG
ttaaccgattgcgacaaaaa

SEQ ID NO: 66055 - DNA, 20 bp, Artificial Sequence
  Description of Artificial Sequence: Synthetic oligonucleotide
  Target: ATXN1; (-) strand; PAM type: NRG; PAM sequence: CAG
agcctgctatatattttgtt

SEQ ID NO: 66056 - DNA, 20 bp, Artificial Sequence
  Description of Artificial Sequence: Synthetic oligonucleotide
  Target: ATXN1; (-) strand; PAM type: NRG; PAM sequence: GAG
tttagaaaaagcagaccaca

SEQ ID NO: 66057 - DNA, 20 bp, Artificial Sequence
  Description of Artificial Sequence: Synthetic oligonucleotide
  Target: ATXN1; (-) strand; PAM type: NRG; PAM sequence: CAG
cttttagaaaaagcagacca

SEQ ID NO: 66058 - DNA, 20 bp, Artificial Sequence
  Description of Artificial Sequence: Synthetic oligonucleotide
  Target: ATXN1; (-) strand; PAM type: NRG; PAM sequence: CAG
ggcagaacttttagaaaaag

SEQ ID NO: 66059 - DNA, 20 bp, Artificial Sequence
  Description of Artificial Sequence: Synthetic oligonucleotide
  Target: ATXN1; (-) strand; PAM type: NRG; PAM sequence: AAG
gtgggcagaacttttagaaa

SEQ ID NO: 66060 - DNA, 20 bp, Artificial Sequence
  Description of Artificial Sequence: Synthetic oligonucleotide
  Target: ATXN1; (-) strand; PAM type: NRG; PAM sequence: TAG
aaatctgtgggcagaacttt

SEQ ID NO: 66061 - DNA, 20 bp, Artificial Sequence
  Description of Artificial Sequence: Synthetic oligonucleotide
  Target: ATXN1; (-) strand; PAM type: NRG; PAM sequence: CAG
ggtgtctgaaaatctgtggg

SEQ ID NO: 66062 - DNA, 20 bp, Artificial Sequence
  Description of Artificial Sequence: Synthetic oligonucleotide
  Target: ATXN1; (-) strand; PAM type: NRG; PAM sequence: GGG
gttggtgtctgaaaatctgt

SEQ ID NO: 66063 - DNA, 20 bp, Artificial Sequence
  Description of Artificial Sequence: Synthetic oligonucleotide
  Target: ATXN1; (-) strand; PAM type: NRG; PAM sequence: TGG
tgttggtgtctgaaaatctg

SEQ ID NO: 66064 - DNA, 20 bp, Artificial Sequence
  Description of Artificial Sequence: Synthetic oligonucleotide
  Target: ATXN1; (-) strand; PAM type: NRG; PAM sequence: TGG
gaatgactgtttgttgctgt

SEQ ID NO: 66065 - DNA, 20 bp, Artificial Sequence
  Description of Artificial Sequence: Synthetic oligonucleotide
  Target: ATXN1; (-) strand; PAM type: NRG; PAM sequence: GGG
accctcacttgcaggaggga

SEQ ID NO: 66066 - DNA, 20 bp, Artificial Sequence
  Description of Artificial Sequence: Synthetic oligonucleotide
  Target: ATXN1; (-) strand; PAM type: NRG; PAM sequence: AGG
caccctcacttgcaggaggg

SEQ ID NO: 66067 - DNA, 20 bp, Artificial Sequence
  Description of Artificial Sequence: Synthetic oligonucleotide
  Target: ATXN1; (-) strand; PAM type: NRG; PAM sequence: GAG
tcaccctcacttgcaggagg

SEQ ID NO: 66068 - DNA, 20 bp, Artificial Sequence
  Description of Artificial Sequence: Synthetic oligonucleotide
  Target: ATXN1; (-) strand; PAM type: NRG; PAM sequence: GGG
tgtcaccctcacttgcagga

SEQ ID NO: 66069 - DNA, 20 bp, Artificial Sequence
  Description of Artificial Sequence: Synthetic oligonucleotide
  Target: ATXN1; (-) strand; PAM type: NRG; PAM sequence: AGG
ctgtcaccctcacttgcagg

SEQ ID NO: 66070 - DNA, 20 bp, Artificial Sequence
  Description of Artificial Sequence: Synthetic oligonucleotide
  Target: ATXN1; (-) strand; PAM type: NRG; PAM sequence: GAG
gctgtcaccctcacttgcag

SEQ ID NO: 66071 - DNA, 20 bp, Artificial Sequence
  Description of Artificial Sequence: Synthetic oligonucleotide
  Target: ATXN1; (-) strand; PAM type: NRG; PAM sequence: AGG
tggctgtcaccctcacttgc

SEQ ID NO: 66072 - DNA, 20 bp, Artificial Sequence
  Description of Artificial Sequence: Synthetic oligonucleotide
  Target: ATXN1; (-) strand; PAM type: NRG; PAM sequence: CAG
ttggctgtcaccctcacttg

SEQ ID NO: 66073 - DNA, 20 bp, Artificial Sequence
  Description of Artificial Sequence: Synthetic oligonucleotide
  Target: ATXN1; (-) strand; PAM type: NRG; PAM sequence: TGG
gttgctgtagctcctggcat

SEQ ID NO: 66074 - DNA, 20 bp, Artificial Sequence
  Description of Artificial Sequence: Synthetic oligonucleotide
  Target: ATXN1; (-) strand; PAM type: NRG; PAM sequence: TGG
tcttctgttgctgtagctcc

SEQ ID NO: 66075 - DNA, 20 bp, Artificial Sequence
  Description of Artificial Sequence: Synthetic oligonucleotide
  Target: ATXN1; (-) strand; PAM type: NRG; PAM sequence: TAG
agtacattcttctgttgctg

SEQ ID NO: 66076 - DNA, 20 bp, Artificial Sequence
  Description of Artificial Sequence: Synthetic oligonucleotide
  Target: ATXN1; (-) strand; PAM type: NRG; PAM sequence: AAG
attctcctgtctctctttta

SEQ ID NO: 66077 - DNA, 20 bp, Artificial Sequence
  Description of Artificial Sequence: Synthetic oligonucleotide
  Target: ATXN1; (-) strand; PAM type: NRG; PAM sequence: AAG
tgatggcaggtagagggtct

SEQ ID NO: 66078 - DNA, 20 bp, Artificial Sequence
  Description of Artificial Sequence: Synthetic oligonucleotide
  Target: ATXN1; (-) strand; PAM type: NRG; PAM sequence: GGG
tgatggtgatggcaggtaga

SEQ ID NO: 66079 - DNA, 20 bp, Artificial Sequence
  Description of Artificial Sequence: Synthetic oligonucleotide
  Target: ATXN1; (-) strand; PAM type: NRG; PAM sequence: AGG
gtgatggtgatggcaggtag

SEQ ID NO: 66080 - DNA, 20 bp, Artificial Sequence
  Description of Artificial Sequence: Synthetic oligonucleotide
  Target: ATXN1; (-) strand; PAM type: NRG; PAM sequence: GAG
ggtgatggtgatggcaggta

SEQ ID NO: 66081 - DNA, 20 bp, Artificial Sequence
  Description of Artificial Sequence: Synthetic oligonucleotide
  Target: ATXN1; (-) strand; PAM type: NRG; PAM sequence: TAG
gaggtgatggtgatggcagg

SEQ ID NO: 66082 - DNA, 20 bp, Artificial Sequence
  Description of Artificial Sequence: Synthetic oligonucleotide
  Target: ATXN1; (-) strand; PAM type: NRG; PAM sequence: AGG
taggaggtgatggtgatggc

SEQ ID NO: 66083 - DNA, 20 bp, Artificial Sequence
  Description of Artificial Sequence: Synthetic oligonucleotide
  Target: ATXN1; (-) strand; PAM type: NRG; PAM sequence: CAG
ttaggaggtgatggtgatgg

SEQ ID NO: 66084 - DNA, 20 bp, Artificial Sequence
  Description of Artificial Sequence: Synthetic oligonucleotide
  Target: ATXN1; (-) strand; PAM type: NRG; PAM sequence: TGG
tggttaggaggtgatggtga

SEQ ID NO: 66085 - DNA, 20 bp, Artificial Sequence
  Description of Artificial Sequence: Synthetic oligonucleotide
  Target: ATXN1; (-) strand; PAM type: NRG; PAM sequence: TGG
catttctggttaggaggtga

SEQ ID NO: 66086 - DNA, 20 bp, Artificial Sequence
  Description of Artificial Sequence: Synthetic oligonucleotide
  Target: ATXN1; (-) strand; PAM type: NRG; PAM sequence: AGG
tgttgtcatttctggttagg

SEQ ID NO: 66087 - DNA, 20 bp, Artificial Sequence
  Description of Artificial Sequence: Synthetic oligonucleotide
  Target: ATXN1; (-) strand; PAM type: NRG; PAM sequence: GAG
ttgttgtcatttctggttag

SEQ ID NO: 66088 - DNA, 20 bp, Artificial Sequence
  Description of Artificial Sequence: Synthetic oligonucleotide
  Target: ATXN1; (-) strand; PAM type: NRG; PAM sequence: AGG
gcttgttgtcatttctggtt

SEQ ID NO: 66089 - DNA, 20 bp, Artificial Sequence
  Description of Artificial Sequence: Synthetic oligonucleotide
  Target: ATXN1; (-) strand; PAM type: NRG; PAM sequence: TAG
tgcttgttgtcatttctggt

SEQ ID NO: 66090 - DNA, 20 bp, Artificial Sequence
  Description of Artificial Sequence: Synthetic oligonucleotide
  Target: ATXN1; (-) strand; PAM type: NRG; PAM sequence: TGG
gtgctgcttgttgtcatttc

SEQ ID NO: 66091 - DNA, 20 bp, Artificial Sequence
  Description of Artificial Sequence: Synthetic oligonucleotide
  Target: ATXN1; (-) strand; PAM type: NRG; PAM sequence: AAG
gccactaacaaattcctaga

SEQ ID NO: 66092 - DNA, 20 bp, Artificial Sequence
  Description of Artificial Sequence: Synthetic oligonucleotide
  Target: ATXN1; (-) strand; PAM type: NRG; PAM sequence: TAG
cacagccactaacaaattcc

SEQ ID NO: 66093 - DNA, 20 bp, Artificial Sequence
  Description of Artificial Sequence: Synthetic oligonucleotide
  Target: ATXN1; (-) strand; PAM type: NRG; PAM sequence: CAG
gcaagaaggacacatgatca

SEQ ID NO: 66094 - DNA, 20 bp, Artificial Sequence
  Description of Artificial Sequence: Synthetic oligonucleotide
  Target: ATXN1; (-) strand; PAM type: NRG; PAM sequence: AGG
agagaaacgtgagtgcaaga

SEQ ID NO: 66095 - DNA, 20 bp, Artificial Sequence
  Description of Artificial Sequence: Synthetic oligonucleotide
  Target: ATXN1; (-) strand; PAM type: NRG; PAM sequence: AAG
aagagaaacgtgagtgcaag

SEQ ID NO: 66096 - DNA, 20 bp, Artificial Sequence
  Description of Artificial Sequence: Synthetic oligonucleotide
  Target: ATXN1; (-) strand; PAM type: NRG; PAM sequence: AAG
caaaagagaaacgtgagtgc

SEQ ID NO: 66097 - DNA, 20 bp, Artificial Sequence
  Description of Artificial Sequence: Synthetic oligonucleotide
  Target: ATXN1; (-) strand; PAM type: NRG; PAM sequence: GAG
tttggtcaaaagagaaacgt

SEQ ID NO: 66098 - DNA, 20 bp, Artificial Sequence
  Description of Artificial Sequence: Synthetic oligonucleotide
  Target: ATXN1; (-) strand; PAM type: NRG; PAM sequence: GAG
taaataatatttggtcaaaa

SEQ ID NO: 66099 - DNA, 20 bp, Artificial Sequence
  Description of Artificial Sequence: Synthetic oligonucleotide
  Target: ATXN1; (-) strand; PAM type: NRG; PAM sequence: AAG
actaaataatatttggtcaa

SEQ ID NO: 66100 - DNA, 20 bp, Artificial Sequence
  Description of Artificial Sequence: Synthetic oligonucleotide
  Target: ATXN1; (-) strand; PAM type: NRG; PAM sequence: TGG
acatcttactaaataatatt

SEQ ID NO: 66101 - DNA, 20 bp, Artificial Sequence
  Description of Artificial Sequence: Synthetic oligonucleotide
  Target: ATXN1; (-) strand; PAM type: NRG; PAM sequence: GGG
gtttcaatggtgattcccag

SEQ ID NO: 66102 - DNA, 20 bp, Artificial Sequence
  Description of Artificial Sequence: Synthetic oligonucleotide
  Target: ATXN1; (-) strand; PAM type: NRG; PAM sequence: GGG
tgtttcaatggtgattccca

SEQ ID NO: 66103 - DNA, 20 bp, Artificial Sequence
  Description of Artificial Sequence: Synthetic oligonucleotide
  Target: ATXN1; (-) strand; PAM type: NRG; PAM sequence: AGG
ctgtttcaatggtgattccc

SEQ ID NO: 66104 - DNA, 20 bp, Artificial Sequence
  Description of Artificial Sequence: Synthetic oligonucleotide
  Target: ATXN1; (-) strand; PAM type: NRG; PAM sequence: CAG
tctgtttcaatggtgattcc

SEQ ID NO: 66105 - DNA, 20 bp, Artificial Sequence
  Description of Artificial Sequence: Synthetic oligonucleotide
  Target: ATXN1; (-) strand; PAM type: NRG; PAM sequence: TGG
tagaaagccttctgtttcaa

SEQ ID NO: 66106 - DNA, 20 bp, Artificial Sequence
  Description of Artificial Sequence: Synthetic oligonucleotide
  Target: ATXN1; (-) strand; PAM type: NRG; PAM sequence: AAG
gaacagatattttacttaga

SEQ ID NO: 66107 - DNA, 20 bp, Artificial Sequence
  Description of Artificial Sequence: Synthetic oligonucleotide
  Target: ATXN1; (-) strand; PAM type: NRG; PAM sequence: TAG
tactgaacagatattttact

SEQ ID NO: 66108 - DNA, 20 bp, Artificial Sequence
  Description of Artificial Sequence: Synthetic oligonucleotide
  Target: ATXN1; (-) strand; PAM type: NRG; PAM sequence: CAG
ctgcaagaacagatactgaa

SEQ ID NO: 66109 - DNA, 20 bp, Artificial Sequence
  Description of Artificial Sequence: Synthetic oligonucleotide
  Target: ATXN1; (-) strand; PAM type: NRG; PAM sequence: CAG
tgtgctttgcactgcaagaa

SEQ ID NO: 66110 - DNA, 20 bp, Artificial Sequence
  Description of Artificial Sequence: Synthetic oligonucleotide
  Target: ATXN1; (-) strand; PAM type: NRG; PAM sequence: AAG
tgaaatgtgctttgcactgc

SEQ ID NO: 66111 - DNA, 20 bp, Artificial Sequence
  Description of Artificial Sequence: Synthetic oligonucleotide
  Target: ATXN1; (-) strand; PAM type: NRG; PAM sequence: TGG
ccaaacattttcctagccgt

SEQ ID NO: 66112 - DNA, 20 bp, Artificial Sequence
  Description of Artificial Sequence: Synthetic oligonucleotide
  Target: ATXN1; (-) strand; PAM type: NRG; PAM sequence: TAG
gcgtgccccaaacattttcc

SEQ ID NO: 66113 - DNA, 20 bp, Artificial Sequence
  Description of Artificial Sequence: Synthetic oligonucleotide
  Target: ATXN1; (-) strand; PAM type: NRG; PAM sequence: GGG
ttagttctgttggcgtagaa

SEQ ID NO: 66114 - DNA, 20 bp, Artificial Sequence
  Description of Artificial Sequence: Synthetic oligonucleotide
  Target: ATXN1; (-) strand; PAM type: NRG; PAM sequence: AGG
attagttctgttggcgtaga

SEQ ID NO: 66115 - DNA, 20 bp, Artificial Sequence
  Description of Artificial Sequence: Synthetic oligonucleotide
  Target: ATXN1; (-) strand; PAM type: NRG; PAM sequence: AAG
gattagttctgttggcgtag

SEQ ID NO: 66116 - DNA, 20 bp, Artificial Sequence
  Description of Artificial Sequence: Synthetic oligonucleotide
  Target: ATXN1; (-) strand; PAM type: NRG; PAM sequence: TAG
tgagattagttctgttggcg

SEQ ID NO: 66117 - DNA, 20 bp, Artificial Sequence
  Description of Artificial Sequence: Synthetic oligonucleotide
  Target: ATXN1; (-) strand; PAM type: NRG; PAM sequence: TGG
atacatgagattagttctgt

SEQ ID NO: 66118 - DNA, 20 bp, Artificial Sequence
  Description of Artificial Sequence: Synthetic oligonucleotide
  Target: ATXN1; (-) strand; PAM type: NRG; PAM sequence: TAG
gaaaaatgcatacatgagat

SEQ ID NO: 66119 - DNA, 20 bp, Artificial Sequence
  Description of Artificial Sequence: Synthetic oligonucleotide
  Target: ATXN1; (-) strand; PAM type: NRG; PAM sequence: GAG
gagctgaaaaatgcatacat

SEQ ID NO: 66120 - DNA, 20 bp, Artificial Sequence
  Description of Artificial Sequence: Synthetic oligonucleotide
  Target: ATXN1; (-) strand; PAM type: NRG; PAM sequence: GAG
aatatgtcttctcaactcag

SEQ ID NO: 66121 - DNA, 20 bp, Artificial Sequence
  Description of Artificial Sequence: Synthetic oligonucleotide
  Target: ATXN1; (-) strand; PAM type: NRG; PAM sequence: AGG
ttaatatgtcttctcaactc

SEQ ID NO: 66122 - DNA, 20 bp, Artificial Sequence
  Description of Artificial Sequence: Synthetic oligonucleotide
  Target: ATXN1; (-) strand; PAM type: NRG; PAM sequence: CAG
tttaatatgtcttctcaact

SEQ ID NO: 66123 - DNA, 20 bp, Artificial Sequence
  Description of Artificial Sequence: Synthetic oligonucleotide
  Target: ATXN1; (-) strand; PAM type: NRG; PAM sequence: GGG
atgaagataaacatgttgct

SEQ ID NO: 66124 - DNA, 20 bp, Artificial Sequence
  Description of Artificial Sequence: Synthetic oligonucleotide
  Target: ATXN1; (-) strand; PAM type: NRG; PAM sequence: TGG
aatgaagataaacatgttgc

SEQ ID NO: 66125 - DNA, 20 bp, Artificial Sequence
  Description of Artificial Sequence: Synthetic oligonucleotide
  Target: ATXN1; (-) strand; PAM type: NRG; PAM sequence: AAG
aggacatttgctgtttaatg

SEQ ID NO: 66126 - DNA, 20 bp, Artificial Sequence
  Description of Artificial Sequence: Synthetic oligonucleotide
  Target: ATXN1; (-) strand; PAM type: NRG; PAM sequence: AGG
cctgttgtatattgtttgaa

SEQ ID NO: 66127 - DNA, 20 bp, Artificial Sequence
  Description of Artificial Sequence: Synthetic oligonucleotide
  Target: ATXN1; (-) strand; PAM type: NRG; PAM sequence: AAG
ccctgttgtatattgtttga

SEQ ID NO: 66128 - DNA, 20 bp, Artificial Sequence
  Description of Artificial Sequence: Synthetic oligonucleotide
  Target: ATXN1; (-) strand; PAM type: NRG; PAM sequence: CAG
tcactttccattagcacaaa

SEQ ID NO: 66129 - DNA, 20 bp, Artificial Sequence
  Description of Artificial Sequence: Synthetic oligonucleotide
  Target: ATXN1; (-) strand; PAM type: NRG; PAM sequence: TAG
ggcttttgatcactttccat

SEQ ID NO: 66130 - DNA, 20 bp, Artificial Sequence
  Description of Artificial Sequence: Synthetic oligonucleotide
  Target: ATXN1; (-) strand; PAM type: NRG; PAM sequence: GGG
cagctaaccaaagaatcttg

SEQ ID NO: 66131 - DNA, 20 bp, Artificial Sequence
  Description of Artificial Sequence: Synthetic oligonucleotide
  Target: ATXN1; (-) strand; PAM type: NRG; PAM sequence: GGG
tcagctaaccaaagaatctt

SEQ ID NO: 66132 - DNA, 20 bp, Artificial Sequence
  Description of Artificial Sequence: Synthetic oligonucleotide
  Target: ATXN1; (-) strand; PAM type: NRG; PAM sequence: TGG
gtcagctaaccaaagaatct

SEQ ID NO: 66133 - DNA, 20 bp, Artificial Sequence
  Description of Artificial Sequence: Synthetic oligonucleotide
  Target: ATXN1; (-) strand; PAM type: NRG; PAM sequence: AAG
gcttcagagtcagctaacca

SEQ ID NO: 66134 - DNA, 20 bp, Artificial Sequence
  Description of Artificial Sequence: Synthetic oligonucleotide
  Target: ATXN1; (-) strand; PAM type: NRG; PAM sequence: CAG
gcacgagcaggcttcagagt

SEQ ID NO: 66135 - DNA, 20 bp, Artificial Sequence
  Description of Artificial Sequence: Synthetic oligonucleotide
  Target: ATXN1; (-) strand; PAM type: NRG; PAM sequence: GAG
tcaagcacgagcaggcttca

SEQ ID NO: 66136 - DNA, 20 bp, Artificial Sequence
  Description of Artificial Sequence: Synthetic oligonucleotide
  Target: ATXN1; (-) strand; PAM type: NRG; PAM sequence: CAG
actcaagcacgagcaggctt

SEQ ID NO: 66137 - DNA, 20 bp, Artificial Sequence
  Description of Artificial Sequence: Synthetic oligonucleotide
  Target: ATXN1; (-) strand; PAM type: NRG; PAM sequence: AGG
gtagaaactcaagcacgagc

SEQ ID NO: 66138 - DNA, 20 bp, Artificial Sequence
  Description of Artificial Sequence: Synthetic oligonucleotide
  Target: ATXN1; (-) strand; PAM type: NRG; PAM sequence: CAG
tgtagaaactcaagcacgag

SEQ ID NO: 66139 - DNA, 20 bp, Artificial Sequence
  Description of Artificial Sequence: Synthetic oligonucleotide
  Target: ATXN1; (-) strand; PAM type: NRG; PAM sequence: GAG
ttgtgtagaaactcaagcac

SEQ ID NO: 66140 - DNA, 20 bp, Artificial Sequence
  Description of Artificial Sequence: Synthetic oligonucleotide
  Target: ATXN1; (-) strand; PAM type: NRG; PAM sequence: AAG
tgtactttgtgtagaaactc

SEQ ID NO: 66141 - DNA, 20 bp, Artificial Sequence
  Description of Artificial Sequence: Synthetic oligonucleotide
  Target: ATXN1; (-) strand; PAM type: NRG; PAM sequence: TAG
ttcttttgatgtactttgtg

SEQ ID NO: 66142 - DNA, 20 bp, Artificial Sequence
  Description of Artificial Sequence: Synthetic oligonucleotide
  Target: ATXN1; (-) strand; PAM type: NRG; PAM sequence: CAG
ctttaaacatttagaatctc

SEQ ID NO: 66143 - DNA, 20 bp, Artificial Sequence
  Description of Artificial Sequence: Synthetic oligonucleotide
  Target: ATXN1; (-) strand; PAM type: NRG; PAM sequence: TAG
tcctagagactttaaacatt

SEQ ID NO: 66144 - DNA, 20 bp, Artificial Sequence
  Description of Artificial Sequence: Synthetic oligonucleotide
  Target: ATXN1; (-) strand; PAM type: NRG; PAM sequence: GAG
atattttcttgctagtccta

SEQ ID NO: 66145 - DNA, 20 bp, Artificial Sequence
  Description of Artificial Sequence: Synthetic oligonucleotide
  Target: ATXN1; (-) strand; PAM type: NRG; PAM sequence: TAG
gcatattttcttgctagtcc

SEQ ID NO: 66146 - DNA, 20 bp, Artificial Sequence
  Description of Artificial Sequence: Synthetic oligonucleotide
  Target: ATXN1; (-) strand; PAM type: NRG; PAM sequence: TAG
tttcaagcatattttcttgc

SEQ ID NO: 66147 - DNA, 20 bp, Artificial Sequence
  Description of Artificial Sequence: Synthetic oligonucleotide
  Target: ATXN1; (-) strand; PAM type: NRG; PAM sequence: AAG
tccccatttcctatagtttc

SEQ ID NO: 66148 - DNA, 20 bp, Artificial Sequence
  Description of Artificial Sequence: Synthetic oligonucleotide
  Target: ATXN1; (-) strand; PAM type: NRG; PAM sequence: TAG
gttctgttccccatttccta

SEQ ID NO: 66149 - DNA, 20 bp, Artificial Sequence
  Description of Artificial Sequence: Synthetic oligonucleotide
  Target: ATXN1; (-) strand; PAM type: NRG; PAM sequence: CAG
agggaaaaggtggaagtcaa

SEQ ID NO: 66150 - DNA, 20 bp, Artificial Sequence
  Description of Artificial Sequence: Synthetic oligonucleotide
  Target: ATXN1; (-) strand; PAM type: NRG; PAM sequence: AAG
gtgttacagggaaaaggtgg

SEQ ID NO: 66151 - DNA, 20 bp, Artificial Sequence
  Description of Artificial Sequence: Synthetic oligonucleotide
  Target: ATXN1; (-) strand; PAM type: NRG; PAM sequence: TGG
attgtgttacagggaaaagg

SEQ ID NO: 66152 - DNA, 20 bp, Artificial Sequence
  Description of Artificial Sequence: Synthetic oligonucleotide
  Target: ATXN1; (-) strand; PAM type: NRG; PAM sequence: AGG
tgtattgtgttacagggaaa

SEQ ID NO: 66153 - DNA, 20 bp, Artificial Sequence
  Description of Artificial Sequence: Synthetic oligonucleotide
  Target: ATXN1; (-) strand; PAM type: NRG; PAM sequence: AAG
atgtattgtgttacagggaa

SEQ ID NO: 66154 - DNA, 20 bp, Artificial Sequence
  Description of Artificial Sequence: Synthetic oligonucleotide
  Target: ATXN1; (-) strand; PAM type: NRG; PAM sequence: GGG
ttgtaatgtattgtgttaca

SEQ ID NO: 66155 - DNA, 20 bp, Artificial Sequence
  Description of Artificial Sequence: Synthetic oligonucleotide
  Target: ATXN1; (-) strand; PAM type: NRG; PAM sequence: AGG
attgtaatgtattgtgttac

SEQ ID NO: 66156 - DNA, 20 bp, Artificial Sequence
  Description of Artificial Sequence: Synthetic oligonucleotide
  Target: ATXN1; (-) strand; PAM type: NRG; PAM sequence: CAG
gattgtaatgtattgtgtta

SEQ ID NO: 66157 - DNA, 20 bp, Artificial Sequence
  Description of Artificial Sequence: Synthetic oligonucleotide
  Target: ATXN1; (-) strand; PAM type: NRG; PAM sequence: TAG
cagacagcctaagctattta

SEQ ID NO: 66158 - DNA, 20 bp, Artificial Sequence
  Description of Artificial Sequence: Synthetic oligonucleotide
  Target: ATXN1; (-) strand; PAM type: NRG; PAM sequence: AAG
catatttaaacagacagcct

SEQ ID NO: 66159 - DNA, 20 bp, Artificial Sequence
  Description of Artificial Sequence: Synthetic oligonucleotide
  Target: ATXN1; (-) strand; PAM type: NRG; PAM sequence: CAG
gaggtgcatatttaaacaga

SEQ ID NO: 66160 - DNA, 20 bp, Artificial Sequence
  Description of Artificial Sequence: Synthetic oligonucleotide
  Target: ATXN1; (-) strand; PAM type: NRG; PAM sequence: CAG
gggggaggtgcatatttaaa

SEQ ID NO: 66161 - DNA, 20 bp, Artificial Sequence
  Description of Artificial Sequence: Synthetic oligonucleotide
  Target: ATXN1; (-) strand; PAM type: NRG; PAM sequence: AGG
gcctctatcttttccggggg

SEQ ID NO: 66162 - DNA, 20 bp, Artificial Sequence
  Description of Artificial Sequence: Synthetic oligonucleotide
  Target: ATXN1; (-) strand; PAM type: NRG; PAM sequence: GAG
agcctctatcttttccgggg

SEQ ID NO: 66163 - DNA, 20 bp, Artificial Sequence
  Description of Artificial Sequence: Synthetic oligonucleotide
  Target: ATXN1; (-) strand; PAM type: NRG; PAM sequence: GGG
gaagcctctatcttttccgg

SEQ ID NO: 66164 - DNA, 20 bp, Artificial Sequence
  Description of Artificial Sequence: Synthetic oligonucleotide
  Target: ATXN1; (-) strand; PAM type: NRG; PAM sequence: GGG
ggaagcctctatcttttccg

SEQ ID NO: 66165 - DNA, 20 bp, Artificial Sequence
  Description of Artificial Sequence: Synthetic oligonucleotide
  Target: ATXN1; (-) strand; PAM type: NRG; PAM sequence: GGG
cggaagcctctatcttttcc

SEQ ID NO: 66166 - DNA, 20 bp, Artificial Sequence
  Description of Artificial Sequence: Synthetic oligonucleotide
  Target: ATXN1; (-) strand; PAM type: NRG; PAM sequence: CGG
tcggaagcctctatcttttc

SEQ ID NO: 66167 - DNA, 20 bp, Artificial Sequence
  Description of Artificial Sequence: Synthetic oligonucleotide
  Target: ATXN1; (-) strand; PAM type: NRG; PAM sequence: AAG
gcaaatagcaagatgatcgg

SEQ ID NO: 66168 - DNA, 20 bp, Artificial Sequence
  Description of Artificial Sequence: Synthetic oligonucleotide
  Target: ATXN1; (-) strand; PAM type: NRG; PAM sequence: CGG
cttgcaaatagcaagatgat

SEQ ID NO: 66169 - DNA, 20 bp, Artificial Sequence
  Description of Artificial Sequence: Synthetic oligonucleotide
  Target: ATXN1; (-) strand; PAM type: NRG; PAM sequence: AAG
taagattccttgcaaatagc

SEQ ID NO: 66170 - DNA, 20 bp, Artificial Sequence
  Description of Artificial Sequence: Synthetic oligonucleotide
  Target: ATXN1; (-) strand; PAM type: NRG; PAM sequence: TAG
tgagtaagattccttgcaaa

SEQ ID NO: 66171 - DNA, 20 bp, Artificial Sequence
  Description of Artificial Sequence: Synthetic oligonucleotide
  Target: ATXN1; (-) strand; PAM type: NRG; PAM sequence: AAG
tgttagattgatttgtgagt

SEQ ID NO: 66172 - DNA, 20 bp, Artificial Sequence
  Description of Artificial Sequence: Synthetic oligonucleotide
  Target: ATXN1; (-) strand; PAM type: NRG; PAM sequence: GAG
ggcctgttagattgatttgt

SEQ ID NO: 66173 - DNA, 20 bp, Artificial Sequence
  Description of Artificial Sequence: Synthetic oligonucleotide
  Target: ATXN1; (-) strand; PAM type: NRG; PAM sequence: TAG
ataatatcaccgtggcctgt

SEQ ID NO: 66174 - DNA, 20 bp, Artificial Sequence
  Description of Artificial Sequence: Synthetic oligonucleotide
  Target: ATXN1; (-) strand; PAM type: NRG; PAM sequence: TGG
acatccccataatatcaccg

SEQ ID NO: 66175 - DNA, 20 bp, Artificial Sequence
  Description of Artificial Sequence: Synthetic oligonucleotide
  Target: ATXN1; (-) strand; PAM type: NRG; PAM sequence: CAG
cgtgacgctcttgatcattt

SEQ ID NO: 66176 - DNA, 20 bp, Artificial Sequence
  Description of Artificial Sequence: Synthetic oligonucleotide
  Target: ATXN1; (-) strand; PAM type: NRG; PAM sequence: AAG
taggaccccacttggcttgg

SEQ ID NO: 66177 - DNA, 20 bp, Artificial Sequence
  Description of Artificial Sequence: Synthetic oligonucleotide
  Target: ATXN1; (-) strand; PAM type: NRG; PAM sequence: TGG
gcataggaccccacttggct

SEQ ID NO: 66178 - DNA, 20 bp, Artificial Sequence
  Description of Artificial Sequence: Synthetic oligonucleotide
  Target: ATXN1; (-) strand; PAM type: NRG; PAM sequence: TGG
gcaaggcataggaccccact

SEQ ID NO: 66179 - DNA, 20 bp, Artificial Sequence
  Description of Artificial Sequence: Synthetic oligonucleotide
  Target: ATXN1; (-) strand; PAM type: NRG; PAM sequence: AGG
tcttcaaaccagcaaggcat

SEQ ID NO: 66180 - DNA, 20 bp, Artificial Sequence
  Description of Artificial Sequence: Synthetic oligonucleotide
  Target: ATXN1; (-) strand; PAM type: NRG; PAM sequence: TAG
ttcttcaaaccagcaaggca

SEQ ID NO: 66181 - DNA, 20 bp, Artificial Sequence
  Description of Artificial Sequence: Synthetic oligonucleotide
  Target: ATXN1; (-) strand; PAM type: NRG; PAM sequence: AGG
cccacttcttcaaaccagca

SEQ ID NO: 66182 - DNA, 20 bp, Artificial Sequence
  Description of Artificial Sequence: Synthetic oligonucleotide
  Target: ATXN1; (-) strand; PAM type: NRG; PAM sequence: AAG
tcccacttcttcaaaccagc

SEQ ID NO: 66183 - DNA, 20 bp, Artificial Sequence
  Description of Artificial Sequence: Synthetic oligonucleotide
  Target: ATXN1; (-) strand; PAM type: NRG; PAM sequence: CAG
tttctcccacttcttcaaac

SEQ ID NO: 66184 - DNA, 20 bp, Artificial Sequence
  Description of Artificial Sequence: Synthetic oligonucleotide
  Target: ATXN1; (-) strand; PAM type: NRG; PAM sequence: AAG
ctgagttgctgctcttgatg

SEQ ID NO: 66185 - DNA, 20 bp, Artificial Sequence
  Description of Artificial Sequence: Synthetic oligonucleotide
  Target: ATXN1; (-) strand; PAM type: NRG; PAM sequence: GAG
actctggtggacagacacct

SEQ ID NO: 66186 - DNA, 20 bp, Artificial Sequence
  Description of Artificial Sequence: Synthetic oligonucleotide
  Target: ATXN1; (-) strand; PAM type: NRG; PAM sequence: CAG
ctcctgcttactctggtgga

SEQ ID NO: 66187 - DNA, 20 bp, Artificial Sequence
  Description of Artificial Sequence: Synthetic oligonucleotide
  Target: ATXN1; (-) strand; PAM type: NRG; PAM sequence: TGG
gaacctcctgcttactctgg

SEQ ID NO: 66188 - DNA, 20 bp, Artificial Sequence
  Description of Artificial Sequence: Synthetic oligonucleotide
  Target: ATXN1; (-) strand; PAM type: NRG; PAM sequence: TGG
tcagaacctcctgcttactc

SEQ ID NO: 66189 - DNA, 20 bp, Artificial Sequence
  Description of Artificial Sequence: Synthetic oligonucleotide
  Target: ATXN1; (-) strand; PAM type: NRG; PAM sequence: CAG
cctaggctacccttgctggt

SEQ ID NO: 66190 - DNA, 20 bp, Artificial Sequence
  Description of Artificial Sequence: Synthetic oligonucleotide
  Target: ATXN1; (-) strand; PAM type: NRG; PAM sequence: TGG
atgccctaggctacccttgc

SEQ ID NO: 66191 - DNA, 20 bp, Artificial Sequence
  Description of Artificial Sequence: Synthetic oligonucleotide
  Target: ATXN1; (-) strand; PAM type: NRG; PAM sequence: AGG
ctccctccctcccatgccct

SEQ ID NO: 66192 - DNA, 20 bp, Artificial Sequence
  Description of Artificial Sequence: Synthetic oligonucleotide
  Target: ATXN1; (-) strand; PAM type: NRG; PAM sequence: TAG
tctccctccctcccatgccc

SEQ ID NO: 66193 - DNA, 20 bp, Artificial Sequence
  Description of Artificial Sequence: Synthetic oligonucleotide
  Target: ATXN1; (-) strand; PAM type: NRG; PAM sequence: AAG
gacagaacaggaaagcttta

SEQ ID NO: 66194 - DNA, 20 bp, Artificial Sequence
  Description of Artificial Sequence: Synthetic oligonucleotide
  Target: ATXN1; (-) strand; PAM type: NRG; PAM sequence: AAG
ggaagtgtgacagaacagga

SEQ ID NO: 66195 - DNA, 20 bp, Artificial Sequence
  Description of Artificial Sequence: Synthetic oligonucleotide
  Target: ATXN1; (-) strand; PAM type: NRG; PAM sequence: AGG
tgcaggaagtgtgacagaac

SEQ ID NO: 66196 - DNA, 20 bp, Artificial Sequence
  Description of Artificial Sequence: Synthetic oligonucleotide
  Target: ATXN1; (-) strand; PAM type: NRG; PAM sequence: CAG
gtgcaggaagtgtgacagaa

SEQ ID NO: 66197 - DNA, 20 bp, Artificial Sequence
  Description of Artificial Sequence: Synthetic oligonucleotide
  Target: ATXN1; (-) strand; PAM type: NRG; PAM sequence: CAG
cagaggtgcaggaagtgtga

SEQ ID NO: 66198 - DNA, 20 bp, Artificial Sequence
  Description of Artificial Sequence: Synthetic oligonucleotide
  Target: ATXN1; (-) strand; PAM type: NRG; PAM sequence: AAG
cctctgggcagaggtgcagg

SEQ ID NO: 66199 - DNA, 20 bp, Artificial Sequence
  Description of Artificial Sequence: Synthetic oligonucleotide
  Target: ATXN1; (-) strand; PAM type: NRG; PAM sequence: AGG
ccacctctgggcagaggtgc

SEQ ID NO: 66200 - DNA, 20 bp, Artificial Sequence
  Description of Artificial Sequence: Synthetic oligonucleotide
  Target: ATXN1; (-) strand; PAM type: NRG; PAM sequence: CAG
gccacctctgggcagaggtg

SEQ ID NO: 66201 - DNA, 20 bp, Artificial Sequence
  Description of Artificial Sequence: Synthetic oligonucleotide
  Target: ATXN1; (-) strand; PAM type: NRG; PAM sequence: AGG
gagcagccacctctgggcag

SEQ ID NO: 66202 - DNA, 20 bp, Artificial Sequence
  Description of Artificial Sequence: Synthetic oligonucleotide
  Target: ATXN1; (-) strand; PAM type: NRG; PAM sequence: GAG
ggagcagccacctctgggca

SEQ ID NO: 66203 - DNA, 20 bp, Artificial Sequence
  Description of Artificial Sequence: Synthetic oligonucleotide
  Target: ATXN1; (-) strand; PAM type: NRG; PAM sequence: CAG
gtggagcagccacctctggg

SEQ ID NO: 66204 - DNA, 20 bp, Artificial Sequence
  Description of Artificial Sequence: Synthetic oligonucleotide
  Target: ATXN1; (-) strand; PAM type: NRG; PAM sequence: GGG
tctgtggagcagccacctct

SEQ ID NO: 66205 - DNA, 20 bp, Artificial Sequence
  Description of Artificial Sequence: Synthetic oligonucleotide
  Target: ATXN1; (-) strand; PAM type: NRG; PAM sequence: TGG
gtctgtggagcagccacctc

SEQ ID NO: 66206 - DNA, 20 bp, Artificial Sequence
  Description of Artificial Sequence: Synthetic oligonucleotide
  Target: ATXN1; (-) strand; PAM type: NRG; PAM sequence: CAG
ttctgcttgggtctgtggag

SEQ ID NO: 66207 - DNA, 20 bp, Artificial Sequence
  Description of Artificial Sequence: Synthetic oligonucleotide
  Target: ATXN1; (-) strand; PAM type: NRG; PAM sequence: GAG
gctttctgcttgggtctgtg

SEQ ID NO: 66208 - DNA, 20 bp, Artificial Sequence
  Description of Artificial Sequence: Synthetic oligonucleotide
  Target: ATXN1; (-) strand; PAM type: NRG; PAM sequence: TGG
ctgctttctgcttgggtctg

SEQ ID NO: 66209 - DNA, 20 bp, Artificial Sequence
  Description of Artificial Sequence: Synthetic oligonucleotide
  Target: ATXN1; (-) strand; PAM type: NRG; PAM sequence: GGG
ttcttgtctgctttctgctt

SEQ ID NO: 66210 - DNA, 20 bp, Artificial Sequence
  Description of Artificial Sequence: Synthetic oligonucleotide
  Target: ATXN1; (-) strand; PAM type: NRG; PAM sequence: TGG
tttcttgtctgctttctgct

SEQ ID NO: 66211 - DNA, 20 bp, Artificial Sequence
  Description of Artificial Sequence: Synthetic oligonucleotide
  Target: ATXN1; (-) strand; PAM type: NRG; PAM sequence: GAG
aagatgctactgggagagaa

SEQ ID NO: 66212 - DNA, 20 bp, Artificial Sequence
  Description of Artificial Sequence: Synthetic oligonucleotide
  Target: ATXN1; (-) strand; PAM type: NRG; PAM sequence: AAG
gaaagatgctactgggagag

SEQ ID NO: 66213 - DNA, 20 bp, Artificial Sequence
  Description of Artificial Sequence: Synthetic oligonucleotide
  Target: ATXN1; (-) strand; PAM type: NRG; PAM sequence: GAG
caggaaagatgctactggga

SEQ ID NO: 66214 - DNA, 20 bp, Artificial Sequence
  Description of Artificial Sequence: Synthetic oligonucleotide
  Target: ATXN1; (-) strand; PAM type: NRG; PAM sequence: GAG
aacaggaaagatgctactgg

SEQ ID NO: 66215 - DNA, 20 bp, Artificial Sequence
  Description of Artificial Sequence: Synthetic oligonucleotide
  Target: ATXN1; (-) strand; PAM type: NRG; PAM sequence: GGG
agaacaggaaagatgctact

SEQ ID NO: 66216 - DNA, 20 bp, Artificial Sequence
  Description of Artificial Sequence: Synthetic oligonucleotide
  Target: ATXN1; (-) strand; PAM type: NRG; PAM sequence: TGG
tagaacaggaaagatgctac

SEQ ID NO: 66217 - DNA, 20 bp, Artificial Sequence
  Description of Artificial Sequence: Synthetic oligonucleotide
  Target: ATXN1; (-) strand; PAM type: NRG; PAM sequence: AAG
gcatttaggctagaacagga

SEQ ID NO: 66218 - DNA, 20 bp, Artificial Sequence
  Description of Artificial Sequence: Synthetic oligonucleotide
  Target: ATXN1; (-) strand; PAM type: NRG; PAM sequence: AGG
ccctgcatttaggctagaac

SEQ ID NO: 66219 - DNA, 20 bp, Artificial Sequence
  Description of Artificial Sequence: Synthetic oligonucleotide
  Target: ATXN1; (-) strand; PAM type: NRG; PAM sequence: CAG
cccctgcatttaggctagaa

SEQ ID NO: 66220 - DNA, 20 bp, Artificial Sequence
  Description of Artificial Sequence: Synthetic oligonucleotide
  Target: ATXN1; (-) strand; PAM type: NRG; PAM sequence: TAG
tttttcccctgcatttaggc

SEQ ID NO: 66221 - DNA, 20 bp, Artificial Sequence
  Description of Artificial Sequence: Synthetic oligonucleotide
  Target: ATXN1; (-) strand; PAM type: NRG; PAM sequence: AGG
aatctttttcccctgcattt

SEQ ID NO: 66222 - DNA, 20 bp, Artificial Sequence
  Description of Artificial Sequence: Synthetic oligonucleotide
  Target: ATXN1; (-) strand; PAM type: NRG; PAM sequence: TAG
aaatctttttcccctgcatt

SEQ ID NO: 66223 - DNA, 20 bp, Artificial Sequence
  Description of Artificial Sequence: Synthetic oligonucleotide
  Target: ATXN1; (-) strand; PAM type: NRG; PAM sequence: CAG
cctgggattcagaggtgcct

SEQ ID NO: 66224 - DNA, 20 bp, Artificial Sequence
  Description of Artificial Sequence: Synthetic oligonucleotide
  Target: ATXN1; (-) strand; PAM type: NRG; PAM sequence: AGG
ctgagctccctgggattcag

SEQ ID NO: 66225 - DNA, 20 bp, Artificial Sequence
  Description of Artificial Sequence: Synthetic oligonucleotide
  Target: ATXN1; (-) strand; PAM type: NRG; PAM sequence: GAG
cctgagctccctgggattca

SEQ ID NO: 66226 - DNA, 20 bp, Artificial Sequence
  Description of Artificial Sequence: Synthetic oligonucleotide
  Target: ATXN1; (-) strand; PAM type: NRG; PAM sequence: CAG
ctcctgagctccctgggatt

SEQ ID NO: 66227 - DNA, 20 bp, Artificial Sequence
  Description of Artificial Sequence: Synthetic oligonucleotide
  Target: ATXN1; (-) strand; PAM type: NRG; PAM sequence: GGG
agtgagctcctgagctccct

SEQ ID NO: 66228 - DNA, 20 bp, Artificial Sequence
  Description of Artificial Sequence: Synthetic oligonucleotide
  Target: ATXN1; (-) strand; PAM type: NRG; PAM sequence: TGG
gagtgagctcctgagctccc

SEQ ID NO: 66229 - DNA, 20 bp, Artificial Sequence
  Description of Artificial Sequence: Synthetic oligonucleotide
  Target: ATXN1; (-) strand; PAM type: NRG; PAM sequence: GAG
aggaatcagagtgagctcct

SEQ ID NO: 66230 - DNA, 20 bp, Artificial Sequence
  Description of Artificial Sequence: Synthetic oligonucleotide
  Target: ATXN1; (-) strand; PAM type: NRG; PAM sequence: GAG
cagctccaaggaatcagagt

SEQ ID NO: 66231 - DNA, 20 bp, Artificial Sequence
  Description of Artificial Sequence: Synthetic oligonucleotide
  Target: ATXN1; (-) strand; PAM type: NRG; PAM sequence: GAG
tcttcagctccaaggaatca

SEQ ID NO: 66232 - DNA, 20 bp, Artificial Sequence
  Description of Artificial Sequence: Synthetic oligonucleotide
  Target: ATXN1; (-) strand; PAM type: NRG; PAM sequence: CAG
actcttcagctccaaggaat

SEQ ID NO: 66233 - DNA, 20 bp, Artificial Sequence
  Description of Artificial Sequence: Synthetic oligonucleotide
  Target: ATXN1; (-) strand; PAM type: NRG; PAM sequence: AGG
acagcaactcttcagctcca

SEQ ID NO: 66234 - DNA, 20 bp, Artificial Sequence
  Description of Artificial Sequence: Synthetic oligonucleotide
  Target: ATXN1; (-) strand; PAM type: NRG; PAM sequence: AAG
cacagcaactcttcagctcc

SEQ ID NO: 66235 - DNA, 20 bp, Artificial Sequence
  Description of Artificial Sequence: Synthetic oligonucleotide
  Target: ATXN1; (-) strand; PAM type: NRG; PAM sequence: CAG
gcttgcacacagcaactctt

SEQ ID NO: 66236 - DNA, 20 bp, Artificial Sequence
  Description of Artificial Sequence: Synthetic oligonucleotide
  Target: ATXN1; (-) strand; PAM type: NRG; PAM sequence: CAG
ggctgtgtgcagcttgcaca

SEQ ID NO: 66237 - DNA, 20 bp, Artificial Sequence
  Description of Artificial Sequence: Synthetic oligonucleotide
  Target: ATXN1; (-) strand; PAM type: NRG; PAM sequence: CAG
agagacgctacggctgtgtg

SEQ ID NO: 66238 - DNA, 20 bp, Artificial Sequence
  Description of Artificial Sequence: Synthetic oligonucleotide
  Target: ATXN1; (-) strand; PAM type: NRG; PAM sequence: CGG
gagtctaatgagagacgcta

SEQ ID NO: 66239 - DNA, 20 bp, Artificial Sequence
  Description of Artificial Sequence: Synthetic oligonucleotide
  Target: ATXN1; (-) strand; PAM type: NRG; PAM sequence: GAG
ggtagaagagagtctaatga

SEQ ID NO: 66240 - DNA, 20 bp, Artificial Sequence
  Description of Artificial Sequence: Synthetic oligonucleotide
  Target: ATXN1; (-) strand; PAM type: NRG; PAM sequence: GAG
gtggtagaagagagtctaat

SEQ ID NO: 66241 - DNA, 20 bp, Artificial Sequence
  Description of Artificial Sequence: Synthetic oligonucleotide
  Target: ATXN1; (-) strand; PAM type: NRG; PAM sequence: GAG
ctggctctagtggtagaaga

SEQ ID NO: 66242 - DNA, 20 bp, Artificial Sequence
  Description of Artificial Sequence: Synthetic oligonucleotide
  Target: ATXN1; (-) strand; PAM type: NRG; PAM sequence: GAG
gcctggctctagtggtagaa

SEQ ID NO: 66243 - DNA, 20 bp, Artificial Sequence
  Description of Artificial Sequence: Synthetic oligonucleotide
  Target: ATXN1; (-) strand; PAM type: NRG; PAM sequence: AAG
ctgcctggctctagtggtag

SEQ ID NO: 66244 - DNA, 20 bp, Artificial Sequence
  Description of Artificial Sequence: Synthetic oligonucleotide
  Target: ATXN1; (-) strand; PAM type: NRG; PAM sequence: TAG
tagctgcctggctctagtgg

SEQ ID NO: 66245 - DNA, 20 bp, Artificial Sequence
  Description of Artificial Sequence: Synthetic oligonucleotide
  Target: ATXN1; (-) strand; PAM type: NRG; PAM sequence: TGG
tcatagctgcctggctctag

SEQ ID NO: 66246 - DNA, 20 bp, Artificial Sequence
  Description of Artificial Sequence: Synthetic oligonucleotide
  Target: ATXN1; (-) strand; PAM type: NRG; PAM sequence: TAG
tcttcatagctgcctggctc

SEQ ID NO: 66247 - DNA, 20 bp, Artificial Sequence
  Description of Artificial Sequence: Synthetic oligonucleotide
  Target: ATXN1; (-) strand; PAM type: NRG; PAM sequence: TGG
tgtcactcttcatagctgcc

SEQ ID NO: 66248 - DNA, 20 bp, Artificial Sequence
  Description of Artificial Sequence: Synthetic oligonucleotide
  Target: ATXN1; (-) strand; PAM type: NRG; PAM sequence: TAG
gctggtcatgtcactcttca

SEQ ID NO: 66249 - DNA, 20 bp, Artificial Sequence
  Description of Artificial Sequence: Synthetic oligonucleotide
  Target: ATXN1; (-) strand; PAM type: NRG; PAM sequence: TGG
ttttgctttctggggctggc

SEQ ID NO: 66250 - DNA, 20 bp, Artificial Sequence
  Description of Artificial Sequence: Synthetic oligonucleotide
  Target: ATXN1; (-) strand; PAM type: NRG; PAM sequence: TGG
cccgttttgctttctggggc

SEQ ID NO: 66251 - DNA, 20 bp, Artificial Sequence
  Description of Artificial Sequence: Synthetic oligonucleotide
  Target: ATXN1; (-) strand; PAM type: NRG; PAM sequence: GGG
cattcccgttttgctttctg

SEQ ID NO: 66252 - DNA, 20 bp, Artificial Sequence
  Description of Artificial Sequence: Synthetic oligonucleotide
  Target: ATXN1; (-) strand; PAM type: NRG; PAM sequence: GGG
gcattcccgttttgctttct

SEQ ID NO: 66253 - DNA, 20 bp, Artificial Sequence
  Description of Artificial Sequence: Synthetic oligonucleotide
  Target: ATXN1; (-) strand; PAM type: NRG; PAM sequence: TGG
tgcattcccgttttgctttc

SEQ ID NO: 66254 - DNA, 20 bp, Artificial Sequence
  Description of Artificial Sequence: Synthetic oligonucleotide
  Target: ATXN1; (-) strand; PAM type: NRG; PAM sequence: AGG
gctgtttgatgggcgagagg

SEQ ID NO: 66255 - DNA, 20 bp, Artificial Sequence
  Description of Artificial Sequence: Synthetic oligonucleotide
  Target: ATXN1; (-) strand; PAM type: NRG; PAM sequence: GAG
agctgtttgatgggcgagag

SEQ ID NO: 66256 - DNA, 20 bp, Artificial Sequence
  Description of Artificial Sequence: Synthetic oligonucleotide
  Target: ATXN1; (-) strand; PAM type: NRG; PAM sequence: AGG
aaagctgtttgatgggcgag

SEQ ID NO: 66257 - DNA, 20 bp, Artificial Sequence
  Description of Artificial Sequence: Synthetic oligonucleotide
  Target: ATXN1; (-) strand; PAM type: NRG; PAM sequence: GAG
gaaagctgtttgatgggcga

SEQ ID NO: 66258 - DNA, 20 bp, Artificial Sequence
  Description of Artificial Sequence: Synthetic oligonucleotide
  Target: ATXN1; (-) strand; PAM type: NRG; PAM sequence: GAG
aagaaagctgtttgatgggc

SEQ ID NO: 66259 - DNA, 20 bp, Artificial Sequence
  Description of Artificial Sequence: Synthetic oligonucleotide
  Target: ATXN1; (-) strand; PAM type: NRG; PAM sequence: GGG
gaggaagaaagctgtttgat

SEQ ID NO: 66260 - DNA, 20 bp, Artificial Sequence
  Description of Artificial Sequence: Synthetic oligonucleotide
  Target: ATXN1; (-) strand; PAM type: NRG; PAM sequence: TGG
ggaggaagaaagctgtttga

SEQ ID NO: 66261 - DNA, 20 bp, Artificial Sequence
  Description of Artificial Sequence: Synthetic oligonucleotide
  Target: ATXN1; (-) strand; PAM type: NRG; PAM sequence: AAG
tttgggagaaaggaggaaga

SEQ ID NO: 66262 - DNA, 20 bp, Artificial Sequence
  Description of Artificial Sequence: Synthetic oligonucleotide
  Target: ATXN1; (-) strand; PAM type: NRG; PAM sequence: AAG
ttgatttgggagaaaggagg

SEQ ID NO: 66263 - DNA, 20 bp, Artificial Sequence
  Description of Artificial Sequence: Synthetic oligonucleotide
  Target: ATXN1; (-) strand; PAM type: NRG; PAM sequence: AGG
gttttgatttgggagaaagg

SEQ ID NO: 66264 - DNA, 20 bp, Artificial Sequence
  Description of Artificial Sequence: Synthetic oligonucleotide
  Target: ATXN1; (-) strand; PAM type: NRG; PAM sequence: GAG
agttttgatttgggagaaag

SEQ ID NO: 66265 - DNA, 20 bp, Artificial Sequence
  Description of Artificial Sequence: Synthetic oligonucleotide
  Target: ATXN1; (-) strand; PAM type: NRG; PAM sequence: AGG
tcagttttgatttgggagaa

SEQ ID NO: 66266 - DNA, 20 bp, Artificial Sequence
  Description of Artificial Sequence: Synthetic oligonucleotide
  Target: ATXN1; (-) strand; PAM type: NRG; PAM sequence: AAG
gtcagttttgatttgggaga

SEQ ID NO: 66267 - DNA, 20 bp, Artificial Sequence
  Description of Artificial Sequence: Synthetic oligonucleotide
  Target: ATXN1; (-) strand; PAM type: NRG; PAM sequence: GAG
gggagtcagttttgatttgg

SEQ ID NO: 66268 - DNA, 20 bp, Artificial Sequence
  Description of Artificial Sequence: Synthetic oligonucleotide
  Target: ATXN1; (-) strand; PAM type: NRG; PAM sequence: GGG
gagggagtcagttttgattt

SEQ ID NO: 66269 - DNA, 20 bp, Artificial Sequence
  Description of Artificial Sequence: Synthetic oligonucleotide
  Target: ATXN1; (-) strand; PAM type: NRG; PAM sequence: TGG
agagggagtcagttttgatt

SEQ ID NO: 66270 - DNA, 20 bp, Artificial Sequence
  Description of Artificial Sequence: Synthetic oligonucleotide
  Target: ATXN1; (-) strand; PAM type: NRG; PAM sequence: CAG
gtgatccaacaagagggagt

SEQ ID NO: 66271 - DNA, 20 bp, Artificial Sequence
  Description of Artificial Sequence: Synthetic oligonucleotide
  Target: ATXN1; (-) strand; PAM type: NRG; PAM sequence: GAG
ctttgtgatccaacaagagg

SEQ ID NO: 66272 - DNA, 20 bp, Artificial Sequence
  Description of Artificial Sequence: Synthetic oligonucleotide
  Target: ATXN1; (-) strand; PAM type: NRG; PAM sequence: GGG
ctctttgtgatccaacaaga

SEQ ID NO: 66273 - DNA, 20 bp, Artificial Sequence
  Description of Artificial Sequence: Synthetic oligonucleotide
  Target: ATXN1; (-) strand; PAM type: NRG; PAM sequence: AGG
gctctttgtgatccaacaag

SEQ ID NO: 66274 - DNA, 20 bp, Artificial Sequence
  Description of Artificial Sequence: Synthetic oligonucleotide
  Target: ATXN1; (-) strand; PAM type: NRG; PAM sequence: GAG
tgctctttgtgatccaacaa

SEQ ID NO: 66275 - DNA, 20 bp, Artificial Sequence
  Description of Artificial Sequence: Synthetic oligonucleotide
  Target: ATXN1; (-) strand; PAM type: NRG; PAM sequence: AAG
cttgctctttgtgatccaac

SEQ ID NO: 66276 - DNA, 20 bp, Artificial Sequence
  Description of Artificial Sequence: Synthetic oligonucleotide
  Target: ATXN1; (-) strand; PAM type: NRG; PAM sequence: AGG
tcttttttttaagctccaca

SEQ ID NO: 66277 - DNA, 20 bp, Artificial Sequence
  Description of Artificial Sequence: Synthetic oligonucleotide
  Target: ATXN1; (-) strand; PAM type: NRG; PAM sequence: AAG
ttcttttttttaagctccac

SEQ ID NO: 66278 - DNA, 20 bp, Artificial Sequence
  Description of Artificial Sequence: Synthetic oligonucleotide
  Target: ATXN1; (-) strand; PAM type: NRG; PAM sequence: AAG
tttttgtttttctttttttt

SEQ ID NO: 66279 - DNA, 20 bp, Artificial Sequence
  Description of Artificial Sequence: Synthetic oligonucleotide
  Target: ATXN1; (-) strand; PAM type: NRG; PAM sequence: CAG
gtaaaattcttgcaagctga

SEQ ID NO: 66280 - DNA, 20 bp, Artificial Sequence
  Description of Artificial Sequence: Synthetic oligonucleotide
  Target: ATXN1; (-) strand; PAM type: NRG; PAM sequence: AAG
ccggttggtaaaattcttgc

SEQ ID NO: 66281 - DNA, 20 bp, Artificial Sequence
  Description of Artificial Sequence: Synthetic oligonucleotide
  Target: ATXN1; (-) strand; PAM type: NRG; PAM sequence: TGG
aggggtaatgtcttgccggt

SEQ ID NO: 66282 - DNA, 20 bp, Artificial Sequence
  Description of Artificial Sequence: Synthetic oligonucleotide
  Target: ATXN1; (-) strand; PAM type: NRG; PAM sequence: CGG
catgaggggtaatgtcttgc

SEQ ID NO: 66283 - DNA, 20 bp, Artificial Sequence
  Description of Artificial Sequence: Synthetic oligonucleotide
  Target: ATXN1; (-) strand; PAM type: NRG; PAM sequence: GGG
ctatggctctgggacatgag

SEQ ID NO: 66284 - DNA, 20 bp, Artificial Sequence
  Description of Artificial Sequence: Synthetic oligonucleotide
  Target: ATXN1; (-) strand; PAM type: NRG; PAM sequence: GGG
cctatggctctgggacatga

SEQ ID NO: 66285 - DNA, 20 bp, Artificial Sequence
  Description of Artificial Sequence: Synthetic oligonucleotide
  Target: ATXN1; (-) strand; PAM type: NRG; PAM sequence: AGG
ccctatggctctgggacatg

SEQ ID NO: 66286 - DNA, 20 bp, Artificial Sequence
  Description of Artificial Sequence: Synthetic oligonucleotide
  Target: ATXN1; (-) strand; PAM type: NRG; PAM sequence: GAG
tccctatggctctgggacat

SEQ ID NO: 66287 - DNA, 20 bp, Artificial Sequence
  Description of Artificial Sequence: Synthetic oligonucleotide
  Target: ATXN1; (-) strand; PAM type: NRG; PAM sequence: GGG
cgcagcctccctatggctct

SEQ ID NO: 66288 - DNA, 20 bp, Artificial Sequence
  Description of Artificial Sequence: Synthetic oligonucleotide
  Target: ATXN1; (-) strand; PAM type: NRG; PAM sequence: TGG
acgcagcctccctatggctc

SEQ ID NO: 66289 - DNA, 20 bp, Artificial Sequence
  Description of Artificial Sequence: Synthetic oligonucleotide
  Target: ATXN1; (-) strand; PAM type: NRG; PAM sequence: TGG
tctcagacgcagcctcccta

SEQ ID NO: 66290 - DNA, 20 bp, Artificial Sequence
  Description of Artificial Sequence: Synthetic oligonucleotide
  Target: ATXN1; (-) strand; PAM type: NRG; PAM sequence: CAG
gtgtgcctcgctctcagacg

SEQ ID NO: 66291 - DNA, 20 bp, Artificial Sequence
  Description of Artificial Sequence: Synthetic oligonucleotide
  Target: ATXN1; (-) strand; PAM type: NRG; PAM sequence: CAG
ctgctggtgtgcctcgctct

SEQ ID NO: 66292 - DNA, 20 bp, Artificial Sequence
  Description of Artificial Sequence: Synthetic oligonucleotide
  Target: ATXN1; (-) strand; PAM type: NRG; PAM sequence: TGG
gagaactgtctctctcctgc

SEQ ID NO: 66293 - DNA, 20 bp, Artificial Sequence
  Description of Artificial Sequence: Synthetic oligonucleotide
  Target: ATXN1; (-) strand; PAM type: NRG; PAM sequence: GAG
agggttcaccatccacccat

SEQ ID NO: 66294 - DNA, 20 bp, Artificial Sequence
  Description of Artificial Sequence: Synthetic oligonucleotide
  Target: ATXN1; (-) strand; PAM type: NRG; PAM sequence: GGG
gtctagctgttgataagaga

SEQ ID NO: 66295 - DNA, 20 bp, Artificial Sequence
  Description of Artificial Sequence: Synthetic oligonucleotide
  Target: ATXN1; (-) strand; PAM type: NRG; PAM sequence: AGG
agtctagctgttgataagag

SEQ ID NO: 66296 - DNA, 20 bp, Artificial Sequence
  Description of Artificial Sequence: Synthetic oligonucleotide
  Target: ATXN1; (-) strand; PAM type: NRG; PAM sequence: GAG
gagtctagctgttgataaga

SEQ ID NO: 66297 - DNA, 20 bp, Artificial Sequence
  Description of Artificial Sequence: Synthetic oligonucleotide
  Target: ATXN1; (-) strand; PAM type: NRG; PAM sequence: GAG
ctgagtctagctgttgataa

SEQ ID NO: 66298 - DNA, 20 bp, Artificial Sequence
  Description of Artificial Sequence: Synthetic oligonucleotide
  Target: ATXN1; (-) strand; PAM type: NRG; PAM sequence: AAG
tgctgagtctagctgttgat

SEQ ID NO: 66299 - DNA, 20 bp, Artificial Sequence
  Description of Artificial Sequence: Synthetic oligonucleotide
  Target: ATXN1; (-) strand; PAM type: NRG; PAM sequence: TAG
gaatgtgtggttgctgagtc

SEQ ID NO: 66300 - DNA, 20 bp, Artificial Sequence
  Description of Artificial Sequence: Synthetic oligonucleotide
  Target: ATXN1; (-) strand; PAM type: NRG; PAM sequence: GAG
aaacggaatgtgtggttgct

SEQ ID NO: 66301 - DNA, 20 bp, Artificial Sequence
  Description of Artificial Sequence: Synthetic oligonucleotide
  Target: ATXN1; (-) strand; PAM type: NRG; PAM sequence: TGG
agaaagtaaaacggaatgtg

SEQ ID NO: 66302 - DNA, 20 bp, Artificial Sequence
  Description of Artificial Sequence: Synthetic oligonucleotide
  Target: ATXN1; (-) strand; PAM type: NRG; PAM sequence: CGG
atgtgggcgagaaagtaaaa

SEQ ID NO: 66303 - DNA, 20 bp, Artificial Sequence
  Description of Artificial Sequence: Synthetic oligonucleotide
  Target: ATXN1; (-) strand; PAM type: NRG; PAM sequence: AAG
tggtttgaatgtgggcgaga

SEQ ID NO: 66304 - DNA, 20 bp, Artificial Sequence
  Description of Artificial Sequence: Synthetic oligonucleotide
  Target: ATXN1; (-) strand; PAM type: NRG; PAM sequence: GAG
aaaatggtttgaatgtgggc

SEQ ID NO: 66305 - DNA, 20 bp, Artificial Sequence
  Description of Artificial Sequence: Synthetic oligonucleotide
  Target: ATXN1; (-) strand; PAM type: NRG; PAM sequence: GGG
agataaaatggtttgaatgt

SEQ ID NO: 66306 - DNA, 20 bp, Artificial Sequence
  Description of Artificial Sequence: Synthetic oligonucleotide
  Target: ATXN1; (-) strand; PAM type: NRG; PAM sequence: TGG
gagataaaatggtttgaatg

SEQ ID NO: 66307 - DNA, 20 bp, Artificial Sequence
  Description of Artificial Sequence: Synthetic oligonucleotide
  Target: ATXN1; (-) strand; PAM type: NRG; PAM sequence: TGG
gccctctagtggagataaaa

SEQ ID NO: 66308 - DNA, 20 bp, Artificial Sequence
  Description of Artificial Sequence: Synthetic oligonucleotide
  Target: ATXN1; (-) strand; PAM type: NRG; PAM sequence: GAG
tccatcctggccctctagtg

SEQ ID NO: 66309 - DNA, 20 bp, Artificial Sequence
  Description of Artificial Sequence: Synthetic oligonucleotide
  Target: ATXN1; (-) strand; PAM type: NRG; PAM sequence: TGG
tctccatcctggccctctag

SEQ ID NO: 66310 - DNA, 20 bp, Artificial Sequence
  Description of Artificial Sequence: Synthetic oligonucleotide
  Target: ATXN1; (-) strand; PAM type: NRG; PAM sequence: TAG
tcatctccatcctggccctc

SEQ ID NO: 66311 - DNA, 20 bp, Artificial Sequence
  Description of Artificial Sequence: Synthetic oligonucleotide
  Target: ATXN1; (-) strand; PAM type: NRG; PAM sequence: TGG
ctgaaatttcatctccatcc

SEQ ID NO: 66312 - DNA, 20 bp, Artificial Sequence
  Description of Artificial Sequence: Synthetic oligonucleotide
  Target: ATXN1; (-) strand; PAM type: NRG; PAM sequence: AGG
aaatcagcagcaaaactgcc

SEQ ID NO: 66313 - DNA, 20 bp, Artificial Sequence
  Description of Artificial Sequence: Synthetic oligonucleotide
  Target: ATXN1; (-) strand; PAM type: NRG; PAM sequence: CAG
taaatcagcagcaaaactgc

SEQ ID NO: 66314 - DNA, 20 bp, Artificial Sequence
  Description of Artificial Sequence: Synthetic oligonucleotide
  Target: ATXN1; (-) strand; PAM type: NRG; PAM sequence: CAG
aggatcaaatcttaaatcag

SEQ ID NO: 66315 - DNA, 20 bp, Artificial Sequence
  Description of Artificial Sequence: Synthetic oligonucleotide
  Target: ATXN1; (-) strand; PAM type: NRG; PAM sequence: CAG
tttaggatcaaatcttaaat

SEQ ID NO: 66316 - DNA, 20 bp, Artificial Sequence
  Description of Artificial Sequence: Synthetic oligonucleotide
  Target: ATXN1; (-) strand; PAM type: NRG; PAM sequence: AGG
gccctccctccccaaggttt

SEQ ID NO: 66317 - DNA, 20 bp, Artificial Sequence
  Description of Artificial Sequence: Synthetic oligonucleotide
  Target: ATXN1; (-) strand; PAM type: NRG; PAM sequence: TAG
agccctccctccccaaggtt

SEQ ID NO: 66318 - DNA, 20 bp, Artificial Sequence
  Description of Artificial Sequence: Synthetic oligonucleotide
  Target: ATXN1; (-) strand; PAM type: NRG; PAM sequence: AGG
cttcgagccctccctcccca

SEQ ID NO: 66319 - DNA, 20 bp, Artificial Sequence
  Description of Artificial Sequence: Synthetic oligonucleotide
  Target: ATXN1; (-) strand; PAM type: NRG; PAM sequence: AAG
ccttcgagccctccctcccc

SEQ ID NO: 66320 - DNA, 20 bp, Artificial Sequence
  Description of Artificial Sequence: Synthetic oligonucleotide
  Target: ATXN1; (-) strand; PAM type: NRG; PAM sequence: GAG
aaccccacctcccttccttc

SEQ ID NO: 66321 - DNA, 20 bp, Artificial Sequence
  Description of Artificial Sequence: Synthetic oligonucleotide
  Target: ATXN1; (-) strand; PAM type: NRG; PAM sequence: GAG
atatgcccacgtgagtatct

SEQ ID NO: 66322 - DNA, 20 bp, Artificial Sequence
  Description of Artificial Sequence: Synthetic oligonucleotide
  Target: ATXN1; (-) strand; PAM type: NRG; PAM sequence: GAG
ggacccagatatgcccacgt

SEQ ID NO: 66323 - DNA, 20 bp, Artificial Sequence
  Description of Artificial Sequence: Synthetic oligonucleotide
  Target: ATXN1; (-) strand; PAM type: NRG; PAM sequence: CAG
cccagggattgcctgggacc

SEQ ID NO: 66324 - DNA, 20 bp, Artificial Sequence
  Description of Artificial Sequence: Synthetic oligonucleotide
  Target: ATXN1; (-) strand; PAM type: NRG; PAM sequence: GGG
gcagaacccagggattgcct

SEQ ID NO: 66325 - DNA, 20 bp, Artificial Sequence
  Description of Artificial Sequence: Synthetic oligonucleotide
  Target: ATXN1; (-) strand; PAM type: NRG; PAM sequence: TGG
ggcagaacccagggattgcc

SEQ ID NO: 66326 - DNA, 20 bp, Artificial Sequence
  Description of Artificial Sequence: Synthetic oligonucleotide
  Target: ATXN1; (-) strand; PAM type: NRG; PAM sequence: GGG
agagcctgtggcagaaccca

SEQ ID NO: 66327 - DNA, 20 bp, Artificial Sequence
  Description of Artificial Sequence: Synthetic oligonucleotide
  Target: ATXN1; (-) strand; PAM type: NRG; PAM sequence: AGG
gagagcctgtggcagaaccc

SEQ ID NO: 66328 - DNA, 20 bp, Artificial Sequence
  Description of Artificial Sequence: Synthetic oligonucleotide
  Target: ATXN1; (-) strand; PAM type: NRG; PAM sequence: CAG
agagagcctgtggcagaacc

SEQ ID NO: 66329 - DNA, 20 bp, Artificial Sequence
  Description of Artificial Sequence: Synthetic oligonucleotide
  Target: ATXN1; (-) strand; PAM type: NRG; PAM sequence: CAG
atgagatagagagcctgtgg

SEQ ID NO: 66330 - DNA, 20 bp, Artificial Sequence
  Description of Artificial Sequence: Synthetic oligonucleotide
  Target: ATXN1; (-) strand; PAM type: NRG; PAM sequence: TGG
cccatgagatagagagcctg

SEQ ID NO: 66331 - DNA, 20 bp, Artificial Sequence
  Description of Artificial Sequence: Synthetic oligonucleotide
  Target: ATXN1; (-) strand; PAM type: NRG; PAM sequence: GAG
gtgtcatcccatgagataga

SEQ ID NO: 66332 - DNA, 20 bp, Artificial Sequence
  Description of Artificial Sequence: Synthetic oligonucleotide
  Target: ATXN1; (-) strand; PAM type: NRG; PAM sequence: GAG
cagtgtcatcccatgagata

SEQ ID NO: 66333 - DNA, 20 bp, Artificial Sequence
  Description of Artificial Sequence: Synthetic oligonucleotide
  Target: ATXN1; (-) strand; PAM type: NRG; PAM sequence: TAG
aacagtgtcatcccatgaga

SEQ ID NO: 66334 - DNA, 20 bp, Artificial Sequence
  Description of Artificial Sequence: Synthetic oligonucleotide
  Target: ATXN1; (-) strand; PAM type: NRG; PAM sequence: GAG
taataacagtgtcatcccat

SEQ ID NO: 66335 - DNA, 20 bp, Artificial Sequence
  Description of Artificial Sequence: Synthetic oligonucleotide
  Target: ATXN1; (-) strand; PAM type: NRG; PAM sequence: CAG
cgtggatattattttaataa

SEQ ID NO: 66336 - DNA, 20 bp, Artificial Sequence
  Description of Artificial Sequence: Synthetic oligonucleotide
  Target: ATXN1; (-) strand; PAM type: NRG; PAM sequence: TGG
cttggcctcccaaagtgccg

SEQ ID NO: 66337 - DNA, 20 bp, Artificial Sequence
  Description of Artificial Sequence: Synthetic oligonucleotide
  Target: ATXN1; (-) strand; PAM type: NRG; PAM sequence: AAG
ctgcccaccttggcctccca

SEQ ID NO: 66338 - DNA, 20 bp, Artificial Sequence
  Description of Artificial Sequence: Synthetic oligonucleotide
  Target: ATXN1; (-) strand; PAM type: NRG; PAM sequence: TGG
acctcgtgatctgcccacct

SEQ ID NO: 66339 - DNA, 20 bp, Artificial Sequence
  Description of Artificial Sequence: Synthetic oligonucleotide
  Target: ATXN1; (-) strand; PAM type: NRG; PAM sequence: TGG
tttcaccatgttggccaggc

SEQ ID NO: 66340 - DNA, 20 bp, Artificial Sequence
  Description of Artificial Sequence: Synthetic oligonucleotide
  Target: ATXN1; (-) strand; PAM type: NRG; PAM sequence: AGG
ggggtttcaccatgttggcc

SEQ ID NO: 66341 - DNA, 20 bp, Artificial Sequence
  Description of Artificial Sequence: Synthetic oligonucleotide
  Target: ATXN1; (-) strand; PAM type: NRG; PAM sequence: CAG
tggggtttcaccatgttggc

SEQ ID NO: 66342 - DNA, 20 bp, Artificial Sequence
  Description of Artificial Sequence: Synthetic oligonucleotide
  Target: ATXN1; (-) strand; PAM type: NRG; PAM sequence: TGG
gagatggggtttcaccatgt

SEQ ID NO: 66343 - DNA, 20 bp, Artificial Sequence
  Description of Artificial Sequence: Synthetic oligonucleotide
  Target: ATXN1; (-) strand; PAM type: NRG; PAM sequence: GGG
ttgtatttttagtagagatg

SEQ ID NO: 66344 - DNA, 20 bp, Artificial Sequence
  Description of Artificial Sequence: Synthetic oligonucleotide
  Target: ATXN1; (-) strand; PAM type: NRG; PAM sequence: GGG
tttgtatttttagtagagat

SEQ ID NO: 66345 - DNA, 20 bp, Artificial Sequence
  Description of Artificial Sequence: Synthetic oligonucleotide
  Target: ATXN1; (-) strand; PAM type: NRG; PAM sequence: TGG
ttttgtatttttagtagaga

SEQ ID NO: 66346 - DNA, 20 bp, Artificial Sequence
  Description of Artificial Sequence: Synthetic oligonucleotide
  Target: ATXN1; (-) strand; PAM type: NRG; PAM sequence: GAG
aattttttgtatttttagta

SEQ ID NO: 66347 - DNA, 20 bp, Artificial Sequence
  Description of Artificial Sequence: Synthetic oligonucleotide
  Target: ATXN1; (-) strand; PAM type: NRG; PAM sequence: TAG
ctaattttttgtatttttag

SEQ ID NO: 66348 - DNA, 20 bp, Artificial Sequence
  Description of Artificial Sequence: Synthetic oligonucleotide
  Target: ATXN1; (-) strand; PAM type: NRG; PAM sequence: TAG
tggctaattttttgtatttt

SEQ ID NO: 66349 - DNA, 20 bp, Artificial Sequence
  Description of Artificial Sequence: Synthetic oligonucleotide
  Target: ATXN1; (-) strand; PAM type: NRG; PAM sequence: TGG
cagcctcccaccaccacgcc

SEQ ID NO: 66350 - DNA, 20 bp, Artificial Sequence
  Description of Artificial Sequence: Synthetic oligonucleotide
  Target: ATXN1; (-) strand; PAM type: NRG; PAM sequence: CAG
ctcccaagtagctgggatta

SEQ ID NO: 66351 - DNA, 20 bp, Artificial Sequence
  Description of Artificial Sequence: Synthetic oligonucleotide
  Target: ATXN1; (-) strand; PAM type: NRG; PAM sequence: GGG
cctcagcctcccaagtagct

SEQ ID NO: 66352 - DNA, 20 bp, Artificial Sequence
  Description of Artificial Sequence: Synthetic oligonucleotide
  Target: ATXN1; (-) strand; PAM type: NRG; PAM sequence: TGG
gcctcagcctcccaagtagc

SEQ ID NO: 66353 - DNA, 20 bp, Artificial Sequence
  Description of Artificial Sequence: Synthetic oligonucleotide
  Target: ATXN1; (-) strand; PAM type: NRG; PAM sequence: TAG
acctgcctcagcctcccaag

SEQ ID NO: 66354 - DNA, 20 bp, Artificial Sequence
  Description of Artificial Sequence: Synthetic oligonucleotide
  Target: ATXN1; (-) strand; PAM type: NRG; PAM sequence: AAG
ttcacctgcctcagcctccc

SEQ ID NO: 66355 - DNA, 20 bp, Artificial Sequence
  Description of Artificial Sequence: Synthetic oligonucleotide
  Target: ATXN1; (-) strand; PAM type: NRG; PAM sequence: CAG
ttcaagtgattcacctgcct

SEQ ID NO: 66356 - DNA, 20 bp, Artificial Sequence
  Description of Artificial Sequence: Synthetic oligonucleotide
  Target: ATXN1; (-) strand; PAM type: NRG; PAM sequence: AAG
aacctctgcctcccgggttc

SEQ ID NO: 66357 - DNA, 20 bp, Artificial Sequence
  Description of Artificial Sequence: Synthetic oligonucleotide
  Target: ATXN1; (-) strand; PAM type: NRG; PAM sequence: GGG
cactgcaacctctgcctccc

SEQ ID NO: 66358 - DNA, 20 bp, Artificial Sequence
  Description of Artificial Sequence: Synthetic oligonucleotide
  Target: ATXN1; (-) strand; PAM type: NRG; PAM sequence: CGG
tcactgcaacctctgcctcc

SEQ ID NO: 66359 - DNA, 20 bp, Artificial Sequence
  Description of Artificial Sequence: Synthetic oligonucleotide
  Target: ATXN1; (-) strand; PAM type: NRG; PAM sequence: CGG
ggagtgcagtggcgtgatct

SEQ ID NO: 66360 - DNA, 20 bp, Artificial Sequence
  Description of Artificial Sequence: Synthetic oligonucleotide
  Target: ATXN1; (-) strand; PAM type: NRG; PAM sequence: TGG
gtcgccaggctggagtgcag

SEQ ID NO: 66361 - DNA, 20 bp, Artificial Sequence
  Description of Artificial Sequence: Synthetic oligonucleotide
  Target: ATXN1; (-) strand; PAM type: NRG; PAM sequence: CAG
tctgtcgccaggctggagtg

SEQ ID NO: 66362 - DNA, 20 bp, Artificial Sequence
  Description of Artificial Sequence: Synthetic oligonucleotide
  Target: ATXN1; (-) strand; PAM type: NRG; PAM sequence: GAG
ctcgctctgtcgccaggctg

SEQ ID NO: 66363 - DNA, 20 bp, Artificial Sequence
  Description of Artificial Sequence: Synthetic oligonucleotide
  Target: ATXN1; (-) strand; PAM type: NRG; PAM sequence: TGG
gcctcgctctgtcgccaggc

SEQ ID NO: 66364 - DNA, 20 bp, Artificial Sequence
  Description of Artificial Sequence: Synthetic oligonucleotide
  Target: ATXN1; (-) strand; PAM type: NRG; PAM sequence: AGG
cagagcctcgctctgtcgcc

SEQ ID NO: 66365 - DNA, 20 bp, Artificial Sequence
  Description of Artificial Sequence: Synthetic oligonucleotide
  Target: ATXN1; (-) strand; PAM type: NRG; PAM sequence: CAG
acagagcctcgctctgtcgc

SEQ ID NO: 66366 - DNA, 20 bp, Artificial Sequence
  Description of Artificial Sequence: Synthetic oligonucleotide
  Target: ATXN1; (-) strand; PAM type: NRG; PAM sequence: GAG
attattattattttgagaca

SEQ ID NO: 66367 - DNA, 20 bp, Artificial Sequence
  Description of Artificial Sequence: Synthetic oligonucleotide
  Target: ATXN1; (-) strand; PAM type: NRG; PAM sequence: CAG
ttattattattattttgaga

SEQ ID NO: 66368 - DNA, 20 bp, Artificial Sequence
  Description of Artificial Sequence: Synthetic oligonucleotide
  Target: ATXN1; (-) strand; PAM type: NRG; PAM sequence: GAG
attattattattattatttt

SEQ ID NO: 66369 - DNA, 20 bp, Artificial Sequence
  Description of Artificial Sequence: Synthetic oligonucleotide
  Target: ATXN1; (-) strand; PAM type: NRG; PAM sequence: TGG
gtgtcctgtgttgtacttta

SEQ ID NO: 66370 - DNA, 20 bp, Artificial Sequence
  Description of Artificial Sequence: Synthetic oligonucleotide
  Target: ATXN1; (-) strand; PAM type: NRG; PAM sequence: AGG
tgagcctaggtggctaccga

SEQ ID NO: 66371 - DNA, 20 bp, Artificial Sequence
  Description of Artificial Sequence: Synthetic oligonucleotide
  Target: ATXN1; (-) strand; PAM type: NRG; PAM sequence: AAG
ttgagcctaggtggctaccg

SEQ ID NO: 66372 - DNA, 20 bp, Artificial Sequence
  Description of Artificial Sequence: Synthetic oligonucleotide
  Target: ATXN1; (-) strand; PAM type: NRG; PAM sequence: TGG
acccaatttttgagcctagg

SEQ ID NO: 66373 - DNA, 20 bp, Artificial Sequence
  Description of Artificial Sequence: Synthetic oligonucleotide
  Target: ATXN1; (-) strand; PAM type: NRG; PAM sequence: AGG
ataacccaatttttgagcct

SEQ ID NO: 66374 - DNA, 20 bp, Artificial Sequence
  Description of Artificial Sequence: Synthetic oligonucleotide
  Target: ATXN1; (-) strand; PAM type: NRG; PAM sequence: TAG
gataacccaatttttgagcc

SEQ ID NO: 66375 - DNA, 20 bp, Artificial Sequence
  Description of Artificial Sequence: Synthetic oligonucleotide
  Target: ATXN1; (-) strand; PAM type: NRG; PAM sequence: GAG
tcagagataacccaattttt

SEQ ID NO: 66376 - DNA, 20 bp, Artificial Sequence
  Description of Artificial Sequence: Synthetic oligonucleotide
  Target: ATXN1; (-) strand; PAM type: NRG; PAM sequence: GAG
caatgaaaggaatggagtca

SEQ ID NO: 66377 - DNA, 20 bp, Artificial Sequence
  Description of Artificial Sequence: Synthetic oligonucleotide
  Target: ATXN1; (-) strand; PAM type: NRG; PAM sequence: CAG
aacaatgaaaggaatggagt

SEQ ID NO: 66378 - DNA, 20 bp, Artificial Sequence
  Description of Artificial Sequence: Synthetic oligonucleotide
  Target: ATXN1; (-) strand; PAM type: NRG; PAM sequence: GAG
tagaaacaatgaaaggaatg

SEQ ID NO: 66379 - DNA, 20 bp, Artificial Sequence
  Description of Artificial Sequence: Synthetic oligonucleotide
  Target: ATXN1; (-) strand; PAM type: NRG; PAM sequence: TGG
attagaaacaatgaaaggaa

SEQ ID NO: 66380 - DNA, 20 bp, Artificial Sequence
  Description of Artificial Sequence: Synthetic oligonucleotide
  Target: ATXN1; (-) strand; PAM type: NRG; PAM sequence: AGG
tgggtattagaaacaatgaa

SEQ ID NO: 66381 - DNA, 20 bp, Artificial Sequence
  Description of Artificial Sequence: Synthetic oligonucleotide
  Target: ATXN1; (-) strand; PAM type: NRG; PAM sequence: AAG
ctgggtattagaaacaatga

SEQ ID NO: 66382 - DNA, 20 bp, Artificial Sequence
  Description of Artificial Sequence: Synthetic oligonucleotide
  Target: ATXN1; (-) strand; PAM type: NRG; PAM sequence: TAG
caaactgagcaactgggtat

SEQ ID NO: 66383 - DNA, 20 bp, Artificial Sequence
  Description of Artificial Sequence: Synthetic oligonucleotide
  Target: ATXN1; (-) strand; PAM type: NRG; PAM sequence: GGG
gttgaacaaactgagcaact

SEQ ID NO: 66384 - DNA, 20 bp, Artificial Sequence
  Description of Artificial Sequence: Synthetic oligonucleotide
  Target: ATXN1; (-) strand; PAM type: NRG; PAM sequence: TGG
agttgaacaaactgagcaac

SEQ ID NO: 66385 - DNA, 20 bp, Artificial Sequence
  Description of Artificial Sequence: Synthetic oligonucleotide
  Target: ATXN1; (-) strand; PAM type: NRG; PAM sequence: GAG
aagaaagagttgaacaaact

SEQ ID NO: 66386 - DNA, 20 bp, Artificial Sequence
  Description of Artificial Sequence: Synthetic oligonucleotide
  Target: ATXN1; (-) strand; PAM type: NRG; PAM sequence: GAG
tggaggacactacaaagaaa

SEQ ID NO: 66387 - DNA, 20 bp, Artificial Sequence
  Description of Artificial Sequence: Synthetic oligonucleotide
  Target: ATXN1; (-) strand; PAM type: NRG; PAM sequence: AAG
tgtggaggacactacaaaga

SEQ ID NO: 66388 - DNA, 20 bp, Artificial Sequence
  Description of Artificial Sequence: Synthetic oligonucleotide
  Target: ATXN1; (-) strand; PAM type: NRG; PAM sequence: AAG
ccgatgtggaggacactaca

SEQ ID NO: 66389 - DNA, 20 bp, Artificial Sequence
  Description of Artificial Sequence: Synthetic oligonucleotide
  Target: ATXN1; (-) strand; PAM type: NRG; PAM sequence: AGG
ttacaaagggaccgatgtgg

SEQ ID NO: 66390 - DNA, 20 bp, Artificial Sequence
  Description of Artificial Sequence: Synthetic oligonucleotide
  Target: ATXN1; (-) strand; PAM type: NRG; PAM sequence: GAG
gttacaaagggaccgatgtg

SEQ ID NO: 66391 - DNA, 20 bp, Artificial Sequence
  Description of Artificial Sequence: Synthetic oligonucleotide
  Target: ATXN1; (-) strand; PAM type: NRG; PAM sequence: TGG
gtgttacaaagggaccgatg

SEQ ID NO: 66392 - DNA, 20 bp, Artificial Sequence
  Description of Artificial Sequence: Synthetic oligonucleotide
  Target: ATXN1; (-) strand; PAM type: NRG; PAM sequence: GGG
tactgtgggcgtgttacaaa

SEQ ID NO: 66393 - DNA, 20 bp, Artificial Sequence
  Description of Artificial Sequence: Synthetic oligonucleotide
  Target: ATXN1; (-) strand; PAM type: NRG; PAM sequence: AGG
ctactgtgggcgtgttacaa

SEQ ID NO: 66394 - DNA, 20 bp, Artificial Sequence
  Description of Artificial Sequence: Synthetic oligonucleotide
  Target: ATXN1; (-) strand; PAM type: NRG; PAM sequence: AAG
actactgtgggcgtgttaca

SEQ ID NO: 66395 - DNA, 20 bp, Artificial Sequence
  Description of Artificial Sequence: Synthetic oligonucleotide
  Target: ATXN1; (-) strand; PAM type: NRG; PAM sequence: GGG
aaggttttgagaactactgt

SEQ ID NO: 66396 - DNA, 20 bp, Artificial Sequence
  Description of Artificial Sequence: Synthetic oligonucleotide
  Target: ATXN1; (-) strand; PAM type: NRG; PAM sequence: TGG
taaggttttgagaactactg

SEQ ID NO: 66397 - DNA, 20 bp, Artificial Sequence
  Description of Artificial Sequence: Synthetic oligonucleotide
  Target: ATXN1; (-) strand; PAM type: NRG; PAM sequence: GAG
gcgtaaggagataaggtttt

SEQ ID NO: 66398 - DNA, 20 bp, Artificial Sequence
  Description of Artificial Sequence: Synthetic oligonucleotide
  Target: ATXN1; (-) strand; PAM type: NRG; PAM sequence: AGG
gttgcaggcgtaaggagata

SEQ ID NO: 66399 - DNA, 20 bp, Artificial Sequence
  Description of Artificial Sequence: Synthetic oligonucleotide
  Target: ATXN1; (-) strand; PAM type: NRG; PAM sequence: AAG
agttgcaggcgtaaggagat

SEQ ID NO: 66400 - DNA, 20 bp, Artificial Sequence
  Description of Artificial Sequence: Synthetic oligonucleotide
  Target: ATXN1; (-) strand; PAM type: NRG; PAM sequence: GAG
aaggcagttgcaggcgtaag

SEQ ID NO: 66401 - DNA, 20 bp, Artificial Sequence
  Description of Artificial Sequence: Synthetic oligonucleotide
  Target: ATXN1; (-) strand; PAM type: NRG; PAM sequence: AGG
ggaaggcagttgcaggcgta

SEQ ID NO: 66402 - DNA, 20 bp, Artificial Sequence
  Description of Artificial Sequence: Synthetic oligonucleotide
  Target: ATXN1; (-) strand; PAM type: NRG; PAM sequence: AAG
gggaaggcagttgcaggcgt

SEQ ID NO: 66403 - DNA, 20 bp, Artificial Sequence
  Description of Artificial Sequence: Synthetic oligonucleotide
  Target: ATXN1; (-) strand; PAM type: NRG; PAM sequence: AGG
cccagagggaaggcagttgc

SEQ ID NO: 66404 - DNA, 20 bp, Artificial Sequence
  Description of Artificial Sequence: Synthetic oligonucleotide
  Target: ATXN1; (-) strand; PAM type: NRG; PAM sequence: CAG
tcccagagggaaggcagttg

SEQ ID NO: 66405 - DNA, 20 bp, Artificial Sequence
  Description of Artificial Sequence: Synthetic oligonucleotide
  Target: ATXN1; (-) strand; PAM type: NRG; PAM sequence: CAG
ctggggtcccagagggaagg

SEQ ID NO: 66406 - DNA, 20 bp, Artificial Sequence
  Description of Artificial Sequence: Synthetic oligonucleotide
  Target: ATXN1; (-) strand; PAM type: NRG; PAM sequence: AGG
agactggggtcccagaggga

SEQ ID NO: 66407 - DNA, 20 bp, Artificial Sequence
  Description of Artificial Sequence: Synthetic oligonucleotide
  Target: ATXN1; (-) strand; PAM type: NRG; PAM sequence: AAG
gagactggggtcccagaggg

SEQ ID NO: 66408 - DNA, 20 bp, Artificial Sequence
  Description of Artificial Sequence: Synthetic oligonucleotide
  Target: ATXN1; (-) strand; PAM type: NRG; PAM sequence: GGG
aaagagactggggtcccaga

SEQ ID NO: 66409 - DNA, 20 bp, Artificial Sequence
  Description of Artificial Sequence: Synthetic oligonucleotide
  Target: ATXN1; (-) strand; PAM type: NRG; PAM sequence: AGG
aaaagagactggggtcccag

SEQ ID NO: 66410 - DNA, 20 bp, Artificial Sequence
  Description of Artificial Sequence: Synthetic oligonucleotide
  Target: ATXN1; (-) strand; PAM type: NRG; PAM sequence: GAG
aaaaagagactggggtccca

SEQ ID NO: 66411 - DNA, 20 bp, Artificial Sequence
  Description of Artificial Sequence: Synthetic oligonucleotide
  Target: ATXN1; (-) strand; PAM type: NRG; PAM sequence: CAG
gaaaaaagagactggggtcc

SEQ ID NO: 66412 - DNA, 20 bp, Artificial Sequence
  Description of Artificial Sequence: Synthetic oligonucleotide
  Target: ATXN1; (-) strand; PAM type: NRG; PAM sequence: GGG
ggtggagaaaaaagagactg

SEQ ID NO: 66413 - DNA, 20 bp, Artificial Sequence
  Description of Artificial Sequence: Synthetic oligonucleotide
  Target: ATXN1; (-) strand; PAM type: NRG; PAM sequence: GGG
tggtggagaaaaaagagact

SEQ ID NO: 66414 - DNA, 20 bp, Artificial Sequence
  Description of Artificial Sequence: Synthetic oligonucleotide
  Target: ATXN1; (-) strand; PAM type: NRG; PAM sequence: TGG
atggtggagaaaaaagagac

SEQ ID NO: 66415 - DNA, 20 bp, Artificial Sequence
  Description of Artificial Sequence: Synthetic oligonucleotide
  Target: ATXN1; (-) strand; PAM type: NRG; PAM sequence: GAG
gtgagatggtggagaaaaaa

SEQ ID NO: 66416 - DNA, 20 bp, Artificial Sequence
  Description of Artificial Sequence: Synthetic oligonucleotide
  Target: ATXN1; (-) strand; PAM type: NRG; PAM sequence: AAG
ccgtgagatggtggagaaaa

SEQ ID NO: 66417 - DNA, 20 bp, Artificial Sequence
  Description of Artificial Sequence: Synthetic oligonucleotide
  Target: ATXN1; (-) strand; PAM type: NRG; PAM sequence: GAG
ccatatcccgtgagatggtg

SEQ ID NO: 66418 - DNA, 20 bp, Artificial Sequence
  Description of Artificial Sequence: Synthetic oligonucleotide
  Target: ATXN1; (-) strand; PAM type: NRG; PAM sequence: TGG
gtccatatcccgtgagatgg

SEQ ID NO: 66419 - DNA, 20 bp, Artificial Sequence
  Description of Artificial Sequence: Synthetic oligonucleotide
  Target: ATXN1; (-) strand; PAM type: NRG; PAM sequence: TGG
tgtgtccatatcccgtgaga

SEQ ID NO: 66420 - DNA, 20 bp, Artificial Sequence
  Description of Artificial Sequence: Synthetic oligonucleotide
  Target: ATXN1; (-) strand; PAM type: NRG; PAM sequence: GAG
cagctgtgtccatatcccgt

SEQ ID NO: 66421 - DNA, 20 bp, Artificial Sequence
  Description of Artificial Sequence: Synthetic oligonucleotide
  Target: ATXN1; (-) strand; PAM type: NRG; PAM sequence: CAG
ttttagtgagatgagcttta

SEQ ID NO: 66422 - DNA, 20 bp, Artificial Sequence
  Description of Artificial Sequence: Synthetic oligonucleotide
  Target: ATXN1; (-) strand; PAM type: NRG; PAM sequence: GAG
gaaccatgttttagtgagat

SEQ ID NO: 66423 - DNA, 20 bp, Artificial Sequence
  Description of Artificial Sequence: Synthetic oligonucleotide
  Target: ATXN1; (-) strand; PAM type: NRG; PAM sequence: GAG
gtgaagaaccatgttttagt

SEQ ID NO: 66424 - DNA, 20 bp, Artificial Sequence
  Description of Artificial Sequence: Synthetic oligonucleotide
  Target: ATXN1; (-) strand; PAM type: NRG; PAM sequence: TAG
ggatgtgaagaaccatgttt

SEQ ID NO: 66425 - DNA, 20 bp, Artificial Sequence
  Description of Artificial Sequence: Synthetic oligonucleotide
  Target: ATXN1; (-) strand; PAM type: NRG; PAM sequence: AAG
ttcaacaagttggggatgtg

SEQ ID NO: 66426 - DNA, 20 bp, Artificial Sequence
  Description of Artificial Sequence: Synthetic oligonucleotide
  Target: ATXN1; (-) strand; PAM type: NRG; PAM sequence: GGG
ggagatttttcaacaagttg

SEQ ID NO: 66427 - DNA, 20 bp, Artificial Sequence
  Description of Artificial Sequence: Synthetic oligonucleotide
  Target: ATXN1; (-) strand; PAM type: NRG; PAM sequence: GGG
tggagatttttcaacaagtt

SEQ ID NO: 66428 - DNA, 20 bp, Artificial Sequence
  Description of Artificial Sequence: Synthetic oligonucleotide
  Target: ATXN1; (-) strand; PAM type: NRG; PAM sequence: TGG
ctggagatttttcaacaagt

SEQ ID NO: 66429 - DNA, 20 bp, Artificial Sequence
  Description of Artificial Sequence: Synthetic oligonucleotide
  Target: ATXN1; (-) strand; PAM type: NRG; PAM sequence: AAG
gtcactggagatttttcaac

SEQ ID NO: 66430 - DNA, 20 bp, Artificial Sequence
  Description of Artificial Sequence: Synthetic oligonucleotide
  Target: ATXN1; (-) strand; PAM type: NRG; PAM sequence: GAG
ctgggggttggcagtcactg

SEQ ID NO: 66431 - DNA, 20 bp, Artificial Sequence
  Description of Artificial Sequence: Synthetic oligonucleotide
  Target: ATXN1; (-) strand; PAM type: NRG; PAM sequence: TGG
aactgggggttggcagtcac

SEQ ID NO: 66432 - DNA, 20 bp, Artificial Sequence
  Description of Artificial Sequence: Synthetic oligonucleotide
  Target: ATXN1; (-) strand; PAM type: NRG; PAM sequence: CAG
ggtcctgaactgggggttgg

SEQ ID NO: 66433 - DNA, 20 bp, Artificial Sequence
  Description of Artificial Sequence: Synthetic oligonucleotide
  Target: ATXN1; (-) strand; PAM type: NRG; PAM sequence: TGG
aggggtcctgaactgggggt

SEQ ID NO: 66434 - DNA, 20 bp, Artificial Sequence
  Description of Artificial Sequence: Synthetic oligonucleotide
  Target: ATXN1; (-) strand; PAM type: NRG; PAM sequence: GGG
ggggaggggtcctgaactgg

SEQ ID NO: 66435 - DNA, 20 bp, Artificial Sequence
  Description of Artificial Sequence: Synthetic oligonucleotide
  Target: ATXN1; (-) strand; PAM type: NRG; PAM sequence: GGG
tggggaggggtcctgaactg

SEQ ID NO: 66436 - DNA, 20 bp, Artificial Sequence
  Description of Artificial Sequence: Synthetic oligonucleotide
  Target: ATXN1; (-) strand; PAM type: NRG; PAM sequence: GGG
gtggggaggggtcctgaact

SEQ ID NO: 66437 - DNA, 20 bp, Artificial Sequence
  Description of Artificial Sequence: Synthetic oligonucleotide
  Target: ATXN1; (-) strand; PAM type: NRG; PAM sequence: TGG
tgtggggaggggtcctgaac

SEQ ID NO: 66438 - DNA, 20 bp, Artificial Sequence
  Description of Artificial Sequence: Synthetic oligonucleotide
  Target: ATXN1; (-) strand; PAM type: NRG; PAM sequence: GGG
atgggcagtgctgtggggag

SEQ ID NO: 66439 - DNA, 20 bp, Artificial Sequence
  Description of Artificial Sequence: Synthetic oligonucleotide
  Target: ATXN1; (-) strand; PAM type: NRG; PAM sequence: GGG
aatgggcagtgctgtgggga

SEQ ID NO: 66440 - DNA, 20 bp, Artificial Sequence
  Description of Artificial Sequence: Synthetic oligonucleotide
  Target: ATXN1; (-) strand; PAM type: NRG; PAM sequence: AGG
aaatgggcagtgctgtgggg

SEQ ID NO: 66441 - DNA, 20 bp, Artificial Sequence
  Description of Artificial Sequence: Synthetic oligonucleotide
  Target: ATXN1; (-) strand; PAM type: NRG; PAM sequence: GAG
taaatgggcagtgctgtggg

SEQ ID NO: 66442 - DNA, 20 bp, Artificial Sequence
  Description of Artificial Sequence: Synthetic oligonucleotide
  Target: ATXN1; (-) strand; PAM type: NRG; PAM sequence: GGG
tgtaaatgggcagtgctgtg

SEQ ID NO: 66443 - DNA, 20 bp, Artificial Sequence
  Description of Artificial Sequence: Synthetic oligonucleotide
  Target: ATXN1; (-) strand; PAM type: NRG; PAM sequence: GGG
gtgtaaatgggcagtgctgt

SEQ ID NO: 66444 - DNA, 20 bp, Artificial Sequence
  Description of Artificial Sequence: Synthetic oligonucleotide
  Target: ATXN1; (-) strand; PAM type: NRG; PAM sequence: TGG
tgtgtaaatgggcagtgctg

SEQ ID NO: 66445 - DNA, 20 bp, Artificial Sequence
  Description of Artificial Sequence: Synthetic oligonucleotide
  Target: ATXN1; (-) strand; PAM type: NRG; PAM sequence: CAG
gtggtcactgtgtaaatggg

SEQ ID NO: 66446 - DNA, 20 bp, Artificial Sequence
  Description of Artificial Sequence: Synthetic oligonucleotide
  Target: ATXN1; (-) strand; PAM type: NRG; PAM sequence: GGG
ggagtggtcactgtgtaaat

SEQ ID NO: 66447 - DNA, 20 bp, Artificial Sequence
  Description of Artificial Sequence: Synthetic oligonucleotide
  Target: ATXN1; (-) strand; PAM type: NRG; PAM sequence: TGG
aggagtggtcactgtgtaaa

SEQ ID NO: 66448 - DNA, 20 bp, Artificial Sequence
  Description of Artificial Sequence: Synthetic oligonucleotide
  Target: ATXN1; (-) strand; PAM type: NRG; PAM sequence: TGG
tagtggtagggagggaggag

SEQ ID NO: 66449 - DNA, 20 bp, Artificial Sequence
  Description of Artificial Sequence: Synthetic oligonucleotide
  Target: ATXN1; (-) strand; PAM type: NRG; PAM sequence: GAG
tggtagtggtagggagggag

SEQ ID NO: 66450 - DNA, 20 bp, Artificial Sequence
  Description of Artificial Sequence: Synthetic oligonucleotide
  Target: ATXN1; (-) strand; PAM type: NRG; PAM sequence: AGG
ggtggtagtggtagggaggg

SEQ ID NO: 66451 - DNA, 20 bp, Artificial Sequence
  Description of Artificial Sequence: Synthetic oligonucleotide
  Target: ATXN1; (-) strand; PAM type: NRG; PAM sequence: GAG
gggtggtagtggtagggagg

SEQ ID NO: 66452 - DNA, 20 bp, Artificial Sequence
  Description of Artificial Sequence: Synthetic oligonucleotide
  Target: ATXN1; (-) strand; PAM type: NRG; PAM sequence: GGG
gggggtggtagtggtaggga

SEQ ID NO: 66453 - DNA, 20 bp, Artificial Sequence
  Description of Artificial Sequence: Synthetic oligonucleotide
  Target: ATXN1; (-) strand; PAM type: NRG; PAM sequence: AGG
tgggggtggtagtggtaggg

SEQ ID NO: 66454 - DNA, 20 bp, Artificial Sequence
  Description of Artificial Sequence: Synthetic oligonucleotide
  Target: ATXN1; (-) strand; PAM type: NRG; PAM sequence: GAG
ttgggggtggtagtggtagg

SEQ ID NO: 66455 - DNA, 20 bp, Artificial Sequence
  Description of Artificial Sequence: Synthetic oligonucleotide
  Target: ATXN1; (-) strand; PAM type: NRG; PAM sequence: GGG
gtttgggggtggtagtggta

SEQ ID NO: 66456 - DNA, 20 bp, Artificial Sequence
  Description of Artificial Sequence: Synthetic oligonucleotide
  Target: ATXN1; (-) strand; PAM type: NRG; PAM sequence: AGG
ggtttgggggtggtagtggt

SEQ ID NO: 66457 - DNA, 20 bp, Artificial Sequence
  Description of Artificial Sequence: Synthetic oligonucleotide
  Target: ATXN1; (-) strand; PAM type: NRG; PAM sequence: TAG
tggtttgggggtggtagtgg

SEQ ID NO: 66458 - DNA, 20 bp, Artificial Sequence
  Description of Artificial Sequence: Synthetic oligonucleotide
  Target: ATXN1; (-) strand; PAM type: NRG; PAM sequence: TGG
ttgtggtttgggggtggtag

SEQ ID NO: 66459 - DNA, 20 bp, Artificial Sequence
  Description of Artificial Sequence: Synthetic oligonucleotide
  Target: ATXN1; (-) strand; PAM type: NRG; PAM sequence: TAG
ggtttgtggtttgggggtgg

SEQ ID NO: 66460 - DNA, 20 bp, Artificial Sequence
  Description of Artificial Sequence: Synthetic oligonucleotide
  Target: ATXN1; (-) strand; PAM type: NRG; PAM sequence: TGG
gttggtttgtggtttggggg

SEQ ID NO: 66461 - DNA, 20 bp, Artificial Sequence
  Description of Artificial Sequence: Synthetic oligonucleotide
  Target: ATXN1; (-) strand; PAM type: NRG; PAM sequence: GGG
cttgttggtttgtggtttgg

SEQ ID NO: 66462 - DNA, 20 bp, Artificial Sequence
  Description of Artificial Sequence: Synthetic oligonucleotide
  Target: ATXN1; (-) strand; PAM type: NRG; PAM sequence: GGG
tcttgttggtttgtggtttg

SEQ ID NO: 66463 - DNA, 20 bp, Artificial Sequence
  Description of Artificial Sequence: Synthetic oligonucleotide
  Target: ATXN1; (-) strand; PAM type: NRG; PAM sequence: GGG
ttcttgttggtttgtggttt

SEQ ID NO: 66464 - DNA, 20 bp, Artificial Sequence
  Description of Artificial Sequence: Synthetic oligonucleotide
  Target: ATXN1; (-) strand; PAM type: NRG; PAM sequence: TGG
cttcttgttggtttgtggtt

SEQ ID NO: 66465 - DNA, 20 bp, Artificial Sequence
  Description of Artificial Sequence: Synthetic oligonucleotide
  Target: ATXN1; (-) strand; PAM type: NRG; PAM sequence: TGG
cggtgcttcttgttggtttg

SEQ ID NO: 66466 - DNA, 20 bp, Artificial Sequence
  Description of Artificial Sequence: Synthetic oligonucleotide
  Target: ATXN1; (-) strand; PAM type: NRG; PAM sequence: TGG
caggacacggtgcttcttgt

SEQ ID NO: 66467 - DNA, 20 bp, Artificial Sequence
  Description of Artificial Sequence: Synthetic oligonucleotide
  Target: ATXN1; (-) strand; PAM type: NRG; PAM sequence: CGG
actgacagattcccaggaca

SEQ ID NO: 66468 - DNA, 20 bp, Artificial Sequence
  Description of Artificial Sequence: Synthetic oligonucleotide
  Target: ATXN1; (-) strand; PAM type: NRG; PAM sequence: AGG
ccagccactgacagattccc

SEQ ID NO: 66469 - DNA, 20 bp, Artificial Sequence
  Description of Artificial Sequence: Synthetic oligonucleotide
  Target: ATXN1; (-) strand; PAM type: NRG; PAM sequence: CAG
cccagccactgacagattcc

SEQ ID NO: 66470 - DNA, 20 bp, Artificial Sequence
  Description of Artificial Sequence: Synthetic oligonucleotide
  Target: ATXN1; (-) strand; PAM type: NRG; PAM sequence: CAG
gactgagtcccagccactga

SEQ ID NO: 66471 - DNA, 20 bp, Artificial Sequence
  Description of Artificial Sequence: Synthetic oligonucleotide
  Target: ATXN1; (-) strand; PAM type: NRG; PAM sequence: CAG
ctgcgaggaggactgagtcc

SEQ ID NO: 66472 - DNA, 20 bp, Artificial Sequence
  Description of Artificial Sequence: Synthetic oligonucleotide
  Target: ATXN1; (-) strand; PAM type: NRG; PAM sequence: GAG
acctgcctgcgaggaggact

SEQ ID NO: 66473 - DNA, 20 bp, Artificial Sequence
  Description of Artificial Sequence: Synthetic oligonucleotide
  Target: ATXN1; (-) strand; PAM type: NRG; PAM sequence: AGG
agagaaacctgcctgcgagg

SEQ ID NO: 66474 - DNA, 20 bp, Artificial Sequence
  Description of Artificial Sequence: Synthetic oligonucleotide
  Target: ATXN1; (-) strand; PAM type: NRG; PAM sequence: GAG
aagagaaacctgcctgcgag

SEQ ID NO: 66475 - DNA, 20 bp, Artificial Sequence
  Description of Artificial Sequence: Synthetic oligonucleotide
  Target: ATXN1; (-) strand; PAM type: NRG; PAM sequence: AGG
tgaagagaaacctgcctgcg

SEQ ID NO: 66476 - DNA, 20 bp, Artificial Sequence
  Description of Artificial Sequence: Synthetic oligonucleotide
  Target: ATXN1; (-) strand; PAM type: NRG; PAM sequence: GAG
gtgaagagaaacctgcctgc

SEQ ID NO: 66477 - DNA, 20 bp, Artificial Sequence
  Description of Artificial Sequence: Synthetic oligonucleotide
  Target: ATXN1; (-) strand; PAM type: NRG; PAM sequence: GAG
cgtgtgtattatgtggtgaa

SEQ ID NO: 66478 - DNA, 20 bp, Artificial Sequence
  Description of Artificial Sequence: Synthetic oligonucleotide
  Target: ATXN1; (-) strand; PAM type: NRG; PAM sequence: AAG
tacgtgtgtattatgtggtg

SEQ ID NO: 66479 - DNA, 20 bp, Artificial Sequence
  Description of Artificial Sequence: Synthetic oligonucleotide
  Target: ATXN1; (-) strand; PAM type: NRG; PAM sequence: TGG
ttcgctacgtgtgtattatg

SEQ ID NO: 66480 - DNA, 20 bp, Artificial Sequence
  Description of Artificial Sequence: Synthetic oligonucleotide
  Target: ATXN1; (-) strand; PAM type: NRG; PAM sequence: GGG
atgtgtcagaccaaagaatg

SEQ ID NO: 66481 - DNA, 20 bp, Artificial Sequence
  Description of Artificial Sequence: Synthetic oligonucleotide
  Target: ATXN1; (-) strand; PAM type: NRG; PAM sequence: GGG
catgtgtcagaccaaagaat

SEQ ID NO: 66482 - DNA, 20 bp, Artificial Sequence
  Description of Artificial Sequence: Synthetic oligonucleotide
  Target: ATXN1; (-) strand; PAM type: NRG; PAM sequence: TGG
acatgtgtcagaccaaagaa

SEQ ID NO: 66483 - DNA, 20 bp, Artificial Sequence
  Description of Artificial Sequence: Synthetic oligonucleotide
  Target: ATXN1; (-) strand; PAM type: NRG; PAM sequence: AAG
acaccacatgtgtcagacca

SEQ ID NO: 66484 - DNA, 20 bp, Artificial Sequence
  Description of Artificial Sequence: Synthetic oligonucleotide
  Target: ATXN1; (-) strand; PAM type: NRG; PAM sequence: CAG
aggggtcacaccacatgtgt

SEQ ID NO: 66485 - DNA, 20 bp, Artificial Sequence
  Description of Artificial Sequence: Synthetic oligonucleotide
  Target: ATXN1; (-) strand; PAM type: NRG; PAM sequence: GGG
tgccttggacagggagatag

SEQ ID NO: 66486 - DNA, 20 bp, Artificial Sequence
  Description of Artificial Sequence: Synthetic oligonucleotide
  Target: ATXN1; (-) strand; PAM type: NRG; PAM sequence: GGG
ctgccttggacagggagata

SEQ ID NO: 66487 - DNA, 20 bp, Artificial Sequence
  Description of Artificial Sequence: Synthetic oligonucleotide
  Target: ATXN1; (-) strand; PAM type: NRG; PAM sequence: AGG
actgccttggacagggagat

SEQ ID NO: 66488 - DNA, 20 bp, Artificial Sequence
  Description of Artificial Sequence: Synthetic oligonucleotide
  Target: ATXN1; (-) strand; PAM type: NRG; PAM sequence: TAG
gactgccttggacagggaga

SEQ ID NO: 66489 - DNA, 20 bp, Artificial Sequence
  Description of Artificial Sequence: Synthetic oligonucleotide
  Target: ATXN1; (-) strand; PAM type: NRG; PAM sequence: GAG
gggagactgccttggacagg

SEQ ID NO: 66490 - DNA, 20 bp, Artificial Sequence
  Description of Artificial Sequence: Synthetic oligonucleotide
  Target: ATXN1; (-) strand; PAM type: NRG; PAM sequence: GGG
gggggagactgccttggaca

SEQ ID NO: 66491 - DNA, 20 bp, Artificial Sequence
  Description of Artificial Sequence: Synthetic oligonucleotide
  Target: ATXN1; (-) strand; PAM type: NRG; PAM sequence: AGG
agggggagactgccttggac

SEQ ID NO: 66492 - DNA, 20 bp, Artificial Sequence
  Description of Artificial Sequence: Synthetic oligonucleotide
  Target: ATXN1; (-) strand; PAM type: NRG; PAM sequence: CAG
aagggggagactgccttgga

SEQ ID NO: 66493 - DNA, 20 bp, Artificial Sequence
  Description of Artificial Sequence: Synthetic oligonucleotide
  Target: ATXN1; (-) strand; PAM type: NRG; PAM sequence: TGG
gagaaagggggagactgcct

SEQ ID NO: 66494 - DNA, 20 bp, Artificial Sequence
  Description of Artificial Sequence: Synthetic oligonucleotide
  Target: ATXN1; (-) strand; PAM type: NRG; PAM sequence: GAG
agctcatagagagaaagggg

SEQ ID NO: 66495 - DNA, 20 bp, Artificial Sequence
  Description of Artificial Sequence: Synthetic oligonucleotide
  Target: ATXN1; (-) strand; PAM type: NRG; PAM sequence: GGG
acagctcatagagagaaagg

SEQ ID NO: 66496 - DNA, 20 bp, Artificial Sequence
  Description of Artificial Sequence: Synthetic oligonucleotide
  Target: ATXN1; (-) strand; PAM type: NRG; PAM sequence: GGG
gacagctcatagagagaaag

SEQ ID NO: 66497 - DNA, 20 bp, Artificial Sequence
  Description of Artificial Sequence: Synthetic oligonucleotide
  Target: ATXN1; (-) strand; PAM type: NRG; PAM sequence: GGG
ggacagctcatagagagaaa

SEQ ID NO: 66498 - DNA, 20 bp, Artificial Sequence
  Description of Artificial Sequence: Synthetic oligonucleotide
  Target: ATXN1; (-) strand; PAM type: NRG; PAM sequence: AGG
tggacagctcatagagagaa

SEQ ID NO: 66499 - DNA, 20 bp, Artificial Sequence
  Description of Artificial Sequence: Synthetic oligonucleotide
  Target: ATXN1; (-) strand; PAM type: NRG; PAM sequence: AAG
atggacagctcatagagaga

SEQ ID NO: 66500 - DNA, 20 bp, Artificial Sequence
  Description of Artificial Sequence: Synthetic oligonucleotide
  Target: ATXN1; (-) strand; PAM type: NRG; PAM sequence: GAG
gagaatggacagctcataga

SEQ ID NO: 66501 - DNA, 20 bp, Artificial Sequence
  Description of Artificial Sequence: Synthetic oligonucleotide
  Target: ATXN1; (-) strand; PAM type: NRG; PAM sequence: GAG
cggagaatggacagctcata

SEQ ID NO: 66502 - DNA, 20 bp, Artificial Sequence
  Description of Artificial Sequence: Synthetic oligonucleotide
  Target: ATXN1; (-) strand; PAM type: NRG; PAM sequence: TAG
cacggagaatggacagctca

SEQ ID NO: 66503 - DNA, 20 bp, Artificial Sequence
  Description of Artificial Sequence: Synthetic oligonucleotide
  Target: ATXN1; (-) strand; PAM type: NRG; PAM sequence: CAG
gactcaacacggagaatgga

SEQ ID NO: 66504 - DNA, 20 bp, Artificial Sequence
  Description of Artificial Sequence: Synthetic oligonucleotide
  Target: ATXN1; (-) strand; PAM type: NRG; PAM sequence: TGG
gtaggactcaacacggagaa

SEQ ID NO: 66505 - DNA, 20 bp, Artificial Sequence
  Description of Artificial Sequence: Synthetic oligonucleotide
  Target: ATXN1; (-) strand; PAM type: NRG; PAM sequence: GAG
tccgtgtaggactcaacacg

SEQ ID NO: 66506 - DNA, 20 bp, Artificial Sequence
  Description of Artificial Sequence: Synthetic oligonucleotide
  Target: ATXN1; (-) strand; PAM type: NRG; PAM sequence: CGG
gctccgtgtaggactcaaca

SEQ ID NO: 66507 - DNA, 20 bp, Artificial Sequence
  Description of Artificial Sequence: Synthetic oligonucleotide
  Target: ATXN1; (-) strand; PAM type: NRG; PAM sequence: AGG
gtaagtgggaagctccgtgt

SEQ ID NO: 66508 - DNA, 20 bp, Artificial Sequence
  Description of Artificial Sequence: Synthetic oligonucleotide
  Target: ATXN1; (-) strand; PAM type: NRG; PAM sequence: TAG
agtaagtgggaagctccgtg

SEQ ID NO: 66509 - DNA, 20 bp, Artificial Sequence
  Description of Artificial Sequence: Synthetic oligonucleotide
  Target: ATXN1; (-) strand; PAM type: NRG; PAM sequence: AAG
taacatgtaaagtaagtggg

SEQ ID NO: 66510 - DNA, 20 bp, Artificial Sequence
  Description of Artificial Sequence: Synthetic oligonucleotide
  Target: ATXN1; (-) strand; PAM type: NRG; PAM sequence: GGG
atctaacatgtaaagtaagt

SEQ ID NO: 66511 - DNA, 20 bp, Artificial Sequence
  Description of Artificial Sequence: Synthetic oligonucleotide
  Target: ATXN1; (-) strand; PAM type: NRG; PAM sequence: TGG
aatctaacatgtaaagtaag

SEQ ID NO: 66512 - DNA, 20 bp, Artificial Sequence
  Description of Artificial Sequence: Synthetic oligonucleotide
  Target: ATXN1; (-) strand; PAM type: NRG; PAM sequence: AAG
agcaatctaacatgtaaagt

SEQ ID NO: 66513 - DNA, 20 bp, Artificial Sequence
  Description of Artificial Sequence: Synthetic oligonucleotide
  Target: ATXN1; (-) strand; PAM type: NRG; PAM sequence: AAG
acacagcaatctaacatgta

SEQ ID NO: 66514 - DNA, 20 bp, Artificial Sequence
  Description of Artificial Sequence: Synthetic oligonucleotide
  Target: ATXN1; (-) strand; PAM type: NRG; PAM sequence: CAG
cgcatatgctgaggaaaaca

SEQ ID NO: 66515 - DNA, 20 bp, Artificial Sequence
  Description of Artificial Sequence: Synthetic oligonucleotide
  Target: ATXN1; (-) strand; PAM type: NRG; PAM sequence: AGG
caggggccacgcatatgctg

SEQ ID NO: 66516 - DNA, 20 bp, Artificial Sequence
  Description of Artificial Sequence: Synthetic oligonucleotide
  Target: ATXN1; (-) strand; PAM type: NRG; PAM sequence: GAG
acaggggccacgcatatgct

SEQ ID NO: 66517 - DNA, 20 bp, Artificial Sequence
  Description of Artificial Sequence: Synthetic oligonucleotide
  Target: ATXN1; (-) strand; PAM type: NRG; PAM sequence: GGG
gaagaggggcttccagacag

SEQ ID NO: 66518 - DNA, 20 bp, Artificial Sequence
  Description of Artificial Sequence: Synthetic oligonucleotide
  Target: ATXN1; (-) strand; PAM type: NRG; PAM sequence: GGG
cgaagaggggcttccagaca

SEQ ID NO: 66519 - DNA, 20 bp, Artificial Sequence
  Description of Artificial Sequence: Synthetic oligonucleotide
  Target: ATXN1; (-) strand; PAM type: NRG; PAM sequence: AGG
acgaagaggggcttccagac

SEQ ID NO: 66520 - DNA, 20 bp, Artificial Sequence
  Description of Artificial Sequence: Synthetic oligonucleotide
  Target: ATXN1; (-) strand; PAM type: NRG; PAM sequence: CAG
aacgaagaggggcttccaga

SEQ ID NO: 66521 - DNA, 20 bp, Artificial Sequence
  Description of Artificial Sequence: Synthetic oligonucleotide
  Target: ATXN1; (-) strand; PAM type: NRG; PAM sequence: CAG
gatcaacgaagaggggcttc

SEQ ID NO: 66522 - DNA, 20 bp, Artificial Sequence
  Description of Artificial Sequence: Synthetic oligonucleotide
  Target: ATXN1; (-) strand; PAM type: NRG; PAM sequence: GGG
agctccagatcaacgaagag

SEQ ID NO: 66523 - DNA, 20 bp, Artificial Sequence
  Description of Artificial Sequence: Synthetic oligonucleotide
  Target: ATXN1; (-) strand; PAM type: NRG; PAM sequence: GGG
cagctccagatcaacgaaga

SEQ ID NO: 66524 - DNA, 20 bp, Artificial Sequence
  Description of Artificial Sequence: Synthetic oligonucleotide
  Target: ATXN1; (-) strand; PAM type: NRG; PAM sequence: AGG
tcagctccagatcaacgaag

SEQ ID NO: 66525 - DNA, 20 bp, Artificial Sequence
  Description of Artificial Sequence: Synthetic oligonucleotide
  Target: ATXN1; (-) strand; PAM type: NRG; PAM sequence: GAG
ttcagctccagatcaacgaa

SEQ ID NO: 66526 - DNA, 20 bp, Artificial Sequence
  Description of Artificial Sequence: Synthetic oligonucleotide
  Target: ATXN1; (-) strand; PAM type: NRG; PAM sequence: AAG
aattcagctccagatcaacg

SEQ ID NO: 66527 - DNA, 20 bp, Artificial Sequence
  Description of Artificial Sequence: Synthetic oligonucleotide
  Target: ATXN1; (-) strand; PAM type: NRG; PAM sequence: CAG
aacagaccacaattcagctc

SEQ ID NO: 66528 - DNA, 20 bp, Artificial Sequence
  Description of Artificial Sequence: Synthetic oligonucleotide
  Target: ATXN1; (-) strand; PAM type: NRG; PAM sequence: CAG
ctggtgaacagaccacaatt

SEQ ID NO: 66529 - DNA, 20 bp, Artificial Sequence
  Description of Artificial Sequence: Synthetic oligonucleotide
  Target: ATXN1; (-) strand; PAM type: NRG; PAM sequence: CAG
tcatctggggtcctggtgaa

SEQ ID NO: 66530 - DNA, 20 bp, Artificial Sequence
  Description of Artificial Sequence: Synthetic oligonucleotide
  Target: ATXN1; (-) strand; PAM type: NRG; PAM sequence: TGG
tcatctttcatctggggtcc

SEQ ID NO: 66531 - DNA, 20 bp, Artificial Sequence
  Description of Artificial Sequence: Synthetic oligonucleotide
  Target: ATXN1; (-) strand; PAM type: NRG; PAM sequence: GGG
atgctttcatctttcatctg

SEQ ID NO: 66532 - DNA, 20 bp, Artificial Sequence
  Description of Artificial Sequence: Synthetic oligonucleotide
  Target: ATXN1; (-) strand; PAM type: NRG; PAM sequence: GGG
catgctttcatctttcatct

SEQ ID NO: 66533 - DNA, 20 bp, Artificial Sequence
  Description of Artificial Sequence: Synthetic oligonucleotide
  Target: ATXN1; (-) strand; PAM type: NRG; PAM sequence: TGG
tcatgctttcatctttcatc

SEQ ID NO: 66534 - DNA, 20 bp, Artificial Sequence
  Description of Artificial Sequence: Synthetic oligonucleotide
  Target: ATXN1; (-) strand; PAM type: NRG; PAM sequence: TGG
atgattccatcccaggtgta

SEQ ID NO: 66535 - DNA, 20 bp, Artificial Sequence
  Description of Artificial Sequence: Synthetic oligonucleotide
  Target: ATXN1; (-) strand; PAM type: NRG; PAM sequence: AGG
tgcttccatgattccatccc

SEQ ID NO: 66536 - DNA, 20 bp, Artificial Sequence
  Description of Artificial Sequence: Synthetic oligonucleotide
  Target: ATXN1; (-) strand; PAM type: NRG; PAM sequence: CAG
atgcttccatgattccatcc

SEQ ID NO: 66537 - DNA, 20 bp, Artificial Sequence
  Description of Artificial Sequence: Synthetic oligonucleotide
  Target: ATXN1; (-) strand; PAM type: NRG; PAM sequence: GGG
aaggcaaagttaacctgtct

SEQ ID NO: 66538 - DNA, 20 bp, Artificial Sequence
  Description of Artificial Sequence: Synthetic oligonucleotide
  Target: ATXN1; (-) strand; PAM type: NRG; PAM sequence: TGG
taaggcaaagttaacctgtc

SEQ ID NO: 66539 - DNA, 20 bp, Artificial Sequence
  Description of Artificial Sequence: Synthetic oligonucleotide
  Target: ATXN1; (-) strand; PAM type: NRG; PAM sequence: AAG
taagaagctttattaaggca

SEQ ID NO: 66540 - DNA, 20 bp, Artificial Sequence
  Description of Artificial Sequence: Synthetic oligonucleotide
  Target: ATXN1; (-) strand; PAM type: NRG; PAM sequence: AGG
aaaattaagaagctttatta

SEQ ID NO: 66541 - DNA, 20 bp, Artificial Sequence
  Description of Artificial Sequence: Synthetic oligonucleotide
  Target: ATXN1; (-) strand; PAM type: NRG; PAM sequence: AAG
aaaaattaagaagctttatt

SEQ ID NO: 66542 - DNA, 20 bp, Artificial Sequence
  Description of Artificial Sequence: Synthetic oligonucleotide
  Target: ATXN1; (-) strand; PAM type: NRG; PAM sequence: AAG
taggcttgttaaaaattaag

SEQ ID NO: 66543 - DNA, 20 bp, Artificial Sequence
  Description of Artificial Sequence: Synthetic oligonucleotide
  Target: ATXN1; (-) strand; PAM type: NRG; PAM sequence: AAG
cattaggcttgttaaaaatt

SEQ ID NO: 66544 - DNA, 20 bp, Artificial Sequence
  Description of Artificial Sequence: Synthetic oligonucleotide
  Target: ATXN1; (-) strand; PAM type: NRG; PAM sequence: AGG
tgaatgagatggagatcatt

SEQ ID NO: 66545 - DNA, 20 bp, Artificial Sequence
  Description of Artificial Sequence: Synthetic oligonucleotide
  Target: ATXN1; (-) strand; PAM type: NRG; PAM sequence: TAG
ctgaatgagatggagatcat

SEQ ID NO: 66546 - DNA, 20 bp, Artificial Sequence
  Description of Artificial Sequence: Synthetic oligonucleotide
  Target: ATXN1; (-) strand; PAM type: NRG; PAM sequence: GAG
tgttcctcctgaatgagatg

SEQ ID NO: 66547 - DNA, 20 bp, Artificial Sequence
  Description of Artificial Sequence: Synthetic oligonucleotide
  Target: ATXN1; (-) strand; PAM type: NRG; PAM sequence: TGG
cttgttcctcctgaatgaga

SEQ ID NO: 66548 - DNA, 20 bp, Artificial Sequence
  Description of Artificial Sequence: Synthetic oligonucleotide
  Target: ATXN1; (-) strand; PAM type: NRG; PAM sequence: GAG
tgaccttgttcctcctgaat

SEQ ID NO: 66549 - DNA, 20 bp, Artificial Sequence
  Description of Artificial Sequence: Synthetic oligonucleotide
  Target: ATXN1; (-) strand; PAM type: NRG; PAM sequence: TGG
ctcacagttcacaagtcatc

SEQ ID NO: 66550 - DNA, 20 bp, Artificial Sequence
  Description of Artificial Sequence: Synthetic oligonucleotide
  Target: ATXN1; (-) strand; PAM type: NRG; PAM sequence: AAG
gagctcaactcacagttcac

SEQ ID NO: 66551 - DNA, 20 bp, Artificial Sequence
  Description of Artificial Sequence: Synthetic oligonucleotide
  Target: ATXN1; (-) strand; PAM type: NRG; PAM sequence: CAG
acagtccagagctcaactca

SEQ ID NO: 66552 - DNA, 20 bp, Artificial Sequence
  Description of Artificial Sequence: Synthetic oligonucleotide
  Target: ATXN1; (-) strand; PAM type: NRG; PAM sequence: GAG
catcactgtctaacagtcca

SEQ ID NO: 66553 - DNA, 20 bp, Artificial Sequence
  Description of Artificial Sequence: Synthetic oligonucleotide
  Target: ATXN1; (-) strand; PAM type: NRG; PAM sequence: CAG
cacatcactgtctaacagtc

SEQ ID NO: 66554 - DNA, 20 bp, Artificial Sequence
  Description of Artificial Sequence: Synthetic oligonucleotide
  Target: ATXN1; (-) strand; PAM type: NRG; PAM sequence: CAG
ttagacacatcactgtctaa

SEQ ID NO: 66555 - DNA, 20 bp, Artificial Sequence
  Description of Artificial Sequence: Synthetic oligonucleotide
  Target: ATXN1; (-) strand; PAM type: NRG; PAM sequence: TAG
gccagacattggccttgtct

SEQ ID NO: 66556 - DNA, 20 bp, Artificial Sequence
  Description of Artificial Sequence: Synthetic oligonucleotide
  Target: ATXN1; (-) strand; PAM type: NRG; PAM sequence: TGG
agccccggcctgccagacat

SEQ ID NO: 66557 - DNA, 20 bp, Artificial Sequence
  Description of Artificial Sequence: Synthetic oligonucleotide
  Target: ATXN1; (-) strand; PAM type: NRG; PAM sequence: CAG
acgctaaagccccggcctgc

SEQ ID NO: 66558 - DNA, 20 bp, Artificial Sequence
  Description of Artificial Sequence: Synthetic oligonucleotide
  Target: ATXN1; (-) strand; PAM type: NRG; PAM sequence: CGG
ctaaacttacgctaaagccc

SEQ ID NO: 66559 - DNA, 20 bp, Artificial Sequence
  Description of Artificial Sequence: Synthetic oligonucleotide
  Target: ATXN1; (-) strand; PAM type: NRG; PAM sequence: AAG
aggtggctaaacttacgcta

SEQ ID NO: 66560 - DNA, 20 bp, Artificial Sequence
  Description of Artificial Sequence: Synthetic oligonucleotide
  Target: ATXN1; (-) strand; PAM type: NRG; PAM sequence: TGG
attaaactcaatttagcagg

SEQ ID NO: 66561 - DNA, 20 bp, Artificial Sequence
  Description of Artificial Sequence: Synthetic oligonucleotide
  Target: ATXN1; (-) strand; PAM type: NRG; PAM sequence: AGG
caaattaaactcaatttagc

SEQ ID NO: 66562 - DNA, 20 bp, Artificial Sequence
  Description of Artificial Sequence: Synthetic oligonucleotide
  Target: ATXN1; (-) strand; PAM type: NRG; PAM sequence: CAG
gcaaattaaactcaatttag

SEQ ID NO: 66563 - DNA, 20 bp, Artificial Sequence
  Description of Artificial Sequence: Synthetic oligonucleotide
  Target: ATXN1; (-) strand; PAM type: NRG; PAM sequence: TAG
cgggcaaattaaactcaatt

SEQ ID NO: 66564 - DNA, 20 bp, Artificial Sequence
  Description of Artificial Sequence: Synthetic oligonucleotide
  Target: ATXN1; (-) strand; PAM type: NRG; PAM sequence: GGG
tgggacaatcataaggacac

SEQ ID NO: 66565 - DNA, 20 bp, Artificial Sequence
  Description of Artificial Sequence: Synthetic oligonucleotide
  Target: ATXN1; (-) strand; PAM type: NRG; PAM sequence: CGG
atgggacaatcataaggaca

SEQ ID NO: 66566 - DNA, 20 bp, Artificial Sequence
  Description of Artificial Sequence: Synthetic oligonucleotide
  Target: ATXN1; (-) strand; PAM type: NRG; PAM sequence: AGG
atggtgatgggacaatcata

SEQ ID NO: 66567 - DNA, 20 bp, Artificial Sequence
  Description of Artificial Sequence: Synthetic oligonucleotide
  Target: ATXN1; (-) strand; PAM type: NRG; PAM sequence: AAG
tatggtgatgggacaatcat

SEQ ID NO: 66568 - DNA, 20 bp, Artificial Sequence
  Description of Artificial Sequence: Synthetic oligonucleotide
  Target: ATXN1; (-) strand; PAM type: NRG; PAM sequence: GGG
cattaattagctatggtgat

SEQ ID NO: 66569 - DNA, 20 bp, Artificial Sequence
  Description of Artificial Sequence: Synthetic oligonucleotide
  Target: ATXN1; (-) strand; PAM type: NRG; PAM sequence: TGG
acattaattagctatggtga

SEQ ID NO: 66570 - DNA, 20 bp, Artificial Sequence
  Description of Artificial Sequence: Synthetic oligonucleotide
  Target: ATXN1; (-) strand; PAM type: NRG; PAM sequence: TGG
tagttaacattaattagcta

SEQ ID NO: 66571 - DNA, 20 bp, Artificial Sequence
  Description of Artificial Sequence: Synthetic oligonucleotide
  Target: ATXN1; (-) strand; PAM type: NRG; PAM sequence: TAG
acaacatagttaacattaat

SEQ ID NO: 66572 - DNA, 20 bp, Artificial Sequence
  Description of Artificial Sequence: Synthetic oligonucleotide
  Target: ATXN1; (-) strand; PAM type: NRG; PAM sequence: TAG
cattaataaaaataacaaca

SEQ ID NO: 66573 - DNA, 20 bp, Artificial Sequence
  Description of Artificial Sequence: Synthetic oligonucleotide
  Target: ATXN1; (-) strand; PAM type: NRG; PAM sequence: GAG
aatatttactaaaattaaaa

SEQ ID NO: 66574 - DNA, 20 bp, Artificial Sequence
  Description of Artificial Sequence: Synthetic oligonucleotide
  Target: ATXN1; (-) strand; PAM type: NRG; PAM sequence: AAG
aaaatatttactaaaattaa

SEQ ID NO: 66575 - DNA, 20 bp, Artificial Sequence
  Description of Artificial Sequence: Synthetic oligonucleotide
  Target: ATXN1; (-) strand; PAM type: NRG; PAM sequence: TGG
aggcttggaacagtcagatc

SEQ ID NO: 66576 - DNA, 20 bp, Artificial Sequence
  Description of Artificial Sequence: Synthetic oligonucleotide
  Target: ATXN1; (-) strand; PAM type: NRG; PAM sequence: CAG
aagcccaggcttggaacagt

SEQ ID NO: 66577 - DNA, 20 bp, Artificial Sequence
  Description of Artificial Sequence: Synthetic oligonucleotide
  Target: ATXN1; (-) strand; PAM type: NRG; PAM sequence: CAG
cccaaagcccaggcttggaa

SEQ ID NO: 66578 - DNA, 20 bp, Artificial Sequence
  Description of Artificial Sequence: Synthetic oligonucleotide
  Target: ATXN1; (-) strand; PAM type: NRG; PAM sequence: TGG
cagcccccaaagcccaggct

SEQ ID NO: 66579 - DNA, 20 bp, Artificial Sequence
  Description of Artificial Sequence: Synthetic oligonucleotide
  Target: ATXN1; (-) strand; PAM type: NRG; PAM sequence: AGG
cctggcagcccccaaagccc

SEQ ID NO: 66580 - DNA, 20 bp, Artificial Sequence
  Description of Artificial Sequence: Synthetic oligonucleotide
  Target: ATXN1; (-) strand; PAM type: NRG; PAM sequence: CAG
acctggcagcccccaaagcc

SEQ ID NO: 66581 - DNA, 20 bp, Artificial Sequence
  Description of Artificial Sequence: Synthetic oligonucleotide
  Target: ATXN1; (-) strand; PAM type: NRG; PAM sequence: AAG
aatatacctggcagccccca

SEQ ID NO: 66582 - DNA, 20 bp, Artificial Sequence
  Description of Artificial Sequence: Synthetic oligonucleotide
  Target: ATXN1; (-) strand; PAM type: NRG; PAM sequence: CAG
tgtagcagtaatatacctgg

SEQ ID NO: 66583 - DNA, 20 bp, Artificial Sequence
  Description of Artificial Sequence: Synthetic oligonucleotide
  Target: ATXN1; (-) strand; PAM type: NRG; PAM sequence: TGG
tgttgtagcagtaatatacc

SEQ ID NO: 66584 - DNA, 20 bp, Artificial Sequence
  Description of Artificial Sequence: Synthetic oligonucleotide
  Target: ATXN1; (-) strand; PAM type: NRG; PAM sequence: CAG
tgctcctgatggtgttgtag

SEQ ID NO: 66585 - DNA, 20 bp, Artificial Sequence
  Description of Artificial Sequence: Synthetic oligonucleotide
  Target: ATXN1; (-) strand; PAM type: NRG; PAM sequence: TAG
acttgctcctgatggtgttg

SEQ ID NO: 66586 - DNA, 20 bp, Artificial Sequence
  Description of Artificial Sequence: Synthetic oligonucleotide
  Target: ATXN1; (-) strand; PAM type: NRG; PAM sequence: TGG
gcattgtgacttgctcctga

SEQ ID NO: 66587 - DNA, 20 bp, Artificial Sequence
  Description of Artificial Sequence: Synthetic oligonucleotide
  Target: ATXN1; (-) strand; PAM type: NRG; PAM sequence: AAG
gtaaaagaatgaatgaactt

SEQ ID NO: 66588 - DNA, 20 bp, Artificial Sequence
  Description of Artificial Sequence: Synthetic oligonucleotide
  Target: ATXN1; (-) strand; PAM type: NRG; PAM sequence: AAG
ctcgataacgtgtagggtaa

SEQ ID NO: 66589 - DNA, 20 bp, Artificial Sequence
  Description of Artificial Sequence: Synthetic oligonucleotide
  Target: ATXN1; (-) strand; PAM type: NRG; PAM sequence: GGG
taggtgctcgataacgtgta

SEQ ID NO: 66590 - DNA, 20 bp, Artificial Sequence
  Description of Artificial Sequence: Synthetic oligonucleotide
  Target: ATXN1; (-) strand; PAM type: NRG; PAM sequence: AGG
gtaggtgctcgataacgtgt

SEQ ID NO: 66591 - DNA, 20 bp, Artificial Sequence
  Description of Artificial Sequence: Synthetic oligonucleotide
  Target: ATXN1; (-) strand; PAM type: NRG; PAM sequence: TAG
agtaggtgctcgataacgtg

SEQ ID NO: 66592 - DNA, 20 bp, Artificial Sequence
  Description of Artificial Sequence: Synthetic oligonucleotide
  Target: ATXN1; (-) strand; PAM type: NRG; PAM sequence: AGG
cctctcacacagcacacagt

SEQ ID NO: 66593 - DNA, 20 bp, Artificial Sequence
  Description of Artificial Sequence: Synthetic oligonucleotide
  Target: ATXN1; (-) strand; PAM type: NRG; PAM sequence: TAG
tcctctcacacagcacacag

SEQ ID NO: 66594 - DNA, 20 bp, Artificial Sequence
  Description of Artificial Sequence: Synthetic oligonucleotide
  Target: ATXN1; (-) strand; PAM type: NRG; PAM sequence: CAG
cagtcctctcacacagcaca

SEQ ID NO: 66595 - DNA, 20 bp, Artificial Sequence
  Description of Artificial Sequence: Synthetic oligonucleotide
  Target: ATXN1; (-) strand; PAM type: NRG; PAM sequence: CAG
aacgtcccagtcctctcaca

SEQ ID NO: 66596 - DNA, 20 bp, Artificial Sequence
  Description of Artificial Sequence: Synthetic oligonucleotide
  Target: ATXN1; (-) strand; PAM type: NRG; PAM sequence: CAG
ttgtataactcccaacgtcc

SEQ ID NO: 66597 - DNA, 20 bp, Artificial Sequence
  Description of Artificial Sequence: Synthetic oligonucleotide
  Target: ATXN1; (-) strand; PAM type: NRG; PAM sequence: TAG
tatgtcctaagcatggcttt

SEQ ID NO: 66598 - DNA, 20 bp, Artificial Sequence
  Description of Artificial Sequence: Synthetic oligonucleotide
  Target: ATXN1; (-) strand; PAM type: NRG; PAM sequence: TGG
cacctgctatgtcctaagca

SEQ ID NO: 66599 - DNA, 20 bp, Artificial Sequence
  Description of Artificial Sequence: Synthetic oligonucleotide
  Target: ATXN1; (-) strand; PAM type: NRG; PAM sequence: AAG
cttgtcacctgctatgtcct

SEQ ID NO: 66600 - DNA, 20 bp, Artificial Sequence
  Description of Artificial Sequence: Synthetic oligonucleotide
  Target: ATXN1; (-) strand; PAM type: NRG; PAM sequence: GGG
ttcaaagctttggcctagaa

SEQ ID NO: 66601 - DNA, 20 bp, Artificial Sequence
  Description of Artificial Sequence: Synthetic oligonucleotide
  Target: ATXN1; (-) strand; PAM type: NRG; PAM sequence: AGG
cttcaaagctttggcctaga

SEQ ID NO: 66602 - DNA, 20 bp, Artificial Sequence
  Description of Artificial Sequence: Synthetic oligonucleotide
  Target: ATXN1; (-) strand; PAM type: NRG; PAM sequence: AAG
gcttcaaagctttggcctag

SEQ ID NO: 66603 - DNA, 20 bp, Artificial Sequence
  Description of Artificial Sequence: Synthetic oligonucleotide
  Target: ATXN1; (-) strand; PAM type: NRG; PAM sequence: TAG
aatgcttcaaagctttggcc

SEQ ID NO: 66604 - DNA, 20 bp, Artificial Sequence
  Description of Artificial Sequence: Synthetic oligonucleotide
  Target: ATXN1; (-) strand; PAM type: NRG; PAM sequence: TGG
aattcaatgcttcaaagctt

SEQ ID NO: 66605 - DNA, 20 bp, Artificial Sequence
  Description of Artificial Sequence: Synthetic oligonucleotide
  Target: ATXN1; (-) strand; PAM type: NRG; PAM sequence: AAG
accagcaattcaatgcttca

SEQ ID NO: 66606 - DNA, 20 bp, Artificial Sequence
  Description of Artificial Sequence: Synthetic oligonucleotide
  Target: ATXN1; (-) strand; PAM type: NRG; PAM sequence: CAG
gaaaaattggaaaattgcac

SEQ ID NO: 66607 - DNA, 20 bp, Artificial Sequence
  Description of Artificial Sequence: Synthetic oligonucleotide
  Target: ATXN1; (-) strand; PAM type: NRG; PAM sequence: TGG
tcactggaagagagaaaaat

SEQ ID NO: 66608 - DNA, 20 bp, Artificial Sequence
  Description of Artificial Sequence: Synthetic oligonucleotide
  Target: ATXN1; (-) strand; PAM type: NRG; PAM sequence: GAG
ctttcatgatcactggaaga

SEQ ID NO: 66609 - DNA, 20 bp, Artificial Sequence
  Description of Artificial Sequence: Synthetic oligonucleotide
  Target: ATXN1; (-) strand; PAM type: NRG; PAM sequence: GAG
ctctttcatgatcactggaa

SEQ ID NO: 66610 - DNA, 20 bp, Artificial Sequence
  Description of Artificial Sequence: Synthetic oligonucleotide
  Target: ATXN1; (-) strand; PAM type: NRG; PAM sequence: AAG
gcctctttcatgatcactgg

SEQ ID NO: 66611 - DNA, 20 bp, Artificial Sequence
  Description of Artificial Sequence: Synthetic oligonucleotide
  Target: ATXN1; (-) strand; PAM type: NRG; PAM sequence: TGG
ggggcctctttcatgatcac

SEQ ID NO: 66612 - DNA, 20 bp, Artificial Sequence
  Description of Artificial Sequence: Synthetic oligonucleotide
  Target: ATXN1; (-) strand; PAM type: NRG; PAM sequence: GGG
ctttttatccagccatctag

SEQ ID NO: 66613 - DNA, 20 bp, Artificial Sequence
  Description of Artificial Sequence: Synthetic oligonucleotide
  Target: ATXN1; (-) strand; PAM type: NRG; PAM sequence: GGG
tctttttatccagccatcta

SEQ ID NO: 66614 - DNA, 20 bp, Artificial Sequence
  Description of Artificial Sequence: Synthetic oligonucleotide
  Target: ATXN1; (-) strand; PAM type: NRG; PAM sequence: AGG
atctttttatccagccatct

SEQ ID NO: 66615 - DNA, 20 bp, Artificial Sequence
  Description of Artificial Sequence: Synthetic oligonucleotide
  Target: ATXN1; (-) strand; PAM type: NRG; PAM sequence: TAG
gatctttttatccagccatc

SEQ ID NO: 66616 - DNA, 20 bp, Artificial Sequence
  Description of Artificial Sequence: Synthetic oligonucleotide
  Target: ATXN1; (-) strand; PAM type: NRG; PAM sequence: CAG
tctgctttgatctttttatc

SEQ ID NO: 66617 - DNA, 20 bp, Artificial Sequence
  Description of Artificial Sequence: Synthetic oligonucleotide
  Target: ATXN1; (-) strand; PAM type: NRG; PAM sequence: CAG
ccatgcataactccatgatg

SEQ ID NO: 66618 - DNA, 20 bp, Artificial Sequence
  Description of Artificial Sequence: Synthetic oligonucleotide
  Target: ATXN1; (-) strand; PAM type: NRG; PAM sequence: AGG
tgtggatgcagtatctctcc

SEQ ID NO: 66619 - DNA, 20 bp, Artificial Sequence
  Description of Artificial Sequence: Synthetic oligonucleotide
  Target: ATXN1; (-) strand; PAM type: NRG; PAM sequence: CAG
ctgtggatgcagtatctctc

SEQ ID NO: 66620 - DNA, 20 bp, Artificial Sequence
  Description of Artificial Sequence: Synthetic oligonucleotide
  Target: ATXN1; (-) strand; PAM type: NRG; PAM sequence: CAG
tacagtgaccgctgtggatg

SEQ ID NO: 66621 - DNA, 20 bp, Artificial Sequence
  Description of Artificial Sequence: Synthetic oligonucleotide
  Target: ATXN1; (-) strand; PAM type: NRG; PAM sequence: TGG
cattcatacagtgaccgctg

SEQ ID NO: 66622 - DNA, 20 bp, Artificial Sequence
  Description of Artificial Sequence: Synthetic oligonucleotide
  Target: ATXN1; (-) strand; PAM type: NRG; PAM sequence: CAG
aagtttatttctcattcata

SEQ ID NO: 66623 - DNA, 20 bp, Artificial Sequence
  Description of Artificial Sequence: Synthetic oligonucleotide
  Target: ATXN1; (-) strand; PAM type: NRG; PAM sequence: AAG
tcagtagcttagcaaaataa

SEQ ID NO: 66624 - DNA, 20 bp, Artificial Sequence
  Description of Artificial Sequence: Synthetic oligonucleotide
  Target: ATXN1; (-) strand; PAM type: NRG; PAM sequence: TAG
accctaaactttcagtagct

SEQ ID NO: 66625 - DNA, 20 bp, Artificial Sequence
  Description of Artificial Sequence: Synthetic oligonucleotide
  Target: ATXN1; (-) strand; PAM type: NRG; PAM sequence: TAG
ggtcaaccctaaactttcag

SEQ ID NO: 66626 - DNA, 20 bp, Artificial Sequence
  Description of Artificial Sequence: Synthetic oligonucleotide
  Target: ATXN1; (-) strand; PAM type: NRG; PAM sequence: CAG
aaaggtcaaccctaaacttt

SEQ ID NO: 66627 - DNA, 20 bp, Artificial Sequence
  Description of Artificial Sequence: Synthetic oligonucleotide
  Target: ATXN1; (-) strand; PAM type: NRG; PAM sequence: AGG
gataagcttttgttgcagaa

SEQ ID NO: 66628 - DNA, 20 bp, Artificial Sequence
  Description of Artificial Sequence: Synthetic oligonucleotide
  Target: ATXN1; (-) strand; PAM type: NRG; PAM sequence: AAG
ggataagcttttgttgcaga

SEQ ID NO: 66629 - DNA, 20 bp, Artificial Sequence
  Description of Artificial Sequence: Synthetic oligonucleotide
  Target: ATXN1; (-) strand; PAM type: NRG; PAM sequence: CAG
gataggataagcttttgttg

SEQ ID NO: 66630 - DNA, 20 bp, Artificial Sequence
  Description of Artificial Sequence: Synthetic oligonucleotide
  Target: ATXN1; (-) strand; PAM type: NRG; PAM sequence: AAG
tgtattagtcaggataggat

SEQ ID NO: 66631 - DNA, 20 bp, Artificial Sequence
  Description of Artificial Sequence: Synthetic oligonucleotide
  Target: ATXN1; (-) strand; PAM type: NRG; PAM sequence: AGG
gctattgtattagtcaggat

SEQ ID NO: 66632 - DNA, 20 bp, Artificial Sequence
  Description of Artificial Sequence: Synthetic oligonucleotide
  Target: ATXN1; (-) strand; PAM type: NRG; PAM sequence: TAG
agctattgtattagtcagga

SEQ ID NO: 66633 - DNA, 20 bp, Artificial Sequence
  Description of Artificial Sequence: Synthetic oligonucleotide
  Target: ATXN1; (-) strand; PAM type: NRG; PAM sequence: AGG
taaaagctattgtattagtc

SEQ ID NO: 66634 - DNA, 20 bp, Artificial Sequence
  Description of Artificial Sequence: Synthetic oligonucleotide
  Target: ATXN1; (-) strand; PAM type: NRG; PAM sequence: CAG
ataaaagctattgtattagt

SEQ ID NO: 66635 - DNA, 20 bp, Artificial Sequence
  Description of Artificial Sequence: Synthetic oligonucleotide
  Target: ATXN1; (-) strand; PAM type: NRG; PAM sequence: TAG
gaaaataaaagctattgtat

SEQ ID NO: 66636 - DNA, 20 bp, Artificial Sequence
  Description of Artificial Sequence: Synthetic oligonucleotide
  Target: ATXN1; (-) strand; PAM type: NRG; PAM sequence: AAG
ggtaataatagagaaaataa

SEQ ID NO: 66637 - DNA, 20 bp, Artificial Sequence
  Description of Artificial Sequence: Synthetic oligonucleotide
  Target: ATXN1; (-) strand; PAM type: NRG; PAM sequence: GAG
attaccaaatggtaataata

SEQ ID NO: 66638 - DNA, 20 bp, Artificial Sequence
  Description of Artificial Sequence: Synthetic oligonucleotide
  Target: ATXN1; (-) strand; PAM type: NRG; PAM sequence: TAG
tcattaccaaatggtaataa

SEQ ID NO: 66639 - DNA, 20 bp, Artificial Sequence
  Description of Artificial Sequence: Synthetic oligonucleotide
  Target: ATXN1; (-) strand; PAM type: NRG; PAM sequence: TGG
agacatgattcattaccaaa

SEQ ID NO: 66640 - DNA, 20 bp, Artificial Sequence
  Description of Artificial Sequence: Synthetic oligonucleotide
  Target: ATXN1; (-) strand; PAM type: NRG; PAM sequence: TAG
agcctagcacaaggcattgt

SEQ ID NO: 66641 - DNA, 20 bp, Artificial Sequence
  Description of Artificial Sequence: Synthetic oligonucleotide
  Target: ATXN1; (-) strand; PAM type: NRG; PAM sequence: AGG
taaatataaagcctagcaca

SEQ ID NO: 66642 - DNA, 20 bp, Artificial Sequence
  Description of Artificial Sequence: Synthetic oligonucleotide
  Target: ATXN1; (-) strand; PAM type: NRG; PAM sequence: AAG
gtaaatataaagcctagcac

SEQ ID NO: 66643 - DNA, 20 bp, Artificial Sequence
  Description of Artificial Sequence: Synthetic oligonucleotide
  Target: ATXN1; (-) strand; PAM type: NRG; PAM sequence: TAG
agggcagtaaatataaagcc

SEQ ID NO: 66644 - DNA, 20 bp, Artificial Sequence
  Description of Artificial Sequence: Synthetic oligonucleotide
  Target: ATXN1; (-) strand; PAM type: NRG; PAM sequence: AAG
tactgagggcagtaaatata

SEQ ID NO: 66645 - DNA, 20 bp, Artificial Sequence
  Description of Artificial Sequence: Synthetic oligonucleotide
  Target: ATXN1; (-) strand; PAM type: NRG; PAM sequence: CAG
caattaaaagatactgaggg

SEQ ID NO: 66646 - DNA, 20 bp, Artificial Sequence
  Description of Artificial Sequence: Synthetic oligonucleotide
  Target: ATXN1; (-) strand; PAM type: NRG; PAM sequence: GGG
aggcaattaaaagatactga

SEQ ID NO: 66647 - DNA, 20 bp, Artificial Sequence
  Description of Artificial Sequence: Synthetic oligonucleotide
  Target: ATXN1; (-) strand; PAM type: NRG; PAM sequence: AGG
aaggcaattaaaagatactg

SEQ ID NO: 66648 - DNA, 20 bp, Artificial Sequence
  Description of Artificial Sequence: Synthetic oligonucleotide
  Target: ATXN1; (-) strand; PAM type: NRG; PAM sequence: GAG
taaggcaattaaaagatact

SEQ ID NO: 66649 - DNA, 20 bp, Artificial Sequence
  Description of Artificial Sequence: Synthetic oligonucleotide
  Target: ATXN1; (-) strand; PAM type: NRG; PAM sequence: AAG
agtgacattaaggcaattaa

SEQ ID NO: 66650 - DNA, 20 bp, Artificial Sequence
  Description of Artificial Sequence: Synthetic oligonucleotide
  Target: ATXN1; (-) strand; PAM type: NRG; PAM sequence: AGG
agtgagtaaaagtgacatta

SEQ ID NO: 66651 - DNA, 20 bp, Artificial Sequence
  Description of Artificial Sequence: Synthetic oligonucleotide
  Target: ATXN1; (-) strand; PAM type: NRG; PAM sequence: AAG
gagtgagtaaaagtgacatt

SEQ ID NO: 66652 - DNA, 20 bp, Artificial Sequence
  Description of Artificial Sequence: Synthetic oligonucleotide
  Target: ATXN1; (-) strand; PAM type: NRG; PAM sequence: AAG
aagtggcaaggagtgagtaa

SEQ ID NO: 66653 - DNA, 20 bp, Artificial Sequence
  Description of Artificial Sequence: Synthetic oligonucleotide
  Target: ATXN1; (-) strand; PAM type: NRG; PAM sequence: GAG
ctcattaagtggcaaggagt

SEQ ID NO: 66654 - DNA, 20 bp, Artificial Sequence
  Description of Artificial Sequence: Synthetic oligonucleotide
  Target: ATXN1; (-) strand; PAM type: NRG; PAM sequence: GAG
ttgtctcattaagtggcaag

SEQ ID NO: 66655 - DNA, 20 bp, Artificial Sequence
  Description of Artificial Sequence: Synthetic oligonucleotide
  Target: ATXN1; (-) strand; PAM type: NRG; PAM sequence: AGG
tcttgtctcattaagtggca

SEQ ID NO: 66656 - DNA, 20 bp, Artificial Sequence
  Description of Artificial Sequence: Synthetic oligonucleotide
  Target: ATXN1; (-) strand; PAM type: NRG; PAM sequence: AAG
ctcttgtctcattaagtggc

SEQ ID NO: 66657 - DNA, 20 bp, Artificial Sequence
  Description of Artificial Sequence: Synthetic oligonucleotide
  Target: ATXN1; (-) strand; PAM type: NRG; PAM sequence: TGG
gaggctcttgtctcattaag

SEQ ID NO: 66658 - DNA, 20 bp, Artificial Sequence
  Description of Artificial Sequence: Synthetic oligonucleotide
  Target: ATXN1; (-) strand; PAM type: NRG; PAM sequence: AAG
caagaggctcttgtctcatt

SEQ ID NO: 66659 - DNA, 20 bp, Artificial Sequence
  Description of Artificial Sequence: Synthetic oligonucleotide
  Target: ATXN1; (-) strand; PAM type: NRG; PAM sequence: AGG
ccaaggtcactgtcttcaag

SEQ ID NO: 66660 - DNA, 20 bp, Artificial Sequence
  Description of Artificial Sequence: Synthetic oligonucleotide
  Target: ATXN1; (-) strand; PAM type: NRG; PAM sequence: GAG
gccaaggtcactgtcttcaa

SEQ ID NO: 66661 - DNA, 20 bp, Artificial Sequence
  Description of Artificial Sequence: Synthetic oligonucleotide
  Target: ATXN1; (-) strand; PAM type: NRG; PAM sequence: AAG
aagccaaggtcactgtcttc

SEQ ID NO: 66662 - DNA, 20 bp, Artificial Sequence
  Description of Artificial Sequence: Synthetic oligonucleotide
  Target: ATXN1; (-) strand; PAM type: NRG; PAM sequence: AGG
agccctgaaagtacaagcca

SEQ ID NO: 66663 - DNA, 20 bp, Artificial Sequence
  Description of Artificial Sequence: Synthetic oligonucleotide
  Target: ATXN1; (-) strand; PAM type: NRG; PAM sequence: AAG
aagccctgaaagtacaagcc

SEQ ID NO: 66664 - DNA, 20 bp, Artificial Sequence
  Description of Artificial Sequence: Synthetic oligonucleotide
  Target: ATXN1; (-) strand; PAM type: NRG; PAM sequence: AAG
aaggtaagccctgaaagtac

SEQ ID NO: 66665 - DNA, 20 bp, Artificial Sequence
  Description of Artificial Sequence: Synthetic oligonucleotide
  Target: ATXN1; (-) strand; PAM type: NRG; PAM sequence: AAG
ggtgaaaaggtaagccctga

SEQ ID NO: 66666 - DNA, 20 bp, Artificial Sequence
  Description of Artificial Sequence: Synthetic oligonucleotide
  Target: ATXN1; (-) strand; PAM type: NRG; PAM sequence: AAG
gagttggagggtgaaaaggt

SEQ ID NO: 66667 - DNA, 20 bp, Artificial Sequence
  Description of Artificial Sequence: Synthetic oligonucleotide
  Target: ATXN1; (-) strand; PAM type: NRG; PAM sequence: AGG
atgtgagttggagggtgaaa

SEQ ID NO: 66668 - DNA, 20 bp, Artificial Sequence
  Description of Artificial Sequence: Synthetic oligonucleotide
  Target: ATXN1; (-) strand; PAM type: NRG; PAM sequence: AAG
aatgtgagttggagggtgaa

SEQ ID NO: 66669 - DNA, 20 bp, Artificial Sequence
  Description of Artificial Sequence: Synthetic oligonucleotide
  Target: ATXN1; (-) strand; PAM type: NRG; PAM sequence: GGG
gaaggaaaatgtgagttgga

SEQ ID NO: 66670 - DNA, 20 bp, Artificial Sequence
  Description of Artificial Sequence: Synthetic oligonucleotide
  Target: ATXN1; (-) strand; PAM type: NRG; PAM sequence: AGG
ggaaggaaaatgtgagttgg

SEQ ID NO: 66671 - DNA, 20 bp, Artificial Sequence
  Description of Artificial Sequence: Synthetic oligonucleotide
  Target: ATXN1; (-) strand; PAM type: NRG; PAM sequence: GAG
aggaaggaaaatgtgagttg

SEQ ID NO: 66672 - DNA, 20 bp, Artificial Sequence
  Description of Artificial Sequence: Synthetic oligonucleotide
  Target: ATXN1; (-) strand; PAM type: NRG; PAM sequence: TGG
agaggaaggaaaatgtgagt

SEQ ID NO: 66673 - DNA, 20 bp, Artificial Sequence
  Description of Artificial Sequence: Synthetic oligonucleotide
  Target: ATXN1; (-) strand; PAM type: NRG; PAM sequence: GAG
gatgagaggaaggaaaatgt

SEQ ID NO: 66674 - DNA, 20 bp, Artificial Sequence
  Description of Artificial Sequence: Synthetic oligonucleotide
  Target: ATXN1; (-) strand; PAM type: NRG; PAM sequence: AGG
tggggaaaatgatgagagga

SEQ ID NO: 66675 - DNA, 20 bp, Artificial Sequence
  Description of Artificial Sequence: Synthetic oligonucleotide
  Target: ATXN1; (-) strand; PAM type: NRG; PAM sequence: AAG
ttggggaaaatgatgagagg

SEQ ID NO: 66676 - DNA, 20 bp, Artificial Sequence
  Description of Artificial Sequence: Synthetic oligonucleotide
  Target: ATXN1; (-) strand; PAM type: NRG; PAM sequence: AGG
attttggggaaaatgatgag

SEQ ID NO: 66677 - DNA, 20 bp, Artificial Sequence
  Description of Artificial Sequence: Synthetic oligonucleotide
  Target: ATXN1; (-) strand; PAM type: NRG; PAM sequence: GAG
aattttggggaaaatgatga

SEQ ID NO: 66678 - DNA, 20 bp, Artificial Sequence
  Description of Artificial Sequence: Synthetic oligonucleotide
  Target: ATXN1; (-) strand; PAM type: NRG; PAM sequence: GAG
taaattttggggaaaatgat

SEQ ID NO: 66679 - DNA, 20 bp, Artificial Sequence
  Description of Artificial Sequence: Synthetic oligonucleotide
  Target: ATXN1; (-) strand; PAM type: NRG; PAM sequence: GGG
aggctcacaactaaattttg

SEQ ID NO: 66680 - DNA, 20 bp, Artificial Sequence
  Description of Artificial Sequence: Synthetic oligonucleotide
  Target: ATXN1; (-) strand; PAM type: NRG; PAM sequence: GGG
gaggctcacaactaaatttt

SEQ ID NO: 66681 - DNA, 20 bp, Artificial Sequence
  Description of Artificial Sequence: Synthetic oligonucleotide
  Target: ATXN1; (-) strand; PAM type: NRG; PAM sequence: TGG
cgaggctcacaactaaattt

SEQ ID NO: 66682 - DNA, 20 bp, Artificial Sequence
  Description of Artificial Sequence: Synthetic oligonucleotide
  Target: ATXN1; (-) strand; PAM type: NRG; PAM sequence: AGG
ttaagcagctactgcttgcg

SEQ ID NO: 66683 - DNA, 20 bp, Artificial Sequence
  Description of Artificial Sequence: Synthetic oligonucleotide
  Target: ATXN1; (-) strand; PAM type: NRG; PAM sequence: GAG
gttaagcagctactgcttgc

SEQ ID NO: 66684 - DNA, 20 bp, Artificial Sequence
  Description of Artificial Sequence: Synthetic oligonucleotide
  Target: ATXN1; (-) strand; PAM type: NRG; PAM sequence: CAG
gtcatcagttatgagttaag

SEQ ID NO: 66685 - DNA, 20 bp, Artificial Sequence
  Description of Artificial Sequence: Synthetic oligonucleotide
  Target: ATXN1; (-) strand; PAM type: NRG; PAM sequence: AAG
caagtcatcagttatgagtt

SEQ ID NO: 66686 - DNA, 20 bp, Artificial Sequence
  Description of Artificial Sequence: Synthetic oligonucleotide
  Target: ATXN1; (-) strand; PAM type: NRG; PAM sequence: GAG
aatatcaagtcatcagttat

SEQ ID NO: 66687 - DNA, 20 bp, Artificial Sequence
  Description of Artificial Sequence: Synthetic oligonucleotide
  Target: ATXN1; (-) strand; PAM type: NRG; PAM sequence: CAG
gtgggaaaatatcaagtcat

SEQ ID NO: 66688 - DNA, 20 bp, Artificial Sequence
  Description of Artificial Sequence: Synthetic oligonucleotide
  Target: ATXN1; (-) strand; PAM type: NRG; PAM sequence: AAG
tttcctagtgggaaaatatc

SEQ ID NO: 66689 - DNA, 20 bp, Artificial Sequence
  Description of Artificial Sequence: Synthetic oligonucleotide
  Target: ATXN1; (-) strand; PAM type: NRG; PAM sequence: GGG
attgggaattatttcctagt

SEQ ID NO: 66690 - DNA, 20 bp, Artificial Sequence
  Description of Artificial Sequence: Synthetic oligonucleotide
  Target: ATXN1; (-) strand; PAM type: NRG; PAM sequence: TGG
tattgggaattatttcctag

SEQ ID NO: 66691 - DNA, 20 bp, Artificial Sequence
  Description of Artificial Sequence: Synthetic oligonucleotide
  Target: ATXN1; (-) strand; PAM type: NRG; PAM sequence: TAG
acgtattgggaattatttcc

SEQ ID NO: 66692 - DNA, 20 bp, Artificial Sequence
  Description of Artificial Sequence: Synthetic oligonucleotide
  Target: ATXN1; (-) strand; PAM type: NRG; PAM sequence: GGG
aataattgttattacgtatt

SEQ ID NO: 66693 - DNA, 20 bp, Artificial Sequence
  Description of Artificial Sequence: Synthetic oligonucleotide
  Target: ATXN1; (-) strand; PAM type: NRG; PAM sequence: TGG
gaataattgttattacgtat

SEQ ID NO: 66694 - DNA, 20 bp, Artificial Sequence
  Description of Artificial Sequence: Synthetic oligonucleotide
  Target: ATXN1; (-) strand; PAM type: NRG; PAM sequence: TGG
ccatgcctgcatggtggtat

SEQ ID NO: 66695 - DNA, 20 bp, Artificial Sequence
  Description of Artificial Sequence: Synthetic oligonucleotide
  Target: ATXN1; (-) strand; PAM type: NRG; PAM sequence: TGG
gatgatccatgcctgcatgg

SEQ ID NO: 66696 - DNA, 20 bp, Artificial Sequence
  Description of Artificial Sequence: Synthetic oligonucleotide
  Target: ATXN1; (-) strand; PAM type: NRG; PAM sequence: TGG
cctgatgatccatgcctgca

SEQ ID NO: 66697 - DNA, 20 bp, Artificial Sequence
  Description of Artificial Sequence: Synthetic oligonucleotide
  Target: ATXN1; (-) strand; PAM type: NRG; PAM sequence: TAG
gaatagctaatgccttcttg

SEQ ID NO: 66698 - DNA, 20 bp, Artificial Sequence
  Description of Artificial Sequence: Synthetic oligonucleotide
  Target: ATXN1; (-) strand; PAM type: NRG; PAM sequence: TAG
aagataaattcacagatgaa

SEQ ID NO: 66699 - DNA, 20 bp, Artificial Sequence
  Description of Artificial Sequence: Synthetic oligonucleotide
  Target: ATXN1; (-) strand; PAM type: NRG; PAM sequence: CAG
ccatggctaagataaattca

SEQ ID NO: 66700 - DNA, 20 bp, Artificial Sequence
  Description of Artificial Sequence: Synthetic oligonucleotide
  Target: ATXN1; (-) strand; PAM type: NRG; PAM sequence: AAG
acagaatcaaggccatggct

SEQ ID NO: 66701 - DNA, 20 bp, Artificial Sequence
  Description of Artificial Sequence: Synthetic oligonucleotide
  Target: ATXN1; (-) strand; PAM type: NRG; PAM sequence: TGG
ttgacacagaatcaaggcca

SEQ ID NO: 66702 - DNA, 20 bp, Artificial Sequence
  Description of Artificial Sequence: Synthetic oligonucleotide
  Target: ATXN1; (-) strand; PAM type: NRG; PAM sequence: AGG
ccatggttgacacagaatca

SEQ ID NO: 66703 - DNA, 20 bp, Artificial Sequence
  Description of Artificial Sequence: Synthetic oligonucleotide
  Target: ATXN1; (-) strand; PAM type: NRG; PAM sequence: AAG
gccatggttgacacagaatc

SEQ ID NO: 66704 - DNA, 20 bp, Artificial Sequence
  Description of Artificial Sequence: Synthetic oligonucleotide
  Target: ATXN1; (-) strand; PAM type: NRG; PAM sequence: CAG
atgatgagccatggttgaca

SEQ ID NO: 66705 - DNA, 20 bp, Artificial Sequence
  Description of Artificial Sequence: Synthetic oligonucleotide
  Target: ATXN1; (-) strand; PAM type: NRG; PAM sequence: TGG
taagtaaaaatgatgagcca

SEQ ID NO: 66706 - DNA, 20 bp, Artificial Sequence
  Description of Artificial Sequence: Synthetic oligonucleotide
  Target: ATXN1; (-) strand; PAM type: NRG; PAM sequence: GAG
cacaaataagtaaaaatgat

SEQ ID NO: 66707 - DNA, 20 bp, Artificial Sequence
  Description of Artificial Sequence: Synthetic oligonucleotide
  Target: ATXN1; (-) strand; PAM type: NRG; PAM sequence: AAG
acattagggtcaacacaaat

SEQ ID NO: 66708 - DNA, 20 bp, Artificial Sequence
  Description of Artificial Sequence: Synthetic oligonucleotide
  Target: ATXN1; (-) strand; PAM type: NRG; PAM sequence: GGG
aaatagacctaaagacatta

SEQ ID NO: 66709 - DNA, 20 bp, Artificial Sequence
  Description of Artificial Sequence: Synthetic oligonucleotide
  Target: ATXN1; (-) strand; PAM type: NRG; PAM sequence: AGG
taaatagacctaaagacatt

SEQ ID NO: 66710 - DNA, 20 bp, Artificial Sequence
  Description of Artificial Sequence: Synthetic oligonucleotide
  Target: ATXN1; (-) strand; PAM type: NRG; PAM sequence: TAG
ttaaatagacctaaagacat

SEQ ID NO: 66711 - DNA, 20 bp, Artificial Sequence
  Description of Artificial Sequence: Synthetic oligonucleotide
  Target: ATXN1; (-) strand; PAM type: NRG; PAM sequence: AAG
aaaatcattaaatagaccta

SEQ ID NO: 66712 - DNA, 20 bp, Artificial Sequence
  Description of Artificial Sequence: Synthetic oligonucleotide
  Target: ATXN1; (-) strand; PAM type: NRG; PAM sequence: TAG
cccagaccaaaatcattaaa

SEQ ID NO: 66713 - DNA, 20 bp, Artificial Sequence
  Description of Artificial Sequence: Synthetic oligonucleotide
  Target: ATXN1; (-) strand; PAM type: NRG; PAM sequence: CAG
gaatgagaattttagaagcc

SEQ ID NO: 66714 - DNA, 20 bp, Artificial Sequence
  Description of Artificial Sequence: Synthetic oligonucleotide
  Target: ATXN1; (-) strand; PAM type: NRG; PAM sequence: AAG
tgactgaatgagaattttag

SEQ ID NO: 66715 - DNA, 20 bp, Artificial Sequence
  Description of Artificial Sequence: Synthetic oligonucleotide
  Target: ATXN1; (-) strand; PAM type: NRG; PAM sequence: TAG
aaatgactgaatgagaattt

SEQ ID NO: 66716 - DNA, 20 bp, Artificial Sequence
  Description of Artificial Sequence: Synthetic oligonucleotide
  Target: ATXN1; (-) strand; PAM type: NRG; PAM sequence: GAG
gaatgaacaaatgactgaat

SEQ ID NO: 66717 - DNA, 20 bp, Artificial Sequence
  Description of Artificial Sequence: Synthetic oligonucleotide
  Target: ATXN1; (-) strand; PAM type: NRG; PAM sequence: CAG
tttttttctctgctacctct

SEQ ID NO: 66718 - DNA, 20 bp, Artificial Sequence
  Description of Artificial Sequence: Synthetic oligonucleotide
  Target: ATXN1; (-) strand; PAM type: NRG; PAM sequence: TAG
tcacagctagcctgactcca

SEQ ID NO: 66719 - DNA, 20 bp, Artificial Sequence
  Description of Artificial Sequence: Synthetic oligonucleotide
  Target: ATXN1; (-) strand; PAM type: NRG; PAM sequence: TAG
ctggcccacagtctcacagc

SEQ ID NO: 66720 - DNA, 20 bp, Artificial Sequence
  Description of Artificial Sequence: Synthetic oligonucleotide
  Target: ATXN1; (-) strand; PAM type: NRG; PAM sequence: CAG
gtggctggcccacagtctca

SEQ ID NO: 66721 - DNA, 20 bp, Artificial Sequence
  Description of Artificial Sequence: Synthetic oligonucleotide
  Target: ATXN1; (-) strand; PAM type: NRG; PAM sequence: CAG
gaggtcaagtggctggccca

SEQ ID NO: 66722 - DNA, 20 bp, Artificial Sequence
  Description of Artificial Sequence: Synthetic oligonucleotide
  Target: ATXN1; (-) strand; PAM type: NRG; PAM sequence: TGG
acatgaagaggtcaagtggc

SEQ ID NO: 66723 - DNA, 20 bp, Artificial Sequence
  Description of Artificial Sequence: Synthetic oligonucleotide
  Target: ATXN1; (-) strand; PAM type: NRG; PAM sequence: TGG
ggggacatgaagaggtcaag

SEQ ID NO: 66724 - DNA, 20 bp, Artificial Sequence
  Description of Artificial Sequence: Synthetic oligonucleotide
  Target: ATXN1; (-) strand; PAM type: NRG; PAM sequence: AAG
actggggacatgaagaggtc

SEQ ID NO: 66725 - DNA, 20 bp, Artificial Sequence
  Description of Artificial Sequence: Synthetic oligonucleotide
  Target: ATXN1; (-) strand; PAM type: NRG; PAM sequence: AGG
aggaaactggggacatgaag

SEQ ID NO: 66726 - DNA, 20 bp, Artificial Sequence
  Description of Artificial Sequence: Synthetic oligonucleotide
  Target: ATXN1; (-) strand; PAM type: NRG; PAM sequence: GAG
aaggaaactggggacatgaa

SEQ ID NO: 66727 - DNA, 20 bp, Artificial Sequence
  Description of Artificial Sequence: Synthetic oligonucleotide
  Target: ATXN1; (-) strand; PAM type: NRG; PAM sequence: AAG
gaaaggaaactggggacatg

SEQ ID NO: 66728 - DNA, 20 bp, Artificial Sequence
  Description of Artificial Sequence: Synthetic oligonucleotide
  Target: ATXN1; (-) strand; PAM type: NRG; PAM sequence: GGG
ttttgtgggaaaggaaactg

SEQ ID NO: 66729 - DNA, 20 bp, Artificial Sequence
  Description of Artificial Sequence: Synthetic oligonucleotide
  Target: ATXN1; (-) strand; PAM type: NRG; PAM sequence: GGG
gttttgtgggaaaggaaact

SEQ ID NO: 66730 - DNA, 20 bp, Artificial Sequence
  Description of Artificial Sequence: Synthetic oligonucleotide
  Target: ATXN1; (-) strand; PAM type: NRG; PAM sequence: TGG
cgttttgtgggaaaggaaac

SEQ ID NO: 66731 - DNA, 20 bp, Artificial Sequence
  Description of Artificial Sequence: Synthetic oligonucleotide
  Target: ATXN1; (-) strand; PAM type: NRG; PAM sequence: AGG
ttaaactcgttttgtgggaa

SEQ ID NO: 66732 - DNA, 20 bp, Artificial Sequence
  Description of Artificial Sequence: Synthetic oligonucleotide
  Target: ATXN1; (-) strand; PAM type: NRG; PAM sequence: AAG
tttaaactcgttttgtggga

SEQ ID NO: 66733 - DNA, 20 bp, Artificial Sequence
  Description of Artificial Sequence: Synthetic oligonucleotide
  Target: ATXN1; (-) strand; PAM type: NRG; PAM sequence: GGG
acattttaaactcgttttgt

SEQ ID NO: 66734 - DNA, 20 bp, Artificial Sequence
  Description of Artificial Sequence: Synthetic oligonucleotide
  Target: ATXN1; (-) strand; PAM type: NRG; PAM sequence: TGG
tacattttaaactcgttttg

SEQ ID NO: 66735 - DNA, 20 bp, Artificial Sequence
  Description of Artificial Sequence: Synthetic oligonucleotide
  Target: ATXN1; (-) strand; PAM type: NRG; PAM sequence: AAG
aattctcacaacaaccttac

SEQ ID NO: 66736 - DNA, 20 bp, Artificial Sequence
  Description of Artificial Sequence: Synthetic oligonucleotide
  Target: ATXN1; (-) strand; PAM type: NRG; PAM sequence: CAG
ctaagcacttacaacatgcc

SEQ ID NO: 66737 - DNA, 20 bp, Artificial Sequence
  Description of Artificial Sequence: Synthetic oligonucleotide
  Target: ATXN1; (-) strand; PAM type: NRG; PAM sequence: AAG
tatgataatattagcattct

SEQ ID NO: 66738 - DNA, 20 bp, Artificial Sequence
  Description of Artificial Sequence: Synthetic oligonucleotide
  Target: ATXN1; (-) strand; PAM type: NRG; PAM sequence: TAG
tgctcagtatatgataatat

SEQ ID NO: 66739 - DNA, 20 bp, Artificial Sequence
  Description of Artificial Sequence: Synthetic oligonucleotide
  Target: ATXN1; (-) strand; PAM type: NRG; PAM sequence: CAG
tctgccatgtagtaggtgct

SEQ ID NO: 66740 - DNA, 20 bp, Artificial Sequence
  Description of Artificial Sequence: Synthetic oligonucleotide
  Target: ATXN1; (-) strand; PAM type: NRG; PAM sequence: AGG
tctaatatctgccatgtagt

SEQ ID NO: 66741 - DNA, 20 bp, Artificial Sequence
  Description of Artificial Sequence: Synthetic oligonucleotide
  Target: ATXN1; (-) strand; PAM type: NRG; PAM sequence: TAG
ctctaatatctgccatgtag

SEQ ID NO: 66742 - DNA, 20 bp, Artificial Sequence
  Description of Artificial Sequence: Synthetic oligonucleotide
  Target: ATXN1; (-) strand; PAM type: NRG; PAM sequence: TAG
ttcctctaatatctgccatg

SEQ ID NO: 66743 - DNA, 20 bp, Artificial Sequence
  Description of Artificial Sequence: Synthetic oligonucleotide
  Target: ATXN1; (-) strand; PAM type: NRG; PAM sequence: GGG
tgcaaatgcttgaagaactg

SEQ ID NO: 66744 - DNA, 20 bp, Artificial Sequence
  Description of Artificial Sequence: Synthetic oligonucleotide
  Target: ATXN1; (-) strand; PAM type: NRG; PAM sequence: GGG
ttgcaaatgcttgaagaact

SEQ ID NO: 66745 - DNA, 20 bp, Artificial Sequence
  Description of Artificial Sequence: Synthetic oligonucleotide
  Target: ATXN1; (-) strand; PAM type: NRG; PAM sequence: TGG
attgcaaatgcttgaagaac

SEQ ID NO: 66746 - DNA, 20 bp, Artificial Sequence
  Description of Artificial Sequence: Synthetic oligonucleotide
  Target: ATXN1; (-) strand; PAM type: NRG; PAM sequence: AAG
tactagattgcaaatgcttg

SEQ ID NO: 66747 - DNA, 20 bp, Artificial Sequence
  Description of Artificial Sequence: Synthetic oligonucleotide
  Target: ATXN1; (-) strand; PAM type: NRG; PAM sequence: TAG
tacatatcttttacccttac

SEQ ID NO: 66748 - DNA, 20 bp, Artificial Sequence
  Description of Artificial Sequence: Synthetic oligonucleotide
  Target: ATXN1; (-) strand; PAM type: NRG; PAM sequence: TGG
acttgtgttctctctctctc

SEQ ID NO: 66749 - DNA, 20 bp, Artificial Sequence
  Description of Artificial Sequence: Synthetic oligonucleotide
  Target: ATXN1; (-) strand; PAM type: NRG; PAM sequence: GAG
gtgtgtgctctcatgtaggt

SEQ ID NO: 66750 - DNA, 20 bp, Artificial Sequence
  Description of Artificial Sequence: Synthetic oligonucleotide
  Target: ATXN1; (-) strand; PAM type: NRG; PAM sequence: AGG
gcatgtgtgtgctctcatgt

SEQ ID NO: 66751 - DNA, 20 bp, Artificial Sequence
  Description of Artificial Sequence: Synthetic oligonucleotide
  Target: ATXN1; (-) strand; PAM type: NRG; PAM sequence: TAG
tgcatgtgtgtgctctcatg

SEQ ID NO: 66752 - DNA, 20 bp, Artificial Sequence
  Description of Artificial Sequence: Synthetic oligonucleotide
  Target: ATXN1; (-) strand; PAM type: NRG; PAM sequence: TGG
gctcatcagttggcagtagt

SEQ ID NO: 66753 - DNA, 20 bp, Artificial Sequence
  Description of Artificial Sequence: Synthetic oligonucleotide
  Target: ATXN1; (-) strand; PAM type: NRG; PAM sequence: TAG
tgtagctcatcagttggcag

SEQ ID NO: 66754 - DNA, 20 bp, Artificial Sequence
  Description of Artificial Sequence: Synthetic oligonucleotide
  Target: ATXN1; (-) strand; PAM type: NRG; PAM sequence: CAG
gtatgtagctcatcagttgg

SEQ ID NO: 66755 - DNA, 20 bp, Artificial Sequence
  Description of Artificial Sequence: Synthetic oligonucleotide
  Target: ATXN1; (-) strand; PAM type: NRG; PAM sequence: TGG
tctgtatgtagctcatcagt

SEQ ID NO: 66756 - DNA, 20 bp, Artificial Sequence
  Description of Artificial Sequence: Synthetic oligonucleotide
  Target: ATXN1; (-) strand; PAM type: NRG; PAM sequence: CAG
ttgctctgtatgtagctcat

SEQ ID NO: 66757 - DNA, 20 bp, Artificial Sequence
  Description of Artificial Sequence: Synthetic oligonucleotide
  Target: ATXN1; (-) strand; PAM type: NRG; PAM sequence: TAG
gtctcttcttgctctgtatg

SEQ ID NO: 66758 - DNA, 20 bp, Artificial Sequence
  Description of Artificial Sequence: Synthetic oligonucleotide
  Target: ATXN1; (-) strand; PAM type: NRG; PAM sequence: TGG
aggagctagttcagcaatcg

SEQ ID NO: 66759 - DNA, 20 bp, Artificial Sequence
  Description of Artificial Sequence: Synthetic oligonucleotide
  Target: ATXN1; (-) strand; PAM type: NRG; PAM sequence: CAG
caagtctgtaggagctagtt

SEQ ID NO: 66760 - DNA, 20 bp, Artificial Sequence
  Description of Artificial Sequence: Synthetic oligonucleotide
  Target: ATXN1; (-) strand; PAM type: NRG; PAM sequence: TAG
tctggcaagtctgtaggagc

SEQ ID NO: 66761 - DNA, 20 bp, Artificial Sequence
  Description of Artificial Sequence: Synthetic oligonucleotide
  Target: ATXN1; (-) strand; PAM type: NRG; PAM sequence: GAG
cttgtctggcaagtctgtag

SEQ ID NO: 66762 - DNA, 20 bp, Artificial Sequence
  Description of Artificial Sequence: Synthetic oligonucleotide
  Target: ATXN1; (-) strand; PAM type: NRG; PAM sequence: AGG
gtcttgtctggcaagtctgt

SEQ ID NO: 66763 - DNA, 20 bp, Artificial Sequence
  Description of Artificial Sequence: Synthetic oligonucleotide
  Target: ATXN1; (-) strand; PAM type: NRG; PAM sequence: TAG
tgtcttgtctggcaagtctg

SEQ ID NO: 66764 - DNA, 20 bp, Artificial Sequence
  Description of Artificial Sequence: Synthetic oligonucleotide
  Target: ATXN1; (-) strand; PAM type: NRG; PAM sequence: AAG
ggtgccctgtcttgtctggc

SEQ ID NO: 66765 - DNA, 20 bp, Artificial Sequence
  Description of Artificial Sequence: Synthetic oligonucleotide
  Target: ATXN1; (-) strand; PAM type: NRG; PAM sequence: TGG
ccctggtgccctgtcttgtc

SEQ ID NO: 66766 - DNA, 20 bp, Artificial Sequence
  Description of Artificial Sequence: Synthetic oligonucleotide
  Target: ATXN1; (-) strand; PAM type: NRG; PAM sequence: TGG
tttaattacctggacatccc

SEQ ID NO: 66767 - DNA, 20 bp, Artificial Sequence
  Description of Artificial Sequence: Synthetic oligonucleotide
  Target: ATXN1; (-) strand; PAM type: NRG; PAM sequence: TGG
gctcacactctttaattacc

SEQ ID NO: 66768 - DNA, 20 bp, Artificial Sequence
  Description of Artificial Sequence: Synthetic oligonucleotide
  Target: ATXN1; (-) strand; PAM type: NRG; PAM sequence: TAG
ttgttgaatgaataaacaca

SEQ ID NO: 66769 - DNA, 20 bp, Artificial Sequence
  Description of Artificial Sequence: Synthetic oligonucleotide
  Target: ATXN1; (-) strand; PAM type: NRG; PAM sequence: AGG
aactgtgccaagcacatagg

SEQ ID NO: 66770 - DNA, 20 bp, Artificial Sequence
  Description of Artificial Sequence: Synthetic oligonucleotide
  Target: ATXN1; (-) strand; PAM type: NRG; PAM sequence: GAG
aaactgtgccaagcacatag

SEQ ID NO: 66771 - DNA, 20 bp, Artificial Sequence
  Description of Artificial Sequence: Synthetic oligonucleotide
  Target: ATXN1; (-) strand; PAM type: NRG; PAM sequence: AGG
taaaactgtgccaagcacat

SEQ ID NO: 66772 - DNA, 20 bp, Artificial Sequence
  Description of Artificial Sequence: Synthetic oligonucleotide
  Target: ATXN1; (-) strand; PAM type: NRG; PAM sequence: TAG
ttaaaactgtgccaagcaca

SEQ ID NO: 66773 - DNA, 20 bp, Artificial Sequence
  Description of Artificial Sequence: Synthetic oligonucleotide
  Target: ATXN1; (-) strand; PAM type: NRG; PAM sequence: AAG
ccagtatttaaaactgtgcc

SEQ ID NO: 66774 - DNA, 20 bp, Artificial Sequence
  Description of Artificial Sequence: Synthetic oligonucleotide
  Target: ATXN1; (-) strand; PAM type: NRG; PAM sequence: CAG
ctcatggactgcatgtatcc

SEQ ID NO: 66775 - DNA, 20 bp, Artificial Sequence
  Description of Artificial Sequence: Synthetic oligonucleotide
  Target: ATXN1; (-) strand; PAM type: NRG; PAM sequence: TGG
caaaagccttgtcggtctca

SEQ ID NO: 66776 - DNA, 20 bp, Artificial Sequence
  Description of Artificial Sequence: Synthetic oligonucleotide
  Target: ATXN1; (-) strand; PAM type: NRG; PAM sequence: CGG
agtggaagcaaaagccttgt

SEQ ID NO: 66777 - DNA, 20 bp, Artificial Sequence
  Description of Artificial Sequence: Synthetic oligonucleotide
  Target: ATXN1; (-) strand; PAM type: NRG; PAM sequence: AAG
aattagctcagtggaagcaa

SEQ ID NO: 66778 - DNA, 20 bp, Artificial Sequence
  Description of Artificial Sequence: Synthetic oligonucleotide
  Target: ATXN1; (-) strand; PAM type: NRG; PAM sequence: AAG
tattagaattagctcagtgg

SEQ ID NO: 66779 - DNA, 20 bp, Artificial Sequence
  Description of Artificial Sequence: Synthetic oligonucleotide
  Target: ATXN1; (-) strand; PAM type: NRG; PAM sequence: TGG
ctctattagaattagctcag

SEQ ID NO: 66780 - DNA, 20 bp, Artificial Sequence
  Description of Artificial Sequence: Synthetic oligonucleotide
  Target: ATXN1; (-) strand; PAM type: NRG; PAM sequence: CAG
ctcctctattagaattagct

SEQ ID NO: 66781 - DNA, 20 bp, Artificial Sequence
  Description of Artificial Sequence: Synthetic oligonucleotide
  Target: ATXN1; (-) strand; PAM type: NRG; PAM sequence: TAG
ttagtctcctctattagaat

SEQ ID NO: 66782 - DNA, 20 bp, Artificial Sequence
  Description of Artificial Sequence: Synthetic oligonucleotide
  Target: ATXN1; (-) strand; PAM type: NRG; PAM sequence: TAG
ttattgttagtctcctctat

SEQ ID NO: 66783 - DNA, 20 bp, Artificial Sequence
  Description of Artificial Sequence: Synthetic oligonucleotide
  Target: ATXN1; (-) strand; PAM type: NRG; PAM sequence: TAG
tccgactgctggtttattgt

SEQ ID NO: 66784 - DNA, 20 bp, Artificial Sequence
  Description of Artificial Sequence: Synthetic oligonucleotide
  Target: ATXN1; (-) strand; PAM type: NRG; PAM sequence: TGG
gggcttctgcatccgactgc

SEQ ID NO: 66785 - DNA, 20 bp, Artificial Sequence
  Description of Artificial Sequence: Synthetic oligonucleotide
  Target: ATXN1; (-) strand; PAM type: NRG; PAM sequence: GGG
ttgttttcttcgtggcgctt

SEQ ID NO: 66786 - DNA, 20 bp, Artificial Sequence
  Description of Artificial Sequence: Synthetic oligonucleotide
  Target: ATXN1; (-) strand; PAM type: NRG; PAM sequence: TGG
gttgttttcttcgtggcgct

SEQ ID NO: 66787 - DNA, 20 bp, Artificial Sequence
  Description of Artificial Sequence: Synthetic oligonucleotide
  Target: ATXN1; (-) strand; PAM type: NRG; PAM sequence: TGG
cttacctgttgttttcttcg

SEQ ID NO: 66788 - DNA, 20 bp, Artificial Sequence
  Description of Artificial Sequence: Synthetic oligonucleotide
  Target: ATXN1; (-) strand; PAM type: NRG; PAM sequence: AAG
tacccgcccccagctcactc

SEQ ID NO: 66789 - DNA, 20 bp, Artificial Sequence
  Description of Artificial Sequence: Synthetic oligonucleotide
  Target: ATXN1; (-) strand; PAM type: NRG; PAM sequence: CAG
ccatcaggcctacccgcccc

SEQ ID NO: 66790 - DNA, 20 bp, Artificial Sequence
  Description of Artificial Sequence: Synthetic oligonucleotide
  Target: ATXN1; (-) strand; PAM type: NRG; PAM sequence: AGG
tctgctccctgcaccccatc

SEQ ID NO: 66791 - DNA, 20 bp, Artificial Sequence
  Description of Artificial Sequence: Synthetic oligonucleotide
  Target: ATXN1; (-) strand; PAM type: NRG; PAM sequence: CAG
ttctgctccctgcaccccat

SEQ ID NO: 66792 - DNA, 20 bp, Artificial Sequence
  Description of Artificial Sequence: Synthetic oligonucleotide
  Target: ATXN1; (-) strand; PAM type: NRG; PAM sequence: TGG
gtggcgtttccttcctgctc

SEQ ID NO: 66793 - DNA, 20 bp, Artificial Sequence
  Description of Artificial Sequence: Synthetic oligonucleotide
  Target: ATXN1; (-) strand; PAM type: NRG; PAM sequence: TGG
tagaaagctggggtggggcg

SEQ ID NO: 66794 - DNA, 20 bp, Artificial Sequence
  Description of Artificial Sequence: Synthetic oligonucleotide
  Target: ATXN1; (-) strand; PAM type: NRG; PAM sequence: GGG
ccccatagaaagctggggtg

SEQ ID NO: 66795 - DNA, 20 bp, Artificial Sequence
  Description of Artificial Sequence: Synthetic oligonucleotide
  Target: ATXN1; (-) strand; PAM type: NRG; PAM sequence: GGG
cccccatagaaagctggggt

SEQ ID NO: 66796 - DNA, 20 bp, Artificial Sequence
  Description of Artificial Sequence: Synthetic oligonucleotide
  Target: ATXN1; (-) strand; PAM type: NRG; PAM sequence: TGG
tcccccatagaaagctgggg

SEQ ID NO: 66797 - DNA, 20 bp, Artificial Sequence
  Description of Artificial Sequence: Synthetic oligonucleotide
  Target: ATXN1; (-) strand; PAM type: NRG; PAM sequence: GGG
tcctcccccatagaaagctg

SEQ ID NO: 66798 - DNA, 20 bp, Artificial Sequence
  Description of Artificial Sequence: Synthetic oligonucleotide
  Target: ATXN1; (-) strand; PAM type: NRG; PAM sequence: GGG
atcctcccccatagaaagct

SEQ ID NO: 66799 - DNA, 20 bp, Artificial Sequence
  Description of Artificial Sequence: Synthetic oligonucleotide
  Target: ATXN1; (-) strand; PAM type: NRG; PAM sequence: TGG
aatcctcccccatagaaagc

SEQ ID NO: 66800 - DNA, 20 bp, Artificial Sequence
  Description of Artificial Sequence: Synthetic oligonucleotide
  Target: ATXN1; (-) strand; PAM type: NRG; PAM sequence: AAG
gggaaatcctcccccataga

SEQ ID NO: 66801 - DNA, 20 bp, Artificial Sequence
  Description of Artificial Sequence: Synthetic oligonucleotide
  Target: ATXN1; (-) strand; PAM type: NRG; PAM sequence: TAG
ataagggaaatcctccccca

SEQ ID NO: 66802 - DNA, 20 bp, Artificial Sequence
  Description of Artificial Sequence: Synthetic oligonucleotide
  Target: ATXN1; (-) strand; PAM type: NRG; PAM sequence: GGG
caagaggtcagagggcataa

SEQ ID NO: 66803 - DNA, 20 bp, Artificial Sequence
  Description of Artificial Sequence: Synthetic oligonucleotide
  Target: ATXN1; (-) strand; PAM type: NRG; PAM sequence: AGG
gcaagaggtcagagggcata

SEQ ID NO: 66804 - DNA, 20 bp, Artificial Sequence
  Description of Artificial Sequence: Synthetic oligonucleotide
  Target: ATXN1; (-) strand; PAM type: NRG; PAM sequence: AAG
agcaagaggtcagagggcat

SEQ ID NO: 66805 - DNA, 20 bp, Artificial Sequence
  Description of Artificial Sequence: Synthetic oligonucleotide
  Target: ATXN1; (-) strand; PAM type: NRG; PAM sequence: GGG
ggttggagcaagaggtcaga

SEQ ID NO: 66806 - DNA, 20 bp, Artificial Sequence
  Description of Artificial Sequence: Synthetic oligonucleotide
  Target: ATXN1; (-) strand; PAM type: NRG; PAM sequence: AGG
aggttggagcaagaggtcag

SEQ ID NO: 66807 - DNA, 20 bp, Artificial Sequence
  Description of Artificial Sequence: Synthetic oligonucleotide
  Target: ATXN1; (-) strand; PAM type: NRG; PAM sequence: GAG
aaggttggagcaagaggtca

SEQ ID NO: 66808 - DNA, 20 bp, Artificial Sequence
  Description of Artificial Sequence: Synthetic oligonucleotide
  Target: ATXN1; (-) strand; PAM type: NRG; PAM sequence: CAG
aaaaggttggagcaagaggt

SEQ ID NO: 66809 - DNA, 20 bp, Artificial Sequence
  Description of Artificial Sequence: Synthetic oligonucleotide
  Target: ATXN1; (-) strand; PAM type: NRG; PAM sequence: AGG
gaagaaaaggttggagcaag

SEQ ID NO: 66810 - DNA, 20 bp, Artificial Sequence
  Description of Artificial Sequence: Synthetic oligonucleotide
  Target: ATXN1; (-) strand; PAM type: NRG; PAM sequence: GAG
ggaagaaaaggttggagcaa

SEQ ID NO: 66811 - DNA, 20 bp, Artificial Sequence
  Description of Artificial Sequence: Synthetic oligonucleotide
  Target: ATXN1; (-) strand; PAM type: NRG; PAM sequence: AAG
ggggaagaaaaggttggagc

SEQ ID NO: 66812 - DNA, 20 bp, Artificial Sequence
  Description of Artificial Sequence: Synthetic oligonucleotide
  Target: ATXN1; (-) strand; PAM type: NRG; PAM sequence: GAG
ccttggggaagaaaaggttg

SEQ ID NO: 66813 - DNA, 20 bp, Artificial Sequence
  Description of Artificial Sequence: Synthetic oligonucleotide
  Target: ATXN1; (-) strand; PAM type: NRG; PAM sequence: TGG
acccttggggaagaaaaggt

SEQ ID NO: 66814 - DNA, 20 bp, Artificial Sequence
  Description of Artificial Sequence: Synthetic oligonucleotide
  Target: ATXN1; (-) strand; PAM type: NRG; PAM sequence: AGG
ccacacccttggggaagaaa

SEQ ID NO: 66815 - DNA, 20 bp, Artificial Sequence
  Description of Artificial Sequence: Synthetic oligonucleotide
  Target: ATXN1; (-) strand; PAM type: NRG; PAM sequence: AAG
tccacacccttggggaagaa

SEQ ID NO: 66816 - DNA, 20 bp, Artificial Sequence
  Description of Artificial Sequence: Synthetic oligonucleotide
  Target: ATXN1; (-) strand; PAM type: NRG; PAM sequence: AAG
ctcattccacacccttgggg

SEQ ID NO: 66817 - DNA, 20 bp, Artificial Sequence
  Description of Artificial Sequence: Synthetic oligonucleotide
  Target: ATXN1; (-) strand; PAM type: NRG; PAM sequence: GGG
ttactcattccacacccttg

SEQ ID NO: 66818 - DNA, 20 bp, Artificial Sequence
  Description of Artificial Sequence: Synthetic oligonucleotide
  Target: ATXN1; (-) strand; PAM type: NRG; PAM sequence: GGG
gttactcattccacaccctt

SEQ ID NO: 66819 - DNA, 20 bp, Artificial Sequence
  Description of Artificial Sequence: Synthetic oligonucleotide
  Target: ATXN1; (-) strand; PAM type: NRG; PAM sequence: TGG
ggttactcattccacaccct

SEQ ID NO: 66820 - DNA, 20 bp, Artificial Sequence
  Description of Artificial Sequence: Synthetic oligonucleotide
  Target: ATXN1; (-) strand; PAM type: NRG; PAM sequence: GGG
cgttggctttagccccagcc

SEQ ID NO: 66821 - DNA, 20 bp, Artificial Sequence
  Description of Artificial Sequence: Synthetic oligonucleotide
  Target: ATXN1; (-) strand; PAM type: NRG; PAM sequence: CGG
acgttggctttagccccagc

SEQ ID NO: 66822 - DNA, 20 bp, Artificial Sequence
  Description of Artificial Sequence: Synthetic oligonucleotide
  Target: ATXN1; (-) strand; PAM type: NRG; PAM sequence: CAG
ggccacgttggctttagccc

SEQ ID NO: 66823 - DNA, 20 bp, Artificial Sequence
  Description of Artificial Sequence: Synthetic oligonucleotide
  Target: ATXN1; (-) strand; PAM type: NRG; PAM sequence: TAG
ggcataggccacgttggctt

SEQ ID NO: 66824 - DNA, 20 bp, Artificial Sequence
  Description of Artificial Sequence: Synthetic oligonucleotide
  Target: ATXN1; (-) strand; PAM type: NRG; PAM sequence: TGG
ggagggggcataggccacgt

SEQ ID NO: 66825 - DNA, 20 bp, Artificial Sequence
  Description of Artificial Sequence: Synthetic oligonucleotide
  Target: ATXN1; (-) strand; PAM type: NRG; PAM sequence: AGG
cctatccaaggagggggcat

SEQ ID NO: 66826 - DNA, 20 bp, Artificial Sequence
  Description of Artificial Sequence: Synthetic oligonucleotide
  Target: ATXN1; (-) strand; PAM type: NRG; PAM sequence: TAG
ccctatccaaggagggggca

SEQ ID NO: 66827 - DNA, 20 bp, Artificial Sequence
  Description of Artificial Sequence: Synthetic oligonucleotide
  Target: ATXN1; (-) strand; PAM type: NRG; PAM sequence: GGG
attcaccctatccaaggagg

SEQ ID NO: 66828 - DNA, 20 bp, Artificial Sequence
  Description of Artificial Sequence: Synthetic oligonucleotide
  Target: ATXN1; (-) strand; PAM type: NRG; PAM sequence: GGG
gattcaccctatccaaggag

SEQ ID NO: 66829 - DNA, 20 bp, Artificial Sequence
  Description of Artificial Sequence: Synthetic oligonucleotide
  Target: ATXN1; (-) strand; PAM type: NRG; PAM sequence: GGG
agattcaccctatccaagga

SEQ ID NO: 66830 - DNA, 20 bp, Artificial Sequence
  Description of Artificial Sequence: Synthetic oligonucleotide
  Target: ATXN1; (-) strand; PAM type: NRG; PAM sequence: AGG
tagattcaccctatccaagg

SEQ ID NO: 66831 - DNA, 20 bp, Artificial Sequence
  Description of Artificial Sequence: Synthetic oligonucleotide
  Target: ATXN1; (-) strand; PAM type: NRG; PAM sequence: GAG
atagattcaccctatccaag

SEQ ID NO: 66832 - DNA, 20 bp, Artificial Sequence
  Description of Artificial Sequence: Synthetic oligonucleotide
  Target: ATXN1; (-) strand; PAM type: NRG; PAM sequence: AGG
atatagattcaccctatcca

SEQ ID NO: 66833 - DNA, 20 bp, Artificial Sequence
  Description of Artificial Sequence: Synthetic oligonucleotide
  Target: ATXN1; (-) strand; PAM type: NRG; PAM sequence: AAG
tatatagattcaccctatcc

SEQ ID NO: 66834 - DNA, 20 bp, Artificial Sequence
  Description of Artificial Sequence: Synthetic oligonucleotide
  Target: ATXN1; (-) strand; PAM type: NRG; PAM sequence: TAG
taaccctgctcaaaattata

SEQ ID NO: 66835 - DNA, 20 bp, Artificial Sequence
  Description of Artificial Sequence: Synthetic oligonucleotide
  Target: ATXN1; (-) strand; PAM type: NRG; PAM sequence: AGG
gtgaagagggaaggagaaag

SEQ ID NO: 66836 - DNA, 20 bp, Artificial Sequence
  Description of Artificial Sequence: Synthetic oligonucleotide
  Target: ATXN1; (-) strand; PAM type: NRG; PAM sequence: GAG
tgtgaagagggaaggagaaa

SEQ ID NO: 66837 - DNA, 20 bp, Artificial Sequence
  Description of Artificial Sequence: Synthetic oligonucleotide
  Target: ATXN1; (-) strand; PAM type: NRG; PAM sequence: AAG
tgtgtgaagagggaaggaga

SEQ ID NO: 66838 - DNA, 20 bp, Artificial Sequence
  Description of Artificial Sequence: Synthetic oligonucleotide
  Target: ATXN1; (-) strand; PAM type: NRG; PAM sequence: GAG
tgtctgtgtgaagagggaag

SEQ ID NO: 66839 - DNA, 20 bp, Artificial Sequence
  Description of Artificial Sequence: Synthetic oligonucleotide
  Target: ATXN1; (-) strand; PAM type: NRG; PAM sequence: AGG
cctgtctgtgtgaagaggga

SEQ ID NO: 66840 - DNA, 20 bp, Artificial Sequence
  Description of Artificial Sequence: Synthetic oligonucleotide
  Target: ATXN1; (-) strand; PAM type: NRG; PAM sequence: AAG
acctgtctgtgtgaagaggg

SEQ ID NO: 66841 - DNA, 20 bp, Artificial Sequence
  Description of Artificial Sequence: Synthetic oligonucleotide
  Target: ATXN1; (-) strand; PAM type: NRG; PAM sequence: GGG
ggcacctgtctgtgtgaaga

SEQ ID NO: 66842 - DNA, 20 bp, Artificial Sequence
  Description of Artificial Sequence: Synthetic oligonucleotide
  Target: ATXN1; (-) strand; PAM type: NRG; PAM sequence: AGG
aggcacctgtctgtgtgaag

SEQ ID NO: 66843 - DNA, 20 bp, Artificial Sequence
  Description of Artificial Sequence: Synthetic oligonucleotide
  Target: ATXN1; (-) strand; PAM type: NRG; PAM sequence: GAG
caggcacctgtctgtgtgaa

SEQ ID NO: 66844 - DNA, 20 bp, Artificial Sequence
  Description of Artificial Sequence: Synthetic oligonucleotide
  Target: ATXN1; (-) strand; PAM type: NRG; PAM sequence: AAG
tacaggcacctgtctgtgtg

SEQ ID NO: 66845 - DNA, 20 bp, Artificial Sequence
  Description of Artificial Sequence: Synthetic oligonucleotide
  Target: ATXN1; (-) strand; PAM type: NRG; PAM sequence: AGG
caggaaagttttgagtctac

SEQ ID NO: 66846 - DNA, 20 bp, Artificial Sequence
  Description of Artificial Sequence: Synthetic oligonucleotide
  Target: ATXN1; (-) strand; PAM type: NRG; PAM sequence: CAG
gcaggaaagttttgagtcta

SEQ ID NO: 66847 - DNA, 20 bp, Artificial Sequence
  Description of Artificial Sequence: Synthetic oligonucleotide
  Target: ATXN1; (-) strand; PAM type: NRG; PAM sequence: GAG
gccacctgcaggaaagtttt

SEQ ID NO: 66848 - DNA, 20 bp, Artificial Sequence
  Description of Artificial Sequence: Synthetic oligonucleotide
  Target: ATXN1; (-) strand; PAM type: NRG; PAM sequence: AAG
gtcgcaggccacctgcagga

SEQ ID NO: 66849 - DNA, 20 bp, Artificial Sequence
  Description of Artificial Sequence: Synthetic oligonucleotide
  Target: ATXN1; (-) strand; PAM type: NRG; PAM sequence: AGG
cctggtcgcaggccacctgc

SEQ ID NO: 66850 - DNA, 20 bp, Artificial Sequence
  Description of Artificial Sequence: Synthetic oligonucleotide
  Target: ATXN1; (-) strand; PAM type: NRG; PAM sequence: CAG
gcctggtcgcaggccacctg

SEQ ID NO: 66851 - DNA, 20 bp, Artificial Sequence
  Description of Artificial Sequence: Synthetic oligonucleotide
  Target: ATXN1; (-) strand; PAM type: NRG; PAM sequence: AGG
ccccagtctagcctggtcgc

SEQ ID NO: 66852 - DNA, 20 bp, Artificial Sequence
  Description of Artificial Sequence: Synthetic oligonucleotide
  Target: ATXN1; (-) strand; PAM type: NRG; PAM sequence: CAG
tccccagtctagcctggtcg

SEQ ID NO: 66853 - DNA, 20 bp, Artificial Sequence
  Description of Artificial Sequence: Synthetic oligonucleotide
  Target: ATXN1; (-) strand; PAM type: NRG; PAM sequence: TGG
gcctgttccccagtctagcc

SEQ ID NO: 66854 - DNA, 20 bp, Artificial Sequence
  Description of Artificial Sequence: Synthetic oligonucleotide
  Target: ATXN1; (-) strand; PAM type: NRG; PAM sequence: TAG
cacctgcctgttccccagtc

SEQ ID NO: 66855 - DNA, 20 bp, Artificial Sequence
  Description of Artificial Sequence: Synthetic oligonucleotide
  Target: ATXN1; (-) strand; PAM type: NRG; PAM sequence: CAG
cttgacacctgcctgttccc

SEQ ID NO: 66856 - DNA, 20 bp, Artificial Sequence
  Description of Artificial Sequence: Synthetic oligonucleotide
  Target: ATXN1; (-) strand; PAM type: NRG; PAM sequence: GAG
actatgtgactgagggcaat

SEQ ID NO: 66857 - DNA, 20 bp, Artificial Sequence
  Description of Artificial Sequence: Synthetic oligonucleotide
  Target: ATXN1; (-) strand; PAM type: NRG; PAM sequence: GGG
gaatgcaactatgtgactga

SEQ ID NO: 66858 - DNA, 20 bp, Artificial Sequence
  Description of Artificial Sequence: Synthetic oligonucleotide
  Target: ATXN1; (-) strand; PAM type: NRG; PAM sequence: AGG
agaatgcaactatgtgactg

SEQ ID NO: 66859 - DNA, 20 bp, Artificial Sequence
  Description of Artificial Sequence: Synthetic oligonucleotide
  Target: ATXN1; (-) strand; PAM type: NRG; PAM sequence: GAG
cagaatgcaactatgtgact

SEQ ID NO: 66860 - DNA, 20 bp, Artificial Sequence
  Description of Artificial Sequence: Synthetic oligonucleotide
  Target: ATXN1; (-) strand; PAM type: NRG; PAM sequence: CAG
gtattgaggcagacgggggc

SEQ ID NO: 66861 - DNA, 20 bp, Artificial Sequence
  Description of Artificial Sequence: Synthetic oligonucleotide
  Target: ATXN1; (-) strand; PAM type: NRG; PAM sequence: GGG
aagagtattgaggcagacgg

SEQ ID NO: 66862 - DNA, 20 bp, Artificial Sequence
  Description of Artificial Sequence: Synthetic oligonucleotide
  Target: ATXN1; (-) strand; PAM type: NRG; PAM sequence: GGG
caagagtattgaggcagacg

SEQ ID NO: 66863 - DNA, 20 bp, Artificial Sequence
  Description of Artificial Sequence: Synthetic oligonucleotide
  Target: ATXN1; (-) strand; PAM type: NRG; PAM sequence: GGG
acaagagtattgaggcagac

SEQ ID NO: 66864 - DNA, 20 bp, Artificial Sequence
  Description of Artificial Sequence: Synthetic oligonucleotide
  Target: ATXN1; (-) strand; PAM type: NRG; PAM sequence: CGG
gacaagagtattgaggcaga

SEQ ID NO: 66865 - DNA, 20 bp, Artificial Sequence
  Description of Artificial Sequence: Synthetic oligonucleotide
  Target: ATXN1; (-) strand; PAM type: NRG; PAM sequence: CAG
ataagacaagagtattgagg

SEQ ID NO: 66866 - DNA, 20 bp, Artificial Sequence
  Description of Artificial Sequence: Synthetic oligonucleotide
  Target: ATXN1; (-) strand; PAM type: NRG; PAM sequence: AGG
gaaataagacaagagtattg

SEQ ID NO: 66867 - DNA, 20 bp, Artificial Sequence
  Description of Artificial Sequence: Synthetic oligonucleotide
  Target: ATXN1; (-) strand; PAM type: NRG; PAM sequence: GAG
agaaataagacaagagtatt

SEQ ID NO: 66868 - DNA, 20 bp, Artificial Sequence
  Description of Artificial Sequence: Synthetic oligonucleotide
  Target: ATXN1; (-) strand; PAM type: NRG; PAM sequence: GAG
cccactgagaaataagacaa

SEQ ID NO: 66869 - DNA, 20 bp, Artificial Sequence
  Description of Artificial Sequence: Synthetic oligonucleotide
  Target: ATXN1; (-) strand; PAM type: NRG; PAM sequence: AAG
agcccactgagaaataagac

SEQ ID NO: 66870 - DNA, 20 bp, Artificial Sequence
  Description of Artificial Sequence: Synthetic oligonucleotide
  Target: ATXN1; (-) strand; PAM type: NRG; PAM sequence: AAG
ttctgagcccactgagaaat

SEQ ID NO: 66871 - DNA, 20 bp, Artificial Sequence
  Description of Artificial Sequence: Synthetic oligonucleotide
  Target: ATXN1; (-) strand; PAM type: NRG; PAM sequence: GAG
tcccaagttctgagcccact

SEQ ID NO: 66872 - DNA, 20 bp, Artificial Sequence
  Description of Artificial Sequence: Synthetic oligonucleotide
  Target: ATXN1; (-) strand; PAM type: NRG; PAM sequence: GAG
ctcttcccgtcccaagttct

SEQ ID NO: 66873 - DNA, 20 bp, Artificial Sequence
  Description of Artificial Sequence: Synthetic oligonucleotide
  Target: ATXN1; (-) strand; PAM type: NRG; PAM sequence: AAG
aagagttctcttcccgtccc

SEQ ID NO: 66874 - DNA, 20 bp, Artificial Sequence
  Description of Artificial Sequence: Synthetic oligonucleotide
  Target: ATXN1; (-) strand; PAM type: NRG; PAM sequence: GAG
tggaaacttttatcttacaa

SEQ ID NO: 66875 - DNA, 20 bp, Artificial Sequence
  Description of Artificial Sequence: Synthetic oligonucleotide
  Target: ATXN1; (-) strand; PAM type: NRG; PAM sequence: AAG
tatggaaacttttatcttac

SEQ ID NO: 66876 - DNA, 20 bp, Artificial Sequence
  Description of Artificial Sequence: Synthetic oligonucleotide
  Target: ATXN1; (-) strand; PAM type: NRG; PAM sequence: TGG
gagggaaggtttttatctta

SEQ ID NO: 66877 - DNA, 20 bp, Artificial Sequence
  Description of Artificial Sequence: Synthetic oligonucleotide
  Target: ATXN1; (-) strand; PAM type: NRG; PAM sequence: AGG
aggtctgtttaggggaggga

SEQ ID NO: 66878 - DNA, 20 bp, Artificial Sequence
  Description of Artificial Sequence: Synthetic oligonucleotide
  Target: ATXN1; (-) strand; PAM type: NRG; PAM sequence: AAG
gaggtctgtttaggggaggg

SEQ ID NO: 66879 - DNA, 20 bp, Artificial Sequence
  Description of Artificial Sequence: Synthetic oligonucleotide
  Target: ATXN1; (-) strand; PAM type: NRG; PAM sequence: GGG
tttgaggtctgtttagggga

SEQ ID NO: 66880 - DNA, 20 bp, Artificial Sequence
  Description of Artificial Sequence: Synthetic oligonucleotide
  Target: ATXN1; (-) strand; PAM type: NRG; PAM sequence: AGG
ttttgaggtctgtttagggg

SEQ ID NO: 66881 - DNA, 20 bp, Artificial Sequence
  Description of Artificial Sequence: Synthetic oligonucleotide
  Target: ATXN1; (-) strand; PAM type: NRG; PAM sequence: GAG
gttttgaggtctgtttaggg

SEQ ID NO: 66882 - DNA, 20 bp, Artificial Sequence
  Description of Artificial Sequence: Synthetic oligonucleotide
  Target: ATXN1; (-) strand; PAM type: NRG; PAM sequence: GGG
tggttttgaggtctgtttag

SEQ ID NO: 66883 - DNA, 20 bp, Artificial Sequence
  Description of Artificial Sequence: Synthetic oligonucleotide
  Target: ATXN1; (-) strand; PAM type: NRG; PAM sequence: GGG
ttggttttgaggtctgttta

SEQ ID NO: 66884 - DNA, 20 bp, Artificial Sequence
  Description of Artificial Sequence: Synthetic oligonucleotide
  Target: ATXN1; (-) strand; PAM type: NRG; PAM sequence: AGG
tttggttttgaggtctgttt

SEQ ID NO: 66885 - DNA, 20 bp, Artificial Sequence
  Description of Artificial Sequence: Synthetic oligonucleotide
  Target: ATXN1; (-) strand; PAM type: NRG; PAM sequence: TAG
atttggttttgaggtctgtt

SEQ ID NO: 66886 - DNA, 20 bp, Artificial Sequence
  Description of Artificial Sequence: Synthetic oligonucleotide
  Target: ATXN1; (-) strand; PAM type: NRG; PAM sequence: AGG
tgattcctaatttggttttg

SEQ ID NO: 66887 - DNA, 20 bp, Artificial Sequence
  Description of Artificial Sequence: Synthetic oligonucleotide
  Target: ATXN1; (-) strand; PAM type: NRG; PAM sequence: GAG
gtgattcctaatttggtttt

SEQ ID NO: 66888 - DNA, 20 bp, Artificial Sequence
  Description of Artificial Sequence: Synthetic oligonucleotide
  Target: ATXN1; (-) strand; PAM type: NRG; PAM sequence: TGG
taggatagtgattcctaatt

SEQ ID NO: 66889 - DNA, 20 bp, Artificial Sequence
  Description of Artificial Sequence: Synthetic oligonucleotide
  Target: ATXN1; (-) strand; PAM type: NRG; PAM sequence: TAG
ttaggtttgatagattagga

SEQ ID NO: 66890 - DNA, 20 bp, Artificial Sequence
  Description of Artificial Sequence: Synthetic oligonucleotide
  Target: ATXN1; (-) strand; PAM type: NRG; PAM sequence: AGG
tagattaggtttgatagatt

SEQ ID NO: 66891 - DNA, 20 bp, Artificial Sequence
  Description of Artificial Sequence: Synthetic oligonucleotide
  Target: ATXN1; (-) strand; PAM type: NRG; PAM sequence: TAG
atagattaggtttgatagat

SEQ ID NO: 66892 - DNA, 20 bp, Artificial Sequence
  Description of Artificial Sequence: Synthetic oligonucleotide
  Target: ATXN1; (-) strand; PAM type: NRG; PAM sequence: TAG
gacagatagattaggtttga

SEQ ID NO: 66893 - DNA, 20 bp, Artificial Sequence
  Description of Artificial Sequence: Synthetic oligonucleotide
  Target: ATXN1; (-) strand; PAM type: NRG; PAM sequence: AGG
attaagatgacagatagatt

SEQ ID NO: 66894 - DNA, 20 bp, Artificial Sequence
  Description of Artificial Sequence: Synthetic oligonucleotide
  Target: ATXN1; (-) strand; PAM type: NRG; PAM sequence: TAG
cattaagatgacagatagat

SEQ ID NO: 66895 - DNA, 20 bp, Artificial Sequence
  Description of Artificial Sequence: Synthetic oligonucleotide
  Target: ATXN1; (-) strand; PAM type: NRG; PAM sequence: TAG
ttttccattaagatgacaga

SEQ ID NO: 66896 - DNA, 20 bp, Artificial Sequence
  Description of Artificial Sequence: Synthetic oligonucleotide
  Target: ATXN1; (-) strand; PAM type: NRG; PAM sequence: CAG
ggatttttccattaagatga

SEQ ID NO: 66897 - DNA, 20 bp, Artificial Sequence
  Description of Artificial Sequence: Synthetic oligonucleotide
  Target: ATXN1; (-) strand; PAM type: NRG; PAM sequence: AAG
atttgagggatttttccatt

SEQ ID NO: 66898 - DNA, 20 bp, Artificial Sequence
  Description of Artificial Sequence: Synthetic oligonucleotide
  Target: ATXN1; (-) strand; PAM type: NRG; PAM sequence: GGG
ctattaagtaagagatttga

SEQ ID NO: 66899 - DNA, 20 bp, Artificial Sequence
  Description of Artificial Sequence: Synthetic oligonucleotide
  Target: ATXN1; (-) strand; PAM type: NRG; PAM sequence: AGG
actattaagtaagagatttg

SEQ ID NO: 66900 - DNA, 20 bp, Artificial Sequence
  Description of Artificial Sequence: Synthetic oligonucleotide
  Target: ATXN1; (-) strand; PAM type: NRG; PAM sequence: GAG
gactattaagtaagagattt

SEQ ID NO: 66901 - DNA, 20 bp, Artificial Sequence
  Description of Artificial Sequence: Synthetic oligonucleotide
  Target: ATXN1; (-) strand; PAM type: NRG; PAM sequence: GAG
cgttttggactattaagtaa

SEQ ID NO: 66902 - DNA, 20 bp, Artificial Sequence
  Description of Artificial Sequence: Synthetic oligonucleotide
  Target: ATXN1; (-) strand; PAM type: NRG; PAM sequence: AAG
agcgttttggactattaagt

SEQ ID NO: 66903 - DNA, 20 bp, Artificial Sequence
  Description of Artificial Sequence: Synthetic oligonucleotide
  Target: ATXN1; (-) strand; PAM type: NRG; PAM sequence: AAG
gtctagcgttttggactatt

SEQ ID NO: 66904 - DNA, 20 bp, Artificial Sequence
  Description of Artificial Sequence: Synthetic oligonucleotide
  Target: ATXN1; (-) strand; PAM type: NRG; PAM sequence: TGG
gacttctcagtctagcgttt

SEQ ID NO: 66905 - DNA, 20 bp, Artificial Sequence
  Description of Artificial Sequence: Synthetic oligonucleotide
  Target: ATXN1; (-) strand; PAM type: NRG; PAM sequence: TAG
tgggatcagacttctcagtc

SEQ ID NO: 66906 - DNA, 20 bp, Artificial Sequence
  Description of Artificial Sequence: Synthetic oligonucleotide
  Target: ATXN1; (-) strand; PAM type: NRG; PAM sequence: CAG
gtctttgggatcagacttct

SEQ ID NO: 66907 - DNA, 20 bp, Artificial Sequence
  Description of Artificial Sequence: Synthetic oligonucleotide
  Target: ATXN1; (-) strand; PAM type: NRG; PAM sequence: CAG
attgaatttgtctttgggat

SEQ ID NO: 66908 - DNA, 20 bp, Artificial Sequence
  Description of Artificial Sequence: Synthetic oligonucleotide
  Target: ATXN1; (-) strand; PAM type: NRG; PAM sequence: GGG
actgtattgaatttgtcttt

SEQ ID NO: 66909 - DNA, 20 bp, Artificial Sequence
  Description of Artificial Sequence: Synthetic oligonucleotide
  Target: ATXN1; (-) strand; PAM type: NRG; PAM sequence: TGG
cactgtattgaatttgtctt

SEQ ID NO: 66910 - DNA, 20 bp, Artificial Sequence
  Description of Artificial Sequence: Synthetic oligonucleotide
  Target: ATXN1; (-) strand; PAM type: NRG; PAM sequence: TGG
tatacccctgggttttatac

SEQ ID NO: 66911 - DNA, 20 bp, Artificial Sequence
  Description of Artificial Sequence: Synthetic oligonucleotide
  Target: ATXN1; (-) strand; PAM type: NRG; PAM sequence: GGG
tgaccatagcatatacccct

SEQ ID NO: 66912 - DNA, 20 bp, Artificial Sequence
  Description of Artificial Sequence: Synthetic oligonucleotide
  Target: ATXN1; (-) strand; PAM type: NRG; PAM sequence: TGG
ctgaccatagcatatacccc

SEQ ID NO: 66913 - DNA, 20 bp, Artificial Sequence
  Description of Artificial Sequence: Synthetic oligonucleotide
  Target: ATXN1; (-) strand; PAM type: NRG; PAM sequence: TAG
ctctttctggctactgacca

SEQ ID NO: 66914 - DNA, 20 bp, Artificial Sequence
  Description of Artificial Sequence: Synthetic oligonucleotide
  Target: ATXN1; (-) strand; PAM type: NRG; PAM sequence: TGG
tttcctcatcttcctctttc

SEQ ID NO: 66915 - DNA, 20 bp, Artificial Sequence
  Description of Artificial Sequence: Synthetic oligonucleotide
  Target: ATXN1; (-) strand; PAM type: NRG; PAM sequence: AGG
cacaaggtaagaatatctaa

SEQ ID NO: 66916 - DNA, 20 bp, Artificial Sequence
  Description of Artificial Sequence: Synthetic oligonucleotide
  Target: ATXN1; (-) strand; PAM type: NRG; PAM sequence: AAG
tcacaaggtaagaatatcta

SEQ ID NO: 66917 - DNA, 20 bp, Artificial Sequence
  Description of Artificial Sequence: Synthetic oligonucleotide
  Target: ATXN1; (-) strand; PAM type: NRG; PAM sequence: AAG
cagatataaagtcacaaggt

SEQ ID NO: 66918 - DNA, 20 bp, Artificial Sequence
  Description of Artificial Sequence: Synthetic oligonucleotide
  Target: ATXN1; (-) strand; PAM type: NRG; PAM sequence: AGG
aatgcagatataaagtcaca

SEQ ID NO: 66919 - DNA, 20 bp, Artificial Sequence
  Description of Artificial Sequence: Synthetic oligonucleotide
  Target: ATXN1; (-) strand; PAM type: NRG; PAM sequence: AAG
taatgcagatataaagtcac

SEQ ID NO: 66920 - DNA, 20 bp, Artificial Sequence
  Description of Artificial Sequence: Synthetic oligonucleotide
  Target: ATXN1; (-) strand; PAM type: NRG; PAM sequence: AAG
gtttttttaatgcagatata

SEQ ID NO: 66921 - DNA, 20 bp, Artificial Sequence
  Description of Artificial Sequence: Synthetic oligonucleotide
  Target: ATXN1; (-) strand; PAM type: NRG; PAM sequence: CAG
ctaatgtggtttttttaatg

SEQ ID NO: 66922 - DNA, 20 bp, Artificial Sequence
  Description of Artificial Sequence: Synthetic oligonucleotide
  Target: ATXN1; (-) strand; PAM type: NRG; PAM sequence: TGG
aagaaattattttcctaatg

SEQ ID NO: 66923 - DNA, 20 bp, Artificial Sequence
  Description of Artificial Sequence: Synthetic oligonucleotide
  Target: ATXN1; (-) strand; PAM type: NRG; PAM sequence: AAG
ttcaaagaaaagataaactc

SEQ ID NO: 66924 - DNA, 20 bp, Artificial Sequence
  Description of Artificial Sequence: Synthetic oligonucleotide
  Target: ATXN1; (-) strand; PAM type: NRG; PAM sequence: AAG
ttgttcagttcttcaaagaa

SEQ ID NO: 66925 - DNA, 20 bp, Artificial Sequence
  Description of Artificial Sequence: Synthetic oligonucleotide
  Target: ATXN1; (-) strand; PAM type: NRG; PAM sequence: AAG
aaatgttgttcagttcttca

SEQ ID NO: 66926 - DNA, 20 bp, Artificial Sequence
  Description of Artificial Sequence: Synthetic oligonucleotide
  Target: ATXN1; (-) strand; PAM type: NRG; PAM sequence: CAG
aatatattgaaaatgttgtt

SEQ ID NO: 66927 - DNA, 20 bp, Artificial Sequence
  Description of Artificial Sequence: Synthetic oligonucleotide
  Target: ATXN1; (-) strand; PAM type: NRG; PAM sequence: AAG
tcccaaggaaattgtgaggc

SEQ ID NO: 66928 - DNA, 20 bp, Artificial Sequence
  Description of Artificial Sequence: Synthetic oligonucleotide
  Target: ATXN1; (-) strand; PAM type: NRG; PAM sequence: AGG
catctcccaaggaaattgtg

SEQ ID NO: 66929 - DNA, 20 bp, Artificial Sequence
  Description of Artificial Sequence: Synthetic oligonucleotide
  Target: ATXN1; (-) strand; PAM type: NRG; PAM sequence: GAG
ccatctcccaaggaaattgt

SEQ ID NO: 66930 - DNA, 20 bp, Artificial Sequence
  Description of Artificial Sequence: Synthetic oligonucleotide
  Target: ATXN1; (-) strand; PAM type: NRG; PAM sequence: AGG
tattctcactccatctccca

SEQ ID NO: 66931 - DNA, 20 bp, Artificial Sequence
  Description of Artificial Sequence: Synthetic oligonucleotide
  Target: ATXN1; (-) strand; PAM type: NRG; PAM sequence: AAG
atattctcactccatctccc

SEQ ID NO: 66932 - DNA, 20 bp, Artificial Sequence
  Description of Artificial Sequence: Synthetic oligonucleotide
  Target: ATXN1; (-) strand; PAM type: NRG; PAM sequence: TAG
tcacaactgagttctgcaga

SEQ ID NO: 66933 - DNA, 20 bp, Artificial Sequence
  Description of Artificial Sequence: Synthetic oligonucleotide
  Target: ATXN1; (-) strand; PAM type: NRG; PAM sequence: CAG
atgctcacaactgagttctg

SEQ ID NO: 66934 - DNA, 20 bp, Artificial Sequence
  Description of Artificial Sequence: Synthetic oligonucleotide
  Target: ATXN1; (-) strand; PAM type: NRG; PAM sequence: GAG
tttctctaatgctcacaact

SEQ ID NO: 66935 - DNA, 20 bp, Artificial Sequence
  Description of Artificial Sequence: Synthetic oligonucleotide
  Target: ATXN1; (-) strand; PAM type: NRG; PAM sequence: AGG
ggtcgaggctaagcccttca

SEQ ID NO: 66936 - DNA, 20 bp, Artificial Sequence
  Description of Artificial Sequence: Synthetic oligonucleotide
  Target: ATXN1; (-) strand; PAM type: NRG; PAM sequence: AAG
aggtcgaggctaagcccttc

SEQ ID NO: 66937 - DNA, 20 bp, Artificial Sequence
  Description of Artificial Sequence: Synthetic oligonucleotide
  Target: ATXN1; (-) strand; PAM type: NRG; PAM sequence: AAG
gtgttttctaggtcgaggct

SEQ ID NO: 66938 - DNA, 20 bp, Artificial Sequence
  Description of Artificial Sequence: Synthetic oligonucleotide
  Target: ATXN1; (-) strand; PAM type: NRG; PAM sequence: AGG
cctgagtgttttctaggtcg

SEQ ID NO: 66939 - DNA, 20 bp, Artificial Sequence
  Description of Artificial Sequence: Synthetic oligonucleotide
  Target: ATXN1; (-) strand; PAM type: NRG; PAM sequence: GAG
gcctgagtgttttctaggtc

SEQ ID NO: 66940 - DNA, 20 bp, Artificial Sequence
  Description of Artificial Sequence: Synthetic oligonucleotide
  Target: ATXN1; (-) strand; PAM type: NRG; PAM sequence: AGG
tgggggcctgagtgttttct

SEQ ID NO: 66941 - DNA, 20 bp, Artificial Sequence
  Description of Artificial Sequence: Synthetic oligonucleotide
  Target: ATXN1; (-) strand; PAM type: NRG; PAM sequence: TAG
ttgggggcctgagtgttttc

SEQ ID NO: 66942 - DNA, 20 bp, Artificial Sequence
  Description of Artificial Sequence: Synthetic oligonucleotide
  Target: ATXN1; (-) strand; PAM type: NRG; PAM sequence: GAG
atatattgctttgggggcct

SEQ ID NO: 66943 - DNA, 20 bp, Artificial Sequence
  Description of Artificial Sequence: Synthetic oligonucleotide
  Target: ATXN1; (-) strand; PAM type: NRG; PAM sequence: GGG
tttcatatatattgctttgg

SEQ ID NO: 66944 - DNA, 20 bp, Artificial Sequence
  Description of Artificial Sequence: Synthetic oligonucleotide
  Target: ATXN1; (-) strand; PAM type: NRG; PAM sequence: GGG
ttttcatatatattgctttg

SEQ ID NO: 66945 - DNA, 20 bp, Artificial Sequence
  Description of Artificial Sequence: Synthetic oligonucleotide
  Target: ATXN1; (-) strand; PAM type: NRG; PAM sequence: GGG
tttttcatatatattgcttt

SEQ ID NO: 66946 - DNA, 20 bp, Artificial Sequence
  Description of Artificial Sequence: Synthetic oligonucleotide
  Target: ATXN1; (-) strand; PAM type: NRG; PAM sequence: TGG
ttttttcatatatattgctt

SEQ ID NO: 66947 - DNA, 20 bp, Artificial Sequence
  Description of Artificial Sequence: Synthetic oligonucleotide
  Target: ATXN1; (-) strand; PAM type: NRG; PAM sequence: AAG
ttttcccctctgaactcctg

SEQ ID NO: 66948 - DNA, 20 bp, Artificial Sequence
  Description of Artificial Sequence: Synthetic oligonucleotide
  Target: ATXN1; (-) strand; PAM type: NRG; PAM sequence: CGG
gtaagaactcttagttccaa

SEQ ID NO: 66949 - DNA, 20 bp, Artificial Sequence
  Description of Artificial Sequence: Synthetic oligonucleotide
  Target: ATXN1; (-) strand; PAM type: NRG; PAM sequence: TAG
gaaagaattgtaagaactct

SEQ ID NO: 66950 - DNA, 20 bp, Artificial Sequence
  Description of Artificial Sequence: Synthetic oligonucleotide
  Target: ATXN1; (-) strand; PAM type: NRG; PAM sequence: AAG
atccttgatgaaagaattgt

SEQ ID NO: 66951 - DNA, 20 bp, Artificial Sequence
  Description of Artificial Sequence: Synthetic oligonucleotide
  Target: ATXN1; (-) strand; PAM type: NRG; PAM sequence: AAG
atctatataatccttgatga

SEQ ID NO: 66952 - DNA, 20 bp, Artificial Sequence
  Description of Artificial Sequence: Synthetic oligonucleotide
  Target: ATXN1; (-) strand; PAM type: NRG; PAM sequence: GGG
tctctactgatgtgtggttg

SEQ ID NO: 66953 - DNA, 20 bp, Artificial Sequence
  Description of Artificial Sequence: Synthetic oligonucleotide
  Target: ATXN1; (-) strand; PAM type: NRG; PAM sequence: GGG
ttctctactgatgtgtggtt

SEQ ID NO: 66954 - DNA, 20 bp, Artificial Sequence
  Description of Artificial Sequence: Synthetic oligonucleotide
  Target: ATXN1; (-) strand; PAM type: NRG; PAM sequence: TGG
tttctctactgatgtgtggt

SEQ ID NO: 66955 - DNA, 20 bp, Artificial Sequence
  Description of Artificial Sequence: Synthetic oligonucleotide
  Target: ATXN1; (-) strand; PAM type: NRG; PAM sequence: TGG
gcagtttctctactgatgtg

SEQ ID NO: 66956 - DNA, 20 bp, Artificial Sequence
  Description of Artificial Sequence: Synthetic oligonucleotide
  Target: ATXN1; (-) strand; PAM type: NRG; PAM sequence: CAG
agagaggcagtttctaattg

SEQ ID NO: 66957 - DNA, 20 bp, Artificial Sequence
  Description of Artificial Sequence: Synthetic oligonucleotide
  Target: ATXN1; (-) strand; PAM type: NRG; PAM sequence: CAG
gggagctcttaccagagagg

SEQ ID NO: 66958 - DNA, 20 bp, Artificial Sequence
  Description of Artificial Sequence: Synthetic oligonucleotide
  Target: ATXN1; (-) strand; PAM type: NRG; PAM sequence: AGG
tctgggagctcttaccagag

SEQ ID NO: 66959 - DNA, 20 bp, Artificial Sequence
  Description of Artificial Sequence: Synthetic oligonucleotide
  Target: ATXN1; (-) strand; PAM type: NRG; PAM sequence: GAG
ttctgggagctcttaccaga

SEQ ID NO: 66960 - DNA, 20 bp, Artificial Sequence
  Description of Artificial Sequence: Synthetic oligonucleotide
  Target: ATXN1; (-) strand; PAM type: NRG; PAM sequence: GAG
tcttctgggagctcttacca

SEQ ID NO: 66961 - DNA, 20 bp, Artificial Sequence
  Description of Artificial Sequence: Synthetic oligonucleotide
  Target: ATXN1; (-) strand; PAM type: NRG; PAM sequence: CAG
catcttctgggagctcttac

SEQ ID NO: 66962 - DNA, 20 bp, Artificial Sequence
  Description of Artificial Sequence: Synthetic oligonucleotide
  Target: ATXN1; (-) strand; PAM type: NRG; PAM sequence: GAG
acccatttctcatcttctgg

SEQ ID NO: 66963 - DNA, 20 bp, Artificial Sequence
  Description of Artificial Sequence: Synthetic oligonucleotide
  Target: ATXN1; (-) strand; PAM type: NRG; PAM sequence: GGG
atacccatttctcatcttct

SEQ ID NO: 66964 - DNA, 20 bp, Artificial Sequence
  Description of Artificial Sequence: Synthetic oligonucleotide
  Target: ATXN1; (-) strand; PAM type: NRG; PAM sequence: TGG
aatacccatttctcatcttc

SEQ ID NO: 66965 - DNA, 20 bp, Artificial Sequence
  Description of Artificial Sequence: Synthetic oligonucleotide
  Target: ATXN1; (-) strand; PAM type: NRG; PAM sequence: GAG
aggcccagtaggactgcaca

SEQ ID NO: 66966 - DNA, 20 bp, Artificial Sequence
  Description of Artificial Sequence: Synthetic oligonucleotide
  Target: ATXN1; (-) strand; PAM type: NRG; PAM sequence: CAG
ccaggcccagtaggactgca

SEQ ID NO: 66967 - DNA, 20 bp, Artificial Sequence
  Description of Artificial Sequence: Synthetic oligonucleotide
  Target: ATXN1; (-) strand; PAM type: NRG; PAM sequence: AGG
cctgcaatgccaggcccagt

SEQ ID NO: 66968 - DNA, 20 bp, Artificial Sequence
  Description of Artificial Sequence: Synthetic oligonucleotide
  Target: ATXN1; (-) strand; PAM type: NRG; PAM sequence: TAG
gcctgcaatgccaggcccag

SEQ ID NO: 66969 - DNA, 20 bp, Artificial Sequence
  Description of Artificial Sequence: Synthetic oligonucleotide
  Target: ATXN1; (-) strand; PAM type: NRG; PAM sequence: CAG
ggagcctgcaatgccaggcc

SEQ ID NO: 66970 - DNA, 20 bp, Artificial Sequence
  Description of Artificial Sequence: Synthetic oligonucleotide
  Target: ATXN1; (-) strand; PAM type: NRG; PAM sequence: AGG
ccagtggagcctgcaatgcc

SEQ ID NO: 66971 - DNA, 20 bp, Artificial Sequence
  Description of Artificial Sequence: Synthetic oligonucleotide
  Target: ATXN1; (-) strand; PAM type: NRG; PAM sequence: CAG
accagtggagcctgcaatgc

SEQ ID NO: 66972 - DNA, 20 bp, Artificial Sequence
  Description of Artificial Sequence: Synthetic oligonucleotide
  Target: ATXN1; (-) strand; PAM type: NRG; PAM sequence: GAG
tgaggagacacctaccagtg

SEQ ID NO: 66973 - DNA, 20 bp, Artificial Sequence
  Description of Artificial Sequence: Synthetic oligonucleotide
  Target: ATXN1; (-) strand; PAM type: NRG; PAM sequence: TGG
attgaggagacacctaccag

SEQ ID NO: 66974 - DNA, 20 bp, Artificial Sequence
  Description of Artificial Sequence: Synthetic oligonucleotide
  Target: ATXN1; (-) strand; PAM type: NRG; PAM sequence: CAG
cagattgaggagacacctac

SEQ ID NO: 66975 - DNA, 20 bp, Artificial Sequence
  Description of Artificial Sequence: Synthetic oligonucleotide
  Target: ATXN1; (-) strand; PAM type: NRG; PAM sequence: GAG
ttaatatgctgcagattgag

SEQ ID NO: 66976 - DNA, 20 bp, Artificial Sequence
  Description of Artificial Sequence: Synthetic oligonucleotide
  Target: ATXN1; (-) strand; PAM type: NRG; PAM sequence: AGG
atttaatatgctgcagattg

SEQ ID NO: 66977 - DNA, 20 bp, Artificial Sequence
  Description of Artificial Sequence: Synthetic oligonucleotide
  Target: ATXN1; (-) strand; PAM type: NRG; PAM sequence: GAG
catttaatatgctgcagatt

SEQ ID NO: 66978 - DNA, 20 bp, Artificial Sequence
  Description of Artificial Sequence: Synthetic oligonucleotide
  Target: ATXN1; (-) strand; PAM type: NRG; PAM sequence: CAG
agtgctcatttaatatgctg

SEQ ID NO: 66979 - DNA, 20 bp, Artificial Sequence
  Description of Artificial Sequence: Synthetic oligonucleotide
  Target: ATXN1; (-) strand; PAM type: NRG; PAM sequence: GAG
atgtgaaatccagggaaaca

SEQ ID NO: 66980 - DNA, 20 bp, Artificial Sequence
  Description of Artificial Sequence: Synthetic oligonucleotide
  Target: ATXN1; (-) strand; PAM type: NRG; PAM sequence: CAG
caatgtgaaatccagggaaa

SEQ ID NO: 66981 - DNA, 20 bp, Artificial Sequence
  Description of Artificial Sequence: Synthetic oligonucleotide
  Target: ATXN1; (-) strand; PAM type: NRG; PAM sequence: GGG
atggagcaatgtgaaatcca

SEQ ID NO: 66982 - DNA, 20 bp, Artificial Sequence
  Description of Artificial Sequence: Synthetic oligonucleotide
  Target: ATXN1; (-) strand; PAM type: NRG; PAM sequence: AGG
catggagcaatgtgaaatcc

SEQ ID NO: 66983 - DNA, 20 bp, Artificial Sequence
  Description of Artificial Sequence: Synthetic oligonucleotide
  Target: ATXN1; (-) strand; PAM type: NRG; PAM sequence: CAG
acatggagcaatgtgaaatc

SEQ ID NO: 66984 - DNA, 20 bp, Artificial Sequence
  Description of Artificial Sequence: Synthetic oligonucleotide
  Target: ATXN1; (-) strand; PAM type: NRG; PAM sequence: GAG
aatgtgtgggtagtgacatg

SEQ ID NO: 66985 - DNA, 20 bp, Artificial Sequence
  Description of Artificial Sequence: Synthetic oligonucleotide
  Target: ATXN1; (-) strand; PAM type: NRG; PAM sequence: TGG
gaaatgtgtgggtagtgaca

SEQ ID NO: 66986 - DNA, 20 bp, Artificial Sequence
  Description of Artificial Sequence: Synthetic oligonucleotide
  Target: ATXN1; (-) strand; PAM type: NRG; PAM sequence: TAG
tcctggctgaaatgtgtggg

SEQ ID NO: 66987 - DNA, 20 bp, Artificial Sequence
  Description of Artificial Sequence: Synthetic oligonucleotide
  Target: ATXN1; (-) strand; PAM type: NRG; PAM sequence: GGG
tgctcctggctgaaatgtgt

SEQ ID NO: 66988 - DNA, 20 bp, Artificial Sequence
  Description of Artificial Sequence: Synthetic oligonucleotide
  Target: ATXN1; (-) strand; PAM type: NRG; PAM sequence: TGG
ctgctcctggctgaaatgtg

SEQ ID NO: 66989 - DNA, 20 bp, Artificial Sequence
  Description of Artificial Sequence: Synthetic oligonucleotide
  Target: ATXN1; (-) strand; PAM type: NRG; PAM sequence: TGG
gcatcgtggtcagctgctcc

SEQ ID NO: 66990 - DNA, 20 bp, Artificial Sequence
  Description of Artificial Sequence: Synthetic oligonucleotide
  Target: ATXN1; (-) strand; PAM type: NRG; PAM sequence: CAG
tacttcctgggcatcgtggt

SEQ ID NO: 66991 - DNA, 20 bp, Artificial Sequence
  Description of Artificial Sequence: Synthetic oligonucleotide
  Target: ATXN1; (-) strand; PAM type: NRG; PAM sequence: TGG
agggtacttcctgggcatcg

SEQ ID NO: 66992 - DNA, 20 bp, Artificial Sequence
  Description of Artificial Sequence: Synthetic oligonucleotide
  Target: ATXN1; (-) strand; PAM type: NRG; PAM sequence: GGG
tggtggggagggtacttcct

SEQ ID NO: 66993 - DNA, 20 bp, Artificial Sequence
  Description of Artificial Sequence: Synthetic oligonucleotide
  Target: ATXN1; (-) strand; PAM type: NRG; PAM sequence: TGG
ctggtggggagggtacttcc

SEQ ID NO: 66994 - DNA, 20 bp, Artificial Sequence
  Description of Artificial Sequence: Synthetic oligonucleotide
  Target: ATXN1; (-) strand; PAM type: NRG; PAM sequence: GGG
tcagaatgacctggtgggga

SEQ ID NO: 66995 - DNA, 20 bp, Artificial Sequence
  Description of Artificial Sequence: Synthetic oligonucleotide
  Target: ATXN1; (-) strand; PAM type: NRG; PAM sequence: AGG
gtcagaatgacctggtgggg

SEQ ID NO: 66996 - DNA, 20 bp, Artificial Sequence
  Description of Artificial Sequence: Synthetic oligonucleotide
  Target: ATXN1; (-) strand; PAM type: NRG; PAM sequence: GAG
tgtcagaatgacctggtggg

SEQ ID NO: 66997 - DNA, 20 bp, Artificial Sequence
  Description of Artificial Sequence: Synthetic oligonucleotide
  Target: ATXN1; (-) strand; PAM type: NRG; PAM sequence: GGG
tctgtcagaatgacctggtg

SEQ ID NO: 66998 - DNA, 20 bp, Artificial Sequence
  Description of Artificial Sequence: Synthetic oligonucleotide
  Target: ATXN1; (-) strand; PAM type: NRG; PAM sequence: GGG
ctctgtcagaatgacctggt

SEQ ID NO: 66999 - DNA, 20 bp, Artificial Sequence
  Description of Artificial Sequence: Synthetic oligonucleotide
  Target: ATXN1; (-) strand; PAM type: NRG; PAM sequence: TGG
gctctgtcagaatgacctgg

SEQ ID NO: 67000 - DNA, 20 bp, Artificial Sequence
  Description of Artificial Sequence: Synthetic oligonucleotide
  Target: ATXN1; (-) strand; PAM type: NRG; PAM sequence: TGG
gcggctctgtcagaatgacc

SEQ ID NO: 67001 - DNA, 20 bp, Artificial Sequence
  Description of Artificial Sequence: Synthetic oligonucleotide
  Target: ATXN1; (-) strand; PAM type: NRG; PAM sequence: CAG
gtgtggcacagcggctctgt

SEQ ID NO: 67002 - DNA, 20 bp, Artificial Sequence
  Description of Artificial Sequence: Synthetic oligonucleotide
  Target: ATXN1; (-) strand; PAM type: NRG; PAM sequence: CGG
cctccctgtgtgtggcacag

SEQ ID NO: 67003 - DNA, 20 bp, Artificial Sequence
  Description of Artificial Sequence: Synthetic oligonucleotide
  Target: ATXN1; (-) strand; PAM type: NRG; PAM sequence: CAG
catcctccctgtgtgtggca

SEQ ID NO: 67004 - DNA, 20 bp, Artificial Sequence
  Description of Artificial Sequence: Synthetic oligonucleotide
  Target: ATXN1; (-) strand; PAM type: NRG; PAM sequence: TGG
cttttcatcctccctgtgtg

SEQ ID NO: 67005 - DNA, 20 bp, Artificial Sequence
  Description of Artificial Sequence: Synthetic oligonucleotide
  Target: ATXN1; (-) strand; PAM type: NRG; PAM sequence: GAG
agcaattgaaaggaggtgga

SEQ ID NO: 67006 - DNA, 20 bp, Artificial Sequence
  Description of Artificial Sequence: Synthetic oligonucleotide
  Target: ATXN1; (-) strand; PAM type: NRG; PAM sequence: GAG
ttagcaattgaaaggaggtg

SEQ ID NO: 67007 - DNA, 20 bp, Artificial Sequence
  Description of Artificial Sequence: Synthetic oligonucleotide
  Target: ATXN1; (-) strand; PAM type: NRG; PAM sequence: TGG
tcttagcaattgaaaggagg

SEQ ID NO: 67008 - DNA, 20 bp, Artificial Sequence
  Description of Artificial Sequence: Synthetic oligonucleotide
  Target: ATXN1; (-) strand; PAM type: NRG; PAM sequence: AGG
ctgtcttagcaattgaaagg

SEQ ID NO: 67009 - DNA, 20 bp, Artificial Sequence
  Description of Artificial Sequence: Synthetic oligonucleotide
  Target: ATXN1; (-) strand; PAM type: NRG; PAM sequence: GAG
cctgtcttagcaattgaaag

SEQ ID NO: 67010 - DNA, 20 bp, Artificial Sequence
  Description of Artificial Sequence: Synthetic oligonucleotide
  Target: ATXN1; (-) strand; PAM type: NRG; PAM sequence: AGG
tgcctgtcttagcaattgaa

SEQ ID NO: 67011 - DNA, 20 bp, Artificial Sequence
  Description of Artificial Sequence: Synthetic oligonucleotide
  Target: ATXN1; (-) strand; PAM type: NRG; PAM sequence: AAG
ctgcctgtcttagcaattga

SEQ ID NO: 67012 - DNA, 20 bp, Artificial Sequence
  Description of Artificial Sequence: Synthetic oligonucleotide
  Target: ATXN1; (-) strand; PAM type: NRG; PAM sequence: TAG
ttggcagcacctgcctgtct

SEQ ID NO: 67013 - DNA, 20 bp, Artificial Sequence
  Description of Artificial Sequence: Synthetic oligonucleotide
  Target: ATXN1; (-) strand; PAM type: NRG; PAM sequence: CAG
gaatgggtcagcagggttgg

SEQ ID NO: 67014 - DNA, 20 bp, Artificial Sequence
  Description of Artificial Sequence: Synthetic oligonucleotide
  Target: ATXN1; (-) strand; PAM type: NRG; PAM sequence: TGG
tctgaatgggtcagcagggt

SEQ ID NO: 67015 - DNA, 20 bp, Artificial Sequence
  Description of Artificial Sequence: Synthetic oligonucleotide
  Target: ATXN1; (-) strand; PAM type: NRG; PAM sequence: GGG
ggcctctgaatgggtcagca

SEQ ID NO: 67016 - DNA, 20 bp, Artificial Sequence
  Description of Artificial Sequence: Synthetic oligonucleotide
  Target: ATXN1; (-) strand; PAM type: NRG; PAM sequence: AGG
aggcctctgaatgggtcagc

SEQ ID NO: 67017 - DNA, 20 bp, Artificial Sequence
  Description of Artificial Sequence: Synthetic oligonucleotide
  Target: ATXN1; (-) strand; PAM type: NRG; PAM sequence: CAG
caggcctctgaatgggtcag

SEQ ID NO: 67018 - DNA, 20 bp, Artificial Sequence
  Description of Artificial Sequence: Synthetic oligonucleotide
  Target: ATXN1; (-) strand; PAM type: NRG; PAM sequence: CAG
ctgcaggcctctgaatgggt

SEQ ID NO: 67019 - DNA, 20 bp, Artificial Sequence
  Description of Artificial Sequence: Synthetic oligonucleotide
  Target: ATXN1; (-) strand; PAM type: NRG; PAM sequence: GGG
tgttctgcaggcctctgaat

SEQ ID NO: 67020 - DNA, 20 bp, Artificial Sequence
  Description of Artificial Sequence: Synthetic oligonucleotide
  Target: ATXN1; (-) strand; PAM type: NRG; PAM sequence: TGG
gtgttctgcaggcctctgaa

SEQ ID NO: 67021 - DNA, 20 bp, Artificial Sequence
  Description of Artificial Sequence: Synthetic oligonucleotide
  Target: ATXN1; (-) strand; PAM type: NRG; PAM sequence: AGG
tgcctgtaggagtgttctgc

SEQ ID NO: 67022 - DNA, 20 bp, Artificial Sequence
  Description of Artificial Sequence: Synthetic oligonucleotide
  Target: ATXN1; (-) strand; PAM type: NRG; PAM sequence: CAG
atgcctgtaggagtgttctg

SEQ ID NO: 67023 - DNA, 20 bp, Artificial Sequence
  Description of Artificial Sequence: Synthetic oligonucleotide
  Target: ATXN1; (-) strand; PAM type: NRG; PAM sequence: GAG
agacaaggcaatgcctgtag

SEQ ID NO: 67024 - DNA, 20 bp, Artificial Sequence
  Description of Artificial Sequence: Synthetic oligonucleotide
  Target: ATXN1; (-) strand; PAM type: NRG; PAM sequence: AGG
agagacaaggcaatgcctgt

SEQ ID NO: 67025 - DNA, 20 bp, Artificial Sequence
  Description of Artificial Sequence: Synthetic oligonucleotide
  Target: ATXN1; (-) strand; PAM type: NRG; PAM sequence: TAG
gagagacaaggcaatgcctg

SEQ ID NO: 67026 - DNA, 20 bp, Artificial Sequence
  Description of Artificial Sequence: Synthetic oligonucleotide
  Target: ATXN1; (-) strand; PAM type: NRG; PAM sequence: AGG
ttggaacttgatgagagaca

SEQ ID NO: 67027 - DNA, 20 bp, Artificial Sequence
  Description of Artificial Sequence: Synthetic oligonucleotide
  Target: ATXN1; (-) strand; PAM type: NRG; PAM sequence: AAG
cttggaacttgatgagagac

SEQ ID NO: 67028 - DNA, 20 bp, Artificial Sequence
  Description of Artificial Sequence: Synthetic oligonucleotide
  Target: ATXN1; (-) strand; PAM type: NRG; PAM sequence: GAG
tccatcttggaacttgatga

SEQ ID NO: 67029 - DNA, 20 bp, Artificial Sequence
  Description of Artificial Sequence: Synthetic oligonucleotide
  Target: ATXN1; (-) strand; PAM type: NRG; PAM sequence: GAG
ggtccatcttggaacttgat

SEQ ID NO: 67030 - DNA, 20 bp, Artificial Sequence
  Description of Artificial Sequence: Synthetic oligonucleotide
  Target: ATXN1; (-) strand; PAM type: NRG; PAM sequence: TGG
cctcctgtctcggtccatct

SEQ ID NO: 67031 - DNA, 20 bp, Artificial Sequence
  Description of Artificial Sequence: Synthetic oligonucleotide
  Target: ATXN1; (-) strand; PAM type: NRG; PAM sequence: CGG
ttaacacttgcctcctgtct

SEQ ID NO: 67032 - DNA, 20 bp, Artificial Sequence
  Description of Artificial Sequence: Synthetic oligonucleotide
  Target: ATXN1; (-) strand; PAM type: NRG; PAM sequence: TGG
ggagaatgtggttttcgtaa

SEQ ID NO: 67033 - DNA, 20 bp, Artificial Sequence
  Description of Artificial Sequence: Synthetic oligonucleotide
  Target: ATXN1; (-) strand; PAM type: NRG; PAM sequence: TGG
cctgtgatatgcggagaatg

SEQ ID NO: 67034 - DNA, 20 bp, Artificial Sequence
  Description of Artificial Sequence: Synthetic oligonucleotide
  Target: ATXN1; (-) strand; PAM type: NRG; PAM sequence: GAG
cctggggcctgtgatatgcg

SEQ ID NO: 67035 - DNA, 20 bp, Artificial Sequence
  Description of Artificial Sequence: Synthetic oligonucleotide
  Target: ATXN1; (-) strand; PAM type: NRG; PAM sequence: CGG
ctcctggggcctgtgatatg

SEQ ID NO: 67036 - DNA, 20 bp, Artificial Sequence
  Description of Artificial Sequence: Synthetic oligonucleotide
  Target: ATXN1; (-) strand; PAM type: NRG; PAM sequence: GGG
ctcttgcctttcccctcctg

SEQ ID NO: 67037 - DNA, 20 bp, Artificial Sequence
  Description of Artificial Sequence: Synthetic oligonucleotide
  Target: ATXN1; (-) strand; PAM type: NRG; PAM sequence: GGG
tctcttgcctttcccctcct

SEQ ID NO: 67038 - DNA, 20 bp, Artificial Sequence
  Description of Artificial Sequence: Synthetic oligonucleotide
  Target: ATXN1; (-) strand; PAM type: NRG; PAM sequence: TGG
ctctcttgcctttcccctcc

SEQ ID NO: 67039 - DNA, 20 bp, Artificial Sequence
  Description of Artificial Sequence: Synthetic oligonucleotide
  Target: ATXN1; (-) strand; PAM type: NRG; PAM sequence: CAG
tatcctgggcaggatgaggg

SEQ ID NO: 67040 - DNA, 20 bp, Artificial Sequence
  Description of Artificial Sequence: Synthetic oligonucleotide
  Target: ATXN1; (-) strand; PAM type: NRG; PAM sequence: GGG
gtgtatcctgggcaggatga

SEQ ID NO: 67041 - DNA, 20 bp, Artificial Sequence
  Description of Artificial Sequence: Synthetic oligonucleotide
  Target: ATXN1; (-) strand; PAM type: NRG; PAM sequence: AGG
agtgtatcctgggcaggatg

SEQ ID NO: 67042 - DNA, 20 bp, Artificial Sequence
  Description of Artificial Sequence: Synthetic oligonucleotide
  Target: ATXN1; (-) strand; PAM type: NRG; PAM sequence: GAG
cagtgtatcctgggcaggat

SEQ ID NO: 67043 - DNA, 20 bp, Artificial Sequence
  Description of Artificial Sequence: Synthetic oligonucleotide
  Target: ATXN1; (-) strand; PAM type: NRG; PAM sequence: AGG
acagccagtgtatcctgggc

SEQ ID NO: 67044 - DNA, 20 bp, Artificial Sequence
  Description of Artificial Sequence: Synthetic oligonucleotide
  Target: ATXN1; (-) strand; PAM type: NRG; PAM sequence: CAG
gacagccagtgtatcctggg

SEQ ID NO: 67045 - DNA, 20 bp, Artificial Sequence
  Description of Artificial Sequence: Synthetic oligonucleotide
  Target: ATXN1; (-) strand; PAM type: NRG; PAM sequence: GGG
tgtgacagccagtgtatcct

SEQ ID NO: 67046 - DNA, 20 bp, Artificial Sequence
  Description of Artificial Sequence: Synthetic oligonucleotide
  Target: ATXN1; (-) strand; PAM type: NRG; PAM sequence: TGG
ctgtgacagccagtgtatcc

SEQ ID NO: 67047 - DNA, 20 bp, Artificial Sequence
  Description of Artificial Sequence: Synthetic oligonucleotide
  Target: ATXN1; (-) strand; PAM type: NRG; PAM sequence: CAG
catataatgactgtgacagc

SEQ ID NO: 67048 - DNA, 20 bp, Artificial Sequence
  Description of Artificial Sequence: Synthetic oligonucleotide
  Target: ATXN1; (-) strand; PAM type: NRG; PAM sequence: CAG
aaaacatataatgactgtga

SEQ ID NO: 67049 - DNA, 20 bp, Artificial Sequence
  Description of Artificial Sequence: Synthetic oligonucleotide
  Target: ATXN1; (-) strand; PAM type: NRG; PAM sequence: CAG
tagcaacgtgactgtgctgc

SEQ ID NO: 67050 - DNA, 20 bp, Artificial Sequence
  Description of Artificial Sequence: Synthetic oligonucleotide
  Target: ATXN1; (-) strand; PAM type: NRG; PAM sequence: TAG
aatgacatgcattggttcca

SEQ ID NO: 67051 - DNA, 20 bp, Artificial Sequence
  Description of Artificial Sequence: Synthetic oligonucleotide
  Target: ATXN1; (-) strand; PAM type: NRG; PAM sequence: TGG
caggtggcaatgacatgcat

SEQ ID NO: 67052 - DNA, 20 bp, Artificial Sequence
  Description of Artificial Sequence: Synthetic oligonucleotide
  Target: ATXN1; (-) strand; PAM type: NRG; PAM sequence: TGG
tttatttgctagaggccagg

SEQ ID NO: 67053 - DNA, 20 bp, Artificial Sequence
  Description of Artificial Sequence: Synthetic oligonucleotide
  Target: ATXN1; (-) strand; PAM type: NRG; PAM sequence: AGG
gattttatttgctagaggcc

SEQ ID NO: 67054 - DNA, 20 bp, Artificial Sequence
  Description of Artificial Sequence: Synthetic oligonucleotide
  Target: ATXN1; (-) strand; PAM type: NRG; PAM sequence: CAG
tgattttatttgctagaggc

SEQ ID NO: 67055 - DNA, 20 bp, Artificial Sequence
  Description of Artificial Sequence: Synthetic oligonucleotide
  Target: ATXN1; (-) strand; PAM type: NRG; PAM sequence: AGG
gctgtgattttatttgctag

SEQ ID NO: 67056 - DNA, 20 bp, Artificial Sequence
  Description of Artificial Sequence: Synthetic oligonucleotide
  Target: ATXN1; (-) strand; PAM type: NRG; PAM sequence: GAG
cgctgtgattttatttgcta

SEQ ID NO: 67057 - DNA, 20 bp, Artificial Sequence
  Description of Artificial Sequence: Synthetic oligonucleotide
  Target: ATXN1; (-) strand; PAM type: NRG; PAM sequence: TAG
agcgctgtgattttatttgc

SEQ ID NO: 67058 - DNA, 20 bp, Artificial Sequence
  Description of Artificial Sequence: Synthetic oligonucleotide
  Target: ATXN1; (-) strand; PAM type: NRG; PAM sequence: CAG
atccagggaaatgctcttgc

SEQ ID NO: 67059 - DNA, 20 bp, Artificial Sequence
  Description of Artificial Sequence: Synthetic oligonucleotide
  Target: ATXN1; (-) strand; PAM type: NRG; PAM sequence: GGG
atctctttaagggaaatcca

SEQ ID NO: 67060 - DNA, 20 bp, Artificial Sequence
  Description of Artificial Sequence: Synthetic oligonucleotide
  Target: ATXN1; (-) strand; PAM type: NRG; PAM sequence: AGG
tatctctttaagggaaatcc

SEQ ID NO: 67061 - DNA, 20 bp, Artificial Sequence
  Description of Artificial Sequence: Synthetic oligonucleotide
  Target: ATXN1; (-) strand; PAM type: NRG; PAM sequence: CAG
gtatctctttaagggaaatc

SEQ ID NO: 67062 - DNA, 20 bp, Artificial Sequence
  Description of Artificial Sequence: Synthetic oligonucleotide
  Target: ATXN1; (-) strand; PAM type: NRG; PAM sequence: GGG
catcaatggtatctctttaa

SEQ ID NO: 67063 - DNA, 20 bp, Artificial Sequence
  Description of Artificial Sequence: Synthetic oligonucleotide
  Target: ATXN1; (-) strand; PAM type: NRG; PAM sequence: AGG
ccatcaatggtatctcttta

SEQ ID NO: 67064 - DNA, 20 bp, Artificial Sequence
  Description of Artificial Sequence: Synthetic oligonucleotide
  Target: ATXN1; (-) strand; PAM type: NRG; PAM sequence: AAG
accatcaatggtatctcttt

SEQ ID NO: 67065 - DNA, 20 bp, Artificial Sequence
  Description of Artificial Sequence: Synthetic oligonucleotide
  Target: ATXN1; (-) strand; PAM type: NRG; PAM sequence: TGG
caaacagcactcaccatcaa

SEQ ID NO: 67066 - DNA, 20 bp, Artificial Sequence
  Description of Artificial Sequence: Synthetic oligonucleotide
  Target: ATXN1; (-) strand; PAM type: NRG; PAM sequence: CAG
ctgttgtttctaagctcaaa

SEQ ID NO: 67067 - DNA, 20 bp, Artificial Sequence
  Description of Artificial Sequence: Synthetic oligonucleotide
  Target: ATXN1; (-) strand; PAM type: NRG; PAM sequence: AAG
acaatgctgctgttgtttct

SEQ ID NO: 67068 - DNA, 20 bp, Artificial Sequence
  Description of Artificial Sequence: Synthetic oligonucleotide
  Target: ATXN1; (-) strand; PAM type: NRG; PAM sequence: GGG
atgcaatggggctgggtctt

SEQ ID NO: 67069 - DNA, 20 bp, Artificial Sequence
  Description of Artificial Sequence: Synthetic oligonucleotide
  Target: ATXN1; (-) strand; PAM type: NRG; PAM sequence: TGG
tatgcaatggggctgggtct

SEQ ID NO: 67070 - DNA, 20 bp, Artificial Sequence
  Description of Artificial Sequence: Synthetic oligonucleotide
  Target: ATXN1; (-) strand; PAM type: NRG; PAM sequence: GGG
tcatggtatgcaatggggct

SEQ ID NO: 67071 - DNA, 20 bp, Artificial Sequence
  Description of Artificial Sequence: Synthetic oligonucleotide
  Target: ATXN1; (-) strand; PAM type: NRG; PAM sequence: TGG
ttcatggtatgcaatggggc

SEQ ID NO: 67072 - DNA, 20 bp, Artificial Sequence
  Description of Artificial Sequence: Synthetic oligonucleotide
  Target: ATXN1; (-) strand; PAM type: NRG; PAM sequence: GGG
cagtttcatggtatgcaatg

SEQ ID NO: 67073 - DNA, 20 bp, Artificial Sequence
  Description of Artificial Sequence: Synthetic oligonucleotide
  Target: ATXN1; (-) strand; PAM type: NRG; PAM sequence: GGG
tcagtttcatggtatgcaat

SEQ ID NO: 67074 - DNA, 20 bp, Artificial Sequence
  Description of Artificial Sequence: Synthetic oligonucleotide
  Target: ATXN1; (-) strand; PAM type: NRG; PAM sequence: TGG
ctcagtttcatggtatgcaa

SEQ ID NO: 67075 - DNA, 20 bp, Artificial Sequence
  Description of Artificial Sequence: Synthetic oligonucleotide
  Target: ATXN1; (-) strand; PAM type: NRG; PAM sequence: TGG
agtccctgggctcagtttca

SEQ ID NO: 67076 - DNA, 20 bp, Artificial Sequence
  Description of Artificial Sequence: Synthetic oligonucleotide
  Target: ATXN1; (-) strand; PAM type: NRG; PAM sequence: CAG
aaaacgtgagtccctgggct

SEQ ID NO: 67077 - DNA, 20 bp, Artificial Sequence
  Description of Artificial Sequence: Synthetic oligonucleotide
  Target: ATXN1; (-) strand; PAM type: NRG; PAM sequence: GGG
cttgtaaaacgtgagtccct

SEQ ID NO: 67078 - DNA, 20 bp, Artificial Sequence
  Description of Artificial Sequence: Synthetic oligonucleotide
  Target: ATXN1; (-) strand; PAM type: NRG; PAM sequence: TGG
ccttgtaaaacgtgagtccc

SEQ ID NO: 67079 - DNA, 20 bp, Artificial Sequence
  Description of Artificial Sequence: Synthetic oligonucleotide
  Target: ATXN1; (-) strand; PAM type: NRG; PAM sequence: GAG
atatataccttgtaaaacgt

SEQ ID NO: 67080 - DNA, 20 bp, Artificial Sequence
  Description of Artificial Sequence: Synthetic oligonucleotide
  Target: ATXN1; (-) strand; PAM type: NRG; PAM sequence: TGG
ctaaaaagaagctcagaagc

SEQ ID NO: 67081 - DNA, 20 bp, Artificial Sequence
  Description of Artificial Sequence: Synthetic oligonucleotide
  Target: ATXN1; (-) strand; PAM type: NRG; PAM sequence: AAG
ctccctaaaaagaagctcag

SEQ ID NO: 67082 - DNA, 20 bp, Artificial Sequence
  Description of Artificial Sequence: Synthetic oligonucleotide
  Target: ATXN1; (-) strand; PAM type: NRG; PAM sequence: CAG
tttctccctaaaaagaagct

SEQ ID NO: 67083 - DNA, 20 bp, Artificial Sequence
  Description of Artificial Sequence: Synthetic oligonucleotide
  Target: ATXN1; (-) strand; PAM type: NRG; PAM sequence: AAG
gtatttttctccctaaaaag

SEQ ID NO: 67084 - DNA, 20 bp, Artificial Sequence
  Description of Artificial Sequence: Synthetic oligonucleotide
  Target: ATXN1; (-) strand; PAM type: NRG; PAM sequence: AAG
tgagtatttttctccctaaa

SEQ ID NO: 67085 - DNA, 20 bp, Artificial Sequence
  Description of Artificial Sequence: Synthetic oligonucleotide
  Target: ATXN1; (-) strand; PAM type: NRG; PAM sequence: GAG
taaacacagatagaagccat

SEQ ID NO: 67086 - DNA, 20 bp, Artificial Sequence
  Description of Artificial Sequence: Synthetic oligonucleotide
  Target: ATXN1; (-) strand; PAM type: NRG; PAM sequence: AAG
aaaaaactaaacacagatag

SEQ ID NO: 67087 - DNA, 20 bp, Artificial Sequence
  Description of Artificial Sequence: Synthetic oligonucleotide
  Target: ATXN1; (-) strand; PAM type: NRG; PAM sequence: TAG
gagaaaaaactaaacacaga

SEQ ID NO: 67088 - DNA, 20 bp, Artificial Sequence
  Description of Artificial Sequence: Synthetic oligonucleotide
  Target: ATXN1; (-) strand; PAM type: NRG; PAM sequence: CAG
aaatgagaaaaaactaaaca

SEQ ID NO: 67089 - DNA, 20 bp, Artificial Sequence
  Description of Artificial Sequence: Synthetic oligonucleotide
  Target: ATXN1; (-) strand; PAM type: NRG; PAM sequence: GAG
atttttttattttaccaaat

SEQ ID NO: 67090 - DNA, 20 bp, Artificial Sequence
  Description of Artificial Sequence: Synthetic oligonucleotide
  Target: ATXN1; (-) strand; PAM type: NRG; PAM sequence: AAG
attattatccaaaatattac

SEQ ID NO: 67091 - DNA, 20 bp, Artificial Sequence
  Description of Artificial Sequence: Synthetic oligonucleotide
  Target: ATXN1; (-) strand; PAM type: NRG; PAM sequence: GGG
tttgatgttgacattcaaga

SEQ ID NO: 67092 - DNA, 20 bp, Artificial Sequence
  Description of Artificial Sequence: Synthetic oligonucleotide
  Target: ATXN1; (-) strand; PAM type: NRG; PAM sequence: AGG
ctttgatgttgacattcaag

SEQ ID NO: 67093 - DNA, 20 bp, Artificial Sequence
  Description of Artificial Sequence: Synthetic oligonucleotide
  Target: ATXN1; (-) strand; PAM type: NRG; PAM sequence: GAG
actttgatgttgacattcaa

SEQ ID NO: 67094 - DNA, 20 bp, Artificial Sequence
  Description of Artificial Sequence: Synthetic oligonucleotide
  Target: ATXN1; (-) strand; PAM type: NRG; PAM sequence: AAG
gcactttgatgttgacattc

SEQ ID NO: 67095 - DNA, 20 bp, Artificial Sequence
  Description of Artificial Sequence: Synthetic oligonucleotide
  Target: ATXN1; (-) strand; PAM type: NRG; PAM sequence: GAG
tggtttccttctggggtcat

SEQ ID NO: 67096 - DNA, 20 bp, Artificial Sequence
  Description of Artificial Sequence: Synthetic oligonucleotide
  Target: ATXN1; (-) strand; PAM type: NRG; PAM sequence: GGG
gctactttggtttccttctg

SEQ ID NO: 67097 - DNA, 20 bp, Artificial Sequence
  Description of Artificial Sequence: Synthetic oligonucleotide
  Target: ATXN1; (-) strand; PAM type: NRG; PAM sequence: GGG
ggctactttggtttccttct

SEQ ID NO: 67098 - DNA, 20 bp, Artificial Sequence
  Description of Artificial Sequence: Synthetic oligonucleotide
  Target: ATXN1; (-) strand; PAM type: NRG; PAM sequence: TGG
tggctactttggtttccttc

SEQ ID NO: 67099 - DNA, 20 bp, Artificial Sequence
  Description of Artificial Sequence: Synthetic oligonucleotide
  Target: ATXN1; (-) strand; PAM type: NRG; PAM sequence: TGG
tagaccacttgtggctactt

SEQ ID NO: 67100 - DNA, 20 bp, Artificial Sequence
  Description of Artificial Sequence: Synthetic oligonucleotide
  Target: ATXN1; (-) strand; PAM type: NRG; PAM sequence: TGG
gaacccatgtagaccacttg

SEQ ID NO: 67101 - DNA, 20 bp, Artificial Sequence
  Description of Artificial Sequence: Synthetic oligonucleotide
  Target: ATXN1; (-) strand; PAM type: NRG; PAM sequence: TAG
aaggactgcctgaacccatg

SEQ ID NO: 67102 - DNA, 20 bp, Artificial Sequence
  Description of Artificial Sequence: Synthetic oligonucleotide
  Target: ATXN1; (-) strand; PAM type: NRG; PAM sequence: AGG
aatggtgaaggaatgaaaga

SEQ ID NO: 67103 - DNA, 20 bp, Artificial Sequence
  Description of Artificial Sequence: Synthetic oligonucleotide
  Target: ATXN1; (-) strand; PAM type: NRG; PAM sequence: AAG
aaatggtgaaggaatgaaag

SEQ ID NO: 67104 - DNA, 20 bp, Artificial Sequence
  Description of Artificial Sequence: Synthetic oligonucleotide
  Target: ATXN1; (-) strand; PAM type: NRG; PAM sequence: AAG
aagaaatggtgaaggaatga

SEQ ID NO: 67105 - DNA, 20 bp, Artificial Sequence
  Description of Artificial Sequence: Synthetic oligonucleotide
  Target: ATXN1; (-) strand; PAM type: NRG; PAM sequence: AGG
tctgaggcaagaaatggtga

SEQ ID NO: 67106 - DNA, 20 bp, Artificial Sequence
  Description of Artificial Sequence: Synthetic oligonucleotide
  Target: ATXN1; (-) strand; PAM type: NRG; PAM sequence: AAG
gtctgaggcaagaaatggtg

SEQ ID NO: 67107 - DNA, 20 bp, Artificial Sequence
  Description of Artificial Sequence: Synthetic oligonucleotide
  Target: ATXN1; (-) strand; PAM type: NRG; PAM sequence: TGG
gaagggtctgaggcaagaaa

SEQ ID NO: 67108 - DNA, 20 bp, Artificial Sequence
  Description of Artificial Sequence: Synthetic oligonucleotide
  Target: ATXN1; (-) strand; PAM type: NRG; PAM sequence: AAG
ggtagagaagggtctgaggc

SEQ ID NO: 67109 - DNA, 20 bp, Artificial Sequence
  Description of Artificial Sequence: Synthetic oligonucleotide
  Target: ATXN1; (-) strand; PAM type: NRG; PAM sequence: AGG
aactggtagagaagggtctg

SEQ ID NO: 67110 - DNA, 20 bp, Artificial Sequence
  Description of Artificial Sequence: Synthetic oligonucleotide
  Target: ATXN1; (-) strand; PAM type: NRG; PAM sequence: GAG
aaactggtagagaagggtct

SEQ ID NO: 67111 - DNA, 20 bp, Artificial Sequence
  Description of Artificial Sequence: Synthetic oligonucleotide
  Target: ATXN1; (-) strand; PAM type: NRG; PAM sequence: GGG
aagaataaactggtagagaa

SEQ ID NO: 67112 - DNA, 20 bp, Artificial Sequence
  Description of Artificial Sequence: Synthetic oligonucleotide
  Target: ATXN1; (-) strand; PAM type: NRG; PAM sequence: AGG
aaagaataaactggtagaga

SEQ ID NO: 67113 - DNA, 20 bp, Artificial Sequence
  Description of Artificial Sequence: Synthetic oligonucleotide
  Target: ATXN1; (-) strand; PAM type: NRG; PAM sequence: AAG
taaagaataaactggtagag

SEQ ID NO: 67114 - DNA, 20 bp, Artificial Sequence
  Description of Artificial Sequence: Synthetic oligonucleotide
  Target: ATXN1; (-) strand; PAM type: NRG; PAM sequence: GAG
gggtaaagaataaactggta

SEQ ID NO: 67115 - DNA, 20 bp, Artificial Sequence
  Description of Artificial Sequence: Synthetic oligonucleotide
  Target: ATXN1; (-) strand; PAM type: NRG; PAM sequence: TAG
ttgggtaaagaataaactgg

SEQ ID NO: 67116 - DNA, 20 bp, Artificial Sequence
  Description of Artificial Sequence: Synthetic oligonucleotide
  Target: ATXN1; (-) strand; PAM type: NRG; PAM sequence: TGG
tctttgggtaaagaataaac

SEQ ID NO: 67117 - DNA, 20 bp, Artificial Sequence
  Description of Artificial Sequence: Synthetic oligonucleotide
  Target: ATXN1; (-) strand; PAM type: NRG; PAM sequence: AAG
atcataggattctttgggta

SEQ ID NO: 67118 - DNA, 20 bp, Artificial Sequence
  Description of Artificial Sequence: Synthetic oligonucleotide
  Target: ATXN1; (-) strand; PAM type: NRG; PAM sequence: GGG
cttacatcataggattcttt

SEQ ID NO: 67119 - DNA, 20 bp, Artificial Sequence
  Description of Artificial Sequence: Synthetic oligonucleotide
  Target: ATXN1; (-) strand; PAM type: NRG; PAM sequence: TGG
gcttacatcataggattctt

SEQ ID NO: 67120 - DNA, 20 bp, Artificial Sequence
  Description of Artificial Sequence: Synthetic oligonucleotide
  Target: ATXN1; (-) strand; PAM type: NRG; PAM sequence: AGG
catttccatgcttacatcat

SEQ ID NO: 67121 - DNA, 20 bp, Artificial Sequence
  Description of Artificial Sequence: Synthetic oligonucleotide
  Target: ATXN1; (-) strand; PAM type: NRG; PAM sequence: TAG
ccatttccatgcttacatca

SEQ ID NO: 67122 - DNA, 20 bp, Artificial Sequence
  Description of Artificial Sequence: Synthetic oligonucleotide
  Target: ATXN1; (-) strand; PAM type: NRG; PAM sequence: AAG
ttaagggccttgagaaagtg

SEQ ID NO: 67123 - DNA, 20 bp, Artificial Sequence
  Description of Artificial Sequence: Synthetic oligonucleotide
  Target: ATXN1; (-) strand; PAM type: NRG; PAM sequence: AAG
ggcaattaagggccttgaga

SEQ ID NO: 67124 - DNA, 20 bp, Artificial Sequence
  Description of Artificial Sequence: Synthetic oligonucleotide
  Target: ATXN1; (-) strand; PAM type: NRG; PAM sequence: GAG
agggggcaattaagggcctt

SEQ ID NO: 67125 - DNA, 20 bp, Artificial Sequence
  Description of Artificial Sequence: Synthetic oligonucleotide
  Target: ATXN1; (-) strand; PAM type: NRG; PAM sequence: GGG
taaaagaagggggcaattaa

SEQ ID NO: 67126 - DNA, 20 bp, Artificial Sequence
  Description of Artificial Sequence: Synthetic oligonucleotide
  Target: ATXN1; (-) strand; PAM type: NRG; PAM sequence: AGG
ctaaaagaagggggcaatta

SEQ ID NO: 67127 - DNA, 20 bp, Artificial Sequence
  Description of Artificial Sequence: Synthetic oligonucleotide
  Target: ATXN1; (-) strand; PAM type: NRG; PAM sequence: AAG
actaaaagaagggggcaatt

SEQ ID NO: 67128 - DNA, 20 bp, Artificial Sequence
  Description of Artificial Sequence: Synthetic oligonucleotide
  Target: ATXN1; (-) strand; PAM type: NRG; PAM sequence: GGG
ttaattagactaaaagaagg

SEQ ID NO: 67129 - DNA, 20 bp, Artificial Sequence
  Description of Artificial Sequence: Synthetic oligonucleotide
  Target: ATXN1; (-) strand; PAM type: NRG; PAM sequence: GGG
attaattagactaaaagaag

SEQ ID NO: 67130 - DNA, 20 bp, Artificial Sequence
  Description of Artificial Sequence: Synthetic oligonucleotide
  Target: ATXN1; (-) strand; PAM type: NRG; PAM sequence: GGG
gattaattagactaaaagaa

SEQ ID NO: 67131 - DNA, 20 bp, Artificial Sequence
  Description of Artificial Sequence: Synthetic oligonucleotide
  Target: ATXN1; (-) strand; PAM type: NRG; PAM sequence: AGG
agattaattagactaaaaga

SEQ ID NO: 67132 - DNA, 20 bp, Artificial Sequence
  Description of Artificial Sequence: Synthetic oligonucleotide
  Target: ATXN1; (-) strand; PAM type: NRG; PAM sequence: AAG
gagattaattagactaaaag

SEQ ID NO: 67133 - DNA, 20 bp, Artificial Sequence
  Description of Artificial Sequence: Synthetic oligonucleotide
  Target: ATXN1; (-) strand; PAM type: NRG; PAM sequence: AAG
caagagattaattagactaa

SEQ ID NO: 67134 - DNA, 20 bp, Artificial Sequence
  Description of Artificial Sequence: Synthetic oligonucleotide
  Target: ATXN1; (-) strand; PAM type: NRG; PAM sequence: TAG
tttagagtcaagagattaat

SEQ ID NO: 67135 - DNA, 20 bp, Artificial Sequence
  Description of Artificial Sequence: Synthetic oligonucleotide
  Target: ATXN1; (-) strand; PAM type: NRG; PAM sequence: GAG
aaaggtctctttagagtcaa

SEQ ID NO: 67136 - DNA, 20 bp, Artificial Sequence
  Description of Artificial Sequence: Synthetic oligonucleotide
  Target: ATXN1; (-) strand; PAM type: NRG; PAM sequence: AAG
gtaaaggtctctttagagtc

SEQ ID NO: 67137 - DNA, 20 bp, Artificial Sequence
  Description of Artificial Sequence: Synthetic oligonucleotide
  Target: ATXN1; (-) strand; PAM type: NRG; PAM sequence: GAG
ggactgtaaaggtctcttta

SEQ ID NO: 67138 - DNA, 20 bp, Artificial Sequence
  Description of Artificial Sequence: Synthetic oligonucleotide
  Target: ATXN1; (-) strand; PAM type: NRG; PAM sequence: TAG
ggggactgtaaaggtctctt

SEQ ID NO: 67139 - DNA, 20 bp, Artificial Sequence
  Description of Artificial Sequence: Synthetic oligonucleotide
  Target: ATXN1; (-) strand; PAM type: NRG; PAM sequence: AGG
ttgctctctggggactgtaa

SEQ ID NO: 67140 - DNA, 20 bp, Artificial Sequence
  Description of Artificial Sequence: Synthetic oligonucleotide
  Target: ATXN1; (-) strand; PAM type: NRG; PAM sequence: AAG
gttgctctctggggactgta

SEQ ID NO: 67141 - DNA, 20 bp, Artificial Sequence
  Description of Artificial Sequence: Synthetic oligonucleotide
  Target: ATXN1; (-) strand; PAM type: NRG; PAM sequence: GGG
ctgacacctgttgctctctg

SEQ ID NO: 67142 - DNA, 20 bp, Artificial Sequence
  Description of Artificial Sequence: Synthetic oligonucleotide
  Target: ATXN1; (-) strand; PAM type: NRG; PAM sequence: GGG
actgacacctgttgctctct

SEQ ID NO: 67143 - DNA, 20 bp, Artificial Sequence
  Description of Artificial Sequence: Synthetic oligonucleotide
  Target: ATXN1; (-) strand; PAM type: NRG; PAM sequence: TGG
cactgacacctgttgctctc

SEQ ID NO: 67144 - DNA, 20 bp, Artificial Sequence
  Description of Artificial Sequence: Synthetic oligonucleotide
  Target: ATXN1; (-) strand; PAM type: NRG; PAM sequence: GGG
agcacaccacagtacaatgt

SEQ ID NO: 67145 - DNA, 20 bp, Artificial Sequence
  Description of Artificial Sequence: Synthetic oligonucleotide
  Target: ATXN1; (-) strand; PAM type: NRG; PAM sequence: TGG
gagcacaccacagtacaatg

SEQ ID NO: 67146 - DNA, 20 bp, Artificial Sequence
  Description of Artificial Sequence: Synthetic oligonucleotide
  Target: ATXN1; (-) strand; PAM type: NRG; PAM sequence: CAG
tttattctcagagcacacca

SEQ ID NO: 67147 - DNA, 20 bp, Artificial Sequence
  Description of Artificial Sequence: Synthetic oligonucleotide
  Target: ATXN1; (-) strand; PAM type: NRG; PAM sequence: GAG
gcccaaaaagtttattctca

SEQ ID NO: 67148 - DNA, 20 bp, Artificial Sequence
  Description of Artificial Sequence: Synthetic oligonucleotide
  Target: ATXN1; (-) strand; PAM type: NRG; PAM sequence: CAG
aagcccaaaaagtttattct

SEQ ID NO: 67149 - DNA, 20 bp, Artificial Sequence
  Description of Artificial Sequence: Synthetic oligonucleotide
  Target: ATXN1; (-) strand; PAM type: NRG; PAM sequence: AAG
ttatctgagaaaagcccaaa

SEQ ID NO: 67150 - DNA, 20 bp, Artificial Sequence
  Description of Artificial Sequence: Synthetic oligonucleotide
  Target: ATXN1; (-) strand; PAM type: NRG; PAM sequence: AAG
tttcctgtcttatctgagaa

SEQ ID NO: 67151 - DNA, 20 bp, Artificial Sequence
  Description of Artificial Sequence: Synthetic oligonucleotide
  Target: ATXN1; (-) strand; PAM type: NRG; PAM sequence: GAG
tccattttcctgtcttatct

SEQ ID NO: 67152 - DNA, 20 bp, Artificial Sequence
  Description of Artificial Sequence: Synthetic oligonucleotide
  Target: ATXN1; (-) strand; PAM type: NRG; PAM sequence: AGG
agcattcattagaactgtga

SEQ ID NO: 67153 - DNA, 20 bp, Artificial Sequence
  Description of Artificial Sequence: Synthetic oligonucleotide
  Target: ATXN1; (-) strand; PAM type: NRG; PAM sequence: AAG
tagcattcattagaactgtg

SEQ ID NO: 67154 - DNA, 20 bp, Artificial Sequence
  Description of Artificial Sequence: Synthetic oligonucleotide
  Target: ATXN1; (-) strand; PAM type: NRG; PAM sequence: TAG
ctacacgagttagcattcat

SEQ ID NO: 67155 - DNA, 20 bp, Artificial Sequence
  Description of Artificial Sequence: Synthetic oligonucleotide
  Target: ATXN1; (-) strand; PAM type: NRG; PAM sequence: TAG
agagctgggtctacacgagt

SEQ ID NO: 67156 - DNA, 20 bp, Artificial Sequence
  Description of Artificial Sequence: Synthetic oligonucleotide
  Target: ATXN1; (-) strand; PAM type: NRG; PAM sequence: GAG
ccacagagctgggtctacac

SEQ ID NO: 67157 - DNA, 20 bp, Artificial Sequence
  Description of Artificial Sequence: Synthetic oligonucleotide
  Target: ATXN1; (-) strand; PAM type: NRG; PAM sequence: GGG
tcgctcctgtccacagagct

SEQ ID NO: 67158 - DNA, 20 bp, Artificial Sequence
  Description of Artificial Sequence: Synthetic oligonucleotide
  Target: ATXN1; (-) strand; PAM type: NRG; PAM sequence: TGG
atcgctcctgtccacagagc

SEQ ID NO: 67159 - DNA, 20 bp, Artificial Sequence
  Description of Artificial Sequence: Synthetic oligonucleotide
  Target: ATXN1; (-) strand; PAM type: NRG; PAM sequence: GAG
attgatcgctcctgtccaca

SEQ ID NO: 67160 - DNA, 20 bp, Artificial Sequence
  Description of Artificial Sequence: Synthetic oligonucleotide
  Target: ATXN1; (-) strand; PAM type: NRG; PAM sequence: CAG
acattgatcgctcctgtcca

SEQ ID NO: 67161 - DNA, 20 bp, Artificial Sequence
  Description of Artificial Sequence: Synthetic oligonucleotide
  Target: ATXN1; (-) strand; PAM type: NRG; PAM sequence: GAG
tttgtgagggatcatctgct

SEQ ID NO: 67162 - DNA, 20 bp, Artificial Sequence
  Description of Artificial Sequence: Synthetic oligonucleotide
  Target: ATXN1; (-) strand; PAM type: NRG; PAM sequence: GGG
catagattgctgatttgtga

SEQ ID NO: 67163 - DNA, 20 bp, Artificial Sequence
  Description of Artificial Sequence: Synthetic oligonucleotide
  Target: ATXN1; (-) strand; PAM type: NRG; PAM sequence: AGG
acatagattgctgatttgtg

SEQ ID NO: 67164 - DNA, 20 bp, Artificial Sequence
  Description of Artificial Sequence: Synthetic oligonucleotide
  Target: ATXN1; (-) strand; PAM type: NRG; PAM sequence: GAG
aacatagattgctgatttgt

SEQ ID NO: 67165 - DNA, 20 bp, Artificial Sequence
  Description of Artificial Sequence: Synthetic oligonucleotide
  Target: ATXN1; (-) strand; PAM type: NRG; PAM sequence: TAG
actgaatggaatgtagaaca

SEQ ID NO: 67166 - DNA, 20 bp, Artificial Sequence
  Description of Artificial Sequence: Synthetic oligonucleotide
  Target: ATXN1; (-) strand; PAM type: NRG; PAM sequence: TAG
ccaacatactgaatggaatg

SEQ ID NO: 67167 - DNA, 20 bp, Artificial Sequence
  Description of Artificial Sequence: Synthetic oligonucleotide
  Target: ATXN1; (-) strand; PAM type: NRG; PAM sequence: TGG
gtgtctaccaacatactgaa

SEQ ID NO: 67168 - DNA, 20 bp, Artificial Sequence
  Description of Artificial Sequence: Synthetic oligonucleotide
  Target: ATXN1; (-) strand; PAM type: NRG; PAM sequence: TGG
tatgtacatacagacgtaat

SEQ ID NO: 67169 - DNA, 20 bp, Artificial Sequence
  Description of Artificial Sequence: Synthetic oligonucleotide
  Target: ATXN1; (-) strand; PAM type: NRG; PAM sequence: CAG
atcatctccttatgtacata

SEQ ID NO: 67170 - DNA, 20 bp, Artificial Sequence
  Description of Artificial Sequence: Synthetic oligonucleotide
  Target: ATXN1; (-) strand; PAM type: NRG; PAM sequence: CGG
cctaactagagtcattattg

SEQ ID NO: 67171 - DNA, 20 bp, Artificial Sequence
  Description of Artificial Sequence: Synthetic oligonucleotide
  Target: ATXN1; (-) strand; PAM type: NRG; PAM sequence: GAG
tttgtcttcttccctaacta

SEQ ID NO: 67172 - DNA, 20 bp, Artificial Sequence
  Description of Artificial Sequence: Synthetic oligonucleotide
  Target: ATXN1; (-) strand; PAM type: NRG; PAM sequence: TAG
actttgtcttcttccctaac

SEQ ID NO: 67173 - DNA, 20 bp, Artificial Sequence
  Description of Artificial Sequence: Synthetic oligonucleotide
  Target: ATXN1; (-) strand; PAM type: NRG; PAM sequence: CAG
tattattttatccaacttgt

SEQ ID NO: 67174 - DNA, 20 bp, Artificial Sequence
  Description of Artificial Sequence: Synthetic oligonucleotide
  Target: ATXN1; (-) strand; PAM type: NRG; PAM sequence: GAG
tggtcaaagggtagtattaa

SEQ ID NO: 67175 - DNA, 20 bp, Artificial Sequence
  Description of Artificial Sequence: Synthetic oligonucleotide
  Target: ATXN1; (-) strand; PAM type: NRG; PAM sequence: AAG
agtggtcaaagggtagtatt

SEQ ID NO: 67176 - DNA, 20 bp, Artificial Sequence
  Description of Artificial Sequence: Synthetic oligonucleotide
  Target: ATXN1; (-) strand; PAM type: NRG; PAM sequence: TAG
cctagggagtggtcaaaggg

SEQ ID NO: 67177 - DNA, 20 bp, Artificial Sequence
  Description of Artificial Sequence: Synthetic oligonucleotide
  Target: ATXN1; (-) strand; PAM type: NRG; PAM sequence: GGG
tcacctagggagtggtcaaa

SEQ ID NO: 67178 - DNA, 20 bp, Artificial Sequence
  Description of Artificial Sequence: Synthetic oligonucleotide
  Target: ATXN1; (-) strand; PAM type: NRG; PAM sequence: AGG
ctcacctagggagtggtcaa

SEQ ID NO: 67179 - DNA, 20 bp, Artificial Sequence
  Description of Artificial Sequence: Synthetic oligonucleotide
  Target: ATXN1; (-) strand; PAM type: NRG; PAM sequence: AAG
tctcacctagggagtggtca

SEQ ID NO: 67180 - DNA, 20 bp, Artificial Sequence
  Description of Artificial Sequence: Synthetic oligonucleotide
  Target: ATXN1; (-) strand; PAM type: NRG; PAM sequence: TGG
atttcatctcacctagggag

SEQ ID NO: 67181 - DNA, 20 bp, Artificial Sequence
  Description of Artificial Sequence: Synthetic oligonucleotide
  Target: ATXN1; (-) strand; PAM type: NRG; PAM sequence: GAG
aacatttcatctcacctagg

SEQ ID NO: 67182 - DNA, 20 bp, Artificial Sequence
  Description of Artificial Sequence: Synthetic oligonucleotide
  Target: ATXN1; (-) strand; PAM type: NRG; PAM sequence: GGG
aaaacatttcatctcaccta

SEQ ID NO: 67183 - DNA, 20 bp, Artificial Sequence
  Description of Artificial Sequence: Synthetic oligonucleotide
  Target: ATXN1; (-) strand; PAM type: NRG; PAM sequence: AGG
caaaacatttcatctcacct

SEQ ID NO: 67184 - DNA, 20 bp, Artificial Sequence
  Description of Artificial Sequence: Synthetic oligonucleotide
  Target: ATXN1; (-) strand; PAM type: NRG; PAM sequence: TAG
ccaaaacatttcatctcacc

SEQ ID NO: 67185 - DNA, 20 bp, Artificial Sequence
  Description of Artificial Sequence: Synthetic oligonucleotide
  Target: ATXN1; (-) strand; PAM type: NRG; PAM sequence: AAG
ttcatttaggttggtgaact

SEQ ID NO: 67186 - DNA, 20 bp, Artificial Sequence
  Description of Artificial Sequence: Synthetic oligonucleotide
  Target: ATXN1; (-) strand; PAM type: NRG; PAM sequence: TGG
caaattgtgttcatttaggt

SEQ ID NO: 67187 - DNA, 20 bp, Artificial Sequence
  Description of Artificial Sequence: Synthetic oligonucleotide
  Target: ATXN1; (-) strand; PAM type: NRG; PAM sequence: AGG
gcttcaaattgtgttcattt

SEQ ID NO: 67188 - DNA, 20 bp, Artificial Sequence
  Description of Artificial Sequence: Synthetic oligonucleotide
  Target: ATXN1; (-) strand; PAM type: NRG; PAM sequence: TAG
ggcttcaaattgtgttcatt

SEQ ID NO: 67189 - DNA, 20 bp, Artificial Sequence
  Description of Artificial Sequence: Synthetic oligonucleotide
  Target: ATXN1; (-) strand; PAM type: NRG; PAM sequence: TGG
tagacatcctaggttaaatc

SEQ ID NO: 67190 - DNA, 20 bp, Artificial Sequence
  Description of Artificial Sequence: Synthetic oligonucleotide
  Target: ATXN1; (-) strand; PAM type: NRG; PAM sequence: AGG
tttgtttttttagacatcct

SEQ ID NO: 67191 - DNA, 20 bp, Artificial Sequence
  Description of Artificial Sequence: Synthetic oligonucleotide
  Target: ATXN1; (-) strand; PAM type: NRG; PAM sequence: TAG
gtttgtttttttagacatcc

SEQ ID NO: 67192 - DNA, 20 bp, Artificial Sequence
  Description of Artificial Sequence: Synthetic oligonucleotide
  Target: ATXN1; (-) strand; PAM type: NRG; PAM sequence: TAG
tgtttgtttgtttgtttttt

SEQ ID NO: 67193 - DNA, 20 bp, Artificial Sequence
  Description of Artificial Sequence: Synthetic oligonucleotide
  Target: ATXN1; (-) strand; PAM type: NRG; PAM sequence: TGG
ggtaaacttgactgtgtgtg

SEQ ID NO: 67194 - DNA, 20 bp, Artificial Sequence
  Description of Artificial Sequence: Synthetic oligonucleotide
  Target: ATXN1; (-) strand; PAM type: NRG; PAM sequence: AGG
ttctcagttagaatcccaga

SEQ ID NO: 67195 - DNA, 20 bp, Artificial Sequence
  Description of Artificial Sequence: Synthetic oligonucleotide
  Target: ATXN1; (-) strand; PAM type: NRG; PAM sequence: AAG
attctcagttagaatcccag

SEQ ID NO: 67196 - DNA, 20 bp, Artificial Sequence
  Description of Artificial Sequence: Synthetic oligonucleotide
  Target: ATXN1; (-) strand; PAM type: NRG; PAM sequence: CAG
atgattctcagttagaatcc

SEQ ID NO: 67197 - DNA, 20 bp, Artificial Sequence
  Description of Artificial Sequence: Synthetic oligonucleotide
  Target: ATXN1; (-) strand; PAM type: NRG; PAM sequence: TAG
ttaagaatatgattctcagt

SEQ ID NO: 67198 - DNA, 20 bp, Artificial Sequence
  Description of Artificial Sequence: Synthetic oligonucleotide
  Target: ATXN1; (-) strand; PAM type: NRG; PAM sequence: CAG
gaagttaagaatatgattct

SEQ ID NO: 67199 - DNA, 20 bp, Artificial Sequence
  Description of Artificial Sequence: Synthetic oligonucleotide
  Target: ATXN1; (-) strand; PAM type: NRG; PAM sequence: AAG
caataagatggagagaagtt

SEQ ID NO: 67200 - DNA, 20 bp, Artificial Sequence
  Description of Artificial Sequence: Synthetic oligonucleotide
  Target: ATXN1; (-) strand; PAM type: NRG; PAM sequence: AAG
ttgtgcaataagatggagag

SEQ ID NO: 67201 - DNA, 20 bp, Artificial Sequence
  Description of Artificial Sequence: Synthetic oligonucleotide
  Target: ATXN1; (-) strand; PAM type: NRG; PAM sequence: GAG
cagttgtgcaataagatgga

SEQ ID NO: 67202 - DNA, 20 bp, Artificial Sequence
  Description of Artificial Sequence: Synthetic oligonucleotide
  Target: ATXN1; (-) strand; PAM type: NRG; PAM sequence: GAG
tgcagttgtgcaataagatg

SEQ ID NO: 67203 - DNA, 20 bp, Artificial Sequence
  Description of Artificial Sequence: Synthetic oligonucleotide
  Target: ATXN1; (-) strand; PAM type: NRG; PAM sequence: TGG
agtgcagttgtgcaataaga

SEQ ID NO: 67204 - DNA, 20 bp, Artificial Sequence
  Description of Artificial Sequence: Synthetic oligonucleotide
  Target: ATXN1; (-) strand; PAM type: NRG; PAM sequence: AAG
taagagtgcagttgtgcaat

SEQ ID NO: 67205 - DNA, 20 bp, Artificial Sequence
  Description of Artificial Sequence: Synthetic oligonucleotide
  Target: ATXN1; (-) strand; PAM type: NRG; PAM sequence: CAG
ttggtttttacataagagtg

SEQ ID NO: 67206 - DNA, 20 bp, Artificial Sequence
  Description of Artificial Sequence: Synthetic oligonucleotide
  Target: ATXN1; (-) strand; PAM type: NRG; PAM sequence: GAG
ttatgttggtttttacataa

SEQ ID NO: 67207 - DNA, 20 bp, Artificial Sequence
  Description of Artificial Sequence: Synthetic oligonucleotide
  Target: ATXN1; (-) strand; PAM type: NRG; PAM sequence: AAG
agttatgttggtttttacat

SEQ ID NO: 67208 - DNA, 20 bp, Artificial Sequence
  Description of Artificial Sequence: Synthetic oligonucleotide
  Target: ATXN1; (-) strand; PAM type: NRG; PAM sequence: TGG
cgttttttttaaagttatgt

SEQ ID NO: 67209 - DNA, 20 bp, Artificial Sequence
  Description of Artificial Sequence: Synthetic oligonucleotide
  Target: ATXN1; (-) strand; PAM type: NRG; PAM sequence: AAG
ccatttattcgtttttttta

SEQ ID NO: 67210 - DNA, 20 bp, Artificial Sequence
  Description of Artificial Sequence: Synthetic oligonucleotide
  Target: ATXN1; (-) strand; PAM type: NRG; PAM sequence: CGG
caggcgtgagccaccgcgcc

SEQ ID NO: 67211 - DNA, 20 bp, Artificial Sequence
  Description of Artificial Sequence: Synthetic oligonucleotide
  Target: ATXN1; (-) strand; PAM type: NRG; PAM sequence: GAG
agtgctgggattacaggcgt

SEQ ID NO: 67212 - DNA, 20 bp, Artificial Sequence
  Description of Artificial Sequence: Synthetic oligonucleotide
  Target: ATXN1; (-) strand; PAM type: NRG; PAM sequence: AGG
tcccaaagtgctgggattac

SEQ ID NO: 67213 - DNA, 20 bp, Artificial Sequence
  Description of Artificial Sequence: Synthetic oligonucleotide
  Target: ATXN1; (-) strand; PAM type: NRG; PAM sequence: CAG
ctcccaaagtgctgggatta

SEQ ID NO: 67214 - DNA, 20 bp, Artificial Sequence
  Description of Artificial Sequence: Synthetic oligonucleotide
  Target: ATXN1; (-) strand; PAM type: NRG; PAM sequence: GGG
cctcggcctcccaaagtgct

SEQ ID NO: 67215 - DNA, 20 bp, Artificial Sequence
  Description of Artificial Sequence: Synthetic oligonucleotide
  Target: ATXN1; (-) strand; PAM type: NRG; PAM sequence: TGG
gcctcggcctcccaaagtgc

SEQ ID NO: 67216 - DNA, 20 bp, Artificial Sequence
  Description of Artificial Sequence: Synthetic oligonucleotide
  Target: ATXN1; (-) strand; PAM type: NRG; PAM sequence: AAG
tgatccgcctcggcctccca

SEQ ID NO: 67217 - DNA, 20 bp, Artificial Sequence
  Description of Artificial Sequence: Synthetic oligonucleotide
  Target: ATXN1; (-) strand; PAM type: NRG; PAM sequence: CGG
cctgacctcgtgatccgcct

SEQ ID NO: 67218 - DNA, 20 bp, Artificial Sequence
  Description of Artificial Sequence: Synthetic oligonucleotide
  Target: ATXN1; (-) strand; PAM type: NRG; PAM sequence: TGG
tttcactgtgttaccaagga

SEQ ID NO: 67219 - DNA, 20 bp, Artificial Sequence
  Description of Artificial Sequence: Synthetic oligonucleotide
  Target: ATXN1; (-) strand; PAM type: NRG; PAM sequence: AGG
tgggtttcactgtgttacca

SEQ ID NO: 67220 - DNA, 20 bp, Artificial Sequence
  Description of Artificial Sequence: Synthetic oligonucleotide
  Target: ATXN1; (-) strand; PAM type: NRG; PAM sequence: AAG
atgggtttcactgtgttacc

SEQ ID NO: 67221 - DNA, 20 bp, Artificial Sequence
  Description of Artificial Sequence: Synthetic oligonucleotide
  Target: ATXN1; (-) strand; PAM type: NRG; PAM sequence: GGG
tttgtatttttagtagagat

SEQ ID NO: 67222 - DNA, 20 bp, Artificial Sequence
  Description of Artificial Sequence: Synthetic oligonucleotide
  Target: ATXN1; (-) strand; PAM type: NRG; PAM sequence: TGG
ttttgtatttttagtagaga

SEQ ID NO: 67223 - DNA, 20 bp, Artificial Sequence
  Description of Artificial Sequence: Synthetic oligonucleotide
  Target: ATXN1; (-) strand; PAM type: NRG; PAM sequence: GAG
aattttttgtatttttagta

SEQ ID NO: 67224 - DNA, 20 bp, Artificial Sequence
  Description of Artificial Sequence: Synthetic oligonucleotide
  Target: ATXN1; (-) strand; PAM type: NRG; PAM sequence: TAG
ctaattttttgtatttttag

SEQ ID NO: 67225 - DNA, 20 bp, Artificial Sequence
  Description of Artificial Sequence: Synthetic oligonucleotide
  Target: ATXN1; (-) strand; PAM type: NRG; PAM sequence: TAG
tggctaattttttgtatttt

SEQ ID NO: 67226 - DNA, 20 bp, Artificial Sequence
  Description of Artificial Sequence: Synthetic oligonucleotide
  Target: ATXN1; (-) strand; PAM type: NRG; PAM sequence: TGG
caggtgcctgccaccatgcc

SEQ ID NO: 67227 - DNA, 20 bp, Artificial Sequence
  Description of Artificial Sequence: Synthetic oligonucleotide
  Target: ATXN1; (-) strand; PAM type: NRG; PAM sequence: AGG
tcctgagtagctgggactac

SEQ ID NO: 67228 - DNA, 20 bp, Artificial Sequence
  Description of Artificial Sequence: Synthetic oligonucleotide
  Target: ATXN1; (-) strand; PAM type: NRG; PAM sequence: CAG
ctcctgagtagctgggacta

SEQ ID NO: 67229 - DNA, 20 bp, Artificial Sequence
  Description of Artificial Sequence: Synthetic oligonucleotide
  Target: ATXN1; (-) strand; PAM type: NRG; PAM sequence: GGG
cctcagcctcctgagtagct

SEQ ID NO: 67230 - DNA, 20 bp, Artificial Sequence
  Description of Artificial Sequence: Synthetic oligonucleotide
  Target: ATXN1; (-) strand; PAM type: NRG; PAM sequence: TGG
gcctcagcctcctgagtagc

SEQ ID NO: 67231 - DNA, 20 bp, Artificial Sequence
  Description of Artificial Sequence: Synthetic oligonucleotide
  Target: ATXN1; (-) strand; PAM type: NRG; PAM sequence: TAG
tcctgcctcagcctcctgag

SEQ ID NO: 67232 - DNA, 20 bp, Artificial Sequence
  Description of Artificial Sequence: Synthetic oligonucleotide
  Target: ATXN1; (-) strand; PAM type: NRG; PAM sequence: GAG
ttctcctgcctcagcctcct

SEQ ID NO: 67233 - DNA, 20 bp, Artificial Sequence
  Description of Artificial Sequence: Synthetic oligonucleotide
  Target: ATXN1; (-) strand; PAM type: NRG; PAM sequence: CAG
ttcacgccattctcctgcct

SEQ ID NO: 67234 - DNA, 20 bp, Artificial Sequence
  Description of Artificial Sequence: Synthetic oligonucleotide
  Target: ATXN1; (-) strand; PAM type: NRG; PAM sequence: GGG
cactgcaagctccgcctccc

SEQ ID NO: 67235 - DNA, 20 bp, Artificial Sequence
  Description of Artificial Sequence: Synthetic oligonucleotide
  Target: ATXN1; (-) strand; PAM type: NRG; PAM sequence: CGG
tcactgcaagctccgcctcc

SEQ ID NO: 67236 - DNA, 20 bp, Artificial Sequence
  Description of Artificial Sequence: Synthetic oligonucleotide
  Target: ATXN1; (-) strand; PAM type: NRG; PAM sequence: AAG
gcacgatctcggctcactgc

SEQ ID NO: 67237 - DNA, 20 bp, Artificial Sequence
  Description of Artificial Sequence: Synthetic oligonucleotide
  Target: ATXN1; (-) strand; PAM type: NRG; PAM sequence: CGG
ggagtgcagtggcacgatct

SEQ ID NO: 67238 - DNA, 20 bp, Artificial Sequence
  Description of Artificial Sequence: Synthetic oligonucleotide
  Target: ATXN1; (-) strand; PAM type: NRG; PAM sequence: TGG
tcgcccaggctggagtgcag

SEQ ID NO: 67239 - DNA, 20 bp, Artificial Sequence
  Description of Artificial Sequence: Synthetic oligonucleotide
  Target: ATXN1; (-) strand; PAM type: NRG; PAM sequence: CAG
ctgtcgcccaggctggagtg

SEQ ID NO: 67240 - DNA, 20 bp, Artificial Sequence
  Description of Artificial Sequence: Synthetic oligonucleotide
  Target: ATXN1; (-) strand; PAM type: NRG; PAM sequence: GAG
tccctctgtcgcccaggctg

SEQ ID NO: 67241 - DNA, 20 bp, Artificial Sequence
  Description of Artificial Sequence: Synthetic oligonucleotide
  Target: ATXN1; (-) strand; PAM type: NRG; PAM sequence: TGG
tctccctctgtcgcccaggc

SEQ ID NO: 67242 - DNA, 20 bp, Artificial Sequence
  Description of Artificial Sequence: Synthetic oligonucleotide
  Target: ATXN1; (-) strand; PAM type: NRG; PAM sequence: AGG
cggatctccctctgtcgccc

SEQ ID NO: 67243 - DNA, 20 bp, Artificial Sequence
  Description of Artificial Sequence: Synthetic oligonucleotide
  Target: ATXN1; (-) strand; PAM type: NRG; PAM sequence: CAG
acggatctccctctgtcgcc

SEQ ID NO: 67244 - DNA, 20 bp, Artificial Sequence
  Description of Artificial Sequence: Synthetic oligonucleotide
  Target: ATXN1; (-) strand; PAM type: NRG; PAM sequence: CGG
tttatttatttactttgaga

SEQ ID NO: 67245 - DNA, 20 bp, Artificial Sequence
  Description of Artificial Sequence: Synthetic oligonucleotide
  Target: ATXN1; (-) strand; PAM type: NRG; PAM sequence: GAG
tttgtttatttatttacttt

SEQ ID NO: 67246 - DNA, 20 bp, Artificial Sequence
  Description of Artificial Sequence: Synthetic oligonucleotide
  Target: ATXN1; (-) strand; PAM type: NRG; PAM sequence: GAG
tgaccttcatagagactttt

SEQ ID NO: 67247 - DNA, 20 bp, Artificial Sequence
  Description of Artificial Sequence: Synthetic oligonucleotide
  Target: ATXN1; (-) strand; PAM type: NRG; PAM sequence: GAG
gtacaaatctgaccttcata

SEQ ID NO: 67248 - DNA, 20 bp, Artificial Sequence
  Description of Artificial Sequence: Synthetic oligonucleotide
  Target: ATXN1; (-) strand; PAM type: NRG; PAM sequence: TAG
aagtacaaatctgaccttca

SEQ ID NO: 67249 - DNA, 20 bp, Artificial Sequence
  Description of Artificial Sequence: Synthetic oligonucleotide
  Target: ATXN1; (-) strand; PAM type: NRG; PAM sequence: AAG
ctaacagggttcctatattg

SEQ ID NO: 67250 - DNA, 20 bp, Artificial Sequence
  Description of Artificial Sequence: Synthetic oligonucleotide
  Target: ATXN1; (-) strand; PAM type: NRG; PAM sequence: GGG
ctgcagaagaatggctaaca

SEQ ID NO: 67251 - DNA, 20 bp, Artificial Sequence
  Description of Artificial Sequence: Synthetic oligonucleotide
  Target: ATXN1; (-) strand; PAM type: NRG; PAM sequence: AGG
cctgcagaagaatggctaac

SEQ ID NO: 67252 - DNA, 20 bp, Artificial Sequence
  Description of Artificial Sequence: Synthetic oligonucleotide
  Target: ATXN1; (-) strand; PAM type: NRG; PAM sequence: CAG
acctgcagaagaatggctaa

SEQ ID NO: 67253 - DNA, 20 bp, Artificial Sequence
  Description of Artificial Sequence: Synthetic oligonucleotide
  Target: ATXN1; (-) strand; PAM type: NRG; PAM sequence: TGG
tgtctgcacctgcagaagaa

SEQ ID NO: 67254 - DNA, 20 bp, Artificial Sequence
  Description of Artificial Sequence: Synthetic oligonucleotide
  Target: ATXN1; (-) strand; PAM type: NRG; PAM sequence: AAG
gcggttgtctgcacctgcag

SEQ ID NO: 67255 - DNA, 20 bp, Artificial Sequence
  Description of Artificial Sequence: Synthetic oligonucleotide
  Target: ATXN1; (-) strand; PAM type: NRG; PAM sequence: CAG
ctcgcggttgtctgcacctg

SEQ ID NO: 67256 - DNA, 20 bp, Artificial Sequence
  Description of Artificial Sequence: Synthetic oligonucleotide
  Target: ATXN1; (-) strand; PAM type: NRG; PAM sequence: CGG
agacccacacacccgactcg

SEQ ID NO: 67257 - DNA, 20 bp, Artificial Sequence
  Description of Artificial Sequence: Synthetic oligonucleotide
  Target: ATXN1; (-) strand; PAM type: NRG; PAM sequence: CAG
aggtgtgtgcagtccagctg

SEQ ID NO: 67258 - DNA, 20 bp, Artificial Sequence
  Description of Artificial Sequence: Synthetic oligonucleotide
  Target: ATXN1; (-) strand; PAM type: NRG; PAM sequence: CAG
acctgcaggtgtgtgcagtc

SEQ ID NO: 67259 - DNA, 20 bp, Artificial Sequence
  Description of Artificial Sequence: Synthetic oligonucleotide
  Target: ATXN1; (-) strand; PAM type: NRG; PAM sequence: CAG
ggtacacctgcaggtgtgtg

SEQ ID NO: 67260 - DNA, 20 bp, Artificial Sequence
  Description of Artificial Sequence: Synthetic oligonucleotide
  Target: ATXN1; (-) strand; PAM type: NRG; PAM sequence: AGG
agaagtcatggtacacctgc

SEQ ID NO: 67261 - DNA, 20 bp, Artificial Sequence
  Description of Artificial Sequence: Synthetic oligonucleotide
  Target: ATXN1; (-) strand; PAM type: NRG; PAM sequence: CAG
tagaagtcatggtacacctg

SEQ ID NO: 67262 - DNA, 20 bp, Artificial Sequence
  Description of Artificial Sequence: Synthetic oligonucleotide
  Target: ATXN1; (-) strand; PAM type: NRG; PAM sequence: TGG
tgctttgcagctagaagtca

SEQ ID NO: 67263 - DNA, 20 bp, Artificial Sequence
  Description of Artificial Sequence: Synthetic oligonucleotide
  Target: ATXN1; (-) strand; PAM type: NRG; PAM sequence: AAG
tacatctgctttgcagctag

SEQ ID NO: 67264 - DNA, 20 bp, Artificial Sequence
  Description of Artificial Sequence: Synthetic oligonucleotide
  Target: ATXN1; (-) strand; PAM type: NRG; PAM sequence: TAG
tggtacatctgctttgcagc

SEQ ID NO: 67265 - DNA, 20 bp, Artificial Sequence
  Description of Artificial Sequence: Synthetic oligonucleotide
  Target: ATXN1; (-) strand; PAM type: NRG; PAM sequence: CAG
ttggtggtacatctgctttg

SEQ ID NO: 67266 - DNA, 20 bp, Artificial Sequence
  Description of Artificial Sequence: Synthetic oligonucleotide
  Target: ATXN1; (-) strand; PAM type: NRG; PAM sequence: TGG
tgtcatgtgctgagacttgg

SEQ ID NO: 67267 - DNA, 20 bp, Artificial Sequence
  Description of Artificial Sequence: Synthetic oligonucleotide
  Target: ATXN1; (-) strand; PAM type: NRG; PAM sequence: TGG
cgttgtcatgtgctgagact

SEQ ID NO: 67268 - DNA, 20 bp, Artificial Sequence
  Description of Artificial Sequence: Synthetic oligonucleotide
  Target: ATXN1; (-) strand; PAM type: NRG; PAM sequence: GAG
atgccacgttgtcatgtgct

SEQ ID NO: 67269 - DNA, 20 bp, Artificial Sequence
  Description of Artificial Sequence: Synthetic oligonucleotide
  Target: ATXN1; (-) strand; PAM type: NRG; PAM sequence: AAG
gttatggatgtcatctgaga

SEQ ID NO: 67270 - DNA, 20 bp, Artificial Sequence
  Description of Artificial Sequence: Synthetic oligonucleotide
  Target: ATXN1; (-) strand; PAM type: NRG; PAM sequence: GAG
ttctgttatggatgtcatct

SEQ ID NO: 67271 - DNA, 20 bp, Artificial Sequence
  Description of Artificial Sequence: Synthetic oligonucleotide
  Target: ATXN1; (-) strand; PAM type: NRG; PAM sequence: TGG
cacccagaacacttctgtta

SEQ ID NO: 67272 - DNA, 20 bp, Artificial Sequence
  Description of Artificial Sequence: Synthetic oligonucleotide
  Target: ATXN1; (-) strand; PAM type: NRG; PAM sequence: CAG
gttggcagagtgagtgcacc

SEQ ID NO: 67273 - DNA, 20 bp, Artificial Sequence
  Description of Artificial Sequence: Synthetic oligonucleotide
  Target: ATXN1; (-) strand; PAM type: NRG; PAM sequence: GAG
agtaaaggggttggcagagt

SEQ ID NO: 67274 - DNA, 20 bp, Artificial Sequence
  Description of Artificial Sequence: Synthetic oligonucleotide
  Target: ATXN1; (-) strand; PAM type: NRG; PAM sequence: GAG
actaagtaaaggggttggca

SEQ ID NO: 67275 - DNA, 20 bp, Artificial Sequence
  Description of Artificial Sequence: Synthetic oligonucleotide
  Target: ATXN1; (-) strand; PAM type: NRG; PAM sequence: CAG
ctactaagtaaaggggttgg

SEQ ID NO: 67276 - DNA, 20 bp, Artificial Sequence
  Description of Artificial Sequence: Synthetic oligonucleotide
  Target: ATXN1; (-) strand; PAM type: NRG; PAM sequence: TGG
tggctactaagtaaaggggt

SEQ ID NO: 67277 - DNA, 20 bp, Artificial Sequence
  Description of Artificial Sequence: Synthetic oligonucleotide
  Target: ATXN1; (-) strand; PAM type: NRG; PAM sequence: GGG
tagttggctactaagtaaag

SEQ ID NO: 67278 - DNA, 20 bp, Artificial Sequence
  Description of Artificial Sequence: Synthetic oligonucleotide
  Target: ATXN1; (-) strand; PAM type: NRG; PAM sequence: GGG
ctagttggctactaagtaaa

SEQ ID NO: 67279 - DNA, 20 bp, Artificial Sequence
  Description of Artificial Sequence: Synthetic oligonucleotide
  Target: ATXN1; (-) strand; PAM type: NRG; PAM sequence: AGG
cctagttggctactaagtaa

SEQ ID NO: 67280 - DNA, 20 bp, Artificial Sequence
  Description of Artificial Sequence: Synthetic oligonucleotide
  Target: ATXN1; (-) strand; PAM type: NRG; PAM sequence: AAG
tcctagttggctactaagta

SEQ ID NO: 67281 - DNA, 20 bp, Artificial Sequence
  Description of Artificial Sequence: Synthetic oligonucleotide
  Target: ATXN1; (-) strand; PAM type: NRG; PAM sequence: AAG
cataatcctagttggctact

SEQ ID NO: 67282 - DNA, 20 bp, Artificial Sequence
  Description of Artificial Sequence: Synthetic oligonucleotide
  Target: ATXN1; (-) strand; PAM type: NRG; PAM sequence: TGG
gactttctcataatcctagt

SEQ ID NO: 67283 - DNA, 20 bp, Artificial Sequence
  Description of Artificial Sequence: Synthetic oligonucleotide
  Target: ATXN1; (-) strand; PAM type: NRG; PAM sequence: TAG
atttgactttctcataatcc

SEQ ID NO: 67284 - DNA, 20 bp, Artificial Sequence
  Description of Artificial Sequence: Synthetic oligonucleotide
  Target: ATXN1; (-) strand; PAM type: NRG; PAM sequence: TAG
agggtcaagactgatactga

SEQ ID NO: 67285 - DNA, 20 bp, Artificial Sequence
  Description of Artificial Sequence: Synthetic oligonucleotide
  Target: ATXN1; (-) strand; PAM type: NRG; PAM sequence: AAG
tcacccctaaggcaagggtc

SEQ ID NO: 67286 - DNA, 20 bp, Artificial Sequence
  Description of Artificial Sequence: Synthetic oligonucleotide
  Target: ATXN1; (-) strand; PAM type: NRG; PAM sequence: GGG
aatgatcacccctaaggcaa

SEQ ID NO: 67287 - DNA, 20 bp, Artificial Sequence
  Description of Artificial Sequence: Synthetic oligonucleotide
  Target: ATXN1; (-) strand; PAM type: NRG; PAM sequence: AGG
taatgatcacccctaaggca

SEQ ID NO: 67288 - DNA, 20 bp, Artificial Sequence
  Description of Artificial Sequence: Synthetic oligonucleotide
  Target: ATXN1; (-) strand; PAM type: NRG; PAM sequence: AAG
ataatgatcacccctaaggc

SEQ ID NO: 67289 - DNA, 20 bp, Artificial Sequence
  Description of Artificial Sequence: Synthetic oligonucleotide
  Target: ATXN1; (-) strand; PAM type: NRG; PAM sequence: AGG
tctaataatgatcaccccta

SEQ ID NO: 67290 - DNA, 20 bp, Artificial Sequence
  Description of Artificial Sequence: Synthetic oligonucleotide
  Target: ATXN1; (-) strand; PAM type: NRG; PAM sequence: AAG
atctaataatgatcacccct

SEQ ID NO: 67291 - DNA, 20 bp, Artificial Sequence
  Description of Artificial Sequence: Synthetic oligonucleotide
  Target: ATXN1; (-) strand; PAM type: NRG; PAM sequence: TGG
agtttaacttaatgtggtct

SEQ ID NO: 67292 - DNA, 20 bp, Artificial Sequence
  Description of Artificial Sequence: Synthetic oligonucleotide
  Target: ATXN1; (-) strand; PAM type: NRG; PAM sequence: TGG
ataggtagtttaacttaatg

SEQ ID NO: 67293 - DNA, 20 bp, Artificial Sequence
  Description of Artificial Sequence: Synthetic oligonucleotide
  Target: ATXN1; (-) strand; PAM type: NRG; PAM sequence: TAG
tgaggctgtagagttatagg

SEQ ID NO: 67294 - DNA, 20 bp, Artificial Sequence
  Description of Artificial Sequence: Synthetic oligonucleotide
  Target: ATXN1; (-) strand; PAM type: NRG; PAM sequence: AGG
ttttgaggctgtagagttat

SEQ ID NO: 67295 - DNA, 20 bp, Artificial Sequence
  Description of Artificial Sequence: Synthetic oligonucleotide
  Target: ATXN1; (-) strand; PAM type: NRG; PAM sequence: TAG
tttttgaggctgtagagtta

SEQ ID NO: 67296 - DNA, 20 bp, Artificial Sequence
  Description of Artificial Sequence: Synthetic oligonucleotide
  Target: ATXN1; (-) strand; PAM type: NRG; PAM sequence: GAG
agattctttttgaggctgta

SEQ ID NO: 67297 - DNA, 20 bp, Artificial Sequence
  Description of Artificial Sequence: Synthetic oligonucleotide
  Target: ATXN1; (-) strand; PAM type: NRG; PAM sequence: TAG
gcagattctttttgaggctg

SEQ ID NO: 67298 - DNA, 20 bp, Artificial Sequence
  Description of Artificial Sequence: Synthetic oligonucleotide
  Target: ATXN1; (-) strand; PAM type: NRG; PAM sequence: AGG
gaatctgcagattctttttg

SEQ ID NO: 67299 - DNA, 20 bp, Artificial Sequence
  Description of Artificial Sequence: Synthetic oligonucleotide
  Target: ATXN1; (-) strand; PAM type: NRG; PAM sequence: GAG
ggaatctgcagattcttttt

SEQ ID NO: 67300 - DNA, 20 bp, Artificial Sequence
  Description of Artificial Sequence: Synthetic oligonucleotide
  Target: ATXN1; (-) strand; PAM type: NRG; PAM sequence: CAG
aagtctggttttggaatctg

SEQ ID NO: 67301 - DNA, 20 bp, Artificial Sequence
  Description of Artificial Sequence: Synthetic oligonucleotide
  Target: ATXN1; (-) strand; PAM type: NRG; PAM sequence: TGG
gccctgcacaagtctggttt

SEQ ID NO: 67302 - DNA, 20 bp, Artificial Sequence
  Description of Artificial Sequence: Synthetic oligonucleotide
  Target: ATXN1; (-) strand; PAM type: NRG; PAM sequence: TGG
atgtttgccctgcacaagtc

SEQ ID NO: 67303 - DNA, 20 bp, Artificial Sequence
  Description of Artificial Sequence: Synthetic oligonucleotide
  Target: ATXN1; (-) strand; PAM type: NRG; PAM sequence: AAG
gcatgatgtttgccctgcac

SEQ ID NO: 67304 - DNA, 20 bp, Artificial Sequence
  Description of Artificial Sequence: Synthetic oligonucleotide
  Target: ATXN1; (-) strand; PAM type: NRG; PAM sequence: TAG
atactggtgtgtttggctcc

SEQ ID NO: 67305 - DNA, 20 bp, Artificial Sequence
  Description of Artificial Sequence: Synthetic oligonucleotide
  Target: ATXN1; (-) strand; PAM type: NRG; PAM sequence: TGG
gattttgatactggtgtgtt

SEQ ID NO: 67306 - DNA, 20 bp, Artificial Sequence
  Description of Artificial Sequence: Synthetic oligonucleotide
  Target: ATXN1; (-) strand; PAM type: NRG; PAM sequence: TGG
cagagctaggattttgatac

SEQ ID NO: 67307 - DNA, 20 bp, Artificial Sequence
  Description of Artificial Sequence: Synthetic oligonucleotide
  Target: ATXN1; (-) strand; PAM type: NRG; PAM sequence: AGG
tcatggagagtagcagagct

SEQ ID NO: 67308 - DNA, 20 bp, Artificial Sequence
  Description of Artificial Sequence: Synthetic oligonucleotide
  Target: ATXN1; (-) strand; PAM type: NRG; PAM sequence: TAG
ttcatggagagtagcagagc

SEQ ID NO: 67309 - DNA, 20 bp, Artificial Sequence
  Description of Artificial Sequence: Synthetic oligonucleotide
  Target: ATXN1; (-) strand; PAM type: NRG; PAM sequence: GAG
gggcttcatggagagtagca

SEQ ID NO: 67310 - DNA, 20 bp, Artificial Sequence
  Description of Artificial Sequence: Synthetic oligonucleotide
  Target: ATXN1; (-) strand; PAM type: NRG; PAM sequence: CAG
tggggcttcatggagagtag

SEQ ID NO: 67311 - DNA, 20 bp, Artificial Sequence
  Description of Artificial Sequence: Synthetic oligonucleotide
  Target: ATXN1; (-) strand; PAM type: NRG; PAM sequence: TAG
ttatggggcttcatggagag

SEQ ID NO: 67312 - DNA, 20 bp, Artificial Sequence
  Description of Artificial Sequence: Synthetic oligonucleotide
  Target: ATXN1; (-) strand; PAM type: NRG; PAM sequence: GAG
cctttatggggcttcatgga

SEQ ID NO: 67313 - DNA, 20 bp, Artificial Sequence
  Description of Artificial Sequence: Synthetic oligonucleotide
  Target: ATXN1; (-) strand; PAM type: NRG; PAM sequence: GAG
cacctttatggggcttcatg

SEQ ID NO: 67314 - DNA, 20 bp, Artificial Sequence
  Description of Artificial Sequence: Synthetic oligonucleotide
  Target: ATXN1; (-) strand; PAM type: NRG; PAM sequence: TGG
atcacctttatggggcttca

SEQ ID NO: 67315 - DNA, 20 bp, Artificial Sequence
  Description of Artificial Sequence: Synthetic oligonucleotide
  Target: ATXN1; (-) strand; PAM type: NRG; PAM sequence: GGG
aggctcacatcacctttatg

SEQ ID NO: 67316 - DNA, 20 bp, Artificial Sequence
  Description of Artificial Sequence: Synthetic oligonucleotide
  Target: ATXN1; (-) strand; PAM type: NRG; PAM sequence: GGG
gaggctcacatcacctttat

SEQ ID NO: 67317 - DNA, 20 bp, Artificial Sequence
  Description of Artificial Sequence: Synthetic oligonucleotide
  Target: ATXN1; (-) strand; PAM type: NRG; PAM sequence: TGG
agaggctcacatcaccttta

SEQ ID NO: 67318 - DNA, 20 bp, Artificial Sequence
  Description of Artificial Sequence: Synthetic oligonucleotide
  Target: ATXN1; (-) strand; PAM type: NRG; PAM sequence: AGG
atggggcatctgaggcccag

SEQ ID NO: 67319 - DNA, 20 bp, Artificial Sequence
  Description of Artificial Sequence: Synthetic oligonucleotide
  Target: ATXN1; (-) strand; PAM type: NRG; PAM sequence: GAG
gatggggcatctgaggccca

SEQ ID NO: 67320 - DNA, 20 bp, Artificial Sequence
  Description of Artificial Sequence: Synthetic oligonucleotide
  Target: ATXN1; (-) strand; PAM type: NRG; PAM sequence: CAG
cagatggggcatctgaggcc

SEQ ID NO: 67321 - DNA, 20 bp, Artificial Sequence
  Description of Artificial Sequence: Synthetic oligonucleotide
  Target: ATXN1; (-) strand; PAM type: NRG; PAM sequence: AGG
atgtacagatggggcatctg

SEQ ID NO: 67322 - DNA, 20 bp, Artificial Sequence
  Description of Artificial Sequence: Synthetic oligonucleotide
  Target: ATXN1; (-) strand; PAM type: NRG; PAM sequence: GAG
tatgtacagatggggcatct

SEQ ID NO: 67323 - DNA, 20 bp, Artificial Sequence
  Description of Artificial Sequence: Synthetic oligonucleotide
  Target: ATXN1; (-) strand; PAM type: NRG; PAM sequence: GGG
aaaggccctatgtacagatg

SEQ ID NO: 67324 - DNA, 20 bp, Artificial Sequence
  Description of Artificial Sequence: Synthetic oligonucleotide
  Target: ATXN1; (-) strand; PAM type: NRG; PAM sequence: GGG
caaaggccctatgtacagat

SEQ ID NO: 67325 - DNA, 20 bp, Artificial Sequence
  Description of Artificial Sequence: Synthetic oligonucleotide
  Target: ATXN1; (-) strand; PAM type: NRG; PAM sequence: TGG
gcaaaggccctatgtacaga

SEQ ID NO: 67326 - DNA, 20 bp, Artificial Sequence
  Description of Artificial Sequence: Synthetic oligonucleotide
  Target: ATXN1; (-) strand; PAM type: NRG; PAM sequence: CAG
tctggcaaaggccctatgta

SEQ ID NO: 67327 - DNA, 20 bp, Artificial Sequence
  Description of Artificial Sequence: Synthetic oligonucleotide
  Target: ATXN1; (-) strand; PAM type: NRG; PAM sequence: AGG
cctgagagcttgtctggcaa

SEQ ID NO: 67328 - DNA, 20 bp, Artificial Sequence
  Description of Artificial Sequence: Synthetic oligonucleotide
  Target: ATXN1; (-) strand; PAM type: NRG; PAM sequence: AAG
acctgagagcttgtctggca

SEQ ID NO: 67329 - DNA, 20 bp, Artificial Sequence
  Description of Artificial Sequence: Synthetic oligonucleotide
  Target: ATXN1; (-) strand; PAM type: NRG; PAM sequence: TGG
atgagacctgagagcttgtc

SEQ ID NO: 67330 - DNA, 20 bp, Artificial Sequence
  Description of Artificial Sequence: Synthetic oligonucleotide
  Target: ATXN1; (-) strand; PAM type: NRG; PAM sequence: GAG
gagcaccagatgagacctga

SEQ ID NO: 67331 - DNA, 20 bp, Artificial Sequence
  Description of Artificial Sequence: Synthetic oligonucleotide
  Target: ATXN1; (-) strand; PAM type: NRG; PAM sequence: GAG
atgagcaccagatgagacct

SEQ ID NO: 67332 - DNA, 20 bp, Artificial Sequence
  Description of Artificial Sequence: Synthetic oligonucleotide
  Target: ATXN1; (-) strand; PAM type: NRG; PAM sequence: GAG
acaggatatgagcaccagat

SEQ ID NO: 67333 - DNA, 20 bp, Artificial Sequence
  Description of Artificial Sequence: Synthetic oligonucleotide
  Target: ATXN1; (-) strand; PAM type: NRG; PAM sequence: CAG
gaataacaggatatgagcac

SEQ ID NO: 67334 - DNA, 20 bp, Artificial Sequence
  Description of Artificial Sequence: Synthetic oligonucleotide
  Target: ATXN1; (-) strand; PAM type: NRG; PAM sequence: GAG
gaccaagaataacaggatat

SEQ ID NO: 67335 - DNA, 20 bp, Artificial Sequence
  Description of Artificial Sequence: Synthetic oligonucleotide
  Target: ATXN1; (-) strand; PAM type: NRG; PAM sequence: AGG
attccatgaccaagaataac

SEQ ID NO: 67336 - DNA, 20 bp, Artificial Sequence
  Description of Artificial Sequence: Synthetic oligonucleotide
  Target: ATXN1; (-) strand; PAM type: NRG; PAM sequence: CAG
aattccatgaccaagaataa

SEQ ID NO: 67337 - DNA, 20 bp, Artificial Sequence
  Description of Artificial Sequence: Synthetic oligonucleotide
  Target: ATXN1; (-) strand; PAM type: NRG; PAM sequence: AAG
gtcttttgaattccatgacc

SEQ ID NO: 67338 - DNA, 20 bp, Artificial Sequence
  Description of Artificial Sequence: Synthetic oligonucleotide
  Target: ATXN1; (-) strand; PAM type: NRG; PAM sequence: AAG
agggggaaccatccagtttc

SEQ ID NO: 67339 - DNA, 20 bp, Artificial Sequence
  Description of Artificial Sequence: Synthetic oligonucleotide
  Target: ATXN1; (-) strand; PAM type: NRG; PAM sequence: CAG
gtaggcaagggggaaccatc

SEQ ID NO: 67340 - DNA, 20 bp, Artificial Sequence
  Description of Artificial Sequence: Synthetic oligonucleotide
  Target: ATXN1; (-) strand; PAM type: NRG; PAM sequence: GGG
agatacagctgtaggcaagg

SEQ ID NO: 67341 - DNA, 20 bp, Artificial Sequence
  Description of Artificial Sequence: Synthetic oligonucleotide
  Target: ATXN1; (-) strand; PAM type: NRG; PAM sequence: GGG
gagatacagctgtaggcaag

SEQ ID NO: 67342 - DNA, 20 bp, Artificial Sequence
  Description of Artificial Sequence: Synthetic oligonucleotide
  Target: ATXN1; (-) strand; PAM type: NRG; PAM sequence: GGG
agagatacagctgtaggcaa

SEQ ID NO: 67343 - DNA, 20 bp, Artificial Sequence
  Description of Artificial Sequence: Synthetic oligonucleotide
  Target: ATXN1; (-) strand; PAM type: NRG; PAM sequence: AGG
cagagatacagctgtaggca

SEQ ID NO: 67344 - DNA, 20 bp, Artificial Sequence
  Description of Artificial Sequence: Synthetic oligonucleotide
  Target: ATXN1; (-) strand; PAM type: NRG; PAM sequence: AAG
acagagatacagctgtaggc

SEQ ID NO: 67345 - DNA, 20 bp, Artificial Sequence
  Description of Artificial Sequence: Synthetic oligonucleotide
  Target: ATXN1; (-) strand; PAM type: NRG; PAM sequence: AGG
gtgcacagagatacagctgt

SEQ ID NO: 67346 - DNA, 20 bp, Artificial Sequence
  Description of Artificial Sequence: Synthetic oligonucleotide
  Target: ATXN1; (-) strand; PAM type: NRG; PAM sequence: TAG
ggtgcacagagatacagctg

SEQ ID NO: 67347 - DNA, 20 bp, Artificial Sequence
  Description of Artificial Sequence: Synthetic oligonucleotide
  Target: ATXN1; (-) strand; PAM type: NRG; PAM sequence: CAG
gcaactggtgcacagagata

SEQ ID NO: 67348 - DNA, 20 bp, Artificial Sequence
  Description of Artificial Sequence: Synthetic oligonucleotide
  Target: ATXN1; (-) strand; PAM type: NRG; PAM sequence: GAG
ccctcagcaactggtgcaca

SEQ ID NO: 67349 - DNA, 20 bp, Artificial Sequence
  Description of Artificial Sequence: Synthetic oligonucleotide
  Target: ATXN1; (-) strand; PAM type: NRG; PAM sequence: CAG
ttccctcagcaactggtgca

SEQ ID NO: 67350 - DNA, 20 bp, Artificial Sequence
  Description of Artificial Sequence: Synthetic oligonucleotide
  Target: ATXN1; (-) strand; PAM type: NRG; PAM sequence: TGG
agtttctttccctcagcaac

SEQ ID NO: 67351 - DNA, 20 bp, Artificial Sequence
  Description of Artificial Sequence: Synthetic oligonucleotide
  Target: ATXN1; (-) strand; PAM type: NRG; PAM sequence: CAG
gaaaggaagtttctttccct

SEQ ID NO: 67352 - DNA, 20 bp, Artificial Sequence
  Description of Artificial Sequence: Synthetic oligonucleotide
  Target: ATXN1; (-) strand; PAM type: NRG; PAM sequence: AAG
ttgtccagctcacagaaagg

SEQ ID NO: 67353 - DNA, 20 bp, Artificial Sequence
  Description of Artificial Sequence: Synthetic oligonucleotide
  Target: ATXN1; (-) strand; PAM type: NRG; PAM sequence: AGG
accttgtccagctcacagaa

SEQ ID NO: 67354 - DNA, 20 bp, Artificial Sequence
  Description of Artificial Sequence: Synthetic oligonucleotide
  Target: ATXN1; (-) strand; PAM type: NRG; PAM sequence: AAG
taccttgtccagctcacaga

SEQ ID NO: 67355 - DNA, 20 bp, Artificial Sequence
  Description of Artificial Sequence: Synthetic oligonucleotide
  Target: ATXN1; (-) strand; PAM type: NRG; PAM sequence: CAG
ctattaccttgtccagctca

SEQ ID NO: 67356 - DNA, 20 bp, Artificial Sequence
  Description of Artificial Sequence: Synthetic oligonucleotide
  Target: ATXN1; (-) strand; PAM type: NRG; PAM sequence: CAG
attgttgctattaccttgtc

SEQ ID NO: 67357 - DNA, 20 bp, Artificial Sequence
  Description of Artificial Sequence: Synthetic oligonucleotide
  Target: ATXN1; (-) strand; PAM type: NRG; PAM sequence: AGG
cacatgctttgcctcgtgcg

SEQ ID NO: 67358 - DNA, 20 bp, Artificial Sequence
  Description of Artificial Sequence: Synthetic oligonucleotide
  Target: ATXN1; (-) strand; PAM type: NRG; PAM sequence: GAG
tcacatgctttgcctcgtgc

SEQ ID NO: 67359 - DNA, 20 bp, Artificial Sequence
  Description of Artificial Sequence: Synthetic oligonucleotide
  Target: ATXN1; (-) strand; PAM type: NRG; PAM sequence: TAG
ggagaggatggtttcccttg

SEQ ID NO: 67360 - DNA, 20 bp, Artificial Sequence
  Description of Artificial Sequence: Synthetic oligonucleotide
  Target: ATXN1; (-) strand; PAM type: NRG; PAM sequence: TGG
actgggtcctttggagagga

SEQ ID NO: 67361 - DNA, 20 bp, Artificial Sequence
  Description of Artificial Sequence: Synthetic oligonucleotide
  Target: ATXN1; (-) strand; PAM type: NRG; PAM sequence: AGG
catcactgggtcctttggag

SEQ ID NO: 67362 - DNA, 20 bp, Artificial Sequence
  Description of Artificial Sequence: Synthetic oligonucleotide
  Target: ATXN1; (-) strand; PAM type: NRG; PAM sequence: GAG
tcatcactgggtcctttgga

SEQ ID NO: 67363 - DNA, 20 bp, Artificial Sequence
  Description of Artificial Sequence: Synthetic oligonucleotide
  Target: ATXN1; (-) strand; PAM type: NRG; PAM sequence: GAG
cctcatcactgggtcctttg

SEQ ID NO: 67364 - DNA, 20 bp, Artificial Sequence
  Description of Artificial Sequence: Synthetic oligonucleotide
  Target: ATXN1; (-) strand; PAM type: NRG; PAM sequence: TGG
ctcctcatcactgggtcctt

SEQ ID NO: 67365 - DNA, 20 bp, Artificial Sequence
  Description of Artificial Sequence: Synthetic oligonucleotide
  Target: ATXN1; (-) strand; PAM type: NRG; PAM sequence: GGG
ctttgactctcctcatcact

SEQ ID NO: 67366 - DNA, 20 bp, Artificial Sequence
  Description of Artificial Sequence: Synthetic oligonucleotide
  Target: ATXN1; (-) strand; PAM type: NRG; PAM sequence: TGG
tctttgactctcctcatcac

SEQ ID NO: 67367 - DNA, 20 bp, Artificial Sequence
  Description of Artificial Sequence: Synthetic oligonucleotide
  Target: ATXN1; (-) strand; PAM type: NRG; PAM sequence: AGG
ttttctcctgcttggaacca

SEQ ID NO: 67368 - DNA, 20 bp, Artificial Sequence
  Description of Artificial Sequence: Synthetic oligonucleotide
  Target: ATXN1; (-) strand; PAM type: NRG; PAM sequence: AAG
gttttctcctgcttggaacc

SEQ ID NO: 67369 - DNA, 20 bp, Artificial Sequence
  Description of Artificial Sequence: Synthetic oligonucleotide
  Target: ATXN1; (-) strand; PAM type: NRG; PAM sequence: TGG
ctctctagttttctcctgct

SEQ ID NO: 67370 - DNA, 20 bp, Artificial Sequence
  Description of Artificial Sequence: Synthetic oligonucleotide
  Target: ATXN1; (-) strand; PAM type: NRG; PAM sequence: TAG
gtgtgacagcatgcactctc

SEQ ID NO: 67371 - DNA, 20 bp, Artificial Sequence
  Description of Artificial Sequence: Synthetic oligonucleotide
  Target: ATXN1; (-) strand; PAM type: NRG; PAM sequence: CAG
caccaagaaaaagtgtgtga

SEQ ID NO: 67372 - DNA, 20 bp, Artificial Sequence
  Description of Artificial Sequence: Synthetic oligonucleotide
  Target: ATXN1; (-) strand; PAM type: NRG; PAM sequence: AAG
tactatgatgcaccaagaaa

SEQ ID NO: 67373 - DNA, 20 bp, Artificial Sequence
  Description of Artificial Sequence: Synthetic oligonucleotide
  Target: ATXN1; (-) strand; PAM type: NRG; PAM sequence: AAG
tccaattactatgatgcacc

SEQ ID NO: 67374 - DNA, 20 bp, Artificial Sequence
  Description of Artificial Sequence: Synthetic oligonucleotide
  Target: ATXN1; (-) strand; PAM type: NRG; PAM sequence: GAG
acgtgctgttttcatagggt

SEQ ID NO: 67375 - DNA, 20 bp, Artificial Sequence
  Description of Artificial Sequence: Synthetic oligonucleotide
  Target: ATXN1; (-) strand; PAM type: NRG; PAM sequence: GGG
atcgacgtgctgttttcata

SEQ ID NO: 67376 - DNA, 20 bp, Artificial Sequence
  Description of Artificial Sequence: Synthetic oligonucleotide
  Target: ATXN1; (-) strand; PAM type: NRG; PAM sequence: AGG
aatcgacgtgctgttttcat

SEQ ID NO: 67377 - DNA, 20 bp, Artificial Sequence
  Description of Artificial Sequence: Synthetic oligonucleotide
  Target: ATXN1; (-) strand; PAM type: NRG; PAM sequence: TAG
aaatcgacgtgctgttttca

SEQ ID NO: 67378 - DNA, 20 bp, Artificial Sequence
  Description of Artificial Sequence: Synthetic oligonucleotide
  Target: ATXN1; (-) strand; PAM type: NRG; PAM sequence: AAG
agaccattttcttcgtgaga

SEQ ID NO: 67379 - DNA, 20 bp, Artificial Sequence
  Description of Artificial Sequence: Synthetic oligonucleotide
  Target: ATXN1; (-) strand; PAM type: NRG; PAM sequence: GAG
aattagaccattttcttcgt

SEQ ID NO: 67380 - DNA, 20 bp, Artificial Sequence
  Description of Artificial Sequence: Synthetic oligonucleotide
  Target: ATXN1; (-) strand; PAM type: NRG; PAM sequence: TAG
ttccagttttccaaagaaat

SEQ ID NO: 67381 - DNA, 20 bp, Artificial Sequence
  Description of Artificial Sequence: Synthetic oligonucleotide
  Target: ATXN1; (-) strand; PAM type: NRG; PAM sequence: AAG
ttttctattccagttttcca

SEQ ID NO: 67382 - DNA, 20 bp, Artificial Sequence
  Description of Artificial Sequence: Synthetic oligonucleotide
  Target: ATXN1; (-) strand; PAM type: NRG; PAM sequence: CAG
aaaaatctttttttctattc

SEQ ID NO: 67383 - DNA, 20 bp, Artificial Sequence
  Description of Artificial Sequence: Synthetic oligonucleotide
  Target: ATXN1; (-) strand; PAM type: NRG; PAM sequence: GAG
ttggactgatttagagaatg

SEQ ID NO: 67384 - DNA, 20 bp, Artificial Sequence
  Description of Artificial Sequence: Synthetic oligonucleotide
  Target: ATXN1; (-) strand; PAM type: NRG; PAM sequence: TGG
atttggactgatttagagaa

SEQ ID NO: 67385 - DNA, 20 bp, Artificial Sequence
  Description of Artificial Sequence: Synthetic oligonucleotide
  Target: ATXN1; (-) strand; PAM type: NRG; PAM sequence: GAG
tgctcatttggactgattta

SEQ ID NO: 67386 - DNA, 20 bp, Artificial Sequence
  Description of Artificial Sequence: Synthetic oligonucleotide
  Target: ATXN1; (-) strand; PAM type: NRG; PAM sequence: TAG
cctgctcatttggactgatt

SEQ ID NO: 67387 - DNA, 20 bp, Artificial Sequence
  Description of Artificial Sequence: Synthetic oligonucleotide
  Target: ATXN1; (-) strand; PAM type: NRG; PAM sequence: TGG
cacctctaggcctgctcatt

SEQ ID NO: 67388 - DNA, 20 bp, Artificial Sequence
  Description of Artificial Sequence: Synthetic oligonucleotide
  Target: ATXN1; (-) strand; PAM type: NRG; PAM sequence: AGG
tggaatttcttatcacctct

SEQ ID NO: 67389 - DNA, 20 bp, Artificial Sequence
  Description of Artificial Sequence: Synthetic oligonucleotide
  Target: ATXN1; (-) strand; PAM type: NRG; PAM sequence: TAG
ctggaatttcttatcacctc

SEQ ID NO: 67390 - DNA, 20 bp, Artificial Sequence
  Description of Artificial Sequence: Synthetic oligonucleotide
  Target: ATXN1; (-) strand; PAM type: NRG; PAM sequence: TGG
aaggccaaagtgctaggggc

SEQ ID NO: 67391 - DNA, 20 bp, Artificial Sequence
  Description of Artificial Sequence: Synthetic oligonucleotide
  Target: ATXN1; (-) strand; PAM type: NRG; PAM sequence: GGG
aataaaggccaaagtgctag

SEQ ID NO: 67392 - DNA, 20 bp, Artificial Sequence
  Description of Artificial Sequence: Synthetic oligonucleotide
  Target: ATXN1; (-) strand; PAM type: NRG; PAM sequence: GGG
taataaaggccaaagtgcta

SEQ ID NO: 67393 - DNA, 20 bp, Artificial Sequence
  Description of Artificial Sequence: Synthetic oligonucleotide
  Target: ATXN1; (-) strand; PAM type: NRG; PAM sequence: AGG
ctaataaaggccaaagtgct

SEQ ID NO: 67394 - DNA, 20 bp, Artificial Sequence
  Description of Artificial Sequence: Synthetic oligonucleotide
  Target: ATXN1; (-) strand; PAM type: NRG; PAM sequence: TAG
cctaataaaggccaaagtgc

SEQ ID NO: 67395 - DNA, 20 bp, Artificial Sequence
  Description of Artificial Sequence: Synthetic oligonucleotide
  Target: ATXN1; (-) strand; PAM type: NRG; PAM sequence: AAG
tgtgcacctaataaaggcca

SEQ ID NO: 67396 - DNA, 20 bp, Artificial Sequence
  Description of Artificial Sequence: Synthetic oligonucleotide
  Target: ATXN1; (-) strand; PAM type: NRG; PAM sequence: AGG
atttattgtgcacctaataa

SEQ ID NO: 67397 - DNA, 20 bp, Artificial Sequence
  Description of Artificial Sequence: Synthetic oligonucleotide
  Target: ATXN1; (-) strand; PAM type: NRG; PAM sequence: AAG
catttattgtgcacctaata

SEQ ID NO: 67398 - DNA, 20 bp, Artificial Sequence
  Description of Artificial Sequence: Synthetic oligonucleotide
  Target: ATXN1; (-) strand; PAM type: NRG; PAM sequence: CAG
atcacgcatctattgttctt

SEQ ID NO: 67399 - DNA, 20 bp, Artificial Sequence
  Description of Artificial Sequence: Synthetic oligonucleotide
  Target: ATXN1; (-) strand; PAM type: NRG; PAM sequence: CAG
gcttttaaaattcatatagt

SEQ ID NO: 67400 - DNA, 20 bp, Artificial Sequence
  Description of Artificial Sequence: Synthetic oligonucleotide
  Target: ATXN1; (-) strand; PAM type: NRG; PAM sequence: TAG
ctctgcttttaaaattcata

SEQ ID NO: 67401 - DNA, 20 bp, Artificial Sequence
  Description of Artificial Sequence: Synthetic oligonucleotide
  Target: ATXN1; (-) strand; PAM type: NRG; PAM sequence: AAG
ctctacatattgattgttca

SEQ ID NO: 67402 - DNA, 20 bp, Artificial Sequence
  Description of Artificial Sequence: Synthetic oligonucleotide
  Target: ATXN1; (-) strand; PAM type: NRG; PAM sequence: AGG
aatatggactccttgtcaca

SEQ ID NO: 67403 - DNA, 20 bp, Artificial Sequence
  Description of Artificial Sequence: Synthetic oligonucleotide
  Target: ATXN1; (-) strand; PAM type: NRG; PAM sequence: AAG
caatatggactccttgtcac

SEQ ID NO: 67404 - DNA, 20 bp, Artificial Sequence
  Description of Artificial Sequence: Synthetic oligonucleotide
  Target: ATXN1; (-) strand; PAM type: NRG; PAM sequence: TGG
atttcttgggcaccacaata

SEQ ID NO: 67405 - DNA, 20 bp, Artificial Sequence
  Description of Artificial Sequence: Synthetic oligonucleotide
  Target: ATXN1; (-) strand; PAM type: NRG; PAM sequence: GGG
acctaaaaaattgatttctt

SEQ ID NO: 67406 - DNA, 20 bp, Artificial Sequence
  Description of Artificial Sequence: Synthetic oligonucleotide
  Target: ATXN1; (-) strand; PAM type: NRG; PAM sequence: TGG
cacctaaaaaattgatttct

SEQ ID NO: 67407 - DNA, 20 bp, Artificial Sequence
  Description of Artificial Sequence: Synthetic oligonucleotide
  Target: ATXN1; (-) strand; PAM type: NRG; PAM sequence: AGG
aggacatgacattttaagaa

SEQ ID NO: 67408 - DNA, 20 bp, Artificial Sequence
  Description of Artificial Sequence: Synthetic oligonucleotide
  Target: ATXN1; (-) strand; PAM type: NRG; PAM sequence: AAG
gaggacatgacattttaaga

SEQ ID NO: 67409 - DNA, 20 bp, Artificial Sequence
  Description of Artificial Sequence: Synthetic oligonucleotide
  Target: ATXN1; (-) strand; PAM type: NRG; PAM sequence: AAG
catggaggacatgacatttt

SEQ ID NO: 67410 - DNA, 20 bp, Artificial Sequence
  Description of Artificial Sequence: Synthetic oligonucleotide
  Target: ATXN1; (-) strand; PAM type: NRG; PAM sequence: AGG
aagcatcatggtgggcatgg

SEQ ID NO: 67411 - DNA, 20 bp, Artificial Sequence
  Description of Artificial Sequence: Synthetic oligonucleotide
  Target: ATXN1; (-) strand; PAM type: NRG; PAM sequence: GAG
taagcatcatggtgggcatg

SEQ ID NO: 67412 - DNA, 20 bp, Artificial Sequence
  Description of Artificial Sequence: Synthetic oligonucleotide
  Target: ATXN1; (-) strand; PAM type: NRG; PAM sequence: TGG
aataagcatcatggtgggca

SEQ ID NO: 67413 - DNA, 20 bp, Artificial Sequence
  Description of Artificial Sequence: Synthetic oligonucleotide
  Target: ATXN1; (-) strand; PAM type: NRG; PAM sequence: GGG
tcttcaataagcatcatggt

SEQ ID NO: 67414 - DNA, 20 bp, Artificial Sequence
  Description of Artificial Sequence: Synthetic oligonucleotide
  Target: ATXN1; (-) strand; PAM type: NRG; PAM sequence: TGG
ttcttcaataagcatcatgg

SEQ ID NO: 67415 - DNA, 20 bp, Artificial Sequence
  Description of Artificial Sequence: Synthetic oligonucleotide
  Target: ATXN1; (-) strand; PAM type: NRG; PAM sequence: TGG
gacttcttcaataagcatca

SEQ ID NO: 67416 - DNA, 20 bp, Artificial Sequence
  Description of Artificial Sequence: Synthetic oligonucleotide
  Target: ATXN1; (-) strand; PAM type: NRG; PAM sequence: AAG
caaaaaaagacttcttcaat

SEQ ID NO: 67417 - DNA, 20 bp, Artificial Sequence
  Description of Artificial Sequence: Synthetic oligonucleotide
  Target: ATXN1; (-) strand; PAM type: NRG; PAM sequence: AAG
acttcaaaaaaatacaaaaa

SEQ ID NO: 67418 - DNA, 20 bp, Artificial Sequence
  Description of Artificial Sequence: Synthetic oligonucleotide
  Target: ATXN1; (-) strand; PAM type: NRG; PAM sequence: CAG
atagtgagaccccatctcta

SEQ ID NO: 67419 - DNA, 20 bp, Artificial Sequence
  Description of Artificial Sequence: Synthetic oligonucleotide
  Target: ATXN1; (-) strand; PAM type: NRG; PAM sequence: GAG
accagcctgggcaacatagt

SEQ ID NO: 67420 - DNA, 20 bp, Artificial Sequence
  Description of Artificial Sequence: Synthetic oligonucleotide
  Target: ATXN1; (-) strand; PAM type: NRG; PAM sequence: TAG
caagaccagcctgggcaaca

SEQ ID NO: 67421 - DNA, 20 bp, Artificial Sequence
  Description of Artificial Sequence: Synthetic oligonucleotide
  Target: ATXN1; (-) strand; PAM type: NRG; PAM sequence: GGG
caggagttcaagaccagcct

SEQ ID NO: 67422 - DNA, 20 bp, Artificial Sequence
  Description of Artificial Sequence: Synthetic oligonucleotide
  Target: ATXN1; (-) strand; PAM type: NRG; PAM sequence: TGG
ccaggagttcaagaccagcc

SEQ ID NO: 67423 - DNA, 20 bp, Artificial Sequence
  Description of Artificial Sequence: Synthetic oligonucleotide
  Target: ATXN1; (-) strand; PAM type: NRG; PAM sequence: CAG
tgaggccaggagttcaagac

SEQ ID NO: 67424 - DNA, 20 bp, Artificial Sequence
  Description of Artificial Sequence: Synthetic oligonucleotide
  Target: ATXN1; (-) strand; PAM type: NRG; PAM sequence: AAG
gcgcttgaggccaggagttc

SEQ ID NO: 67425 - DNA, 20 bp, Artificial Sequence
  Description of Artificial Sequence: Synthetic oligonucleotide
  Target: ATXN1; (-) strand; PAM type: NRG; PAM sequence: GAG
gaaggagcgcttgaggccag

SEQ ID NO: 67426 - DNA, 20 bp, Artificial Sequence
  Description of Artificial Sequence: Synthetic oligonucleotide
  Target: ATXN1; (-) strand; PAM type: NRG; PAM sequence: AGG
tggaaggagcgcttgaggcc

SEQ ID NO: 67427 - DNA, 20 bp, Artificial Sequence
  Description of Artificial Sequence: Synthetic oligonucleotide
  Target: ATXN1; (-) strand; PAM type: NRG; PAM sequence: CAG
gtggaaggagcgcttgaggc

SEQ ID NO: 67428 - DNA, 20 bp, Artificial Sequence
  Description of Artificial Sequence: Synthetic oligonucleotide
  Target: ATXN1; (-) strand; PAM type: NRG; PAM sequence: AGG
tgaggtggaaggagcgcttg

SEQ ID NO: 67429 - DNA, 20 bp, Artificial Sequence
  Description of Artificial Sequence: Synthetic oligonucleotide
  Target: ATXN1; (-) strand; PAM type: NRG; PAM sequence: GAG
ctgaggtggaaggagcgctt

SEQ ID NO: 67430 - DNA, 20 bp, Artificial Sequence
  Description of Artificial Sequence: Synthetic oligonucleotide
  Target: ATXN1; (-) strand; PAM type: NRG; PAM sequence: GAG
ttgggaggctgaggtggaag

SEQ ID NO: 67431 - DNA, 20 bp, Artificial Sequence
  Description of Artificial Sequence: Synthetic oligonucleotide
  Target: ATXN1; (-) strand; PAM type: NRG; PAM sequence: AGG
ctttgggaggctgaggtgga

SEQ ID NO: 67432 - DNA, 20 bp, Artificial Sequence
  Description of Artificial Sequence: Synthetic oligonucleotide
  Target: ATXN1; (-) strand; PAM type: NRG; PAM sequence: AAG
actttgggaggctgaggtgg

SEQ ID NO: 67433 - DNA, 20 bp, Artificial Sequence
  Description of Artificial Sequence: Synthetic oligonucleotide
  Target: ATXN1; (-) strand; PAM type: NRG; PAM sequence: TGG
aacactttgggaggctgagg

SEQ ID NO: 67434 - DNA, 20 bp, Artificial Sequence
  Description of Artificial Sequence: Synthetic oligonucleotide
  Target: ATXN1; (-) strand; PAM type: NRG; PAM sequence: AGG
cccaacactttgggaggctg

SEQ ID NO: 67435 - DNA, 20 bp, Artificial Sequence
  Description of Artificial Sequence: Synthetic oligonucleotide
  Target: ATXN1; (-) strand; PAM type: NRG; PAM sequence: GAG
tcccaacactttgggaggct

SEQ ID NO: 67436 - DNA, 20 bp, Artificial Sequence
  Description of Artificial Sequence: Synthetic oligonucleotide
  Target: ATXN1; (-) strand; PAM type: NRG; PAM sequence: AGG
tgtaatcccaacactttggg

SEQ ID NO: 67437 - DNA, 20 bp, Artificial Sequence
  Description of Artificial Sequence: Synthetic oligonucleotide
  Target: ATXN1; (-) strand; PAM type: NRG; PAM sequence: GAG
ctgtaatcccaacactttgg

SEQ ID NO: 67438 - DNA, 20 bp, Artificial Sequence
  Description of Artificial Sequence: Synthetic oligonucleotide
  Target: ATXN1; (-) strand; PAM type: NRG; PAM sequence: GGG
acctgtaatcccaacacttt

SEQ ID NO: 67439 - DNA, 20 bp, Artificial Sequence
  Description of Artificial Sequence: Synthetic oligonucleotide
  Target: ATXN1; (-) strand; PAM type: NRG; PAM sequence: TGG
aacctgtaatcccaacactt

SEQ ID NO: 67440 - DNA, 20 bp, Artificial Sequence
  Description of Artificial Sequence: Synthetic oligonucleotide
  Target: ATXN1; (-) strand; PAM type: NRG; PAM sequence: TGG
taaaacacggctgggtacga

SEQ ID NO: 67441 - DNA, 20 bp, Artificial Sequence
  Description of Artificial Sequence: Synthetic oligonucleotide
  Target: ATXN1; (-) strand; PAM type: NRG; PAM sequence: GGG
caaaaaaataaaacacggct

SEQ ID NO: 67442 - DNA, 20 bp, Artificial Sequence
  Description of Artificial Sequence: Synthetic oligonucleotide
  Target: ATXN1; (-) strand; PAM type: NRG; PAM sequence: TGG
tcaaaaaaataaaacacggc

SEQ ID NO: 67443 - DNA, 20 bp, Artificial Sequence
  Description of Artificial Sequence: Synthetic oligonucleotide
  Target: ATXN1; (-) strand; PAM type: NRG; PAM sequence: CGG
tatctcaaaaaaataaaaca

SEQ ID NO: 67444 - DNA, 20 bp, Artificial Sequence
  Description of Artificial Sequence: Synthetic oligonucleotide
  Target: ATXN1; (-) strand; PAM type: NRG; PAM sequence: AAG
acaaacccgggtaacaaagc

SEQ ID NO: 67445 - DNA, 20 bp, Artificial Sequence
  Description of Artificial Sequence: Synthetic oligonucleotide
  Target: ATXN1; (-) strand; PAM type: NRG; PAM sequence: AAG
tatgacaaacccgggtaaca

SEQ ID NO: 67446 - DNA, 20 bp, Artificial Sequence
  Description of Artificial Sequence: Synthetic oligonucleotide
  Target: ATXN1; (-) strand; PAM type: NRG; PAM sequence: GGG
cacggatctatgacaaaccc

SEQ ID NO: 67447 - DNA, 20 bp, Artificial Sequence
  Description of Artificial Sequence: Synthetic oligonucleotide
  Target: ATXN1; (-) strand; PAM type: NRG; PAM sequence: CGG
gcacggatctatgacaaacc

SEQ ID NO: 67448 - DNA, 20 bp, Artificial Sequence
  Description of Artificial Sequence: Synthetic oligonucleotide
  Target: ATXN1; (-) strand; PAM type: NRG; PAM sequence: CGG
ttccagctataaaatgggca

SEQ ID NO: 67449 - DNA, 20 bp, Artificial Sequence
  Description of Artificial Sequence: Synthetic oligonucleotide
  Target: ATXN1; (-) strand; PAM type: NRG; PAM sequence: GGG
agggtttccagctataaaat

SEQ ID NO: 67450 - DNA, 20 bp, Artificial Sequence
  Description of Artificial Sequence: Synthetic oligonucleotide
  Target: ATXN1; (-) strand; PAM type: NRG; PAM sequence: TGG
cagggtttccagctataaaa

SEQ ID NO: 67451 - DNA, 20 bp, Artificial Sequence
  Description of Artificial Sequence: Synthetic oligonucleotide
  Target: ATXN1; (-) strand; PAM type: NRG; PAM sequence: CAG
cccctgggcctcagggtttc

SEQ ID NO: 67452 - DNA, 20 bp, Artificial Sequence
  Description of Artificial Sequence: Synthetic oligonucleotide
  Target: ATXN1; (-) strand; PAM type: NRG; PAM sequence: GGG
gctcagtcccctgggcctca

SEQ ID NO: 67453 - DNA, 20 bp, Artificial Sequence
  Description of Artificial Sequence: Synthetic oligonucleotide
  Target: ATXN1; (-) strand; PAM type: NRG; PAM sequence: AGG
ggctcagtcccctgggcctc

SEQ ID NO: 67454 - DNA, 20 bp, Artificial Sequence
  Description of Artificial Sequence: Synthetic oligonucleotide
  Target: ATXN1; (-) strand; PAM type: NRG; PAM sequence: CAG
tggctcagtcccctgggcct

SEQ ID NO: 67455 - DNA, 20 bp, Artificial Sequence
  Description of Artificial Sequence: Synthetic oligonucleotide
  Target: ATXN1; (-) strand; PAM type: NRG; PAM sequence: GGG
agcaagtggctcagtcccct

SEQ ID NO: 67456 - DNA, 20 bp, Artificial Sequence
  Description of Artificial Sequence: Synthetic oligonucleotide
  Target: ATXN1; (-) strand; PAM type: NRG; PAM sequence: TGG
gagcaagtggctcagtcccc

SEQ ID NO: 67457 - DNA, 20 bp, Artificial Sequence
  Description of Artificial Sequence: Synthetic oligonucleotide
  Target: ATXN1; (-) strand; PAM type: NRG; PAM sequence: CAG
gtgcacgtgagcaagtggct

SEQ ID NO: 67458 - DNA, 20 bp, Artificial Sequence
  Description of Artificial Sequence: Synthetic oligonucleotide
  Target: ATXN1; (-) strand; PAM type: NRG; PAM sequence: TGG
gccatgtgcacgtgagcaag

SEQ ID NO: 67459 - DNA, 20 bp, Artificial Sequence
  Description of Artificial Sequence: Synthetic oligonucleotide
  Target: ATXN1; (-) strand; PAM type: NRG; PAM sequence: AAG
acagccatgtgcacgtgagc

SEQ ID NO: 67460 - DNA, 20 bp, Artificial Sequence
  Description of Artificial Sequence: Synthetic oligonucleotide
  Target: ATXN1; (-) strand; PAM type: NRG; PAM sequence: GAG
actcacagccatgtgcacgt

SEQ ID NO: 67461 - DNA, 20 bp, Artificial Sequence
  Description of Artificial Sequence: Synthetic oligonucleotide
  Target: ATXN1; (-) strand; PAM type: NRG; PAM sequence: CAG
gagctcagctctgccactca

SEQ ID NO: 67462 - DNA, 20 bp, Artificial Sequence
  Description of Artificial Sequence: Synthetic oligonucleotide
  Target: ATXN1; (-) strand; PAM type: NRG; PAM sequence: CAG
aggatcccagggtctgagct

SEQ ID NO: 67463 - DNA, 20 bp, Artificial Sequence
  Description of Artificial Sequence: Synthetic oligonucleotide
  Target: ATXN1; (-) strand; PAM type: NRG; PAM sequence: GAG
gagggaggatcccagggtct

SEQ ID NO: 67464 - DNA, 20 bp, Artificial Sequence
  Description of Artificial Sequence: Synthetic oligonucleotide
  Target: ATXN1; (-) strand; PAM type: NRG; PAM sequence: GGG
actttggagggaggatccca

SEQ ID NO: 67465 - DNA, 20 bp, Artificial Sequence
  Description of Artificial Sequence: Synthetic oligonucleotide
  Target: ATXN1; (-) strand; PAM type: NRG; PAM sequence: AGG
gactttggagggaggatccc

SEQ ID NO: 67466 - DNA, 20 bp, Artificial Sequence
  Description of Artificial Sequence: Synthetic oligonucleotide
  Target: ATXN1; (-) strand; PAM type: NRG; PAM sequence: CAG
ggactttggagggaggatcc

SEQ ID NO: 67467 - DNA, 20 bp, Artificial Sequence
  Description of Artificial Sequence: Synthetic oligonucleotide
  Target: ATXN1; (-) strand; PAM type: NRG; PAM sequence: AGG
atgagagggactttggaggg

SEQ ID NO: 67468 - DNA, 20 bp, Artificial Sequence
  Description of Artificial Sequence: Synthetic oligonucleotide
  Target: ATXN1; (-) strand; PAM type: NRG; PAM sequence: GAG
catgagagggactttggagg

SEQ ID NO: 67469 - DNA, 20 bp, Artificial Sequence
  Description of Artificial Sequence: Synthetic oligonucleotide
  Target: ATXN1; (-) strand; PAM type: NRG; PAM sequence: GGG
cccatgagagggactttgga

SEQ ID NO: 67470 - DNA, 20 bp, Artificial Sequence
  Description of Artificial Sequence: Synthetic oligonucleotide
  Target: ATXN1; (-) strand; PAM type: NRG; PAM sequence: AGG
ccccatgagagggactttgg

SEQ ID NO: 67471 - DNA, 20 bp, Artificial Sequence
  Description of Artificial Sequence: Synthetic oligonucleotide
  Target: ATXN1; (-) strand; PAM type: NRG; PAM sequence: GAG
cccccatgagagggactttg

SEQ ID NO: 67472 - DNA, 20 bp, Artificial Sequence
  Description of Artificial Sequence: Synthetic oligonucleotide
  Target: ATXN1; (-) strand; PAM type: NRG; PAM sequence: TGG
ttcccccatgagagggactt

SEQ ID NO: 67473 - DNA, 20 bp, Artificial Sequence
  Description of Artificial Sequence: Synthetic oligonucleotide
  Target: ATXN1; (-) strand; PAM type: NRG; PAM sequence: GGG
cactgaattcccccatgaga

SEQ ID NO: 67474 - DNA, 20 bp, Artificial Sequence
  Description of Artificial Sequence: Synthetic oligonucleotide
  Target: ATXN1; (-) strand; PAM type: NRG; PAM sequence: AGG
tcactgaattcccccatgag

SEQ ID NO: 67475 - DNA, 20 bp, Artificial Sequence
  Description of Artificial Sequence: Synthetic oligonucleotide
  Target: ATXN1; (-) strand; PAM type: NRG; PAM sequence: GAG
gtcactgaattcccccatga

SEQ ID NO: 67476 - DNA, 20 bp, Artificial Sequence
  Description of Artificial Sequence: Synthetic oligonucleotide
  Target: ATXN1; (-) strand; PAM type: NRG; PAM sequence: GAG
cggtcactgaattcccccat

SEQ ID NO: 67477 - DNA, 20 bp, Artificial Sequence
  Description of Artificial Sequence: Synthetic oligonucleotide
  Target: ATXN1; (-) strand; PAM type: NRG; PAM sequence: CGG
tatgatggcatccccatcca

SEQ ID NO: 67478 - DNA, 20 bp, Artificial Sequence
  Description of Artificial Sequence: Synthetic oligonucleotide
  Target: ATXN1; (-) strand; PAM type: NRG; PAM sequence: TGG
gaggctgcagtgagctatga

SEQ ID NO: 67479 - DNA, 20 bp, Artificial Sequence
  Description of Artificial Sequence: Synthetic oligonucleotide
  Target: ATXN1; (-) strand; PAM type: NRG; PAM sequence: GAG
taggagttggaggctgcagt

SEQ ID NO: 67480 - DNA, 20 bp, Artificial Sequence
  Description of Artificial Sequence: Synthetic oligonucleotide
  Target: ATXN1; (-) strand; PAM type: NRG; PAM sequence: CAG
agtctaggagttggaggctg

SEQ ID NO: 67481 - DNA, 20 bp, Artificial Sequence
  Description of Artificial Sequence: Synthetic oligonucleotide
  Target: ATXN1; (-) strand; PAM type: NRG; PAM sequence: AGG
agtttgagtctaggagttgg

SEQ ID NO: 67482 - DNA, 20 bp, Artificial Sequence
  Description of Artificial Sequence: Synthetic oligonucleotide
  Target: ATXN1; (-) strand; PAM type: NRG; PAM sequence: GAG
gagtttgagtctaggagttg

SEQ ID NO: 67483 - DNA, 20 bp, Artificial Sequence
  Description of Artificial Sequence: Synthetic oligonucleotide
  Target: ATXN1; (-) strand; PAM type: NRG; PAM sequence: TGG
aggagtttgagtctaggagt

SEQ ID NO: 67484 - DNA, 20 bp, Artificial Sequence
  Description of Artificial Sequence: Synthetic oligonucleotide
  Target: ATXN1; (-) strand; PAM type: NRG; PAM sequence: GAG
aggcaggagtttgagtctag

SEQ ID NO: 67485 - DNA, 20 bp, Artificial Sequence
  Description of Artificial Sequence: Synthetic oligonucleotide
  Target: ATXN1; (-) strand; PAM type: NRG; PAM sequence: AGG
taaggcaggagtttgagtct

SEQ ID NO: 67486 - DNA, 20 bp, Artificial Sequence
  Description of Artificial Sequence: Synthetic oligonucleotide
  Target: ATXN1; (-) strand; PAM type: NRG; PAM sequence: TAG
ctaaggcaggagtttgagtc

SEQ ID NO: 67487 - DNA, 20 bp, Artificial Sequence
  Description of Artificial Sequence: Synthetic oligonucleotide
  Target: ATXN1; (-) strand; PAM type: NRG; PAM sequence: GAG
ggcggctaaggcaggagttt

SEQ ID NO: 67488 - DNA, 20 bp, Artificial Sequence
  Description of Artificial Sequence: Synthetic oligonucleotide
  Target: ATXN1; (-) strand; PAM type: NRG; PAM sequence: GAG
ctacttggcggctaaggcag

SEQ ID NO: 67489 - DNA, 20 bp, Artificial Sequence
  Description of Artificial Sequence: Synthetic oligonucleotide
  Target: ATXN1; (-) strand; PAM type: NRG; PAM sequence: AGG
agctacttggcggctaaggc

SEQ ID NO: 67490 - DNA, 20 bp, Artificial Sequence
  Description of Artificial Sequence: Synthetic oligonucleotide
  Target: ATXN1; (-) strand; PAM type: NRG; PAM sequence: CAG
cagctacttggcggctaagg

SEQ ID NO: 67491 - DNA, 20 bp, Artificial Sequence
  Description of Artificial Sequence: Synthetic oligonucleotide
  Target: ATXN1; (-) strand; PAM type: NRG; PAM sequence: AGG
tcccagctacttggcggcta

SEQ ID NO: 67492 - DNA, 20 bp, Artificial Sequence
  Description of Artificial Sequence: Synthetic oligonucleotide
  Target: ATXN1; (-) strand; PAM type: NRG; PAM sequence: AAG
gtcccagctacttggcggct

SEQ ID NO: 67493 - DNA, 20 bp, Artificial Sequence
  Description of Artificial Sequence: Synthetic oligonucleotide
  Target: ATXN1; (-) strand; PAM type: NRG; PAM sequence: CGG
ctgtagtcccagctacttgg

SEQ ID NO: 67494 - DNA, 20 bp, Artificial Sequence
  Description of Artificial Sequence: Synthetic oligonucleotide
  Target: ATXN1; (-) strand; PAM type: NRG; PAM sequence: TGG
tgcctgtagtcccagctact

SEQ ID NO: 67495 - DNA, 20 bp, Artificial Sequence
  Description of Artificial Sequence: Synthetic oligonucleotide
  Target: ATXN1; (-) strand; PAM type: NRG; PAM sequence: CAG
gtggcacatgcctgtagtcc

SEQ ID NO: 67496 - DNA, 20 bp, Artificial Sequence
  Description of Artificial Sequence: Synthetic oligonucleotide
  Target: ATXN1; (-) strand; PAM type: NRG; PAM sequence: TAG
ggtgtggtggcacatgcctg

SEQ ID NO: 67497 - DNA, 20 bp, Artificial Sequence
  Description of Artificial Sequence: Synthetic oligonucleotide
  Target: ATXN1; (-) strand; PAM type: NRG; PAM sequence: TGG
acattttaatccaggtgtgg

SEQ ID NO: 67498 - DNA, 20 bp, Artificial Sequence
  Description of Artificial Sequence: Synthetic oligonucleotide
  Target: ATXN1; (-) strand; PAM type: NRG; PAM sequence: TGG
acaacattttaatccaggtg

SEQ ID NO: 67499 - DNA, 20 bp, Artificial Sequence
  Description of Artificial Sequence: Synthetic oligonucleotide
  Target: ATXN1; (-) strand; PAM type: NRG; PAM sequence: AGG
aaaacacaacattttaatcc

SEQ ID NO: 67500 - DNA, 20 bp, Artificial Sequence
  Description of Artificial Sequence: Synthetic oligonucleotide
  Target: ATXN1; (-) strand; PAM type: NRG; PAM sequence: CAG
aaaaacacaacattttaatc

SEQ ID NO: 67501 - DNA, 20 bp, Artificial Sequence
  Description of Artificial Sequence: Synthetic oligonucleotide
  Target: ATXN1; (-) strand; PAM type: NRG; PAM sequence: AAG
aaactccatctccgcaaata

SEQ ID NO: 67502 - DNA, 20 bp, Artificial Sequence
  Description of Artificial Sequence: Synthetic oligonucleotide
  Target: ATXN1; (-) strand; PAM type: NRG; PAM sequence: TAG
ttcttcacagcctggcaatg

SEQ ID NO: 67503 - DNA, 20 bp, Artificial Sequence
  Description of Artificial Sequence: Synthetic oligonucleotide
  Target: ATXN1; (-) strand; PAM type: NRG; PAM sequence: TGG
attaagacttcttcacagcc

SEQ ID NO: 67504 - DNA, 20 bp, Artificial Sequence
  Description of Artificial Sequence: Synthetic oligonucleotide
  Target: ATXN1; (-) strand; PAM type: NRG; PAM sequence: CAG
tatttattaagacttcttca

SEQ ID NO: 67505 - DNA, 20 bp, Artificial Sequence
  Description of Artificial Sequence: Synthetic oligonucleotide
  Target: ATXN1; (-) strand; PAM type: NRG; PAM sequence: AAG
gggtactttggttatttatt

SEQ ID NO: 67506 - DNA, 20 bp, Artificial Sequence
  Description of Artificial Sequence: Synthetic oligonucleotide
  Target: ATXN1; (-) strand; PAM type: NRG; PAM sequence: TGG
agtgcaggaatggggtactt

SEQ ID NO: 67507 - DNA, 20 bp, Artificial Sequence
  Description of Artificial Sequence: Synthetic oligonucleotide
  Target: ATXN1; (-) strand; PAM type: NRG; PAM sequence: GGG
aagagcaaagtgcaggaatg

SEQ ID NO: 67508 - DNA, 20 bp, Artificial Sequence
  Description of Artificial Sequence: Synthetic oligonucleotide
  Target: ATXN1; (-) strand; PAM type: NRG; PAM sequence: GGG
aaagagcaaagtgcaggaat

SEQ ID NO: 67509 - DNA, 20 bp, Artificial Sequence
  Description of Artificial Sequence: Synthetic oligonucleotide
  Target: ATXN1; (-) strand; PAM type: NRG; PAM sequence: TGG
gaaagagcaaagtgcaggaa

SEQ ID NO: 67510 - DNA, 20 bp, Artificial Sequence
  Description of Artificial Sequence: Synthetic oligonucleotide
  Target: ATXN1; (-) strand; PAM type: NRG; PAM sequence: AGG
tttgggaaagagcaaagtgc

SEQ ID NO: 67511 - DNA, 20 bp, Artificial Sequence
  Description of Artificial Sequence: Synthetic oligonucleotide
  Target: ATXN1; (-) strand; PAM type: NRG; PAM sequence: CAG
ttttgggaaagagcaaagtg

SEQ ID NO: 67512 - DNA, 20 bp, Artificial Sequence
  Description of Artificial Sequence: Synthetic oligonucleotide
  Target: ATXN1; (-) strand; PAM type: NRG; PAM sequence: AAG
taccattttgggaaagagca

SEQ ID NO: 67513 - DNA, 20 bp, Artificial Sequence
  Description of Artificial Sequence: Synthetic oligonucleotide
  Target: ATXN1; (-) strand; PAM type: NRG; PAM sequence: GAG
gggtataccattttgggaaa

SEQ ID NO: 67514 - DNA, 20 bp, Artificial Sequence
  Description of Artificial Sequence: Synthetic oligonucleotide
  Target: ATXN1; (-) strand; PAM type: NRG; PAM sequence: AAG
gtgggtataccattttggga

SEQ ID NO: 67515 - DNA, 20 bp, Artificial Sequence
  Description of Artificial Sequence: Synthetic oligonucleotide
  Target: ATXN1; (-) strand; PAM type: NRG; PAM sequence: GGG
agctgtgggtataccatttt

SEQ ID NO: 67516 - DNA, 20 bp, Artificial Sequence
  Description of Artificial Sequence: Synthetic oligonucleotide
  Target: ATXN1; (-) strand; PAM type: NRG; PAM sequence: TGG
aagctgtgggtataccattt

SEQ ID NO: 67517 - DNA, 20 bp, Artificial Sequence
  Description of Artificial Sequence: Synthetic oligonucleotide
  Target: ATXN1; (-) strand; PAM type: NRG; PAM sequence: GGG
actgcagggagtgaagctgt

SEQ ID NO: 67518 - DNA, 20 bp, Artificial Sequence
  Description of Artificial Sequence: Synthetic oligonucleotide
  Target: ATXN1; (-) strand; PAM type: NRG; PAM sequence: TGG
cactgcagggagtgaagctg

SEQ ID NO: 67519 - DNA, 20 bp, Artificial Sequence
  Description of Artificial Sequence: Synthetic oligonucleotide
  Target: ATXN1; (-) strand; PAM type: NRG; PAM sequence: AAG
acagatcactgcagggagtg

SEQ ID NO: 67520 - DNA, 20 bp, Artificial Sequence
  Description of Artificial Sequence: Synthetic oligonucleotide
  Target: ATXN1; (-) strand; PAM type: NRG; PAM sequence: GAG
tacatacagatcactgcagg

SEQ ID NO: 67521 - DNA, 20 bp, Artificial Sequence
  Description of Artificial Sequence: Synthetic oligonucleotide
  Target: ATXN1; (-) strand; PAM type: NRG; PAM sequence: GGG
attacatacagatcactgca

SEQ ID NO: 67522 - DNA, 20 bp, Artificial Sequence
  Description of Artificial Sequence: Synthetic oligonucleotide
  Target: ATXN1; (-) strand; PAM type: NRG; PAM sequence: AGG
aattacatacagatcactgc

SEQ ID NO: 67523 - DNA, 20 bp, Artificial Sequence
  Description of Artificial Sequence: Synthetic oligonucleotide
  Target: ATXN1; (-) strand; PAM type: NRG; PAM sequence: CAG
taattacatacagatcactg

SEQ ID NO: 67524 - DNA, 20 bp, Artificial Sequence
  Description of Artificial Sequence: Synthetic oligonucleotide
  Target: ATXN1; (-) strand; PAM type: NRG; PAM sequence: CAG
catatgagcctaattacata

SEQ ID NO: 67525 - DNA, 20 bp, Artificial Sequence
  Description of Artificial Sequence: Synthetic oligonucleotide
  Target: ATXN1; (-) strand; PAM type: NRG; PAM sequence: GAG
ccaagtccacattcccatat

SEQ ID NO: 67526 - DNA, 20 bp, Artificial Sequence
  Description of Artificial Sequence: Synthetic oligonucleotide
  Target: ATXN1; (-) strand; PAM type: NRG; PAM sequence: AAG
gcctccagcgcccctctgcc

SEQ ID NO: 67527 - DNA, 20 bp, Artificial Sequence
  Description of Artificial Sequence: Synthetic oligonucleotide
  Target: ATXN1; (-) strand; PAM type: NRG; PAM sequence: CAG
tcagcctgatatgtggcctc

SEQ ID NO: 67528 - DNA, 20 bp, Artificial Sequence
  Description of Artificial Sequence: Synthetic oligonucleotide
  Target: ATXN1; (-) strand; PAM type: NRG; PAM sequence: TGG
tactcagtcagcctgatatg

SEQ ID NO: 67529 - DNA, 20 bp, Artificial Sequence
  Description of Artificial Sequence: Synthetic oligonucleotide
  Target: ATXN1; (-) strand; PAM type: NRG; PAM sequence: CAG
tcctcacgggattactcagt

SEQ ID NO: 67530 - DNA, 20 bp, Artificial Sequence
  Description of Artificial Sequence: Synthetic oligonucleotide
  Target: ATXN1; (-) strand; PAM type: NRG; PAM sequence: CAG
ggcttcctcacgggattact

SEQ ID NO: 67531 - DNA, 20 bp, Artificial Sequence
  Description of Artificial Sequence: Synthetic oligonucleotide
  Target: ATXN1; (-) strand; PAM type: NRG; PAM sequence: GGG
agacactgtggcttcctcac

SEQ ID NO: 67532 - DNA, 20 bp, Artificial Sequence
  Description of Artificial Sequence: Synthetic oligonucleotide
  Target: ATXN1; (-) strand; PAM type: NRG; PAM sequence: CGG
cagacactgtggcttcctca

SEQ ID NO: 67533 - DNA, 20 bp, Artificial Sequence
  Description of Artificial Sequence: Synthetic oligonucleotide
  Target: ATXN1; (-) strand; PAM type: NRG; PAM sequence: TGG
cgtcagtatctcagacactg

SEQ ID NO: 67534 - DNA, 20 bp, Artificial Sequence
  Description of Artificial Sequence: Synthetic oligonucleotide
  Target: ATXN1; (-) strand; PAM type: NRG; PAM sequence: CAG
tgtttggcccgtcagtatct

SEQ ID NO: 67535 - DNA, 20 bp, Artificial Sequence
  Description of Artificial Sequence: Synthetic oligonucleotide
  Target: ATXN1; (-) strand; PAM type: NRG; PAM sequence: CAG
ccacactttgtttggcccgt

SEQ ID NO: 67536 - DNA, 20 bp, Artificial Sequence
  Description of Artificial Sequence: Synthetic oligonucleotide
  Target: ATXN1; (-) strand; PAM type: NRG; PAM sequence: TGG
gttctttcccacactttgtt

SEQ ID NO: 67537 - DNA, 20 bp, Artificial Sequence
  Description of Artificial Sequence: Synthetic oligonucleotide
  Target: ATXN1; (-) strand; PAM type: NRG; PAM sequence: AGG
cccttatctccctttctttc

SEQ ID NO: 67538 - DNA, 20 bp, Artificial Sequence
  Description of Artificial Sequence: Synthetic oligonucleotide
  Target: ATXN1; (-) strand; PAM type: NRG; PAM sequence: CAG
tcccttatctccctttcttt

SEQ ID NO: 67539 - DNA, 20 bp, Artificial Sequence
  Description of Artificial Sequence: Synthetic oligonucleotide
  Target: ATXN1; (-) strand; PAM type: NRG; PAM sequence: TAG
cttgtgtggtgtagattaaa

SEQ ID NO: 67540 - DNA, 20 bp, Artificial Sequence
  Description of Artificial Sequence: Synthetic oligonucleotide
  Target: ATXN1; (-) strand; PAM type: NRG; PAM sequence: TAG
acttagttccttgtgtggtg

SEQ ID NO: 67541 - DNA, 20 bp, Artificial Sequence
  Description of Artificial Sequence: Synthetic oligonucleotide
  Target: ATXN1; (-) strand; PAM type: NRG; PAM sequence: TGG
cttgaacttagttccttgtg

SEQ ID NO: 67542 - DNA, 20 bp, Artificial Sequence
  Description of Artificial Sequence: Synthetic oligonucleotide
  Target: ATXN1; (-) strand; PAM type: NRG; PAM sequence: TAG
gttgagttggatcttgaact

SEQ ID NO: 67543 - DNA, 20 bp, Artificial Sequence
  Description of Artificial Sequence: Synthetic oligonucleotide
  Target: ATXN1; (-) strand; PAM type: NRG; PAM sequence: TGG
tctggagattattgttgagt

SEQ ID NO: 67544 - DNA, 20 bp, Artificial Sequence
  Description of Artificial Sequence: Synthetic oligonucleotide
  Target: ATXN1; (-) strand; PAM type: NRG; PAM sequence: GAG
agtctctggagattattgtt

SEQ ID NO: 67545 - DNA, 20 bp, Artificial Sequence
  Description of Artificial Sequence: Synthetic oligonucleotide
  Target: ATXN1; (-) strand; PAM type: NRG; PAM sequence: GAG
cgtctttaaaatagtctctg

SEQ ID NO: 67546 - DNA, 20 bp, Artificial Sequence
  Description of Artificial Sequence: Synthetic oligonucleotide
  Target: ATXN1; (-) strand; PAM type: NRG; PAM sequence: TGG
ggcgtctttaaaatagtctc

SEQ ID NO: 67547 - DNA, 20 bp, Artificial Sequence
  Description of Artificial Sequence: Synthetic oligonucleotide
  Target: ATXN1; (-) strand; PAM type: NRG; PAM sequence: TAG
ctgcaaaggcgtctttaaaa

SEQ ID NO: 67548 - DNA, 20 bp, Artificial Sequence
  Description of Artificial Sequence: Synthetic oligonucleotide
  Target: ATXN1; (-) strand; PAM type: NRG; PAM sequence: AGG
agcctctcttaaacctgcaa

SEQ ID NO: 67549 - DNA, 20 bp, Artificial Sequence
  Description of Artificial Sequence: Synthetic oligonucleotide
  Target: ATXN1; (-) strand; PAM type: NRG; PAM sequence: AAG
cagcctctcttaaacctgca

SEQ ID NO: 67550 - DNA, 20 bp, Artificial Sequence
  Description of Artificial Sequence: Synthetic oligonucleotide
  Target: ATXN1; (-) strand; PAM type: NRG; PAM sequence: CAG
gctggaatagctttgcctca

SEQ ID NO: 67551 - DNA, 20 bp, Artificial Sequence
  Description of Artificial Sequence: Synthetic oligonucleotide
  Target: ATXN1; (-) strand; PAM type: NRG; PAM sequence: TAG
cagaacatcaggagctggaa

SEQ ID NO: 67552 - DNA, 20 bp, Artificial Sequence
  Description of Artificial Sequence: Synthetic oligonucleotide
  Target: ATXN1; (-) strand; PAM type: NRG; PAM sequence: TGG
gcccacagaacatcaggagc

SEQ ID NO: 67553 - DNA, 20 bp, Artificial Sequence
  Description of Artificial Sequence: Synthetic oligonucleotide
  Target: ATXN1; (-) strand; PAM type: NRG; PAM sequence: GAG
acttgcccacagaacatcag

SEQ ID NO: 67554 - DNA, 20 bp, Artificial Sequence
  Description of Artificial Sequence: Synthetic oligonucleotide
  Target: ATXN1; (-) strand; PAM type: NRG; PAM sequence: AGG
aaacttgcccacagaacatc

SEQ ID NO: 67555 - DNA, 20 bp, Artificial Sequence
  Description of Artificial Sequence: Synthetic oligonucleotide
  Target: ATXN1; (-) strand; PAM type: NRG; PAM sequence: CAG
gaaacttgcccacagaacat

SEQ ID NO: 67556 - DNA, 20 bp, Artificial Sequence
  Description of Artificial Sequence: Synthetic oligonucleotide
  Target: ATXN1; (-) strand; PAM type: NRG; PAM sequence: CAG
aatcctgggaaacttgccca

SEQ ID NO: 67557 - DNA, 20 bp, Artificial Sequence
  Description of Artificial Sequence: Synthetic oligonucleotide
  Target: ATXN1; (-) strand; PAM type: NRG; PAM sequence: GGG
cccaaagatgctggaatcct

SEQ ID NO: 67558 - DNA, 20 bp, Artificial Sequence
  Description of Artificial Sequence: Synthetic oligonucleotide
  Target: ATXN1; (-) strand; PAM type: NRG; PAM sequence: TGG
tcccaaagatgctggaatcc

SEQ ID NO: 67559 - DNA, 20 bp, Artificial Sequence
  Description of Artificial Sequence: Synthetic oligonucleotide
  Target: ATXN1; (-) strand; PAM type: NRG; PAM sequence: TGG
agaatgaatcccaaagatgc

SEQ ID NO: 67560 - DNA, 20 bp, Artificial Sequence
  Description of Artificial Sequence: Synthetic oligonucleotide
  Target: ATXN1; (-) strand; PAM type: NRG; PAM sequence: AAG
agctcatagaatgaatccca

SEQ ID NO: 67561 - DNA, 20 bp, Artificial Sequence
  Description of Artificial Sequence: Synthetic oligonucleotide
  Target: ATXN1; (-) strand; PAM type: NRG; PAM sequence: TAG
ctgtggccttccacagctca

SEQ ID NO: 67562 - DNA, 20 bp, Artificial Sequence
  Description of Artificial Sequence: Synthetic oligonucleotide
  Target: ATXN1; (-) strand; PAM type: NRG; PAM sequence: CAG
gggaaagctgtggccttcca

SEQ ID NO: 67563 - DNA, 20 bp, Artificial Sequence
  Description of Artificial Sequence: Synthetic oligonucleotide
  Target: ATXN1; (-) strand; PAM type: NRG; PAM sequence: TGG
tgaaaagggcgggaaagctg

SEQ ID NO: 67564 - DNA, 20 bp, Artificial Sequence
  Description of Artificial Sequence: Synthetic oligonucleotide
  Target: ATXN1; (-) strand; PAM type: NRG; PAM sequence: AAG
ctctgatgaaaagggcggga

SEQ ID NO: 67565 - DNA, 20 bp, Artificial Sequence
  Description of Artificial Sequence: Synthetic oligonucleotide
  Target: ATXN1; (-) strand; PAM type: NRG; PAM sequence: GGG
cgtcctctgatgaaaagggc

SEQ ID NO: 67566 - DNA, 20 bp, Artificial Sequence
  Description of Artificial Sequence: Synthetic oligonucleotide
  Target: ATXN1; (-) strand; PAM type: NRG; PAM sequence: CGG
acgtcctctgatgaaaaggg

SEQ ID NO: 67567 - DNA, 20 bp, Artificial Sequence
  Description of Artificial Sequence: Synthetic oligonucleotide
  Target: ATXN1; (-) strand; PAM type: NRG; PAM sequence: GGG
tccacgtcctctgatgaaaa

SEQ ID NO: 67568 - DNA, 20 bp, Artificial Sequence
  Description of Artificial Sequence: Synthetic oligonucleotide
  Target: ATXN1; (-) strand; PAM type: NRG; PAM sequence: AGG
gtccacgtcctctgatgaaa

SEQ ID NO: 67569 - DNA, 20 bp, Artificial Sequence
  Description of Artificial Sequence: Synthetic oligonucleotide
  Target: ATXN1; (-) strand; PAM type: NRG; PAM sequence: AAG
cgtccacgtcctctgatgaa

SEQ ID NO: 67570 - DNA, 20 bp, Artificial Sequence
  Description of Artificial Sequence: Synthetic oligonucleotide
  Target: ATXN1; (-) strand; PAM type: NRG; PAM sequence: CGG
ctctatcctgccctggtggc

SEQ ID NO: 67571 - DNA, 20 bp, Artificial Sequence
  Description of Artificial Sequence: Synthetic oligonucleotide
  Target: ATXN1; (-) strand; PAM type: NRG; PAM sequence: TGG
aaagctctatcctgccctgg

SEQ ID NO: 67572 - DNA, 20 bp, Artificial Sequence
  Description of Artificial Sequence: Synthetic oligonucleotide
  Target: ATXN1; (-) strand; PAM type: NRG; PAM sequence: TGG
gaaaaagctctatcctgccc

SEQ ID NO: 67573 - DNA, 20 bp, Artificial Sequence
  Description of Artificial Sequence: Synthetic oligonucleotide
  Target: ATXN1; (-) strand; PAM type: NRG; PAM sequence: AAG
gctggtgggccatcctgaaa

SEQ ID NO: 67574 - DNA, 20 bp, Artificial Sequence
  Description of Artificial Sequence: Synthetic oligonucleotide
  Target: ATXN1; (-) strand; PAM type: NRG; PAM sequence: GGG
gaatcttcctgcaggctggt

SEQ ID NO: 67575 - DNA, 20 bp, Artificial Sequence
  Description of Artificial Sequence: Synthetic oligonucleotide
  Target: ATXN1; (-) strand; PAM type: NRG; PAM sequence: TGG
ggaatcttcctgcaggctgg

SEQ ID NO: 67576 - DNA, 20 bp, Artificial Sequence
  Description of Artificial Sequence: Synthetic oligonucleotide
  Target: ATXN1; (-) strand; PAM type: NRG; PAM sequence: TGG
ctgggaatcttcctgcaggc

SEQ ID NO: 67577 - DNA, 20 bp, Artificial Sequence
  Description of Artificial Sequence: Synthetic oligonucleotide
  Target: ATXN1; (-) strand; PAM type: NRG; PAM sequence: AGG
gagtctgggaatcttcctgc

SEQ ID NO: 67578 - DNA, 20 bp, Artificial Sequence
  Description of Artificial Sequence: Synthetic oligonucleotide
  Target: ATXN1; (-) strand; PAM type: NRG; PAM sequence: CAG
tgagtctgggaatcttcctg

SEQ ID NO: 67579 - DNA, 20 bp, Artificial Sequence
  Description of Artificial Sequence: Synthetic oligonucleotide
  Target: ATXN1; (-) strand; PAM type: NRG; PAM sequence: GGG
gattctgaggaactgagtct

SEQ ID NO: 67580 - DNA, 20 bp, Artificial Sequence
  Description of Artificial Sequence: Synthetic oligonucleotide
  Target: ATXN1; (-) strand; PAM type: NRG; PAM sequence: TGG
agattctgaggaactgagtc

SEQ ID NO: 67581 - DNA, 20 bp, Artificial Sequence
  Description of Artificial Sequence: Synthetic oligonucleotide
  Target: ATXN1; (-) strand; PAM type: NRG; PAM sequence: GAG
ccttcagattctgaggaact

SEQ ID NO: 67582 - DNA, 20 bp, Artificial Sequence
  Description of Artificial Sequence: Synthetic oligonucleotide
  Target: ATXN1; (-) strand; PAM type: NRG; PAM sequence: AGG
ggagtgcccttcagattctg

SEQ ID NO: 67583 - DNA, 20 bp, Artificial Sequence
  Description of Artificial Sequence: Synthetic oligonucleotide
  Target: ATXN1; (-) strand; PAM type: NRG; PAM sequence: GAG
aggagtgcccttcagattct

SEQ ID NO: 67584 - DNA, 20 bp, Artificial Sequence
  Description of Artificial Sequence: Synthetic oligonucleotide
  Target: ATXN1; (-) strand; PAM type: NRG; PAM sequence: CAG
ggacttggaggagtgccctt

SEQ ID NO: 67585 - DNA, 20 bp, Artificial Sequence
  Description of Artificial Sequence: Synthetic oligonucleotide
  Target: ATXN1; (-) strand; PAM type: NRG; PAM sequence: GAG
ctgctctgtgggacttggag

SEQ ID NO: 67586 - DNA, 20 bp, Artificial Sequence
  Description of Artificial Sequence: Synthetic oligonucleotide
  Target: ATXN1; (-) strand; PAM type: NRG; PAM sequence: AGG
ggctgctctgtgggacttgg

SEQ ID NO: 67587 - DNA, 20 bp, Artificial Sequence
  Description of Artificial Sequence: Synthetic oligonucleotide
  Target: ATXN1; (-) strand; PAM type: NRG; PAM sequence: GAG
gggctgctctgtgggacttg

SEQ ID NO: 67588 - DNA, 20 bp, Artificial Sequence
  Description of Artificial Sequence: Synthetic oligonucleotide
  Target: ATXN1; (-) strand; PAM type: NRG; PAM sequence: TGG
gtgggctgctctgtgggact

SEQ ID NO: 67589 - DNA, 20 bp, Artificial Sequence
  Description of Artificial Sequence: Synthetic oligonucleotide
  Target: ATXN1; (-) strand; PAM type: NRG; PAM sequence: GGG
acacttgtgggctgctctgt

SEQ ID NO: 67590 - DNA, 20 bp, Artificial Sequence
  Description of Artificial Sequence: Synthetic oligonucleotide
  Target: ATXN1; (-) strand; PAM type: NRG; PAM sequence: TGG
aacacttgtgggctgctctg

SEQ ID NO: 67591 - DNA, 20 bp, Artificial Sequence
  Description of Artificial Sequence: Synthetic oligonucleotide
  Target: ATXN1; (-) strand; PAM type: NRG; PAM sequence: GGG
gtgtcatgttaaacacttgt

SEQ ID NO: 67592 - DNA, 20 bp, Artificial Sequence
  Description of Artificial Sequence: Synthetic oligonucleotide
  Target: ATXN1; (-) strand; PAM type: NRG; PAM sequence: TGG
agtgtcatgttaaacacttg

SEQ ID NO: 67593 - DNA, 20 bp, Artificial Sequence
  Description of Artificial Sequence: Synthetic oligonucleotide
  Target: ATXN1; (-) strand; PAM type: NRG; PAM sequence: AAG
ggatagtctgactgcatagt

SEQ ID NO: 67594 - DNA, 20 bp, Artificial Sequence
  Description of Artificial Sequence: Synthetic oligonucleotide
  Target: ATXN1; (-) strand; PAM type: NRG; PAM sequence: TAG
cctaggatagtctgactgca

SEQ ID NO: 67595 - DNA, 20 bp, Artificial Sequence
  Description of Artificial Sequence: Synthetic oligonucleotide
  Target: ATXN1; (-) strand; PAM type: NRG; PAM sequence: TAG
cagccccacctagcctagga

SEQ ID NO: 67596 - DNA, 20 bp, Artificial Sequence
  Description of Artificial Sequence: Synthetic oligonucleotide
  Target: ATXN1; (-) strand; PAM type: NRG; PAM sequence: AGG
tttgcagccccacctagcct

SEQ ID NO: 67597 - DNA, 20 bp, Artificial Sequence
  Description of Artificial Sequence: Synthetic oligonucleotide
  Target: ATXN1; (-) strand; PAM type: NRG; PAM sequence: TAG
ctttgcagccccacctagcc

SEQ ID NO: 67598 - DNA, 20 bp, Artificial Sequence
  Description of Artificial Sequence: Synthetic oligonucleotide
  Target: ATXN1; (-) strand; PAM type: NRG; PAM sequence: TAG
tttgtctttgcagccccacc

SEQ ID NO: 67599 - DNA, 20 bp, Artificial Sequence
  Description of Artificial Sequence: Synthetic oligonucleotide
  Target: ATXN1; (-) strand; PAM type: NRG; PAM sequence: CAG
gagcataacctttgtctttg

SEQ ID NO: 67600 - DNA, 20 bp, Artificial Sequence
  Description of Artificial Sequence: Synthetic oligonucleotide
  Target: ATXN1; (-) strand; PAM type: NRG; PAM sequence: GAG
ctggcagtttttttcaattg

SEQ ID NO: 67601 - DNA, 20 bp, Artificial Sequence
  Description of Artificial Sequence: Synthetic oligonucleotide
  Target: ATXN1; (-) strand; PAM type: NRG; PAM sequence: TGG
ttctggcagtttttttcaat

SEQ ID NO: 67602 - DNA, 20 bp, Artificial Sequence
  Description of Artificial Sequence: Synthetic oligonucleotide
  Target: ATXN1; (-) strand; PAM type: NRG; PAM sequence: CAG
atgtttgcatggctttctgg

SEQ ID NO: 67603 - DNA, 20 bp, Artificial Sequence
  Description of Artificial Sequence: Synthetic oligonucleotide
  Target: ATXN1; (-) strand; PAM type: NRG; PAM sequence: TGG
tcaatgtttgcatggctttc

SEQ ID NO: 67604 - DNA, 20 bp, Artificial Sequence
  Description of Artificial Sequence: Synthetic oligonucleotide
  Target: ATXN1; (-) strand; PAM type: NRG; PAM sequence: TGG
accatttttcaatgtttgca

SEQ ID NO: 67605 - DNA, 20 bp, Artificial Sequence
  Description of Artificial Sequence: Synthetic oligonucleotide
  Target: ATXN1; (-) strand; PAM type: NRG; PAM sequence: CAG
aagatactcagagattttgc

SEQ ID NO: 67606 - DNA, 20 bp, Artificial Sequence
  Description of Artificial Sequence: Synthetic oligonucleotide
  Target: ATXN1; (-) strand; PAM type: NRG; PAM sequence: GAG
taaaacgaagaagatactca

SEQ ID NO: 67607 - DNA, 20 bp, Artificial Sequence
  Description of Artificial Sequence: Synthetic oligonucleotide
  Target: ATXN1; (-) strand; PAM type: NRG; PAM sequence: CAG
tttaaaacgaagaagatact

SEQ ID NO: 67608 - DNA, 20 bp, Artificial Sequence
  Description of Artificial Sequence: Synthetic oligonucleotide
  Target: ATXN1; (-) strand; PAM type: NRG; PAM sequence: AAG
agtgttgctttaaaacgaag

SEQ ID NO: 67609 - DNA, 20 bp, Artificial Sequence
  Description of Artificial Sequence: Synthetic oligonucleotide
  Target: ATXN1; (-) strand; PAM type: NRG; PAM sequence: AAG
taaagtgttgctttaaaacg

SEQ ID NO: 67610 - DNA, 20 bp, Artificial Sequence
  Description of Artificial Sequence: Synthetic oligonucleotide
  Target: ATXN1; (-) strand; PAM type: NRG; PAM sequence: AAG
atgcgtgtgagtggattata

SEQ ID NO: 67611 - DNA, 20 bp, Artificial Sequence
  Description of Artificial Sequence: Synthetic oligonucleotide
  Target: ATXN1; (-) strand; PAM type: NRG; PAM sequence: TGG
aaaaggtcaatgcgtgtgag

SEQ ID NO: 67612 - DNA, 20 bp, Artificial Sequence
  Description of Artificial Sequence: Synthetic oligonucleotide
  Target: ATXN1; (-) strand; PAM type: NRG; PAM sequence: GAG
atgaaaaggtcaatgcgtgt

SEQ ID NO: 67613 - DNA, 20 bp, Artificial Sequence
  Description of Artificial Sequence: Synthetic oligonucleotide
  Target: ATXN1; (-) strand; PAM type: NRG; PAM sequence: AGG
cgtctgttgttaggatgaaa

SEQ ID NO: 67614 - DNA, 20 bp, Artificial Sequence
  Description of Artificial Sequence: Synthetic oligonucleotide
  Target: ATXN1; (-) strand; PAM type: NRG; PAM sequence: AAG
tcgtctgttgttaggatgaa

SEQ ID NO: 67615 - DNA, 20 bp, Artificial Sequence
  Description of Artificial Sequence: Synthetic oligonucleotide
  Target: ATXN1; (-) strand; PAM type: NRG; PAM sequence: AGG
tagacgtctcgtctgttgtt

SEQ ID NO: 67616 - DNA, 20 bp, Artificial Sequence
  Description of Artificial Sequence: Synthetic oligonucleotide
  Target: ATXN1; (-) strand; PAM type: NRG; PAM sequence: TAG
gtagacgtctcgtctgttgt

SEQ ID NO: 67617 - DNA, 20 bp, Artificial Sequence
  Description of Artificial Sequence: Synthetic oligonucleotide
  Target: ATXN1; (-) strand; PAM type: NRG; PAM sequence: TAG
ggtctcaagaattcgtactg

SEQ ID NO: 67618 - DNA, 20 bp, Artificial Sequence
  Description of Artificial Sequence: Synthetic oligonucleotide
  Target: ATXN1; (-) strand; PAM type: NRG; PAM sequence: AAG
aaatcagttttcgtggtctc

SEQ ID NO: 67619 - DNA, 20 bp, Artificial Sequence
  Description of Artificial Sequence: Synthetic oligonucleotide
  Target: ATXN1; (-) strand; PAM type: NRG; PAM sequence: TGG
gactttgaaatcagttttcg

SEQ ID NO: 67620 - DNA, 20 bp, Artificial Sequence
  Description of Artificial Sequence: Synthetic oligonucleotide
  Target: ATXN1; (-) strand; PAM type: NRG; PAM sequence: CAG
ctgaggtctgactttgaaat

SEQ ID NO: 67621 - DNA, 20 bp, Artificial Sequence
  Description of Artificial Sequence: Synthetic oligonucleotide
  Target: ATXN1; (-) strand; PAM type: NRG; PAM sequence: AGG
ctcagctgaggctcagactg

SEQ ID NO: 67622 - DNA, 20 bp, Artificial Sequence
  Description of Artificial Sequence: Synthetic oligonucleotide
  Target: ATXN1; (-) strand; PAM type: NRG; PAM sequence: GAG
actcagctgaggctcagact

SEQ ID NO: 67623 - DNA, 20 bp, Artificial Sequence
  Description of Artificial Sequence: Synthetic oligonucleotide
  Target: ATXN1; (-) strand; PAM type: NRG; PAM sequence: CAG
tctgtgactcagctgaggct

SEQ ID NO: 67624 - DNA, 20 bp, Artificial Sequence
  Description of Artificial Sequence: Synthetic oligonucleotide
  Target: ATXN1; (-) strand; PAM type: NRG; PAM sequence: AGG
gctcctctgtgactcagctg

SEQ ID NO: 67625 - DNA, 20 bp, Artificial Sequence
  Description of Artificial Sequence: Synthetic oligonucleotide
  Target: ATXN1; (-) strand; PAM type: NRG; PAM sequence: GAG
agctcctctgtgactcagct

SEQ ID NO: 67626 - DNA, 20 bp, Artificial Sequence
  Description of Artificial Sequence: Synthetic oligonucleotide
  Target: ATXN1; (-) strand; PAM type: NRG; PAM sequence: CAG
cacacagctcctctgtgact

SEQ ID NO: 67627 - DNA, 20 bp, Artificial Sequence
  Description of Artificial Sequence: Synthetic oligonucleotide
  Target: ATXN1; (-) strand; PAM type: NRG; PAM sequence: CAG
tttaagtaactggaaccaca

SEQ ID NO: 67628 - DNA, 20 bp, Artificial Sequence
  Description of Artificial Sequence: Synthetic oligonucleotide
  Target: ATXN1; (-) strand; PAM type: NRG; PAM sequence: TGG
gttcagagagtttaagtaac

SEQ ID NO: 67629 - DNA, 20 bp, Artificial Sequence
  Description of Artificial Sequence: Synthetic oligonucleotide
  Target: ATXN1; (-) strand; PAM type: NRG; PAM sequence: AAG
ggaaagggttcagagagttt

SEQ ID NO: 67630 - DNA, 20 bp, Artificial Sequence
  Description of Artificial Sequence: Synthetic oligonucleotide
  Target: ATXN1; (-) strand; PAM type: NRG; PAM sequence: GAG
aaatgaggaaagggttcaga

SEQ ID NO: 67631 - DNA, 20 bp, Artificial Sequence
  Description of Artificial Sequence: Synthetic oligonucleotide
  Target: ATXN1; (-) strand; PAM type: NRG; PAM sequence: GAG
acaaatgaggaaagggttca

SEQ ID NO: 67632 - DNA, 20 bp, Artificial Sequence
  Description of Artificial Sequence: Synthetic oligonucleotide
  Target: ATXN1; (-) strand; PAM type: NRG; PAM sequence: CAG
atacaaatgaggaaagggtt

SEQ ID NO: 67633 - DNA, 20 bp, Artificial Sequence
  Description of Artificial Sequence: Synthetic oligonucleotide
  Target: ATXN1; (-) strand; PAM type: NRG; PAM sequence: GGG
ccattatacaaatgaggaaa

SEQ ID NO: 67634 - DNA, 20 bp, Artificial Sequence
  Description of Artificial Sequence: Synthetic oligonucleotide
  Target: ATXN1; (-) strand; PAM type: NRG; PAM sequence: AGG
gccattatacaaatgaggaa

SEQ ID NO: 67635 - DNA, 20 bp, Artificial Sequence
  Description of Artificial Sequence: Synthetic oligonucleotide
  Target: ATXN1; (-) strand; PAM type: NRG; PAM sequence: AAG
tgccattatacaaatgagga

SEQ ID NO: 67636 - DNA, 20 bp, Artificial Sequence
  Description of Artificial Sequence: Synthetic oligonucleotide
  Target: ATXN1; (-) strand; PAM type: NRG; PAM sequence: AGG
ttattgccattatacaaatg

SEQ ID NO: 67637 - DNA, 20 bp, Artificial Sequence
  Description of Artificial Sequence: Synthetic oligonucleotide
  Target: ATXN1; (-) strand; PAM type: NRG; PAM sequence: GAG
gttattgccattatacaaat

SEQ ID NO: 67638 - DNA, 20 bp, Artificial Sequence
  Description of Artificial Sequence: Synthetic oligonucleotide
  Target: ATXN1; (-) strand; PAM type: NRG; PAM sequence: AAG
aaaactagaaacattctatg

SEQ ID NO: 67639 - DNA, 20 bp, Artificial Sequence
  Description of Artificial Sequence: Synthetic oligonucleotide
  Target: ATXN1; (-) strand; PAM type: NRG; PAM sequence: TAG
ccaagcgccacactaaaaac

SEQ ID NO: 67640 - DNA, 20 bp, Artificial Sequence
  Description of Artificial Sequence: Synthetic oligonucleotide
  Target: ATXN1; (-) strand; PAM type: NRG; PAM sequence: AAG
ttcagtctcttctgtgtacc

SEQ ID NO: 67641 - DNA, 20 bp, Artificial Sequence
  Description of Artificial Sequence: Synthetic oligonucleotide
  Target: ATXN1; (-) strand; PAM type: NRG; PAM sequence: CAG
taatgcctttttgttttatt

SEQ ID NO: 67642 - DNA, 20 bp, Artificial Sequence
  Description of Artificial Sequence: Synthetic oligonucleotide
  Target: ATXN1; (-) strand; PAM type: NRG; PAM sequence: TGG
tgaacatgttgtgtgccaaa

SEQ ID NO: 67643 - DNA, 20 bp, Artificial Sequence
  Description of Artificial Sequence: Synthetic oligonucleotide
  Target: ATXN1; (-) strand; PAM type: NRG; PAM sequence: CAG
gtgtctttcctccattgtta

SEQ ID NO: 67644 - DNA, 20 bp, Artificial Sequence
  Description of Artificial Sequence: Synthetic oligonucleotide
  Target: ATXN1; (-) strand; PAM type: NRG; PAM sequence: AAG
ggcaaattattaagtcacca

SEQ ID NO: 67645 - DNA, 20 bp, Artificial Sequence
  Description of Artificial Sequence: Synthetic oligonucleotide
  Target: ATXN1; (-) strand; PAM type: NRG; PAM sequence: AAG
tcacattctggcaaattatt

SEQ ID NO: 67646 - DNA, 20 bp, Artificial Sequence
  Description of Artificial Sequence: Synthetic oligonucleotide
  Target: ATXN1; (-) strand; PAM type: NRG; PAM sequence: TGG
caccacgcccagtcacattc

SEQ ID NO: 67647 - DNA, 20 bp, Artificial Sequence
  Description of Artificial Sequence: Synthetic oligonucleotide
  Target: ATXN1; (-) strand; PAM type: NRG; PAM sequence: CAG
taggagtgagccaccacgcc

SEQ ID NO: 67648 - DNA, 20 bp, Artificial Sequence
  Description of Artificial Sequence: Synthetic oligonucleotide
  Target: ATXN1; (-) strand; PAM type: NRG; PAM sequence: GAG
agtgctgggattataggagt

SEQ ID NO: 67649 - DNA, 20 bp, Artificial Sequence
  Description of Artificial Sequence: Synthetic oligonucleotide
  Target: ATXN1; (-) strand; PAM type: NRG; PAM sequence: GAG
ccaaagtgctgggattatag

SEQ ID NO: 67650 - DNA, 20 bp, Artificial Sequence
  Description of Artificial Sequence: Synthetic oligonucleotide
  Target: ATXN1; (-) strand; PAM type: NRG; PAM sequence: AGG
tcccaaagtgctgggattat

SEQ ID NO: 67651 - DNA, 20 bp, Artificial Sequence
  Description of Artificial Sequence: Synthetic oligonucleotide
  Target: ATXN1; (-) strand; PAM type: NRG; PAM sequence: TAG
ctcccaaagtgctgggatta

SEQ ID NO: 67652 - DNA, 20 bp, Artificial Sequence
  Description of Artificial Sequence: Synthetic oligonucleotide
  Target: ATXN1; (-) strand; PAM type: NRG; PAM sequence: GGG
gcttggcctcccaaagtgct

SEQ ID NO: 67653 - DNA, 20 bp, Artificial Sequence
  Description of Artificial Sequence: Synthetic oligonucleotide
  Target: ATXN1; (-) strand; PAM type: NRG; PAM sequence: TGG
ggcttggcctcccaaagtgc

SEQ ID NO: 67654 - DNA, 20 bp, Artificial Sequence
  Description of Artificial Sequence: Synthetic oligonucleotide
  Target: ATXN1; (-) strand; PAM type: NRG; PAM sequence: AAG
ccacctggcttggcctccca

SEQ ID NO: 67655 - DNA, 20 bp, Artificial Sequence
  Description of Artificial Sequence: Synthetic oligonucleotide
  Target: ATXN1; (-) strand; PAM type: NRG; PAM sequence: TGG
ttcaggtgatccacctggct

SEQ ID NO: 67656 - DNA, 20 bp, Artificial Sequence
  Description of Artificial Sequence: Synthetic oligonucleotide
  Target: ATXN1; (-) strand; PAM type: NRG; PAM sequence: TGG
ctgacttcaggtgatccacc

SEQ ID NO: 67657 - DNA, 20 bp, Artificial Sequence
  Description of Artificial Sequence: Synthetic oligonucleotide
  Target: ATXN1; (-) strand; PAM type: NRG; PAM sequence: AGG
ggtcttgaactcctgacttc

SEQ ID NO: 67658 - DNA, 20 bp, Artificial Sequence
  Description of Artificial Sequence: Synthetic oligonucleotide
  Target: ATXN1; (-) strand; PAM type: NRG; PAM sequence: CAG
tggtcttgaactcctgactt

SEQ ID NO: 67659 - DNA, 20 bp, Artificial Sequence
  Description of Artificial Sequence: Synthetic oligonucleotide
  Target: ATXN1; (-) strand; PAM type: NRG; PAM sequence: TGG
ttttaccatggtggccaggc

SEQ ID NO: 67660 - DNA, 20 bp, Artificial Sequence
  Description of Artificial Sequence: Synthetic oligonucleotide
  Target: ATXN1; (-) strand; PAM type: NRG; PAM sequence: AGG
ggggttttaccatggtggcc

SEQ ID NO: 67661 - DNA, 20 bp, Artificial Sequence
  Description of Artificial Sequence: Synthetic oligonucleotide
  Target: ATXN1; (-) strand; PAM type: NRG; PAM sequence: CAG
tggggttttaccatggtggc

SEQ ID NO: 67662 - DNA, 20 bp, Artificial Sequence
  Description of Artificial Sequence: Synthetic oligonucleotide
  Target: ATXN1; (-) strand; PAM type: NRG; PAM sequence: TGG
gagatggggttttaccatgg

SEQ ID NO: 67663 - DNA, 20 bp, Artificial Sequence
  Description of Artificial Sequence: Synthetic oligonucleotide
  Target: ATXN1; (-) strand; PAM type: NRG; PAM sequence: TGG
gtagagatggggttttacca

SEQ ID NO: 67664 - DNA, 20 bp, Artificial Sequence
  Description of Artificial Sequence: Synthetic oligonucleotide
  Target: ATXN1; (-) strand; PAM type: NRG; PAM sequence: GGG
ttgtatttttagtagagatg

SEQ ID NO: 67665 - DNA, 20 bp, Artificial Sequence
  Description of Artificial Sequence: Synthetic oligonucleotide
  Target: ATXN1; (-) strand; PAM type: NRG; PAM sequence: GGG
tttgtatttttagtagagat

SEQ ID NO: 67666 - DNA, 20 bp, Artificial Sequence
  Description of Artificial Sequence: Synthetic oligonucleotide
  Target: ATXN1; (-) strand; PAM type: NRG; PAM sequence: TGG
ttttgtatttttagtagaga

SEQ ID NO: 67667 - DNA, 20 bp, Artificial Sequence
  Description of Artificial Sequence: Synthetic oligonucleotide
  Target: ATXN1; (-) strand; PAM type: NRG; PAM sequence: GAG
ctaattttgtatttttagta

SEQ ID NO: 67668 - DNA, 20 bp, Artificial Sequence
  Description of Artificial Sequence: Synthetic oligonucleotide
  Target: ATXN1; (-) strand; PAM type: NRG; PAM sequence: TAG
ggctaattttgtatttttag

SEQ ID NO: 67669 - DNA, 20 bp, Artificial Sequence
  Description of Artificial Sequence: Synthetic oligonucleotide
  Target: ATXN1; (-) strand; PAM type: NRG; PAM sequence: TAG
cccggctaattttgtatttt

SEQ ID NO: 67670 - DNA, 20 bp, Artificial Sequence
  Description of Artificial Sequence: Synthetic oligonucleotide
  Target: ATXN1; (-) strand; PAM type: NRG; PAM sequence: CGG
caggtgcatgccaccatgcc

SEQ ID NO: 67671 - DNA, 20 bp, Artificial Sequence
  Description of Artificial Sequence: Synthetic oligonucleotide
  Target: ATXN1; (-) strand; PAM type: NRG; PAM sequence: AGG
tcccaaatagctgggattac

SEQ ID NO: 67672 - DNA, 20 bp, Artificial Sequence
  Description of Artificial Sequence: Synthetic oligonucleotide
  Target: ATXN1; (-) strand; PAM type: NRG; PAM sequence: CAG
ttcccaaatagctgggatta

SEQ ID NO: 67673 - DNA, 20 bp, Artificial Sequence
  Description of Artificial Sequence: Synthetic oligonucleotide
  Target: ATXN1; (-) strand; PAM type: NRG; PAM sequence: GGG
cctcagcttcccaaatagct

SEQ ID NO: 67674 - DNA, 20 bp, Artificial Sequence
  Description of Artificial Sequence: Synthetic oligonucleotide
  Target: ATXN1; (-) strand; PAM type: NRG; PAM sequence: TGG
gcctcagcttcccaaatagc

SEQ ID NO: 67675 - DNA, 20 bp, Artificial Sequence
  Description of Artificial Sequence: Synthetic oligonucleotide
  Target: ATXN1; (-) strand; PAM type: NRG; PAM sequence: TAG
tcctgcctcagcttcccaaa

SEQ ID NO: 67676 - DNA, 20 bp, Artificial Sequence
  Description of Artificial Sequence: Synthetic oligonucleotide
  Target: ATXN1; (-) strand; PAM type: NRG; PAM sequence: CAG
ttcaagcaattttcctgcct

SEQ ID NO: 67677 - DNA, 20 bp, Artificial Sequence
  Description of Artificial Sequence: Synthetic oligonucleotide
  Target: ATXN1; (-) strand; PAM type: NRG; PAM sequence: AAG
aacttctgcctcccgagttc

SEQ ID NO: 67678 - DNA, 20 bp, Artificial Sequence
  Description of Artificial Sequence: Synthetic oligonucleotide
  Target: ATXN1; (-) strand; PAM type: NRG; PAM sequence: GAG
cactgcaacttctgcctccc

SEQ ID NO: 67679 - DNA, 20 bp, Artificial Sequence
  Description of Artificial Sequence: Synthetic oligonucleotide
  Target: ATXN1; (-) strand; PAM type: NRG; PAM sequence: TGG
ggagtacagtggcatgatct

SEQ ID NO: 67680 - DNA, 20 bp, Artificial Sequence
  Description of Artificial Sequence: Synthetic oligonucleotide
  Target: ATXN1; (-) strand; PAM type: NRG; PAM sequence: TGG
ttgcccaggctggagtacag

SEQ ID NO: 67681 - DNA, 20 bp, Artificial Sequence
  Description of Artificial Sequence: Synthetic oligonucleotide
  Target: ATXN1; (-) strand; PAM type: NRG; PAM sequence: CAG
ttgttgcccaggctggagta

SEQ ID NO: 67682 - DNA, 20 bp, Artificial Sequence
  Description of Artificial Sequence: Synthetic oligonucleotide
  Target: ATXN1; (-) strand; PAM type: NRG; PAM sequence: GAG
tgctcttgttgcccaggctg

SEQ ID NO: 67683 - DNA, 20 bp, Artificial Sequence
  Description of Artificial Sequence: Synthetic oligonucleotide
  Target: ATXN1; (-) strand; PAM type: NRG; PAM sequence: TGG
tttgctcttgttgcccaggc

SEQ ID NO: 67684 - DNA, 20 bp, Artificial Sequence
  Description of Artificial Sequence: Synthetic oligonucleotide
  Target: ATXN1; (-) strand; PAM type: NRG; PAM sequence: AGG
ttgttttgctcttgttgccc

SEQ ID NO: 67685 - DNA, 20 bp, Artificial Sequence
  Description of Artificial Sequence: Synthetic oligonucleotide
  Target: ATXN1; (-) strand; PAM type: NRG; PAM sequence: CAG
tttgttttgctcttgttgcc

SEQ ID NO: 67686 - DNA, 20 bp, Artificial Sequence
  Description of Artificial Sequence: Synthetic oligonucleotide
  Target: ATXN1; (-) strand; PAM type: NRG; PAM sequence: TGG
cagtacaggtactcacattc

SEQ ID NO: 67687 - DNA, 20 bp, Artificial Sequence
  Description of Artificial Sequence: Synthetic oligonucleotide
  Target: ATXN1; (-) strand; PAM type: NRG; PAM sequence: AGG
ggaaaaagggaatacagtac

SEQ ID NO: 67688 - DNA, 20 bp, Artificial Sequence
  Description of Artificial Sequence: Synthetic oligonucleotide
  Target: ATXN1; (-) strand; PAM type: NRG; PAM sequence: CAG
aggaaaaagggaatacagta

SEQ ID NO: 67689 - DNA, 20 bp, Artificial Sequence
  Description of Artificial Sequence: Synthetic oligonucleotide
  Target: ATXN1; (-) strand; PAM type: NRG; PAM sequence: CAG
gggtgaggaaaaagggaata

SEQ ID NO: 67690 - DNA, 20 bp, Artificial Sequence
  Description of Artificial Sequence: Synthetic oligonucleotide
  Target: ATXN1; (-) strand; PAM type: NRG; PAM sequence: GGG
ttgtgaggggtgaggaaaaa

SEQ ID NO: 67691 - DNA, 20 bp, Artificial Sequence
  Description of Artificial Sequence: Synthetic oligonucleotide
  Target: ATXN1; (-) strand; PAM type: NRG; PAM sequence: AGG
cttgtgaggggtgaggaaaa

SEQ ID NO: 67692 - DNA, 20 bp, Artificial Sequence
  Description of Artificial Sequence: Synthetic oligonucleotide
  Target: ATXN1; (-) strand; PAM type: NRG; PAM sequence: AAG
acttgtgaggggtgaggaaa

SEQ ID NO: 67693 - DNA, 20 bp, Artificial Sequence
  Description of Artificial Sequence: Synthetic oligonucleotide
  Target: ATXN1; (-) strand; PAM type: NRG; PAM sequence: AGG
tcatttacttgtgaggggtg

SEQ ID NO: 67694 - DNA, 20 bp, Artificial Sequence
  Description of Artificial Sequence: Synthetic oligonucleotide
  Target: ATXN1; (-) strand; PAM type: NRG; PAM sequence: GAG
ctcatttacttgtgaggggt

SEQ ID NO: 67695 - DNA, 20 bp, Artificial Sequence
  Description of Artificial Sequence: Synthetic oligonucleotide
  Target: ATXN1; (-) strand; PAM type: NRG; PAM sequence: GGG
ttgtctcatttacttgtgag

SEQ ID NO: 67696 - DNA, 20 bp, Artificial Sequence
  Description of Artificial Sequence: Synthetic oligonucleotide
  Target: ATXN1; (-) strand; PAM type: NRG; PAM sequence: GGG
cttgtctcatttacttgtga

SEQ ID NO: 67697 - DNA, 20 bp, Artificial Sequence
  Description of Artificial Sequence: Synthetic oligonucleotide
  Target: ATXN1; (-) strand; PAM type: NRG; PAM sequence: AGG
acttgtctcatttacttgtg

SEQ ID NO: 67698 - DNA, 20 bp, Artificial Sequence
  Description of Artificial Sequence: Synthetic oligonucleotide
  Target: ATXN1; (-) strand; PAM type: NRG; PAM sequence: GAG
aacttgtctcatttacttgt

SEQ ID NO: 67699 - DNA, 20 bp, Artificial Sequence
  Description of Artificial Sequence: Synthetic oligonucleotide
  Target: ATXN1; (-) strand; PAM type: NRG; PAM sequence: TGG
cgtgggatttctggatcata

SEQ ID NO: 67700 - DNA, 20 bp, Artificial Sequence
  Description of Artificial Sequence: Synthetic oligonucleotide
  Target: ATXN1; (-) strand; PAM type: NRG; PAM sequence: TGG
atacccagtcgtgggatttc

SEQ ID NO: 67701 - DNA, 20 bp, Artificial Sequence
  Description of Artificial Sequence: Synthetic oligonucleotide
  Target: ATXN1; (-) strand; PAM type: NRG; PAM sequence: GGG
ttgagtatatacccagtcgt

SEQ ID NO: 67702 - DNA, 20 bp, Artificial Sequence
  Description of Artificial Sequence: Synthetic oligonucleotide
  Target: ATXN1; (-) strand; PAM type: NRG; PAM sequence: TGG
tttgagtatatacccagtcg

SEQ ID NO: 67703 - DNA, 20 bp, Artificial Sequence
  Description of Artificial Sequence: Synthetic oligonucleotide
  Target: ATXN1; (-) strand; PAM type: NRG; PAM sequence: CAG
ctttcttttgagtatatacc

SEQ ID NO: 67704 - DNA, 20 bp, Artificial Sequence
  Description of Artificial Sequence: Synthetic oligonucleotide
  Target: ATXN1; (-) strand; PAM type: NRG; PAM sequence: GAG
atactgatttcctttctttt

SEQ ID NO: 67705 - DNA, 20 bp, Artificial Sequence
  Description of Artificial Sequence: Synthetic oligonucleotide
  Target: ATXN1; (-) strand; PAM type: NRG; PAM sequence: CAG
tgtaacaaacagaggaagtg

SEQ ID NO: 67706 - DNA, 20 bp, Artificial Sequence
  Description of Artificial Sequence: Synthetic oligonucleotide
  Target: ATXN1; (-) strand; PAM type: NRG; PAM sequence: AAG
agtgctgtaacaaacagagg

SEQ ID NO: 67707 - DNA, 20 bp, Artificial Sequence
  Description of Artificial Sequence: Synthetic oligonucleotide
  Target: ATXN1; (-) strand; PAM type: NRG; PAM sequence: AGG
aacagtgctgtaacaaacag

SEQ ID NO: 67708 - DNA, 20 bp, Artificial Sequence
  Description of Artificial Sequence: Synthetic oligonucleotide
  Target: ATXN1; (-) strand; PAM type: NRG; PAM sequence: GAG
aaacagtgctgtaacaaaca

SEQ ID NO: 67709 - DNA, 20 bp, Artificial Sequence
  Description of Artificial Sequence: Synthetic oligonucleotide
  Target: ATXN1; (-) strand; PAM type: NRG; PAM sequence: CAG
gtaaacagtgctgtaacaaa

SEQ ID NO: 67710 - DNA, 20 bp, Artificial Sequence
  Description of Artificial Sequence: Synthetic oligonucleotide
  Target: ATXN1; (-) strand; PAM type: NRG; PAM sequence: CAG
caaatcttagctattgtaaa

SEQ ID NO: 67711 - DNA, 20 bp, Artificial Sequence
  Description of Artificial Sequence: Synthetic oligonucleotide
  Target: ATXN1; (-) strand; PAM type: NRG; PAM sequence: TAG
tttagattgcttccaaatct

SEQ ID NO: 67712 - DNA, 20 bp, Artificial Sequence
  Description of Artificial Sequence: Synthetic oligonucleotide
  Target: ATXN1; (-) strand; PAM type: NRG; PAM sequence: TAG
ttcatctgttggtagacatt

SEQ ID NO: 67713 - DNA, 20 bp, Artificial Sequence
  Description of Artificial Sequence: Synthetic oligonucleotide
  Target: ATXN1; (-) strand; PAM type: NRG; PAM sequence: TAG
tttatccattcatctgttgg

SEQ ID NO: 67714 - DNA, 20 bp, Artificial Sequence
  Description of Artificial Sequence: Synthetic oligonucleotide
  Target: ATXN1; (-) strand; PAM type: NRG; PAM sequence: TGG
ttctttatccattcatctgt

SEQ ID NO: 67715 - DNA, 20 bp, Artificial Sequence
  Description of Artificial Sequence: Synthetic oligonucleotide
  Target: ATXN1; (-) strand; PAM type: NRG; PAM sequence: TGG
ctggatctcattctttttta

SEQ ID NO: 67716 - DNA, 20 bp, Artificial Sequence
  Description of Artificial Sequence: Synthetic oligonucleotide
  Target: ATXN1; (-) strand; PAM type: NRG; PAM sequence: TGG
tccatgttgttgcaaatgac

SEQ ID NO: 67717 - DNA, 20 bp, Artificial Sequence
  Description of Artificial Sequence: Synthetic oligonucleotide
  Target: ATXN1; (-) strand; PAM type: NRG; PAM sequence: TGG
taagtttgtctttctgtgcc

SEQ ID NO: 67718 - DNA, 20 bp, Artificial Sequence
  Description of Artificial Sequence: Synthetic oligonucleotide
  Target: ATXN1; (-) strand; PAM type: NRG; PAM sequence: AAG
cagataagtgagaacatgct

SEQ ID NO: 67719 - DNA, 20 bp, Artificial Sequence
  Description of Artificial Sequence: Synthetic oligonucleotide
  Target: ATXN1; (-) strand; PAM type: NRG; PAM sequence: GAG
tttgaatcccacagataagt

SEQ ID NO: 67720 - DNA, 20 bp, Artificial Sequence
  Description of Artificial Sequence: Synthetic oligonucleotide
  Target: ATXN1; (-) strand; PAM type: NRG; PAM sequence: AAG
gatttttgaatcccacagat

SEQ ID NO: 67721 - DNA, 20 bp, Artificial Sequence
  Description of Artificial Sequence: Synthetic oligonucleotide
  Target: ATXN1; (-) strand; PAM type: NRG; PAM sequence: CAG
ggtttgatttttgaatccca

SEQ ID NO: 67722 - DNA, 20 bp, Artificial Sequence
  Description of Artificial Sequence: Synthetic oligonucleotide
  Target: ATXN1; (-) strand; PAM type: NRG; PAM sequence: AGG
tctgtgtccatgagttcagt

SEQ ID NO: 67723 - DNA, 20 bp, Artificial Sequence
  Description of Artificial Sequence: Synthetic oligonucleotide
  Target: ATXN1; (-) strand; PAM type: NRG; PAM sequence: TAG
ctctgtgtccatgagttcag

SEQ ID NO: 67724 - DNA, 20 bp, Artificial Sequence
  Description of Artificial Sequence: Synthetic oligonucleotide
  Target: ATXN1; (-) strand; PAM type: NRG; PAM sequence: CAG
actctctgtgtccatgagtt

SEQ ID NO: 67725 - DNA, 20 bp, Artificial Sequence
  Description of Artificial Sequence: Synthetic oligonucleotide
  Target: ATXN1; (-) strand; PAM type: NRG; PAM sequence: GAG
ctcctactctctgtgtccat

SEQ ID NO: 67726 - DNA, 20 bp, Artificial Sequence
  Description of Artificial Sequence: Synthetic oligonucleotide
  Target: ATXN1; (-) strand; PAM type: NRG; PAM sequence: TAG
ctacccttcccagcctttgg

SEQ ID NO: 67727 - DNA, 20 bp, Artificial Sequence
  Description of Artificial Sequence: Synthetic oligonucleotide
  Target: ATXN1; (-) strand; PAM type: NRG; PAM sequence: TGG
ctactacccttcccagcctt

SEQ ID NO: 67728 - DNA, 20 bp, Artificial Sequence
  Description of Artificial Sequence: Synthetic oligonucleotide
  Target: ATXN1; (-) strand; PAM type: NRG; PAM sequence: CAG
cagccccctactacccttcc

SEQ ID NO: 67729 - DNA, 20 bp, Artificial Sequence
  Description of Artificial Sequence: Synthetic oligonucleotide
  Target: ATXN1; (-) strand; PAM type: NRG; PAM sequence: CAG
aaccatccccacctcccctc

SEQ ID NO: 67730 - DNA, 20 bp, Artificial Sequence
  Description of Artificial Sequence: Synthetic oligonucleotide
  Target: ATXN1; (-) strand; PAM type: NRG; PAM sequence: TAG
tctgttgtgctatcaaatag

SEQ ID NO: 67731 - DNA, 20 bp, Artificial Sequence
  Description of Artificial Sequence: Synthetic oligonucleotide
  Target: ATXN1; (-) strand; PAM type: NRG; PAM sequence: TAG
cactctgttgtgctatcaaa

SEQ ID NO: 67732 - DNA, 20 bp, Artificial Sequence
  Description of Artificial Sequence: Synthetic oligonucleotide
  Target: ATXN1; (-) strand; PAM type: NRG; PAM sequence: TAG
tgtacagttattattgacta

SEQ ID NO: 67733 - DNA, 20 bp, Artificial Sequence
  Description of Artificial Sequence: Synthetic oligonucleotide
  Target: ATXN1; (-) strand; PAM type: NRG; PAM sequence: CAG
actctttattttaaaatgta

SEQ ID NO: 67734 - DNA, 20 bp, Artificial Sequence
  Description of Artificial Sequence: Synthetic oligonucleotide
  Target: ATXN1; (-) strand; PAM type: NRG; PAM sequence: CAG
atccattacaacaaacactc

SEQ ID NO: 67735 - DNA, 20 bp, Artificial Sequence
  Description of Artificial Sequence: Synthetic oligonucleotide
  Target: ATXN1; (-) strand; PAM type: NRG; PAM sequence: AAG
aatggggtatccatccactc

SEQ ID NO: 67736 - DNA, 20 bp, Artificial Sequence
  Description of Artificial Sequence: Synthetic oligonucleotide
  Target: ATXN1; (-) strand; PAM type: NRG; PAM sequence: GGG
taaacacatcatgaagaatg

SEQ ID NO: 67737 - DNA, 20 bp, Artificial Sequence
  Description of Artificial Sequence: Synthetic oligonucleotide
  Target: ATXN1; (-) strand; PAM type: NRG; PAM sequence: GGG
ataaacacatcatgaagaat

SEQ ID NO: 67738 - DNA, 20 bp, Artificial Sequence
  Description of Artificial Sequence: Synthetic oligonucleotide
  Target: ATXN1; (-) strand; PAM type: NRG; PAM sequence: TGG
aataaacacatcatgaagaa

SEQ ID NO: 67739 - DNA, 20 bp, Artificial Sequence
  Description of Artificial Sequence: Synthetic oligonucleotide
  Target: ATXN1; (-) strand; PAM type: NRG; PAM sequence: AAG
tgtaaaataaacacatcatg

SEQ ID NO: 67740 - DNA, 20 bp, Artificial Sequence
  Description of Artificial Sequence: Synthetic oligonucleotide
  Target: ATXN1; (-) strand; PAM type: NRG; PAM sequence: CAG
gtacatgagatgttttgata

SEQ ID NO: 67741 - DNA, 20 bp, Artificial Sequence
  Description of Artificial Sequence: Synthetic oligonucleotide
  Target: ATXN1; (-) strand; PAM type: NRG; PAM sequence: GAG
tgtatatgtatggggtacat

SEQ ID NO: 67742 - DNA, 20 bp, Artificial Sequence
  Description of Artificial Sequence: Synthetic oligonucleotide
  Target: ATXN1; (-) strand; PAM type: NRG; PAM sequence: GGG
cataggtgtgtatatgtatg

SEQ ID NO: 67743 - DNA, 20 bp, Artificial Sequence
  Description of Artificial Sequence: Synthetic oligonucleotide
  Target: ATXN1; (-) strand; PAM type: NRG; PAM sequence: GGG
acataggtgtgtatatgtat

SEQ ID NO: 67744 - DNA, 20 bp, Artificial Sequence
  Description of Artificial Sequence: Synthetic oligonucleotide
  Target: ATXN1; (-) strand; PAM type: NRG; PAM sequence: TGG
tacataggtgtgtatatgta

SEQ ID NO: 67745 - DNA, 20 bp, Artificial Sequence
  Description of Artificial Sequence: Synthetic oligonucleotide
  Target: ATXN1; (-) strand; PAM type: NRG; PAM sequence: AGG
taatttttttgtgggtacat

SEQ ID NO: 67746 - DNA, 20 bp, Artificial Sequence
  Description of Artificial Sequence: Synthetic oligonucleotide
  Target: ATXN1; (-) strand; PAM type: NRG; PAM sequence: TAG
ttaatttttttgtgggtaca

SEQ ID NO: 67747 - DNA, 20 bp, Artificial Sequence
  Description of Artificial Sequence: Synthetic oligonucleotide
  Target: ATXN1; (-) strand; PAM type: NRG; PAM sequence: GGG
ttaatttttaatttttttgt

SEQ ID NO: 67748 - DNA, 20 bp, Artificial Sequence
  Description of Artificial Sequence: Synthetic oligonucleotide
  Target: ATXN1; (-) strand; PAM type: NRG; PAM sequence: TGG
tttaatttttaatttttttg

SEQ ID NO: 67749 - DNA, 20 bp, Artificial Sequence
  Description of Artificial Sequence: Synthetic oligonucleotide
  Target: ATXN1; (-) strand; PAM type: NRG; PAM sequence: TAG
atccactttttttgactgca

SEQ ID NO: 67750 - DNA, 20 bp, Artificial Sequence
  Description of Artificial Sequence: Synthetic oligonucleotide
  Target: ATXN1; (-) strand; PAM type: NRG; PAM sequence: CAG
tctaattattatacagtgaa

SEQ ID NO: 67751 - DNA, 20 bp, Artificial Sequence
  Description of Artificial Sequence: Synthetic oligonucleotide
  Target: ATXN1; (-) strand; PAM type: NRG; PAM sequence: CAG
ctatttatctaattattata

SEQ ID NO: 67752 - DNA, 20 bp, Artificial Sequence
  Description of Artificial Sequence: Synthetic oligonucleotide
  Target: ATXN1; (-) strand; PAM type: NRG; PAM sequence: GGG
tctgtggatttgtattactt

SEQ ID NO: 67753 - DNA, 20 bp, Artificial Sequence
  Description of Artificial Sequence: Synthetic oligonucleotide
  Target: ATXN1; (-) strand; PAM type: NRG; PAM sequence: TGG
ttctgtggatttgtattact

SEQ ID NO: 67754 - DNA, 20 bp, Artificial Sequence
  Description of Artificial Sequence: Synthetic oligonucleotide
  Target: ATXN1; (-) strand; PAM type: NRG; PAM sequence: TGG
gattattagtgggacttctg

SEQ ID NO: 67755 - DNA, 20 bp, Artificial Sequence
  Description of Artificial Sequence: Synthetic oligonucleotide
  Target: ATXN1; (-) strand; PAM type: NRG; PAM sequence: GGG
tgttaatagtgattattagt

SEQ ID NO: 67756 - DNA, 20 bp, Artificial Sequence
  Description of Artificial Sequence: Synthetic oligonucleotide
  Target: ATXN1; (-) strand; PAM type: NRG; PAM sequence: TGG
ctgttaatagtgattattag

SEQ ID NO: 67757 - DNA, 20 bp, Artificial Sequence
  Description of Artificial Sequence: Synthetic oligonucleotide
  Target: ATXN1; (-) strand; PAM type: NRG; PAM sequence: TAG
agactgttaatagtgattat

SEQ ID NO: 67758 - DNA, 20 bp, Artificial Sequence
  Description of Artificial Sequence: Synthetic oligonucleotide
  Target: ATXN1; (-) strand; PAM type: NRG; PAM sequence: TAG
tcatataaccagactgttaa

SEQ ID NO: 67759 - DNA, 20 bp, Artificial Sequence
  Description of Artificial Sequence: Synthetic oligonucleotide
  Target: ATXN1; (-) strand; PAM type: NRG; PAM sequence: CAG
agagtctggggtcatataac

SEQ ID NO: 67760 - DNA, 20 bp, Artificial Sequence
  Description of Artificial Sequence: Synthetic oligonucleotide
  Target: ATXN1; (-) strand; PAM type: NRG; PAM sequence: GGG
tgggcataggagagagtctg

SEQ ID NO: 67761 - DNA, 20 bp, Artificial Sequence
  Description of Artificial Sequence: Synthetic oligonucleotide
  Target: ATXN1; (-) strand; PAM type: NRG; PAM sequence: GGG
ttgggcataggagagagtct

SEQ ID NO: 67762 - DNA, 20 bp, Artificial Sequence
  Description of Artificial Sequence: Synthetic oligonucleotide
  Target: ATXN1; (-) strand; PAM type: NRG; PAM sequence: TGG
cttgggcataggagagagtc

SEQ ID NO: 67763 - DNA, 20 bp, Artificial Sequence
  Description of Artificial Sequence: Synthetic oligonucleotide
  Target: ATXN1; (-) strand; PAM type: NRG; PAM sequence: GAG
gtatacttgggcataggaga

SEQ ID NO: 67764 - DNA, 20 bp, Artificial Sequence
  Description of Artificial Sequence: Synthetic oligonucleotide
  Target: ATXN1; (-) strand; PAM type: NRG; PAM sequence: GAG
ctgtatacttgggcatagga

SEQ ID NO: 67765 - DNA, 20 bp, Artificial Sequence
  Description of Artificial Sequence: Synthetic oligonucleotide
  Target: ATXN1; (-) strand; PAM type: NRG; PAM sequence: GAG
ctctgtatacttgggcatag

SEQ ID NO: 67766 - DNA, 20 bp, Artificial Sequence
  Description of Artificial Sequence: Synthetic oligonucleotide
  Target: ATXN1; (-) strand; PAM type: NRG; PAM sequence: AGG
tactctgtatacttgggcat

SEQ ID NO: 67767 - DNA, 20 bp, Artificial Sequence
  Description of Artificial Sequence: Synthetic oligonucleotide
  Target: ATXN1; (-) strand; PAM type: NRG; PAM sequence: TAG
atactctgtatacttgggca

SEQ ID NO: 67768 - DNA, 20 bp, Artificial Sequence
  Description of Artificial Sequence: Synthetic oligonucleotide
  Target: ATXN1; (-) strand; PAM type: NRG; PAM sequence: GGG
acaatatactctgtatactt

SEQ ID NO: 67769 - DNA, 20 bp, Artificial Sequence
  Description of Artificial Sequence: Synthetic oligonucleotide
  Target: ATXN1; (-) strand; PAM type: NRG; PAM sequence: TGG
tacaatatactctgtatact

SEQ ID NO: 67770 - DNA, 20 bp, Artificial Sequence
  Description of Artificial Sequence: Synthetic oligonucleotide
  Target: ATXN1; (-) strand; PAM type: NRG; PAM sequence: TAG
tatatatatatatatatata

SEQ ID NO: 67771 - DNA, 20 bp, Artificial Sequence
  Description of Artificial Sequence: Synthetic oligonucleotide
  Target: ATXN1; (-) strand; PAM type: NRG; PAM sequence: TAG
ctatcatagtacattataaa

SEQ ID NO: 67772 - DNA, 20 bp, Artificial Sequence
  Description of Artificial Sequence: Synthetic oligonucleotide
  Target: ATXN1; (-) strand; PAM type: NRG; PAM sequence: TAG
aaatactatgaatactatca

SEQ ID NO: 67773 - DNA, 20 bp, Artificial Sequence
  Description of Artificial Sequence: Synthetic oligonucleotide
  Target: ATXN1; (-) strand; PAM type: NRG; PAM sequence: CAG
aataagtaaaaaaaatgaga

SEQ ID NO: 67774 - DNA, 20 bp, Artificial Sequence
  Description of Artificial Sequence: Synthetic oligonucleotide
  Target: ATXN1; (-) strand; PAM type: NRG; PAM sequence: GAG
aattaataagtaaaaaaaat

SEQ ID NO: 67775 - DNA, 20 bp, Artificial Sequence
  Description of Artificial Sequence: Synthetic oligonucleotide
  Target: ATXN1; (-) strand; PAM type: NRG; PAM sequence: AAG
aggttttcaatataattaat

SEQ ID NO: 67776 - DNA, 20 bp, Artificial Sequence
  Description of Artificial Sequence: Synthetic oligonucleotide
  Target: ATXN1; (-) strand; PAM type: NRG; PAM sequence: AGG
acatctattgatgttaaagg

SEQ ID NO: 67777 - DNA, 20 bp, Artificial Sequence
  Description of Artificial Sequence: Synthetic oligonucleotide
  Target: ATXN1; (-) strand; PAM type: NRG; PAM sequence: GAG
tacatctattgatgttaaag

SEQ ID NO: 67778 - DNA, 20 bp, Artificial Sequence
  Description of Artificial Sequence: Synthetic oligonucleotide
  Target: ATXN1; (-) strand; PAM type: NRG; PAM sequence: AGG
gatacatctattgatgttaa

SEQ ID NO: 67779 - DNA, 20 bp, Artificial Sequence
  Description of Artificial Sequence: Synthetic oligonucleotide
  Target: ATXN1; (-) strand; PAM type: NRG; PAM sequence: AAG
tgatacatctattgatgtta

SEQ ID NO: 67780 - DNA, 20 bp, Artificial Sequence
  Description of Artificial Sequence: Synthetic oligonucleotide
  Target: ATXN1; (-) strand; PAM type: NRG; PAM sequence: CAG
ccttcaatgtaatactcttt

SEQ ID NO: 67781 - DNA, 20 bp, Artificial Sequence
  Description of Artificial Sequence: Synthetic oligonucleotide
  Target: ATXN1; (-) strand; PAM type: NRG; PAM sequence: TGG
ttcaacaaataaatatgtat

SEQ ID NO: 67782 - DNA, 20 bp, Artificial Sequence
  Description of Artificial Sequence: Synthetic oligonucleotide
  Target: ATXN1; (-) strand; PAM type: NRG; PAM sequence: TAG
ataaacttgggacactttgg

SEQ ID NO: 67783 - DNA, 20 bp, Artificial Sequence
  Description of Artificial Sequence: Synthetic oligonucleotide
  Target: ATXN1; (-) strand; PAM type: NRG; PAM sequence: TGG
cttataaacttgggacactt

SEQ ID NO: 67784 - DNA, 20 bp, Artificial Sequence
  Description of Artificial Sequence: Synthetic oligonucleotide
  Target: ATXN1; (-) strand; PAM type: NRG; PAM sequence: GGG
tagtcacttcttataaactt

SEQ ID NO: 67785 - DNA, 20 bp, Artificial Sequence
  Description of Artificial Sequence: Synthetic oligonucleotide
  Target: ATXN1; (-) strand; PAM type: NRG; PAM sequence: TGG
gtagtcacttcttataaact

SEQ ID NO: 67786 - DNA, 20 bp, Artificial Sequence
  Description of Artificial Sequence: Synthetic oligonucleotide
  Target: ATXN1; (-) strand; PAM type: NRG; PAM sequence: TAG
ccacatgctaccacaatatg

SEQ ID NO: 67787 - DNA, 20 bp, Artificial Sequence
  Description of Artificial Sequence: Synthetic oligonucleotide
  Target: ATXN1; (-) strand; PAM type: NRG; PAM sequence: AAG
cttgaaaaatgtagaagaaa

SEQ ID NO: 67788 - DNA, 20 bp, Artificial Sequence
  Description of Artificial Sequence: Synthetic oligonucleotide
  Target: ATXN1; (-) strand; PAM type: NRG; PAM sequence: AAG
ctcaatcttgaaaaatgtag

SEQ ID NO: 67789 - DNA, 20 bp, Artificial Sequence
  Description of Artificial Sequence: Synthetic oligonucleotide
  Target: ATXN1; (-) strand; PAM type: NRG; PAM sequence: TAG
tttctcaatcttgaaaaatg

SEQ ID NO: 67790 - DNA, 20 bp, Artificial Sequence
  Description of Artificial Sequence: Synthetic oligonucleotide
  Target: ATXN1; (-) strand; PAM type: NRG; PAM sequence: CAG
taaggctttttatatttatt

SEQ ID NO: 67791 - DNA, 20 bp, Artificial Sequence
  Description of Artificial Sequence: Synthetic oligonucleotide
  Target: ATXN1; (-) strand; PAM type: NRG; PAM sequence: AGG
aaaacaactttttgctgtta

SEQ ID NO: 67792 - DNA, 20 bp, Artificial Sequence
  Description of Artificial Sequence: Synthetic oligonucleotide
  Target: ATXN1; (-) strand; PAM type: NRG; PAM sequence: AAG
caaaacaactttttgctgtt

SEQ ID NO: 67793 - DNA, 20 bp, Artificial Sequence
  Description of Artificial Sequence: Synthetic oligonucleotide
  Target: ATXN1; (-) strand; PAM type: NRG; PAM sequence: TAG
attccctgtggtatatgtgt

SEQ ID NO: 67794 - DNA, 20 bp, Artificial Sequence
  Description of Artificial Sequence: Synthetic oligonucleotide
  Target: ATXN1; (-) strand; PAM type: NRG; PAM sequence: TGG
atgtgtgattctattccctg

SEQ ID NO: 67795 - DNA, 20 bp, Artificial Sequence
  Description of Artificial Sequence: Synthetic oligonucleotide
  Target: ATXN1; (-) strand; PAM type: NRG; PAM sequence: CGG
caggcgtgagccaccgcgtc

SEQ ID NO: 67796 - DNA, 20 bp, Artificial Sequence
  Description of Artificial Sequence: Synthetic oligonucleotide
  Target: ATXN1; (-) strand; PAM type: NRG; PAM sequence: GAG
agtgctgggattacaggcgt

SEQ ID NO: 67797 - DNA, 20 bp, Artificial Sequence
  Description of Artificial Sequence: Synthetic oligonucleotide
  Target: ATXN1; (-) strand; PAM type: NRG; PAM sequence: AGG
tcccaaagtgctgggattac

SEQ ID NO: 67798 - DNA, 20 bp, Artificial Sequence
  Description of Artificial Sequence: Synthetic oligonucleotide
  Target: ATXN1; (-) strand; PAM type: NRG; PAM sequence: CAG
ctcccaaagtgctgggatta

SEQ ID NO: 67799 - DNA, 20 bp, Artificial Sequence
  Description of Artificial Sequence: Synthetic oligonucleotide
  Target: ATXN1; (-) strand; PAM type: NRG; PAM sequence: GGG
ccttggcctcccaaagtgct

SEQ ID NO: 67800 - DNA, 20 bp, Artificial Sequence
  Description of Artificial Sequence: Synthetic oligonucleotide
  Target: ATXN1; (-) strand; PAM type: NRG; PAM sequence: TGG
gccttggcctcccaaagtgc

SEQ ID NO: 67801 - DNA, 20 bp, Artificial Sequence
  Description of Artificial Sequence: Synthetic oligonucleotide
  Target: ATXN1; (-) strand; PAM type: NRG; PAM sequence: AAG
ccacccgccttggcctccca

SEQ ID NO: 67802 - DNA, 20 bp, Artificial Sequence
  Description of Artificial Sequence: Synthetic oligonucleotide
  Target: ATXN1; (-) strand; PAM type: NRG; PAM sequence: TGG
ctcaggtaatccacccgcct

SEQ ID NO: 67803 - DNA, 20 bp, Artificial Sequence
  Description of Artificial Sequence: Synthetic oligonucleotide
  Target: ATXN1; (-) strand; PAM type: NRG; PAM sequence: AGG
ggtcttgacctcctgacctc

SEQ ID NO: 67804 - DNA, 20 bp, Artificial Sequence
  Description of Artificial Sequence: Synthetic oligonucleotide
  Target: ATXN1; (-) strand; PAM type: NRG; PAM sequence: CAG
tggtcttgacctcctgacct

SEQ ID NO: 67805 - DNA, 20 bp, Artificial Sequence
  Description of Artificial Sequence: Synthetic oligonucleotide
  Target: ATXN1; (-) strand; PAM type: NRG; PAM sequence: TGG
tttcaccattttggccaggc

SEQ ID NO: 67806 - DNA, 20 bp, Artificial Sequence
  Description of Artificial Sequence: Synthetic oligonucleotide
  Target: ATXN1; (-) strand; PAM type: NRG; PAM sequence: AGG
agggtttcaccattttggcc

SEQ ID NO: 67807 - DNA, 20 bp, Artificial Sequence
  Description of Artificial Sequence: Synthetic oligonucleotide
  Target: ATXN1; (-) strand; PAM type: NRG; PAM sequence: CAG
cagggtttcaccattttggc

SEQ ID NO: 67808 - DNA, 20 bp, Artificial Sequence
  Description of Artificial Sequence: Synthetic oligonucleotide
  Target: ATXN1; (-) strand; PAM type: NRG; PAM sequence: TGG
gagacagggtttcaccattt

SEQ ID NO: 67809 - DNA, 20 bp, Artificial Sequence
  Description of Artificial Sequence: Synthetic oligonucleotide
  Target: ATXN1; (-) strand; PAM type: NRG; PAM sequence: GGG
ttgtatttttagtagagaca

SEQ ID NO: 67810 - DNA, 20 bp, Artificial Sequence
  Description of Artificial Sequence: Synthetic oligonucleotide
  Target: ATXN1; (-) strand; PAM type: NRG; PAM sequence: AGG
tttgtatttttagtagagac

SEQ ID NO: 67811 - DNA, 20 bp, Artificial Sequence
  Description of Artificial Sequence: Synthetic oligonucleotide
  Target: ATXN1; (-) strand; PAM type: NRG; PAM sequence: CAG
ttttgtatttttagtagaga

SEQ ID NO: 67812 - DNA, 20 bp, Artificial Sequence
  Description of Artificial Sequence: Synthetic oligonucleotide
  Target: ATXN1; (-) strand; PAM type: NRG; PAM sequence: GAG
taatttttgtatttttagta

SEQ ID NO: 67813 - DNA, 20 bp, Artificial Sequence
  Description of Artificial Sequence: Synthetic oligonucleotide
  Target: ATXN1; (-) strand; PAM type: NRG; PAM sequence: TAG
gctaatttttgtatttttag

SEQ ID NO: 67814 - DNA, 20 bp, Artificial Sequence
  Description of Artificial Sequence: Synthetic oligonucleotide
  Target: ATXN1; (-) strand; PAM type: NRG; PAM sequence: TAG
ccagctaatttttgtatttt

SEQ ID NO: 67815 - DNA, 20 bp, Artificial Sequence
  Description of Artificial Sequence: Synthetic oligonucleotide
  Target: ATXN1; (-) strand; PAM type: NRG; PAM sequence: CAG
caggcacctgccaccaagcc

SEQ ID NO: 67816 - DNA, 20 bp, Artificial Sequence
  Description of Artificial Sequence: Synthetic oligonucleotide
  Target: ATXN1; (-) strand; PAM type: NRG; PAM sequence: AAG
gattacaggcacctgccacc

SEQ ID NO: 67817 - DNA, 20 bp, Artificial Sequence
  Description of Artificial Sequence: Synthetic oligonucleotide
  Target: ATXN1; (-) strand; PAM type: NRG; PAM sequence: AGG
tcccgagtagctgggattac

SEQ ID NO: 67818 - DNA, 20 bp, Artificial Sequence
  Description of Artificial Sequence: Synthetic oligonucleotide
  Target: ATXN1; (-) strand; PAM type: NRG; PAM sequence: CAG
ctcccgagtagctgggatta

SEQ ID NO: 67819 - DNA, 20 bp, Artificial Sequence
  Description of Artificial Sequence: Synthetic oligonucleotide
  Target: ATXN1; (-) strand; PAM type: NRG; PAM sequence: GGG
cctcagcctcccgagtagct

SEQ ID NO: 67820 - DNA, 20 bp, Artificial Sequence
  Description of Artificial Sequence: Synthetic oligonucleotide
  Target: ATXN1; (-) strand; PAM type: NRG; PAM sequence: TGG
gcctcagcctcccgagtagc

SEQ ID NO: 67821 - DNA, 20 bp, Artificial Sequence
  Description of Artificial Sequence: Synthetic oligonucleotide
  Target: ATXN1; (-) strand; PAM type: NRG; PAM sequence: TAG
tcctgcctcagcctcccgag

SEQ ID NO: 67822 - DNA, 20 bp, Artificial Sequence
  Description of Artificial Sequence: Synthetic oligonucleotide
  Target: ATXN1; (-) strand; PAM type: NRG; PAM sequence: GAG
tcctcctgcctcagcctccc

SEQ ID NO: 67823 - DNA, 20 bp, Artificial Sequence
  Description of Artificial Sequence: Synthetic oligonucleotide
  Target: ATXN1; (-) strand; PAM type: NRG; PAM sequence: CAG
ttcaagtgatcctcctgcct

SEQ ID NO: 67824 - DNA, 20 bp, Artificial Sequence
  Description of Artificial Sequence: Synthetic oligonucleotide
  Target: ATXN1; (-) strand; PAM type: NRG; PAM sequence: AAG
agcttccacctcccgggttc

SEQ ID NO: 67825 - DNA, 20 bp, Artificial Sequence
  Description of Artificial Sequence: Synthetic oligonucleotide
  Target: ATXN1; (-) strand; PAM type: NRG; PAM sequence: GGG
cactgcagcttccacctccc

SEQ ID NO: 67826 - DNA, 20 bp, Artificial Sequence
  Description of Artificial Sequence: Synthetic oligonucleotide
  Target: ATXN1; (-) strand; PAM type: NRG; PAM sequence: CGG
tcactgcagcttccacctcc

SEQ ID NO: 67827 - DNA, 20 bp, Artificial Sequence
  Description of Artificial Sequence: Synthetic oligonucleotide
  Target: ATXN1; (-) strand; PAM type: NRG; PAM sequence: CAG
ggtgcattctcgactcactg

SEQ ID NO: 67828 - DNA, 20 bp, Artificial Sequence
  Description of Artificial Sequence: Synthetic oligonucleotide
  Target: ATXN1; (-) strand; PAM type: NRG; PAM sequence: TGG
ttgcccaggctggagtgcag

SEQ ID NO: 67829 - DNA, 20 bp, Artificial Sequence
  Description of Artificial Sequence: Synthetic oligonucleotide
  Target: ATXN1; (-) strand; PAM type: NRG; PAM sequence: CAG
ttgttgcccaggctggagtg

SEQ ID NO: 67830 - DNA, 20 bp, Artificial Sequence
  Description of Artificial Sequence: Synthetic oligonucleotide
  Target: ATXN1; (-) strand; PAM type: NRG; PAM sequence: GAG
tgctcttgttgcccaggctg

SEQ ID NO: 67831 - DNA, 20 bp, Artificial Sequence
  Description of Artificial Sequence: Synthetic oligonucleotide
  Target: ATXN1; (-) strand; PAM type: NRG; PAM sequence: TGG
tttgctcttgttgcccaggc

SEQ ID NO: 67832 - DNA, 20 bp, Artificial Sequence
  Description of Artificial Sequence: Synthetic oligonucleotide
  Target: ATXN1; (-) strand; PAM type: NRG; PAM sequence: AGG
aagttttgctcttgttgccc

SEQ ID NO: 67833 - DNA, 20 bp, Artificial Sequence
  Description of Artificial Sequence: Synthetic oligonucleotide
  Target: ATXN1; (-) strand; PAM type: NRG; PAM sequence: CAG
gaagttttgctcttgttgcc

SEQ ID NO: 67834 - DNA, 20 bp, Artificial Sequence
  Description of Artificial Sequence: Synthetic oligonucleotide
  Target: ATXN1; (-) strand; PAM type: NRG; PAM sequence: AAG
ttttttttttttttgagatg

SEQ ID NO: 67835 - DNA, 20 bp, Artificial Sequence
  Description of Artificial Sequence: Synthetic oligonucleotide
  Target: ATXN1; (-) strand; PAM type: NRG; PAM sequence: GAG
attctttttttttttttttt

SEQ ID NO: 67836 - DNA, 20 bp, Artificial Sequence
  Description of Artificial Sequence: Synthetic oligonucleotide
  Target: ATXN1; (-) strand; PAM type: NRG; PAM sequence: GAG
tatcccgagtctttaaaatt

SEQ ID NO: 67837 - DNA, 20 bp, Artificial Sequence
  Description of Artificial Sequence: Synthetic oligonucleotide
  Target: ATXN1; (-) strand; PAM type: NRG; PAM sequence: GAG
ccctattcacccattatccc

SEQ ID NO: 67838 - DNA, 20 bp, Artificial Sequence
  Description of Artificial Sequence: Synthetic oligonucleotide
  Target: ATXN1; (-) strand; PAM type: NRG; PAM sequence: TAG
tagcgatttaatacttgatc

SEQ ID NO: 67839 - DNA, 20 bp, Artificial Sequence
  Description of Artificial Sequence: Synthetic oligonucleotide
  Target: ATXN1; (-) strand; PAM type: NRG; PAM sequence: TAG
catttgcttgacttcagact

SEQ ID NO: 67840 - DNA, 20 bp, Artificial Sequence
  Description of Artificial Sequence: Synthetic oligonucleotide
  Target: ATXN1; (-) strand; PAM type: NRG; PAM sequence: CAG
caaggacatttgcttgactt

SEQ ID NO: 67841 - DNA, 20 bp, Artificial Sequence
  Description of Artificial Sequence: Synthetic oligonucleotide
  Target: ATXN1; (-) strand; PAM type: NRG; PAM sequence: AGG
accatgattgggctgaaaca

SEQ ID NO: 67842 - DNA, 20 bp, Artificial Sequence
  Description of Artificial Sequence: Synthetic oligonucleotide
  Target: ATXN1; (-) strand; PAM type: NRG; PAM sequence: AAG
taccatgattgggctgaaac

SEQ ID NO: 67843 - DNA, 20 bp, Artificial Sequence
  Description of Artificial Sequence: Synthetic oligonucleotide
  Target: ATXN1; (-) strand; PAM type: NRG; PAM sequence: GGG
taagtaactctaccatgatt

SEQ ID NO: 67844 - DNA, 20 bp, Artificial Sequence
  Description of Artificial Sequence: Synthetic oligonucleotide
  Target: ATXN1; (-) strand; PAM type: NRG; PAM sequence: TGG
ttaagtaactctaccatgat

SEQ ID NO: 67845 - DNA, 20 bp, Artificial Sequence
  Description of Artificial Sequence: Synthetic oligonucleotide
  Target: ATXN1; (-) strand; PAM type: NRG; PAM sequence: AAG
taactttcctctgtatcatt

SEQ ID NO: 67846 - DNA, 20 bp, Artificial Sequence
  Description of Artificial Sequence: Synthetic oligonucleotide
  Target: ATXN1; (-) strand; PAM type: NRG; PAM sequence: CAG
tcaagatcatacagtttttt

SEQ ID NO: 67847 - DNA, 20 bp, Artificial Sequence
  Description of Artificial Sequence: Synthetic oligonucleotide
  Target: ATXN1; (-) strand; PAM type: NRG; PAM sequence: CAG
taggatcactcaagatcata

SEQ ID NO: 67848 - DNA, 20 bp, Artificial Sequence
  Description of Artificial Sequence: Synthetic oligonucleotide
  Target: ATXN1; (-) strand; PAM type: NRG; PAM sequence: AAG
tttaatttctaggatcactc

SEQ ID NO: 67849 - DNA, 20 bp, Artificial Sequence
  Description of Artificial Sequence: Synthetic oligonucleotide
  Target: ATXN1; (-) strand; PAM type: NRG; PAM sequence: AGG
caaatagtgatttaatttct

SEQ ID NO: 67850 - DNA, 20 bp, Artificial Sequence
  Description of Artificial Sequence: Synthetic oligonucleotide
  Target: ATXN1; (-) strand; PAM type: NRG; PAM sequence: TAG
tcaaatagtgatttaatttc

SEQ ID NO: 67851 - DNA, 20 bp, Artificial Sequence
  Description of Artificial Sequence: Synthetic oligonucleotide
  Target: ATXN1; (-) strand; PAM type: NRG; PAM sequence: TAG
tttaggttttcaccttcaaa

SEQ ID NO: 67852 - DNA, 20 bp, Artificial Sequence
  Description of Artificial Sequence: Synthetic oligonucleotide
  Target: ATXN1; (-) strand; PAM type: NRG; PAM sequence: AGG
gatttttttttttttttttt

SEQ ID NO: 67853 - DNA, 20 bp, Artificial Sequence
  Description of Artificial Sequence: Synthetic oligonucleotide
  Target: ATXN1; (-) strand; PAM type: NRG; PAM sequence: TAG
tgattttttttttttttttt

SEQ ID NO: 67854 - DNA, 20 bp, Artificial Sequence
  Description of Artificial Sequence: Synthetic oligonucleotide
  Target: ATXN1; (-) strand; PAM type: NRG; PAM sequence: AAG
accttctaaagaaatatggt

SEQ ID NO: 67855 - DNA, 20 bp, Artificial Sequence
  Description of Artificial Sequence: Synthetic oligonucleotide
  Target: ATXN1; (-) strand; PAM type: NRG; PAM sequence: TGG
tgataccttctaaagaaata

SEQ ID NO: 67856 - DNA, 20 bp, Artificial Sequence
  Description of Artificial Sequence: Synthetic oligonucleotide
  Target: ATXN1; (-) strand; PAM type: NRG; PAM sequence: AAG
ttaatttttgataccttcta

SEQ ID NO: 67857 - DNA, 20 bp, Artificial Sequence
  Description of Artificial Sequence: Synthetic oligonucleotide
  Target: ATXN1; (-) strand; PAM type: NRG; PAM sequence: TAG
ctttgagaaggaacttagat

SEQ ID NO: 67858 - DNA, 20 bp, Artificial Sequence
  Description of Artificial Sequence: Synthetic oligonucleotide
  Target: ATXN1; (-) strand; PAM type: NRG; PAM sequence: TAG
attctctttgagaaggaact

SEQ ID NO: 67859 - DNA, 20 bp, Artificial Sequence
  Description of Artificial Sequence: Synthetic oligonucleotide
  Target: ATXN1; (-) strand; PAM type: NRG; PAM sequence: AGG
accaaccattctctttgaga

SEQ ID NO: 67860 - DNA, 20 bp, Artificial Sequence
  Description of Artificial Sequence: Synthetic oligonucleotide
  Target: ATXN1; (-) strand; PAM type: NRG; PAM sequence: AAG
aaccaaccattctctttgag

SEQ ID NO: 67861 - DNA, 20 bp, Artificial Sequence
  Description of Artificial Sequence: Synthetic oligonucleotide
  Target: ATXN1; (-) strand; PAM type: NRG; PAM sequence: GAG
ccaaaccaaccattctcttt

SEQ ID NO: 67862 - DNA, 20 bp, Artificial Sequence
  Description of Artificial Sequence: Synthetic oligonucleotide
  Target: ATXN1; (-) strand; PAM type: NRG; PAM sequence: CAG
aaggatgtgtcatgtgactt

SEQ ID NO: 67863 - DNA, 20 bp, Artificial Sequence
  Description of Artificial Sequence: Synthetic oligonucleotide
  Target: ATXN1; (-) strand; PAM type: NRG; PAM sequence: AGG
ggcacccttaattgagggca

SEQ ID NO: 67864 - DNA, 20 bp, Artificial Sequence
  Description of Artificial Sequence: Synthetic oligonucleotide
  Target: ATXN1; (-) strand; PAM type: NRG; PAM sequence: AAG
tggcacccttaattgagggc

SEQ ID NO: 67865 - DNA, 20 bp, Artificial Sequence
  Description of Artificial Sequence: Synthetic oligonucleotide
  Target: ATXN1; (-) strand; PAM type: NRG; PAM sequence: GGG
ggtatggcacccttaattga

SEQ ID NO: 67866 - DNA, 20 bp, Artificial Sequence
  Description of Artificial Sequence: Synthetic oligonucleotide
  Target: ATXN1; (-) strand; PAM type: NRG; PAM sequence: AGG
aggtatggcacccttaattg

SEQ ID NO: 67867 - DNA, 20 bp, Artificial Sequence
  Description of Artificial Sequence: Synthetic oligonucleotide
  Target: ATXN1; (-) strand; PAM type: NRG; PAM sequence: GAG
gaggtatggcacccttaatt

SEQ ID NO: 67868 - DNA, 20 bp, Artificial Sequence
  Description of Artificial Sequence: Synthetic oligonucleotide
  Target: ATXN1; (-) strand; PAM type: NRG; PAM sequence: TGG
actagtcgcggggggaggta

SEQ ID NO: 67869 - DNA, 20 bp, Artificial Sequence
  Description of Artificial Sequence: Synthetic oligonucleotide
  Target: ATXN1; (-) strand; PAM type: NRG; PAM sequence: AGG
atgtcactagtcgcgggggg

SEQ ID NO: 67870 - DNA, 20 bp, Artificial Sequence
  Description of Artificial Sequence: Synthetic oligonucleotide
  Target: ATXN1; (-) strand; PAM type: NRG; PAM sequence: GAG
aatgtcactagtcgcggggg

SEQ ID NO: 67871 - DNA, 20 bp, Artificial Sequence
  Description of Artificial Sequence: Synthetic oligonucleotide
  Target: ATXN1; (-) strand; PAM type: NRG; PAM sequence: GGG
ggaatgtcactagtcgcggg

SEQ ID NO: 67872 - DNA, 20 bp, Artificial Sequence
  Description of Artificial Sequence: Synthetic oligonucleotide
  Target: ATXN1; (-) strand; PAM type: NRG; PAM sequence: GGG
tggaatgtcactagtcgcgg

SEQ ID NO: 67873 - DNA, 20 bp, Artificial Sequence
  Description of Artificial Sequence: Synthetic oligonucleotide
  Target: ATXN1; (-) strand; PAM type: NRG; PAM sequence: GGG
ctggaatgtcactagtcgcg

SEQ ID NO: 67874 - DNA, 20 bp, Artificial Sequence
  Description of Artificial Sequence: Synthetic oligonucleotide
  Target: ATXN1; (-) strand; PAM type: NRG; PAM sequence: GGG
cctggaatgtcactagtcgc

SEQ ID NO: 67875 - DNA, 20 bp, Artificial Sequence
  Description of Artificial Sequence: Synthetic oligonucleotide
  Target: ATXN1; (-) strand; PAM type: NRG; PAM sequence: CGG
tcctggaatgtcactagtcg

SEQ ID NO: 67876 - DNA, 20 bp, Artificial Sequence
  Description of Artificial Sequence: Synthetic oligonucleotide
  Target: ATXN1; (-) strand; PAM type: NRG; PAM sequence: TAG
agattttcctggaatgtcac

SEQ ID NO: 67877 - DNA, 20 bp, Artificial Sequence
  Description of Artificial Sequence: Synthetic oligonucleotide
  Target: ATXN1; (-) strand; PAM type: NRG; PAM sequence: TGG
cctcaaaagtgagattttcc

SEQ ID NO: 67878 - DNA, 20 bp, Artificial Sequence
  Description of Artificial Sequence: Synthetic oligonucleotide
  Target: ATXN1; (-) strand; PAM type: NRG; PAM sequence: GAG
cccagcctcccctcaaaagt

SEQ ID NO: 67879 - DNA, 20 bp, Artificial Sequence
  Description of Artificial Sequence: Synthetic oligonucleotide
  Target: ATXN1; (-) strand; PAM type: NRG; PAM sequence: AAG
cttccccagcctcccctcaa

SEQ ID NO: 67880 - DNA, 20 bp, Artificial Sequence
  Description of Artificial Sequence: Synthetic oligonucleotide
  Target: ATXN1; (-) strand; PAM type: NRG; PAM sequence: CAG
cggggatatgctcacttccc

SEQ ID NO: 67881 - DNA, 20 bp, Artificial Sequence
  Description of Artificial Sequence: Synthetic oligonucleotide
  Target: ATXN1; (-) strand; PAM type: NRG; PAM sequence: GGG
cacacactctgcccattgcg

SEQ ID NO: 67882 - DNA, 20 bp, Artificial Sequence
  Description of Artificial Sequence: Synthetic oligonucleotide
  Target: ATXN1; (-) strand; PAM type: NRG; PAM sequence: GGG
ccacacactctgcccattgc

SEQ ID NO: 67883 - DNA, 20 bp, Artificial Sequence
  Description of Artificial Sequence: Synthetic oligonucleotide
  Target: ATXN1; (-) strand; PAM type: NRG; PAM sequence: CGG
tccacacactctgcccattg

SEQ ID NO: 67884 - DNA, 20 bp, Artificial Sequence
  Description of Artificial Sequence: Synthetic oligonucleotide
  Target: ATXN1; (-) strand; PAM type: NRG; PAM sequence: GAG
cattcgtgtctccatggctg

SEQ ID NO: 67885 - DNA, 20 bp, Artificial Sequence
  Description of Artificial Sequence: Synthetic oligonucleotide
  Target: ATXN1; (-) strand; PAM type: NRG; PAM sequence: TGG
tgcattcgtgtctccatggc

SEQ ID NO: 67886 - DNA, 20 bp, Artificial Sequence
  Description of Artificial Sequence: Synthetic oligonucleotide
  Target: ATXN1; (-) strand; PAM type: NRG; PAM sequence: TGG
taactgcattcgtgtctcca

SEQ ID NO: 67887 - DNA, 20 bp, Artificial Sequence
  Description of Artificial Sequence: Synthetic oligonucleotide
  Target: ATXN1; (-) strand; PAM type: NRG; PAM sequence: AGG
cagtgttggatacttagaaa

SEQ ID NO: 67888 - DNA, 20 bp, Artificial Sequence
  Description of Artificial Sequence: Synthetic oligonucleotide
  Target: ATXN1; (-) strand; PAM type: NRG; PAM sequence: AAG
gcagtgttggatacttagaa

SEQ ID NO: 67889 - DNA, 20 bp, Artificial Sequence
  Description of Artificial Sequence: Synthetic oligonucleotide
  Target: ATXN1; (-) strand; PAM type: NRG; PAM sequence: TAG
atggagcagtgttggatact

SEQ ID NO: 67890 - DNA, 20 bp, Artificial Sequence
  Description of Artificial Sequence: Synthetic oligonucleotide
  Target: ATXN1; (-) strand; PAM type: NRG; PAM sequence: TGG
cctgattcatggagcagtgt

SEQ ID NO: 67891 - DNA, 20 bp, Artificial Sequence
  Description of Artificial Sequence: Synthetic oligonucleotide
  Target: ATXN1; (-) strand; PAM type: NRG; PAM sequence: CAG
ctcctgcctgattcatggag

SEQ ID NO: 67892 - DNA, 20 bp, Artificial Sequence
  Description of Artificial Sequence: Synthetic oligonucleotide
  Target: ATXN1; (-) strand; PAM type: NRG; PAM sequence: GAG
catctcctgcctgattcatg

SEQ ID NO: 67893 - DNA, 20 bp, Artificial Sequence
  Description of Artificial Sequence: Synthetic oligonucleotide
  Target: ATXN1; (-) strand; PAM type: NRG; PAM sequence: TGG
cccatctcctgcctgattca

SEQ ID NO: 67894 - DNA, 20 bp, Artificial Sequence
  Description of Artificial Sequence: Synthetic oligonucleotide
  Target: ATXN1; (-) strand; PAM type: NRG; PAM sequence: CAG
ctccctctgctgctctctgc

SEQ ID NO: 67895 - DNA, 20 bp, Artificial Sequence
  Description of Artificial Sequence: Synthetic oligonucleotide
  Target: ATXN1; (-) strand; PAM type: NRG; PAM sequence: TGG
cagccagtatctatctcctt

SEQ ID NO: 67896 - DNA, 20 bp, Artificial Sequence
  Description of Artificial Sequence: Synthetic oligonucleotide
  Target: ATXN1; (-) strand; PAM type: NRG; PAM sequence: CAG
tctcgctgggattttgcagc

SEQ ID NO: 67897 - DNA, 20 bp, Artificial Sequence
  Description of Artificial Sequence: Synthetic oligonucleotide
  Target: ATXN1; (-) strand; PAM type: NRG; PAM sequence: CAG
ttgatctcgctgggattttg

SEQ ID NO: 67898 - DNA, 20 bp, Artificial Sequence
  Description of Artificial Sequence: Synthetic oligonucleotide
  Target: ATXN1; (-) strand; PAM type: NRG; PAM sequence: GGG
tctccgcctttgatctcgct

SEQ ID NO: 67899 - DNA, 20 bp, Artificial Sequence
  Description of Artificial Sequence: Synthetic oligonucleotide
  Target: ATXN1; (-) strand; PAM type: NRG; PAM sequence: TGG
atctccgcctttgatctcgc

SEQ ID NO: 67900 - DNA, 20 bp, Artificial Sequence
  Description of Artificial Sequence: Synthetic oligonucleotide
  Target: ATXN1; (-) strand; PAM type: NRG; PAM sequence: CAG
tggaccttggtttcacagat

SEQ ID NO: 67901 - DNA, 20 bp, Artificial Sequence
  Description of Artificial Sequence: Synthetic oligonucleotide
  Target: ATXN1; (-) strand; PAM type: NRG; PAM sequence: CAG
ggttatggaccttggtttca

SEQ ID NO: 67902 - DNA, 20 bp, Artificial Sequence
  Description of Artificial Sequence: Synthetic oligonucleotide
  Target: ATXN1; (-) strand; PAM type: NRG; PAM sequence: TGG
ctgccattggttatggacct

SEQ ID NO: 67903 - DNA, 20 bp, Artificial Sequence
  Description of Artificial Sequence: Synthetic oligonucleotide
  Target: ATXN1; (-) strand; PAM type: NRG; PAM sequence: TGG
ctgtcacctgccattggtta

SEQ ID NO: 67904 - DNA, 20 bp, Artificial Sequence
  Description of Artificial Sequence: Synthetic oligonucleotide
  Target: ATXN1; (-) strand; PAM type: NRG; PAM sequence: TGG
aagggactgtcacctgccat

SEQ ID NO: 67905 - DNA, 20 bp, Artificial Sequence
  Description of Artificial Sequence: Synthetic oligonucleotide
  Target: ATXN1; (-) strand; PAM type: NRG; PAM sequence: GGG
ttagggagcatttgttgtaa

SEQ ID NO: 67906 - DNA, 20 bp, Artificial Sequence
  Description of Artificial Sequence: Synthetic oligonucleotide
  Target: ATXN1; (-) strand; PAM type: NRG; PAM sequence: AGG
tttagggagcatttgttgta

SEQ ID NO: 67907 - DNA, 20 bp, Artificial Sequence
  Description of Artificial Sequence: Synthetic oligonucleotide
  Target: ATXN1; (-) strand; PAM type: NRG; PAM sequence: AAG
atttagggagcatttgttgt

SEQ ID NO: 67908 - DNA, 20 bp, Artificial Sequence
  Description of Artificial Sequence: Synthetic oligonucleotide
  Target: ATXN1; (-) strand; PAM type: NRG; PAM sequence: GAG
ccagggatgaagcatttagg

SEQ ID NO: 67909 - DNA, 20 bp, Artificial Sequence
  Description of Artificial Sequence: Synthetic oligonucleotide
  Target: ATXN1; (-) strand; PAM type: NRG; PAM sequence: GGG
gaccagggatgaagcattta

SEQ ID NO: 67910 - DNA, 20 bp, Artificial Sequence
  Description of Artificial Sequence: Synthetic oligonucleotide
  Target: ATXN1; (-) strand; PAM type: NRG; PAM sequence: AGG
ggaccagggatgaagcattt

SEQ ID NO: 67911 - DNA, 20 bp, Artificial Sequence
  Description of Artificial Sequence: Synthetic oligonucleotide
  Target: ATXN1; (-) strand; PAM type: NRG; PAM sequence: TAG
tggaccagggatgaagcatt

SEQ ID NO: 67912 - DNA, 20 bp, Artificial Sequence
  Description of Artificial Sequence: Synthetic oligonucleotide
  Target: ATXN1; (-) strand; PAM type: NRG; PAM sequence: AAG
catcggctggaccagggatg

SEQ ID NO: 67913 - DNA, 20 bp, Artificial Sequence
  Description of Artificial Sequence: Synthetic oligonucleotide
  Target: ATXN1; (-) strand; PAM type: NRG; PAM sequence: GGG
aaattgcatcggctggacca

SEQ ID NO: 67914 - DNA, 20 bp, Artificial Sequence
  Description of Artificial Sequence: Synthetic oligonucleotide
  Target: ATXN1; (-) strand; PAM type: NRG; PAM sequence: AGG
aaaattgcatcggctggacc

SEQ ID NO: 67915 - DNA, 20 bp, Artificial Sequence
  Description of Artificial Sequence: Synthetic oligonucleotide
  Target: ATXN1; (-) strand; PAM type: NRG; PAM sequence: CAG
aaaaattgcatcggctggac

SEQ ID NO: 67916 - DNA, 20 bp, Artificial Sequence
  Description of Artificial Sequence: Synthetic oligonucleotide
  Target: ATXN1; (-) strand; PAM type: NRG; PAM sequence: TGG
cccttaaaaattgcatcggc

SEQ ID NO: 67917 - DNA, 20 bp, Artificial Sequence
  Description of Artificial Sequence: Synthetic oligonucleotide
  Target: ATXN1; (-) strand; PAM type: NRG; PAM sequence: CGG
actccccttaaaaattgcat

SEQ ID NO: 67918 - DNA, 20 bp, Artificial Sequence
  Description of Artificial Sequence: Synthetic oligonucleotide
  Target: ATXN1; (-) strand; PAM type: NRG; PAM sequence: GAG
aatagacatgttttttctaa

SEQ ID NO: 67919 - DNA, 20 bp, Artificial Sequence
  Description of Artificial Sequence: Synthetic oligonucleotide
  Target: ATXN1; (-) strand; PAM type: NRG; PAM sequence: AAG
gtaatagacatgttttttct

SEQ ID NO: 67920 - DNA, 20 bp, Artificial Sequence
  Description of Artificial Sequence: Synthetic oligonucleotide
  Target: ATXN1; (-) strand; PAM type: NRG; PAM sequence: TAG
ttcacatggtcaaaatgtaa

SEQ ID NO: 67921 - DNA, 20 bp, Artificial Sequence
  Description of Artificial Sequence: Synthetic oligonucleotide
  Target: ATXN1; (-) strand; PAM type: NRG; PAM sequence: TGG
aacattgattctatttcaca

SEQ ID NO: 67922 - DNA, 20 bp, Artificial Sequence
  Description of Artificial Sequence: Synthetic oligonucleotide
  Target: ATXN1; (-) strand; PAM type: NRG; PAM sequence: TAG
acatttaaggtctgtgttct

SEQ ID NO: 67923 - DNA, 20 bp, Artificial Sequence
  Description of Artificial Sequence: Synthetic oligonucleotide
  Target: ATXN1; (-) strand; PAM type: NRG; PAM sequence: AGG
ccatccactgctgacattta

SEQ ID NO: 67924 - DNA, 20 bp, Artificial Sequence
  Description of Artificial Sequence: Synthetic oligonucleotide
  Target: ATXN1; (-) strand; PAM type: NRG; PAM sequence: AAG
tccatccactgctgacattt

SEQ ID NO: 67925 - DNA, 20 bp, Artificial Sequence
  Description of Artificial Sequence: Synthetic oligonucleotide
  Target: ATXN1; (-) strand; PAM type: NRG; PAM sequence: AAG
atgcctagagtgaattgtca

SEQ ID NO: 67926 - DNA, 20 bp, Artificial Sequence
  Description of Artificial Sequence: Synthetic oligonucleotide
  Target: ATXN1; (-) strand; PAM type: NRG; PAM sequence: GAG
catgatattgcaaatgccta

SEQ ID NO: 67927 - DNA, 20 bp, Artificial Sequence
  Description of Artificial Sequence: Synthetic oligonucleotide
  Target: ATXN1; (-) strand; PAM type: NRG; PAM sequence: TAG
tccatgatattgcaaatgcc

SEQ ID NO: 67928 - DNA, 20 bp, Artificial Sequence
  Description of Artificial Sequence: Synthetic oligonucleotide
  Target: ATXN1; (-) strand; PAM type: NRG; PAM sequence: CAG
gagatttgttaaaagtagct

SEQ ID NO: 67929 - DNA, 20 bp, Artificial Sequence
  Description of Artificial Sequence: Synthetic oligonucleotide
  Target: ATXN1; (-) strand; PAM type: NRG; PAM sequence: TAG
gaaaagagatttgttaaaag

SEQ ID NO: 67930 - DNA, 20 bp, Artificial Sequence
  Description of Artificial Sequence: Synthetic oligonucleotide
  Target: ATXN1; (-) strand; PAM type: NRG; PAM sequence: AAG
tatgaaaagagatttgttaa

SEQ ID NO: 67931 - DNA, 20 bp, Artificial Sequence
  Description of Artificial Sequence: Synthetic oligonucleotide
  Target: ATXN1; (-) strand; PAM type: NRG; PAM sequence: GAG
cctgaattgtactatgaaaa

SEQ ID NO: 67932 - DNA, 20 bp, Artificial Sequence
  Description of Artificial Sequence: Synthetic oligonucleotide
  Target: ATXN1; (-) strand; PAM type: NRG; PAM sequence: AAG
gtcctgaattgtactatgaa

SEQ ID NO: 67933 - DNA, 20 bp, Artificial Sequence
  Description of Artificial Sequence: Synthetic oligonucleotide
  Target: ATXN1; (-) strand; PAM type: NRG; PAM sequence: AGG
agatctggaaacatctcacc

SEQ ID NO: 67934 - DNA, 20 bp, Artificial Sequence
  Description of Artificial Sequence: Synthetic oligonucleotide
  Target: ATXN1; (-) strand; PAM type: NRG; PAM sequence: CAG
tagatctggaaacatctcac

SEQ ID NO: 67935 - DNA, 20 bp, Artificial Sequence
  Description of Artificial Sequence: Synthetic oligonucleotide
  Target: ATXN1; (-) strand; PAM type: NRG; PAM sequence: TGG
aagaagtgcattgttagatc

SEQ ID NO: 67936 - DNA, 20 bp, Artificial Sequence
  Description of Artificial Sequence: Synthetic oligonucleotide
  Target: ATXN1; (-) strand; PAM type: NRG; PAM sequence: TAG
ccctataagaagtgcattgt

SEQ ID NO: 67937 - DNA, 20 bp, Artificial Sequence
  Description of Artificial Sequence: Synthetic oligonucleotide
  Target: ATXN1; (-) strand; PAM type: NRG; PAM sequence: AAG
aaaaactctgtccctataag

SEQ ID NO: 67938 - DNA, 20 bp, Artificial Sequence
  Description of Artificial Sequence: Synthetic oligonucleotide
  Target: ATXN1; (-) strand; PAM type: NRG; PAM sequence: AAG
agcaaaaactctgtccctat

SEQ ID NO: 67939 - DNA, 20 bp, Artificial Sequence
  Description of Artificial Sequence: Synthetic oligonucleotide
  Target: ATXN1; (-) strand; PAM type: NRG; PAM sequence: AAG
gaccacgagagagttgggca

SEQ ID NO: 67940 - DNA, 20 bp, Artificial Sequence
  Description of Artificial Sequence: Synthetic oligonucleotide
  Target: ATXN1; (-) strand; PAM type: NRG; PAM sequence: GGG
gcggtgaccacgagagagtt

SEQ ID NO: 67941 - DNA, 20 bp, Artificial Sequence
  Description of Artificial Sequence: Synthetic oligonucleotide
  Target: ATXN1; (-) strand; PAM type: NRG; PAM sequence: TGG
agcggtgaccacgagagagt

SEQ ID NO: 67942 - DNA, 20 bp, Artificial Sequence
  Description of Artificial Sequence: Synthetic oligonucleotide
  Target: ATXN1; (-) strand; PAM type: NRG; PAM sequence: GAG
taaaagcggtgaccacgaga

SEQ ID NO: 67943 - DNA, 20 bp, Artificial Sequence
  Description of Artificial Sequence: Synthetic oligonucleotide
  Target: ATXN1; (-) strand; PAM type: NRG; PAM sequence: GAG
tgtaaaagcggtgaccacga

SEQ ID NO: 67944 - DNA, 20 bp, Artificial Sequence
  Description of Artificial Sequence: Synthetic oligonucleotide
  Target: ATXN1; (-) strand; PAM type: NRG; PAM sequence: GAG
catgtaaaagcggtgaccac

SEQ ID NO: 67945 - DNA, 20 bp, Artificial Sequence
  Description of Artificial Sequence: Synthetic oligonucleotide
  Target: ATXN1; (-) strand; PAM type: NRG; PAM sequence: CGG
aatgctcactcatgtaaaag

SEQ ID NO: 67946 - DNA, 20 bp, Artificial Sequence
  Description of Artificial Sequence: Synthetic oligonucleotide
  Target: ATXN1; (-) strand; PAM type: NRG; PAM sequence: AAG
tctaatgctcactcatgtaa

SEQ ID NO: 67947 - DNA, 20 bp, Artificial Sequence
  Description of Artificial Sequence: Synthetic oligonucleotide
  Target: ATXN1; (-) strand; PAM type: NRG; PAM sequence: CAG
ccattgtatagcacacaaca

SEQ ID NO: 67948 - DNA, 20 bp, Artificial Sequence
  Description of Artificial Sequence: Synthetic oligonucleotide
  Target: ATXN1; (-) strand; PAM type: NRG; PAM sequence: TAG
ggtgtaaaaaagccattgta

SEQ ID NO: 67949 - DNA, 20 bp, Artificial Sequence
  Description of Artificial Sequence: Synthetic oligonucleotide
  Target: ATXN1; (-) strand; PAM type: NRG; PAM sequence: AAG
ttagtcttgatggtgtaaaa

SEQ ID NO: 67950 - DNA, 20 bp, Artificial Sequence
  Description of Artificial Sequence: Synthetic oligonucleotide
  Target: ATXN1; (-) strand; PAM type: NRG; PAM sequence: TGG
cccagcagatttagtcttga

SEQ ID NO: 67951 - DNA, 20 bp, Artificial Sequence
  Description of Artificial Sequence: Synthetic oligonucleotide
  Target: ATXN1; (-) strand; PAM type: NRG; PAM sequence: TAG
gccacagcacccagcagatt

SEQ ID NO: 67952 - DNA, 20 bp, Artificial Sequence
  Description of Artificial Sequence: Synthetic oligonucleotide
  Target: ATXN1; (-) strand; PAM type: NRG; PAM sequence: CAG
gcatgagccacagcacccag

SEQ ID NO: 67953 - DNA, 20 bp, Artificial Sequence
  Description of Artificial Sequence: Synthetic oligonucleotide
  Target: ATXN1; (-) strand; PAM type: NRG; PAM sequence: CAG
caggcatgagccacagcacc

SEQ ID NO: 67954 - DNA, 20 bp, Artificial Sequence
  Description of Artificial Sequence: Synthetic oligonucleotide
  Target: ATXN1; (-) strand; PAM type: NRG; PAM sequence: CAG
gggattacaggcatgagcca

SEQ ID NO: 67955 - DNA, 20 bp, Artificial Sequence
  Description of Artificial Sequence: Synthetic oligonucleotide
  Target: ATXN1; (-) strand; PAM type: NRG; PAM sequence: GAG
agtgctgggattacaggcat

SEQ ID NO: 67956 - DNA, 20 bp, Artificial Sequence
  Description of Artificial Sequence: Synthetic oligonucleotide
  Target: ATXN1; (-) strand; PAM type: NRG; PAM sequence: AGG
tccgaaagtgctgggattac

SEQ ID NO: 67957 - DNA, 20 bp, Artificial Sequence
  Description of Artificial Sequence: Synthetic oligonucleotide
  Target: ATXN1; (-) strand; PAM type: NRG; PAM sequence: CAG
ctccgaaagtgctgggatta

SEQ ID NO: 67958 - DNA, 20 bp, Artificial Sequence
  Description of Artificial Sequence: Synthetic oligonucleotide
  Target: ATXN1; (-) strand; PAM type: NRG; PAM sequence: GGG
ccttggcctccgaaagtgct

SEQ ID NO: 67959 - DNA, 20 bp, Artificial Sequence
  Description of Artificial Sequence: Synthetic oligonucleotide
  Target: ATXN1; (-) strand; PAM type: NRG; PAM sequence: TGG
gccttggcctccgaaagtgc

SEQ ID NO: 67960 - DNA, 20 bp, Artificial Sequence
  Description of Artificial Sequence: Synthetic oligonucleotide
  Target: ATXN1; (-) strand; PAM type: NRG; PAM sequence: AAG
cttcctgccttggcctccga

SEQ ID NO: 67961 - DNA, 20 bp, Artificial Sequence
  Description of Artificial Sequence: Synthetic oligonucleotide
  Target: ATXN1; (-) strand; PAM type: NRG; PAM sequence: TGG
ctcaagtgatcttcctgcct

SEQ ID NO: 67962 - DNA, 20 bp, Artificial Sequence
  Description of Artificial Sequence: Synthetic oligonucleotide
  Target: ATXN1; (-) strand; PAM type: NRG; PAM sequence: AAG
tgtcttgaactcctgacctc

SEQ ID NO: 67963 - DNA, 20 bp, Artificial Sequence
  Description of Artificial Sequence: Synthetic oligonucleotide
  Target: ATXN1; (-) strand; PAM type: NRG; PAM sequence: AGG
ggggttttgccatgttgccc

SEQ ID NO: 67964 - DNA, 20 bp, Artificial Sequence
  Description of Artificial Sequence: Synthetic oligonucleotide
  Target: ATXN1; (-) strand; PAM type: NRG; PAM sequence: CAG
cggggttttgccatgttgcc

SEQ ID NO: 67965 - DNA, 20 bp, Artificial Sequence
  Description of Artificial Sequence: Synthetic oligonucleotide
  Target: ATXN1; (-) strand; PAM type: NRG; PAM sequence: GGG
ttgtatttttagtagagacg

SEQ ID NO: 67966 - DNA, 20 bp, Artificial Sequence
  Description of Artificial Sequence: Synthetic oligonucleotide
  Target: ATXN1; (-) strand; PAM type: NRG; PAM sequence: GGG
tttgtatttttagtagagac

SEQ ID NO: 67967 - DNA, 20 bp, Artificial Sequence
  Description of Artificial Sequence: Synthetic oligonucleotide
  Target: ATXN1; (-) strand; PAM type: NRG; PAM sequence: CGG
ttttgtatttttagtagaga

SEQ ID NO: 67968 - DNA, 20 bp, Artificial Sequence
  Description of Artificial Sequence: Synthetic oligonucleotide
  Target: ATXN1; (-) strand; PAM type: NRG; PAM sequence: GAG
taatttttgtatttttagta

SEQ ID NO: 67969 - DNA, 20 bp, Artificial Sequence
  Description of Artificial Sequence: Synthetic oligonucleotide
  Target: ATXN1; (-) strand; PAM type: NRG; PAM sequence: TAG
gctaatttttgtatttttag

SEQ ID NO: 67970 - DNA, 20 bp, Artificial Sequence
  Description of Artificial Sequence: Synthetic oligonucleotide
  Target: ATXN1; (-) strand; PAM type: NRG; PAM sequence: TAG
ctggctaatttttgtatttt

SEQ ID NO: 67971 - DNA, 20 bp, Artificial Sequence
  Description of Artificial Sequence: Synthetic oligonucleotide
  Target: ATXN1; (-) strand; PAM type: NRG; PAM sequence: TGG
caggcgtgcaccaggacacc

SEQ ID NO: 67972 - DNA, 20 bp, Artificial Sequence
  Description of Artificial Sequence: Synthetic oligonucleotide
  Target: ATXN1; (-) strand; PAM type: NRG; PAM sequence: AGG
tgggattacaggcgtgcacc

SEQ ID NO: 67973 - DNA, 20 bp, Artificial Sequence
  Description of Artificial Sequence: Synthetic oligonucleotide
  Target: ATXN1; (-) strand; PAM type: NRG; PAM sequence: CAG
ctgggattacaggcgtgcac

SEQ ID NO: 67974 - DNA, 20 bp, Artificial Sequence
  Description of Artificial Sequence: Synthetic oligonucleotide
  Target: ATXN1; (-) strand; PAM type: NRG; PAM sequence: AGG
tcccgagtagctgggattac

SEQ ID NO: 67975 - DNA, 20 bp, Artificial Sequence
  Description of Artificial Sequence: Synthetic oligonucleotide
  Target: ATXN1; (-) strand; PAM type: NRG; PAM sequence: CAG
ctcccgagtagctgggatta

SEQ ID NO: 67976 - DNA, 20 bp, Artificial Sequence
  Description of Artificial Sequence: Synthetic oligonucleotide
  Target: ATXN1; (-) strand; PAM type: NRG; PAM sequence: GGG
cctcagcctcccgagtagct

SEQ ID NO: 67977 - DNA, 20 bp, Artificial Sequence
  Description of Artificial Sequence: Synthetic oligonucleotide
  Target: ATXN1; (-) strand; PAM type: NRG; PAM sequence: TGG
gcctcagcctcccgagtagc

SEQ ID NO: 67978 - DNA, 20 bp, Artificial Sequence
  Description of Artificial Sequence: Synthetic oligonucleotide
  Target: ATXN1; (-) strand; PAM type: NRG; PAM sequence: TAG
tgctgcctcagcctcccgag

SEQ ID NO: 67979 - DNA, 20 bp, Artificial Sequence
  Description of Artificial Sequence: Synthetic oligonucleotide
  Target: ATXN1; (-) strand; PAM type: NRG; PAM sequence: GAG
ttctgctgcctcagcctccc

SEQ ID NO: 67980 - DNA, 20 bp, Artificial Sequence
  Description of Artificial Sequence: Synthetic oligonucleotide
  Target: ATXN1; (-) strand; PAM type: NRG; PAM sequence: CAG
ttaaagagattctgctgcct

SEQ ID NO: 67981 - DNA, 20 bp, Artificial Sequence
  Description of Artificial Sequence: Synthetic oligonucleotide
  Target: ATXN1; (-) strand; PAM type: NRG; PAM sequence: GAG
cctccacctcccgggttaaa

SEQ ID NO: 67982 - DNA, 20 bp, Artificial Sequence
  Description of Artificial Sequence: Synthetic oligonucleotide
  Target: ATXN1; (-) strand; PAM type: NRG; PAM sequence: AAG
aacctccacctcccgggtta

SEQ ID NO: 67983 - DNA, 20 bp, Artificial Sequence
  Description of Artificial Sequence: Synthetic oligonucleotide
  Target: ATXN1; (-) strand; PAM type: NRG; PAM sequence: GGG
atctgcaacctccacctccc

SEQ ID NO: 67984 - DNA, 20 bp, Artificial Sequence
  Description of Artificial Sequence: Synthetic oligonucleotide
  Target: ATXN1; (-) strand; PAM type: NRG; PAM sequence: CGG
tatctgcaacctccacctcc

SEQ ID NO: 67985 - DNA, 20 bp, Artificial Sequence
  Description of Artificial Sequence: Synthetic oligonucleotide
  Target: ATXN1; (-) strand; PAM type: NRG; PAM sequence: CAG
ggagtgcagtggtgcgatct

SEQ ID NO: 67986 - DNA, 20 bp, Artificial Sequence
  Description of Artificial Sequence: Synthetic oligonucleotide
  Target: ATXN1; (-) strand; PAM type: NRG; PAM sequence: TGG
ttgcccaggttggagtgcag

SEQ ID NO: 67987 - DNA, 20 bp, Artificial Sequence
  Description of Artificial Sequence: Synthetic oligonucleotide
  Target: ATXN1; (-) strand; PAM type: NRG; PAM sequence: CAG
ctgttgcccaggttggagtg

SEQ ID NO: 67988 - DNA, 20 bp, Artificial Sequence
  Description of Artificial Sequence: Synthetic oligonucleotide
  Target: ATXN1; (-) strand; PAM type: NRG; PAM sequence: GAG
tcactctgttgcccaggttg

SEQ ID NO: 67989 - DNA, 20 bp, Artificial Sequence
  Description of Artificial Sequence: Synthetic oligonucleotide
  Target: ATXN1; (-) strand; PAM type: NRG; PAM sequence: TGG
tctcactctgttgcccaggt

SEQ ID NO: 67990 - DNA, 20 bp, Artificial Sequence
  Description of Artificial Sequence: Synthetic oligonucleotide
  Target: ATXN1; (-) strand; PAM type: NRG; PAM sequence: AGG
ggagtctcactctgttgccc

SEQ ID NO: 67991 - DNA, 20 bp, Artificial Sequence
  Description of Artificial Sequence: Synthetic oligonucleotide
  Target: ATXN1; (-) strand; PAM type: NRG; PAM sequence: CAG
gggagtctcactctgttgcc

SEQ ID NO: 67992 - DNA, 20 bp, Artificial Sequence
  Description of Artificial Sequence: Synthetic oligonucleotide
  Target: ATXN1; (-) strand; PAM type: NRG; PAM sequence: GAG
ttttttttttttttgagagg

SEQ ID NO: 67993 - DNA, 20 bp, Artificial Sequence
  Description of Artificial Sequence: Synthetic oligonucleotide
  Target: ATXN1; (-) strand; PAM type: NRG; PAM sequence: GGG
ttttttttttttttttgaga

SEQ ID NO: 67994 - DNA, 20 bp, Artificial Sequence
  Description of Artificial Sequence: Synthetic oligonucleotide
  Target: ATXN1; (-) strand; PAM type: NRG; PAM sequence: AGG
tttttttttttttttttgag

SEQ ID NO: 67995 - DNA, 20 bp, Artificial Sequence
  Description of Artificial Sequence: Synthetic oligonucleotide
  Target: ATXN1; (-) strand; PAM type: NRG; PAM sequence: GAG
ctttttttttttttttttga

SEQ ID NO: 67996 - DNA, 20 bp, Artificial Sequence
  Description of Artificial Sequence: Synthetic oligonucleotide
  Target: ATXN1; (-) strand; PAM type: NRG; PAM sequence: GAG
ttcttttttttttttttttt

SEQ ID NO: 67997 - DNA, 20 bp, Artificial Sequence
  Description of Artificial Sequence: Synthetic oligonucleotide
  Target: ATXN1; (-) strand; PAM type: NRG; PAM sequence: TAG
tttggaagcaatgtatgatt

SEQ ID NO: 67998 - DNA, 20 bp, Artificial Sequence
  Description of Artificial Sequence: Synthetic oligonucleotide
  Target: ATXN1; (-) strand; PAM type: NRG; PAM sequence: AAG
ggatatggagctacctttgg

SEQ ID NO: 67999 - DNA, 20 bp, Artificial Sequence
  Description of Artificial Sequence: Synthetic oligonucleotide
  Target: ATXN1; (-) strand; PAM type: NRG; PAM sequence: TGG
agaggatatggagctacctt

SEQ ID NO: 68000 - DNA, 20 bp, Artificial Sequence
  Description of Artificial Sequence: Synthetic oligonucleotide
  Target: ATXN1; (-) strand; PAM type: NRG; PAM sequence: GAG
gtataccttcagaggatatg

SEQ ID NO: 68001 - DNA, 20 bp, Artificial Sequence
  Description of Artificial Sequence: Synthetic oligonucleotide
  Target: ATXN1; (-) strand; PAM type: NRG; PAM sequence: TGG
atgtataccttcagaggata

SEQ ID NO: 68002 - DNA, 20 bp, Artificial Sequence
  Description of Artificial Sequence: Synthetic oligonucleotide
  Target: ATXN1; (-) strand; PAM type: NRG; PAM sequence: AGG
cctcccatgtataccttcag

SEQ ID NO: 68003 - DNA, 20 bp, Artificial Sequence
  Description of Artificial Sequence: Synthetic oligonucleotide
  Target: ATXN1; (-) strand; PAM type: NRG; PAM sequence: GAG
ccctcccatgtataccttca

SEQ ID NO: 68004 - DNA, 20 bp, Artificial Sequence
  Description of Artificial Sequence: Synthetic oligonucleotide
  Target: ATXN1; (-) strand; PAM type: NRG; PAM sequence: CAG
ggccctcccatgtatacctt

SEQ ID NO: 68005 - DNA, 20 bp, Artificial Sequence
  Description of Artificial Sequence: Synthetic oligonucleotide
  Target: ATXN1; (-) strand; PAM type: NRG; PAM sequence: GGG
tggaatacatgatatgttat

SEQ ID NO: 68006 - DNA, 20 bp, Artificial Sequence
  Description of Artificial Sequence: Synthetic oligonucleotide
  Target: ATXN1; (-) strand; PAM type: NRG; PAM sequence: TGG
ctggaatacatgatatgtta

SEQ ID NO: 68007 - DNA, 20 bp, Artificial Sequence
  Description of Artificial Sequence: Synthetic oligonucleotide
  Target: ATXN1; (-) strand; PAM type: NRG; PAM sequence: TGG
catggttttatggctagatc

SEQ ID NO: 68008 - DNA, 20 bp, Artificial Sequence
  Description of Artificial Sequence: Synthetic oligonucleotide
  Target: ATXN1; (-) strand; PAM type: NRG; PAM sequence: TAG
aaaccgcatggttttatggc

SEQ ID NO: 68009 - DNA, 20 bp, Artificial Sequence
  Description of Artificial Sequence: Synthetic oligonucleotide
  Target: ATXN1; (-) strand; PAM type: NRG; PAM sequence: TGG
atctaaaccgcatggtttta

SEQ ID NO: 68010 - DNA, 20 bp, Artificial Sequence
  Description of Artificial Sequence: Synthetic oligonucleotide
  Target: ATXN1; (-) strand; PAM type: NRG; PAM sequence: TGG
atgttaaaatctaaaccgca

SEQ ID NO: 68011 - DNA, 20 bp, Artificial Sequence
  Description of Artificial Sequence: Synthetic oligonucleotide
  Target: ATXN1; (-) strand; PAM type: NRG; PAM sequence: TGG
cagagacacacaattggatt

SEQ ID NO: 68012 - DNA, 20 bp, Artificial Sequence
  Description of Artificial Sequence: Synthetic oligonucleotide
  Target: ATXN1; (-) strand; PAM type: NRG; PAM sequence: TGG
gtttaccagagacacacaat

SEQ ID NO: 68013 - DNA, 20 bp, Artificial Sequence
  Description of Artificial Sequence: Synthetic oligonucleotide
  Target: ATXN1; (-) strand; PAM type: NRG; PAM sequence: GAG
tgggcaagtcatgtttacca

SEQ ID NO: 68014 - DNA, 20 bp, Artificial Sequence
  Description of Artificial Sequence: Synthetic oligonucleotide
  Target: ATXN1; (-) strand; PAM type: NRG; PAM sequence: CAG
actgggcaagtcatgtttac

SEQ ID NO: 68015 - DNA, 20 bp, Artificial Sequence
  Description of Artificial Sequence: Synthetic oligonucleotide
  Target: ATXN1; (-) strand; PAM type: NRG; PAM sequence: AAG
tcagcacggttttactgggc

SEQ ID NO: 68016 - DNA, 20 bp, Artificial Sequence
  Description of Artificial Sequence: Synthetic oligonucleotide
  Target: ATXN1; (-) strand; PAM type: NRG; PAM sequence: GGG
agtatcagcacggttttact

SEQ ID NO: 68017 - DNA, 20 bp, Artificial Sequence
  Description of Artificial Sequence: Synthetic oligonucleotide
  Target: ATXN1; (-) strand; PAM type: NRG; PAM sequence: TGG
tagtatcagcacggttttac

SEQ ID NO: 68018 - DNA, 20 bp, Artificial Sequence
  Description of Artificial Sequence: Synthetic oligonucleotide
  Target: ATXN1; (-) strand; PAM type: NRG; PAM sequence: CGG
tggaacatgtagtatcagca

SEQ ID NO: 68019 - DNA, 20 bp, Artificial Sequence
  Description of Artificial Sequence: Synthetic oligonucleotide
  Target: ATXN1; (-) strand; PAM type: NRG; PAM sequence: CAG
aactgtggaacatgtagtat

SEQ ID NO: 68020 - DNA, 20 bp, Artificial Sequence
  Description of Artificial Sequence: Synthetic oligonucleotide
  Target: ATXN1; (-) strand; PAM type: NRG; PAM sequence: TAG
taacgtaactgtggaacatg

SEQ ID NO: 68021 - DNA, 20 bp, Artificial Sequence
  Description of Artificial Sequence: Synthetic oligonucleotide
  Target: ATXN1; (-) strand; PAM type: NRG; PAM sequence: TGG
atataatgataacgtaactg

SEQ ID NO: 68022 - DNA, 20 bp, Artificial Sequence
  Description of Artificial Sequence: Synthetic oligonucleotide
  Target: ATXN1; (-) strand; PAM type: NRG; PAM sequence: TAG
aagacaacatttccaaaagt

SEQ ID NO: 68023 - DNA, 20 bp, Artificial Sequence
  Description of Artificial Sequence: Synthetic oligonucleotide
  Target: ATXN1; (-) strand; PAM type: NRG; PAM sequence: AAG
cgacaagacaacatttccaa

SEQ ID NO: 68024 - DNA, 20 bp, Artificial Sequence
  Description of Artificial Sequence: Synthetic oligonucleotide
  Target: ATXN1; (-) strand; PAM type: NRG; PAM sequence: AAG
ggatgatacaatacaacgac

SEQ ID NO: 68025 - DNA, 20 bp, Artificial Sequence
  Description of Artificial Sequence: Synthetic oligonucleotide
  Target: ATXN1; (-) strand; PAM type: NRG; PAM sequence: AGG
aaggaatttaatacttactc

SEQ ID NO: 68026 - DNA, 20 bp, Artificial Sequence
  Description of Artificial Sequence: Synthetic oligonucleotide
  Target: ATXN1; (-) strand; PAM type: NRG; PAM sequence: CAG
taaggaatttaatacttact

SEQ ID NO: 68027 - DNA, 20 bp, Artificial Sequence
  Description of Artificial Sequence: Synthetic oligonucleotide
  Target: ATXN1; (-) strand; PAM type: NRG; PAM sequence: AGG
aatggttgtggcaaatatta

SEQ ID NO: 68028 - DNA, 20 bp, Artificial Sequence
  Description of Artificial Sequence: Synthetic oligonucleotide
  Target: ATXN1; (-) strand; PAM type: NRG; PAM sequence: AAG
aaatggttgtggcaaatatt

SEQ ID NO: 68029 - DNA, 20 bp, Artificial Sequence
  Description of Artificial Sequence: Synthetic oligonucleotide
  Target: ATXN1; (-) strand; PAM type: NRG; PAM sequence: TGG
agccactcagcaaatggttg

SEQ ID NO: 68030 - DNA, 20 bp, Artificial Sequence
  Description of Artificial Sequence: Synthetic oligonucleotide
  Target: ATXN1; (-) strand; PAM type: NRG; PAM sequence: TGG
caaattagccactcagcaaa

SEQ ID NO: 68031 - DNA, 20 bp, Artificial Sequence
  Description of Artificial Sequence: Synthetic oligonucleotide
  Target: ATXN1; (-) strand; PAM type: NRG; PAM sequence: CAG
gtccatacaaattagccact

SEQ ID NO: 68032 - DNA, 20 bp, Artificial Sequence
  Description of Artificial Sequence: Synthetic oligonucleotide
  Target: ATXN1; (-) strand; PAM type: NRG; PAM sequence: TAG
aaaaatgtgtccatacaaat

SEQ ID NO: 68033 - DNA, 20 bp, Artificial Sequence
  Description of Artificial Sequence: Synthetic oligonucleotide
  Target: ATXN1; (-) strand; PAM type: NRG; PAM sequence: TAG
tttgtcaggattaaagataa

SEQ ID NO: 68034 - DNA, 20 bp, Artificial Sequence
  Description of Artificial Sequence: Synthetic oligonucleotide
  Target: ATXN1; (-) strand; PAM type: NRG; PAM sequence: AAG
cagagattttgtcaggatta

SEQ ID NO: 68035 - DNA, 20 bp, Artificial Sequence
  Description of Artificial Sequence: Synthetic oligonucleotide
  Target: ATXN1; (-) strand; PAM type: NRG; PAM sequence: AGG
tattttacagagattttgtc

SEQ ID NO: 68036 - DNA, 20 bp, Artificial Sequence
  Description of Artificial Sequence: Synthetic oligonucleotide
  Target: ATXN1; (-) strand; PAM type: NRG; PAM sequence: CAG
ctattttacagagattttgt

SEQ ID NO: 68037 - DNA, 20 bp, Artificial Sequence
  Description of Artificial Sequence: Synthetic oligonucleotide
  Target: ATXN1; (-) strand; PAM type: NRG; PAM sequence: GAG
ccaataaaacctattttaca

SEQ ID NO: 68038 - DNA, 20 bp, Artificial Sequence
  Description of Artificial Sequence: Synthetic oligonucleotide
  Target: ATXN1; (-) strand; PAM type: NRG; PAM sequence: CAG
ggccaataaaacctatttta

SEQ ID NO: 68039 - DNA, 20 bp, Artificial Sequence
  Description of Artificial Sequence: Synthetic oligonucleotide
  Target: ATXN1; (-) strand; PAM type: NRG; PAM sequence: AGG
ttttcctcatctgtacaatg

SEQ ID NO: 68040 - DNA, 20 bp, Artificial Sequence
  Description of Artificial Sequence: Synthetic oligonucleotide
  Target: ATXN1; (-) strand; PAM type: NRG; PAM sequence: GAG
attttcctcatctgtacaat

SEQ ID NO: 68041 - DNA, 20 bp, Artificial Sequence
  Description of Artificial Sequence: Synthetic oligonucleotide
  Target: ATXN1; (-) strand; PAM type: NRG; PAM sequence: GAG
ttggttaggttacttttctt

SEQ ID NO: 68042 - DNA, 20 bp, Artificial Sequence
  Description of Artificial Sequence: Synthetic oligonucleotide
  Target: ATXN1; (-) strand; PAM type: NRG; PAM sequence: AGG
acttactggtgaccttggtt

SEQ ID NO: 68043 - DNA, 20 bp, Artificial Sequence
  Description of Artificial Sequence: Synthetic oligonucleotide
  Target: ATXN1; (-) strand; PAM type: NRG; PAM sequence: TAG
cacttactggtgaccttggt

SEQ ID NO: 68044 - DNA, 20 bp, Artificial Sequence
  Description of Artificial Sequence: Synthetic oligonucleotide
  Target: ATXN1; (-) strand; PAM type: NRG; PAM sequence: TGG
ttgtcacttactggtgacct

SEQ ID NO: 68045 - DNA, 20 bp, Artificial Sequence
  Description of Artificial Sequence: Synthetic oligonucleotide
  Target: ATXN1; (-) strand; PAM type: NRG; PAM sequence: TGG
aacctagctttgtcacttac

SEQ ID NO: 68046 - DNA, 20 bp, Artificial Sequence
  Description of Artificial Sequence: Synthetic oligonucleotide
  Target: ATXN1; (-) strand; PAM type: NRG; PAM sequence: TAG
ccgtgaaacccagacaaacc

SEQ ID NO: 68047 - DNA, 20 bp, Artificial Sequence
  Description of Artificial Sequence: Synthetic oligonucleotide
  Target: ATXN1; (-) strand; PAM type: NRG; PAM sequence: CAG
ttctctttgaccgtgaaacc

SEQ ID NO: 68048 - DNA, 20 bp, Artificial Sequence
  Description of Artificial Sequence: Synthetic oligonucleotide
  Target: ATXN1; (-) strand; PAM type: NRG; PAM sequence: GAG
ctctcgtgcatgttgccagg

SEQ ID NO: 68049 - DNA, 20 bp, Artificial Sequence
  Description of Artificial Sequence: Synthetic oligonucleotide
  Target: ATXN1; (-) strand; PAM type: NRG; PAM sequence: GGG
atctctcgtgcatgttgcca

SEQ ID NO: 68050 - DNA, 20 bp, Artificial Sequence
  Description of Artificial Sequence: Synthetic oligonucleotide
  Target: ATXN1; (-) strand; PAM type: NRG; PAM sequence: AGG
aatctctcgtgcatgttgcc

SEQ ID NO: 68051 - DNA, 20 bp, Artificial Sequence
  Description of Artificial Sequence: Synthetic oligonucleotide
  Target: ATXN1; (-) strand; PAM type: NRG; PAM sequence: CAG
taatctctcgtgcatgttgc

SEQ ID NO: 68052 - DNA, 20 bp, Artificial Sequence
  Description of Artificial Sequence: Synthetic oligonucleotide
  Target: ATXN1; (-) strand; PAM type: NRG; PAM sequence: GAG
tgtcagaatgcttatgtatt

SEQ ID NO: 68053 - DNA, 20 bp, Artificial Sequence
  Description of Artificial Sequence: Synthetic oligonucleotide
  Target: ATXN1; (-) strand; PAM type: NRG; PAM sequence: CAG
agtgcttattttttgtttgt

SEQ ID NO: 68054 - DNA, 20 bp, Artificial Sequence
  Description of Artificial Sequence: Synthetic oligonucleotide
  Target: ATXN1; (-) strand; PAM type: NRG; PAM sequence: AAG
gagccactgtgcccggctgc

SEQ ID NO: 68055 - DNA, 20 bp, Artificial Sequence
  Description of Artificial Sequence: Synthetic oligonucleotide
  Target: ATXN1; (-) strand; PAM type: NRG; PAM sequence: CGG
caggtgtgagccactgtgcc

SEQ ID NO: 68056 - DNA, 20 bp, Artificial Sequence
  Description of Artificial Sequence: Synthetic oligonucleotide
  Target: ATXN1; (-) strand; PAM type: NRG; PAM sequence: GAG
agtgctgagattacaggtgt

SEQ ID NO: 68057 - DNA, 20 bp, Artificial Sequence
  Description of Artificial Sequence: Synthetic oligonucleotide
  Target: ATXN1; (-) strand; PAM type: NRG; PAM sequence: AGG
tcccaaagtgctgagattac

SEQ ID NO: 68058 - DNA, 20 bp, Artificial Sequence
  Description of Artificial Sequence: Synthetic oligonucleotide
  Target: ATXN1; (-) strand; PAM type: NRG; PAM sequence: CAG
ttcccaaagtgctgagatta

SEQ ID NO: 68059 - DNA, 20 bp, Artificial Sequence
  Description of Artificial Sequence: Synthetic oligonucleotide
  Target: ATXN1; (-) strand; PAM type: NRG; PAM sequence: GAG
cctcggcttcccaaagtgct

SEQ ID NO: 68060 - DNA, 20 bp, Artificial Sequence
  Description of Artificial Sequence: Synthetic oligonucleotide
  Target: ATXN1; (-) strand; PAM type: NRG; PAM sequence: AAG
ccacctccctcggcttccca

SEQ ID NO: 68061 - DNA, 20 bp, Artificial Sequence
  Description of Artificial Sequence: Synthetic oligonucleotide
  Target: ATXN1; (-) strand; PAM type: NRG; PAM sequence: CGG
ctcaggtgatccacctccct

SEQ ID NO: 68062 - DNA, 20 bp, Artificial Sequence
  Description of Artificial Sequence: Synthetic oligonucleotide
  Target: ATXN1; (-) strand; PAM type: NRG; PAM sequence: AGG
ggtctcgaactcctgacctc

SEQ ID NO: 68063 - DNA, 20 bp, Artificial Sequence
  Description of Artificial Sequence: Synthetic oligonucleotide
  Target: ATXN1; (-) strand; PAM type: NRG; PAM sequence: CAG
tggtctcgaactcctgacct

SEQ ID NO: 68064 - DNA, 20 bp, Artificial Sequence
  Description of Artificial Sequence: Synthetic oligonucleotide
  Target: ATXN1; (-) strand; PAM type: NRG; PAM sequence: TGG
tttcaccatgttgcccaggc

SEQ ID NO: 68065 - DNA, 20 bp, Artificial Sequence
  Description of Artificial Sequence: Synthetic oligonucleotide
  Target: ATXN1; (-) strand; PAM type: NRG; PAM sequence: AGG
ggggtttcaccatgttgccc

SEQ ID NO: 68066 - DNA, 20 bp, Artificial Sequence
  Description of Artificial Sequence: Synthetic oligonucleotide
  Target: ATXN1; (-) strand; PAM type: NRG; PAM sequence: CAG
tggggtttcaccatgttgcc

SEQ ID NO: 68067 - DNA, 20 bp, Artificial Sequence
  Description of Artificial Sequence: Synthetic oligonucleotide
  Target: ATXN1; (-) strand; PAM type: NRG; PAM sequence: GGG
ctgtatttttagtagagatg

SEQ ID NO: 68068 - DNA, 20 bp, Artificial Sequence
  Description of Artificial Sequence: Synthetic oligonucleotide
  Target: ATXN1; (-) strand; PAM type: NRG; PAM sequence: GGG
tctgtatttttagtagagat

SEQ ID NO: 68069 - DNA, 20 bp, Artificial Sequence
  Description of Artificial Sequence: Synthetic oligonucleotide
  Target: ATXN1; (-) strand; PAM type: NRG; PAM sequence: TGG
ttctgtatttttagtagaga

SEQ ID NO: 68070 - DNA, 20 bp, Artificial Sequence
  Description of Artificial Sequence: Synthetic oligonucleotide
  Target: ATXN1; (-) strand; PAM type: NRG; PAM sequence: GAG
taatttctgtatttttagta

SEQ ID NO: 68071 - DNA, 20 bp, Artificial Sequence
  Description of Artificial Sequence: Synthetic oligonucleotide
  Target: ATXN1; (-) strand; PAM type: NRG; PAM sequence: TAG
gctaatttctgtatttttag

SEQ ID NO: 68072 - DNA, 20 bp, Artificial Sequence
  Description of Artificial Sequence: Synthetic oligonucleotide
  Target: ATXN1; (-) strand; PAM type: NRG; PAM sequence: TAG
ccagctaatttctgtatttt

SEQ ID NO: 68073 - DNA, 20 bp, Artificial Sequence
  Description of Artificial Sequence: Synthetic oligonucleotide
  Target: ATXN1; (-) strand; PAM type: NRG; PAM sequence: CAG
caggcacacaccgccatgcc

SEQ ID NO: 68074 - DNA, 20 bp, Artificial Sequence
  Description of Artificial Sequence: Synthetic oligonucleotide
  Target: ATXN1; (-) strand; PAM type: NRG; PAM sequence: AGG
tcccaagtagctgggattac

SEQ ID NO: 68075 - DNA, 20 bp, Artificial Sequence
  Description of Artificial Sequence: Synthetic oligonucleotide
  Target: ATXN1; (-) strand; PAM type: NRG; PAM sequence: CAG
ctcccaagtagctgggatta

SEQ ID NO: 68076 - DNA, 20 bp, Artificial Sequence
  Description of Artificial Sequence: Synthetic oligonucleotide
  Target: ATXN1; (-) strand; PAM type: NRG; PAM sequence: GGG
cctcagcctcccaagtagct

SEQ ID NO: 68077 - DNA, 20 bp, Artificial Sequence
  Description of Artificial Sequence: Synthetic oligonucleotide
  Target: ATXN1; (-) strand; PAM type: NRG; PAM sequence: TGG
gcctcagcctcccaagtagc

SEQ ID NO: 68078 - DNA, 20 bp, Artificial Sequence
  Description of Artificial Sequence: Synthetic oligonucleotide
  Target: ATXN1; (-) strand; PAM type: NRG; PAM sequence: TAG
tcctgcctcagcctcccaag

SEQ ID NO: 68079 - DNA, 20 bp, Artificial Sequence
  Description of Artificial Sequence: Synthetic oligonucleotide
  Target: ATXN1; (-) strand; PAM type: NRG; PAM sequence: AAG
ttctcctgcctcagcctccc

SEQ ID NO: 68080 - DNA, 20 bp, Artificial Sequence
  Description of Artificial Sequence: Synthetic oligonucleotide
  Target: ATXN1; (-) strand; PAM type: NRG; PAM sequence: CAG
tttaagcaattctcctgcct

SEQ ID NO: 68081 - DNA, 20 bp, Artificial Sequence
  Description of Artificial Sequence: Synthetic oligonucleotide
  Target: ATXN1; (-) strand; PAM type: NRG; PAM sequence: AAG
aacctccacctcccaggttt

SEQ ID NO: 68082 - DNA, 20 bp, Artificial Sequence
  Description of Artificial Sequence: Synthetic oligonucleotide
  Target: ATXN1; (-) strand; PAM type: NRG; PAM sequence: AGG
tactgcaacctccacctccc

SEQ ID NO: 68083 - DNA, 20 bp, Artificial Sequence
  Description of Artificial Sequence: Synthetic oligonucleotide
  Target: ATXN1; (-) strand; PAM type: NRG; PAM sequence: CAG
ttactgcaacctccacctcc

SEQ ID NO: 68084 - DNA, 20 bp, Artificial Sequence
  Description of Artificial Sequence: Synthetic oligonucleotide
  Target: ATXN1; (-) strand; PAM type: NRG; PAM sequence: CAG
ggagtgcagtggcacagtct

SEQ ID NO: 68085 - DNA, 20 bp, Artificial Sequence
  Description of Artificial Sequence: Synthetic oligonucleotide
  Target: ATXN1; (-) strand; PAM type: NRG; PAM sequence: CAG
caggctggagtgcagtggca

SEQ ID NO: 68086 - DNA, 20 bp, Artificial Sequence
  Description of Artificial Sequence: Synthetic oligonucleotide
  Target: ATXN1; (-) strand; PAM type: NRG; PAM sequence: TGG
ttgtccaggctggagtgcag

SEQ ID NO: 68087 - DNA, 20 bp, Artificial Sequence
  Description of Artificial Sequence: Synthetic oligonucleotide
  Target: ATXN1; (-) strand; PAM type: NRG; PAM sequence: CAG
gtgttgtccaggctggagtg

SEQ ID NO: 68088 - DNA, 20 bp, Artificial Sequence
  Description of Artificial Sequence: Synthetic oligonucleotide
  Target: ATXN1; (-) strand; PAM type: NRG; PAM sequence: GAG
ttgatgtgttgtccaggctg

SEQ ID NO: 68089 - DNA, 20 bp, Artificial Sequence
  Description of Artificial Sequence: Synthetic oligonucleotide
  Target: ATXN1; (-) strand; PAM type: NRG; PAM sequence: TGG
tcttgatgtgttgtccaggc

SEQ ID NO: 68090 - DNA, 20 bp, Artificial Sequence
  Description of Artificial Sequence: Synthetic oligonucleotide
  Target: ATXN1; (-) strand; PAM type: NRG; PAM sequence: AGG
agagtcttgatgtgttgtcc

SEQ ID NO: 68091 - DNA, 20 bp, Artificial Sequence
  Description of Artificial Sequence: Synthetic oligonucleotide
  Target: ATXN1; (-) strand; PAM type: NRG; PAM sequence: CAG
cagagtcttgatgtgttgtc

SEQ ID NO: 68092 - DNA, 20 bp, Artificial Sequence
  Description of Artificial Sequence: Synthetic oligonucleotide
  Target: ATXN1; (-) strand; PAM type: NRG; PAM sequence: GAG
agatttttttttttttgaca

SEQ ID NO: 68093 - DNA, 20 bp, Artificial Sequence
  Description of Artificial Sequence: Synthetic oligonucleotide
  Target: ATXN1; (-) strand; PAM type: NRG; PAM sequence: CAG
aaagatttttttttttttga

SEQ ID NO: 68094 - DNA, 20 bp, Artificial Sequence
  Description of Artificial Sequence: Synthetic oligonucleotide
  Target: ATXN1; (-) strand; PAM type: NRG; PAM sequence: AAG
aaaaacaaaaaaccctgaca

SEQ ID NO: 68095 - DNA, 20 bp, Artificial Sequence
  Description of Artificial Sequence: Synthetic oligonucleotide
  Target: ATXN1; (-) strand; PAM type: NRG; PAM sequence: GGG
aactttccactgaatgtcat

SEQ ID NO: 68096 - DNA, 20 bp, Artificial Sequence
  Description of Artificial Sequence: Synthetic oligonucleotide
  Target: ATXN1; (-) strand; PAM type: NRG; PAM sequence: TGG
caactttccactgaatgtca

SEQ ID NO: 68097 - DNA, 20 bp, Artificial Sequence
  Description of Artificial Sequence: Synthetic oligonucleotide
  Target: ATXN1; (-) strand; PAM type: NRG; PAM sequence: GGG
acgcttgcctggcacctgtt

SEQ ID NO: 68098 - DNA, 20 bp, Artificial Sequence
  Description of Artificial Sequence: Synthetic oligonucleotide
  Target: ATXN1; (-) strand; PAM type: NRG; PAM sequence: TGG
aacgcttgcctggcacctgt

SEQ ID NO: 68099 - DNA, 20 bp, Artificial Sequence
  Description of Artificial Sequence: Synthetic oligonucleotide
  Target: ATXN1; (-) strand; PAM type: NRG; PAM sequence: TGG
ctgcctgaagaacgcttgcc

SEQ ID NO: 68100 - DNA, 20 bp, Artificial Sequence
  Description of Artificial Sequence: Synthetic oligonucleotide
  Target: ATXN1; (-) strand; PAM type: NRG; PAM sequence: AAG
tggtcccgctgtgctgcctg

SEQ ID NO: 68101 - DNA, 20 bp, Artificial Sequence
  Description of Artificial Sequence: Synthetic oligonucleotide
  Target: ATXN1; (-) strand; PAM type: NRG; PAM sequence: TGG
cgttgccactgtcagcactt

SEQ ID NO: 68102 - DNA, 20 bp, Artificial Sequence
  Description of Artificial Sequence: Synthetic oligonucleotide
  Target: ATXN1; (-) strand; PAM type: NRG; PAM sequence: CAG
ttttgtgtcgttgccactgt

SEQ ID NO: 68103 - DNA, 20 bp, Artificial Sequence
  Description of Artificial Sequence: Synthetic oligonucleotide
  Target: ATXN1; (-) strand; PAM type: NRG; PAM sequence: AGG
attgttagactgacttgcca

SEQ ID NO: 68104 - DNA, 20 bp, Artificial Sequence
  Description of Artificial Sequence: Synthetic oligonucleotide
  Target: ATXN1; (-) strand; PAM type: NRG; PAM sequence: AAG
aattgttagactgacttgcc

SEQ ID NO: 68105 - DNA, 20 bp, Artificial Sequence
  Description of Artificial Sequence: Synthetic oligonucleotide
  Target: ATXN1; (-) strand; PAM type: NRG; PAM sequence: TAG
gaatgatgcaaagtaattgt

SEQ ID NO: 68106 - DNA, 20 bp, Artificial Sequence
  Description of Artificial Sequence: Synthetic oligonucleotide
  Target: ATXN1; (-) strand; PAM type: NRG; PAM sequence: AAG
ctcataatcagaatgatgca

SEQ ID NO: 68107 - DNA, 20 bp, Artificial Sequence
  Description of Artificial Sequence: Synthetic oligonucleotide
  Target: ATXN1; (-) strand; PAM type: NRG; PAM sequence: CAG
gcatgcttgtggctcataat

SEQ ID NO: 68108 - DNA, 20 bp, Artificial Sequence
  Description of Artificial Sequence: Synthetic oligonucleotide
  Target: ATXN1; (-) strand; PAM type: NRG; PAM sequence: TGG
tgctgttgattgcatgcttg

SEQ ID NO: 68109 - DNA, 20 bp, Artificial Sequence
  Description of Artificial Sequence: Synthetic oligonucleotide
  Target: ATXN1; (-) strand; PAM type: NRG; PAM sequence: AAG
aatgctgatggagatcattt

SEQ ID NO: 68110 - DNA, 20 bp, Artificial Sequence
  Description of Artificial Sequence: Synthetic oligonucleotide
  Target: ATXN1; (-) strand; PAM type: NRG; PAM sequence: GAG
actaaagtaaaatgctgatg

SEQ ID NO: 68111 - DNA, 20 bp, Artificial Sequence
  Description of Artificial Sequence: Synthetic oligonucleotide
  Target: ATXN1; (-) strand; PAM type: NRG; PAM sequence: TGG
taactaaagtaaaatgctga

SEQ ID NO: 68112 - DNA, 20 bp, Artificial Sequence
  Description of Artificial Sequence: Synthetic oligonucleotide
  Target: ATXN1; (-) strand; PAM type: NRG; PAM sequence: AAG
ctgccacactttgataacta

SEQ ID NO: 68113 - DNA, 20 bp, Artificial Sequence
  Description of Artificial Sequence: Synthetic oligonucleotide
  Target: ATXN1; (-) strand; PAM type: NRG; PAM sequence: GGG
tgcgcttaggtcagatgagc

SEQ ID NO: 68114 - DNA, 20 bp, Artificial Sequence
  Description of Artificial Sequence: Synthetic oligonucleotide
  Target: ATXN1; (-) strand; PAM type: NRG; PAM sequence: CGG
ttgcgcttaggtcagatgag

SEQ ID NO: 68115 - DNA, 20 bp, Artificial Sequence
  Description of Artificial Sequence: Synthetic oligonucleotide
  Target: ATXN1; (-) strand; PAM type: NRG; PAM sequence: GAG
acattgcgcttaggtcagat

SEQ ID NO: 68116 - DNA, 20 bp, Artificial Sequence
  Description of Artificial Sequence: Synthetic oligonucleotide
  Target: ATXN1; (-) strand; PAM type: NRG; PAM sequence: CAG
tattaacattgcgcttaggt

SEQ ID NO: 68117 - DNA, 20 bp, Artificial Sequence
  Description of Artificial Sequence: Synthetic oligonucleotide
  Target: ATXN1; (-) strand; PAM type: NRG; PAM sequence: AGG
gggttattaacattgcgctt

SEQ ID NO: 68118 - DNA, 20 bp, Artificial Sequence
  Description of Artificial Sequence: Synthetic oligonucleotide
  Target: ATXN1; (-) strand; PAM type: NRG; PAM sequence: TAG
tgggttattaacattgcgct

SEQ ID NO: 68119 - DNA, 20 bp, Artificial Sequence
  Description of Artificial Sequence: Synthetic oligonucleotide
  Target: ATXN1; (-) strand; PAM type: NRG; PAM sequence: GGG
cctgcacattctttgtgttt

SEQ ID NO: 68120 - DNA, 20 bp, Artificial Sequence
  Description of Artificial Sequence: Synthetic oligonucleotide
  Target: ATXN1; (-) strand; PAM type: NRG; PAM sequence: TGG
tcctgcacattctttgtgtt

SEQ ID NO: 68121 - DNA, 20 bp, Artificial Sequence
  Description of Artificial Sequence: Synthetic oligonucleotide
  Target: ATXN1; (-) strand; PAM type: NRG; PAM sequence: GAG
ccagcaaggccagtgctctt

SEQ ID NO: 68122 - DNA, 20 bp, Artificial Sequence
  Description of Artificial Sequence: Synthetic oligonucleotide
  Target: ATXN1; (-) strand; PAM type: NRG; PAM sequence: CAG
ccaatggcccccagcaaggc

SEQ ID NO: 68123 - DNA, 20 bp, Artificial Sequence
  Description of Artificial Sequence: Synthetic oligonucleotide
  Target: ATXN1; (-) strand; PAM type: NRG; PAM sequence: AGG
ataaccaatggcccccagca

SEQ ID NO: 68124 - DNA, 20 bp, Artificial Sequence
  Description of Artificial Sequence: Synthetic oligonucleotide
  Target: ATXN1; (-) strand; PAM type: NRG; PAM sequence: AAG
tataaccaatggcccccagc

SEQ ID NO: 68125 - DNA, 20 bp, Artificial Sequence
  Description of Artificial Sequence: Synthetic oligonucleotide
  Target: ATXN1; (-) strand; PAM type: NRG; PAM sequence: CAG
ctgttataaccaatggcccc

SEQ ID NO: 68126 - DNA, 20 bp, Artificial Sequence
  Description of Artificial Sequence: Synthetic oligonucleotide
  Target: ATXN1; (-) strand; PAM type: NRG; PAM sequence: TGG
aatacatctgttataaccaa

SEQ ID NO: 68127 - DNA, 20 bp, Artificial Sequence
  Description of Artificial Sequence: Synthetic oligonucleotide
  Target: ATXN1; (-) strand; PAM type: NRG; PAM sequence: TGG
aggtaataaatgaaaaaagt

SEQ ID NO: 68128 - DNA, 20 bp, Artificial Sequence
  Description of Artificial Sequence: Synthetic oligonucleotide
  Target: ATXN1; (-) strand; PAM type: NRG; PAM sequence: AAG
tctgaggtaataaatgaaaa

SEQ ID NO: 68129 - DNA, 20 bp, Artificial Sequence
  Description of Artificial Sequence: Synthetic oligonucleotide
  Target: ATXN1; (-) strand; PAM type: NRG; PAM sequence: AGG
aataatatgtatctactctg

SEQ ID NO: 68130 - DNA, 20 bp, Artificial Sequence
  Description of Artificial Sequence: Synthetic oligonucleotide
  Target: ATXN1; (-) strand; PAM type: NRG; PAM sequence: GAG
taataatatgtatctactct

SEQ ID NO: 68131 - DNA, 20 bp, Artificial Sequence
  Description of Artificial Sequence: Synthetic oligonucleotide
  Target: ATXN1; (-) strand; PAM type: NRG; PAM sequence: GAG
tgtggataaatttatccgac

SEQ ID NO: 68132 - DNA, 20 bp, Artificial Sequence
  Description of Artificial Sequence: Synthetic oligonucleotide
  Target: ATXN1; (-) strand; PAM type: NRG; PAM sequence: TGG
atttaaattgtgttagactg

SEQ ID NO: 68133 - DNA, 20 bp, Artificial Sequence
  Description of Artificial Sequence: Synthetic oligonucleotide
  Target: ATXN1; (-) strand; PAM type: NRG; PAM sequence: TAG
taactcaatttaaattgtgt

SEQ ID NO: 68134 - DNA, 20 bp, Artificial Sequence
  Description of Artificial Sequence: Synthetic oligonucleotide
  Target: ATXN1; (-) strand; PAM type: NRG; PAM sequence: AAG
gggaatttggaaactcactt

SEQ ID NO: 68135 - DNA, 20 bp, Artificial Sequence
  Description of Artificial Sequence: Synthetic oligonucleotide
  Target: ATXN1; (-) strand; PAM type: NRG; PAM sequence: TGG
catagtaagtttagggaatt

SEQ ID NO: 68136 - DNA, 20 bp, Artificial Sequence
  Description of Artificial Sequence: Synthetic oligonucleotide
  Target: ATXN1; (-) strand; PAM type: NRG; PAM sequence: GGG
atcatgccatagtaagttta

SEQ ID NO: 68137 - DNA, 20 bp, Artificial Sequence
  Description of Artificial Sequence: Synthetic oligonucleotide
  Target: ATXN1; (-) strand; PAM type: NRG; PAM sequence: AGG
catcatgccatagtaagttt

SEQ ID NO: 68138 - DNA, 20 bp, Artificial Sequence
  Description of Artificial Sequence: Synthetic oligonucleotide
  Target: ATXN1; (-) strand; PAM type: NRG; PAM sequence: TAG
acatcatgccatagtaagtt

SEQ ID NO: 68139 - DNA, 20 bp, Artificial Sequence
  Description of Artificial Sequence: Synthetic oligonucleotide
  Target: ATXN1; (-) strand; PAM type: NRG; PAM sequence: AAG
catgtacatcatgccatagt

SEQ ID NO: 68140 - DNA, 20 bp, Artificial Sequence
  Description of Artificial Sequence: Synthetic oligonucleotide
  Target: ATXN1; (-) strand; PAM type: NRG; PAM sequence: TAG
gagacatgtacatcatgcca

SEQ ID NO: 68141 - DNA, 20 bp, Artificial Sequence
  Description of Artificial Sequence: Synthetic oligonucleotide
  Target: ATXN1; (-) strand; PAM type: NRG; PAM sequence: GAG
tgtgaaaagtgctcctcata

SEQ ID NO: 68142 - DNA, 20 bp, Artificial Sequence
  Description of Artificial Sequence: Synthetic oligonucleotide
  Target: ATXN1; (-) strand; PAM type: NRG; PAM sequence: TAG
agtgtgaaaagtgctcctca

SEQ ID NO: 68143 - DNA, 20 bp, Artificial Sequence
  Description of Artificial Sequence: Synthetic oligonucleotide
  Target: ATXN1; (-) strand; PAM type: NRG; PAM sequence: AAG
aatttaccatggagtgtgaa

SEQ ID NO: 68144 - DNA, 20 bp, Artificial Sequence
  Description of Artificial Sequence: Synthetic oligonucleotide
  Target: ATXN1; (-) strand; PAM type: NRG; PAM sequence: GAG
tacgacaaaaatttaccatg

SEQ ID NO: 68145 - DNA, 20 bp, Artificial Sequence
  Description of Artificial Sequence: Synthetic oligonucleotide
  Target: ATXN1; (-) strand; PAM type: NRG; PAM sequence: TGG
agtacgacaaaaatttacca

SEQ ID NO: 68146 - DNA, 20 bp, Artificial Sequence
  Description of Artificial Sequence: Synthetic oligonucleotide
  Target: ATXN1; (-) strand; PAM type: NRG; PAM sequence: GAG
cacaatttagtggagaagat

SEQ ID NO: 68147 - DNA, 20 bp, Artificial Sequence
  Description of Artificial Sequence: Synthetic oligonucleotide
  Target: ATXN1; (-) strand; PAM type: NRG; PAM sequence: AAG
tgggtcacaatttagtggag

SEQ ID NO: 68148 - DNA, 20 bp, Artificial Sequence
  Description of Artificial Sequence: Synthetic oligonucleotide
  Target: ATXN1; (-) strand; PAM type: NRG; PAM sequence: GAG
agctgggtcacaatttagtg

SEQ ID NO: 68149 - DNA, 20 bp, Artificial Sequence
  Description of Artificial Sequence: Synthetic oligonucleotide
  Target: ATXN1; (-) strand; PAM type: NRG; PAM sequence: TGG
agagctgggtcacaatttag

SEQ ID NO: 68150 - DNA, 20 bp, Artificial Sequence
  Description of Artificial Sequence: Synthetic oligonucleotide
  Target: ATXN1; (-) strand; PAM type: NRG; PAM sequence: TAG
atcagagctgggtcacaatt

SEQ ID NO: 68151 - DNA, 20 bp, Artificial Sequence
  Description of Artificial Sequence: Synthetic oligonucleotide
  Target: ATXN1; (-) strand; PAM type: NRG; PAM sequence: GGG
aaatccaggctatcagagct

SEQ ID NO: 68152 - DNA, 20 bp, Artificial Sequence
  Description of Artificial Sequence: Synthetic oligonucleotide
  Target: ATXN1; (-) strand; PAM type: NRG; PAM sequence: TGG
aaaatccaggctatcagagc

SEQ ID NO: 68153 - DNA, 20 bp, Artificial Sequence
  Description of Artificial Sequence: Synthetic oligonucleotide
  Target: ATXN1; (-) strand; PAM type: NRG; PAM sequence: GAG
atgtaaaatccaggctatca

SEQ ID NO: 68154 - DNA, 20 bp, Artificial Sequence
  Description of Artificial Sequence: Synthetic oligonucleotide
  Target: ATXN1; (-) strand; PAM type: NRG; PAM sequence: CAG
tgatgtaaaatccaggctat

SEQ ID NO: 68155 - DNA, 20 bp, Artificial Sequence
  Description of Artificial Sequence: Synthetic oligonucleotide
  Target: ATXN1; (-) strand; PAM type: NRG; PAM sequence: AGG
agataaatgatgtaaaatcc

SEQ ID NO: 68156 - DNA, 20 bp, Artificial Sequence
  Description of Artificial Sequence: Synthetic oligonucleotide
  Target: ATXN1; (-) strand; PAM type: NRG; PAM sequence: CAG
gagataaatgatgtaaaatc

SEQ ID NO: 68157 - DNA, 20 bp, Artificial Sequence
  Description of Artificial Sequence: Synthetic oligonucleotide
  Target: ATXN1; (-) strand; PAM type: NRG; PAM sequence: GAG
ttttgaatgtctgctacaca

SEQ ID NO: 68158 - DNA, 20 bp, Artificial Sequence
  Description of Artificial Sequence: Synthetic oligonucleotide
  Target: ATXN1; (-) strand; PAM type: NRG; PAM sequence: CAG
tattttgaatgtctgctaca

SEQ ID NO: 68159 - DNA, 20 bp, Artificial Sequence
  Description of Artificial Sequence: Synthetic oligonucleotide
  Target: ATXN1; (-) strand; PAM type: NRG; PAM sequence: AGG
cttttatttatgattctctg

SEQ ID NO: 68160 - DNA, 20 bp, Artificial Sequence
  Description of Artificial Sequence: Synthetic oligonucleotide
  Target: ATXN1; (-) strand; PAM type: NRG; PAM sequence: GAG
ccttttatttatgattctct

SEQ ID NO: 68161 - DNA, 20 bp, Artificial Sequence
  Description of Artificial Sequence: Synthetic oligonucleotide
  Target: ATXN1; (-) strand; PAM type: NRG; PAM sequence: AAG
gggacattcacggactcaat

SEQ ID NO: 68162 - DNA, 20 bp, Artificial Sequence
  Description of Artificial Sequence: Synthetic oligonucleotide
  Target: ATXN1; (-) strand; PAM type: NRG; PAM sequence: CGG
ctccaacttggggacattca

SEQ ID NO: 68163 - DNA, 20 bp, Artificial Sequence
  Description of Artificial Sequence: Synthetic oligonucleotide
  Target: ATXN1; (-) strand; PAM type: NRG; PAM sequence: GGG
ctggtgacttctccaacttg

SEQ ID NO: 68164 - DNA, 20 bp, Artificial Sequence
  Description of Artificial Sequence: Synthetic oligonucleotide
  Target: ATXN1; (-) strand; PAM type: NRG; PAM sequence: GGG
gctggtgacttctccaactt

SEQ ID NO: 68165 - DNA, 20 bp, Artificial Sequence
  Description of Artificial Sequence: Synthetic oligonucleotide
  Target: ATXN1; (-) strand; PAM type: NRG; PAM sequence: TGG
tgctggtgacttctccaact

SEQ ID NO: 68166 - DNA, 20 bp, Artificial Sequence
  Description of Artificial Sequence: Synthetic oligonucleotide
  Target: ATXN1; (-) strand; PAM type: NRG; PAM sequence: TGG
gatgttgctctttgaaatgc

SEQ ID NO: 68167 - DNA, 20 bp, Artificial Sequence
  Description of Artificial Sequence: Synthetic oligonucleotide
  Target: ATXN1; (-) strand; PAM type: NRG; PAM sequence: CAG
tttagacaaattttggaatt

SEQ ID NO: 68168 - DNA, 20 bp, Artificial Sequence
  Description of Artificial Sequence: Synthetic oligonucleotide
  Target: ATXN1; (-) strand; PAM type: NRG; PAM sequence: TGG
tttcaattttagacaaattt

SEQ ID NO: 68169 - DNA, 20 bp, Artificial Sequence
  Description of Artificial Sequence: Synthetic oligonucleotide
  Target: ATXN1; (-) strand; PAM type: NRG; PAM sequence: TAG
tataatcatcttttcaattt

SEQ ID NO: 68170 - DNA, 20 bp, Artificial Sequence
  Description of Artificial Sequence: Synthetic oligonucleotide
  Target: ATXN1; (-) strand; PAM type: NRG; PAM sequence: TAG
atctaccaaatttcatggta

SEQ ID NO: 68171 - DNA, 20 bp, Artificial Sequence
  Description of Artificial Sequence: Synthetic oligonucleotide
  Target: ATXN1; (-) strand; PAM type: NRG; PAM sequence: TGG
cagatatctaccaaatttca

SEQ ID NO: 68172 - DNA, 20 bp, Artificial Sequence
  Description of Artificial Sequence: Synthetic oligonucleotide
  Target: ATXN1; (-) strand; PAM type: NRG; PAM sequence: CAG
atgttttaattccttaagaa

SEQ ID NO: 68173 - DNA, 20 bp, Artificial Sequence
  Description of Artificial Sequence: Synthetic oligonucleotide
  Target: ATXN1; (-) strand; PAM type: NRG; PAM sequence: AAG
tttatatgttttaattcctt

SEQ ID NO: 68174 - DNA, 20 bp, Artificial Sequence
  Description of Artificial Sequence: Synthetic oligonucleotide
  Target: ATXN1; (-) strand; PAM type: NRG; PAM sequence: GAG
ttcttcagccaatatcagag

SEQ ID NO: 68175 - DNA, 20 bp, Artificial Sequence
  Description of Artificial Sequence: Synthetic oligonucleotide
  Target: ATXN1; (-) strand; PAM type: NRG; PAM sequence: AGG
ttttcttcagccaatatcag

SEQ ID NO: 68176 - DNA, 20 bp, Artificial Sequence
  Description of Artificial Sequence: Synthetic oligonucleotide
  Target: ATXN1; (-) strand; PAM type: NRG; PAM sequence: GAG
attttcttcagccaatatca

SEQ ID NO: 68177 - DNA, 20 bp, Artificial Sequence
  Description of Artificial Sequence: Synthetic oligonucleotide
  Target: ATXN1; (-) strand; PAM type: NRG; PAM sequence: CAG
tgattttcttcagccaatat

SEQ ID NO: 68178 - DNA, 20 bp, Artificial Sequence
  Description of Artificial Sequence: Synthetic oligonucleotide
  Target: ATXN1; (-) strand; PAM type: NRG; PAM sequence: CAG
tccttgaaaatgattttctt

SEQ ID NO: 68179 - DNA, 20 bp, Artificial Sequence
  Description of Artificial Sequence: Synthetic oligonucleotide
  Target: ATXN1; (-) strand; PAM type: NRG; PAM sequence: GAG
tgaaaatagagctttggtaa

SEQ ID NO: 68180 - DNA, 20 bp, Artificial Sequence
  Description of Artificial Sequence: Synthetic oligonucleotide
  Target: ATXN1; (-) strand; PAM type: NRG; PAM sequence: AAG
gttgaaaatagagctttggt

SEQ ID NO: 68181 - DNA, 20 bp, Artificial Sequence
  Description of Artificial Sequence: Synthetic oligonucleotide
  Target: ATXN1; (-) strand; PAM type: NRG; PAM sequence: TGG
taatgttgaaaatagagctt

SEQ ID NO: 68182 - DNA, 20 bp, Artificial Sequence
  Description of Artificial Sequence: Synthetic oligonucleotide
  Target: ATXN1; (-) strand; PAM type: NRG; PAM sequence: GAG
aagctttaatgttgaaaata

SEQ ID NO: 68183 - DNA, 20 bp, Artificial Sequence
  Description of Artificial Sequence: Synthetic oligonucleotide
  Target: ATXN1; (-) strand; PAM type: NRG; PAM sequence: TAG
ttaagctttaatgttgaaaa

SEQ ID NO: 68184 - DNA, 20 bp, Artificial Sequence
  Description of Artificial Sequence: Synthetic oligonucleotide
  Target: ATXN1; (-) strand; PAM type: NRG; PAM sequence: AAG
ctctctgccccttacatttt

SEQ ID NO: 68185 - DNA, 20 bp, Artificial Sequence
  Description of Artificial Sequence: Synthetic oligonucleotide
  Target: ATXN1; (-) strand; PAM type: NRG; PAM sequence: TGG
cagtatttctcttctggatc

SEQ ID NO: 68186 - DNA, 20 bp, Artificial Sequence
  Description of Artificial Sequence: Synthetic oligonucleotide
  Target: ATXN1; (-) strand; PAM type: NRG; PAM sequence: TGG
agcaatcagtatttctcttc

SEQ ID NO: 68187 - DNA, 20 bp, Artificial Sequence
  Description of Artificial Sequence: Synthetic oligonucleotide
  Target: ATXN1; (-) strand; PAM type: NRG; PAM sequence: CAG
cacccctgaaatatagcaat

SEQ ID NO: 68188 - DNA, 20 bp, Artificial Sequence
  Description of Artificial Sequence: Synthetic oligonucleotide
  Target: ATXN1; (-) strand; PAM type: NRG; PAM sequence: TAG
cttttttcacccctgaaata

SEQ ID NO: 68189 - DNA, 20 bp, Artificial Sequence
  Description of Artificial Sequence: Synthetic oligonucleotide
  Target: ATXN1; (-) strand; PAM type: NRG; PAM sequence: AGG
atacagtattgaaaactttc

SEQ ID NO: 68190 - DNA, 20 bp, Artificial Sequence
  Description of Artificial Sequence: Synthetic oligonucleotide
  Target: ATXN1; (-) strand; PAM type: NRG; PAM sequence: CAG
gatacagtattgaaaacttt

SEQ ID NO: 68191 - DNA, 20 bp, Artificial Sequence
  Description of Artificial Sequence: Synthetic oligonucleotide
  Target: ATXN1; (-) strand; PAM type: NRG; PAM sequence: CAG
tgaagtgatgggcattgata

SEQ ID NO: 68192 - DNA, 20 bp, Artificial Sequence
  Description of Artificial Sequence: Synthetic oligonucleotide
  Target: ATXN1; (-) strand; PAM type: NRG; PAM sequence: GGG
aactttttgagtgaagtgat

SEQ ID NO: 68193 - DNA, 20 bp, Artificial Sequence
  Description of Artificial Sequence: Synthetic oligonucleotide
  Target: ATXN1; (-) strand; PAM type: NRG; PAM sequence: TGG
taactttttgagtgaagtga

SEQ ID NO: 68194 - DNA, 20 bp, Artificial Sequence
  Description of Artificial Sequence: Synthetic oligonucleotide
  Target: ATXN1; (-) strand; PAM type: NRG; PAM sequence: AAG
cttcactaactttttgagtg

SEQ ID NO: 68195 - DNA, 20 bp, Artificial Sequence
  Description of Artificial Sequence: Synthetic oligonucleotide
  Target: ATXN1; (-) strand; PAM type: NRG; PAM sequence: GAG
tactgcttcactaacttttt

SEQ ID NO: 68196 - DNA, 20 bp, Artificial Sequence
  Description of Artificial Sequence: Synthetic oligonucleotide
  Target: ATXN1; (-) strand; PAM type: NRG; PAM sequence: TGG
atgaacccttaacccttcca

SEQ ID NO: 68197 - DNA, 20 bp, Artificial Sequence
  Description of Artificial Sequence: Synthetic oligonucleotide
  Target: ATXN1; (-) strand; PAM type: NRG; PAM sequence: AGG
agatacaatatttatctaaa

SEQ ID NO: 68198 - DNA, 20 bp, Artificial Sequence
  Description of Artificial Sequence: Synthetic oligonucleotide
  Target: ATXN1; (-) strand; PAM type: NRG; PAM sequence: AAG
cagatacaatatttatctaa

SEQ ID NO: 68199 - DNA, 20 bp, Artificial Sequence
  Description of Artificial Sequence: Synthetic oligonucleotide
  Target: ATXN1; (-) strand; PAM type: NRG; PAM sequence: CAG
taagaggttaccttttgctc

SEQ ID NO: 68200 - DNA, 20 bp, Artificial Sequence
  Description of Artificial Sequence: Synthetic oligonucleotide
  Target: ATXN1; (-) strand; PAM type: NRG; PAM sequence: AGG
caatggatgaatctgctaag

SEQ ID NO: 68201 - DNA, 20 bp, Artificial Sequence
  Description of Artificial Sequence: Synthetic oligonucleotide
  Target: ATXN1; (-) strand; PAM type: NRG; PAM sequence: GAG
acaatggatgaatctgctaa

SEQ ID NO: 68202 - DNA, 20 bp, Artificial Sequence
  Description of Artificial Sequence: Synthetic oligonucleotide
  Target: ATXN1; (-) strand; PAM type: NRG; PAM sequence: AAG
cgacaatggatgaatctgct

SEQ ID NO: 68203 - DNA, 20 bp, Artificial Sequence
  Description of Artificial Sequence: Synthetic oligonucleotide
  Target: ATXN1; (-) strand; PAM type: NRG; PAM sequence: TGG
tccaaataagattccgacaa

SEQ ID NO: 68204 - DNA, 20 bp, Artificial Sequence
  Description of Artificial Sequence: Synthetic oligonucleotide
  Target: ATXN1; (-) strand; PAM type: NRG; PAM sequence: AAG
tcgttttgtacagtccaaat

SEQ ID NO: 68205 - DNA, 20 bp, Artificial Sequence
  Description of Artificial Sequence: Synthetic oligonucleotide
  Target: ATXN1; (-) strand; PAM type: NRG; PAM sequence: CAG
gatggggtagtcgttttgta

SEQ ID NO: 68206 - DNA, 20 bp, Artificial Sequence
  Description of Artificial Sequence: Synthetic oligonucleotide
  Target: ATXN1; (-) strand; PAM type: NRG; PAM sequence: TAG
tcttaagtaaaacgatgggg

SEQ ID NO: 68207 - DNA, 20 bp, Artificial Sequence
  Description of Artificial Sequence: Synthetic oligonucleotide
  Target: ATXN1; (-) strand; PAM type: NRG; PAM sequence: GGG
ttctcttaagtaaaacgatg

SEQ ID NO: 68208 - DNA, 20 bp, Artificial Sequence
  Description of Artificial Sequence: Synthetic oligonucleotide
  Target: ATXN1; (-) strand; PAM type: NRG; PAM sequence: GGG
gttctcttaagtaaaacgat

SEQ ID NO: 68209 - DNA, 20 bp, Artificial Sequence
  Description of Artificial Sequence: Synthetic oligonucleotide
  Target: ATXN1; (-) strand; PAM type: NRG; PAM sequence: TGG
tgttctcttaagtaaaacga

SEQ ID NO: 68210 - DNA, 20 bp, Artificial Sequence
  Description of Artificial Sequence: Synthetic oligonucleotide
  Target: ATXN1; (-) strand; PAM type: NRG; PAM sequence: AAG
tccagtgtagatgttctctt

SEQ ID NO: 68211 - DNA, 20 bp, Artificial Sequence
  Description of Artificial Sequence: Synthetic oligonucleotide
  Target: ATXN1; (-) strand; PAM type: NRG; PAM sequence: TAG
ccctccagtagattccagtg

SEQ ID NO: 68212 - DNA, 20 bp, Artificial Sequence
  Description of Artificial Sequence: Synthetic oligonucleotide
  Target: ATXN1; (-) strand; PAM type: NRG; PAM sequence: CAG
ctccaccctccagtagattc

SEQ ID NO: 68213 - DNA, 20 bp, Artificial Sequence
  Description of Artificial Sequence: Synthetic oligonucleotide
  Target: ATXN1; (-) strand; PAM type: NRG; PAM sequence: TAG
ctcccacctccaccctccag

SEQ ID NO: 68214 - DNA, 20 bp, Artificial Sequence
  Description of Artificial Sequence: Synthetic oligonucleotide
  Target: ATXN1; (-) strand; PAM type: NRG; PAM sequence: CAG
gtcctcccacctccaccctc

SEQ ID NO: 68215 - DNA, 20 bp, Artificial Sequence
  Description of Artificial Sequence: Synthetic oligonucleotide
  Target: ATXN1; (-) strand; PAM type: NRG; PAM sequence: TAG
gtactaagcctagtaaccat

SEQ ID NO: 68216 - DNA, 20 bp, Artificial Sequence
  Description of Artificial Sequence: Synthetic oligonucleotide
  Target: ATXN1; (-) strand; PAM type: NRG; PAM sequence: TAG
ttgtcaccaggtactaagcc

SEQ ID NO: 68217 - DNA, 20 bp, Artificial Sequence
  Description of Artificial Sequence: Synthetic oligonucleotide
  Target: ATXN1; (-) strand; PAM type: NRG; PAM sequence: AAG
ttattttgtcaccaggtact

SEQ ID NO: 68218 - DNA, 20 bp, Artificial Sequence
  Description of Artificial Sequence: Synthetic oligonucleotide
  Target: ATXN1; (-) strand; PAM type: NRG; PAM sequence: AGG
ttacagattattttgtcacc

SEQ ID NO: 68219 - DNA, 20 bp, Artificial Sequence
  Description of Artificial Sequence: Synthetic oligonucleotide
  Target: ATXN1; (-) strand; PAM type: NRG; PAM sequence: CAG
tttacagattattttgtcac

SEQ ID NO: 68220 - DNA, 20 bp, Artificial Sequence
  Description of Artificial Sequence: Synthetic oligonucleotide
  Target: ATXN1; (-) strand; PAM type: NRG; PAM sequence: CAG
tgtcatgggggtttgtttta

SEQ ID NO: 68221 - DNA, 20 bp, Artificial Sequence
  Description of Artificial Sequence: Synthetic oligonucleotide
  Target: ATXN1; (-) strand; PAM type: NRG; PAM sequence: GGG
taggtaaacttgtgtcatgg

SEQ ID NO: 68222 - DNA, 20 bp, Artificial Sequence
  Description of Artificial Sequence: Synthetic oligonucleotide
  Target: ATXN1; (-) strand; PAM type: NRG; PAM sequence: GGG
ataggtaaacttgtgtcatg

SEQ ID NO: 68223 - DNA, 20 bp, Artificial Sequence
  Description of Artificial Sequence: Synthetic oligonucleotide
  Target: ATXN1; (-) strand; PAM type: NRG; PAM sequence: GGG
tataggtaaacttgtgtcat

SEQ ID NO: 68224 - DNA, 20 bp, Artificial Sequence
  Description of Artificial Sequence: Synthetic oligonucleotide
  Target: ATXN1; (-) strand; PAM type: NRG; PAM sequence: TGG
atataggtaaacttgtgtca

SEQ ID NO: 68225 - DNA, 20 bp, Artificial Sequence
  Description of Artificial Sequence: Synthetic oligonucleotide
  Target: ATXN1; (-) strand; PAM type: NRG; PAM sequence: AGG
cgtgtgcaggttcgttatat

SEQ ID NO: 68226 - DNA, 20 bp, Artificial Sequence
  Description of Artificial Sequence: Synthetic oligonucleotide
  Target: ATXN1; (-) strand; PAM type: NRG; PAM sequence: TAG
acgtgtgcaggttcgttata

SEQ ID NO: 68227 - DNA, 20 bp, Artificial Sequence
  Description of Artificial Sequence: Synthetic oligonucleotide
  Target: ATXN1; (-) strand; PAM type: NRG; PAM sequence: AGG
aagttcagatgtacgtgtgc

SEQ ID NO: 68228 - DNA, 20 bp, Artificial Sequence
  Description of Artificial Sequence: Synthetic oligonucleotide
  Target: ATXN1; (-) strand; PAM type: NRG; PAM sequence: CAG
taagttcagatgtacgtgtg

SEQ ID NO: 68229 - DNA, 20 bp, Artificial Sequence
  Description of Artificial Sequence: Synthetic oligonucleotide
  Target: ATXN1; (-) strand; PAM type: NRG; PAM sequence: CAG
tttaacttatattttaagtt

SEQ ID NO: 68230 - DNA, 20 bp, Artificial Sequence
  Description of Artificial Sequence: Synthetic oligonucleotide
  Target: ATXN1; (-) strand; PAM type: NRG; PAM sequence: AAG
attcatttaacttatatttt

SEQ ID NO: 68231 - DNA, 20 bp, Artificial Sequence
  Description of Artificial Sequence: Synthetic oligonucleotide
  Target: ATXN1; (-) strand; PAM type: NRG; PAM sequence: TGG
acctgattgacttctatgtg

SEQ ID NO: 68232 - DNA, 20 bp, Artificial Sequence
  Description of Artificial Sequence: Synthetic oligonucleotide
  Target: ATXN1; (-) strand; PAM type: NRG; PAM sequence: AGG
acccgtgaacacagacaccc

SEQ ID NO: 68233 - DNA, 20 bp, Artificial Sequence
  Description of Artificial Sequence: Synthetic oligonucleotide
  Target: ATXN1; (-) strand; PAM type: NRG; PAM sequence: CAG
cacccgtgaacacagacacc

SEQ ID NO: 68234 - DNA, 20 bp, Artificial Sequence
  Description of Artificial Sequence: Synthetic oligonucleotide
  Target: ATXN1; (-) strand; PAM type: NRG; PAM sequence: CAG
cgcatacccacccgtgaaca

SEQ ID NO: 68235 - DNA, 20 bp, Artificial Sequence
  Description of Artificial Sequence: Synthetic oligonucleotide
  Target: ATXN1; (-) strand; PAM type: NRG; PAM sequence: AAG
taagcattgagataatggga

SEQ ID NO: 68236 - DNA, 20 bp, Artificial Sequence
  Description of Artificial Sequence: Synthetic oligonucleotide
  Target: ATXN1; (-) strand; PAM type: NRG; PAM sequence: GGG
ataataagcattgagataat

SEQ ID NO: 68237 - DNA, 20 bp, Artificial Sequence
  Description of Artificial Sequence: Synthetic oligonucleotide
  Target: ATXN1; (-) strand; PAM type: NRG; PAM sequence: TGG
tataataagcattgagataa

SEQ ID NO: 68238 - DNA, 20 bp, Artificial Sequence
  Description of Artificial Sequence: Synthetic oligonucleotide
  Target: ATXN1; (-) strand; PAM type: NRG; PAM sequence: GAG
aattatgtataataagcatt

SEQ ID NO: 68239 - DNA, 20 bp, Artificial Sequence
  Description of Artificial Sequence: Synthetic oligonucleotide
  Target: ATXN1; (-) strand; PAM type: NRG; PAM sequence: AAG
cttaaaaaattatgtataat

SEQ ID NO: 68240 - DNA, 20 bp, Artificial Sequence
  Description of Artificial Sequence: Synthetic oligonucleotide
  Target: ATXN1; (-) strand; PAM type: NRG; PAM sequence: AAG
tttggcagttgaagagtatt

SEQ ID NO: 68241 - DNA, 20 bp, Artificial Sequence
  Description of Artificial Sequence: Synthetic oligonucleotide
  Target: ATXN1; (-) strand; PAM type: NRG; PAM sequence: GAG
ggtatgttttggcagttgaa

SEQ ID NO: 68242 - DNA, 20 bp, Artificial Sequence
  Description of Artificial Sequence: Synthetic oligonucleotide
  Target: ATXN1; (-) strand; PAM type: NRG; PAM sequence: AAG
atggtatgttttggcagttg

SEQ ID NO: 68243 - DNA, 20 bp, Artificial Sequence
  Description of Artificial Sequence: Synthetic oligonucleotide
  Target: ATXN1; (-) strand; PAM type: NRG; PAM sequence: CAG
gtttatatggtatgttttgg

SEQ ID NO: 68244 - DNA, 20 bp, Artificial Sequence
  Description of Artificial Sequence: Synthetic oligonucleotide
  Target: ATXN1; (-) strand; PAM type: NRG; PAM sequence: TGG
agagtttatatggtatgttt

SEQ ID NO: 68245 - DNA, 20 bp, Artificial Sequence
  Description of Artificial Sequence: Synthetic oligonucleotide
  Target: ATXN1; (-) strand; PAM type: NRG; PAM sequence: TGG
ctgtctttgaagagtttata

SEQ ID NO: 68246 - DNA, 20 bp, Artificial Sequence
  Description of Artificial Sequence: Synthetic oligonucleotide
  Target: ATXN1; (-) strand; PAM type: NRG; PAM sequence: GAG
gtatggacactgtctttgaa

SEQ ID NO: 68247 - DNA, 20 bp, Artificial Sequence
  Description of Artificial Sequence: Synthetic oligonucleotide
  Target: ATXN1; (-) strand; PAM type: NRG; PAM sequence: AAG
gtgtatggacactgtctttg

SEQ ID NO: 68248 - DNA, 20 bp, Artificial Sequence
  Description of Artificial Sequence: Synthetic oligonucleotide
  Target: ATXN1; (-) strand; PAM type: NRG; PAM sequence: TGG
agaggacttattaaggtgta

SEQ ID NO: 68249 - DNA, 20 bp, Artificial Sequence
  Description of Artificial Sequence: Synthetic oligonucleotide
  Target: ATXN1; (-) strand; PAM type: NRG; PAM sequence: AGG
agctgttagaggacttatta

SEQ ID NO: 68250 - DNA, 20 bp, Artificial Sequence
  Description of Artificial Sequence: Synthetic oligonucleotide
  Target: ATXN1; (-) strand; PAM type: NRG; PAM sequence: AAG
tagctgttagaggacttatt

SEQ ID NO: 68251 - DNA, 20 bp, Artificial Sequence
  Description of Artificial Sequence: Synthetic oligonucleotide
  Target: ATXN1; (-) strand; PAM type: NRG; PAM sequence: AGG
aaacttatgctagctgttag

SEQ ID NO: 68252 - DNA, 20 bp, Artificial Sequence
  Description of Artificial Sequence: Synthetic oligonucleotide
  Target: ATXN1; (-) strand; PAM type: NRG; PAM sequence: GAG
taaacttatgctagctgtta

SEQ ID NO: 68253 - DNA, 20 bp, Artificial Sequence
  Description of Artificial Sequence: Synthetic oligonucleotide
  Target: ATXN1; (-) strand; PAM type: NRG; PAM sequence: TAG
agtaaacttatgctagctgt

SEQ ID NO: 68254 - DNA, 20 bp, Artificial Sequence
  Description of Artificial Sequence: Synthetic oligonucleotide
  Target: ATXN1; (-) strand; PAM type: NRG; PAM sequence: TAG
tgtatacagtaaacttatgc

SEQ ID NO: 68255 - DNA, 20 bp, Artificial Sequence
  Description of Artificial Sequence: Synthetic oligonucleotide
  Target: ATXN1; (-) strand; PAM type: NRG; PAM sequence: CAG
caataccttgaccatgtata

SEQ ID NO: 68256 - DNA, 20 bp, Artificial Sequence
  Description of Artificial Sequence: Synthetic oligonucleotide
  Target: ATXN1; (-) strand; PAM type: NRG; PAM sequence: TGG
ttgggaattttgagatactg

SEQ ID NO: 68257 - DNA, 20 bp, Artificial Sequence
  Description of Artificial Sequence: Synthetic oligonucleotide
  Target: ATXN1; (-) strand; PAM type: NRG; PAM sequence: GAG
attgccaatttgggaatttt

SEQ ID NO: 68258 - DNA, 20 bp, Artificial Sequence
  Description of Artificial Sequence: Synthetic oligonucleotide
  Target: ATXN1; (-) strand; PAM type: NRG; PAM sequence: GGG
aaggcagtgattgccaattt

SEQ ID NO: 68259 - DNA, 20 bp, Artificial Sequence
  Description of Artificial Sequence: Synthetic oligonucleotide
  Target: ATXN1; (-) strand; PAM type: NRG; PAM sequence: TGG
taaggcagtgattgccaatt

SEQ ID NO: 68260 - DNA, 20 bp, Artificial Sequence
  Description of Artificial Sequence: Synthetic oligonucleotide
  Target: ATXN1; (-) strand; PAM type: NRG; PAM sequence: CAG
gagatgcagctttgctaagg

SEQ ID NO: 68261 - DNA, 20 bp, Artificial Sequence
  Description of Artificial Sequence: Synthetic oligonucleotide
  Target: ATXN1; (-) strand; PAM type: NRG; PAM sequence: AGG
tcagagatgcagctttgcta

SEQ ID NO: 68262 - DNA, 20 bp, Artificial Sequence
  Description of Artificial Sequence: Synthetic oligonucleotide
  Target: ATXN1; (-) strand; PAM type: NRG; PAM sequence: AAG
gtcagagatgcagctttgct

SEQ ID NO: 68263 - DNA, 20 bp, Artificial Sequence
  Description of Artificial Sequence: Synthetic oligonucleotide
  Target: ATXN1; (-) strand; PAM type: NRG; PAM sequence: CAG
ctatctccaggtcagagatg

SEQ ID NO: 68264 - DNA, 20 bp, Artificial Sequence
  Description of Artificial Sequence: Synthetic oligonucleotide
  Target: ATXN1; (-) strand; PAM type: NRG; PAM sequence: GAG
tcccctctatctccaggtca

SEQ ID NO: 68265 - DNA, 20 bp, Artificial Sequence
  Description of Artificial Sequence: Synthetic oligonucleotide
  Target: ATXN1; (-) strand; PAM type: NRG; PAM sequence: CAG
cttcccctctatctccaggt

SEQ ID NO: 68266 - DNA, 20 bp, Artificial Sequence
  Description of Artificial Sequence: Synthetic oligonucleotide
  Target: ATXN1; (-) strand; PAM type: NRG; PAM sequence: AGG
ttctcttcccctctatctcc

SEQ ID NO: 68267 - DNA, 20 bp, Artificial Sequence
  Description of Artificial Sequence: Synthetic oligonucleotide
  Target: ATXN1; (-) strand; PAM type: NRG; PAM sequence: CAG
cttctcttcccctctatctc

SEQ ID NO: 68268 - DNA, 20 bp, Artificial Sequence
  Description of Artificial Sequence: Synthetic oligonucleotide
  Target: ATXN1; (-) strand; PAM type: NRG; PAM sequence: TGG
gctgcctggcaccctaaaga

SEQ ID NO: 68269 - DNA, 20 bp, Artificial Sequence
  Description of Artificial Sequence: Synthetic oligonucleotide
  Target: ATXN1; (-) strand; PAM type: NRG; PAM sequence: AAG
acttgctgcctggcacccta

SEQ ID NO: 68270 - DNA, 20 bp, Artificial Sequence
  Description of Artificial Sequence: Synthetic oligonucleotide
  Target: ATXN1; (-) strand; PAM type: NRG; PAM sequence: TGG
accacaggcaacttgctgcc

SEQ ID NO: 68271 - DNA, 20 bp, Artificial Sequence
  Description of Artificial Sequence: Synthetic oligonucleotide
  Target: ATXN1; (-) strand; PAM type: NRG; PAM sequence: AGG
tgccccgaaacgtagaccac

SEQ ID NO: 68272 - DNA, 20 bp, Artificial Sequence
  Description of Artificial Sequence: Synthetic oligonucleotide
  Target: ATXN1; (-) strand; PAM type: NRG; PAM sequence: CAG
ctgccccgaaacgtagacca

SEQ ID NO: 68273 - DNA, 20 bp, Artificial Sequence
  Description of Artificial Sequence: Synthetic oligonucleotide
  Target: ATXN1; (-) strand; PAM type: NRG; PAM sequence: TAG
gagggacctgccccgaaacg

SEQ ID NO: 68274 - DNA, 20 bp, Artificial Sequence
  Description of Artificial Sequence: Synthetic oligonucleotide
  Target: ATXN1; (-) strand; PAM type: NRG; PAM sequence: GGG
gtgagaggagttatggaaga

SEQ ID NO: 68275 - DNA, 20 bp, Artificial Sequence
  Description of Artificial Sequence: Synthetic oligonucleotide
  Target: ATXN1; (-) strand; PAM type: NRG; PAM sequence: AGG
ggtgagaggagttatggaag

SEQ ID NO: 68276 - DNA, 20 bp, Artificial Sequence
  Description of Artificial Sequence: Synthetic oligonucleotide
  Target: ATXN1; (-) strand; PAM type: NRG; PAM sequence: GAG
tggtgagaggagttatggaa

SEQ ID NO: 68277 - DNA, 20 bp, Artificial Sequence
  Description of Artificial Sequence: Synthetic oligonucleotide
  Target: ATXN1; (-) strand; PAM type: NRG; PAM sequence: AAG
tgtggtgagaggagttatgg

SEQ ID NO: 68278 - DNA, 20 bp, Artificial Sequence
  Description of Artificial Sequence: Synthetic oligonucleotide
  Target: ATXN1; (-) strand; PAM type: NRG; PAM sequence: TGG
agctgtggtgagaggagtta

SEQ ID NO: 68279 - DNA, 20 bp, Artificial Sequence
  Description of Artificial Sequence: Synthetic oligonucleotide
  Target: ATXN1; (-) strand; PAM type: NRG; PAM sequence: GAG
atctttagctgtggtgagag

SEQ ID NO: 68280 - DNA, 20 bp, Artificial Sequence
  Description of Artificial Sequence: Synthetic oligonucleotide
  Target: ATXN1; (-) strand; PAM type: NRG; PAM sequence: AGG
tgatctttagctgtggtgag

SEQ ID NO: 68281 - DNA, 20 bp, Artificial Sequence
  Description of Artificial Sequence: Synthetic oligonucleotide
  Target: ATXN1; (-) strand; PAM type: NRG; PAM sequence: GAG
ctgatctttagctgtggtga

SEQ ID NO: 68282 - DNA, 20 bp, Artificial Sequence
  Description of Artificial Sequence: Synthetic oligonucleotide
  Target: ATXN1; (-) strand; PAM type: NRG; PAM sequence: GAG
ctctgatctttagctgtggt

SEQ ID NO: 68283 - DNA, 20 bp, Artificial Sequence
  Description of Artificial Sequence: Synthetic oligonucleotide
  Target: ATXN1; (-) strand; PAM type: NRG; PAM sequence: TGG
gtagctctgatctttagctg

SEQ ID NO: 68284 - DNA, 20 bp, Artificial Sequence
  Description of Artificial Sequence: Synthetic oligonucleotide
  Target: ATXN1; (-) strand; PAM type: NRG; PAM sequence: TAG
ggtgaagtagctctgatctt

SEQ ID NO: 68285 - DNA, 20 bp, Artificial Sequence
  Description of Artificial Sequence: Synthetic oligonucleotide
  Target: ATXN1; (-) strand; PAM type: NRG; PAM sequence: TAG
cgtactaaactttggtgaag

SEQ ID NO: 68286 - DNA, 20 bp, Artificial Sequence
  Description of Artificial Sequence: Synthetic oligonucleotide
  Target: ATXN1; (-) strand; PAM type: NRG; PAM sequence: AAG
attcgtactaaactttggtg

SEQ ID NO: 68287 - DNA, 20 bp, Artificial Sequence
  Description of Artificial Sequence: Synthetic oligonucleotide
  Target: ATXN1; (-) strand; PAM type: NRG; PAM sequence: TGG
ttcctattcgtactaaactt

SEQ ID NO: 68288 - DNA, 20 bp, Artificial Sequence
  Description of Artificial Sequence: Synthetic oligonucleotide
  Target: ATXN1; (-) strand; PAM type: NRG; PAM sequence: CAG
ggttgcactttttaaagtca

SEQ ID NO: 68289 - DNA, 20 bp, Artificial Sequence
  Description of Artificial Sequence: Synthetic oligonucleotide
  Target: ATXN1; (-) strand; PAM type: NRG; PAM sequence: AAG
tgcctgggttgcacttttta

SEQ ID NO: 68290 - DNA, 20 bp, Artificial Sequence
  Description of Artificial Sequence: Synthetic oligonucleotide
  Target: ATXN1; (-) strand; PAM type: NRG; PAM sequence: GGG
tgagccactgcgtcctgcct

SEQ ID NO: 68291 - DNA, 20 bp, Artificial Sequence
  Description of Artificial Sequence: Synthetic oligonucleotide
  Target: ATXN1; (-) strand; PAM type: NRG; PAM sequence: TGG
gtgagccactgcgtcctgcc

SEQ ID NO: 68292 - DNA, 20 bp, Artificial Sequence
  Description of Artificial Sequence: Synthetic oligonucleotide
  Target: ATXN1; (-) strand; PAM type: NRG; PAM sequence: GAG
agtgttaggattacaggtgt

SEQ ID NO: 68293 - DNA, 20 bp, Artificial Sequence
  Description of Artificial Sequence: Synthetic oligonucleotide
  Target: ATXN1; (-) strand; PAM type: NRG; PAM sequence: AGG
tcccaaagtgttaggattac

SEQ ID NO: 68294 - DNA, 20 bp, Artificial Sequence
  Description of Artificial Sequence: Synthetic oligonucleotide
  Target: ATXN1; (-) strand; PAM type: NRG; PAM sequence: CAG
ctcccaaagtgttaggatta

SEQ ID NO: 68295 - DNA, 20 bp, Artificial Sequence
  Description of Artificial Sequence: Synthetic oligonucleotide
  Target: ATXN1; (-) strand; PAM type: NRG; PAM sequence: AGG
cctcggcctcccaaagtgtt

SEQ ID NO: 68296 - DNA, 20 bp, Artificial Sequence
  Description of Artificial Sequence: Synthetic oligonucleotide
  Target: ATXN1; (-) strand; PAM type: NRG; PAM sequence: TAG
gcctcggcctcccaaagtgt

SEQ ID NO: 68297 - DNA, 20 bp, Artificial Sequence
  Description of Artificial Sequence: Synthetic oligonucleotide
  Target: ATXN1; (-) strand; PAM type: NRG; PAM sequence: AAG
ccactggcctcggcctccca

SEQ ID NO: 68298 - DNA, 20 bp, Artificial Sequence
  Description of Artificial Sequence: Synthetic oligonucleotide
  Target: ATXN1; (-) strand; PAM type: NRG; PAM sequence: CGG
ctcaggtgatccactggcct

SEQ ID NO: 68299 - DNA, 20 bp, Artificial Sequence
  Description of Artificial Sequence: Synthetic oligonucleotide
  Target: ATXN1; (-) strand; PAM type: NRG; PAM sequence: TGG
tctgacctcaggtgatccac

SEQ ID NO: 68300 - DNA, 20 bp, Artificial Sequence
  Description of Artificial Sequence: Synthetic oligonucleotide
  Target: ATXN1; (-) strand; PAM type: NRG; PAM sequence: AGG
ggtcttgaacttctgacctc

SEQ ID NO: 68301 - DNA, 20 bp, Artificial Sequence
  Description of Artificial Sequence: Synthetic oligonucleotide
  Target: ATXN1; (-) strand; PAM type: NRG; PAM sequence: CAG
tggtcttgaacttctgacct

SEQ ID NO: 68302 - DNA, 20 bp, Artificial Sequence
  Description of Artificial Sequence: Synthetic oligonucleotide
  Target: ATXN1; (-) strand; PAM type: NRG; PAM sequence: TGG
tttcgccatgttggccaggc

SEQ ID NO: 68303 - DNA, 20 bp, Artificial Sequence
  Description of Artificial Sequence: Synthetic oligonucleotide
  Target: ATXN1; (-) strand; PAM type: NRG; PAM sequence: AGG
agggtttcgccatgttggcc

SEQ ID NO: 68304 - DNA, 20 bp, Artificial Sequence
  Description of Artificial Sequence: Synthetic oligonucleotide
  Target: ATXN1; (-) strand; PAM type: NRG; PAM sequence: CAG
cagggtttcgccatgttggc

SEQ ID NO: 68305 - DNA, 20 bp, Artificial Sequence
  Description of Artificial Sequence: Synthetic oligonucleotide
  Target: ATXN1; (-) strand; PAM type: NRG; PAM sequence: TGG
gagacagggtttcgccatgt

SEQ ID NO: 68306 - DNA, 20 bp, Artificial Sequence
  Description of Artificial Sequence: Synthetic oligonucleotide
  Target: ATXN1; (-) strand; PAM type: NRG; PAM sequence: GGG
ttgtatatttagtagagaca

SEQ ID NO: 68307 - DNA, 20 bp, Artificial Sequence
  Description of Artificial Sequence: Synthetic oligonucleotide
  Target: ATXN1; (-) strand; PAM type: NRG; PAM sequence: AGG
tttgtatatttagtagagac

SEQ ID NO: 68308 - DNA, 20 bp, Artificial Sequence
  Description of Artificial Sequence: Synthetic oligonucleotide
  Target: ATXN1; (-) strand; PAM type: NRG; PAM sequence: CAG
ttttgtatatttagtagaga

SEQ ID NO: 68309 - DNA, 20 bp, Artificial Sequence
  Description of Artificial Sequence: Synthetic oligonucleotide
  Target: ATXN1; (-) strand; PAM type: NRG; PAM sequence: GAG
tcatttttgtatatttagta

SEQ ID NO: 68310 - DNA, 20 bp, Artificial Sequence
  Description of Artificial Sequence: Synthetic oligonucleotide
  Target: ATXN1; (-) strand; PAM type: NRG; PAM sequence: TAG
gctcatttttgtatatttag

SEQ ID NO: 68311 - DNA, 20 bp, Artificial Sequence
  Description of Artificial Sequence: Synthetic oligonucleotide
  Target: ATXN1; (-) strand; PAM type: NRG; PAM sequence: TAG
ccagctcatttttgtatatt

SEQ ID NO: 68312 - DNA, 20 bp, Artificial Sequence
  Description of Artificial Sequence: Synthetic oligonucleotide
  Target: ATXN1; (-) strand; PAM type: NRG; PAM sequence: CAG
caggtgtctgccaccacgcc

SEQ ID NO: 68313 - DNA, 20 bp, Artificial Sequence
  Description of Artificial Sequence: Synthetic oligonucleotide
  Target: ATXN1; (-) strand; PAM type: NRG; PAM sequence: AGG
tcctgagtagctgagattac

SEQ ID NO: 68314 - DNA, 20 bp, Artificial Sequence
  Description of Artificial Sequence: Synthetic oligonucleotide
  Target: ATXN1; (-) strand; PAM type: NRG; PAM sequence: CAG
ctcctgagtagctgagatta

SEQ ID NO: 68315 - DNA, 20 bp, Artificial Sequence
  Description of Artificial Sequence: Synthetic oligonucleotide
  Target: ATXN1; (-) strand; PAM type: NRG; PAM sequence: GAG
cctcagcctcctgagtagct

SEQ ID NO: 68316 - DNA, 20 bp, Artificial Sequence
  Description of Artificial Sequence: Synthetic oligonucleotide
  Target: ATXN1; (-) strand; PAM type: NRG; PAM sequence: TAG
tcctgcctcagcctcctgag

SEQ ID NO: 68317 - DNA, 20 bp, Artificial Sequence
  Description of Artificial Sequence: Synthetic oligonucleotide
  Target: ATXN1; (-) strand; PAM type: NRG; PAM sequence: GAG
ttctcctgcctcagcctcct

SEQ ID NO: 68318 - DNA, 20 bp, Artificial Sequence
  Description of Artificial Sequence: Synthetic oligonucleotide
  Target: ATXN1; (-) strand; PAM type: NRG; PAM sequence: CAG
ttcaagcaattctcctgcct

SEQ ID NO: 68319 - DNA, 20 bp, Artificial Sequence
  Description of Artificial Sequence: Synthetic oligonucleotide
  Target: ATXN1; (-) strand; PAM type: NRG; PAM sequence: AAG
aacctccacatcccaggttc

SEQ ID NO: 68320 - DNA, 20 bp, Artificial Sequence
  Description of Artificial Sequence: Synthetic oligonucleotide
  Target: ATXN1; (-) strand; PAM type: NRG; PAM sequence: AGG
cactgcaacctccacatccc

SEQ ID NO: 68321 - DNA, 20 bp, Artificial Sequence
  Description of Artificial Sequence: Synthetic oligonucleotide
  Target: ATXN1; (-) strand; PAM type: NRG; PAM sequence: CAG
tcactgcaacctccacatcc

SEQ ID NO: 68322 - DNA, 20 bp, Artificial Sequence
  Description of Artificial Sequence: Synthetic oligonucleotide
  Target: ATXN1; (-) strand; PAM type: NRG; PAM sequence: CGG
ggagtgcaatggcatgatct

SEQ ID NO: 68323 - DNA, 20 bp, Artificial Sequence
  Description of Artificial Sequence: Synthetic oligonucleotide
  Target: ATXN1; (-) strand; PAM type: NRG; PAM sequence: TGG
tttcccaggctggagtgcaa

SEQ ID NO: 68324 - DNA, 20 bp, Artificial Sequence
  Description of Artificial Sequence: Synthetic oligonucleotide
  Target: ATXN1; (-) strand; PAM type: NRG; PAM sequence: GAG
cgctcttgtttcccaggctg

SEQ ID NO: 68325 - DNA, 20 bp, Artificial Sequence
  Description of Artificial Sequence: Synthetic oligonucleotide
  Target: ATXN1; (-) strand; PAM type: NRG; PAM sequence: TGG
ttcgctcttgtttcccaggc

SEQ ID NO: 68326 - DNA, 20 bp, Artificial Sequence
  Description of Artificial Sequence: Synthetic oligonucleotide
  Target: ATXN1; (-) strand; PAM type: NRG; PAM sequence: AGG
cagtttcgctcttgtttccc

SEQ ID NO: 68327 - DNA, 20 bp, Artificial Sequence
  Description of Artificial Sequence: Synthetic oligonucleotide
  Target: ATXN1; (-) strand; PAM type: NRG; PAM sequence: CAG
acagtttcgctcttgtttcc

SEQ ID NO: 68328 - DNA, 20 bp, Artificial Sequence
  Description of Artificial Sequence: Synthetic oligonucleotide
  Target: ATXN1; (-) strand; PAM type: NRG; PAM sequence: CAG
ttttttttttttttgagaca

SEQ ID NO: 68329 - DNA, 20 bp, Artificial Sequence
  Description of Artificial Sequence: Synthetic oligonucleotide
  Target: ATXN1; (-) strand; PAM type: NRG; PAM sequence: GAG
cttttttttttttttttttt

SEQ ID NO: 68330 - DNA, 20 bp, Artificial Sequence
  Description of Artificial Sequence: Synthetic oligonucleotide
  Target: ATXN1; (-) strand; PAM type: NRG; PAM sequence: TAG
caaaaggtttctaacatggg

SEQ ID NO: 68331 - DNA, 20 bp, Artificial Sequence
  Description of Artificial Sequence: Synthetic oligonucleotide
  Target: ATXN1; (-) strand; PAM type: NRG; PAM sequence: GGG
gaccaaaaggtttctaacat

SEQ ID NO: 68332 - DNA, 20 bp, Artificial Sequence
  Description of Artificial Sequence: Synthetic oligonucleotide
  Target: ATXN1; (-) strand; PAM type: NRG; PAM sequence: TGG
tgaccaaaaggtttctaaca

SEQ ID NO: 68333 - DNA, 20 bp, Artificial Sequence
  Description of Artificial Sequence: Synthetic oligonucleotide
  Target: ATXN1; (-) strand; PAM type: NRG; PAM sequence: AGG
tgttaccagatgtgaccaaa

SEQ ID NO: 68334 - DNA, 20 bp, Artificial Sequence
  Description of Artificial Sequence: Synthetic oligonucleotide
  Target: ATXN1; (-) strand; PAM type: NRG; PAM sequence: AAG
ctgttaccagatgtgaccaa

SEQ ID NO: 68335 - DNA, 20 bp, Artificial Sequence
  Description of Artificial Sequence: Synthetic oligonucleotide
  Target: ATXN1; (-) strand; PAM type: NRG; PAM sequence: CAG
agcaccactggggctgttac

SEQ ID NO: 68336 - DNA, 20 bp, Artificial Sequence
  Description of Artificial Sequence: Synthetic oligonucleotide
  Target: ATXN1; (-) strand; PAM type: NRG; PAM sequence: GGG
tcatgtccttagcaccactg

SEQ ID NO: 68337 - DNA, 20 bp, Artificial Sequence
  Description of Artificial Sequence: Synthetic oligonucleotide
  Target: ATXN1; (-) strand; PAM type: NRG; PAM sequence: GGG
ttcatgtccttagcaccact

SEQ ID NO: 68338 - DNA, 20 bp, Artificial Sequence
  Description of Artificial Sequence: Synthetic oligonucleotide
  Target: ATXN1; (-) strand; PAM type: NRG; PAM sequence: TGG
tttcatgtccttagcaccac

SEQ ID NO: 68339 - DNA, 20 bp, Artificial Sequence
  Description of Artificial Sequence: Synthetic oligonucleotide
  Target: ATXN1; (-) strand; PAM type: NRG; PAM sequence: TAG
ggcaatggctttcatgtcct

SEQ ID NO: 68340 - DNA, 20 bp, Artificial Sequence
  Description of Artificial Sequence: Synthetic oligonucleotide
  Target: ATXN1; (-) strand; PAM type: NRG; PAM sequence: TGG
ttgttttttgattggggcaa

SEQ ID NO: 68341 - DNA, 20 bp, Artificial Sequence
  Description of Artificial Sequence: Synthetic oligonucleotide
  Target: ATXN1; (-) strand; PAM type: NRG; PAM sequence: GGG
ttgcctttgttttttgattg

SEQ ID NO: 68342 - DNA, 20 bp, Artificial Sequence
  Description of Artificial Sequence: Synthetic oligonucleotide
  Target: ATXN1; (-) strand; PAM type: NRG; PAM sequence: GGG
tttgcctttgttttttgatt

SEQ ID NO: 68343 - DNA, 20 bp, Artificial Sequence
  Description of Artificial Sequence: Synthetic oligonucleotide
  Target: ATXN1; (-) strand; PAM type: NRG; PAM sequence: TGG
ctttgcctttgttttttgat

SEQ ID NO: 68344 - DNA, 20 bp, Artificial Sequence
  Description of Artificial Sequence: Synthetic oligonucleotide
  Target: ATXN1; (-) strand; PAM type: NRG; PAM sequence: GAG
gaattccaattttgtgtcca

SEQ ID NO: 68345 - DNA, 20 bp, Artificial Sequence
  Description of Artificial Sequence: Synthetic oligonucleotide
  Target: ATXN1; (-) strand; PAM type: NRG; PAM sequence: CAG
ctgaattccaattttgtgtc

SEQ ID NO: 68346 - DNA, 20 bp, Artificial Sequence
  Description of Artificial Sequence: Synthetic oligonucleotide
  Target: ATXN1; (-) strand; PAM type: NRG; PAM sequence: AAG
cctgttacattactgctttt

SEQ ID NO: 68347 - DNA, 20 bp, Artificial Sequence
  Description of Artificial Sequence: Synthetic oligonucleotide
  Target: ATXN1; (-) strand; PAM type: NRG; PAM sequence: TAG
taagtatttactgaataaga

SEQ ID NO: 68348 - DNA, 20 bp, Artificial Sequence
  Description of Artificial Sequence: Synthetic oligonucleotide
  Target: ATXN1; (-) strand; PAM type: NRG; PAM sequence: AAG
gttttaagtatttactgaat

SEQ ID NO: 68349 - DNA, 20 bp, Artificial Sequence
  Description of Artificial Sequence: Synthetic oligonucleotide
  Target: ATXN1; (-) strand; PAM type: NRG; PAM sequence: AAG
gtagtagatattactgtttt

SEQ ID NO: 68350 - DNA, 20 bp, Artificial Sequence
  Description of Artificial Sequence: Synthetic oligonucleotide
  Target: ATXN1; (-) strand; PAM type: NRG; PAM sequence: TAG
aaacaataaagcttatgtag

SEQ ID NO: 68351 - DNA, 20 bp, Artificial Sequence
  Description of Artificial Sequence: Synthetic oligonucleotide
  Target: ATXN1; (-) strand; PAM type: NRG; PAM sequence: TAG
tgaaaacaataaagcttatg

SEQ ID NO: 68352 - DNA, 20 bp, Artificial Sequence
  Description of Artificial Sequence: Synthetic oligonucleotide
  Target: ATXN1; (-) strand; PAM type: NRG; PAM sequence: AAG
tattcactttgaaaacaata

SEQ ID NO: 68353 - DNA, 20 bp, Artificial Sequence
  Description of Artificial Sequence: Synthetic oligonucleotide
  Target: ATXN1; (-) strand; PAM type: NRG; PAM sequence: AAG
aatgtagtgatgttgactgc

SEQ ID NO: 68354 - DNA, 20 bp, Artificial Sequence
  Description of Artificial Sequence: Synthetic oligonucleotide
  Target: ATXN1; (-) strand; PAM type: NRG; PAM sequence: TAG
ttagaaccgtatatataatg

SEQ ID NO: 68355 - DNA, 20 bp, Artificial Sequence
  Description of Artificial Sequence: Synthetic oligonucleotide
  Target: ATXN1; (-) strand; PAM type: NRG; PAM sequence: TAG
tgtttaagaaatactatttt

SEQ ID NO: 68356 - DNA, 20 bp, Artificial Sequence
  Description of Artificial Sequence: Synthetic oligonucleotide
  Target: ATXN1; (-) strand; PAM type: NRG; PAM sequence: AAG
tttggctgttctaggtgttt

SEQ ID NO: 68357 - DNA, 20 bp, Artificial Sequence
  Description of Artificial Sequence: Synthetic oligonucleotide
  Target: ATXN1; (-) strand; PAM type: NRG; PAM sequence: AGG
tgccaacctttggctgttct

SEQ ID NO: 68358 - DNA, 20 bp, Artificial Sequence
  Description of Artificial Sequence: Synthetic oligonucleotide
  Target: ATXN1; (-) strand; PAM type: NRG; PAM sequence: TAG
ttgccaacctttggctgttc

SEQ ID NO: 68359 - DNA, 20 bp, Artificial Sequence
  Description of Artificial Sequence: Synthetic oligonucleotide
  Target: ATXN1; (-) strand; PAM type: NRG; PAM sequence: TGG
agaaaaagtttgccaacctt

SEQ ID NO: 68360 - DNA, 20 bp, Artificial Sequence
  Description of Artificial Sequence: Synthetic oligonucleotide
  Target: ATXN1; (-) strand; PAM type: NRG; PAM sequence: AAG
tccctggtcctttatagaaa

SEQ ID NO: 68361 - DNA, 20 bp, Artificial Sequence
  Description of Artificial Sequence: Synthetic oligonucleotide
  Target: ATXN1; (-) strand; PAM type: NRG; PAM sequence: TAG
atttgctccctggtccttta

SEQ ID NO: 68362 - DNA, 20 bp, Artificial Sequence
  Description of Artificial Sequence: Synthetic oligonucleotide
  Target: ATXN1; (-) strand; PAM type: NRG; PAM sequence: TGG
agcctaaagcatttgctccc

SEQ ID NO: 68363 - DNA, 20 bp, Artificial Sequence
  Description of Artificial Sequence: Synthetic oligonucleotide
  Target: ATXN1; (-) strand; PAM type: NRG; PAM sequence: AAG
tgtctggcccacacagccta

SEQ ID NO: 68364 - DNA, 20 bp, Artificial Sequence
  Description of Artificial Sequence: Synthetic oligonucleotide
  Target: ATXN1; (-) strand; PAM type: NRG; PAM sequence: CAG
atggagatgtctggcccaca

SEQ ID NO: 68365 - DNA, 20 bp, Artificial Sequence
  Description of Artificial Sequence: Synthetic oligonucleotide
  Target: ATXN1; (-) strand; PAM type: NRG; PAM sequence: TGG
gtagttgcaatggagatgtc

SEQ ID NO: 68366 - DNA, 20 bp, Artificial Sequence
  Description of Artificial Sequence: Synthetic oligonucleotide
  Target: ATXN1; (-) strand; PAM type: NRG; PAM sequence: GAG
cagattgagtagttgcaatg

SEQ ID NO: 68367 - DNA, 20 bp, Artificial Sequence
  Description of Artificial Sequence: Synthetic oligonucleotide
  Target: ATXN1; (-) strand; PAM type: NRG; PAM sequence: TGG
gacagattgagtagttgcaa

SEQ ID NO: 68368 - DNA, 20 bp, Artificial Sequence
  Description of Artificial Sequence: Synthetic oligonucleotide
  Target: ATXN1; (-) strand; PAM type: NRG; PAM sequence: TAG
cacgacaatgacagattgag

SEQ ID NO: 68369 - DNA, 20 bp, Artificial Sequence
  Description of Artificial Sequence: Synthetic oligonucleotide
  Target: ATXN1; (-) strand; PAM type: NRG; PAM sequence: GAG
ttgcacgacaatgacagatt

SEQ ID NO: 68370 - DNA, 20 bp, Artificial Sequence
  Description of Artificial Sequence: Synthetic oligonucleotide
  Target: ATXN1; (-) strand; PAM type: NRG; PAM sequence: CAG
ctgcttttgcacgacaatga

SEQ ID NO: 68371 - DNA, 20 bp, Artificial Sequence
  Description of Artificial Sequence: Synthetic oligonucleotide
  Target: ATXN1; (-) strand; PAM type: NRG; PAM sequence: GAG
accgacatgcctgtttgtat

SEQ ID NO: 68372 - DNA, 20 bp, Artificial Sequence
  Description of Artificial Sequence: Synthetic oligonucleotide
  Target: ATXN1; (-) strand; PAM type: NRG; PAM sequence: TGG
ttctgtaaattaagttttat

SEQ ID NO: 68373 - DNA, 20 bp, Artificial Sequence
  Description of Artificial Sequence: Synthetic oligonucleotide
  Target: ATXN1; (-) strand; PAM type: NRG; PAM sequence: AAG
ccagcctgtttctgtaaatt

SEQ ID NO: 68374 - DNA, 20 bp, Artificial Sequence
  Description of Artificial Sequence: Synthetic oligonucleotide
  Target: ATXN1; (-) strand; PAM type: NRG; PAM sequence: CAG
ccatgggccaaatatcaccc

SEQ ID NO: 68375 - DNA, 20 bp, Artificial Sequence
  Description of Artificial Sequence: Synthetic oligonucleotide
  Target: ATXN1; (-) strand; PAM type: NRG; PAM sequence: GGG
gtattgacaaactggaccat

SEQ ID NO: 68376 - DNA, 20 bp, Artificial Sequence
  Description of Artificial Sequence: Synthetic oligonucleotide
  Target: ATXN1; (-) strand; PAM type: NRG; PAM sequence: TGG
ggtattgacaaactggacca

SEQ ID NO: 68377 - DNA, 20 bp, Artificial Sequence
  Description of Artificial Sequence: Synthetic oligonucleotide
  Target: ATXN1; (-) strand; PAM type: NRG; PAM sequence: TGG
tagaccaggtattgacaaac

SEQ ID NO: 68378 - DNA, 20 bp, Artificial Sequence
  Description of Artificial Sequence: Synthetic oligonucleotide
  Target: ATXN1; (-) strand; PAM type: NRG; PAM sequence: AGG
gtgtaataatattctagacc

SEQ ID NO: 68379 - DNA, 20 bp, Artificial Sequence
  Description of Artificial Sequence: Synthetic oligonucleotide
  Target: ATXN1; (-) strand; PAM type: NRG; PAM sequence: CAG
agtgtaataatattctagac

SEQ ID NO: 68380 - DNA, 20 bp, Artificial Sequence
  Description of Artificial Sequence: Synthetic oligonucleotide
  Target: ATXN1; (-) strand; PAM type: NRG; PAM sequence: TAG
ttttcagtgtaataatattc

SEQ ID NO: 68381 - DNA, 20 bp, Artificial Sequence
  Description of Artificial Sequence: Synthetic oligonucleotide
  Target: ATXN1; (-) strand; PAM type: NRG; PAM sequence: CAG
gagtccatcttataattttt

SEQ ID NO: 68382 - DNA, 20 bp, Artificial Sequence
  Description of Artificial Sequence: Synthetic oligonucleotide
  Target: ATXN1; (-) strand; PAM type: NRG; PAM sequence: GAG
gaggaaaggaaggaagttga

SEQ ID NO: 68383 - DNA, 20 bp, Artificial Sequence
  Description of Artificial Sequence: Synthetic oligonucleotide
  Target: ATXN1; (-) strand; PAM type: NRG; PAM sequence: GAG
tagaggaaaggaaggaagtt

SEQ ID NO: 68384 - DNA, 20 bp, Artificial Sequence
  Description of Artificial Sequence: Synthetic oligonucleotide
  Target: ATXN1; (-) strand; PAM type: NRG; PAM sequence: AAG
ctctttagaggaaaggaagg

SEQ ID NO: 68385 - DNA, 20 bp, Artificial Sequence
  Description of Artificial Sequence: Synthetic oligonucleotide
  Target: ATXN1; (-) strand; PAM type: NRG; PAM sequence: AGG
aatctctttagaggaaagga

SEQ ID NO: 68386 - DNA, 20 bp, Artificial Sequence
  Description of Artificial Sequence: Synthetic oligonucleotide
  Target: ATXN1; (-) strand; PAM type: NRG; PAM sequence: AAG
taatctctttagaggaaagg

SEQ ID NO: 68387 - DNA, 20 bp, Artificial Sequence
  Description of Artificial Sequence: Synthetic oligonucleotide
  Target: ATXN1; (-) strand; PAM type: NRG; PAM sequence: AGG
aaataatctctttagaggaa

SEQ ID NO: 68388 - DNA, 20 bp, Artificial Sequence
  Description of Artificial Sequence: Synthetic oligonucleotide
  Target: ATXN1; (-) strand; PAM type: NRG; PAM sequence: AAG
aaaataatctctttagagga

SEQ ID NO: 68389 - DNA, 20 bp, Artificial Sequence
  Description of Artificial Sequence: Synthetic oligonucleotide
  Target: ATXN1; (-) strand; PAM type: NRG; PAM sequence: AGG
aagaaaaataatctctttag

SEQ ID NO: 68390 - DNA, 20 bp, Artificial Sequence
  Description of Artificial Sequence: Synthetic oligonucleotide
  Target: ATXN1; (-) strand; PAM type: NRG; PAM sequence: GAG
taagaaaaataatctcttta

SEQ ID NO: 68391 - DNA, 20 bp, Artificial Sequence
  Description of Artificial Sequence: Synthetic oligonucleotide
  Target: ATXN1; (-) strand; PAM type: NRG; PAM sequence: TAG
actaagaaaaataatctctt

SEQ ID NO: 68392 - DNA, 20 bp, Artificial Sequence
  Description of Artificial Sequence: Synthetic oligonucleotide
  Target: ATXN1; (-) strand; PAM type: NRG; PAM sequence: AAG
ttgtcatctaacttttcact

SEQ ID NO: 68393 - DNA, 20 bp, Artificial Sequence
  Description of Artificial Sequence: Synthetic oligonucleotide
  Target: ATXN1; (-) strand; PAM type: NRG; PAM sequence: TGG
aatataccaccgactgcttt

SEQ ID NO: 68394 - DNA, 20 bp, Artificial Sequence
  Description of Artificial Sequence: Synthetic oligonucleotide
  Target: ATXN1; (-) strand; PAM type: NRG; PAM sequence: CAG
aggttcagtggtggatgctg

SEQ ID NO: 68395 - DNA, 20 bp, Artificial Sequence
  Description of Artificial Sequence: Synthetic oligonucleotide
  Target: ATXN1; (-) strand; PAM type: NRG; PAM sequence: TGG
tcatggacgaggttcagtgg

SEQ ID NO: 68396 - DNA, 20 bp, Artificial Sequence
  Description of Artificial Sequence: Synthetic oligonucleotide
  Target: ATXN1; (-) strand; PAM type: NRG; PAM sequence: TGG
ttatcatggacgaggttcag

SEQ ID NO: 68397 - DNA, 20 bp, Artificial Sequence
  Description of Artificial Sequence: Synthetic oligonucleotide
  Target: ATXN1; (-) strand; PAM type: NRG; PAM sequence: CAG
tgcttatcatggacgaggtt

SEQ ID NO: 68398 - DNA, 20 bp, Artificial Sequence
  Description of Artificial Sequence: Synthetic oligonucleotide
  Target: ATXN1; (-) strand; PAM type: NRG; PAM sequence: AGG
atatctgcttatcatggacg

SEQ ID NO: 68399 - DNA, 20 bp, Artificial Sequence
  Description of Artificial Sequence: Synthetic oligonucleotide
  Target: ATXN1; (-) strand; PAM type: NRG; PAM sequence: GAG
catatctgcttatcatggac

SEQ ID NO: 68400 - DNA, 20 bp, Artificial Sequence
  Description of Artificial Sequence: Synthetic oligonucleotide
  Target: ATXN1; (-) strand; PAM type: NRG; PAM sequence: TGG
ttgcccatatctgcttatca

SEQ ID NO: 68401 - DNA, 20 bp, Artificial Sequence
  Description of Artificial Sequence: Synthetic oligonucleotide
  Target: ATXN1; (-) strand; PAM type: NRG; PAM sequence: CAG
aaaactgcacctggaattct

SEQ ID NO: 68402 - DNA, 20 bp, Artificial Sequence
  Description of Artificial Sequence: Synthetic oligonucleotide
  Target: ATXN1; (-) strand; PAM type: NRG; PAM sequence: TGG
taccactggaaaactgcacc

SEQ ID NO: 68403 - DNA, 20 bp, Artificial Sequence
  Description of Artificial Sequence: Synthetic oligonucleotide
  Target: ATXN1; (-) strand; PAM type: NRG; PAM sequence: TGG
aatatgtagagacttaccac

SEQ ID NO: 68404 - DNA, 20 bp, Artificial Sequence
  Description of Artificial Sequence: Synthetic oligonucleotide
  Target: ATXN1; (-) strand; PAM type: NRG; PAM sequence: GAG
aatgcagagatgaatatgta

SEQ ID NO: 68405 - DNA, 20 bp, Artificial Sequence
  Description of Artificial Sequence: Synthetic oligonucleotide
  Target: ATXN1; (-) strand; PAM type: NRG; PAM sequence: TAG
gtaatgcagagatgaatatg

SEQ ID NO: 68406 - DNA, 20 bp, Artificial Sequence
  Description of Artificial Sequence: Synthetic oligonucleotide
  Target: ATXN1; (-) strand; PAM type: NRG; PAM sequence: GAG
ctttgcacatatgtaatgca

SEQ ID NO: 68407 - DNA, 20 bp, Artificial Sequence
  Description of Artificial Sequence: Synthetic oligonucleotide
  Target: ATXN1; (-) strand; PAM type: NRG; PAM sequence: CAG
ccctttgcacatatgtaatg

SEQ ID NO: 68408 - DNA, 20 bp, Artificial Sequence
  Description of Artificial Sequence: Synthetic oligonucleotide
  Target: ATXN1; (-) strand; PAM type: NRG; PAM sequence: CAG
ttatctggggttccatgggg

SEQ ID NO: 68409 - DNA, 20 bp, Artificial Sequence
  Description of Artificial Sequence: Synthetic oligonucleotide
  Target: ATXN1; (-) strand; PAM type: NRG; PAM sequence: GGG
catttatctggggttccatg

SEQ ID NO: 68410 - DNA, 20 bp, Artificial Sequence
  Description of Artificial Sequence: Synthetic oligonucleotide
  Target: ATXN1; (-) strand; PAM type: NRG; PAM sequence: GGG
gcatttatctggggttccat

SEQ ID NO: 68411 - DNA, 20 bp, Artificial Sequence
  Description of Artificial Sequence: Synthetic oligonucleotide
  Target: ATXN1; (-) strand; PAM type: NRG; PAM sequence: TGG
agcatttatctggggttcca

SEQ ID NO: 68412 - DNA, 20 bp, Artificial Sequence
  Description of Artificial Sequence: Synthetic oligonucleotide
  Target: ATXN1; (-) strand; PAM type: NRG; PAM sequence: GGG
ggctatttagcatttatctg

SEQ ID NO: 68413 - DNA, 20 bp, Artificial Sequence
  Description of Artificial Sequence: Synthetic oligonucleotide
  Target: ATXN1; (-) strand; PAM type: NRG; PAM sequence: GGG
aggctatttagcatttatct

SEQ ID NO: 68414 - DNA, 20 bp, Artificial Sequence
  Description of Artificial Sequence: Synthetic oligonucleotide
  Target: ATXN1; (-) strand; PAM type: NRG; PAM sequence: TGG
gaggctatttagcatttatc

SEQ ID NO: 68415 - DNA, 20 bp, Artificial Sequence
  Description of Artificial Sequence: Synthetic oligonucleotide
  Target: ATXN1; (-) strand; PAM type: NRG; PAM sequence: TAG
cactacttcaagaggctatt

SEQ ID NO: 68416 - DNA, 20 bp, Artificial Sequence
  Description of Artificial Sequence: Synthetic oligonucleotide
  Target: ATXN1; (-) strand; PAM type: NRG; PAM sequence: AGG
agatagtacactacttcaag

SEQ ID NO: 68417 - DNA, 20 bp, Artificial Sequence
  Description of Artificial Sequence: Synthetic oligonucleotide
  Target: ATXN1; (-) strand; PAM type: NRG; PAM sequence: GAG
tagatagtacactacttcaa

SEQ ID NO: 68418 - DNA, 20 bp, Artificial Sequence
  Description of Artificial Sequence: Synthetic oligonucleotide
  Target: ATXN1; (-) strand; PAM type: NRG; PAM sequence: AAG
cctagatagtacactacttc

SEQ ID NO: 68419 - DNA, 20 bp, Artificial Sequence
  Description of Artificial Sequence: Synthetic oligonucleotide
  Target: ATXN1; (-) strand; PAM type: NRG; PAM sequence: TAG
agtcttcttgcatgcctaga

SEQ ID NO: 68420 - DNA, 20 bp, Artificial Sequence
  Description of Artificial Sequence: Synthetic oligonucleotide
  Target: ATXN1; (-) strand; PAM type: NRG; PAM sequence: TAG
caagagtcttcttgcatgcc

SEQ ID NO: 68421 - DNA, 20 bp, Artificial Sequence
  Description of Artificial Sequence: Synthetic oligonucleotide
  Target: ATXN1; (-) strand; PAM type: NRG; PAM sequence: GAG
tgttttttgttgttgctcaa

SEQ ID NO: 68422 - DNA, 20 bp, Artificial Sequence
  Description of Artificial Sequence: Synthetic oligonucleotide
  Target: ATXN1; (-) strand; PAM type: NRG; PAM sequence: AAG
tttgttttttgttgttgctc

SEQ ID NO: 68423 - DNA, 20 bp, Artificial Sequence
  Description of Artificial Sequence: Synthetic oligonucleotide
  Target: ATXN1; (-) strand; PAM type: NRG; PAM sequence: AGG
ctttgcccattttttaatca

SEQ ID NO: 68424 - DNA, 20 bp, Artificial Sequence
  Description of Artificial Sequence: Synthetic oligonucleotide
  Target: ATXN1; (-) strand; PAM type: NRG; PAM sequence: AAG
cctttgcccattttttaatc

SEQ ID NO: 68425 - DNA, 20 bp, Artificial Sequence
  Description of Artificial Sequence: Synthetic oligonucleotide
  Target: ATXN1; (-) strand; PAM type: NRG; PAM sequence: AAG
ctttgaagaaatgtcaattc

SEQ ID NO: 68426 - DNA, 20 bp, Artificial Sequence
  Description of Artificial Sequence: Synthetic oligonucleotide
  Target: ATXN1; (-) strand; PAM type: NRG; PAM sequence: AAG
tcatttgcatattttctttg

SEQ ID NO: 68427 - DNA, 20 bp, Artificial Sequence
  Description of Artificial Sequence: Synthetic oligonucleotide
  Target: ATXN1; (-) strand; PAM type: NRG; PAM sequence: TGG
gtgtcttttcgtgtgcttaa

SEQ ID NO: 68428 - DNA, 20 bp, Artificial Sequence
  Description of Artificial Sequence: Synthetic oligonucleotide
  Target: ATXN1; (-) strand; PAM type: NRG; PAM sequence: GAG
tcctaatgattagtgatgtt

SEQ ID NO: 68429 - DNA, 20 bp, Artificial Sequence
  Description of Artificial Sequence: Synthetic oligonucleotide
  Target: ATXN1; (-) strand; PAM type: NRG; PAM sequence: TAG
atttgcattttcctaatgat

SEQ ID NO: 68430 - DNA, 20 bp, Artificial Sequence
  Description of Artificial Sequence: Synthetic oligonucleotide
  Target: ATXN1; (-) strand; PAM type: NRG; PAM sequence: TGG
agtgaaatggtatgtcattg

SEQ ID NO: 68431 - DNA, 20 bp, Artificial Sequence
  Description of Artificial Sequence: Synthetic oligonucleotide
  Target: ATXN1; (-) strand; PAM type: NRG; PAM sequence: TGG
ccatcttaatgtgagtgaaa

SEQ ID NO: 68432 - DNA, 20 bp, Artificial Sequence
  Description of Artificial Sequence: Synthetic oligonucleotide
  Target: ATXN1; (-) strand; PAM type: NRG; PAM sequence: GAG
aatcagagccatcttaatgt

SEQ ID NO: 68433 - DNA, 20 bp, Artificial Sequence
  Description of Artificial Sequence: Synthetic oligonucleotide
  Target: ATXN1; (-) strand; PAM type: NRG; PAM sequence: GAG
gttttttttgttgttaatca

SEQ ID NO: 68434 - DNA, 20 bp, Artificial Sequence
  Description of Artificial Sequence: Synthetic oligonucleotide
  Target: ATXN1; (-) strand; PAM type: NRG; PAM sequence: CAG
ttgttttttttgttgttaat

SEQ ID NO: 68435 - DNA, 20 bp, Artificial Sequence
  Description of Artificial Sequence: Synthetic oligonucleotide
  Target: ATXN1; (-) strand; PAM type: NRG; PAM sequence: GGG
ttgttattttcttgttttgg

SEQ ID NO: 68436 - DNA, 20 bp, Artificial Sequence
  Description of Artificial Sequence: Synthetic oligonucleotide
  Target: ATXN1; (-) strand; PAM type: NRG; PAM sequence: GGG
tttgttattttcttgttttg

SEQ ID NO: 68437 - DNA, 20 bp, Artificial Sequence
  Description of Artificial Sequence: Synthetic oligonucleotide
  Target: ATXN1; (-) strand; PAM type: NRG; PAM sequence: GGG
atttgttattttcttgtttt

SEQ ID NO: 68438 - DNA, 20 bp, Artificial Sequence
  Description of Artificial Sequence: Synthetic oligonucleotide
  Target: ATXN1; (-) strand; PAM type: NRG; PAM sequence: TGG
catttgttattttcttgttt

SEQ ID NO: 68439 - DNA, 20 bp, Artificial Sequence
  Description of Artificial Sequence: Synthetic oligonucleotide
  Target: ATXN1; (-) strand; PAM type: NRG; PAM sequence: GAG
ttctatcagtaatgtacaca

SEQ ID NO: 68440 - DNA, 20 bp, Artificial Sequence
  Description of Artificial Sequence: Synthetic oligonucleotide
  Target: ATXN1; (-) strand; PAM type: NRG; PAM sequence: CAG
atttctatcagtaatgtaca

SEQ ID NO: 68441 - DNA, 20 bp, Artificial Sequence
  Description of Artificial Sequence: Synthetic oligonucleotide
  Target: ATXN1; (-) strand; PAM type: NRG; PAM sequence: CAG
gtaccattttgcatttctat

SEQ ID NO: 68442 - DNA, 20 bp, Artificial Sequence
  Description of Artificial Sequence: Synthetic oligonucleotide
  Target: ATXN1; (-) strand; PAM type: NRG; PAM sequence: CAG
catcatggtatttttcacag

SEQ ID NO: 68443 - DNA, 20 bp, Artificial Sequence
  Description of Artificial Sequence: Synthetic oligonucleotide
  Target: ATXN1; (-) strand; PAM type: NRG; PAM sequence: CAG
aaccatcatggtatttttca

SEQ ID NO: 68444 - DNA, 20 bp, Artificial Sequence
  Description of Artificial Sequence: Synthetic oligonucleotide
  Target: ATXN1; (-) strand; PAM type: NRG; PAM sequence: TGG
aattttttgaggaaccatca

SEQ ID NO: 68445 - DNA, 20 bp, Artificial Sequence
  Description of Artificial Sequence: Synthetic oligonucleotide
  Target: ATXN1; (-) strand; PAM type: NRG; PAM sequence: AGG
agtattttttaaattttttg

SEQ ID NO: 68446 - DNA, 20 bp, Artificial Sequence
  Description of Artificial Sequence: Synthetic oligonucleotide
  Target: ATXN1; (-) strand; PAM type: NRG; PAM sequence: GAG
tagtattttttaaatttttt

SEQ ID NO: 68447 - DNA, 20 bp, Artificial Sequence
  Description of Artificial Sequence: Synthetic oligonucleotide
  Target: ATXN1; (-) strand; PAM type: NRG; PAM sequence: TAG
agtggaattggtgaatcatg

SEQ ID NO: 68448 - DNA, 20 bp, Artificial Sequence
  Description of Artificial Sequence: Synthetic oligonucleotide
  Target: ATXN1; (-) strand; PAM type: NRG; PAM sequence: TGG
tatatacctagaagtggaat

SEQ ID NO: 68449 - DNA, 20 bp, Artificial Sequence
  Description of Artificial Sequence: Synthetic oligonucleotide
  Target: ATXN1; (-) strand; PAM type: NRG; PAM sequence: TGG
tttgggtatatacctagaag

SEQ ID NO: 68450 - DNA, 20 bp, Artificial Sequence
  Description of Artificial Sequence: Synthetic oligonucleotide
  Target: ATXN1; (-) strand; PAM type: NRG; PAM sequence: AAG
ttttttgggtatatacctag

SEQ ID NO: 68451 - DNA, 20 bp, Artificial Sequence
  Description of Artificial Sequence: Synthetic oligonucleotide
  Target: ATXN1; (-) strand; PAM type: NRG; PAM sequence: TAG
agtttttttgggtatatacc

SEQ ID NO: 68452 - DNA, 20 bp, Artificial Sequence
  Description of Artificial Sequence: Synthetic oligonucleotide
  Target: ATXN1; (-) strand; PAM type: NRG; PAM sequence: GGG
tgcctcctttcagttttttt

SEQ ID NO: 68453 - DNA, 20 bp, Artificial Sequence
  Description of Artificial Sequence: Synthetic oligonucleotide
  Target: ATXN1; (-) strand; PAM type: NRG; PAM sequence: TGG
gtgcctcctttcagtttttt

SEQ ID NO: 68454 - DNA, 20 bp, Artificial Sequence
  Description of Artificial Sequence: Synthetic oligonucleotide
  Target: ATXN1; (-) strand; PAM type: NRG; PAM sequence: CAG
tctgttcaagtgcctccttt

SEQ ID NO: 68455 - DNA, 20 bp, Artificial Sequence
  Description of Artificial Sequence: Synthetic oligonucleotide
  Target: ATXN1; (-) strand; PAM type: NRG; PAM sequence: AAG
tggtatacaaatatctgttc

SEQ ID NO: 68456 - DNA, 20 bp, Artificial Sequence
  Description of Artificial Sequence: Synthetic oligonucleotide
  Target: ATXN1; (-) strand; PAM type: NRG; PAM sequence: TGG
aattatgtggctatgaacac

SEQ ID NO: 68457 - DNA, 20 bp, Artificial Sequence
  Description of Artificial Sequence: Synthetic oligonucleotide
  Target: ATXN1; (-) strand; PAM type: NRG; PAM sequence: TGG
ttaggttattgtgaattatg

SEQ ID NO: 68458 - DNA, 20 bp, Artificial Sequence
  Description of Artificial Sequence: Synthetic oligonucleotide
  Target: ATXN1; (-) strand; PAM type: NRG; PAM sequence: AGG
acttaggttgcttccacttt

SEQ ID NO: 68459 - DNA, 20 bp, Artificial Sequence
  Description of Artificial Sequence: Synthetic oligonucleotide
  Target: ATXN1; (-) strand; PAM type: NRG; PAM sequence: TAG
cacttaggttgcttccactt

SEQ ID NO: 68460 - DNA, 20 bp, Artificial Sequence
  Description of Artificial Sequence: Synthetic oligonucleotide
  Target: ATXN1; (-) strand; PAM type: NRG; PAM sequence: AGG
tcatccattgatggacactt

SEQ ID NO: 68461 - DNA, 20 bp, Artificial Sequence
  Description of Artificial Sequence: Synthetic oligonucleotide
  Target: ATXN1; (-) strand; PAM type: NRG; PAM sequence: TAG
ttcatccattgatggacact

SEQ ID NO: 68462 - DNA, 20 bp, Artificial Sequence
  Description of Artificial Sequence: Synthetic oligonucleotide
  Target: ATXN1; (-) strand; PAM type: NRG; PAM sequence: TGG
tgtatctattcatccattga

SEQ ID NO: 68463 - DNA, 20 bp, Artificial Sequence
  Description of Artificial Sequence: Synthetic oligonucleotide
  Target: ATXN1; (-) strand; PAM type: NRG; PAM sequence: GGG
cagaatctccttcctcttta

SEQ ID NO: 68464 - DNA, 20 bp, Artificial Sequence
  Description of Artificial Sequence: Synthetic oligonucleotide
  Target: ATXN1; (-) strand; PAM type: NRG; PAM sequence: AGG
tcagaatctccttcctcttt

SEQ ID NO: 68465 - DNA, 20 bp, Artificial Sequence
  Description of Artificial Sequence: Synthetic oligonucleotide
  Target: ATXN1; (-) strand; PAM type: NRG; PAM sequence: TAG
gtcagaatctccttcctctt

SEQ ID NO: 68466 - DNA, 20 bp, Artificial Sequence
  Description of Artificial Sequence: Synthetic oligonucleotide
  Target: ATXN1; (-) strand; PAM type: NRG; PAM sequence: CAG
atccatgttgtagcatgtgt

SEQ ID NO: 68467 - DNA, 20 bp, Artificial Sequence
  Description of Artificial Sequence: Synthetic oligonucleotide
  Target: ATXN1; (-) strand; PAM type: NRG; PAM sequence: TAG
aaaactgcatatccatgttg

SEQ ID NO: 68468 - DNA, 20 bp, Artificial Sequence
  Description of Artificial Sequence: Synthetic oligonucleotide
  Target: ATXN1; (-) strand; PAM type: NRG; PAM sequence: AAG
agaacgttttcatcttccca

SEQ ID NO: 68469 - DNA, 20 bp, Artificial Sequence
  Description of Artificial Sequence: Synthetic oligonucleotide
  Target: ATXN1; (-) strand; PAM type: NRG; PAM sequence: CAG
tcatcaccacgatccatctt

SEQ ID NO: 68470 - DNA, 20 bp, Artificial Sequence
  Description of Artificial Sequence: Synthetic oligonucleotide
  Target: ATXN1; (-) strand; PAM type: NRG; PAM sequence: CAG
agtacattcacattatattg

SEQ ID NO: 68471 - DNA, 20 bp, Artificial Sequence
  Description of Artificial Sequence: Synthetic oligonucleotide
  Target: ATXN1; (-) strand; PAM type: NRG; PAM sequence: AAG
gtgtacagttcagtggcatt

SEQ ID NO: 68472 - DNA, 20 bp, Artificial Sequence
  Description of Artificial Sequence: Synthetic oligonucleotide
  Target: ATXN1; (-) strand; PAM type: NRG; PAM sequence: TGG
tttttaagtgtacagttcag

SEQ ID NO: 68473 - DNA, 20 bp, Artificial Sequence
  Description of Artificial Sequence: Synthetic oligonucleotide
  Target: ATXN1; (-) strand; PAM type: NRG; PAM sequence: CAG
ccatttttaagtgtacagtt

SEQ ID NO: 68474 - DNA, 20 bp, Artificial Sequence
  Description of Artificial Sequence: Synthetic oligonucleotide
  Target: ATXN1; (-) strand; PAM type: NRG; PAM sequence: CAG
ttttcccatttttaagtgta

SEQ ID NO: 68475 - DNA, 20 bp, Artificial Sequence
  Description of Artificial Sequence: Synthetic oligonucleotide
  Target: ATXN1; (-) strand; PAM type: NRG; PAM sequence: AAG
tcatcatttttcccattttt

SEQ ID NO: 68476 - DNA, 20 bp, Artificial Sequence
  Description of Artificial Sequence: Synthetic oligonucleotide
  Target: ATXN1; (-) strand; PAM type: NRG; PAM sequence: GGG
ataaggtcaagtgatcacag

SEQ ID NO: 68477 - DNA, 20 bp, Artificial Sequence
  Description of Artificial Sequence: Synthetic oligonucleotide
  Target: ATXN1; (-) strand; PAM type: NRG; PAM sequence: GGG
tataaggtcaagtgatcaca

SEQ ID NO: 68478 - DNA, 20 bp, Artificial Sequence
  Description of Artificial Sequence: Synthetic oligonucleotide
  Target: ATXN1; (-) strand; PAM type: NRG; PAM sequence: AGG
ttataaggtcaagtgatcac

SEQ ID NO: 68479 - DNA, 20 bp, Artificial Sequence
  Description of Artificial Sequence: Synthetic oligonucleotide
  Target: ATXN1; (-) strand; PAM type: NRG; PAM sequence: CAG
cttataaggtcaagtgatca

SEQ ID NO: 68480 - DNA, 20 bp, Artificial Sequence
  Description of Artificial Sequence: Synthetic oligonucleotide
  Target: ATXN1; (-) strand; PAM type: NRG; PAM sequence: AAG
aaaagctcccttataaggtc

SEQ ID NO: 68481 - DNA, 20 bp, Artificial Sequence
  Description of Artificial Sequence: Synthetic oligonucleotide
  Target: ATXN1; (-) strand; PAM type: NRG; PAM sequence: AGG
acctgaaaagctcccttata

SEQ ID NO: 68482 - DNA, 20 bp, Artificial Sequence
  Description of Artificial Sequence: Synthetic oligonucleotide
  Target: ATXN1; (-) strand; PAM type: NRG; PAM sequence: AAG
cacctgaaaagctcccttat

SEQ ID NO: 68483 - DNA, 20 bp, Artificial Sequence
  Description of Artificial Sequence: Synthetic oligonucleotide
  Target: ATXN1; (-) strand; PAM type: NRG; PAM sequence: AAG
atccaaacagatcacctgaa

SEQ ID NO: 68484 - DNA, 20 bp, Artificial Sequence
  Description of Artificial Sequence: Synthetic oligonucleotide
  Target: ATXN1; (-) strand; PAM type: NRG; PAM sequence: CAG
ttgggatatcttgatccaaa

SEQ ID NO: 68485 - DNA, 20 bp, Artificial Sequence
  Description of Artificial Sequence: Synthetic oligonucleotide
  Target: ATXN1; (-) strand; PAM type: NRG; PAM sequence: GGG
actctcatttgaaacttctt

SEQ ID NO: 68486 - DNA, 20 bp, Artificial Sequence
  Description of Artificial Sequence: Synthetic oligonucleotide
  Target: ATXN1; (-) strand; PAM type: NRG; PAM sequence: TGG
aactctcatttgaaacttct

SEQ ID NO: 68487 - DNA, 20 bp, Artificial Sequence
  Description of Artificial Sequence: Synthetic oligonucleotide
  Target: ATXN1; (-) strand; PAM type: NRG; PAM sequence: AAG
tcccataaaccaaccctctc

SEQ ID NO: 68488 - DNA, 20 bp, Artificial Sequence
  Description of Artificial Sequence: Synthetic oligonucleotide
  Target: ATXN1; (-) strand; PAM type: NRG; PAM sequence: CAG
caaacgaggtcacagttcat

SEQ ID NO: 68489 - DNA, 20 bp, Artificial Sequence
  Description of Artificial Sequence: Synthetic oligonucleotide
  Target: ATXN1; (-) strand; PAM type: NRG; PAM sequence: CAG
ggaacactcaaacgaggtca

SEQ ID NO: 68490 - DNA, 20 bp, Artificial Sequence
  Description of Artificial Sequence: Synthetic oligonucleotide
  Target: ATXN1; (-) strand; PAM type: NRG; PAM sequence: AGG
tttcctggaacactcaaacg

SEQ ID NO: 68491 - DNA, 20 bp, Artificial Sequence
  Description of Artificial Sequence: Synthetic oligonucleotide
  Target: ATXN1; (-) strand; PAM type: NRG; PAM sequence: GAG
atttcctggaacactcaaac

SEQ ID NO: 68492 - DNA, 20 bp, Artificial Sequence
  Description of Artificial Sequence: Synthetic oligonucleotide
  Target: ATXN1; (-) strand; PAM type: NRG; PAM sequence: TGG
agatgtggaagccgatttcc

SEQ ID NO: 68493 - DNA, 20 bp, Artificial Sequence
  Description of Artificial Sequence: Synthetic oligonucleotide
  Target: ATXN1; (-) strand; PAM type: NRG; PAM sequence: AAG
caagtgattcctagatgtgg

SEQ ID NO: 68494 - DNA, 20 bp, Artificial Sequence
  Description of Artificial Sequence: Synthetic oligonucleotide
  Target: ATXN1; (-) strand; PAM type: NRG; PAM sequence: TGG
gtccaagtgattcctagatg

SEQ ID NO: 68495 - DNA, 20 bp, Artificial Sequence
  Description of Artificial Sequence: Synthetic oligonucleotide
  Target: ATXN1; (-) strand; PAM type: NRG; PAM sequence: TAG
tttttagtccaagtgattcc

SEQ ID NO: 68496 - DNA, 20 bp, Artificial Sequence
  Description of Artificial Sequence: Synthetic oligonucleotide
  Target: ATXN1; (-) strand; PAM type: NRG; PAM sequence: AAG
ctcacattcttttttagtcc

SEQ ID NO: 68497 - DNA, 20 bp, Artificial Sequence
  Description of Artificial Sequence: Synthetic oligonucleotide
  Target: ATXN1; (-) strand; PAM type: NRG; PAM sequence: TAG
ggagctctcacattcttttt

SEQ ID NO: 68498 - DNA, 20 bp, Artificial Sequence
  Description of Artificial Sequence: Synthetic oligonucleotide
  Target: ATXN1; (-) strand; PAM type: NRG; PAM sequence: GAG
gagctcactctgaatcaaag

SEQ ID NO: 68499 - DNA, 20 bp, Artificial Sequence
  Description of Artificial Sequence: Synthetic oligonucleotide
  Target: ATXN1; (-) strand; PAM type: NRG; PAM sequence: AGG
gagagctcactctgaatcaa

SEQ ID NO: 68500 - DNA, 20 bp, Artificial Sequence
  Description of Artificial Sequence: Synthetic oligonucleotide
  Target: ATXN1; (-) strand; PAM type: NRG; PAM sequence: AAG
tgagagctcactctgaatca

SEQ ID NO: 68501 - DNA, 20 bp, Artificial Sequence
  Description of Artificial Sequence: Synthetic oligonucleotide
  Target: ATXN1; (-) strand; PAM type: NRG; PAM sequence: GAG
atattacaaatctcatgtga

SEQ ID NO: 68502 - DNA, 20 bp, Artificial Sequence
  Description of Artificial Sequence: Synthetic oligonucleotide
  Target: ATXN1; (-) strand; PAM type: NRG; PAM sequence: GAG
ccatattacaaatctcatgt

SEQ ID NO: 68503 - DNA, 20 bp, Artificial Sequence
  Description of Artificial Sequence: Synthetic oligonucleotide
  Target: ATXN1; (-) strand; PAM type: NRG; PAM sequence: TGG
aaaggatattgcaagcattc

SEQ ID NO: 68504 - DNA, 20 bp, Artificial Sequence
  Description of Artificial Sequence: Synthetic oligonucleotide
  Target: ATXN1; (-) strand; PAM type: NRG; PAM sequence: AAG
aactcagaaaaggatattgc

SEQ ID NO: 68505 - DNA, 20 bp, Artificial Sequence
  Description of Artificial Sequence: Synthetic oligonucleotide
  Target: ATXN1; (-) strand; PAM type: NRG; PAM sequence: AGG
gaggttgtaaaactcagaaa

SEQ ID NO: 68506 - DNA, 20 bp, Artificial Sequence
  Description of Artificial Sequence: Synthetic oligonucleotide
  Target: ATXN1; (-) strand; PAM type: NRG; PAM sequence: AAG
tgaggttgtaaaactcagaa

SEQ ID NO: 68507 - DNA, 20 bp, Artificial Sequence
  Description of Artificial Sequence: Synthetic oligonucleotide
  Target: ATXN1; (-) strand; PAM type: NRG; PAM sequence: CAG
gtctctgaggttgtaaaact

SEQ ID NO: 68508 - DNA, 20 bp, Artificial Sequence
  Description of Artificial Sequence: Synthetic oligonucleotide
  Target: ATXN1; (-) strand; PAM type: NRG; PAM sequence: AGG
actgccaaattgggtctctg

SEQ ID NO: 68509 - DNA, 20 bp, Artificial Sequence
  Description of Artificial Sequence: Synthetic oligonucleotide
  Target: ATXN1; (-) strand; PAM type: NRG; PAM sequence: GAG
cactgccaaattgggtctct

SEQ ID NO: 68510 - DNA, 20 bp, Artificial Sequence
  Description of Artificial Sequence: Synthetic oligonucleotide
  Target: ATXN1; (-) strand; PAM type: NRG; PAM sequence: GGG
tcctgatccactgccaaatt

SEQ ID NO: 68511 - DNA, 20 bp, Artificial Sequence
  Description of Artificial Sequence: Synthetic oligonucleotide
  Target: ATXN1; (-) strand; PAM type: NRG; PAM sequence: TGG
ctcctgatccactgccaaat

SEQ ID NO: 68512 - DNA, 20 bp, Artificial Sequence
  Description of Artificial Sequence: Synthetic oligonucleotide
  Target: ATXN1; (-) strand; PAM type: NRG; PAM sequence: TAG
ttcctagcttttgttcctat

SEQ ID NO: 68513 - DNA, 20 bp, Artificial Sequence
  Description of Artificial Sequence: Synthetic oligonucleotide
  Target: ATXN1; (-) strand; PAM type: NRG; PAM sequence: TAG
tcaggtatggtaaattttcc

SEQ ID NO: 68514 - DNA, 20 bp, Artificial Sequence
  Description of Artificial Sequence: Synthetic oligonucleotide
  Target: ATXN1; (-) strand; PAM type: NRG; PAM sequence: TGG
ctatgtccctccatcaggta

SEQ ID NO: 68515 - DNA, 20 bp, Artificial Sequence
  Description of Artificial Sequence: Synthetic oligonucleotide
  Target: ATXN1; (-) strand; PAM type: NRG; PAM sequence: AGG
ctttcctatgtccctccatc

SEQ ID NO: 68516 - DNA, 20 bp, Artificial Sequence
  Description of Artificial Sequence: Synthetic oligonucleotide
  Target: ATXN1; (-) strand; PAM type: NRG; PAM sequence: CAG
cctttcctatgtccctccat

SEQ ID NO: 68517 - DNA, 20 bp, Artificial Sequence
  Description of Artificial Sequence: Synthetic oligonucleotide
  Target: ATXN1; (-) strand; PAM type: NRG; PAM sequence: GGG
ttggctttgccttaattaca
